United States Patent 11,078,247 (RNA ENCODING A THERAPEUTIC PROTEIN) - sequence listing, part 31

SEQ ID NO: 53032 - RNA, 1257 nt, Artificial Sequence
  derived and/or modified sequence opt3 from ARRDC4__Homo_sapiens__NP_899232
augggcggggaggccggaugcgcugcagccgugggugcggaaggcagagucaagagccuggggcucguuuucgaggacgaaaggaaaggauguuacuccucuggcgagaccguggcuggucacguacuucuggaagccucagagcccguggcauugcgggccuuacgccuggaggcucaggggcgagcaacagccgcuuggggaccuaguacuugcccacgugccagcgcguccacggcagcccuagcugucuuuucugaaguggaguaucucaacguuagacugucgcuuagggaaccgcccgccggcgagggcaucauucuguugcaaccugggaagcaugaguucccauuucgguuccagcuccccucagaaccucuggugaccagcuuuacaggaaaauacgguaguauacaguauuguguccgcgcagugcuggagagaccaaagguacccgaucaguccguuaaaagggaacuccaaguggucucucacguggacgugaauacuccugcuuuacugaccccaguccuuaagacacaggagaagaugguuggcugcugguucuuuaccagcgggccgguguccuugucagccaaaaucgaacggaagggauacuguaacggcgaggcgauucccaucuaugccgagauugaaaauugcaguagccgccugaucguaccuaaagcagcuauauuccagacucagacauaccuagccucugguaagaccaaaacgauccgacauaugguggcuaacgucagagggaaucacauugccuccggaucaacugauaccuggaacggcaagacacucaagaucccacccgugacuccuagcauucuggacuguugcaucauaaggguugauuauagucuugcaguguacauucauaucccaggcgccaaaaagcugauguuggagcucccccuggucauugggaccaucccguacaauggauuugguucucggaacuccagcaucgcuucgcaauucucuauggacauguccugguuaacacugacccucccugaacagcccgaggcgccaccuaauuaugcagaugugguaucagaagaggaguuuagucgucacauucccccauacccccagccuccaaacugugaaggcgagguuugcuguccgguguucgccugcauacaggaauuucgcuuccaacccccuccacuuuauagcgaggucgacccccacccuuccgauguggaagagucucagccagucagcuucauccuguga

SEQ ID NO: 53033 - RNA, 1530 nt, Artificial Sequence
  derived and/or modified sequence opt3 from ARSA__Homo_sapiens__NP_001078895
augagcaugggcgcccccagaucccugcuccuugcucuggcagccggguuggcgguggcuaggccuccaaacaucgucuuaauuuucgccgacgaucugggauacggugaccuaggcugcuaugggcacccgucuucaaccacacccaaucucgaucagcuggcagccggaggccuucgguuuacugacuucuacguuccugugagucuguguacgccaagccgcgcugcauugcucaccggucgacugcccguacguauggggauguauccuggagugcuggucccauccucuagaggcggccuccccuuagaggaagugacaguugccgaggugcuggcugccaggggguaccuuacuggaauggcggguaaguggcauuugggcgucgggccugaaggagcauuucugccaccgcaccaaggcuuccaucgguuucuagguauacccuauucgcacgaucaggggccuugccagaaccucaccuguuucccacccgccacaccuugcgacggaggcugugaucagggccuggugccaaucccccuucuggcuaauuugucaguagaggcccaaccgccuuggcuccccgggcuggaagcacgcuacauggcuuuugcccaugacuuaauggcggaugcccagagacaggacaggccauucuuucuguauuacgcaagccaccacacccauuacccucaguucaguggacaauccuuugcugagcggucuggucgcggccccuucggggauagccucauggagcuugacgccgcuguuggaacucugaugacagccauuggcgauuugggucuacuggaagagacccucgugaucuuuacggcagacaacgggccagaaacuaugcgaauguccagaggcggaugcucaggccugcuuaggugugggaaaggaaccacauaugaggguggcguccgggagcccgcccuggcuuucuggccugggcacauugcgccaggagugacucaugaauuggcaaguagccucgaccuguuaccgacccuggccgcucuagccggcgcaccccucccuaaugugacacuggaugguuucgaccuuucuccauugcugcucgggaccggcaagucaccccgucagucccuguuuuucuacccuagcuauccagaugagguccgcggaguuuuugccgugagaacgggcaaauacaaggcucacuucuuuacucaggggagugcccacucugacacaaccgcagaucccgcgugccaugcuuccagcucgcuuacugcccacgaaccgccucuguuguaugaccucucuaaagauccaggagagaacuacaaucuguuagguggcguagcaggggccacacccgaagugcugcaggcucuaaagcaacuccagcugcuuaaggcccaguuggacgcagcugucaccuucggaccuucccaaguggccaggggcgaggaucccgcgcugcagaucuguugccauccagguuguacgccucggcccgccugcugccacuguccagacccgcaugcuuga

SEQ ID NO: 53034 - RNA, 1602 nt, Artificial Sequence
  derived and/or modified sequence opt3 from ARSB__Homo_sapiens__NP_000037
augggccccagaggggccgcuagccugccuaggggaccagguccgcggcgccuccuucugcccguggucuugccuuuacugcuacuccugcuucuggcaccacccggcuccggggccggagcgucucgaccuccacacuugguuuuccuccuggcugacgaucugggcuggaacgacguggguuuucaugggucacguaucagaacaccccaccucgaugccuuagcagccggaggcguacugcuugacaauuacuauacccagccuuugugcacuccaaguaggagccaacugcuaacgggccgguaccagauucgcaccgggcuccagcaucagauaaucuggccgugucaacccuccugcgugccucuggaugagaaacuucugccacaguugcucaaggaagcuggauauacaacucacauggucgguaaguggcaucugggcauguacagaaaagaguguuuacccaccaggcggggguucgacacauauuuuggauaccugcucggcucugaagauuauuacucgcacgagcgcugcacccuuauugacgcacugaacgugacucgaugugccuuggauuucagagacggugaagagguugcuacaggguacaagaauauguauucaaccaacaucuuuacgaaaagggccauugcgcuaaucacuaaucacccuccagagaagccccuguuccucuaccuggcacuucagagcgugcaugaaccgcugcaggucccugaggaauauuugaagcccuacgauuuuauacaagacaaaaaccggcaccauuaugccggaauggugagucucauggaugaggcuguaggcaauguuaccgccgcacugaaguccucuggcuuauggaacaauacaguguucaucuuuagcacugacaacgggggacagacccuggcugguggcaauaacuggccacuacgugggcgcaaauggucccucugggagggaggcgucagaggugugggguucguggccucaccucugcuuaagcagaaaggcgucaagaauagggaauugauucacaucagugacuggcugcccacacucguuaagcuggcgcggggacacaccaacggcacgaaaccacuugauggguuugacguguggaagacuauuagcgagggaucucccuccccucgaaucgaacuguugcauaauauagauccaaacuucguagacucaagcccgugcccccgcaacaguauggccccugcaaaagaugacucuucccucccagaguacagcgcuuuuaauacaucggugcacgccgcuauuagacaugguaacuggaagcuguuaaccggcuaucccggguguggauacugguucccuccacccucucaguacaaugucuccgaaaucccgucaagugauccuccaacuaaaacacuguggcuauucgacauugauagggaccccgaggagcggcacgaucucagccgcgaauauccucauaucgugaccaagcugcuuuccagauugcaauuuuaccacaaacacucuguucccguguauuucccagcccaggacccuaggugcgaccccaaggcaacgggcgucugggguccauggauguga

SEQ ID NO: 53035 - RNA, 1782 nt, Artificial Sequence
  derived and/or modified sequence opt3 from ARSD__Homo_sapiens__NP_001660
augagaagcgccgcuaggcggggccgcgcagcccccgcggcucgagacucccugccugugcuccuuuuccugugcuuguuacugaagaccugugagccaaaaacagccaacgcauuuaagccgaauauccuacucauuauggccgaugaccuggggacuggagaucuugguugcuacggcaacaauacgcugcguacccccaacauagaccaguuggcugaagagggggucagacucacacaacaccuggcagccgcuccucuguguacuccaucuagggccgcguuccucaccggacggcauucauuucgcaguggcauggaugcaagcaaugguuauagagccuuacaguggaacgcuggguccggaggccugcccgaaaaugagacaaccuucgccaggauccuucagcagcacggcuacgcaacuggguugauuggaaaauggcaucaagguguuaacugcgcuucucggggcgaccacugucaucacccucugaaucacggguuugauuauuucuacggaaugccauuuacacuaaccaacgacugcgaucccggccgcccuccagaaguggacgccgcgcuccgagcccagcugugggguuauacgcaguuccuugcacuggggaucuugacucucgcugccggacagaccuguggcuuuuucucgguaucagcuagagccgugacaggcauggcaggggucggaugccuguuuuucauuagcugguacaguuccuuugguuucgugaggcgguggaauuguaucuuaaugcguaaccaugauguuacugagcaaccgauggugcuggagaagaccgccucucucaugcuuaaagaagcugucagcuauauagagcgccacaagcauggccccuuccuguuguuucuaucccugcuccacgugcacaucccucugguaacaaccucagcguuccuugggaagagucagcauggacuguacggcgacaauguugaagagauggauugguugauugguaaagugcucaacgcaaucgaggacaaugggcugaagaacagcacguuuacuuacuucacaucugaccacggcggacauuuagaagccagagauggccacucccagcuagggggauggaacgguauuuauaaaggcgggaagggaaugggcgguugggaagggggcaucagggucccaggaauauuucauuggcccggcgugcugccugcugggcgggugauuggagagccaaccucacucauggacgucuuccccacuguugugcagcugguagguggcgaggugccgcaagaucgagucaucgacgggcacagccuugugccuuugcugcagggagccgaagcacgcagugcccacgaguuucucuuccauuacugcggccagcaucugcacgcugccagauggcaccaaaaagauucugguuccguuuggaaggugcacuauacaacgccccaguuucauccagagggggcaggcgcguguuacggaaggggcgucugcccuugcagcggggaaggagugacccaccaucggcccccacuucuguucgacuugucgcgcgaucccucugaggcuagaccucucaccccagacuccgaaccgcuguaucacgccguaauugcaaggguuggcgccgcugugucagagcaucgucagacauuaagucccgucccucagcaauuuagcauguccaauauccuguggaagccauggcuacagcccuguugcggucacuucccuuuuuguucuugccacgaagauggggacggaacuccauga

SEQ ID NO: 53036 - RNA, 1845 nt, Artificial Sequence
  derived and/or modified sequence opt3 from ARSE__Homo_sapiens__NP_001269557
augagacccgugaucaacaggugcgccccuggcagccuggaccucaugcuuccacaggcugcauccgaggggauugucuuccacucucugcaaauaucauuguguuuucggaguugguuaccggccaugcuggcgguucuacucagccuggcucccuccgccucuucggauaucucagcaagccgcccuaauauucuucuguugauggccgacgaucucggaaucggugacauuggcugcuacgggaacaauaccaugcgaacaccaaacaucgaucgucuggcugaagacggagugaagcugacucagcauauaagugcagccucccucuguacgcccucuagagcugccuucuuaaccggcagguauccuguacggagcgguaugguguccucaaucggguaccgcguccugcaguggacaggagcgaguggcggccuuccaacuaaugagaccacauuugcaaaaauuuugaaggaaaaaggguaugccaccggacugaucgguaaguggcaccuaggccucaacugcgagagcgcuucugaucauugucaccauccccugcaccacggguucgaccauuuuuacggaaugccuuucucccuuaugggcgauugcgccagaugggaacugucagagaaaagggugaauuuggagcagaagcucaacuuucuguuccaaguuuuagcacugguggcucucacucuugucgccgguaagcugacacacuugauuccagugagcuggaugccgguaaucuggagugcgcuaucugccguucugcuccuggcauccagcuauuuugugggggcucuuauaguccaugccgacuguuuccugaugcggaaucacaccauuacggaacagcccaugugcuuucagcgcacuaccccuuugauccuccaggagguggcuucguuccugaaacgaaacaagcacggaccauuuuuacuguucgugucuuuccuacauguccacauuccccucaucacaauggaaaauuuucugggcaaaucccuucauggcuuguacggggauaacguugaggagauggacuggauggugggaagaauccuggauacucucgacguagaaggucugucaaauaguacccuuauuuauuucacaagcgaccacggcgggucccuggagaaccaauugggaaauacccaguacggcgguuggaacgggauauacaagggcggaaaaggcauggguggaugggaagguggcaucagggugccugggauuuuucgguggccaggaguccuccccgccggccgugugaucggugagccgacgucucugauggauguuuucccuacugugguccgcuuagcagggggcgaagugccccaggacagaguaauagauggacaggaccugcuaccacuccugcuuggcacagcccaacauagcgaucacgaguuuuugaugcacuauugugagagguuccugcaugcugcgcgguggcaccagcgagaccgcgggaccauguggaagguucauuuugugacuccugucuuccagcccgaaggagcaggggccugcuacggcagaaagguguguccaugcuuuggggagaaagucgugcaccacgaucccccucuccuguucgacuuaucaagggauccaagugaaacacauauucugaccccggcuuccgagcccguguuuuaucaaguuauggaacggguacagcaggccgucugggagcaccagcgcacgcuuagcccugugccauugcaacucgacagacugggaaacaucuggaggcccuggcuacagccuugcuguggcccauucccccugugcuggugucuccgugaggaugacccgcaguga

SEQ ID NO: 53037 - RNA, 1773 nt, Artificial Sequence
  derived and/or modified sequence opt3 from ARSF__Homo_sapiens__NP_004033
augagacccaggcggccucugguguucaugagccucgucugcgcccuucugaacaccugucaggcucaccgcguucaugacgauaagccaaauaucguguugauuaugguagacgauuuaggcauaggggaccugggaugcuacgguaacgauacaaugcgaacuccgcacaucgaccgucuagcaagagagggcgugaggcucacgcaacauauuuccgccgcgucucuguguucacccagucggagcgcuuuucuuaccgggcgcuauccuaucagauccggaauggucucuucgggcaauaggcgggugauucagaaccuggccguuccagcagguuugccccucaaugaaacaacucuggccgcucugcucaaaaagcagggguacucaaccggauuaaucggcaaauggcaccagggccugaacugcgauagccgcagugaccaaugucaucacccuuauaauuacggguucgauuauuacuauggaaugccauuuacacuuguggacuccugcuggcccgauccuucucgaaacaccgaguuggcauucgaaagccagcuguggcuauguguccagcucguggccauagcuauccugacucuuacauuugguaagcuguccggcuggguaucaguuccaugguugcucauuuucaguaugauccuguuuauuuucuuacugggguacgccugguuuagcucucacaccuccccgcucuacugggacugccuucugaugagaggacaugagaucacggaacagcccaugaaagcggagagggcaggcucaauaauggugaaggaggccauuagcuucuuggaacggcacaguaaggagacuuuucuacuguucuuuucuuuccuccauguccacaccccucugccaacaacugaugacuucaccgguacauccaaacacgggcuuuauggagacaauguggaagagauggauagcauggugggcaagauccuggacgcuauugaugacuuuggcuugcguaacaauacccucgucuacuucacgucggaucaugggggacaccuggaggcccgcagaggucaugcacaauuaggcggguggaacggaaucuauaaaggcgguaaggggaugggcggaugggaaggcgggaucaggguucccggaauugugcgguggccugguaaaguaccagcuggccgacugauaaaggagcccacuucucuaauggacauccucccgacaguggccuccgucucagggggaagucugccucaggaucgcgugauugacggcagagaucuuaugcccuugcugcaggguaauguuaggcacagcgaacaugaguuucucuuccacuacuguggguccuaucugcacgcggugcgguggaucccaaaggacgauucuggcagcgucuggaaagcccauuacgugaccccuguauuucagcccccagcaucaggaggcugcuauguuacaagucuuugucgcugcuucggggaacaagugacuuaccacaaucccccucuguuguuugaccucuccagagacccaagcgagucuaccccgcugacgcccgcuaccgagccuuuacaugauuucgucauaaagaaaguggccaacgcucugaaggaacaccaggagacaauugucccagugacuuaccagcuaucagaacucaaccaaggaaggaccuggcugaaacccugcugugguguuuuuccuuucugccuuugugacaaggaggaagaggugagucagccacguggccccaacgagaaacgguga

SEQ ID NO: 53038 - RNA, 1578 nt, Artificial Sequence
  derived and/or modified sequence opt3 from ARSG__Homo_sapiens__NP_055775
augggcuggcuguuccucaaggugcuucuggccggggucagcuuuuccggauucuuguaccccuuaguugacuuuugcaucucugguaaaaccagaggccagaagccuaacuucgugauuauacuggcugaugacaugggguggggagaucuaggcgcaaauugggccgagacaaaagacacugcgaaccucgauaagauggcuucagaagguaugagguuuguagacuuccacgccgcagccaguacguguagcccaucccgggcuucucugcuuaccgggcgccugggauugcgaaauggcgugacacguaacuuugcagucacuucggugggcgggcucccgcugaaugagaccacacuggccgaaguucuccaacaggcuggauaugugaccgguaucauuggcaaauggcauuuagggcaccauggaucauaccaccccaacuucagaggcuuugauuauuacuucgguaucccuuauagccaugacauggggugcacugauacaccaggauacaaucaucccccuuguccagccugcccccagggcgacggcccuaguaggaaccugcagcgggauuguuauaccgacgucgcgcuuccauuguacgagaaucugaacauuguggaacaaccgguaaaucuauccucucucgcacagaaguacgccgagaaggcuacgcaguuuauccagcgcgccagcacuuccgggagacccuuccugcuuuauguugcacuggcucacaugcacgugccuuugccagucacccaacuccccgccgcgccuaggggacggucacuguacggugccggcuuaugggagauggauagucugguggggcagauaaaagacaagguggaccacacagucaaagaaaacacuuuucucugguucaccggagauaauggcccaugggcacagaagugcgagcuugcugguagcguugggcccuucacaggcuuuuggcagacccgccaaggaggcucuccggccaaacagacgacuugggaagggggacaucgagugccugcucuggccuauuggcccgguagaguaccagugaacgucacauccaccgcauugcuaucagugcuggacaucuucccuacuguuguggcccucgcucaggcgagccugccccaaggcaggcgguuugauggggucgacgugagugagguacuuuucggacguucucagccaggccaccgcguucuguuucaccccaauuccggugcagccggggaguucggcgcuuugcagacagugagacucgaaagguacaaggccuuuuauauuaccggaggcgcacgggccugugaugggagcacgggaccugagcugcagcauaaguucccauuaaucuuuaaccuggaagacgauaccgcugaggccgucccgcuagaacgagguggcgcagaguaccaagcggugcuccccgagguccgcaaagugcuggcugacguucuucaggauauugccaacgacaauaucucgucugcagauuauacacaggacccuuccgugacuccaugcuguaaccccuaccagauagccugcagaugucaagcugccuga

SEQ ID NO: 53039 - RNA, 1689 nt, Artificial Sequence
  derived and/or modified sequence opt3 from ARSH__Homo_sapiens__NP_001011719
augaccagaaacgccaggcccaauaucgugcugcucauggcugacgaucuuggcgucggggaccugugcuguuacggaaacaauagcguuuccacaccuaacauugaucgguuggcaucugagggugugcgcuuaacucagcaccuggccgcggcuucaaugugcacgccaagucgagccgcauuccuaaccggccguuauccgauaagaagcgggaugguauccgccuacaaucucaacagggcuuuuacauggcugggaggcucuggugggcuucccacuaaugaaaccacauucgcaaagcuguugcaacaucggggauaucgcaccggccucaucggcaaauggcaccuggggcugucgugugccucaagaaacgaccauugcuaccacccucucaaucauggauuucacuauuucuacggugugccauuuggcuuacugagcgauugucaggcuaguaagacucccgagcuucacaggugguugcggauuaaacuguggaucuccacagucgcccuagcgcucgugccuuuccugcuucugauuccaaaguuugcacgcugguucucuguucccuggaaagugaucuuugucuucgccuugcucgcuuuucuguucuuuaccagcugguauuccucauacggguucacgcgaagauggaacugcauauuaaugaggaaucaugaaaucauucagcagccuaugaaggaggaaaagguggccagucugaugcucaaagaggcacuugcuuucaucgagcgguacaagcgugaaccauuucuguuguucuuuagcuuccuacacguacauacuccgcugauuucuaaaaagaaauuuguuggacgcuccaaguauggcagauacggugacaacguggaggaaauggauuggauggucgggaagauccucgacgcccuggaucaagagaggcuugcgaaucacacccugguguauuucacaucagacaacggaggccacuuggagccccucgauggcgccgugcaguuagggggauggaaugguauauacaaaggcgggaagggaaugggcgguugggaagggggcauucgggucccuggaaucuuucgauggccaagcguucuggaggcaggccgcgugauuaacgaacccaccagucugauggacaucuauccuacucuaucuuacaucgggggagguauucucucccaggauagaguaauagacggccagaaccugaugccacuuuuggaggggagggcuagccauucggaccacgaguuccuguuucauuauuguggaguguaccuccacacaguccgguggcaucaaaaagauugcgccaccguguggaaggcucacuacguuacgcccaaauucuauccggaaggcacuggugccuguuacgggucuggcaucugcuccuguucaggagacgugacauaucacgauccuccccugcuuuuugacauuagucgcgauccaagcgaggcacugccuuugaaucccgacaacgaaccacucuucgauuccgucaucaagaaaauggaggccgcuauaagagaacauaggcguacccugacucccgugccucagcaguuuucuguauucaauacaauuuggaagccaugguuacagccgugcugcggcaccuuccccuuuugugggugcgacaaggaggaugacauccugccuauggcgccauga

SEQ ID NO: 53040 - RNA, 1710 nt, Artificial Sequence
  derived and/or modified sequence opt3 from ARSI__Homo_sapiens__NP_001012301
augcacacccugacaggcuucagccucgugucccuucugucuuuuggguacuugucaugggacugggccaagcccaguuucgucgcugauggaccuggugaggcaggcgaacagccaagcgccgcgccgccccaaccuccacauaucauuuuuauauuaacugacgaucagggguaucacgacguuggauaccauggcuccgauaucgagacgcccacccuggacagacuagcugccaaaggugugaagcucgaaaacuauuacauucagccuaucugcacaccaucuaggucgcagcugcuuacugggcgguaucaaauucacaccggacugcagcauucaaucauacgcccccagcagccuaauuguuugccacucgaucaaguaacacugccgcagaaacugcaggaggcaggcuacagcacccacauggugggcaaguggcaccucggguucuaucgaaaagaaugcuuacccacucguagaggauuugacacauuccuggguagucuuaccggcaacgucgauuacuacacguaugacaauugugaugggccuggagugugcggcuuugacuugcaugagggugagaacguugccugggggcuguccggacaguacucuacuaugcuauaugcucaaagggcaagccacauccucgccucccauucaccacagcggccccuguuccuuuacguggcuuuucaggccguccacaccccucugcaaaguccacgcgaauauuuguacagauauaggacaaugggcaauguggcgcggcgcaaguacgcagccaugguaacuuguauggaugaggcuguucgaaacauuaccugggcccucaagagauacggcuucuauaauaacagcgugaucaucuuuucuuccgacaaugggggacagacauucucagguggcagcaacuggccccugagggggcggaaaggaaccuacugggaaggcgguguccguggguuaggcuuugugcacaguccgcugcucaagcgcaaacagagaacgucuagggcacuuaugcauauuacugacugguauccuacacuggugggauuggcuggcgggaccacuuccgccgcggauggacuagacgguuacgaugucuggcccgccauaagcgagggccgggcaucgccacgaacagagauucugcacaauaucgacccucucuauaaccaugcucagcacgggucucuggaaggaggcuucgguauuuggaauaccgccguucaagcugccauccgcgugggggaguggaaacuucugacgggcgaucccggauacggcgacuggaucccaccccagaccuuggcaacauucccuggguccugguggaaccucgaaagaauggccucaguaaggcaggcuguguggcuguuuaauauuagugcggauccauaugagcgggaagacuuagcaggacagcgcccggaugucgugagaacucugcuagccaggcucgcugaguacaaccguaccgccauacccguucgguacccugcagagaacccacgagcccaucccgacuucaaugguggcgcuugggggccuugggccagcgaugaagaggaagaggaagaggagggcagagcaagguccuuuucucgcggacggagaaagaagaagugcaaaaucuguaagcugaggagcuucuuucgcaaacuuaacacacgauugaugucacaacggauuuga

SEQ ID NO: 53041 - RNA, 1800 nt, Artificial Sequence
  derived and/or modified sequence opt3 from ARSJ__Homo_sapiens__NP_078866
auggcccccagaggcugcgcugggcacccuccaccgcccagcccucaggcaugugucugcccaggaaagaugcuggccaugggugcgcucgcuggcuucuggauccuuugucuguugaccuacggguauuuauccuggggacaagcccuggaggaagaggaagagggcgcacuacucgcccaggcuggugaaaaacuggagcccucuacaacuucaacgagucagccucaucuuauuuuuauacuggcagacgaucagggguucagggacgucggauaccacggcagcgagaucaagaccccaacauuggauaaacucgccgcugaaggcguuaagcuggagaacuauuacgugcaacccauuugcacuccuucccggucucaguuuaucaccgggaaauaucagauucauacaggacugcagcacucgaucauacgcccaacccaaccgaauugucuccccuuagacaacgccacucugccucagaaacuuaaggaaguagguuacucaacacauauggugggcaaauggcacuugggguucuaucgaaaggagugcaugccaacccguagaggauuugauacguucuuuggcagccugcuagguaguggggacuacuacacucacuauaaaugugauucccccggaaugugcggcuacgaccucuaugagaaugauaacgcggcaugggacuacgauaauggcaucuauucuacccagauguacacacagaggguccaacagauucuggccagccauaacccuacuaagccaaucuuccuuuauauugcuuaccaggccgugcacucaccccugcaagcaccggggcgguacuuugaacauuaucgcuccaucauaaauauuaacagaaggcgguacgcugccauguugaguugucucgacgaggcgaucaauaacguuacccuggccuuaaaaacauauggauucuacaauaacagcauuaucaucuauucuuccgauaaugguggccagccuaccgcagggggaucaaacuggccccugcgcggcagcaaggguacguacugggaagggggcauucgagcugugggauuuguccacaguccacuccuuaagaauaaaggcacugugugcaaggagcugguacacauaacagacugguauccuaccuugaucucucuagccgaagggcagauugacgaggauauccagcuggacggauacgauauaugggagacuauuuccgaaggucucagaagccccaggguugacauccugcauaacaucgauccaauuuacacaaaagcuaagaacggcucgugggccgcaggguauggaaucuggaauaccgccauucaaucugcuauacgggugcagcacuggaaacuucugacgggcaaccccgguuacuccgacugggucccuccacagucauucaguaauuuggggccgaaccguuggcauaaugagcgcaucacccucagcacaggcaaguccguguggcuguuuaacauuacugcggaucccuaugaaagaguggacuuaucuaauagguacccuggaaucgucaaaaagcugcuacggcgacucagccaguucaacaagaccgcaguuccagugcgcuaucccccuaaagauccaagaucaaaucccaggcugaacggcgggguauggggaccgugguacaaggaggaaacaaagaagaaaaagccuaguaagaaucaagccgagaaaaagcagaaaaaguccaaaaagaagaaaaagaaacagcagaaggcugugagcgguucuacuugucacucaggcgugaccugcggguga

SEQ ID NO: 53042 - RNA, 1611 nt, Artificial Sequence
  derived and/or modified sequence opt3 from ARSK__Homo_sapiens__NP_937793
augcugcuccuuugggugagcgucguugccgcucuggcauuggccguguuagcgcccggcgcuggggagcagagaaggcgggccgcaaaggccccuaacguagugcuggucguguccgacucuuucgauggacgccuaaccuuucacccagguucacaaguugugaaacucccguucaucaauuuuaugaagacacgaggcacaaguuuccugaacgcuuacacgaauagccccauuugcuguccuucccgugcagccauguggucugggcuuuuuacccaucugacagaaucguggaacaauuucaaaggauuggacccaaacuauacuaccuggauggaugucauggagagacacggcuacaggacacagaaguuugguaaacucgacuauaccucagggcaucacagcauaaguaaucggguggaggcuuggacucgcgauguagccuuccugcugagacaggaaggaaggcccaugguuaaccucauccggaaucgcacaaaggugcgagucauggaaagagacuggcagaacaccgauaaggcggugaauugguuaaggaaagaggcaauuaacuacacggagccuuuugugaucuaucugggccuuaauuugccacaucccuacccuuccccaucuagcggcgaaaacuucggguccucaacuuuucacaccagucuguauuggcuagagaaggucagccacgacgccauuaaaaucccgaaguggucuccccucuccgaaaugcauccuguugauuacuacucaagcuauacuaaaaauugcacuggacgguucaccaagaaggagaucaaaaacauacgugcuuuuuacuaugccaugugugcagagacagacgcuaugcugggugaaauuauccuugcccugcaccaauuggaucuccugcagaagaccauugugaucuacaguucugaccauggcgaguuagcgauggaacaccgccaguucuauaaaauguccauguacgaggccagcgcacacguaccacugcucaugauggggcccggaauaaaggcuggccuucaggugucgaacgucgugucucugguugauauuuauccuacgauguuggacaucgccgguauuccacuaccccaaaaucuguccggguacucacuccugccgcuuaguagcgaaacuuucaaaaacgagcauaaggugaaaaaucugcacccucccuggaucuuguccgaguuucauggaugcaacgucaaugcuucuacauacaugcucagaaccaaccacuggaaguauaucgccuacagcgacggcgcaucaauucugccacaguuauucgaucugaguuccgacccugaugaacuaacuaauguggccguaaaguuucccgagauaacauauagccucgaccagaaacugcauucuaucauuaacuacccaaagguuucagcuagugugcaccaguauaauaaagaacaauucaucaaguggaaacagagcauaggccagaacuacuccaaugucauugcgaaccuuagguggcaccaagauuggcagaaggagccccggaaguaugaaaaugcaaucgaccagugguugaaaacccauaugaacccucgagccguguga

SEQ ID NO: 53043 - RNA, 984 nt, Artificial Sequence
  derived and/or modified sequence opt3 from ART1__Homo_sapiens__NP_004305
augcagaugcccgccaugaugagccugcuccuuguguccgucggccugauggaggcuuugcaagcacagucucacccuaucaccagaagggacuuauucucacaggaaauucagcuggauauggcccuagcgaguuuugacgaucaauacgcugggugcgccgcagccaugacagcugcacucccagaccugaaccauacugaguuccaggccaaucagguuuaugcugauagcuggacgcuugccuccucucaguggcaagaacggcaggcgcgcuggccggaguggucgcugucacccacccgaccuagcccacccccuuugggauuucgugacgaacacgguguggcacuccuggccuacacagcuaacaguccacugcauaaggaguucaaugccgcaguaagagaggcuggcaggucccgggcccacuaucuccaucacuuuucuuucaaaacuuuacacuuucugcuuaccgaagcguugcagcugcuagggagcggacagagacccccucgcugucaucaaguguucaggggcguccacggucuccgguuucgcccagccgggccgcgagcaacagugagacugggaggcuucgcuuccgccucacuuaagcauguugcugcccagcaguuuggcgaggauaccuucuuugggauauggacuugccugggagcacccaucaaagguuacaguuucuucccuggcgaagaggagguguugauuccacccuuugaaacauuccaagucaucaacgccagcaggcucgcucaggggccugcgcggauuuaucugcgugcauuaggaaagcacucuaccuacaauugugaguauaucaaagacaagaagugcaaauccggcccaugucaccuggauaacucagccaugggucagagcccccucagugcuguguggucucuucuguugcuacugugguuucucguaguucgcgccuucccggacgggccuggacugcuuuga

SEQ ID NO: 53044 - RNA, 1170 nt, Artificial Sequence
  derived and/or modified sequence opt3 from ART3__Homo_sapiens__NP_001123488
augaagaccggccacuucgagaucgugacaaugcugcucgccacuaugauucuugucgacauauuucagguuaaagcugaagugcuggauauggcagacaacgccuucgaugacgaguacuugaagugcacggauagaauggaaaucaaauauguaccccaauuacugaaggaggaaaaagcgagccaucagcagcuagacaccgugugggagaaugcuaaggccaagugggcagccaggaaaacacagauuuuucucccuaugaacuucaaggauaaucacgggaucgcucugauggcauacauuuccgaggcccaagaacagacuccauuuuaucaucuuuucucugaggcugucaaaauggccggacagucacgggaagacuacaucuaugguuuucaguucaaggcguuucacuucuaccugacccgcgcauugcaacuccugcgaaaaccgugugaggccaguagcaagacagugguuuaucguaccucccagggcacuucuuuuacauucgggggacugaaccaggcuagauuuggccauuucacccucgccuacucggcaaagccccaggcugccaaugaucaauuaacggugcugucaauauacacuugccuuggugucgacaucgagaacuucuuggauaaagaaagcgagaggauuacccugaucccucuaaaugaaguguuucagguaagucaggagggggcgggaaacaaucucauucugcaauccaucaacaagacauguucucacuaugaaugcgccuuccuuggcggccugaaaacugagaauuguauagagaacuuggaauacuuucagccaauuuauguuuacaaucccggggagaagaaccagaaacucgaagaccacagcgagaagaauuggaaacuggaagaucauggagagaagaaccagaaguuagaggaccacggugugaaaauccuggaaccuacccaaauuccaggcaugaagauccccgagccuuucccacucccggaagacaaaucccaggggaacaucaauaaccccacaccuggaccaguccccgugccuggcccaaagucacaucccagugcaagcucugguaaacuucuguugccgcaguuugggauggugauuauacuaaucuccgucucagcuauuaaucuguucguugcccucuga

SEQ ID NO: 53045 - RNA, 945 nt, Artificial Sequence
  derived and/or modified sequence opt3 from ART4__Homo_sapiens__NP_066549
augggcccccugaucaacagaugcaagaaaauucuccuuccuaccacagugccaccggccacuaugaggauauggcuguuagggggauugcugcccuuccuacuccugcuuagcggucugcagcggccuacggagggcuccgaagucgcuaucaagauugacuuugauuucgcaccagggucuuuugacgaucaauaccagggauguucaaaacagguuauggagaaguugacccagggcgacuauuucacaaaagauaucgaagcccaaaagaauuacuuucgcauguggcagaaggcgcaccucgcuuggcugaaccaggguaaagugcugccccagaauaugacuaccacacaugccguagcaauucucuucuauaccuuaaacaguaaugugcacagcgacuuuacucgagccauggcuuccgucgcacguacaccucaacaguacgagagaucuuuccauuuuaaguaucugcacuacuaucuuaccucggccauccaguugcugaggaaagauucaauaauggaaaacgggacgcuaugcuacgaggugcauuaccggacuaaggacguucacuucaaugcuuauaccggagccacaauccgcuuuggccaguuccucagcaccagucugcuuaaagaggaagcgcaagaguuuggcaaccagacucuguucacaauuuucaccuguuugggggcaccagugcaguacuuuucccucaagaaggaaguccugauucccccuuaugaguuauucaaagugaucaauaugucuuaccacccaagaggagauuggcugcaacucaggagcacggguaaccuuuccacuuauaauugccagcuguugaaggccucaaguaaaaaguguaucccggaccccauagcuauugccagccuaucuuuucugacauccguaaucauuuucucaaaaagccggguuuga

SEQ ID NO: 53046 - RNA, 2871 nt, Artificial Sequence
  derived and/or modified sequence opt3 from ARVCF__Homo_sapiens__XP_005261300
auggaggacugcaacgugcacagcgccgcuuccauccuggcaucugucaaggaacaggaggccagauucgaaaggcucacccgggcgcuugagcaagaacgccgacauguugcucugcaguuggagcgugcccagcagcccggcauggugucagggggaauggguaguggccaaccuuuaccaauggcauggcagcagcugguacuacaggagcaaagcccggggucccaggccucucucgcuacaaugcccgaagcaccugaugugcuggaggaaacugucacgguggaggaggacccaggaacccccacaucgcacguuucaauugugacuagcgaagauggcaccacaagaaggaccgagacuaaagucacaaagaccgugaaaacgguaacuacccggacaguucgccaggugccugucgguccagacgggcuuccccuguuggauggaggcccuccacucggcccguuugccgacggggcucuggauagacauuuccugcucaggggagguggccccguggccacuuuaagucgggcguaccuguccucugggggaggcuuuccugaagguccagagccccgcgacagcccuuccuaugggucacuuagucgaggauugggcaugagaccacccagggcaggcccgcuggggccuggacccggugauggcuguuucacccuaccagggcaccgggaagccuuuccugugggacccgagccagggcccccuggugggcguagccucccagagcgcuuccaggcugaaccguacggccuggaggacgauacaagaucucuugccgcagacgaugaaggaggccccgagcuggaaccugacuaugggaccgcuacgaggcggcgaccagagugcggacgcgguuugcauacuagagccuacgaggacacagcggaugacggcggggaacucgccgaugagaggcccgcauuuccuauggucaccgcuccacuggcccaacccgaacggggauccaugggcucauuagaccgccugguuagaaggagcccgaguguggauucugcucguaaggagccucgguggcgagacccagaacuccccgagguacuugccaugcugagacacccuguggaucccgucaaagcaaaugccgcugcguauuugcagcaccuauguuucgagaacgaaggugugaagaggcgcguucggcagcugagagggcucccacugcuuguggcacuguuggaccauccuagggccgagguccgccgacgggcuugcggcgcccuccguaaucuguccuacggaagagauacugacaacaaggcagccauaagggauuguggcggggugcccgcuuuaguacgccugcuacgggccgcaagagacaaugaaguuagggagcucgugacaggaacccuguggaaccuuagcucguaugagccauugaaaauggucaucauugaccacggucugcaaacgcucacccaugaagugaucgucccgcacucuggcugggagcgagaaccuaaugaggauuccaagccccgcgacgcggaauggacaacuguguuuaaaaacaccucagggugccugcggaauguuaguagcgauggagcugaggccagaaggcgucuucgcgagugugaaggccugguggacgcauugcuccacgcccugcaguccgcuguaggucggaaggauacagacaacaaaucugucgagaauugcguguguauuaugagaaacuuaagcuaccauguucacaaggaagugccaggggccgauagguaccaggaggcagaacccggcccucugggaucagcugucggcagucagcgacggcgcagagacgaugccuccugcuucgggggaaagaaagcgaagggcaaaaaggacggugagauggauaggaauuuugacacucuagaucucccaaaacggaccgaggccgcuaagggguucgaacugcuuuaucaacccgaggugguacgauuguaccugagccuccugacagaaucuagaaacuuuaauaccuuagaggcagccgcuggagcccugcagaaccuuucagcaggcaacuggaugugggcgacuuauauccgcgccacggugaggaaagaacgugguuugccuguucucgucgagcugcuacagagugagacagacaagguggugcgggcugucgccauagcacugagaaaucucagccuggacaggcgcaacaaggaucuuaucggcuccuacgcuauggccgaauugguucgaaaugugagaaacgcacaggccccgccacggcccggggcuugucuggaggaagacaccgugguagcggucuuaaauacuauucaugagaucgugucugauucgcucgacaacgccaggagccugcuucaagcacgcggaguuccugcucugguggccuuggucgccuccucacagagugugcgugaggcuaaagcagccucucacguucuccagaccguguggagcuauaaggaacugagaggcacacuacagaaagauggguggaccaaggcgcgguuccaauccgcugccgcaacugccaaaggaccaaagggcgcucugucacccgguggguucgacgauagcacacucccucugguagacaagucucuugagggagagaaaacgggcuccagggaugucauuccgauggacgcauugggucccgauggcuacaguaccguggaccgccgagaaagacggccaaggggcgccagcucugcgggagaggcuuccgaaaaggagccucugaaauuagaucccucacgcaaggccccaccucccggcccaaguagaccggcagugaggcucgucgacgccguuggggacgcuaaaccucagcccguggauagcuggguauga

SEQ ID NO: 53047 - RNA, 1689 nt, Artificial Sequence
  derived and/or modified sequence opt3 from ARX__Homo_sapiens__NP_620689
augagcaaccaguaccaagaggaaggcugcuccgagagacccgaauguaagucuaaaucaccuacccugcucaguagcuauugcaucgacuccauucuugggaggcggucuccauguaagaugcgccuguugggagccgcucagucguuaccggcaccccugacaucacgagccgauccugagaaagcggugcaggguagcccaaagaguuccucugcucccuucgaagccgagcuacaccucccuccaaaacugcguagacuuuacggccccgggggaggcaggcuguugcagggugcagccgcugcagccgcugccgcggcagccgcugccgcagcugccgcgacugccacggcagggccucggggagaggcuccaccgcccccuccacccaccgcccgcccuggcgaaagaccagacggcgcuggggccgcagccgcugcggcagccgcugccgcagccgcuugggauacacucaagauaagccaagccccucaggucuccaucucaaggaguaagagcuaucgggagaauggagcaccguuuguuccucccccacccgcgcuggacgaacuggguggccccgggggagugacucauccagaggagcgccucggcguagcuggugggcccggaucugccccugcagccggcggcgggaccggaacagaagaugacgaggaagaguuacuggaagaugaggaggacgaagaugaggaagaggaacuuuuggaggacgaugaggaagaacugcuagaagacgaugcucgagcccuccugaaagagccaagaaggugcccgguggcagcuaccggugccgucgcggccgcugcagccgcugccguggcaacugaaggcggggagcuuucccccaaggaggaacuguugcuccacccugaggacgcggaaggaaaagacggcgaggauucaguuugucugagcgccgguagugacucugaggaaggguuacugaagcggaaacagcgucgcuacagaacaaccuucacguccuaucagcucgaggaacuugagagggcuuuucaaaagacucauuacccagauguguucacccgggaggagcuggccaugcgauuggaccuaacagaggcacgcguccaggugugguuucagaacagaagggcuaaguggcggaaacgcgaaaaggccggcgcacagacucaucccccuggacugccauuccccggcccgcucagcgccacccacccucugucgccauaucuugaugcuucucccuuuccuccccaccacccagcgcuggacuccgccuggacagcagcugccgccgcugcagccgcggcuuucccuucauugcccccaccgccugggagugccagccugcccccauccggagcaccccucgguuuaucuaccuuucugggcgccgcuguauucagacauccugcauuuauuagcccagccuucgggaggcuauuuucaacgauggcgccccucacaagugcuuccacugccgcagcccugcuucgucaaccuaccccggcuguugagggagccguggcaagcggcgcuuuggccgauccagcgacugccgcagcugaccggcgagccucuucaaucgcugcacugagacucaaagccaaggaacacgccgcucagcugacacagcuuaauauucugcccgguaccaguacggggaaagaggucugcuga

SEQ ID NO: 53048 - RNA, 1128 nt, Artificial Sequence
  derived and/or modified sequence opt3 from AS3MT__Homo_sapiens__NP_065733
auggccgcucugagagacgcagagauccagaaggaugugcaaaccuacuauggccagguccucaaaaggagcgccgaccuucagacaaacgggugcguuacuacggcgcggcccgugccuaagcacauucgcgaagcucugcagaauguacaugaggaaguggccuugcgauacuauggaugugguuuagucauaccagagcaccuggaaaacugcuggauccuagaucucggcuccgggucuggacgugacuguuacgugcugucacaacuuguuggcgagaaaggucaugugaccgggauugauaugacaaagggacaggucgagguggcagaaaaauaucuggacuaccacauggagaaguauggcuuccaggccaguaauguaacuuuuauccauggcuacauugaaaaguugggggaggcuggaaucaaaaacgagagccacgauauaguuguguccaauugcgucaucaaccucgugccggacaagcagcaagugcugcaggaagcauacagaguccugaaacacgguggcgagcucuauuucucugauguuuacaccucguuagaacugcccgaggaaauuaggacacauaaggugcuuuggggagaguguuugggcggggcccuguauuggaaagagcuagcuguacucgcccagaagaucgguuuuugcccuccacggcuggugaccgcgaaucuuauuacuauccagaacaaggaacuggagcgcgucauaggggacuguagauucgugucagcaacauuuagguuguucaaacacagcaagaccggacccacgaaacggugccaaguuauuuacaauggcggcaucacugggcaugaaaaggagcucauguuugaugccaacuucaccuuuaaagaaggagagauuguggaggucgacgaagagacagcugccauccugaagaauagucgcuucgcacaggacuuuuuaauccgaccuauuggugaaaaacugccaacuuccggcggguguucugcucucgagcuuaaggauauaaucaccgaccccuucaagcuggccgaagagagcgauuccaugaaaucaagaugcgugccugacgcggccggaggcuguugcgguacaaagaaaaguugcuga

SEQ ID NO: 53049 - RNA, 1170 nt, Artificial Sequence
  derived and/or modified sequence opt3 from ASAH1__Homo_sapiens__NP_001120977
augaacugcuguaucggccugggggagaaggccagaggaagccacagggcuuccuaccccucucucucagcacuuuucaccgaagccaguauucuggguuuuggcagcuucgcggugaaagcucaguggacagaggacugccggaaguccacuuauccuccaucugggccgacggucuuucccgccguuauacgcuaccgaggagcagugccuugguauaccaucaauuuggauuuaccacccuacaaacguuggcaugaacugaugcuagacaaggccccuguaccaggccuccuggguaacuuccccgggccuuuugaggaagagaugaaaggaauugcugcagugacagauaucccacuuggcgagauuaucucguucaauauauuuuaugaacuguucacuaucuguaccucaauugucgccgaggacaagaagggccacuugauccaugggagaaacauggauuuuggaguguuccucgguuggaauauuaacaaugacacauggguuaucaccgaacaacugaaaccgcugacugugaaccucgauuuucagaggaauaacaagacagucuucaaagcuagcaguuuugccggcuacguggggauguuaaccggauucaagcccggccuguucucccuuacguugaaugagcgguuuucuauaaacgguggguaucuggggauucuagaguggauccucggcaaaaaggacguaauguggauuggcuuccugacucgcaccguucuugaaaauagcacauccuacgaggaagcgaagaaccuguugacuaaaaccaagauccucgccccugcauacuuuauccugggaggaaaucagucaggugagggcugcgugauuacaagagauaggaaagaaaguuuagacgucuaugagcuggaugcuaagcaggggcggugguacguggugcaaaccaacuaugaccgcuggaaacacccauucuuucucgaugaccgaagaacgcccgccaagaugugucuuaacaggacuagccaggagaauauaucuuucgaaacaauguacgacguccuguccaccaaaccuguuuugaacaagcuaacuguguauacaacccugaucgauguaacgaagggacaguuugagaccuaccuccgggacugcccagaucccuguauuggcugguga

SEQ ID NO: 53050 - RNA, 2238 nt, Artificial Sequence
  derived and/or modified sequence opt3 from ASAH2__Homo_sapiens__NP_001137446
auggccaagagaaccuucagcaaccuggagacauuucucaucuuccuucuggugaugauguccgcuauuacugucgcauuguuaucucugcuauuuauaacgucaggcaccaucgaaaaucacaaagaccucgggggacauuucuuuaguacaacucagagcccucccgccacccaagguuccacagcggcucagaggucuaccgccacucagcacucgacagcaacccagucaagcacggccacucaaaccaguccaguuccgcugacacccgaguccccucuuuuccagaacuuuucuggcuaccauauuggggugggacgggcugauugcacuggccagguagcagacaucaaucugauggguuaugggaaaagcggacagaacgcccaaggcauuuugacccgccucuacucccgagcuuucaucauggccgaaccagauggcucaaaucguacaguguuugucaguauagacaucgggauggugagccagagacugaggcuggagguucucaaccgguuacagucuaaauauggaucccuguaccgcagagauaaugugauucuuucagguacccacacgcauagcggccccgcgggguauuuccaguacacugucuuugugaucgcaagugaaggauucucuaaccaaacauuucagcacaugguaaccggcauuuugaaguccaucgacauagcccacacuaauaugaaaccugguaagauuuucaucaacaaggggaauguugauggagugcagauuaacaggagcccauauucguaccugcaaaauccccagucugagcgggcucgcuacuccucaaacacagacaaagagaugaucguccuaaagaugguggaucucaauggcgacgaucugggccuuaucaguugguucgccauucauccugugagcaugaacaacuccaaucaccuggucaacucugacaauguuggguaugcaagcuacuugcucgaacaggagaaaaacaagggauaucugccaggucagggcccguuuguggcugccuucgcgucaaguaauuuaggggauguaucccccaacauacugggaccucgauguaucaauaccggcgaaagcugcgacaacgccaauucuacguguccaauuggugggcccucaaugugcaucgcaaaaggcccuggacaagacauguuugauaguacccagauaauuggcagagcuauguaccagagggccaagagcaagacauguaaaccagcucucggguauuccuucgccgcaggaacuaucgacggugugggcgggcuuaacuuuacccagggaaagacagagggcgaucccuucugggacacuauccgggaucaaauucuggguaaaccgucugaggaaaucaaggagugccauaaaccuaagcccauuuugcuacacaccggggaacugucgaaaccacacccuuggcaucccgacauagucgaugugcagaucauuacacucggcagccuggccaucaccgcuaucccaggagaguuuacuacgauguccggccgucgccuuagagaagcgguucaggcagaguucgccucacacgggaugcagaauaugacaguggucauuaguggacuguguaacguguacacccauuauauaacuaccuacgaggaauaccaagcucagagguaugaggccgcaucuacaaucuacgguccccacaccuugagcgccuauauucagcucuuucggaaucuggcuaaggccaucgcaacugacacaguagcgaacuuaucccgaggcccugaaccaccguucuuuaagcagcugauuguuccccuaaucccuucaauaguggaucgcgcuccaaaagggagaacguucggagacguccuccaacccgccaagccugaguacagggugggcgaagucgcagaggugaucuuuguuggugccaauccaaagaacagcgugcagaaccagacccaucaaacuuuccugacaguagagaaguaugaagcuaccucuacauccuggcagauugucugcaaugaugccaguugggagacucgguucuacuggcacaaagggcuuuugggccugagcaacgcaaccguggaauggcacauccccgacacggcucagccgggaauuuaucgcaucagauacuuuggccauaauaggaagcaggacauacucaagccugccguuauucugucuuucgaggggaccuccccagcguuugaaguggucacaaucuga

SEQ ID NO: 53051 - RNA, 3390 nt, Artificial Sequence
  derived and/or modified sequence opt3 from ASAP1__Homo_sapiens__NP_060952
augagaagcuccgccucuaggcugucaaguuucagcucccgggacucucucuggaaccgcaugcccgaucagaucucggugucagaguuuauugcugaaaccacagaggacuacaauagcccuacuacgaguuccuucaccacacgacuucacaacugccguaauacugucacccuguuggaagaggcauuagaucaagacagaacagcccugcagaagguuaaaaagucugugaaagcgauauauaacagcggccaggaucauguacagaaugaagagaacuacgcucaagugcuagacaaguuuggguccaauuuccucucaagggauaacccagaccugggaaccgccuuugucaaauucaguacucuuacaaaggagcugagcaccuugcucaagaaucugcugcagggucucucucacaacgugaucuuuacguuagauucccugcuuaaaggcgacuugaaggggguuaaaggagaucugaagaaaccguucgacaaggcauggaaggauuaugaaacuaaauuuaccaagauugagaaagaaaagcgggagcaugccaaacagcacggcaugauccgcacagagauuacuggugcugaaaucgcagaggaaauggagaaggaaagaaggcuauuccagcuccaaaugugugaguaccugauaaaagugaaugagaucaagaccaagaaaggggucgaccuucugcagaacuugauuaaguauuaccaugcccagugcaacuuuuuccaggacggacucaaaacagcugauaagcugaaacaauauaucgaaaaguuagccgcggaccuguacaauauuaagcagacccaggaugaggagaaaaagcaacucacggcacuucgggaccugaucaaaucaagccuccagcuagaucagaaggaggacagucagucucgccaaggcggcuacuccaugcaccagcugcaggggaauaaagaauauggaagcgagaagaaggguuaccuccugaaaaagucggauggcauacgaaaaguguggcagagaaggaaguguucuguuaaaaacgggauucuuacuaucucccacgccacaucaaaccggcaacccgcuaagcugaauuuguugaccugccagguaaagccuaacgccgaggacaaaaagaguuuugaucugauuagccauaaucguacuuaucacuuccaggcagaagacgagcaggauuacguggcuuggaucuccgucuuaacaaacucuaaagaagaggcccugaccauggcguuccgcggagaacaaagcgccggcgaaaauucacuagaggaccucacgaaggcaaucauugaagacgugcagagacugccagguaacgauauauguugcgacugugggaguuccgagcccaccuggcuuagcacaaauuugggaauccugacuugcauugaauguucuggcauccauagggagaugggcgugcacauaucacggauucagagucucgagcuggauaaacuugggaccagcgaacuguugcucgcuaagaacgucggaaauaacuccuuuaaugacaucauggaggccaaccugccuucuccaucgcccaaaccuacaccaagcuccgauaugacuguucgaaaggaauauaucaccgcuaaguacguggaccaccgcuucucaagaaaaacaugcaguaccucuagcgccaaguuaaaugagcugcuagaagcaauuaaauccagggaucuccuggcccuuauccagguauaugcugaggguguggaguugauggaaccgcugcucgagcccggccaagaacugggggagacugcguuacaucuggcaguccggacggccgaccagacaucacuucacuugguggauuuucucguucagaacuguggaaaucuggacaagcaaaccgcucuaggcaacacugugcugcauuacugcagcauguacucuaaaccugaaugccucaagcugcuuuugcgcuccaagccaaccgucgauauugugaaccaggccggugagacagcacuggacauagccaaaagauuaaaggcuacccagugugaggaucuccugagucaggccaaaagcgggaaguucaauccccacguacauguugaauaugaguggaaccuuaggcaagaagagaucgacgaaucugacgaugaccuggaugacaaaccuuccccaauuaagaaggagcguucaccccggccgcagaguuuuugccacagcucguccaucucuccucaggauaaauuggcacuccccggcuucagcacuccacgagacaagcagagacugucauacggagcguuuacaaaucaaaucuucgugaguacguccaccgauucuccuacuagccccacaaccgaggcuccaccccuaccuccaaggaacgccggcaaagggccgacaggacccccuuccacucugccacucucaacccagacgagcagugguucuuccacccugagcaagaaacggcccccuccacccccgccuggccacaagcgcacacuuucggacccacccucaccuuugccccaugggccaccuaauaagggagcaguccccuggggcaacgauggugggccaucuaguuccagcaaaacuaccaauaaguuugaaggccugucucagcagagcuccacaucaagugccaaaacugcuuuaggaccgagagugcucccuaagcugccccaaaaagucgcccuuaggaagaccgaccaccugagccuagauaaagcaacgauuccacccgagauauuccagaagucuucccagcucgcugaacugccucaaaagccacccccuggcgacuugccgccaaaacccacagagcuggccccuaagccacagaucggggauuuacccccuaaaccgggagagcugcccccaaagccucagcucggugaccuucccccaaaaccucagcugucagacuugcccccaaagccgcaaaugaaggaucucccucccaaaccacagcugggcgaccuacuggcgaagagucagaccggggaugugagccccaaagcccagcaaccuuccgaaguuacucuuaagucucauccacucgaccugucgcccaacgugcagagccgcgaugcuauucagaaacaggcaucagaggacuccaaugauuugacaccuacccugccggaaacuccaguacccuuaccucgaaagaucaacaccggaaagaauaaaguccggcgugugaagacaauuuaugacugucaagccgauaacgacgaugagcucacguuuaucgaaggcgagguuauaaucgugaccggugaggaagaccaggagugguggauugggcacaucgaaggccagcccgagagaaaaggagucuucccagugaguuuuguacacauucugucugacuga

SEQ ID NO: 53052 - RNA, 2886 nt, Artificial Sequence
  derived and/or modified sequence opt3 from ASAP2__Homo_sapiens__NP_001128663
augcccgaccagaucagcguguccgaguucgucgccgaaacccacgaggauuacaaggcuccuacagcaucuucauuuacuacgagaaccgcccaaugcaggaacacaguugcggcuauugaagaggcccuggacguggaucggaugguacucuauaaaaugaagaaaagugugaaggcaauaaauagcuccggccuugcccaugucgaaaacgaggagcaguacacucaggcucuggaaaaauucgggggaaauugugugugccgcgacgauccagacuuggguucugcauuuuuaaaguucucgguuuuuaccaaggagcugacagcccuauucaaaaaccucauccagaauaugaacaauauuaucucauuuccgcuggauagccuucugaagggcgacuugaaaggggugaagggagaucucaaaaagcccuucgacaaggcuuggaaagauuaugaaaccaagauuacuaaaaucgagaaggagaaaaaggaacacgccaaacugcauggcaugauacgaacagagaucaguggugcggaaauugcagaggaaauggagaaggagcguagauuuuuccaacugcagaugugugaauaccucuuaaaggucaacgagaucaaaauuaagaaagggguggaccugcuucagaauuugaucaaguauuuucacgcccagugcaacuucuuucaagauggacugaaagcuguagaaucccuaaagccuucuauagagacccucagcacggaccugcauacuauuaagcaggcccaggacgaagagaggcggcagcuuauccaacugcgcgauauuuugaaauccgcacuccagguugagcagaaggaagacucacaaaucagacagaguaccgcuuacagccugcaccagccacagggcaauaaagagcacggcacagaaaggaacgggucuuuauauaagaaauccgauggaauccggaagguguggcaaaagcgcaaauguucagucaagaaugguuuccugacuauuagccauggcaccgccaaccgacccccugcgaaacucaaucuucugacaugccaggugaagaccaacccagaggagaaaaaguguuucgacuugauaagucacgauagaacguaccauuuucaggccgaggacgagcaggaaugccaaaucuggaugucugugcuacagaacuccaaggaggaagcacugaauaacgcuuucaaaggggaugacaauacuggagagaacaauauuguccaggagcucacaaaggaaaucauaagcgagguucagaggaugaccggcaacgauguguguugcgacuguggugcccccgauccuacuuggcugucgacaaaucuugggauucugaccugcaucgaaugcucuggaauccaccgggaguugggcguacacuacucccguaugcaaucacucacgcuggacguguuaggcaccagugaacugcuacucgcuaaaaacauugggaaugccggauuuaacgagaucauggaguguugccugccagcagaagacagcgucaagccgaaucccgguuccgauaugaacgcccgcaaagacuauauuacagcuaaguacauagagagaagguaugcgcggaaaaagcaugcagauaaugccgcuaaacuucacucuuugugugaagccgugaaaacucgagacaucuucggccugcuccaggcauacgccgaugggguugaccugaccgagaagauuccucuugcuaacggacaugaaccagaugagacagcccugcacuuggcagugcgcagcgucgacagaacuucacuccauaucguggauuuucugguacagaauaguggcaacuuagacaaacagaccgguaagggguccacagcgcugcacuauugcugucuaaccgauaacgcugagugccucaaacugcuuuugaggggcaaggccagcaucgaaauugcaaaugagucuggagaaacuccccuggacauagccaagcggcucaaacacgagcauugugaagaacuguuaacgcaagcucugucaggccgcuucaacagucacguucauguggaguacgaauggagacuuuugcacgaggaucucgacgaaagcgacgaugacauggaugagaagcugcagccuuccccaaauaggcgugaggaccggcccaucucuuuuuaucagcuagggucgaaccaacugcagagcaaugccgucucccucgcacgagaugcugccaaccuggcgaaagaaaagcagagagccuucaugccgucaauucuucagaaugagacauacggagcuuugcugagugguucuccucccccagcacaaccugccgcucccagcaccacuuccgccccacccuuaccuccaaggaacgugggcaaagacccgcucacccccacaccuccacccccugucgcaaagaccccaucagugauggaagcgcugagccagcccucuaagccggccccuccagggaucucccagauucggcccccuccccuuccaccucagcccccaagucgccugccgcaaaagaagccugcucccggagccgauaaaagcacuccauugacaaauaagggccagcccagagguccuguugaccucucugcaacggaggcucuggggccacuauccaacgccauggugcugcagcccccugcaccgaugccaaggaaaucacaggccaccaagcucaagcccaaacgcguaaaggcucuguacaauugcgucgcggauaacccugacgaacuuacuuuuagugagggcgaugugaucauaguugacggagaggaagaucaagagugguggaucggccacauugacggggacccaggacgaaaaggugccuuccccgugagcuuuguccauuucaucgcagauuga

SEQ ID NO: 53053 - RNA, 1404 nt, Artificial Sequence
  derived and/or modified sequence opt3 from ASB10__Homo_sapiens__NP_001135931
augcugaugagcuggucccccgaggaaugcaagggccagggggagccucucgacgauagacacccacuuugugccaggcugguggaaaaaccgucucggggaucagaggaacauuugaagaguggucccggcccuaucgucacccgcacagcuagcgggccagcauuagccuucuggcaagcgguucuggcuggagacgugggcugcguaucccguauucuagccgauucuucgacuggucucgcacccgacucaguguuugauacgagcgacccugagcgauggagagauuucagguuuaacauacgggcccugcgccuuuggagucugaccuacgaggaagaguugacaacuccacuccacgucgcugcauccagagggcauaccgaagugcugaggcugcucuuacggcgccgagccagacccgacucugcuccuggaggcaggacagcccugcacgaggcgugugcagccggccauaccgcuugcguucacgugcuuuuggucgccggggcagauccaaauaucgcugaccaggauggaaaacggccgcugcaccuaugucguggucccggcacucucgagugcgccgaacugcuucugcgcuucggggcgagaguggacggaaggagcgaggaagaggaagagacaccuuugcauguagccgcacggcucggccacguugagcuggcugauuuacugcuccgacgcggugccuguccagacgcuagaaacgccgaaggguggacgccccuucuggcagccugcgacgugaggugucaguccauuaccgaugcugaggcgacuaccgcacggugcuugcagcuauguucacugcuccugagugccggagcugacgccgaugcagccgaccaagauaagcagcgcccucuucaucuggcuugcagaaggggccacgccgcagucguggaauugcuccugagcugcggcgugucugcgaauacaauggacuaugggggacacacuccauuacauugugcucugcagggucccgccgcagcccuagcucaguccccggagcacgucguucgugcccuccugaaccauggcgcagugcggguauggccuggggcccuucccaaaguguuggaacgauggucaaccugcccaagaacaaucgagguccugaugaauaccuacagcgugguucaacucccugaggaagcugugggacuggucacgcccgagacucuucagaagcaccagagguuuuauaguucucuguucgcguuggugcgccagccacggucccuccaacaucugagcagaugugccuuaaggucgcaccuggaaggcucucuaccccaggcucucccucgccugccacuuccgccccgauugcugcgguaccuccagcuggauuuugaggguguauuauauuga

SEQ ID NO: 53054 - RNA, 837 nt, Artificial Sequence
  derived and/or modified sequence opt3 from ASB13__Homo_sapiens__NP_078977
auggagcccagagccgcugacggcugcuuccugggggaugugggauuuugggucgaaaggaccccuguucacgaggcagcccagcggggugaaagccuccaacuucagcagcugaucgaguccggcgcgugugugaaccagguaacaguggacucuauuacuccauugcaugcugccucauuacaagggcaggcacgcugcguccagcugcuacucgccgcuggagcacagguggaugcccgaaauauagacggcaguacgccgcugugugaugcuugcgccagcgguuccaucgaauguguuaaacuucuguugucuuacggggcgaaggugaaucccccucucuauaccgcaucgccacugcacgaggccugcaugucaggaagcagugaguguguccgucugcucauugacgugggcgcuaacuuagaagcccaugauugccacuucggcacaccccugcauguagcaugugcuagagagcaccuugacugcguuaagguguugcugaacgccggggcgaaugucaacgccgcaaaacuacacgaaacugcucuccaucacgccgcuaaggugaaaaauguggaucugaucgagaugcuuauugaguuuggagguaacaucuacgccagggacaaucggggcaagaagccuuccgauuauaccuggucuagcuccgcaccagccaaauguuucgaauacuaugagaagacaccccugaccuugucacaacucugccgcgucaaccugagaaaagcuacugggguuaggggauuagaaaagauagcgaaacugaauaucccuccacggcucauugacuaccuuaguuauaacuga

SEQ ID NO: 53055 - RNA, 1767 nt, Artificial Sequence
  derived and/or modified sequence opt3 from ASB15__Homo_sapiens__XP_005250203
auggacaccaacgaugaccccgaugaggaccaccugacaagcuacgauauccagcucuccauucaagaaucuauagaggccucaaagacugcucuuugcccugaaagauucgugccacugagugcacagaauaggaaauuggucgaggccaucaagcagggccauauuccggaauuacaggaguauguuaaauacaaguaugcgauggacgaggcugaugaaaaagggugguuuccccugcacgaggccgugguacaaccuauccagcagauucuagaaaucgugcucgacgcaagcuacaagacgcugugggaguucaagaccugugauggagagacaccacuuacucuggccgucaaagcugguuugguggaaaacguucggacccuccuggagaagggcguguggcccaauaccaaaaacgacaagggggaaaccccucugcucauagcagucaaaaagggauccuaugauauggugucuacuuuaaucaagcauaauacaucgcuggaccagccaugcguaaaacgcuggucagccaugcacgaggcugccaagcaaggccgaaaagauauuguugcgcuuuugcugaagcauggugggaacgugcaccuacgugacggauuuggcgucacaccccucggcguggcagccgaauacgggcacugugacgugcuggagcaucuuauccacaaaggaggugauguccuggcuuuggccgacgauggcgcaagcguucucuucgaggcugccgggggaggcaauccugacugcauuagucuguuacuggaauaugguggguccggaaacgugccaaauagagcgggccaucucccgauccacagggccgcauacgagggccacuaccuugcucugaaguauuugauacccguaacgucuaaaaacgccauucggaagucagggcuaacuccuauccauuccgcugccgauggacagaaugcacagugucuggaacuccugauugagaacgguuuugacgugaauacccuucuggccgaucacaucucacagaguuacgacgaugaacgcaagacagcuuuguauuucggcgucagcaacaaugacgugcauugcacugagguucuccuggcggcaggggccgauccaaacuuagacccccugaacugucuacucguggcugucagagccaauaacuacgagaucgugaggcugcuuuugucucacggagcaaauguaaacugcuauuuuaugcauguuaaugacacccgguucccuuccgugauucaauacgcccugaacgaugaagucaugcuccgccugcuucugaauaacggcuaucagguggagauguguuuugacugcaugcacggugauauauucgggaauagcuuugucuggagcgaaauccaggaggaaguguugccaggcuggacaaguuguguuauuaaagacaaccccuucugcgaguuuaucaccgugccguggaugaagcaccucguaggacgagucacgagagugcugauagauuacauggacuacguuccuuuaugcgcuaaacugaagucugcccuagaggugcaaagggaauggcccgagauucggcagauccucgaaaauccauguucccugaaacaucuuugccguuugaagauccgcagacugaugggccuccagaagcugugucagccugcaagcgucgagaaauuaccccugccacccgcgauucaaagguauauccuuuucaaggaguacgauuuguaugggcaggaacucaaacugacuuga

SEQ ID NO: 53056 - RNA, 1401 nt, Artificial Sequence
  derived and/or modified sequence opt3 from ASB18__Homo_sapiens__NP_997721
augagcaacuccgacuaccugcccgauuauccucucaauucugaccuugugaagagacugaaaucagccuuggaugcuaaggacgaggaaaggguccgggauuuaaucugcaccgagauuacaccaguugacgcagugauagaacuggccaacgaugacuggaugaaagauccgagugcgcagcuacccacuggcaugcuccugggggaccuugaucaccugaagccuuugauggaccaauucuuucaggaugcuaauguaguguucgagaucaacaaagacgaaauggaguggcaggucaagagcccagccacguuuggacucuccggucuguggacccuggaguacaagcgcgaacucacaacucccuuauguauugcagccgcucauggccacaccgcaugcgugcgacaucugcuugggcguggagccgacccugaugcuucuccaggcgguagaggggccuugcacgaggcgugucugggaggccauacagcaugcguuaggcuacuccugcagcaccgggccgaccccgaucuucugucggcugaaggcuuggccccucuccaccugugucgcaccgcagcuucauuagggugcgcccaagcgcugcucgagcauggagccagcgugcagagagucgguggcacugggagggacacaccacuucacguggcagcucagcggggacuggaugagcaugcccgcuuguaucuaggccgaggugcucacguagacgccagaaaugggaggggagaaaccgcacugagugccgcuuguggcgcggcacggcguccggaugagcacggccgcugccucagacugugugcccuucuguugaggcgaggggcugaagccgacgcacgggaugaggacgaacgcucuccccuccauaaagccugcggacacgcuucccauagccuggccagauuacugcuaaggcacggugcagaugcgggcgcucucgacuacgggggagccuccccucugggccggguucuucagacggcaucaugugccuugcaagcuaguccacagcgcacugugcaggcccugcucaaccaugguagccccaccgucuggccugacgcauucccaaaggugcugaaaacaugcgcuucugugcccgccgucaucgagguucuuuuuaauuccuauccgcagcugugcuugucagagagcuggaaggaagugauuccugaggaaguauuccaaaugcacaaacccuuuuaccagagucucuucgcgcuggccuuaacuccaagaugucugcagcaccuauguaggugcgcucuccgucggcuguuugggaagcgaugcuucgaucuuaucccuuugcugccccucccaaagccccugcaaaacuauuuacugcuugagccucagggcguguugcauuga

SEQ ID NO: 53057 - RNA, 1008 nt, Artificial Sequence
  derived and/or modified sequence opt3 from ASB1__Homo_sapiens__NP_001035535
auggccgagggcgggagccccgacgguagagcuggaccuggcuccgcagggaggaaccugaaggaauggcuccgggagcaguucugcgaucacccacuugaacauugugaggacacccgccugcacgaugccgcguacgugggagacuugcaaacauuacgaucucugcuacaggaagagucauaucguaguagaaucaaugagaaaagcgucuggugcuguggcuggcucccgugcacuccccugaggauugcugccacggcaggucauggguccuguguugauuuucuuauacggaagggagccgaaguggaccugguagaugugaaaggccagaccgcuuuguacgucgcagugguuaacggccaccucgagucuacacagauccugcuggaagccggggcugacccuaauggaucgcgccaucacagaucaacuccaguguaucacgccagcagggucggucgggcggauauucucaaggcauuaauccgcuacggcgccgacguggauguaaaccaucaccugacccccgacguucaaccucgauucaguagaaggcuuacauccuugguggucugcccacuguauauuucugcugccuaccauaaucuacaguguuuucggcuccugcuucuggcaggggcuaaccccgauuucaauugcaacggaccugugaauacccagggcuuuuaucgugguagcccagggugugugauggacgccgucuugcgccacggaugcgaggcggccuucguuucccuccugguggaguuuggcgcaaacuuaaaucugguaaaaugggaaucacucggcccggagaguagagggaggcggaagguggaccccgaagcccuucaggucuucaaggaggcucgaagcgugccucgcacucuguugugucuaugcagaguugcugugaggcgggcccugggaaaacaccgccuccaucugaucccaucucuuccccugccugauccaauaaagaaauuuuugcuccacgaauga

SEQ ID NO: 53058 - RNA, 1764 nt, Artificial Sequence
  derived and/or modified sequence opt3 from ASB2__Homo_sapiens__NP_057234
augaccagauucagcuacgccgaguauuuuucccuguuccacucuugcucagcucccaguaggagcacagcaccuccagaauccucuccggcccgggcgcccaugggccucuuucagggggugaugcaaaaguacucgucaagccuuuucaaaacgagucagcuggcuccugccgacccauugaucaaggcaauuaaagauggagacgaggaagccuuaaagacuaugauaaaagaggguaagaaccuggcugaacccaauaaggagggcuggcuaccucuccaugaggcagccuauuacgggcaggucggaugucugaaaguucuucagcgcgcuuauccaggcaccaucgaucaacgaacacugcaggaagagacugccguguacuuggcgaccugccguggucaccucgacugucugcugucccucuuacaggcaggggccgaacccgauauuucuaacaagagcagagagacaccucuguauaaggcuugcgagaggaagaaugccgaagcaguaaaaauccuugugcagcauaacgcugacaccaaucaccgguguaaccgcggauggacugccuugcaugaguccgucucaagaaaugaucuggaagugaugcaaauucuaguuaguggcggcgcgaagguggagagcaagaacgccuacgggaucacaccacucuuugucgcagcucagucuggacagcuggaagcccuuagguuccuggcuaaauacggugccgacauaaauacccaggcauccgauaacgccucagcuuuguaugaggcgugcaagaaugagcacgaagaggugguagaauuucuccugagccaaggcgcagacgccaacaaaacgaauaaggauggguuacugccgcuccacaucgcuaguaaaaagggaaacuaccggauuguucagaugcuucugcccgugacuucucgcacccgaaucagaagguccggcgucagcccuuugcaucuagccgcagagcggaaucacgacgaagugcuggaggcccuccugucggcucguuucgaugugaacacaccacuugcccccgagcgcgcaagacuguaugaagacaggcggucuuccgcguuguacuuugcugucguuaacaauaacguguaugccacugagcuccuguuacagcauggugcagacccuaaucgagauguaauuucaccacugcuaguggccauccgccacgggugucucagaaccaugcaacugcuuuuggaccacggagcuaacauagaugccuacauugcaacacaucccaccgcuuucccggccacgaucauguuugcgaugaaaugccugagucuccugaaguuccuuauggaccugggcugugauggcgaaccuugcuuuagcuguuuguaugggaauggaccccacccacccgccccucagccauccucuagguucaacgacgcucccgcagccgauaaggagccuagcgucgugcaguucugcgaauuuguuucagcuccagaggugagucggugggccgguccgauuaucgacguccuccuggauuacgugggcaauguacaguuaugcucccgccugaaagagcauaucgacagcuucgaagauugggcaguuauuaaggagaaagcggaacccccuagaccacuagcccaccucuguaggcugcgugugcggaaggcuauagggaaauaccgaaucaaacuuuuggacacucugccccucccuggaagacugauuagguauuuaaaguacgagaacacacaauga

SEQ ID NO: 53059 - RNA, 1266 nt, Artificial Sequence
  derived and/or modified sequence opt3 from ASB6__Homo_sapiens__NP_060343
augcccuuccugcacggcuuuagaaggaucauuuucgaguaccagccucucguggacgccauacuugggagccugggaauccaagauccagaacggcaggaguccuuggaccgcccgucuuaugucgcuucagaagagagucgaauuuuaguucugaccgaacuacucgagcguaaggcacauagccccuuuuaccaggaggguguguccaacgcccugcuuaaaauggcggaacugggcuugacaagagcugccgauguacuccugaggcacggggcaaaucugaacuucgaggacccugugacuuauuacacggcccuccauaucgcugucuuacggaaucagccagauaugguggaacugcuuguucaccauggagcagacgugaaccgcagagauaggauucacgagucuucgcccuuggaccuggccucagaggaaccugagcggcuaccaugccuccaacgccugcuugaucugggcgcugacgucaaugccgcggauaagcacgguaaaaccgcauugcuccaugcccuggcuagcagugacggggugcagauccacaacacagaaaauauacgauuacugcucgagggaggcgccgauguaaaggcaacuaccaaagacggcgacacaguuuuuaccuguaucauuuuccuucugggggaaacugugggaggugauaaggaggaggcucagaugaucaacagauuuugcuuccaggucacaagguugcuacuggcccauggcgcggaccccuccgaauguccugcccacgagucucucacccacauuugccuuaagagcuuuaaacugcauuucccacuguugcgguuucuccuggaauccggggcagcuuauaauuguucauuacacggagccaguugcuggagcggcuuccauaucauauuugagcgucuguguucucacccggguugcacggaagaugagucccaugcugaccuacuccgcaaggccgagacugugcuggaucuuauggugaccaacucacaaaaauugcagcugcccgaaaauuucgacauucacccugucgggagccucgcagagaagauccaggcccugcacuucagucuuagacagcuggaaucuuacccacccccuuugaaacaucucuguaggguugcuauucggcuguauuuacaaccauggcccguggauguaaaggugaaggcgcugccgcuaccugaccgacucaaaugguaccugcuuuccgagcacagcggaucggucgaagaugacaucuga

SEQ ID NO: 53060 - RNA, 825 nt, Artificial Sequence
  derived and/or modified sequence opt3 from ASB7__Homo_sapiens__NP_078984
augcugcaccaucacugcagaaggaaccccgagcuccaggaagaacuucaaauccaggccgcuguggcagccggcgacguccauaccguucggaagaugcuggaacagggguacagcccuaauggacgcgaugcgaacgguuggacauuguuacacuucuccgcugcccgaggcaaagagcguugugugagaguauuucuggaacauggggcagacccaacugugaaggaucuaauuggaggcuucacggcccuccacuaugcugcaaugcacgguagggcccggauagcucgccugaugcuugagucugaguacagaucagacaucauuaaugccaaaaguaacgauggguggaccccgcugcaugucgcggcacacuauggaagggacagcuuugugcgguugcuccuggaguucaaggccgagguugauccccuguccgacaaaggcacaacuccucuccaguuagcuaucauucgcgaacgaucuucgugcgugaagauccugcuugaucauaaugccaacauagacauccaaaauggcuuuuugcugagauacgcagucauuaagucaaaccacagcuauuguaggauguuccuacagcguggggcugauaccaaucucggacggcuggaggacggucagacaccacuucaccugagugccuugcgcgaugacgugcucugcgcgagaaugcuguacaacuauggcgccgacaccaauacuaggaacuacgaggggcagacacccuuagcaguauccaucucuauuagcggauccucacggccuugucuggauuuucuccaagaaguuaccaguauguga

SEQ ID NO: 53061 - RNA, 1074 nt, Artificial Sequence
  derived and/or modified sequence opt3 from ASCC1__Homo_sapiens__NP_001185727
auggaggugcugagaccccagcucaucaggauugacggccggaacuaccgcaagaauccuguccaagaacagaccuaucagcacgaggaagaugaggaagacuucuaccaggggagcauggagugcgccgaugagccaugugacgcuuaugaaguugagcaaacaccgcagggauuucgauccacucuucgugcacccucucuguuguacaaacauauaguggguaagagaggcgauacgaggaaaaagaucgaaauggagaccaaaacaucaauuaguaucccuaagccagggcaggacggagagauuguaaucacuggccagcaccggaacggugugauaagcgcccgcaccagaaucgaugucuuacuggacacauucaggcggaagcaacccuuuacccauuuccuagcguuuuuccucaaugaaguggagguucaggaaggguuucugcgcuuccaggaggaagugcuugcuaaaugcuccauggaucacggagucgacucuucgauuuuucagaacccuaagaaacugcauuugacuaucggcaugcucgugcugcugucagaggaggaaauucaacagacaugugagaugcuccagcaaugcaaggaagaguucaucaaugauauaagcggcgggaaaccauuagaaguagagauggccggaauugaguauaugaacgacgaucccgguaugguugacgugcuguacgcaaagguccacaugaaggacggcaguaaucgacuucaggaauugguggauagagugcuggagagguuucaggccuccgggcuaaucgucaaagaauggaacucuguuaagcuccacgcuaccgugaugaauacgcuguuccggaaagacccuaacgcagagggacguuauaaucuuuacacugccgaaggcaaguacauuuuuaaagagcgcgagagcuucgaugguagaaacauccugaaguuguucgaaaauuuuuauuucgggucccucaaacugaacucaauccauauuagucagagguuuaccguagacagcuucggaaauuacgcuucuuguggccaaauagauuuuuccuga

SEQ ID NO: 53062 - RNA, 2046 nt, Artificial Sequence
  derived and/or modified sequence opt3 from ASCC2__Homo_sapiens__NP_001229835
augcccgcccugccucucgaccagcuucaaaucacccacaaggauccaaaaacaggcaagcugagaacuagcccggcuuuggugauuuucgacgagacguuacagaaaugccuggauuccuaccuaagguaugucccccggaaguuugacgaagggguugcaucugccccugaggugguagauaugcagaaacgccuccaucgaucaguguuccugaccuuucuucguaugaguacacacaaggaaagcaagauacuggacuuguguguccucuucggaaaagguaacuccccacugcugcagaagaugaucggcaauauuuuuacucaacagcccucuuacuauucggaucucgacgagaccuuaccuacaauccuucagguguucucaaacauucugcagcauugcggguugcaaggagauggcgcgaauaccacuccacagaaacuggaagagagagguaggcuaacacccagcgacaugccucuccuggagcuuaaggauaucguucuguacuugugugauaccugcacgacucucugggcuuuucuggacauauucccauuagccugucagaccuuucagaaacacgacuucugcuaucggcuggcaaguuuuuacgaagccgcuaucccggagauggaauccgcaauuaagaagcgcagacucgaggacucuaaacuucugggggauuuguggcaaaggcuaagccauucccggaagaaacugauggagaucuuccacauuauccucaaccagauaugucugcuucccauucuggaaucaaguugcgacaauauccagggauuuauugaggaauuuuugcaaaucuucagcucucuccugcaggagaagcgcuuuuuacgagauuaugacgcccuguucccuguggcugaagauaucucccuacuccagcaggccucaagcguccuggacgagacaagaacugcguacauucuucaagcaguggagagugccugggaaggcguagauaggcggaaagcuaccgacgccaaggauccaucuguuauagaggaacccaacggcgagccuaauggggugacagucaccgcagaagcugugucccaggccagcucgcacccagagaacucugaggaagaggaauguaugggagcggccgcagcugugggucccgccaugugcggcgucgaguuggacucccugaucucacagguuaaagaucuccugccggaccuuggggaaggauuuauucuggcuuguuuggaguacuaucauuacgacccugaacaggugaucaauaacauacucgaggagcgucuggcccccacguuaagucaacuggaucgcaaucuagacagagaaaugaagccagauccuacuccccuccugacaagcaggcacaacguauuccagaaugacgaguuugauguguucucccgggacucugucgaucuuagccgagugcauaagggcaaaucaacccgcaaggaggaaaacacuagaaguuugcugaaugacaaaagggcaguugccgcucagcggcagcgcuaugagcaauacuccguggucguggaagagguaccacuccagcccggugaaagccugccuuaucacucuguuuacuaugaggaugaguacgacgauacauacgacgggaaccaggugggagcgaacgaugcagacucagacgaugaauuaauuaguagaaggccauuuaccaucccgcagguccugcguacgaaggugccccgggagggccaagaagaggacgaugacgaugaagaggacgaugccgacgaggaagcuccuaaaccagaucacuucguccaggaccccgccgugcuucgagagaaggcagaagccagaaggauggcuuucuuggccaagaaaggcuaucgccaugauagcuccaccgcaguugcggggucuccucggggacacggucagucgagagagacaacucaagaaaggcgcaagaaagaggcuaauaaggccacccgagcaaaccauaaucggcguacaauggccgacagaaaaaggagcaagggcaugaucccauccuga

SEQ ID NO: 53063 - RNA, 2196 nt, Artificial Sequence
  derived and/or modified sequence opt3 from ASCC3__Homo_sapiens__NP_001271200
auggcccugcccagacucaccggcgcucuuaggagcuucuccaacgugacaaagcaggacaauuacaacgaggaagucgcagaucugaaaaucaagcggucuaaauugcacgagcaaguuuuagaccuggggcuaacuuggaagaaaauuauaaaguuucucaaugaaaagcuggagaaaucaaagaugcagaguaucaacgaagaucuuaaagacauucugcaugccgcgaagcagaucgugggaacggauaauggucgcgaggcuauugagagcggcgccgcauucuuguuuaugaccuuccaccucaaagacuccguagggcauaaggaaacaaaggccaucaaacagauguuuggaccuuucccaucuucgucagcuacugcagccugcaacgcuaccaaucgaauaaucagccacuuuagucaagaugaccugacagcccuggugcagaugaccgagaaggaacauggcgaucgugucuucuuugguaaaaaccucgcguucuccuuugacaugcacgauuuagaccacuucgaugagcugccgauuaauggggagacucagaagacaaucucucuugacuauaaaaaguuuuugaacgaacaucugcaggaggcauguacccccgaacuaaaaccuguggagaagacgaauggcagcuuccucuggugcgaaguugagaaguaccugaacuccacucuuaaagagaugaccgaagugccaagagucgaggaccuguguugcacauuguaugauaugcucgccucaauuaagaguggagacgaacugcaagaugaguuauucgaacugcucggccccgaggggcuugagcugaucgaaaaauugcuacagaauaggauaacuauuguggaccgguuucugaacagcucuaaugaucaccgcuuccaggcucuccaggacaacuguaagaaaauccugggagagaacgccaagccuaauuacgguugccaaguaaccauucaguccgaacaggagaagcaacuuaugaaacaguauagaagggaagagaagcggaucgcacgccgagagaaaaaggcuggcgaagaucuggagguuucagaaggguugauguguuuugacccaaaagagcucagaauccagagggagcaggcccuguuaaacgcgcggagcgugcccauucugagucgucaacgcgaugccgacgucgaaaagauacauuacccucacguguaugauucucaggcagaggcuaugaagacauccgccuucaucgcuggagccaaaaugauucuaccagaaggcauccagagagagaauaacaagcucuacgaagaggugaggauaccguacagcgagcccaugccucugucguuugaagagaaaccagucuauauucaggaccuugacgaaaucggucaauuggcauucaaggggaugaaacggcugaaucgaauccagucuauuguuuuugagaccgccuacaacacgaaugaaaacaugcucaucugcgcucccacuggagcgggcaagacaaauauugcaaugcugaccgugcuucacgagauacgccagcauuuccagcaaggcguaaucaagaaaaacgaguuuaagauuguguaugucgccccuaugaaagcucuggccgcagaaaugacugauuacuucuccagaagguuggagccacucgggaucaucgugaaggaacugacaggagacaugcaguuaucaaaaagugagauucugcggacccagaugcuaguuacgacccccgaaaagugggauguggucacacgcaaaagcgugggugacguagcccucucccagauaguuagacugcuuaucuuggaugaggugcaucugcuccacgaggacaggggcccgguccuggaaucuauuguggcucguacuuuacggcaagucgagagcacccagucaaugauccgaauccuggggcuuagugccacauugccuaauuaucucgauguggcaacuuuucugcacguuaaccccuacauuggacuauucuuuuucgacggcagauucaggccagugccucugggucagaccuuucucgggauaaagugugcgaauaagaugcaacagcugaacaauauggaugaaguaugcuaugagaacguccuuaaacaggugaaggcuggccaucagguucacuuguucuaccuguuacuccaccuguuuaucuguuucuga

SEQ ID NO: 53064 - RNA, 711 nt, Artificial Sequence
  derived and/or modified sequence opt3 from ASCL1__Homo_sapiens__NP_004307
auggagagcuccgccaagauggaaucuggcggggcuggacagcaaccccagccucagccacagcaaccguuccugcccccugcagccugcuuuuucgcgaccgcugccgcagccgcugcagccgcugccgcggcagccgcucagucagcccagcagcaacagcagcagcaacagcagcaacagcaggcaccacagcucagacccgcugccgacggucaaccuaguggcgggggacacaaaagcgcgccaaaacaggugaagaggcagcgguccucuucgcccgagcuuaugcgcuguaagcgacgucugaacuuuucaggcuucgguuacagcuugccucagcaacagccagccgcagucgcuagaaggaaugaacgggagcgcaacagaguuaaauuagugaaucugggguuugccacacuaagggaacauguaccgaacggagcugccaauaagaagaugaguaaaguggagacucuccgguccgcagucgaguauauccgcgcccugcagcagcuucuggaugaacacgacgcugugucugcggcauuccaagccggcguuuugagccccacgauuuccccuaacuacucaaaugaucucaacaguauggcuggcagcccagugucuuccuauucaagcgacgaggggaguuacgauccccugucuccugaggaacaggagcugcucgacuuuaccaauugguucuga

SEQ ID NO: 53065 - RNA, 582 nt, Artificial Sequence
  derived and/or modified sequence opt3 from ASCL2__Homo_sapiens__NP_005161
auggacggcgggacccugcccagaagcgccccuccagcuccgcccgugccugucggaugcgcagccaggcggcgcccagcgucccccgagcuccuucgauguucucguagaaggcggccugcuacagccgaaacugguggcggggcagccgcuguugcacgcagaaacgagagggaacggaaucgcgugaagcugguaaacuugggauuccaggccuuacgacaacacgugccacauggcggugcuaguaaaaagcugucaaaagucgagacgcuaagaagcgccguggaauacaucagggcgcuccagcggcugcuugcagagcacgaugccguucguaaugcucuggccgggggauugcgcccccaggcagugagaccuuccgcuccaaggggcccgcccggcaccacaccugucgccgcgucuccaucgcgggccucaagcagucccgggcgaggagguuccucugagccuggcagcccacgcuccgcauauucaagugacgauagcgggugcgaaggagcucucucucccgccgagagagaacugcuggacuuuuccucauggcucggcgguuacuga

SEQ ID NO: 53066 - RNA, 522 nt, Artificial Sequence
  derived and/or modified sequence opt3 from ASCL4__Homo_sapiens__NP_982260
augauggagaccagaaagcccgccgaaaggcuggcucucccuuacagccuucggacagcaccacugggcgugccggggacuuugcccggauuaccucgccgagacccacugcgugucgcccuaagacucgaugcggcuugcugggagugggccagguccgguugugcacggggcuggcaguaucugcccguuccucuugacucugccuucgaaccagcuuuucugcgcaaaagaaacgagagggaacggcaacgcgugcgaugcguaaaugagggguacgcaagauugagggaucaccucccccgggagcuggccgacaagcgucugucaaaaguggaaacgcuccgcgcugccaucgauuauauuaagcauuuacaggagcugcuugaaagacaggcguggggauuggagggcgcagccggugcugucccucagaggcgggccgaguguaacagugacggggaaagcaaagcauccucugcuccaucgccgucaagcgagcccgaagagggaggcaguuga

SEQ ID NO: 53067 - RNA, 615 nt, Artificial Sequence
  derived and/or modified sequence opt3 from ASF1A__Homo_sapiens__NP_054753
auggccaaggugcaggucaacaauguugugguacuggacaaccccagcccuuucuacaauccauuucaauucgagaucaccuuugaaugcauugaggaucucuccgaagaccuugaguggaaaauaaucuaugugggcucugcugaaucagaggaguacgaucagguccuggacaguguguugguugggccggugcccgcaggaagacacauguucgucuuucaggccgaugcgccuaacccagguuuaauucccgacgcugaugccgugggcguaacaguugugcugaucacuuguacguauagggggcaggaguucauucgggucggauacuaugugaauaacgaauacaccgaaacagagcuacgcgagaauccuccagugaagcccgacuuuagcaaacuccaacgaaacauccuggcauccaauccucgugucacuagauuccauauaaacugggaagauaauaccgagaaacuugaagacgccgagucuucgaacccaaaucugcagucauugcucagcacagaugcucugccgagugcauccaagggcuggucuaccagcgaaaacucccugaauguuaugcucgagucacacauggacugcauguga

SEQ ID NO: 53068 - RNA, 609 nt, Artificial Sequence
  derived and/or modified sequence opt3 from ASF1B__Homo_sapiens__NP_060624
auggccaaggugagcguccugaacguugcugugcucgagaaucccuccccuuuccacucuccauuuagauucgaaaucucauuugagugcagugaagcacuugccgacgaucuggaguggaaaauuauauacguaggcagcgcggaauccgaggaguucgaccagaucuuggauucuguguuagucgggccggugcccgcuggaaggcauauguuuguuuuccaagccgacgcaccuaacccaucgcugauucccgaaaccgaugccgugggugucacagugguacuaaucacuuguacguaucacggccaggaguuuauucggguuggguacuaugugaauaacgaauaccucaauccugagcugcgcgagaacccacccaugaagccugacuucucacagcuucagcgaaauauccuggcuagcaacccacgugucaccagauuucauauaaauugggauaacaauauggacagguuggaagcaaucgagacacaagauccgagucucggaugcggccugccccugaacuguacuccuauuaaaggucucggguuaccaggaugcauccccggccugcuuccugaaaauuccauggacuguauuuga

SEQ ID NO: 53069 - RNA, 8895 nt, Artificial Sequence
  derived and/or modified sequence opt3 from ASH1L__Homo_sapiens__XP_006711513
auggauccccgaaacaccgccaugcugggacucgggagcgauuccgagggguucucuagaaagucaccuagugcuaucagcacagguacucuuguguccaaacgggaagucgagcuggaaaagaacacgaaagaggaagaggacuugcgcaagcgaaaccgugagagaaauauugaagcaggcaaagaugacggguuaaccgaugcccagcaacaguuuucuguuaaggagacaaacuucucggaaggaaaucugaagcuaaaaauaggccuccaggcgaagaggacuaaaaagccgccgaaaaaccuggagaauuacgugugccggcccgcuaucaagaccacaauuaagcacccucgcaaagcccuuaagucagguaaaaugaccgacgagaagaacgaacauuguccaagcaaaagagaucccaguaagcuguauaaaaaggccgacgauguagccgcuaucgagugccaguccgaagaggugauuagguugcacucucaaggggaaaauaacccucucagcaagaaacuguccccaguccauucagagauggcagacuacaucaaugccacucccaguacacugcucggaagccgggauccugacuuaaaggaucgcgcucugcuuaacggcggcaccucugugacggagaaauuggcccagcugauagcgacuuguccaccguccaagucaagcaaaaccaagcccaagaaacuagggacaggaacuaccgcaggucucguuaguaaggaccugauccgaaaagccggcguggggucugucgcuggaauuauccacaaggaccuuauuaaaaagccuacaaucuccaccgccgugggccugguaacgaaggauccagguaaaaagcccguuuuuaaugcagcugugggguuggucaacaaagacagcgugaagaaacucggaacuggcacaaccgccguguucauaaauaagaaccugggcaagaaaccugggacuauuacaaccgucggauuacugucgaaggauucugguaaaaagcucggcaucgggauuguuccaggacuugugcauaaagaauccggcaagaaacuggguuuggggacgguagugggccuagucaacaaggaccugggaaagaaacucggcucaaccguggggcugguugcgaaggauugcgccaaaaagaucguggcaaguagcgcuaugggacuugucaauaaagacaucgguaagaagcugauguccugucccuuggccggccucauuucuaaagaugcuauaaaccugaaggccgaggcauuacugccgacacaggaaccucuaaaagccagcugcucaacuaauaucaacaaucaggagagucaagaacucuccgagagccugaaggacucugcuaccucaaaaacauuugagaagaacgugguaagacagaauaaggaaaguauucuugagaaauucagcguuaggaaggaaaucauaaacuuggagaaagaaauguuuaaugaggggacuuguauucagcaggauuccuucucuucgagcgagaagggauccuaugaaaccucaaaacacgagaagcaacccccaguguacugcacaaguccugacuuuaagaugggcggugcgucugaugucagcaccgcaaaaucccccuucucagccgugggggaaagcaaccugccaucucccuccccuacugucagugugaauccacucacgcggagcccgcccgagacaucuucccagcuggcuccuaacccacuucuguugucaaguaccacugagcucaucgaagagaucagcgaaucgguuggcaagaaucaguuuaccuccgagucuacacaccugaacgugggacaucguagcguaggccacucaauuaguaucgaauguaaagggauugacaaggaggucaaugacuccaaaaccacucauauagauaucccccgcauuucuagcuccuuaggaaagaaaccuucacugacaagcgagaguucuauccacacgaucaccccauccgugguuaacuucacuagccuauuuucgaacaagcccuuccucaagcugggugccgugucagcaucugacaaacacugccaagucgccgaaagucuuuccacuagcuugcagucuaagccgcugaaaaagagaaaaggcaggaagccucgguggaccaaggugguagcucgaagcacaugucgcuccccaaaagggcucgagcuggaaagaucagaguuauucaagaaugugaguugcagcucucuguccaacucaaauagugaacccgccaaauuuaugaagaacauuggaccucccagcuucguugaucaugacuuucuuaaaaggcgguugccaaagcucuccaagucuacugcaccuucgcuggcgcuacuggcugauagcgagaaacccucacacaaguccuucgccacccauaaacucaguucuagcaugugcgucuccucagaccugcuuucugauauauauaagccaaaacgcggcagaccaaagagcaaggagaugccucaguuggaaggucccccaaaaaggacgcugaagauccccgcaaguaaaguguuuuccuuacagagcaaggaggaacaagagccuccaauucuccagcccgaaaucgagauuccuucuuucaaacaggggcugucaguguccccguuuccaaagaagcguggccggcccaaacgacagaugagaaguccugucaagaugaaaccacccguucuuagcguggccccuuucguggcuaccgagucgccgucuaagcuggaauccgagagcgacaaucacaggucaaguucugacuuuuucgaauccgaggaccaauugcaggaucccgacgaucucgacgacagccaucgcccaucaguauguaguaugagcgaucuggagauggaaccugacaaaaagaucacaaaacggaacaauggacagcuaaugaagacuauaaucagaaagauuaacaaaaugaagacccugaaaaggaagaaacuccugaaucagauccuuuccucuagcgucgaguccucaaacaagggcaaggugcaaucuaaauugcacaauacaguuaguucgcuggccgcaacuuuugggagcaaguuaggacagcagauuaacguguccaaaaagggcaccaucuacauagguaaacgccgagggcggaagcccaagacgguccucaauggcauucugucuggcucaccaacaagccuugcugugcuggaacagaccgcccaacaggcggccgguuccgcucuaggccagauccucccuccccuguugccaaguucugcaagcucauccgagauucugccgaguccuaucugcagccaaucuuccgggacuucaggaggccagagccccguuucgucugaugccggguucguggaaccaaguuccguacccuauuuacaccuccauagccgucagggaucaaugauacagacacuggcuaugaaaaaggccuccaaaggcagaaggcgccuuucuccuccaacccuguugcccaacagcccuagucaccucuccgagcugacuagccuaaaggaggcaaccccgucuccaaucucagaaagucauuccgacgagacaauucccagcgauucugguaucgggacggacaauaacucgaccucagaucgggcggaaaaauuuuguggacaaaagaagagaaggcacagcuucgagcacgucucccugauuccucccgaaacaaguacagugcuuucuagccucaaagagaagcauaaacacaagugcaaacgacgcaaccaugacuaccuguccuacgauaagaugaaacggcagaagagaaagaggaaaaagaaauauccacaguugcguaaucgccaggacccugauuucaucgccgagcuggaagaguuaauaucacggcucagugaaauuagaaucacccacaggucucaucacuuuaucccccgagaccugcuuccaacaauuuuccggaucaacuuuaauagcuucuacacucacccuuccuuuccgcuggaucccuugcauuauauucgcaagccagaccucaaaaagaagagaggcaggccucccaaaaugcgggaggcuauggccgaaaugccauucaugcacucacugagcuuuccucuaucuuccaccgguuucuaccccaguuauggcaugccguacagcccaucgccucugacggcagcucccauagggcuuggauauuacggccgauacccacccacacucuauccuccgcccccauccccuucuuuuaccacuccccugccuccacccucauacaugcaugccgggcacuuguuacugaacccugcaaaguaucauaaaaagaaacacaagcuccugagacaagaggccuuccuuaccacaagccgcacuccacuguugaguauguccaccuaccccucugugccgccugagauggcuuauggauggauggucgaacacaagcauaggcaccgucauaaacaccgggagcacagaagcucagaacagccacagguuuccauggacacaggcaguagcaggucugugcuagagucacugaagcgcuaccgauuugguaaagaugcgguaggggagagauauaagcauaaagaaaagcaccggugucauauguccugcccccaccucagcccuucuaagagucugaucaauagggaggaacagugggugcaucgcgagccaucggaauccagcccccuugccuuaggacugcaaacgccgcuccagauugacuguucagagucuagcccuuccuugagucugggcgguuucacccccaacucagagccagcaucuagcgaugaacacacuaaucucuuuacauccgcuaucggcaguugccgugucagcaacccuaauuccucugggaggaaaaagcugaccgacucacccggacuuuucagcgcccaggauacuucgcugaaccgguugcacaggaaagagucccuaccaaguaaugaacgcgccgugcaaacacuggcuggcucucagcccaccagcgacaagccuucacagcgaccauccgagucuacgaacuguaguccgacuagaaaacggagcuccucagaaagcaccucuaguacaguuaauggggugcccuccaggagcccucgccucgucgcaucaggagaugacucuguggauuccuuacugcagagaaugguucaaaacgaggaccaggagccaauggaaaagucgauugaugccgugaucgcgaccgcuagcgcacccccuaguucuuccccaggcaggagccauucaaaagaccggacucuugguaagcccgacagucugcucgucccugcaguaacauccgauagcugcaauaacucuauaucauugcugagcgagaagcucaccuccucuuguaguccgcaccauaucaaacguucggugguugaagccaugcagcgccaggcucgaaagaugugcaacuacgacaaaauucuggcaacaaagaaaaaucuugaucacgugaacaagauccuaaaggccaaaaagcugcaaagacaggcgaggacugggaauaacuucgucaaacggcgcccaggaagacccaggaagugcccuuugcaggcugugguaagcaugcaggccuuucaagcagcccaguucgugaaucccgaguuaaaccgggacgaagagggcgcugcccugcaccucuccccagauaccgucacggacguuauugaggcaguggugcagucagucaaucugaacccugaacauaaaaagggccuuaagcgaaaaggguggcugcucgaggaacagacaagaaagaaacaaaagcccuugccagaggaggaggaacaggaaaauaacaaaucuuuuaaugaggcuccgguggaaaucccuagccccagugagaccccagccaagcccuccgagccugaaucaacucugcagccaguucuaucucugauaccccgcgagaagaaaccuccgaggccacccaagaaaaaguaccaaaaagcgggacucuauagcgauguauacaagaccacagacccuaagucccggcuuauucagcugaaaaaggaaaaauuagaguauacuccaggugaacacgaguacggcuuguuccccgccccuauccauguggggaaguaucugcgucagaaaagaaucgauuuucagcuccccuacgacauucuguggcaauggaagcacaaccagcuuuauaaaaagccagaugucccgcuguacaagaaaauaaggaguaauguguacguugacgugaagccucucagcggauaugaggcaaccacguguaacugcaaaaagcccgaugacgacacacgcaaaggcugugucgaugacugcuugaaucggaugaucuucgcugaauguucuccaaauaccugcccuuguggugagcagugcuguaaucagaggauucaaagacaugaaugggugcagugccuggagagauuucgcgccgaagagaagggguggggaauccggacuaaggagcccuuaaaagcuggccaguucauuaucgaauaccuaggcgagguagucucagaacaggaguuuagaaaccguaugauagagcaauaucacaaccacuccgaucauuacugucugaaucucgacagcgggauggugaucgauaguuauaggaugggaaacgaagcacgguucauuaaucacucuugcgacccaaacugcgagaugcagaagugguccguuaaugguguguaccgcaucggccuuuaugcccugaaagauaugccugccgggacagaauugaccuacgacuacaacuuucauucguucaaugucgagaagcagcaacuguguaaaugcggauucgaaaagugucgaggcauuaucgguggaaagagccagagagugaacggacucacuucauccaaaaauucucagcccauggcuacacacaagaaaaguggcaggagcaaggagaaacggaagucaaagcacaaacugaagaaacgcagaggccaucuuuccgaggaaccgagcgagaacauaaauaccccaacgaggcucacuccucagcugcaaaugaagcccaugucuaaccgagaacggaauuuuguuuugaaacaccauguguuccugguccguaacugggagaagauuagacagaaacaggaagaggugaagcacaccagugauaauauccauuccgcgagcuuauauacacgcuggaacgggaucugcagggacgauggaaacauuaagucagacguauuuaugacccaguucucugcacuacaaacagcccggucggugagaacucgcaggcuggcugccgcagaggaaaauaucgagguugcccgagcugcgcggcucgcccagauauuuaaagaaauuugugaugguaucauuagcuacaaggacuccaguagacaggcacuugcugccccacuguugaaccugcccccuaaaaagaaaaaugcagacuauuacgagaagaucucugauccgcucgaccugauaaccauugaaaagcagauccuuacgggcuauuacaaaacagucgaggccuucgaugcugacauguuaaagguguuuaggaacgccgagaaauauuacgggcgcaagucaccagugggacgugaugucugccggcugagaaaagcguacuauaaugcaaggcacgaagccagcgcucaaaucgacgagauuguaggcgaaacugccuccgaggcugauaguucugagaccagcguguccgaaaaggagaacggucacgaaaaggacgaugacguuauccgcuguauuugcgggcucuacaaagaugagggauugaugauacagugugacaagugcaugguguggcagcauugugacugcaugggcgucaauucagauguggaacacuaucugugcgagcagugugacccccgaccuguugaucgggaggugcccaugaucccaagaccucauuacgcacaacccggcugcgucuauuucauuugucuacugagggacgaucuccuucugcgccagggggacugcguguacuugaugagagauagccggaggacaccagacggacacccuguacgucagucuuaucgacugcucucccauaucaaccgcgauaaacuggacaucuuuagaauugaaaaguuauggaaaaaugagaaggaggaacgguucgccuuuggucaccacuacuucaggccgcaugaaacccaccauagucccucacgcagauuuuaccacaacgagcuuuuccgggugccacuguaugagauaaucccucucgaagcuguugucggcacuuguugcgugcuagaucuguacaccuauuguaaggggaggcccaaaggagugaaggagcaagacgucuacauuugcgauuaucgauuggacaaaagcgcccaccuguucuacaagauccaucguaauagauauccaguuuguacaaaaccuuacgcauuugaccacuuccccaagaaacucacgccgaagaaggauuuuucgccacauuacgugccugacaacuauaaacgcaauggcggucgguccucuuggaagagugaaaggagcaaacccccacuuaaggaucuggggcaggaggacgaugcguugccccugauugaagagguacucgccucacaggagcaggcugccaacgaaaucccuuccuuagaggaacccgagagagagggagcaacugcuaaugugucugaaggcgagaaaaagaccgaagagagcagucaagaaccacaguccacaugcaccccugaggagcgccggcacaaccagagggaacgacugaaccagauacuucugaaucuacucgagaagaucccgggcaaaaacgccauugacgucacuuaccuguuggaagaggggagcggaagaaagcugcggaggcgcacacucuucauccccgaaaauucuuuucguaaauga

SEQ ID NO: 53070 - RNA, 1605 nt, Artificial Sequence
  derived and/or modified sequence opt3 from ASH2L__Homo_sapiens__NP_001098684
auggacacccaggccggcagcguggaugaggaaaacgggagacaacugggagaggucgaacuccagugcgguaucuguacaaagugguucacugcugacacguuuggcauugauaccuccucuugccuucccuucaugacaaauuacucauuucacuguaacguuugccaucacagugggaauacuuauuuccugaggaaacaggcaaacuugaaggagauguguuuaagcgcccuggcgaaucuaaccuggcagucccggacacaagacgaacauccuaaaaccauguuuucuaaggauaaagacauaaucccauucauugauaaguacugggagugcaugacuacacgccagcgaccgggaaagaugaccuggcccaacaauaucgugaaaacgaugucgaaggagcgugacguauuucucgugaaagaacacccugauccaggcucaaaggaccccgaggaagauuauccuaaauucggucugcuugaccaggaucugagcaacauugggccagcuuacgacaaucagaagcaaaguuccgccgucucuacuagcggaaacuugaauggcggcaucgcagccggguccucaggaaaggguagaggcgcuaaaaggaagcagcaggacgggggaaccacaggcacuaccaaaaaggcacggagugauccccucuuuagcgcccagcgccugccuccacaugguuauccgcuggagcaccccuucaacaaagacggguacagauauauacucgcugagccugauccacacgcccccgacccugaaaaguuagagcuggauuguugggcgggaaaaccaauccccggcgaccuuuacagggcaugcuuguacgaacgggugcugcuagcccuccaugaucgcgcuccgcaacugaagauuucugacgaucgacuuacaguugugggcgagaagggguauuccauggucagagccucacacggagugaggaaaggugcaugguacuuugaaaucaccguagacgagaugccucccgauacggcugcccggcugggcuggagccagccauuggggaaucuccaggcgccucugggauaugacaaguucaguuacucuuggcguuccaaaaagggcacuaaauuucaucaaagcauugguaagcacuauucgucuggguacggccagggagacguuuuaggcuucuauaucaaccugcccgaggauacagaaaccgccaagucccucccagacacuuacaaagauaaggcacuuauaaaauucaagucauaccuguauuuugaggaaaaagacuucguggauaaggcugagaagaguuugaaacagacaccccacagcgaaauuaucuuuuacaagaauggggucaaccagggaguggccuauaaagacauuuucgaggguguguacuuuccugcuaucucccuauauaagucuuguaccgucagcaucaacuucggcccaugcuuuaaauacccgcccaaggaucugacguaucgcccuaugucagacaugggguggggagccguuguggagcauacccucgcagauguacuguaccacguggaaacagaggucgacggcagaaggaguccacccugggaaccuuga

SEQ ID NO: 53071 - RNA, 1587 nt, Artificial Sequence
  derived and/or modified sequence opt3 from ASIC1__Homo_sapiens__NP_001086
auggagcugaaggccgaagaggaagaggugggcgggguccagcccguuagcauccaggcuuucgcauccucuucaacccuccacggacuugcccauauuuuuaguuacgaaagacugagcuugaaaagggcguuaugggcucugugcuuccuagguucccucgccgugcugcuuuguguaugcacagagcgggugcaguauuacuuucacuaucaucacgucacuaagcuggacgagguggcagccucucaguugacguucccugcuguuacccucuguaaccugaaugaauuucgcuucucgcaagugagcaaaaacgaucuguaccaugcaggcgagcucuuagcccugcuuaauaaccgauaugaaauaccagacacacaaauggcugaugagaagcaguuggagauccugcaggacaaagccaauuuucguagcuucaagccgaagcccuuuaacaugagagaguucuacgauagggcggggcacgacauucgggauaugcuacucaguugccacuuucgcggagaagucuguuccgcagaagacuucaaagugguauuuacuagauauggcaagugcuacaccuucaauucugguagggaugggcggccucgccugaaaacaaugaagggaggcaccggcaacgggcuugagaucaugcuggacauucagcaagaugaauacuugccaguuuggggagagacugacgagacaucauucgaagccgguaucaaagugcagauacauucccaggaugagcccccuuuuaucgaccagcucggcuucggggucgcuccaggauuucaaaccuucguggccugucaggaacagcgacugauuuauuuacccccuccauggggcacgugcaaggcagugacuauggacucagaucuggacuuuuucgauaguuacagcaucaccgcuuguagaauugacugcgagacaagguaucucgucgaaaauuguaacugccggaugguucacaugccgggugaugcccccuacugcacuccugagcaauauaaggagugugcggacccagcccuugauuuucugguggaaaaagaccaggaguacugcguaugugaaaugcccugcaauuugacccguuaugggaaggagcuaucuauggugaaaaucccuuccaaggcaucagcuaaauaccuggccaagaaauucaacaagagcgaacaguacauaggagagaauauucucguccuggauaucuuuuucgaggugcuuaacuaugaaacaauugagcagaagaaggcuuacgaaaucgccggccuguugggcgacaucgggggacaaaugggucucuuuauuggcgcaaguauacugaccguuuuagagcuguucgauuaugccuacgaggugaucaaacauaaacuaugucgcagagggaagugccagaaagaagcuaagaggucuuccgcggacaagggagucgcacucagccuggacgaugugaaacggcacaauccaugugagucgcuucgaggccaccccgccgguaugacguaugcugccaacauuuugccgcaucacccugcacgcgggacuuuugaagacuucacaugcuga

SEQ ID NO: 53072 - RNA, 1539 nt, Artificial Sequence
  derived and/or modified sequence opt3 from ASIC2__Homo_sapiens__NP_001085
auggaccugaaggagagccccuccgaaggcucucuccagccuucaaguauccaaauuuucgccaacaccagcacacuucacgggauaagacauaucuuuguguacggaccacugacuauuaggcgggucuugugggcuguugcauucguggguuccuuaggccugcuacucguagagucuucggaacgcgugucauauuacuuuagcuaucagcacgucacgaaaguggaugagguuguggcccagagucuggucuucccggcggugacccuuugcaaucugaacggguuucgauucucccguuugacaacuaaugaccucuaccaugcuggagaacugcuggcccucuuagauguaaaccugcagauccccgacccucaccuugcagauccaucuguuuuggaggcccugagacaaaaggcuaauuuuaaacauuauaagcccaaacaguucagcaugcuagaguuucuccacagggugggccacgaccugaaggauaugaugcuuuacuguaaguucaaaggucaggaaugcgggcaucaggacuuuaccacagucuucaccaaguauggaaaauguuacauguuuaacuccggcgaggauggcaagccucuguugacuacagugaaagggggaaccgguaauggccucgaaauuaugcuggacauccaacaggaugaguacuuaccaauauggggagagacggaagagacuaccuucgaagcaggggugaagguccagauccacucacagagugagcccccuuucauucaagaacugggcuuugguguugccccaggguuccagacauuuguggcuacucaggagcaacggcucaccuaucuuccgcccccuuggggagagugccgcagcucugaaaugggccuggacuucuuuccaguauacuccaucacagccuguagaauugauugcgagaccagguauaucguggaaaacuguaauugccggaugguccauaugcccggcgacgcgccuuucuguacgccagagcagcacaaggaaugcgcagagcccgccuuggggcuacuggcugagaaagacucaaacuacugucucugccgcacuccgugcaaucugacacgauauaacaaggaacuuagcauggugaaaauaccuaguaagaccucugccaaauaccuggagaagaaauuuaauaaguccgaaaaguauauuagcgagaacaucuugguucucgauauuuucuuugaagcacugaauuacgagacuaucgagcagaaaaaggcuuacgaaguggccgcguuacugggagacaucgguggccagauggggcuauucauuggagccucgauacucacaauccuggagcuuuuugauuauauuuacgaauugaucaaagagaagcugcucgaccugcuuggcaaagaggaagaugaggguucucacgacgaaaacgucuccaccugugauacgaugcccaaccauucagagaccauaagucacacagugaauguaccacugcaaacuaccuuggggacacucgaagagauugcaugcuga

SEQ ID NO: 53073 - RNA, 1596 nt, Artificial Sequence
  derived and/or modified sequence opt3 from ASIC3__Homo_sapiens__NP_004760
augaagcccaccagcggcccugaggaagccagaaggccagcuuccgacauccggguguucgcaucuaacugcucaaugcacgggcugggacaugucuuugguccgggcagucucagccuucgccgagggaugugggccgcggcuguugugcuguccguagccacauucuuguaccagguggcagagcgugucagauauuacagggaauuucaccaucaaacugccuuagaugagcgggaaucucaccgccugauuuuccccgcugugacgcuauguaauauaaacccucucagaaggucgcggcugaccccaaaugaccuucauugggcaggaucagcccuguugggccucgaucccgcugagcacgccgcguuucugcgcgcacugggucgaccuccagcucccccuggguucaugccaagcccgacauuugacauggcucagcucuaugccagagcaggacacaguuuagaugacaugcugcuugauugcagguuccggggccagcccuguggcccugagaacuuuacuaccaucuucacacguauggggaaaugcuacaccuuuaauuccggagcugacggugccgaauugcugacuacaacccgcggcgggaugggaaacggccuagauauuaugcucgacguucagcaagaggaauaucugccaguguggagagauaaugaggagacgcccuucgaagucgguaucagggugcagauucauucucaggaggaaccuccaaucauagaccagcuugggcugggaguaagccccggcuaccaaacuuuuguuuccugucagcagcagcaauugucauuccucccgccucccuggggcgauugcaguagcgcgucucugaacccaaauuaugagccugaacccuccgacccauuagggucacccagcccuaguccaucuccgcccuacacccugaugggaugucggcucgccugcgagacacgauacguggcacgcaagugugguugcagaauggucuauaugccuggcgacgugccaguguguagcccccagcaguacaaaaacugcgcucacccugccaucgaugcuaugcuuaggaaggacuccugcgccuguccaaaucccugcgcaucgacucgguaugccaaagagcugucuaugguccgcauuccguccagagcugcggcaagguucuuggcccguaagcuaaaccggucagaagccuacaucgccgagaauguucuggcacucgauaucuuuuucgaagcccugaacuaugagaccguggaacaaaagaaggcuuacgagaugagugagcuucugggggacauuggaggccagauggguuuguuuauaggggccagccuccugacaauuuuagaaauccuggauuaucuaugugagguauuccgagacaaagugcucggcuacuuuuggaauagacagcauucccagaggcacucuagcaccaaccugcuucaagaaggauugggcucacaccgcacgcaggucccucaucugagucucgggccacggcccccuacucccccaugcgcagugacaaaaacccuguccgcgagccacagaacuuguuaccuuguuacacagcuguga

SEQ ID NO: 53074 - RNA, 1944 nt, Artificial Sequence
  derived and/or modified sequence opt3 from ASIC4__Homo_sapiens__NP_878267
augcugagcggcgccgcuggggcagccagaaggggaggugcggcucucgccccgucccuuacccggucucuggcaggcacacacgccggggcugacucaugcgcaggagccgauaagggcagucauaaagagacuaucgaagaacgcgacaagcgacagcaacgucagcagagacagaggcaacaccaggguuguggggcugccggaagcggcuccgauucuccuacgucgggcccacauccggugcccgucuuguucccuuuagcgcugucacuagaggagcagccacugcccccucugccacuugggcgggcacccggacuguuggcccgcgaaggucagggcagagaggcucucgccagcccuaguuccagggggcaaaugccaauugagauaguuugcaaaaucaaguuugcagaagaggacgcuaaaccgaaggaaaaggaggccggagaugagcagucucugcugggcgcgguggcccccggugcagcuccucgggaccucgccaccuucgcuagcacauccacuuuacacgggcugggacgcgccuguggcccaggcccccaugggcuucgaagaaccuugugggcacuggcccuacucacaucacuggcugcguuucuuuaccaggcagccggacuggcuagggguuauuugacccggccucaccucguagccauggauccagcagcccccgcuccgguggccggcuucccugcagucacucugugcaacauuaaucguuuucgccacagugcguuaagcgacgcugauaucuuccaucuggccaaccucacagggcuucccccaaaagacagagauggacacagggcagccggccugcgguacccugaacccgacaugguggauauuuugaaucgaaccggucaucagcuagcugacaugcugaagucuuguaacuuuuccgggcaccacugcucagccagcaauuucaguguuguguauacgcgcuacggcaaauguuauacuuuuaacgcagacccaagaucuucccuccccagcagggcuggaggcauggggucgggacuggagaucaugcuugauauacaacaggaagaguaccugccuaucuggcgggaaaccaaugagacaucuuucgaggccgguauucgcguccagauccauucccaagaggagccaccguauauucaccaguugggcuuuggggugucacccggauuccagacuuuuguaaguugccaggaacaaagacucaccuaccugccucagccauggggcaacuguagggcggagagcgaauuacgugagcccgagcugcaggguuacuccgccuauucuguuagcgcuugccggcuacgaugugaaaaggaggcagugcuccagagaugccauugcaggaugguccacaugccugacucacucgggggcggaccagaaggccccuguuucugcccgacaccuuguaaucuuacccgcuacgggaaagagaucaguauggugcggauaccaaacagaggauccgccagguauuuggcucgcaaguacaaucgaaacgaaacguauauucgggagaauuuccuggugcucgaugucuuuuucgaggcccugacuagcgaagcaauggagcaacgugcggccuacggucuuucugcucuguugggcgaccucgggggacagaugggccuguuuaucggugccucaauuuuaacacugcuagaaauccucgauuauaucuacgagguuaguugggacagacugaagaggguguggcgccggcccaaaaccccucuuagaacuagcacagggggcauuuccaccuugggacugcaggagcucaaggaacagucucccugcccaucgaggggccgaguagaagggggaggcgugagcucccuguuaccuaaccaucaccacccccaugguccacccgggggacuguucgaagauuuugcauguuga

SEQ ID NO: 53075 - RNA, 1518 nt, Artificial Sequence
  derived and/or modified sequence opt3 from ASIC5__Homo_sapiens__NP_059115
auggagcagaccgaaaagagcaaaguguacgccgagaacggccugcucgaaaagaucaaacuuugccuguccaagaaacccuugccuucuccaacagagagaaagaaguucgaccacgauuuugcuauuucaacgaguuuccaugggauacacaauaucguccaaaacaggagcaaaauucggcgcguuuuauggcuggugguagugcuaggauccgucucucucgugacuuggcagaucuauauucgacugcuuaauuacuuuaccuggccgacaacuaccucgaucgaaguucaguauguggagaagauggaguuccccgcagucacauuuuguaaccugaaucguuuccagaccgacgccguggcgaaauuugguguaauauucuuuuuguggcauaucguuucaaaggugcuccaucugcaagaaauuacugcuaacagcacaggcaguagagaggccaccgauuucgcagccucccaccagaauuuuucuaucgucgaauuuauuaggaacaaaggguucuaccugaauaacagcacgcucuuagacugcgaguucuucggaaagccuuguuccccaaaggauuuugcucacguguucacugaguauggcaauugcuuuaccuucaaccacggugaaacacugcaggcaaaacggaaggugucagucagugggcgcggacuuagcuugcuguuuaauguuaaccaggaggccuucacugacaaucccgcucuaggcuuuguggaugccggcaucauauucguaauucauucuccuaaaaaggugccacaauuugacgggcucggacugcuuucccccgucgguaugcacgcgagagugaccaucaggcagguuaaaacagugcaucaggaauacccuuggggcgaguguaacccaaacauuaagcugcagaauuucucaagcuauaguaccucugggugcuugaaagaauguaaggcacaacacaucaagaaacagugcggaugugucccguuucuccugcccggcuacgguaucgagugcgauuuacagaaguacuucuccugugugagcccuguacuggaccacauugaguuuaaagaucucugcacgguugggacucauaacucgucuugcccaguguccugugaagagauagaauaucccgccacaaucucauacaguagcuucccuucccaaaaggcucuuaaauaucugucuaagaaguugaaucagagccggaaauacauucgcgagaaccuagucaagaucgaaauaaauuauucagaccugaacuacaaaauuacccagcagcaaaaggccgugagugucuccgagcuccuggcagaucuuggaggccagcugggcuuguucugcggggcuagccucaucacuaucauugagaucauugaauaucuguuuacaaauuucuacuggauauguaucuuuuucuuacugaaaauuucugagaugacccaguggacgccacccccgcagaaccaccuaggaaauaagaaccgaaucgaagagugcuga

SEQ ID NO: 53076 - RNA, 411 nt, Artificial Sequence
  derived and/or modified sequence opt3 from ASIP__Homo_sapiens__XP_005260469
augcccccuggcauggacgugaccagacugcuccuugccacacuguuggucuucuuaugcuuuuucacugcuaacagccaccuaccaccggaggaaaagcugagggaugaccggucccuccgcucuaauucaaguguuaaccugcuugaugugcccagcguauccaucguggcacugaauaaaaagucuaaacagauugggcgaaaggccgcggagaaaaagcguucgucaaagaaagaagcuagcaugaagaaagucgugagaccuaggacgccauugagugcccccuguguugcaacccggaacuccugcaagccuccagcccccgcuuguugcgacccuugugcaucuugccaaugucgcuuuuucagaagcgccugcuccuguagggugcucucacugaauugcuga

SEQ ID NO: 53077 - RNA, 1395 nt, Artificial Sequence
  derived and/or modified sequence opt3 from ASL__Homo_sapiens__NP_000039
auggccagcgaguccggcaagcuguggggagggagauucgugggugcugucgaccccaucauggaaaaauuuaacgcaucuauugccuacgauaggcaccucugggagguugacgugcagggcucaaaggcguauagucgggggcuugaaaaagcuggacuguugaccaaggccgagauggaucaaauauuacauggccuggacaaaguagcagaagagugggcccaggguacauucaagcuaaauagcaacgaugaggacauccacacugcuaaugaacgccgacucaaggagcugauuggggcaacggccggaaaacuucauaccggccguuccagaaacgaucagguggucacagaccugagguuguggaugcggcagacuugcucuacccucucgggccugcugugggaacucauccgcacaaugguggauagagcugaggccgagagggacguuuuauuuccuggguacacccaucugcaacgggcgcagccaauucgcuggucacacuggauccuuagccacgcaguggccuugacucgagauagugaaagacugcuagaggucaggaagcggauaaaugugcucccgcugggauccggugcuaucgccggcaacccccuugggguagaccgugaacuguugcgcgcagagcucaauuucggagcuauuacacugaacucuauggaugccaccagcgaaagagacuuuguugcggaguucuuauuuugggccucccuguguaugacgcaccucucaaggauggcagaggaccuuauccuguauugcacuaaagaguucaguuuugugcaguugagcgaugcuuacucuaccggcuccucacuaaugccucagaagaaaaauccagacagccuggaacucauucggaguaaggccggucgagucuucgggcgcugugcuggacugcuuaugacacugaagggcuugcccucuacuuauaacaaagaucuccaagaagacaaggaggccguguuugaaguguccgauaccaugagcgcaguccugcagguugccacaggcgugaucucgaccuuacagauacaucaggagaauauggggcaagcucugucuccugacaugcuagcgacggaucucgcauacuaucugguaagaaaaggaaugccauucaggcaggcccacgaggcuuccgguaaggccguguuuauggcagaaacuaaaggcgucgcccuuaaccaguugucacugcaagagcuccagacaauuaguccccuguucagcggggacgugaucugcguuugggauuacggacauuccguggaacaguacggcgcucuuggugggaccgcccggucuagcgucgacuggcagauucgccaagugagagcacuguugcaggcgcagcaggcuuga

SEQ ID NO: 53078 - RNA, 897 nt, Artificial Sequence
  derived and/or modified sequence opt3 from ASMT__Homo_sapiens__NP_001164510
augggcagcuccgaggaccaggccuacagacugcucaacgauuaugcuaauggguucauggugucucaaguccuuuuugcagccugcgaacugggaguuuucgacuuguuagcggaggcucccgguccucuggauguggccgcaguagccgcuggcgugagggcaucagcccacgggaccgaacuacuccuggacaucugugucagucuuaagcuguugaaaguggagacacggggaggcaaggcuuuuuaccgcaacacugaacucagcuccgauuaucugacgaccguuucuccaacaucgcagugcucaaugcugaaauacaugggucgaacuagcuaucguuguugggggcaucucgccgacgcggugagagagggaaggaaucaguacuuagagaccuucggcgucccggcagaagaguuguuuacagccauuuaucggagugaaggcgagcgccuucaguucaugcaagcucugcaggaggugugguccguaaacgggagaucuguucugaccgccuuugaucuaagcguguucccccucaugugcgaccugggaggugacuuuuucaaggauccucuuccagaagcagaucuguacauauuggcuaggguccuccacgacugggccgauggcaaauguucccaucuguuagagcggaucuaccacacuugcaagcccgggggaggcauucuggugaucgaaucacuccuugacgaggaccgccgagguccucuguugacacagcuauauagucugaauaugcucgugcagaccgaagggcaagagagaacgccaacucauuaccacaugcugcuuagcucugcgggauuuagggauuuccaguuuaagaaaaccggcgccauuuaugacgcaauccuggcucggaaguga

SEQ ID NO: 53079 - RNA, 1818 nt, Artificial Sequence
  derived and/or modified sequence opt3 from ASMTL__Homo_sapiens__NP_001166945
auggugcugugccccgucaucggcaagcuccuucacaaaagaguugugcuggccagcgcuuccccuaggcggcaggagauuuugucuaacgcaggguuacgcuucgaaguagugccaucaaaguuuaaagagaagcuggacaaagccaguuucgcgaccccguacggauaugcuauggaaacagccaagcaaaaggcacuagaggucgccaaucgacucuaccagacuguggguggccugauacuugaaaaacccguugauaagcaggacgcuuaucguaugcugagcagauuguccgggagggagcauucuguguuuacgggagucgcaaucgugcacuguucgucaaaagaucaucagcucgacacccggguaagcgaguucuacgaagagacaaagguuaaauuuagugaacuguccgaggagcugcucugggaauaugugcacucuggcgagccuauggauaaggccgguggguacgggauucaggcuuuaggcggcaugcuggucgaaagcgugcauggggacuuccuuaacguggucggauuuccauugaaucacuucugcaagcaacugguuaaacuauauuaucccccucgcccagaggaucucagaagguccgugaagcacgacucaauccccgccgcggauacuuuugaagaccugagugauguagaggguggcgggagcgagccuacccagcgggacgcaggaucucgcgaugaaaaagccgaggcuggcgaagccggucaggcaacagcugaggccgaaugucaucgaaccagagagacucuuccaccguuccccacaaggcuguuggagcucauugaaggguuuaugcuguccaagggauuacugaccgcgugcaaacucaagguguucgaccuucugaaagacgaggccccucaaaaggcagcugauaucgccucaaaggucgacgcuagcgccuguggcauggaacgguugcuagauauaugcgcagccaugggccugcucgagaaaacggaacagggguacaguaacacugagaccgcuaauguguaccuggcgucugacggagaguacucccuucacgguuuuaucaugcauaacaaugaucugacauggaacuuguucacuuaucucgaguucgcaauucgugaaggcaccaaucagcaccaccgcgcccuggggaagaaagcugaagacuuauuucaggaugccuacuaucaaagcccagagacaagacugagguucaugcgggcaaugcauggaaugaccaagcuaacggccugucagguugcuacugccuuuaaccucucgcgauucucuuccgcaugcgacgugggcgguuguacaggggcgcuggcucgcgagcuugccagagaauaccccaggaugcaggucaccguguuugauuugccugacaucauugagcuggcagcccacuuccaaccacccggcccgcaggcuguacagauccauuuugccgcaggagauuucuuucgggacccucuccccucagcugaacuguauguucuuugccgcauacugcacgacuggccagaugacaaagugcauaaguugcucaguagagucgccgagagcuguaagccuggcgcggggcuguuacugguggaaacucuacucgaugaggagaaaagggucgcccagcgugcucugaugcaaucccuuaauauguuggugcagacagaaggaaaggagcggucucugggugaauaccagugccuccuggaguuacacggcuuccaccagguucaagugguacaucugggaggaguccuugacgcaauuuuggccaccaaaguggcucccuga

SEQ ID NO: 53080 - RNA, 1047 nt, Artificial Sequence
  derived and/or modified sequence opt3 from ASNA1__Homo_sapiens__NP_004308
auggccgcuggcguggcaggguggggagucgaggccgaagaguucgaagacgcgcccgauguugagccucuggaaccaacccucagcaacaucauugagcagagaucccuuaaguggauauuuguggguggcaaagggggaguaggcaagacaacuugcucuuguucacuggcugugcaauugaguaaagguagggagagcgucuuaaucauuuccacggacccggcccacaauaucucugaugcauucgaccagaaguuuucgaaagugcccaccaagguuaagggguacgauaaccuguucgccauggaaauugacccuucacuaggaguggcugagcucccagaugaauuuuucgaggaggacaauaugcugagcaugggcaaaaagaugaugcaggaagcaaugagugccuuucccggcaucgaugaggcuauguccuaugccgaagucaugcggcuugugaaagggaugaacuucucuguaguuguguuugacacagcgccuacuggacauacccugcgcuugcucaauuucccaacaauagucgagcgaggucugggccgucugaugcagaucaagaaccaaauuagccccuuuaucucccagaugugcaauaugcucggguuaggagauaugaacgcagaccagcuggccucaaaacuugaagagaccuugccugugauuagaagugugagcgagcaguucaaggauccagaacaaacuacauuuaucugugucugcauagcugaguuccugucucuauacgaaaccgagaggcucauucaggaacuggccaaguguaaaaucgacacgcacaauauuaucguuaaccagcuuguguucccggaccccgagaagccuugcaaaaugugugaggcacggcauaagauccaggcuaaauaucuggaucaaauggaagacuuguacgaggauuuucacauuguaaagcucccacuguuaccccaugaagugcgcggcgccgacaaagucaauacuuucuccgcgcugcuccuugagccuuauaagccacccucagcccaguga

SEQ ID NO: 53081 - RNA, 1623 nt, Artificial Sequence
  derived and/or modified sequence opt3 from ASNS__Homo_sapiens__NP_001171546
augaaaaucgcccacagaggacccgacgcuuucagguuugagaacgugaauggguacaccaacugcuguuucggauuucaucggcuggcagucguugauccucucuucgguaugcagccaauucgcgugaaaaaguauccguaccuuuggcugugcuauaauggcgaaauauacaaccacaaaaagaugcaacagcauuuugaguucgaauaucagacaaaaguagacggggagaucauuuugcacuuauacgauaagggaggcaucgaacagacuauuuguaugcuggacgguguguuugccuucguccuacucgauacggcgaauaagaaaguguuucuggggcgagacaccuauggaguucguccccuuuucaaggcuaugacagaggauggcuuucuggccgugugcagcgaggcaaaaggcuuggucacucucaagcauuccgccaccccuuuccugaaaguggaaccauuucugcccgggcacuacgagguacucgacuuaaagccuaacggaaagguugcuucuguggaaauggucaaauaccaccauuguagagaugugccacugcacgcacuuuaugacaauguggagaaguuguuccccgguuucgagaucgaaacagucaaaaacaaucugaggauacuauuuaacaaugccguuaagaaacggcucaugaccgaucgcagaaucggcugccugcuuucagggggacuggacaguagcuugguggcugccacucuccugaagcaauuaaaagaggcgcagguacaguacccucugcagacauucgcaauuggcauggaagauuccccagaccuccuugccgcuaggaagguggccgaccauaucgguucugagcacuaugaaguccuguuuaacucggaggaggggauucaagcauuggaugaagugaucuucucacuagagaccuacgacauaacgacuguucgggcuagcgugggaauguaucugauuaguaaguacauccgcaaaaauaccgauuccgucgugaucuuuucuggcgaaggcagcgacgagcucacacagggguauauuuacuuccacaaggccccgucccccgaaaaagcggaggaggaaucagagcgacugcuuagagaacuguacuuguuugauguacucagggccgaccggacuaccgcagcucauggacuggaguuacguguuccuuuccuggaucaccgcuuuaguagcuauuaccuaucucucccacccgaaaugagaaucccuaagaacgguauugagaaacaucugcuuagggagacauucgaagacuccaauuugauaccaaaggagauccuguggcggcccaaggaagccuuuucagauggcauuaccagcgugaaaaacaguugguucaagauccuccaggaguaugucgagcaccagguggacgaugcuaugauggccaacgcagcccaaaaauuuccguucaauacgccuaagacuaaagaaggguacuauuaccgacaggucuucgagcgccauuaucccggcagagcugacuggcugucucacuacuggaugccaaaguggauaaacgcgacagacccuuccgcaaggacccuuacucacuacaagagcgccgugaaggcuuga

SEQ ID NO: 53082 - RNA, 942 nt, Artificial Sequence
  derived and/or modified sequence opt3 from ASPA__Homo_sapiens__XP_006721590
augaccagcugccacaucgccgaggaacauauucagaagguggcuauauucggcgggacacacggaaacgagcugacuggugucuuucucguuaaacauuggcuugaaaauggcgcagagauccaaagaacggggcuggaagugaagcccuucauuaccaacccuagggccgugaaaaaguguacacgguacaucgacugcgauuugaaucgcauuuuugacuuagagaaccugggcaaaaagauguccgaggaucuaccauaugaaguacgacgugcgcaggagaucaaucaccucuucggaccgaaggacucugaagauucauacgacauaaucuuugaucugcauaacacuaccaguaauauggguuguacacuuauucuggaggacagcagaaacaauuucuugauccagauguuucacuauauuaaaaccucccucgcuccccugccuugcuacgucuaucugaucgagcacccaucucucaaguacgccacuacaaggucgauagcaaaauaucccguggggauugaaguuggaccucagccacaaggcguguuacgggccgauauccuggaccagaugcgcaagaugauuaaacaugcucuugauuucauccaccauuuuaacgagggcaaggaauuucccccuugugcaaucgaggucuacaagauuauagaaaaaguggacuacccaagagaugagaauggggagaucgccgcuauuauccacccgaacuugcaggaccaggacuggaagccccugcacccuggagauccaauguuccuaacccucgacgguaaaacgauaccccugggcggggauugcacuguauauccuguuuucgugaaugaagccgcguacuaugagaagaaagaagcauuugccaagaccacaaaacuuacucugaacgcuaagucaauuagguguugcuugcauuga

SEQ ID NO: 53083 - RNA, 1722 nt, Artificial Sequence
  derived and/or modified sequence opt3 from ASPG__Homo_sapiens__NP_001073933
auggccagagcugugggccccgagaggcggcugcucgcagucuacaccgggggaacaaucgguaugcgcagcgaacuuggcguucuggugccugggacuggauuggccgcgauuuuacgaacgcugccaauguuccacgacgaggaacaugcucgugccagaggccuauccgaggauacccucguacugccgcccgcaucuaggaaccagcggauacuuuauacagugcuggaaugccaaccuuuguuugacucaagugauaugacuaucgccgagugggucugucucgcucagaccauuaagcgccacuacgagcaguaucaugguuucgugguuauccacgggacagacaccauggcauuugccgcuagcaugcuguccuucaugcuggaaaaucuccagaaaacugugauuuuaacaggagcccaagucccaauccaugcgcuguggucugauggcagagagaaccuuuugggcgcacugcuaauggccgggcaguacgugauacccgaaguaugccucuuuuuccagaaucagcuguuuaggggaaaccgggcuaccaagguugacgcccgccgauucgcagcuuuuuguucgccuaaucuucugccauuggccacggugggugcggauaucacuauuaacagagagcucgucaggaaaguggacggcaaggccgggcuggugguccacucaagcauggagcaagauguuggauuacugcggcucuaucccggcaucccugcagcucuugugcgugccuuccugcagccaccguugaaagguguagugauggaaaccuuugggaguggaaauggccccacaaagccugaccuacugcaggagcuccgcgucgcuacugaaagaggccuggugauuguuaacugcacccacugucuucagggggccgugacaaccgauuacgcagccggaauggcuauggcgggugcaggcgucaucuccggguucgacaugacgucugaggccgcucuggccaaguugagcuaugugcucggacaaccaggccuguccuuagauguaaggaaagaacugcuaacuaaggaccuccggggugagaugacacccccuucaguugaggaacgacgcccaagucugcaggggaauacccuuggcggaggcgugagcugguugcugucucucuccgggucacaggaggcagacgcccugagaaacgcucuuguccccagccuggccugcgcagcggcucaugccggagauguggaagcauugcaagcccucgucgagcuggguagugacuuaggccugguggauuuuaaugggcagacuccgcuacacgcugccgcaaggggaggccauacagaagcuguuaccaugcuccugcagcgggguguggacguaaacacgcgcgauaccgacggguucucuccucuuuugcuggccgucagaggcaggcaccccggagugauaggccuccugcgugaggcgggggccuccuuaagcacacaggagcuggaagaggcuggaacugaacuuugucgguuggcauaccgagccgaucucgagggucugcaaguuugguggcaggcuggcgccgaccuagggcagccaggauacgauggccacucggcacugcauguggcggaagccgcugguaaucucgccgucguggcauuccugcagucucuugagggggcuguaggcgcccaagcaccuugccccgagguguugccaggaguuuga

SEQ ID NO: 53084 - RNA, 2190 nt, Artificial Sequence
  derived and/or modified sequence opt3 from ASPH__Homo_sapiens__NP_001158222
auggccgaggacaaggaaaccaaacacggcgggcauaagaacggaagaaaagguggccugagcgggacauccuucuuuacuugguucauggugaucgcucuccuuggagucuggacgucuguugcagugguaugguuugaucugguggacuacgaggaagucuugggcaaguuagguauuuaugaugccgacggggauggagacuucgauguggacgaugcgaaaguucugcuaggccucaaggagaggucaaccagugaacccgcugugccuccagaggaggccgaaccgcacacagagcccgaggaacaggucccuguggaggcagaaccacaaaauauagaggacgaagccaaggagcagauccagagccugcuucaugaaaugguacacgcugagcauguugagggcgaagaucugcagcaagaggacgggcccacuggagaaccucagcaggaggaugacgaauuuuugauggcaaccgacguggaugaccgguucgagacacucgagccagaagucucccacgaggaaaccgagcacucuuaccauguggaagagacugugucgcaggauugcaaccaagacauggaggaaaugaugucagagcaggaaaaucccgauagcagugagccugucguugaggacgaacgccugcaccaugauacagacgaugugaccuaucagguauacgaggaacaggccguguaugagccacuggaaaacgaggguauugagaucacggaagucacugcuccgcccgaggacaauccuguggaagauucccaaguuauuguggaggaagucucuaucuuuccaguggaggagcagcaggaaguacccccugagaccaaccgaaaaacagacgacccagaacaaaaggccaaaguuaagaaaaagaagcccaaacucuuaaauaaguucgauaaaacuauaaaggcggagcuggacgcagccgaaaaacuucguaagagaggcaaaaucgaggaggcugugaacgccuuuaaggaauuggucaggaaguacccgcagagcccucgggcacgcuaugggaaagcucagugugaggaugaccuggccgaaaagagaagguccaaugaggugcuacggggagcgauugagaccuaccaggaagucgccucacuccccgaugugccagcagaccugcuuaaacugaguuugaagcgccgaagcgauagacaacaguuccucggccacaugagggguucucuguuaacacugcagcggcucguucagcuuuuuccuaacgacaccucccugaaaaaugauuugggggugggauaccuacugaucggcgacaacgauaaugcuaagaagguauaugaggaaguccucucagugacgcccaacgacggcuucgccaaaguucacuacggguuuauucugaaggcucaaaauaaaaucgccgagagcauaccauaucuuaaggaaggaauugagaguggugaucccggcacugacgacgggcguuucuacuuccaucugggagaugcaaugcagcgcgugggcaacaaagaggccuauaagugguacgaauugggucacaagagagggcauuuugcuucugucuggcagaggucccucuauaacgugaauggccugaaagcgcagccuugguggacaccaaaggagaccggauacacugaauuaguaaaaagccuggagcggaacuggaagcuaauccgagacgaaggccucgcagugauggauaaagccaaggggcuguuccuuccggaggacgagaauuugcgcgaaaagggagauuggucgcaauuuacacuguggcagcaggguagaaggaacgagaaugcuugcaaaggcgcccccaagaccuguacgcuccuggaaaaauucccugagaccacagggugccggcgcggacagauuaaguacucuaucaugcacccaggcacucauguuuggccccacaccgguccuacaaacuguagacuuaggaugcaccugggguuggucaucccaaaagaaggcugcaagauucguugugcaaaugagacuaaaaccugggaggaaggaaaggugcucauauuugacgauuccuucgagcaugaaguguggcaagacgccucaaguuuucggcugaucuucauugucgauguuuggcaccccgaguuaacaccgcagcagcgaagaagccugccugcuaucuga

SEQ ID NO: 53085 - RNA, 5679 nt, Artificial Sequence
  derived and/or modified sequence opt3 from ASPM__Homo_sapiens__NP_001193775
auggccaacagaagggugggccgggggugcugggaggucagccccaccgaacgccgaccuccagcuggacugcgugguccggcagccgaggaagaggcguccucucccccuguucucucacuuagucacuucuguagaagcccauuucugugcuucggcgacguguuguuaggggcuuccaggacacugucucuagcccucgauaaucccaacgaagagguagcagaggugaagaucucgcauuuuccugccgcugaccugggauucucagucagccagcgguguuuugugcuucaaccaaaagaaaagauuguuauaagugugaauuggacuccccugaaagagggccgcgucagagaaaucaugacguucuuggugaacgauguacucaagcaccaggcaauucugcuggguaaugccgaggagcagaaaaagaagaaaaggucccucugggacaccaucaagaaaaagaaaauuucugcuagcacaucccauaaccggcgcguuucaaauauccagaacgugaauaagacuuuuagugucagccaaaagguggaucgagugagaucuccuuuacaggccugcgaaaaccuggcgaugaaugaggggggaccaccgaccgaaaacaauucccuuauauuggaggaaaacaaaauccccauuucaccuaucagcccagcauucaaugagugucacggcgccacaugccugccccuaagugucaggcggucuaccacuuacuccagccuccaugcuucggagaaccgugaacugcuuaacguucacucugccaauguguccaagguaucauuuaacgagaaagcagugacagaaaccaguuucaauagcgucaacgugaauggccagcgcggggagaacuccaagcugucuuugacgccuaauuguagcucaacucucaacauuacccagagucaaauccacuuucuguccccagacagcuucguuaauaacucucauggagcuaauaacgaauuagagcuggugacaugccucucaagugauauguuuaugaaagacaauagccagcccguccaccuugaguccacuauagcccaugaaauuuaucagaagauccugucuccggauucguucauuaaagacaacuacgguuugaaucaggaucuagagagcgaauccgugaacccuauccugucacccaaccaauuccucaaggacaauauggcguauauguguaccagucagcagacaugcaagguaccacugucuaacgagaauagccaaguuccucagucccccgaagauuggagaaaaucagaggugagcccaaggauccccgagugucagggcucuaaguccccuaaagccauuuuugaagagcuugucgaaaugaagaguaacuacuauagcuucauaaaacagaauaacccaaaguuuucugcagugcaagacaucuccucacacagucacaauaagcagccgaaacggcgacccauucugagcgcuaccgucacgaagcgcaaagccacuugcacaagagagaaccagaccgagaucaauaagccuaaagcuaagaggugcuugaacucggccgugggggaacaugagaagguuauaaauaaccagaaagaaaaggaggacuuccacuccuaccucccaauuaucgaucccauccugucuaaaagcaagucauauaaaaaugaagugacuccuaguuccacaaccgcaucuguagcccggaagcgcaagagcgacggauccauggaggaugcuaacgucagaguggcgauuacggagcauaccgaaguuagggagaucaaacguauucacuuuucaccaagcgaacccaagacaagugcagugaaaaagacuaaaaaugucaccacaccgauaucuaagcggaucuccaaccgagagaaauuaaaccugaagaagaaaacugaccuaagcauuuucagaaccccuaucucgaagacaaauaaaaggaccaagccaaucauugccguggcucaaucaucucucacuuuuauaaaaccccugaagacggauaucccucgccaucccaugccauucgccgcaaagaacauguuuuacgacgaacgguggaaagagaagcaggagcagggcuucacaugguggcuuaauuuuauuuugaccccugaugacuucacuguaaaaaccaacaucagugaagugaaugccgcuacacugcuccuggguauugagaaccagcacaagaucuccguucccagagccccaaccaaagaagagaugagccuuagggcauacacugcgcgcugucgacugaaucgguugcguagagcugccugcaggcucuuuacaucugaaaagauggucaaggcaauaaaaaagcuggagaucgagauugaagcccgccgguuaaucgugagaaaagauaggcaccuguggaaggacgugggggagcgacaaaaaguccuaaacuggcuccugagcuauaauccgcuuugguugcgcauuggacuggaaacgaccuacggcgagcucaucucccuggaggauaacucagacguuacuggcuuagcuauguucauacugaaucggcuuuuguggaacccugacauugccgcagaauauagacaucccacagugccacaccucuacagggaugggcaugaggaagcucugaguaaguucacccuaaagaaacugcuccugcuuguguguuuuuuggacuaugccaagaucagccgucugauugaucacgaccccugcuuauucuguaaagaugcggaguuuaaggccucuaaagaaauccuccuggcuuucucccgcgacuuucuuucaggagagggugaucugagucggcacuugggccuccuggggcuaccuguaaaucauguccagacaccauucgacgaguuugauuucgcagugacuaaccuggccguugaccuccagugcggagugagacuggucaggaccauggaacuuuugacgcagaauugggaucugagcaagaaauuacgaauacccgcuaucucccggcuccaaaagaugcacaacguggacauuguucugcaggugcuuaagucucgcggcaucgagcugucggaugaacaugguaacaccauucuaagcaaagacaucguagacagacacagggagaagacacuccggcuguuguggaaaauagccuuugcauuccaggucgauauuucacugaauuuagaccaacucaaggaagagaucgcguuucugaaacauacuaaguccaucaagaaaaccauuagucuucugucuugucacagcgaugacuugaucaacaagaaaaaggggaaacgagauuccggcucauucgagcaguacucugaaaauauuaagcuccugauggacugggugaacgccgugugcgcuuuuuauaauaagaaagucgagaacuucacaguuagcuucagugauggaagagugcuauguuaccugauacaccauuaccacccuugcuauguaccguuugacgccaucugucagcgcacuacccagacgguggaaugcacacaaaccggcuccgucgugcuuaauagcucuucagaguccgaugacaguagccucgauaugucgcugaaggcauucgaccaugaaaacacuucugaguuguacaaagagcuguuagaaaaugagaagaaaaacuuucaccucguuagguccgcugugcgugaucuggggggaauuccagccaugaucaaucauagcgacaugucaaacacaauucccgacgaaaaggucgugaucaccuaucuuaguuuccugugcgcacgguugcucgaucugagaaaggagauaagggccgcucgccuaauccagacuaccuggcgaaaauacaagcugaaaacagaccuuaagagacaccaggagcgggaaaaagcggccaggauuauccagcucgcaguuauuaauuuucuggcuaagcaacgcuugcguaagagagugaacgccgccuuagucauccagaaauauuggcggaggguacuggcucagcgcaagcuccugaugcuuaaaaaggagaaacuggaaaaggugcagaauaaagcagccucuuugauacaagcgauguggcgaagauaccgggcuaagaaguaucuauguaaaguuaaggccgcaugcaaaauucaggccugguacagguguuggcgcgcucacaaggaguaccuggcaauccucaaagccgugaagaucauucaggguugcuucuauacgaagcuggaaagaaccagguuucuuaacguccgggcguccgcuauaaucauucaacguaaauggcgcgccaucuuaccugcaaagauugcccaugagcacuuccugaugaucaaacgacauagagcugccugucucauacaggcacacuacaggggcuauaaggggcggcagguguuuuugcgccagaaaagcgcugcccugaucauucaaaaguacaucagagcgagggaggccggaaagcacgaacggauuaaauauaucgaguucaagaaaucaacuguaauacuccaggcacuggugcgaggcuggcuugucagaaagcgcuuucuggaacagagggcuaaaauucgguugcuacauuucacagccgcugcauacuaucaccugaaugccguucguauccagagagccuacaagcucuacuuagcugugaagaacgcgaacaaacaagugaauagugucaucugcauucagaggugguuccgcgcacggcugcaggagaagcgauuuauccagaaauaucauagcauaaagaaaauugaacacgagggucaagagugucuuucccagagaaacagggccgcuucugugauccagaaggccguucgccauuuccugcuccggaaaaagcaggaaaaguuuaccagcgggauuaucaaaauacaagcauuguggagaggcuacuccuggcguaagaaaaaugauugcacaaagauuaaagccaucaggcugucacuccagguagugaaccgggagauccgcgaagagaauaagcuguauaagcgaacugcucuugcgcuacacuaccuguugaccuauaaacacuuaucugccauucuggaagcacucaagcaucuggaggucgugacgagacuuaguccacuguguugcgagaacauggcucagucgggagccaucagcaaaauuuucguucucauaagguccuguaaucggucuauccccugcauggaagugauucgcuacgcaguccaaguguugcugaacguaucaaaguaugagaaaacaaccagcgccgucuacgacguggaaaauugcaucgauauccuacuggagcuccuucagauuuacagagagaagccuggcaacaagguugcugacaaagggggauccauauuuacuaagaccuguugccuguuagccaucuugcugaaaacaacuaauagggcgagugaugugcgaucucggagcaaggucguggaccguauuuauucacucuacaaacugaccgcacacaagcauaagaugaacacagaaagaauccuuuauaaacagaagaaaaauuccaguauuagcaucccguucauacccgagacgccaguucgcaccaggaucgugucucggcugaagccugauuggguccucagacgcgacaacauggaagagauuacuaaucccuugcaggccauccaaauggugauggauacacuggguauuccauacuga

SEQ ID NO: 53086 - RNA, 729 nt, Artificial Sequence
  derived and/or modified sequence opt3 from ASPN__Homo_sapiens__NP_001180264
augaaggaguacgugcugcuccuuuuccuggccuugugcagcgcuaaacccuuuuucuccccuucucacaucgcauuaaagaacaugaugcugaaagacauggaagauaccgacgaugacgaugacgaugacgaugacgaugacgaugacgaggacaauucacuauuuccaacaagagaaccgaggagucauuucuuucccuucgaucucuuuccuauguguccauucggcugccaguguuauagccgggucguucacugcuccgaccuggggcuuacuucugugcccacgaacauuccuuuugauacccgcaugcuggacuugcaaaauaacaagauaaaagagaucaaggaaaaugauuucaagggacucacaucgcuguacggucugauucucaacaauaacaaauuaacuaagauccauccaaaagccuuucugaccacaaagaaacuucgacguuuguaucugucacacaaucagcuaagcgagauuccccucaaccugccuaagagucuugcggagcugagaauccaugaaaauaaggugaaaaagauacagaaagacaccuucaagggcaugaacgcuuugcacguacucgagauguccgccaauccacuggauaacaaugggaucgaaccgggagcauuugagggcgucacuguguuccacauuaggaucgccgaggcuaaauuaacaucuguucccaaggacaaccugccuagcuucuga

SEQ ID NO: 53087 - RNA, 1032 nt, Artificial Sequence
  derived and/or modified sequence opt3 from ASPRV1__Homo_sapiens__NP_690005
augggcagccccggggccucccugggaaucaagaaagcucuccagucugagcaagcaaccgcccuuccugcgucagcuccagccgugagucagccgacagcacccgccccuagcugccugccaaaggcuggucaggucauucccacuuuguuaagagaagcaccuuucuccucuguuauagccccaacgcugcuauguggcuuucucuuccuggcuuggguggccgcggagguacccgaagagucgucaaggauggcagggagcggagcccggagugaagagggccgccgacagcacgcuuuugugccugagccauucgacggugccaacgucgugccgaaucuuuggcugcauuccuuugaaguuaucaacgauuugaaucacugggaccauauuaccaaacuccguuuccugaaggagucucugagaggggaagcacucggaguguacaacagguuaagcccccaagaucagggcgacuauggcacagucaaagaggcucugcuuaaggccuuuggggugccuggagcggccccaucccacuugcccaaggagaucguauucgcaaauucaauggguaaaggcuacuaucugaaggggaaaauuggaaagguuccugugcgguuucuagucgauaguggcgcucaggugagcgugguccauccaaaccucugggaagagguuacugacggugaucuggacacccuucagcccuucgaaaaugugguaaaaguggccaacggggcugagaugaagauccugggagucugggauacagccgugucuuugggcaagcucaaacugaaggcacaauuuuuaguugccaaugcuuccgcggaagaggcaauaaucggcaccgacgugcugcaggaucacaacgccauucucgacuucgagcaccgcacuugcacacuuaaagggaagaaauuuagacuguugccggucggagguucacuagaagaugaguucgaccuggaacucaucgaggaagacccuagcagugaggagggcaggcaggaacugucucauuga

SEQ ID NO: 53088 - RNA, 1944 nt, Artificial Sequence
  derived and/or modified sequence opt3 from ASPSCR1__Homo_sapiens__NP_001238817
auggccgcucccgcaggcgggggagguagcgccguguccguccuggcgccuaacggcagaaggcacaccguuaaggugacaccaucuacuguacuccuucaggugcuggaggacacgugccggcgccaagauuucaauccgugugaauacgacuugaaauuucagcgaucagucuuagaucugagucuacaguggcguuucgcuaaccuccccaauaacgccaagcuggagauggugccugcaagcagauccagggaagggccagagaauaugguucggaucgcccuucagcuggacgauggaucucgcuugcaagacucguuuugcucaggccagacccucugggaacugcugagccauuucccccagauuagagagugucuccagcacccugguggggcuacaccagugugcgucuauacuagggaugaggugaccggagaagcagccuuacggggcacaacccugcaaagucuuggcuugacugggggauccgcuacaauacgcuuuguaaugaaauguuacgaccccguugguaagaccccuggcucucuggggagcuccgccucagcgggacaggcagccgcuagugccccacuaccgcucgagagcggcgaacugucucgaggugaucuuuccagacccgaggacgcagauacgucagggccuugcugugagcauacucaggaaaaacagagcaccagggcuccagccgcggcccccuucgugccuuuuaguggaggcggccaacggcugggaggaccacccgguccgacacguccuuugacuucuuccagcgcaaagcuccccaagucgcugucuuccccaggcgggccuucaaaacccaagaaaaguaagagcggacaggacccacagcaagagcaggaacaggagcgcgaaagagauccccagcaagagcaggagagggaacggccugucgaccgagagccaguggaccgcgaaccgguggucugccaccccgauuuagaggaaagacugcaggcuuggccugccgagcucccagacgaguucuuugaacuuaccguugaugacgugaggcggcgccuggcucaguugaaauccgagagaaagaggcuagaagaggcaccccugguaacaaaggccuuccgugaagcccaaaucaaagagaagcucgagcgguauccuaaaguggcucugcgaguccuuuuuccagauagauacgugcugcagggcuucuuuaggcccucugaaaccguuggugacuugcgcgauuucgugcggagccaucucgggaacccggagcugucauucuauuuauuuauuacgccuccaaagacuguccuggacgaucacacacagacccuauuccagccccaacucggcgacagaguggcgccuuuuacucugggacccagucuuaaaagguguuugggcccagaacagcgcacacgacugccuguaguuggggauggaggugacguggacuccggccggcuccuguucugggggcccagccgugggagagcaucuccaucaaccggccagccgccuugccaccccgucuguaggccaaguagcccucccuccccacgccccucuucgggugauccuagccgggugaaggccgggcauaaacacgucggcacgggcagagcuaaucuuuuuccggccgcacuggugcauuugggagccgaggagccagcugggguuuaccucgaacccggacuguuagagcacgccaucuccccuucagcagcggacgugcugguagcuagguauaugagucgagccgcagguucuccaagcccccuaccugccccggaucccgcuccaaaguccgaaccugccgcagaggaaggcgcucucgugcccccagagccuauucccgggaccgcccagccagucaagcgcucacugggaaaaguuccgaaguggcuuaaauugccugcgagcaagcgguga

SEQ ID NO: 53089 - RNA, 927 nt, Artificial Sequence
  derived and/or modified sequence opt3 from ASRGL1__Homo_sapiens__NP_001077395
augaaccccaucguggucguucacggcgggggagccgguccuauuagcaaggacagaaaagagagggugcaucagggcaugguacgggcugcaaccgugggguacggaauacugcgcgaaggcgguuccgccgucgaugcgguggagggggcuguuguggcccucgaagacgauccagaguucaaugcaggaugcggcucuguccuuaacacaaauggcgaaguggagauggacgccucaaucauggaugggaaggaccugagugcuggagcaguaagcgccguucaauguauugcuaacccgaucaaauuggcccgauuagugauggagaagacuccccacugcuuucugacggaucagggugcggcacaguucgccgcugccaugggcgucccugaaauuccaggggagaagcuagugaccgaacguaauaaaaagagacucgagaaagagaagcaugaaaaaggagcacagaagacagacugucagaaaaaccugggcacugugggugcugucgcccuugauugcaaggggaauguugcguaugccaccuccacaggaggcaucgugaacaagaugguaggcagggugggggacucucccugucugggagcugguggcuacgcagauaaugacauaggggccgucucgaccacuggacacggcgagucaaucuugaaagugaaccucgcucggcugacacuguuucauauugaacaagguaagaccguugaggaagccgcagaucucagcuuaggguauaugaaaagucgcgugaagggccugggaggccuuaucgucguguccaaaacgggggacuggguagccaaguggacuucuaccagcaugccuugggcugcggcaaaagacggaaaguugcacuucgguauugauccagacgauacaacuaucaccgaccugcccuga

SEQ ID NO: 53090 - RNA, 1239 nt, Artificial Sequence
  derived and/or modified sequence opt3 from ASS1__Homo_sapiens__XP_005272257
augagcuccaagggcucugugguccuggccuacucagggggacucgacaccaguugcauccuuguuuggcugaaagagcaggguuaugaugugauugcuuacuuggcaaacauaggccaaaaggaagacuucgaggaagccaggaaaaaggcguuaaaacugggggcuaagaagguauuuaucgaggaugugagcagagaguucgucgaagaguuuauuuggcccgccauccaguccucugcacuauaugaagaccgguaccuccugggaacaucgcuugcccgcccuuguauugcucgaaaacagguggagaucgcacagcgugaaggcgccaaguauguuucacacggugcuacugggaaaggaaaugaucaagugagauucgagcugagcugcuacaguuuggccccacagauaaaggucaucgcgccguggaggaugcccgaguuuuauaaccgguucaaaggccgcaaugaccucauggaauacgcaaagcagcauggcauuccuaucccagugacgcccaagaacccuugguccauggaugagaaucugaugcacauuucuuacgaagccgggauccuggagaaccccaaaaaucaggcuccaccuggacucuauaccaagacacaagacccagccaaagcaccgaacacucccgauauauuagaaauugaguuuaagaaagguguaccuguuaaggugaccaaugucaaagacggcacaacccaucagacuagccuggagcuuuucauguacuugaacgaaguggcugggaagcacggagugggcagaaucgauauugucgagaauagguuuaucgguaugaagucccgggggaucuaugaaacaccagccggaaccauucuguaccaugcgcaccuagacauagaggccuucacgauggaucgcgaaguucgaaaaaucaagcagggccucggccugaaauuugcagagcuuguguauacuggguucuggcacucacccgagugugaauuuguaagacauugcauugcuaagagucaggagaggguggaaggaaaaguccaagugagcguucugaagggucagguguacaucuugggccgggagucuccucucucccuguauaacgaagaguuagucucaaugaaugugcagggggacuacgagccaaccgacgccacaggauucauaaacauuaauagccugcgucucaaggaauaccaccgccuucaaaguaaaguaacugcuaaguga

SEQ ID NO: 53091 - RNA, 1128 nt, Artificial Sequence
  derived and/or modified sequence opt3 from ASTN2__Homo_sapiens__NP_001171663
augcccuucaucaccuaccugagcggccuccuuacagcccagaugcuguccgacgaucaauugauuucugggguggagauaagaugcgaagagaagggaagguguccuucaacuugccacuuaugucggcgcccagguaaagaacagcugaguccgacgcccguccuacucgagaucaaccgaguugugccucuguauacccuuauucaggacaauggcacaaaggaggcuuuuaaaagcgcacugauguccucuuacuggugcucggggaagggagauguaaucgacgauuggugucguugcgacuugucagccuucgaugcgaacggccucccaaauuguagcccccugcugcagccugugcucagauuaaguccaacugucgaacccuccucuaccgugguuagccuggaguggguggacguccaaccugcuauugguacaaaaguguccgauuauauccuucagcauaagaagguagacgaauacaccgauacugacuuguauacaggggaguuucugucauucgccgaugaccuacucaguggacugggcaccagcugcguugcagccggcaggucucacggggaagugccagaggucuccauauacucagugaucuuuaaaugucuugagccggacggacuguauaaguucacguuguacgcuguggauacucggggucgccauagcgaacucaguaccgucacacugagaacugcaugccccuuaguugacgauaacaaagccgaggaaauugcugacaagaucuacaaucuguauaacggcuacaccucugggaaagagcagcagauggccuauaauacacucauggaaguguccgcgagcaugcuuuuuaggguacaacaccauuacaacucgcacuaugagaaguucggagauuuuguguggcggucugaggacgaacugggcccucgcaaggcacacuugauucuacgaagacuggagagggucuccucacauuguaguagccuccugcgguccgccuacauccagucucguguggaaaccguuccauaucuuuucugccgcagcgaggaagugagacccgcugguauggucugguacucaauacugaaagauacgaagauuacuuacaucauuuga

SEQ ID NO: 53092 - RNA, 2121 nt, Artificial Sequence
  derived and/or modified sequence opt3 from ASUN__Homo_sapiens__NP_060634
augaagaucuucagcgagucccacaaaaccguguuugucguugaccauugccccuacauggccgaaucuuguagacagcacguggaguucgauaugcugguaaagaacaggacacaaggcauuauaccucucgcuccaaucucaaaaagucuuuggacuugcagcguggaauccucuauggaguauugucggauuauguacgacaucuuuccguucaagaaacuggucaauuuuauugugucggauucaggggcacauguuuugaacagcuggacgcaggaagaccagaauuuacaggagcugauggccgcgcuagcugccgugggacccccuaacccacgcgcagaucccgagugcuguaguauccuccacggucuggucgccgcuguggaaacccuuugcaagauaacagaguaucaacaugaagcacgaacucuguugauggagaaugccgagcguguaggcaacagagggaggaucauuuguaucaccaaugcuaaguccgacucucacguucggaugcucgaagauugcgugcaggagacaauucacgaacauaacaaacuggccgcgaauagcgaccaccugaugcagauccagaagugugagcucgucuuaauacauaccuacccugugggagaagauucccuggugucagaccgcaguaaaaaggagcuuagcccagucuugacuucugagguucacuccgugagagcaggcaggcaccuggccacaaaacuaaacauucucguacaacagcauuucgaucuggcuucaaccacgaucacuaauauucccaugaaggaagaacagcacgccaacaccagcgcaaauuaugacguggaacuucugcaucacaaggaugcucaugucgacuuuuugaaaaguggugacucucaccucgggggaggcucccgggagggcagcuucaaggaaacaaucacucugaaauggugcaccccucgcacaaacaauaucgaguuacacuacuguaccggggccuaucgaauuucgccaguggauguuaacucuagaccguccucaugccugacgaacuuucuccuuaauggaaggagugugcuguuggagcagccccggaaaagcgguuccaaagucauaucucauaugcuaagcucacacggcggggaaaucuuccugcaugugcucaguuccagccguucuauucuggaggacccuccaucaaucagugaaggaugcggcggucgcguaacugauuacagaauaacagacuuuggggaguucaugagggaaaaccggcuuacccccuuucuggauccucgauacaagauugacggcagcuuggagguuccacucgagcgcgcgaaagaucaacuggaaaagcacacuagauauuggcccaugaucaucucccagacaaccauuuucaauaugcaggccguggucccguuagcaucugugaucgucaaggagucgcugacggaagaggacgugcuaaacugucaaaagaccauuuacaaucucguugauauggagaggaagaacgacccucugcccauaagcacagugggaacucggggcaaagggccaaagcgcgaugaacaguauagaaucauguggaaugagcuugaaaccuugguaagggcucacauuaacaauuccgagaaacaucagcguguccuggaaugccucauggccugucggucaaagccucccgaggaggaggagcgaaagaaaagaggaaggaagcgcgaagacaaagaggacaagagugaaaaagcugugaaggauuacgagcaggagaagucuuggcaagacagcgaacggcugaaagguauccuugagagaggcaaggaggaacuggccgaagcagagaucauuaaagauuccccagacucacccgagccuccaaacaagaaaccguugguugaaauggaugagacaccccagguggaaaagagcaaggggccugucucucuccuguccuuauggaguaauaggauaaacacugccaauagccgcaaacaccaggaguucgcuggacgacugaacucugugaauaaccgggcggagcuauaucagcaucucaaggaagagaacggcauggaaaccacagagaaugguaaagcaucccgucaauga

SEQ ID NO: 53093 - RNA, 258 nt, Artificial Sequence
  derived and/or modified sequence opt3 from ASXL1__Homo_sapiens__NP_001158075
augaaggacaaacagaagaaaaagaaagagagaaccugggccgaagcugcaaggcuggugcucgagaacuacagcgaugcccccaugacaccuaagcaaauccuucaggucauugaagcggagggccugaaggaaaugcgguccgggacuucuccauuggcuugcuuaaaugccaugcugcacucaaacagucgcggaggugagggccuauucuauaaacucccggggcgaauaagccuguuuacgcuuaagguuuga

SEQ ID NO: 53094 - RNA, 4308 nt, Artificial Sequence
  derived and/or modified sequence opt3 from ASXL2__Homo_sapiens__NP_060733
augagagagaagggcaggcggaaaaaggggcgcaccugggccgaagcugcaaaaacagugcuggagaaguaccccaacacuccuaugagccacaaagaaauccuccaggucauucaacgagagggacuuaaggaaauacguuccgguacgucuccacuggccugcuugaaugcgauguuacauaccaacucaagaggcgaggaggggaucuucuauaagguuccgggaaggaugggcguguacacacugaaaaaggacguacccgauggugugaaagaacuaagugaggggagcgaagaguccucugacggacagucggauucacagagcagugaaaauuccucuagcuccucagacggcggcaguaacaaggaagggaaaaagagccgguggaagcgcaaagucucuuccucaagcccucagaguggauguccaucucccacuauuccugcugguaaggugaucuccccaagccaaaaacacucgaagaaagcccucaagcaggcacugaaacagcagcaacagaagaagcagcagcaacagugcagacccucuauuuccaucucaaguaaucagcaucuuagccugaaaaccguuaaggccgcuuccgauucugugccugcaaaaccagccacaugggagggcaagcaaagcgacgggcagaccggaucaccgcagaacaguaauuccagcuuuucuucaagugucaaaguggaaaacacuuugcucggccuggguaaaaagagcuuccagagguccgagcggcugcacacacgccaaaugaaacgaaccaagugugcugauauagacguagaaacgcccgauucuauccucguuaauacuaacuuaagagcccugauuaauaaacauaccuuuucggugcuuccuggggacugccagcagagguugcugcuacuccugccagaggucgaucgucaggugggacccgacggccuuaugaagcugaacggcagcgcguugaauaacgaguucuuuacauccgcagcccaaggguggaaagaacggcucucagagggagaguucacuccugagaugcaagugcgcaucagacaggaaauugagaaggagaagaaagucgaaccauggaaggagcaguuuuucgaaaguuauuacggucagucuagcggccuguccuuagaggauucaaagaagcugaccgcuagccccucugacccgaaaguuaagaagaccccugccgaacagcccaaauccaugccagugagugaggcaagccucaucaggauaguaccuguggucucucaguccgaguguaaggaagaggcacuucagaugucaagucccgggcggaaagaagagugcgagagccaaggagaagugcagccaaauuuuucgacauccucugagccccuguugagcucagcccuaaacacgcacgaacugaguuccauucucccuaucaaguguccaaaagacgaggaucugcuugaacagaagccgguuacuucugcggagcaagagagcgagaaaaaccaccugacaaccgccuccaauuauaacaagucagaaagccaggaaaguuuggugacuucucccuccaagccuaaaagcccaggcgucgagaagcccauugugaaaccuacagcuggugcugggccacaggaaaccaauaugaaggagccccucgccacgcugguagaccagucgccggagucauuaaaacgaaagucuagucugacccaagaagaggcuccuguuuccugggaaaagcgcccaagagugacagagaacaggcagcaucagcagcccuuccaagucagcccucagcccuuucuaaaucggggcgaucgcauccaggugagaaaagucccaccucucaagauccccgugucuaggauuagcccaaugccguuccacccuucccagguuucaccccgugcccgguuuccagugaguauaacuagccccaaccgaaccggagcaagaacacuggccgacaucaaagcuaaggcgcaacuuguaaaagcacagagggccgcugccgcagccgcugccgcagcggcugccgcagccucugucggcgggacuauuccuggaccaggucccggcgggggacagggcccuggugaagggggcgagggacaaaccgcucgcggcggguccccgggaucagaucgggugagugagacagguaagggcccaaccuuggaacuggccgggacuggaagcagaggcgguacgagggagcuccugcccugcgggccugaaacacagccacaguccgagaccaagacuacccccucucaggcacaaccucauucgguuagcggcgcucagcuucagcagacaccgcccgugccaccuacccccgccgucucaggagcguguacuuccgugccaaguccugcccacaucgagaaacuggacaaugaaaaguugaaccccacacgcgcuacggcaaccguagccucugugagccacccacaaggcccguccucaugccgacaggagaaagcuccuucucccacugggccagcccucauaagcggagcaagucccguucauugugcggccgauggcacagucgaacugaaggcugguccuuccaaaaauauuccaaaccccagcgccucuucaaagaccgacgcauccgugccuguggcugucacaccgaguccauuaacuagccugcuaaccacggccacccucgagaagcugcccguuccucaggugucggcaacaacugcccccgcugggucugcgccaccuuccagcacccuucccgccgcaucaaguuugaaaacaccaggaacuucucugaauaugaacggcccuacccuccggccgacguccagcauccccgcuaauaacccacuggugacacaguuacugcaagguaaggauguaccuauggaacagauccuucccaaaccauugaccaaggucgagaugaaaacugugccucucacagccaaggaggaacguggcaugggggcccugauugcuaccaauacuaccgagaacucaacaagagaagagguuaacgaaaggcagagucaccccgcaacgcagcaacagcuaggaaaaacccugcagagcaagcaacucccacaggugccgcgcccucugcagcuuuucuccgccaaggaguugcgggacucuagcaucgauacucaucaguaccacgagggccuguccaaagcgacacaagaccagauuuuacagacccucauacagagagucaggcgacaaaaucugcuuucagugguucccccaucucaguucaacuuugcucauaguggguuccagcuggaagacaucucgacaagccagcgcuuuauguugggauucgccggccggagaacuuccaagcccgcaauggccggucacuaucuccugaauauuucuaccuacgggaggggaucagagagcuuucgucgcacgcacuccgugaacccugaagaucgguucugccuaaguucuccgacagaggcucugaaaaugggcuacaccgacugcaagaaugcaacuggugaaagcucauccaguaaagaggaugacaccgaugaggaaagcacaggcgacgagcaagaaucuguaacugucaaggaggagccccaggugucccagucagccgggaagggagauaccagcucgggcccacauucuagagaaacacucaguacguccgacugucuggcgagcaaaaacgugaaggcugagaucccucuuaaugaacaaaccacuuugucaaaagagaacuaucuguuuacaagggggcagaccuucgaugaaaagacuuuagcccgagaccucauccaggcagcccagaaacaaauggcucacgccguccggggaaaggcaauucgcuccucucccgagcuguuuagcaguacaguucuuccucugccagcugauucccccacccaucagccucuacuccugccacccuugcagacgccgaagcuguacggcagcccuacucagauagguccaucuuauagagggaugaucaaugugucaaccaguuccgacauggaucacaacagcgccguacccggaucucaagugucgucaaaugucggcgacgugaugagcuucuccguuacagugaccacuauuccugcgagucaggccaugaacccaucuagccacggucagacaauccccguccaggcauuuuccgaggaaaauucaauugagggcaccccgaguaaaugcuacuguagguuaaaggcuaugaucaugugcaaaggguguggagccuucugccaugacgauuguauaggcccuucuaagcucugcgugagcugucugguugugcgguga

SEQ ID NO: 53095 - RNA, 6747 nt, Artificial Sequence
  derived and/or modified sequence opt3 from ASXL3__Homo_sapiens__NP_085135
augaaggacaaaagaaagaaaaaggauaggaccugggccgaggcugcacggcuggcccucgaaaaacaccccaacagcccuaugacagcgaagcagauccuugaggugauucaaaaggaaggccugaaagagacuuccgggacgucuccauuggcuugcuuaaaugccaugcugcauaccaacacacgcauaggagacgguacuuucuuuaagaucccgggcaaaucagggcuauacgcacucaagaaagaagagaguagcugucccgccgauggaacccuggaccuugucugcgaguccgaacuggauggcacagacauggcugaggcaaaugcccacggugaagagaacgggguuuguucuaagcaggugaccgaugaggcuucgucaacucgagacagcaguuugacaaauaccgccguacaguccaagcucgugucuagcuuccagcaacauacgaaaaaggcgcugaaacaggcacugcgucagcagcaaaagagaaggaacggagucuccaugauggugaauaaaacuguuccucgggugguccucaccccauuaaaggugucagaugaacagagugacagccccucuggcuccgagucaaaaaacggcgaagccgauagcagugacaaggagaugaagcacgggcagaaaucuccuacaggaaagcagacuucccaacaucugaaacgccuuaagaaaagcgguuugggccaccugaaguggaccaaggcugaagauauugacaucgagacaccagggucgauucuaguaaauaccaaccucagagcccugaucaauaaacacacguuugcaucucuuccccagcauuuccagcaauaucuguugcuccuguuaccugagguugacaggcagaugggauccgauggcauacugcggcucucaacuagugcucuuaacaaugaauuuuucgccuacgcggcccaggguuggaagcagcgccuggcagagggggaauuuacaccagagaugcaauugcgaaucagacaggaaauugagaaagagaagaaaaccgaaccguggaaggagaaguucuuugaaagguucuauggagagaaacuaggcaugagccgggaagaguccgugaagcugacuacaggccccaacaaugcuggggcccagucuagcucaaguugcggaaccuccggucucccugucagcgcucagacggcccuggcagagcaacagccaaaaucuaugaagucacccgccaguccugaaccaggcuuuugugcuacccuuugccccaugguggagaucccgccuaaagacauuauggcggaacuggagagcgaggauaucuugauacccgaagaguccgugauucaggaagagaucgcagaagaggucgagacaucuauuugugaaugccaggacgagaaccacaagacuaucccagaauucucggaggaagccgagagccucaccaacucccaugaggaaccucaaaucgcucccccagaggauaaucuggaaucauguguuaugaugaacgacguguuagagacacugccccacauugaaguaaagauagaggggaaaagugagucuccucaggaagagaugacuguggucaucgaucagcuagaagugugcgacagccucauuccauccaccucaagcaugacacacguuucugauaccgagcauaaggaguccgaaacugccguggagacgaguacaccgaaaaucaagaccggaagcucuucccuggaaggccaguuucccaaugaggguauagcaauugacauggaacuucaaucagauccugaggagcaguugagugaaaacgccuguaucagcgagacuucguucuccucugaaagcccagagggggcuugcaccucacugcccaguccuggcggagaaacacaguccaccucugaggagagcugcacuccagccucccucgaaacaacguucuguucagaggucagcaguaccgaaaauacugacaaauacaaccaacguaauucuacagacgagaacuuucacgcaucccugaugagcgaaaucucgcccauuucaaccucuccggagaucagugaggcgucccuuaugagcaaucugccuuugacaucugaagcuagcccaguguccaaccucccccugacuucagagaccaguccuaugagcgauuuaccccugacgucugaaaccuccucaguaaguagcaugcuacucacauccgagacuaccuucguuucuucgcugccacuuccuagcgagacaucacccauuuccaauaguucuauaaacgaacgcauggcccaucagcagagaaagagcccauccgugucagaggaaccguugucuccucagaaagacgagagcagugcaacugccaagccccugggcgaaaaucucaccucccaacagaagaaccugagcaauacgccagagcccaucauuaugucuucauccaguaucgcuccugaggccuuuccaagcgaagauuuacacaacaaaacacugucgcagcagaccugcaagucucaugucgacacugagaaacccuauccugcauccaucccggaacuugcuagcacagagaugauuaaggugaaaaaccacucagucuugcaaaggaccgaaaagaaggugcucccaaguccccuggagcuaucuguuuucuccgaggggacugauaauaaaggaaacgaacugccuagcgccaagcuccaggacaaacaguacauaucaaguguggauaaggcgccauuuagcgaggguucccggaauaaaacccacaagcagggcucuacacaaagccgacuggaaacgucccauaccucaaagucuagugagcccucgaaaagcccugacgggauccgcaacgaauccagagauucugagauuucaaagaggaaaacugccgagcagcacagcuucggaaucuguaaggaaaaacgggcucgcauugaggacgaucaguccacaagaaauaucaguucuagcucaccgcccgaaaaggagcaaccaccuagggaggaaccccguguaccaccucuuaagauacaguuguccaaaaucggccccccauuuauuaucaagagucagccggucagcaaaccugagucucgggcauccaccucaacaagcgugucgggugggcgaaacacuggcgccagaacccuggcugacauuaaggccagggcacagcaagcgcgcgcccagcgggaagcugccgcagcugccgcaguugccgcugcggccucuaucgugaguggagcaaugggcucccccggggagggagguaaaacgagaacauuagcucauauaaaggaacagaccaaagccaagcucuucgccaagcaccaggcuagggcacaccuguuucaaacuagcaaagagacccgccuuccacccccucugucauccaaggagggcccacccaauuuggaagucucuagcacaccugagacuaaaauggaagggaguaccggagugauuaucguaaacccgaauugccgauccccaagcaacaagucugcccaucuccgggagacaacgaccgugcugcagcagucacuaaaucccaguaaacugccugaaacugcgacagaucucuccguucacagcucugacgagaacauucccgucucgcaucugucagagaagaucgugagcuccaccaguucugaaaauagcuccgugccaaugcuuuucaacaagaauucagucccuguuaguguguguucuacugcuauaagcggcgccaucaaagagcaccccuuuguguccucaguagacaagagcucugucuugauguccguggauagugcaaacacaaccauuagcgccugcaacaucucgaugcugaaaacgauucaggguacugacaccccauguaucgcuauaauuccuaagugcaucgaauccacaccgaucucugcaaccacugaggggucaagcauuaguuccucuauggaugacaaacaauuacucaucagcucauccagugccagcaaucugguuucuacacaguauaccucagugcccacaccauccauuggcaacaaucuuccuaaccugagcacuucuaguguccuaauacccccaaugggaaucaauaaccguuucccuucggaaaagauugcgauccccggcuccgaggagcaggcuaccgugagcauggggacgacaguuagagccgcacucucauguucugauagcguggccguaaccgacucccuggucgcucauccgacuguggccauguuuaccggaaauauguugacaauuaacaguuacgauucaccaccuaagcugucugcagaaagcuuagacaaaaauuccggccccaggaaccgcgcugauaauagugguaagccacagcaacccccugggggauucgccccggcggccaucaaccggagcauacccugcaaagugaucgucgaccacuccacuacccucacgucuucacugagccuuacaguuucgguggaguccagugaagcaucucuggauuugcagggcagaccaguaaggaccgaggcuagcgugcagccugucgccuguccccaagugucaguuauuucccgaccugagccaguggcuaaugaagguaucgaccacucuaguacuuucauugcagccagcgccgcuaagcaggauuccaaaacacuccccgcgaccugcacuucacugcgcgagcuaccucuggucccagacaagcuuaacgaacccacagcaccgagccauaauuuugccgagcaggcucggggcccugccccauucaagucugaagcagacaccacgugcaguaaccaguacaaccccuccaauagaaucuguuggaacgaugacgggaugaggagcacuggacaaccucucgugacccacucaggcucuuccaaacagaaggaguaucuggagcagucgugcccaaaagccauaaagacagaacaugcuaauuacuugaacguuagcgagcugcacccccguaauuuagugaccaacgucgcgcucccgguaaaaagugaacugcaugaggccgauaagggguuucgcauggacacagaagauuucccuggacccgagcuuccaccucccgcagcugagggcgccucuuccgugcagcaaacucagaauaugaaggcaagcaccucaaguccaauggaagaggccauuucccuggcuacggacgccuugaaacggguucccggugcggggagcucuggauguagacucucaagcguggaagcaaacaauccucuggucacacagcuacugcagggcaaccuuccacucgagaaggugcugccgcaacccagguugggugccaaauuagaaaucaaucgacugccucucccacugcagacuaccuccguaggcaagacagcucccgagcggaacguggagaucccuccaucuagucccaauccugaugggaaaggauaucuugccggcacccuggcuccguugcagaugcgcaagagagaaaaccacccaaaaaagagggucgcacggacuguuggggagcacacccaagugaagugcgaacccggaaaacuacugguggagccugacgucaagggcgugcccuguguuauuucgagcgguauaucccagcucgggcauucacagccauuuaaacaggaguggcugaauaagcacucuaugcaaaaccgaaucguacauagcccugaagugaaacagcagaagagacuuuuacccaguugcuccuuccagcaaaaucuguuucacgucgauaagaacggaggcuuccacacagacgccgguacgucacaucgccagcaguuuuaccagaugccaguggcugccaggggcccgauuccuacugcagcgcucuugcaagccucuagcaaaacccccguuggguguaacgcuuucgccuuuaaucgucaccuggagcagaagggacucggcgaagugucccugaguagcgcaccacaucagcuucggcuggcuaacauguugucucccaauaugccuaugaaagagggggaugaagucggaggcacagcccacaccaugccaaacaaggcacuagugcaucccccuccgccacccccuccacccccucccccaccgcuggcccucccucccccaccucccccaccucccccguuaccaccuccccugccaaaugcugagguacccucagaccagaaacaaccuccggucacuauggagacaaccaagagacuuuccuggccacagagcacggguaucugcaguaacauuaagucugaaccccuguccuucgaggaagggcucucgagcucaugugaguugggaaugaaacagguguccuaugaccaaaaugaaaugaaggagcagcugaaagcguuugcccucaagucugcagauuucaguagcuaccugcuuucagagccucagaaacccuucacucagcuagcugcccaaaagaugcagguucagcagcaacagcagcugugcggcaacuauccaacaauccacuuuggcuccaccagcuucaagagggccgcaucugcuauagaaaaaaguaucgggauuuugggauccgguagcaauccugccaccggcuuaucagggcagaacgcgcaaaugcccgugcagaauuuugcugacucuucgaacgccgaugagcuggaacucaaguguagcugccgccugaaagcaaugaucgucugcaagggauguggcgccuucugccacgacgauuguauugguccauccaaacuuugcguggcuugucugguugugcgauga

SEQ ID NO: 53096 - RNA, 1428 nt, Artificial Sequence
  derived and/or modified sequence opt3 from ASZ1__Homo_sapiens__NP_570124
auggccgcuagcgcacugagaggccuccccguggccgggggaggugaguccucugaaucagaggacgauggcugggaaaucggguaccuugacaggaccagucagaagcugaaacgguuguuaccuauugaggaaaagaaagagaaguucaaaaaggcgaugacaauaggagaugucagccugguucaagagcuacucgacuccggcaucucuguggauucgaacuuucaguaugguuggacuccacugauguacgcugccucaguagcaaaugccgaacuugugcgcguccuguuggaccgaggggcuaacgcaucuuucgagaaggauaaacagaguauucucaucacggccugcuccgcucacggaucugaagaacagauucugaaguguguggagcugcucuuaagccguaaugccgacccgaacguugcgugcagaaggcugaugacccccaucauguaugcagcccgggauggccauacacaaguggucgcucuuuugguggcccacggcgcagaaguaaauacucaggacgagaacggguacaccgcucugacaugggccgcgcgccagggacauaaaaauauaguucuaaagcuccuggaacuuggugccaacaaaaugcugcagaccaaggauggcaagaugccuuccgagaucgcaaaaagaaauaagcaccaugaaauuuuuaacuugcucucauucacucugaauccauuagaggggaaacugcaacagcucacaaaggaggacaccaucuguaaaauucuuacgacugauagugacagggaaaaggaccacaucuuuagcucuuauaccgcuuucggagaucuggagguguuuuugcacggccuaggucuggaacauaugacagaccuccugaaagagcgggauauaacucuucgccaccuguugaccaugcgagaagacgaguucacaaagaacgggauuaccuccaaggaucagcagaaaauccucgccgcucugaaggaguuacaagucgaagagauucaguuuggagaacugucagaggaaacgaaacuagagaucagcggcgacgaguuccucaauuuucugcuuaaguugaacaaacagugcggccaucugaucacugccgugcaaaaugugauuacagaacuccccgucaacagucagaagauaacccuggagugggcaucuccucagaacuucacuuccguuugugaggagcuugugaauaacguagaggaucugagcgaaaaggugugcaaauugaaggaccucauccagaaacugcaaaaugagagagaaaacgauccaacacacauucaguuaagggaggaagucucgaccuggaauagccggauccugaagcguacggccauaaccauuuguggguuuggauuccuacucuucaucugcaaacugacauuucagcgcaaguga

SEQ ID NO: 53097 - RNA, 4173 nt, Artificial Sequence
  derived and/or modified sequence opt3 from ATAD2__Homo_sapiens__NP_054828
auggugguccugagaagcucccucgagcuucacaaccauucugccgcuucagcaaccggcagucuggacuugagcuccgauuucuuaucucuggaacacaucgggaggcggcgccuacgaucggccggagcggcucagaagaaacccgccgcaacaacugccaaggcuggugacggcucaagcguuaaagagguggaaacguaccaucguaccagagcacucaggagucugcggaaggaugcccaaaauuccucugacagcuccuuugagaaaaacguagaaauuacagagcagcuugcuaaugggcgccacuucacuagacagcuggccaggcagcaagcggauaagaagaaagaggaacaucgggaggacaaggugauaccugucacccgcucauugcgagcaagaaacaucgugcagaguacagaacaccuccacgaggauaauggagacguugaggugaggcggagcugccguauucgcucuagauauuccggcgucaaccagucaaugcuguuugauaaacugaucaccaauacugccgaagcugugcuccagaagauggacgauaugaaaaagaugaggcggcaacgaaugcgcgaguuagaagaccuggguguauucaacgagacagaagagagcaaucuuaacauguacaccagagggaagcagaaagauauucagaggacggacgaggaaacuaccgacaaucaggagggaaguguugaaucuuccgaggaaggcgaggaucaagagcaugaagacgauggcgaggacgaagaugacgaggaugacgaugacgaugacgacgaugacgaugacgaugacgaugaagacgaugaggacgaggaagauggggaggaagagaaccagaagcgguauuacuugcgccagagaaaagccacaguguauuaccaagcaccacuggagaagccgaggcaccagcguaaacccaauaucuuuuauagcggaccugcuucgccagcccggccccgauacagacuaucuuccgcggguccuaggucaccauacuguaagcgcaugaaccggagaaggcaugccauacacaguagcgacuccacuucuagcucaaguuccgaagaugagcagcacuucgaacgccgacggaaacguagcagaaauagggcaaucaaccgcugccucccccugaacuuucggaaggacgagcuuaagggcauuuauaaagacagaaugaagaucggggcuucucuggccgaugucgacccuaugcaguuggauucaagugugagguucgacagcgugggaggccucuccaaucauauugcugcccugaaagaaauggucguuuuuccauuacuguacccggagguguucgagaaguuuaaaauccaacccccucgagguugucucuucuaugggccacccggaaccggcaagacacuuguagcacgcgcccuggcuaacgaaugcucucagggcgauaagcggguggcguuuuucaugagaaaaggggcagacuguuugucgaagugggucggagagagcgaaaggcagcuacgucuacucuucgaucaggccuaccaaaugcgcccuuccauaaucuuuuucgacgagauugauggucuggcuccagugcggucaaguagacaggaccagauucacucuagcaucguuuccacccuucuggccuugauggauggccucgacucacgaggggaaaucguggucauuggagcaacgaauaggcuggauagcauagaccccgccuuacggcgcccgggcagauuugacagggaguuccuguuuucucuaccugauaaagaggcucggaaggaaauccucaaaauucauacucgagacuggaaccccaagccacuggauacauuccuugaggaauuggccgagaauugcguggguuauuguggggcagacaucaaguccauaugcgcggaagcugcccugugugcacucagacgcagguacccucagauuuauaccacaagugagaaacugcaacuugaucugagcucuaucaacaucuccgccaaggacuuugagguagcuaugcagaaaaugauucccgccucacagcgugcaguuacaaguccaggccaggcuuugagcaccguggucaagccccuccugcaaaauacgguggauaaaaucuuagaagcccugcagcgggucuucccucacgcggaguuuagaaccaacaagacacuagacucggauauuuccugcccacuccuggaaucugaccuugccuacagcgaugacgacgugccgucaguuuacgagaauggauugagucagaaguccucucauaaagcuaaggauaacuucaauuuucugcaccucaacaggaaugcauguuaucaacccaugagcuuccgcccucgaauacugaucgugggcgagccaggguuuggacaggguucccacuuagcccccgcuguaauucaugcccuggaaaaauucacugucuacacccuugacaucccuguguuguucggcguuucaacaacuagcccagaggaaaccugcgcacaggugaucagagaggcgaagcggacagcccccaguauugucuaugugccgcacauacauguauggugggaaaucguggggccuacccucaaagcuacuuuuacgacacugcuacagaacauuccaucuuucgcccccguucugcuccuggcaaccuccgauaagccucacagcgcccuucccgaggagguccaagaauuguuuaucagggacuacggagagauuuucaaugugcagcugccagauaaagaggaacgcacuaaguuuuucgaagacuuaauccucaagcaggcugcaaaaccucccauaucgaagaaaaaggccgugcugcaggcucuugagguccugccaguugcgccgccucccgagccacguucauugaccgccgaagaggugaaaagacucgaggaacaagaagaggauacauuucgggagcugaggaucuuccuacgcaacgugacccaccgacuggcaauugacaagagauuucggguauucacuaagcccgucgauccugacgaagugccagauuauguuacagugaucaaacagcccauggaccucucuagugucauuuccaagaucgaucugcauaaauaccuuacggugaaggacuauuugagggacauagaucugauuugcagcaacgcuuuagaguacaauccugaccgcgauccgggcgacagacucaucaggcaccgggccugugcccugcgugauaccgcuuacgcaauuaucaaagaggaacuugacgaggauuuugaacagcugugcgaggaaauacaggagucucgcaagaagcgagguuguagcuccucaaaauaugccccaaguuacuaucauguuaugcccaagcaaaacagcacucuagugggggacaaaagaucugauccugaacagaaugagaagcucaaaacaccauccacccccguagcgugcucaacuccugcucagcugaagaggaagauccggaaaaagaguaacugguacuugggcacuauuaaaaagcgcagaaaaaucagccaagccaaggacgauucccagaaugcaauugaccacaaaaucgagucugauaccgaagagacgcaggacaccucggucgaccauaacgaaacaggaaauacuggcgagagcucaguggaagagaacgagaagcagcaaaaugccuccgaaaguaagcuggaguuaaggaacaauucuaacaccuguaauauagaaaacgagcucgaagauagccggaaaacaacugcuugcaccgagcugcgagacaagauugcauguaauggggaugccuccucaucucagaucauccacauuagcgacgagaacgaaggaaaagagaugugcgugcuuagaaugacgcgcgcgaggcggagucaggucgaacagcaacagcugaucacaguugagaaggcuuuggccauucucucccagccgacccccagccuggugguagaucacgagcgucugaaaaaccugcuuaagacuguggucaagaaaucucagaauuauaacauauuccaacucgaaaaucuguacgcagugaucucacaguguauuuauagacauaggaaggaccacgauaaaacauccuugauccagaagauggagcaggaaguugagaacuuuaguugcagccgcuga

SEQ ID NO: 53098 - RNA, 1443 nt, Artificial Sequence
  derived and/or modified sequence opt3 from ATAD3B__Homo_sapiens__XP_011540545
augagaagggccaccguggagcgggaaauggagcugcgccacaagaacgaaaugcuccgagucgagacagaagcucgugcaagagccaaagcggagagggagaaugcugacaucauucgggaacagauacgccuuaaggccagcgagcauagacaaacuguucuggaauccaucaggacggcaggcaccuuguucggggagggauuucgggccuucgugacagaucgcgacaaaguaacugcuaccguggcagguuuaacacugcuagccgucggcguguacucugcuaagaacgccaccgcgguuacugggcgauuuauugaggcaagacucggaaaacccucacuggugagggaaacaagucggaucaccguccuugaggcccugcgucacccuauucaggugagccgcagauugcucuccaggccacaggauguacuggaaggcguugugcugucuccgucgcucgaggcucggguccgagacaucgccauagcaacgcgcaauacuaagaagaacagagguuuauauaggcauauccugcuuuacgggcccccuggaaccggcaaaacauuguucgcuaagaaacuggcccuacacucaggcauggauuaugcgauuaugacugggggagacguggccccaaugggucgggaaggcgugaccgcaaugcauaagcucuuugauugggcuaauacaagccgcagagggcugcuucuguucauggacgaggccgaugccuuuuugaggaaacgugcuaccgaggaaaucaguaaggaccuccgggcaacgcugaacgccuucuuauaccacaugggacagcacuccaauaaguuuaugcugguccucgcuucuaaccuucccgagcaauucgauugcgcgauuaauagccgaaucgacguuauggugcauuuugaucugccucagcaggaagagagagaaagguugguacgccuacacuucgacaacugugugcugaaaccagcaacugagggcaagcggagacucaaacuggcccaguuugacuaugguaggaagugcuccgaggucgcucgccuuacagaagggaugucaggacgagagauagcccaacuggcagugaguuggcaggccaccgcuuacgccagcaaagauggcguuuugacugaagcaaugauggacgcgugugugcaggaugcuguccagcaauaucggcagaagaugcguuggcucaaagccgagggccccgggagaggaguggaacauccucugucugguguacagggcgagacauuaaccuccuggucacuggcaacggacccaagcuacccgugccuagccgggcccuguaccuucaggauuugcaguuggaugggaacaggccucuguccugguccacugucuccccgcauguccugcgggggcggacggccuuucuguccacccggccacccgcuuuuguga

SEQ ID NO: 53099 - RNA, 1290 nt, Artificial Sequence
  derived and/or modified sequence opt3 from ATAD3C__Homo_sapiens__XP_011539310
augcagagagcccacaggcgggcugaccccagcgagcugcaaugccucgaagcaauguccaaggaugcccuuaaccuggcgcagaugcaggagcagaccuugcaauuagaacagcagucuaaacugaagcagcuagugaaugaggaccuccgcaaacaagaagagucaguccagaagcaucaccagacauuccuggagaguauccgagcugccggcacucuuuuuggggaaggauuccgugcauuuguuacggauagagacaaagugaccgccacaguagcuggucugacuuugcucgcagugggcgucuacagcgccaagaacgcuaccgccgugacagggagguauauugaggcgcggcugggaaagccuucccugguucgcgaaaccucuagaauaacugugcucgaggcauuaaggcauccaauccagcaagucucgcggcgccugcuuucacgaccgcaggauguguuggagggcguaguucugagccccagucuagaagccagagugagggacauugcuaucaugacacggaauauuaaaaagaaccguggucucuaccgccacauccugcuuuaugggccuccaggaaccggcaaaacgcuguucgccaagaaauuggcacuccauuccggcauggauuacgcuauaaugacugggggagacgucgcccccauggguagagagggcgugaccgcgaugcacaagcuguuugauugggccaauacaucuaggcggggguuacuccuguucguggacgaagcagaugcuuuucuucgaaagcgcgccacugagaaaaucagcgaagaccugagagcuaccuugaacgccuuccuauauaggacaggacagcacuccaauaaguuuaugcugauucucgcaucaugucauccugagcaauucgauugggccaucaacgcuugcauugacgucaugguucacuuugaccugccaggccaggaggaacgggcgcgccuugugagaauguaccugaaugaguauguauugaaacccgcaaccgaagguaagaggcgucucaaacuggcccaguucgauuacgggcggaaguguuuagagaucgcucgacugacggaaggaaugaguugcagaaaaauagcccagcuagcagugagcuggcaagccacugcuuacgccucuaaggacggcguccucacagaggcaaugauggaugcgugugugcaggacuuuguucagcagcaucaacagaugaugagguggcugaagggcgagcgcccugggccagaagaugagcagccguccucauga

SEQ ID NO: 53100 - RNA, 5535 nt, Artificial Sequence
  derived and/or modified sequence opt3 from ATAD5__Homo_sapiens__NP_079133
auggugggaguccuggccauggcugcagccgcggcucccccuccaguuaaggacugcgagaucgaaccguguaaaaagaggaagaaagaugacgauaccagcacuugcaaaacuauuacgaaguaccucagcccccuugggaagaccagagaccggguguucgccccuccaaaacccucuaacauacuggauuauuuucgcaagacuucaccuacuaaugagaaaacccaguugggaaaggaauguaaaaucaagaguccagagagcguacccguggacuccaacaaggauugcacgaccccuuuagaaauguucucuaaugucgaguuuaaaaagaaacgaaagcgugugaaccugucgcaccaacuaaauaacauuaaaacugagaaugaagcaccaaucgagauuucaagcgacgauaguaaggaagacuacucccucaacaaugauuucguugagucuagcacauccgugcugagauauaaaaagcaggucgaggugcuugccgaaaacauccaggacaccaagucacagccgaauacgaugacaagucugcaaaacagcaaaaagguaaaucccaaacaggguaccacaaagaacgauuuuaaaaaguugagaaagcggaaaugucgcgacguuguggaccucucugagucccugccucuggcugaggaacucaauuuacugaagaaagauggaaaggacacuaaacagauggaaaacaccacaucacaugcaaacagcagagauaaugucaccgaggccgcucagcuuaacgacaguauaaucacggugucuuacgaggaguucuugaagucccacaaggagaauaaaguggaagagauuccagauagcacuaugucgaucugcguccccucugaaacaguugacgagauugugaaguccggguauaucucagagagugaaaacagcgagauaucccaacagguaagguuuaaaaccgugacuguccuggcccaggugcauccuauuccacccaagaaaacaggaaagaucccgcggauuuucuuaaagcagaaacaauuugaaauggaaaauucucucagcgauccugaaaacgagcagaccguucagaagcgcaaaucaaauguggucauccaagaggaagaacuggaacuugcggugcuggaggcaggaaguuccgaggccguaaagcccaaauguacguuggaagaacgacagcaguucaugaaggcuuuuagacagccagccagcgacgcacucaaaaacgguguuaagaagucuucagauaaacaaaaggaccugaaugaaaaaugcuuauacgagguggggagggaugacaacaguaagaaaaucauggaaaauagcggcauucagauggucuccaagaacggcaaucugcagcuccacaccgacaagggcucuuuccuuaaagagaagaacaaaaagcugaaaaagaagaauaaaaagacauuggauacuggggcuauaccuggcaagaaccgggaggguaacacccagaagaaagaaacaacauuuuuccugaaggagaagcaauaucagaaucguaugucgcugcgccagagaaaaaccgaguucuuuaagagcuccacacucuucaacaaugagucacugguguacgaagacaucgccaacgaugaccuucugaaagucaguucuuuguguaauaacaauaagcucagcaggaaaaccuccauucccgugaaggauaucaaacugacucagucaaaggcggagagcgaggccucuuuacugaacguuuccacgccaaagaguacacggcgaagcggccgcauaucuuccacccccacuaccgaaacaauuagagggaucgacucagaugacgugcaagauaauagucagcugaaagcaagcacccagaaggcugccaaccucucggagaaacauucccuguacacugcugaacuuaucacaguaccuuuugacucugagagcccaauuaggaugaaguucacgcggaucucaaccccgaaaaagaguaagaaaaaguccaauaaacgcucugaaaagagcgaggccacugauggaggcuuuacaucccagauuagaaaagcaucaaacaccagcaagaauauaaguaaggccaaacaauugaucgagaaggcuaaagcgcugcacauuucuagguccaaggucacagaagagaucgcaaucccccuccgucggagcucgcgacaccagacucugccugaaaggaagaaacuuucagagaccgaggacucugugauuauaaucgauaguuccccaacggcccugaaacaucccgagaaaaaccagaagaaauugcaaugccucaaugacguucuggguaagaaauuaaacaccagcacaaagaacgugccugggaagaugaaagucgcuccacuguuccuagugaggaaggcccagaaagcagccgaccccguaccgucuuuugaugagagcucccaggacacuucagaaaagagucaggauugugacgugcaaugcaaagcuaagcgcgauuuccucaugagcggacugccugaccuuuugaaacggcagauugccaagaaggcagcggcucuggauguuuauaaugccgucucuaccuccuuucagagaguggugcacguccagcaaaaagacgauggcugcugucucuggcaucugaagccacccucaugcccuuuacugacaaaauucaaggagcuuaacacuaaaguuaucgacuugaguaaguguggcauugcacucggggaauuuagcacccuaaauuccaagcuaaaaucuggaaacucggccgcuguguucaugaggacgcgcaaggaguuuacagaggaagugcgaaaucugcuccuggaggaaauccgguggagcaaccccgaguucucacuuaaaaaguacuucccauugcugcucaaaaagcagauagaacaccagguacuauccagugagugccacucuaagcaggagcuggaagccgaugucagccauaaagagaccaagcguaaacuuguggaagcagaaaauuccaagucaaaaagaaagaagccuaacgaauauucuaaaaaucuggagaagacuaacaggaaaagcgaggaauugaguaagcgcaauaacuccagcgguaucaaacucgacucuucaaaggauuccggcacagaggacaugcuguggaccgaaaaauaccaaccccagacugcuagugagcuaauugggaaugagcuggccaucaagaagcuccacagcuggcugaaagacuggaagcggagagcggaacuugaggaaaggcagaacuugaaaggaaagcgagaugagaaacaugaagacuuuucgggcgguauugauuucaaggggucuuccgacgaugaggaggaaagccgccuguguaauaccguuuuaaucacaggcccaacgggagugggcaagaccgccgcugucuaugcaugcgcccaagagcucggguuuaaaauauucgaagugaacgcuucaagucagcggucuggaagacagauucugucccagcuuaaggaggccacucaaagccaccagguugacaaacagggugugaacucacagaagccgugcuuuuucaauaguuacuauaucggcaaaagcccuaagaagauuuccucucccaaaaagguagucacaagcccaaggaaagugcccccuccaucccccaagucaucugggccuaaacgugcacugccgccaaagacccuagcgaacuacuuuaaggugagucccaaaccuaagaauaacgaagagaucggaaugcuccuggagaauaacaaaggcaucaaaaauucguucgaacaaaaacagauaacacagacuaagagcaccaacgccacaaauuccaacgucaaagauguuggugcugaggaaccaucucgcaagaaugccacaucauugauucuguuugaggaaguggacguaaucuucgaugaggacgcaggguuuuuaaacgcuauuaagaccuucauggccacuaccaaacggcccgugauccucacaacuagcgauccuaccuuuucccugauguucgacggcuguuucgaggaaauaaaguuuaguacaccgucucuucugaaugucgcaagcuacuugcagaugauuugucucacggagaacuucagaaccgacgugaaagauuuuguuacucugcuaacagccaauaccugcgacaucaggaagucaauccuguaucuucaauucuggauucgauccggaggcggggugcucgaagaacggccccugacuuuguaccgcggaaacaguagaaauguccagcugguguguagcgagcaugguuuagauaacaaaaucuauccaaagaacacaaagaaaaagaggguugaccucccuaaaugcgauucuggcugcgcugaaacccuguuugggcuuaagaauauuuucucccccucagaggaccuguuuagcuucuugaaacacaagauaacgaugaaggaagaguggcacaaauuuauccagcuccugacugaguuccagaugcggaacguggauuuucuauacucgaaucuggaguucauucuuccacucccugucgacaccauccccgagacaaagaacuucuguggaccaucuguaaccguggaugcgagugccgcaacuaaauccaugaauugccuggcucgaaagcauagcgaaagagagcaaccguugaaaaagucacagaagaaaaagcagaaaaagacauuaguuauucuggacgauuccgaccucuuugauaccgaccuggacuucccugaucaaucuaucagccuuaguuccguguccucuucaaguaacgccgaagaguccaaaacaggcgacgaagagagcaaggcccgcgauaaggguaauaaccccgagacuaaaaagucuauaccaugucccccuaaaaccacggcugggaagaaaugcucggcacuggucucacacuguuugaauagccuauccgaauuuauggacaacaugaguuuccuggaugcccuccugacagacgugagggagcagaauaaguauggccguaacgauuuuucuuggaccaauggaaaaguaacuagcggccuuugcgacgaguucuccuuagagucaaacgauggguggaccagucagucuagcggagaacugaaggcggcugccgaggcacucuccuuuacaaaguguucaagcgccaucucuaaggcuuuggagacucuaaauuccugcaagaaacucggccgggacccaaccaacgaucugacguucuacgugagucagaagagaaacaaugucuauuuuagccaaucggcagccaaccuugacaaugcguggaaaaggauuuccguuaucaagucuguguucucaagccgcagucuguuguacguggguaaccgacaggcuuccauuaucgaauaccuacccacacugagaaauauauguaagaccgagaaacucaaggaacaggggaaaucuaagcggagguuuuuacauuauuucgagggcauucaccuggauaucccuaaagagacugucaacacacuugccgcagacuuuccguga

SEQ ID NO: 53101 - RNA, 1230 nt, Artificial Sequence
  derived and/or modified sequence opt3 from ATAT1__Homo_sapiens__NP_001026892
auguggcugaccuggcccuucugcuuucucacaaucacucuuagagaggaaggcgugugucaccuggagagcgucgacuugcagcaacagauuaugacgauaaucgaugaauuagggaaggccuccgcuaaagcacagaaccugucugccccuauuaccucagcgaguaggaugcagagcaaucggcauguuguguacauccuaaaggacuccucugcucgcccagccggaaaaggugcaauuaucggcuucauaaagguaggguauaaaaagcucuuugugcuggaugaccgagaggcccacaacgaagucgagccgcuuugcauccuggauuucuacauucaugagucggugcaacgucacggacauggcagagaauuguuucaguauaugcuccagaaggagaggguugaaccccaccagcuggcuaucgaccggccuucacaaaaacugcucaaguucuuaaauaaacacuacaaccuggagacaacugugccacaggucaauaacuuugugauuuucgagggguuuuucgcacaucagcacagacccccugccccaagccuucgcgcuaccaggcauagucgggccgcggcaguagaucccaccccugccgcuccagcccgcaaguugccgcccaaacgagcagaaggugacaucaagccuuauuccucuagcgauagagaguuucugaagguugcuguggaaccacccuggccucuaaauagggccccacggcgugcgacacccccggcccacccucccccacgcuccucaagucucggaaacagcccugagagaggcccccugaggccauucguccccgaacaggagcuucugcggucuuugcgacucuguccuccacacccgacugcacgccuguuacuggcugccgaccccggcggguccccugcucaaagaaggcggacacgcggaaccccacccggucucguggcccagucaugcuguuacagcagacauggcggggugaauaguucuuccccuaacacgggaaaucaggauagcaaacaaggcgagcaggaaacuaagaacaggucggcaucugaggaacaggcccuuucccaggacgguucaggggagaaaccaaugcacaccgcucccccgcaagcgccugcaccacccgcccagaguuggacagucggaggcgauauacugaaugcucguuuuauucggaacuugcaggaacgaagaagcacuaggccuugguga

SEQ ID NO: 53102 - RNA, 1116 nt, Artificial Sequence
  derived and/or modified sequence opt3 from ATCAY__Homo_sapiens__NP_149053
augggcaccacagaggccacucugagaauggaaaacguggacgucaaggaggaauggcaggaugaggaccuccccaggccucuuccagaagagacggggguugagcuguugggaagcccgguggaagauaccuccucucccccuaauacauuaaacuucaauggugcucaccggaaacgcaagacucugguagcaccagagaucaacauuucacuagaccaaagugaaggcagccuccuguccgaugacuuucuugauacccccgacgaucuggacauaaauguggaugacaucgagacaccugaugagaccgacucuuuggaguuccucgggaacggaaaugaacuggaaugggaggacgauacuccagucgccacagcgaaaaacaugcccggcgacucggcugaucuguuuggugacgggaccacggaagauggaucagccgcaaauggccgacucuggcguacugugauuaucggcgagcaggagcauagaauugacuuacacaugaucaggccuuacaugaagguugugacccaugggggauauuacggugaaggccugaacgccauaaucgucuucgcugcaugcuuucuuccagauagcaguuugccggacuaucacuacauuauggagaaucuguuccuauaugugaucuccucucucgaacugcuuguagccgaggauuacaugauuguuuaucugaacggggcuacaccccggcgcagaaugccuggaaucggcugguugaaaaaguguuaccagaugauagacaggcggcuccgcaagaaucugaaauccuuaauuaucgugcauccaagcugguuuauucgaacuguccuggccaucucaagacccuucaucagugugaaguuuauuaacaaaauacaguacgugcacagccucgaagaucuugagcaacugaucccuauggagcacguccagauuccagacugcguuuugcaguaugaagaggaaaggcuaaaggcgcggcgugagucugcacgcccccagccggaguucgugcugccuagauccgaagagaaacccgaaguagccccaguggagaauaggucagcucucgucagcgaagaccaagagaccaguaugucuuga

SEQ ID NO: 53103 - RNA, 1557 nt, Artificial Sequence
  derived and/or modified sequence opt3 from ATE1__Homo_sapiens__NP_001001976
auggccuucugggcuggcgggagccccuccguggucgacuacuuuccuucugaggauuucuauagaugcggauacuguaagaacgaaucagguaguaggagcaauggcaugugggcacacuccaugaccguucaggacuaucaagaucugaucgaccggggguggcgccgaucuggaaaauacguguauaagccaguaaugaaccagacaugcuguccgcaguacacuauucguugcagaccccuccaguuucaaccuucgaaaucacauaagaaagugcuuaagaagaugcugaaauucuuggccaagggcgaggucccaaaagguagcugugaagaugagcccauggacaguacgauggaugacgcgguggcuggggauuuugccuuaauaaauaagcuggacauccagugcgaucuaaaaacccucuccgacgauauuaaggaaucucuggagagcgagggaaagaacuccaaaaaggaggaaccucaggaacuucugcagucacaagacuucguuggcgagaaauugggcaguggggagccaagccacucugugaagguccauacagugcccaaaccuggaaagggugcagaccucuccaaaccaccguguaggaaggccaaggaaauccggaaagagcgcaagagacugaaacugaugcagcagaaucccgcuggcgaacucgagggguuucaggcacaaggacacccuccaucauuauuucccccuaaggccaaaagcaaccagccaaagagucuggaagaucuuauuuucgagucuuugcccgagaaugcuucccauaagcuggaaguaaggguugugcggagcucgccgccuucuucccaguucaaagccacucuacucgagucauaucaagucuacaagcgcuaccagauggugauccacaaaaaucccccagacaccccuacagaaagucaguuuacccgauuccugugcagcucuccccuugaggcggaaacuccacccaacggcccugauugugguuauggguccuuucaccagcaauacuggcuggacggaaagauaaucgcagugggcgucauugauaucuugccaaacugcguuagcucaguguaucucuacuaugacccggauuacaguuuccuguccuuaggcguauauagcgcccugagagagauugcuuucacaaggcagcuccaugagaaaaccucucagcuuucauacuacuauaugggguuuuacauccacaguugucccaagaugaaguauaaaggacaguaccggccuagcgaccuguugugcccagaaacguauguguggguccccauagagcaaugccuaccuucccuggaaaauucuaaguacugucguuucaaccaggauccagaggccguggacgaagaucgcucgacugagcccgacagacuccagguuuuucauaaaagggcaauuaugccguaugguguguacaagaaacagcaaaaggacccuagcgaggaagcugccguccugcaguacgcgucccuugugggccagaagugcucagagcggaugcuguuguuccgaaauuga

SEQ ID NO: 53104 - RNA, 816 nt, Artificial Sequence
  derived and/or modified sequence opt3 from ATF1__Homo_sapiens__XP_011536689
auggaggacagccacaaguccaccacaucugaaacugcuccccagccuggcucagccgugcaaggggcacauaucagucacauugcccagcaggucagcucccugucugagucggaagagucacaggauagcagugacuccauaggaucuagccaaaaagcgcaugguauccucgcuagaaggccauccuaccggaagauucuuaaagaucugucaagugaagacacgcgcggccgaaagggggauggagagaacagcggcguuucugccgcagugaccuccaugucaguaccgacacccaucuaucagacuagcaguggucaguacauugccaucgcuccuaauggggcauugcaguuagccucuccaggaaccgacggcgugcaaggccugcagacacuaaccaugacuaacuccgggagcacacagcagggaaccacgauacuccaauaugcucagacuucggauggucagcaaauccugguccccucuaaucaggugguugugcagaccgccuccggcgacaugcagacauaccaaauucguacuaccccuucagcgacaagucuuccacagaccgucgugaugacgagccccguaacucugacaucccagaccacuaaaacagaugacccucaguugaagagagagaucaggcucaugaagaaccgggaagcagcccgcgagugcagaaggaaaaagaaagaauauguuaagugucuggagaaucggguggcuguccuggagaaccaaaauaaaacccucauugaagaguuaaagacgcugaaggaucuuuacucuaacaaaagcguguga

SEQ ID NO: 53105 - RNA, 1518 nt, Artificial Sequence
  derived and/or modified sequence opt3 from ATF2__Homo_sapiens__NP_001243019
augaaguucaaacugcacgugaacagcgccagacaguacaaggaccucuggaauauguccgaugacaaacccuuucuuugcaccgcuccuggcugugggcaaagguucacaaacgaggaucaucuggcaguccacaagcauaaacacgaaaugacuuugaaguuuggaccagcccggaaugacucuguuaucguggcggaucagacgccgacccccacacgcuucuuaaagaacugcgaggaaguaggucuguuuaaugagcuagcuucaccuuucgaaaacgaguuuaaaaaggccagugaggacgauauuaaaaagaugccacucgaccugagcccccuugcaacuccuauaauccgauccaaaauugaggaaccaucuguggucgaaaccacacaucaggauucgccccugccucacccagagucaaccacuagcgacgagaaggaagugccguuggcccagacagcucaacccaccagugcaaucguucguccugccucccuccaggugccaaauguccugcugacgucuagcgauuccucagugauuauccagcaggcuguacccaguccuacuagcucuaccguuauaacacaagccccauccucaaacagacccaucgugccggucccuggccccuucccacucuuacugcaccuuccuaaugggcagacuaugcccguggcgauuccagcaagcaucaccaguucuaacgugcauguccccgccgcuguuccuuuggugaggccaguaacaauggugccguccguccccggcauuccuggaccaagcucgccccagccugugcagucugaggccaagaugcggcugaaagcagcucuaacccaacagcacccacccguuacgaauggugacacugugaaggggcauggauccggccucguccgcacacagucagaagagaguagaccgcaaagccugcagcagccugccaccuccacuacagaaaccccagcgucucccgcccacacgaccccucagacacaaagcacuucaggcaggcggcgccgagcagcuaacgaggaucccgacgagaaaagaaggaaguuucuugaacggaaucgugccgcugccagucgcuguagacagaaaaggaagguguggguacagucccuggagaaaaaggcagaagacuugagcucucucaacgggcagcugcaaucagagguuaccuuacugcggaaugaaguggcccagcucaagcagcuucuguuggcucacaaagauugcccagucacagcgaugcagaagaaaaguggauaucauacugcagacaaggaugacagcuccgaggauaucucugugccuucgagcccccacaccgaggccauacaacauuccucagucaguacaucuaacggugugagcuccaccucaaaagcugaagccguugcaacuagcgugcuaacgcagauggccgaccagucuacagagccagcucugucccagauuguaauggccccgaguagccaaucucagccuuccggcucauga

SEQ ID NO: 53106 - RNA, 408 nt, Artificial Sequence
  derived and/or modified sequence opt3 from ATF3__Homo_sapiens__NP_001035709
augaugcugcagcaccccggccaagugagcgccuccgaggucucugcuucagcaaucguuccuugccucaguccaccggggagccuuguguucgaagacuuugccaaccugacccccuucguaaaggaggaauugagauuugcgauucagaauaaacauuuaugucacaggauguccucugcucuggagucggugacagucucagaucggccucuaggagugagcauaacuaaggccgaaguugcaccagaggaggacgaacgcaaaaagcgacguagagagaggaacaaaaucgccgcugcaaagugccggaauaagaaaaaggagaaaacggaaugucuccagaagcugccccgcccuuucugggugcagaaaaccugcauuugggccgucgauaguuguaaguga

SEQ ID NO: 53107 - RNA, 1056 nt, Artificial Sequence
  derived and/or modified sequence opt3 from ATF4__Homo_sapiens__NP_001666
augaccgagaugagcuuccuguccucugaagugcucgucggcgaccuuaugucacccuuugaucagagugggcugggagccgaggaaagccuggguuuacuggacgauuaccuagagguugcuaagcacuucaaaccucauggcuuuuccucugacaaggcaaaagccgggucgucagaauggcucgcgguggauggacugguaagcccaaguaacaauuccaaggaggacgcuuucucuggcacagauuggaugcuugagaaaauggaccugaaggaauuugauuuggacgcccuccuggguaucgaugaccuggagacuaugccggaugaccucuuaacgacccuggacgauacaugcgaccuuuucgcacccuuggugcaagaaacuaacaagcagccuccacagaccgucaaucccauugggcacuugccugagagccuaacaaaaccagaucagguggcccccuuuaccuuccuccaaccucugccacuuuccccgggaguucugucaaguacucccgaccauagcuuuucuuuggagcucggcuccgaaguggauauaacagagggcgacagaaagccugauuauaccgcuuacgucgcaaugaucccacaguguauuaaagaagaggacacgcccucagauaacgacagcgggaucugcaugaguccugaaucuuaucugggauccccacagcacagccccucgacuagggguucuccgaaucgguccuuaccuucacccggcgugcugugugggagugcccgcccaaagccuuacgaucccccaggagagaaaaugguagcugccaagguuaagggcgagaaacucgacaagaaacuuaagaaaauggaacagaacaagaccgcggcaacacgauaucgucagaaaaagagagccgagcaagaagcucugacuggugagugcaaggaauuggagaaaaagaaugaggcccuaaaagaaagggcagacagccuggcuaaggagauucaguaccucaaagaucugaucgaagaggugcggaaggcccgcgggaagaaaagaguccccuga

SEQ ID NO: 53108 - RNA, 849 nt, Artificial Sequence
  derived and/or modified sequence opt3 from ATF5__Homo_sapiens__NP_001277675
augagccugcucgccacccuuggccuggaguuggacagagcuuuacugcccgcauccgggcuaggauggcucguggauuacgguaagcugccuccagccccggcgccccuugcuccuuaugaaguccugggcggggccuuggagggaggccucccaguugguggggaaccccuggcaggagacggcuucucugauuggaugacagagaggguggacuuuacugcccugcucccuuuagaaccaccccugccuccaggcacgcuuccgcagcccucaccuaccccacccgauuuggaggcuauggcaagucugcucaaaaaggagcuagaacaaauggaggacuucuuucuggaugccccuccacuucccccgccuagcccacccccucugcccccacccccuuugccaccggcucccucccucccucugucuuuaccaucguucgaccugccccagccuccaguacucgauacacuugaccuguuggccaucuacugccggaacgaagcggggcaggaggaggugggaaugcccccgcuaccuccaccccagcaaccucccccaccuucacccccacagccgagccgccuggcaccuuauccccacccagccacuacccgaggugaucguaaacagaagaaaagagaccagaauaagagugcugcccucagguaccggcaacgcaagagagcagaaggcgaggcucuggaaggggagugucagggacuugaagccaggaaccgggagcugaaagagcgcgcggaauccgucgagcgagaaauucaguaugugaaggauuugcucauagagguuuacaaagccagaucucagaggacacggagcugcuga

SEQ ID NO: 53109 - RNA, 2103 nt, Artificial Sequence
  derived and/or modified sequence opt3 from ATF6B__Homo_sapiens__NP_001129625
auggccgagcugaugcuccuuagcgaaaucgcugaccccaccagauucuuuacagauaaccuguuguccccugaggacugggauucuacuuuauacucaggccuggacgaaguggcagaggaacagacgcaacuauucaggugcccagagcaggaugucccguuugacgggaguagccucgauguuggaauggacgugucccccucugagccuccaugggaacugcuucccauuuucccugaucugcagguaaagucggagccaucaagccccuguaguuccucuagcuuguccucagaaaguagccggcucucuaccgagccuuccucagaggcccugggugugggcgaaguccugcacgugaaaacagagagccucgcgccaccguuaugccugcuuggggacgaucccacuucaucuuuugaaaccguucagauaaaugugaucccuacauccgacgauagcucggacguccaaaccaagauugagccagugucucccuguuccucaguaaacagugaagcuagcuugcuguccgccgacucuagcucacaggcauucaucggagaggagguucuagaagugaaaacugagagucucuccccuagcggcugccugcuuugggaugucccagcccccucucugggugcugugcagauuucaauggggccgaguuuggacggaagcuccggcaaggcacucccuacacgcaaacccccacugcagccuaagcccguggucuuaaccacgguuccaaugcccucucgagccgugccuccaucgacuaccguacugcuccaaagccuugugcagccgcccccugucuccccagugguucugauccagggcgcuauacgugugcagcccgaagggccugccccaucauugcccagaccggagaggaagaguaucgucccugcgccaaugcccggaaauucuuguccucccgaaguggaugcaaaacuacugaagcggcaacagcgcaugauuaaaaacagagagagcgccugccaguccaggcggaagaaaaaggaguaucuccaaggucuggaagcucgccuucaggccguacuggcagacaaucagcaguugcgaagagagaacgcugcccucaggcggcgucuggaagcguuacuggccgagaauagugaacuaaagcucggcagcgggaaccgcaaaguuguguguaucauggucuuucugcuuuucauugcauuuaauuucggaccagugucuaucuccgagccucccagugcuccaauaagcccgagaaugaacaagggcgagccucaacccaggcggcauuugcuggguuuuucugaacaggagccaguccaggggguggaaccccuccagggauccucacaaggcccuaaagagccacagcccaguccuacagaucagccgagcuucucgaaucugacugccuuuccaggcggggcuaaggagcuucuguugcgagaccucgaucagcuguucuuauccucugacugccgccacuucaacagaaccgaaagccugaggcuagccgaugagcucucaggauggguucaacggcaucagcgcgguagaaggaaaauuccccagcgugcacaggaacggcaaaagagucagccucgaaagaaauccccacccgugaaggccguaccuauccagccgcccggcccaccugagagagacucugucgggcaacugcagcuuuacaggcaccccgaucgcagccagccagcguuuuuggacgcuauugaccggagagaagauacauucuaugugguuuccuuuaggcgcgaccaucugcuccugccugcaaucucacacaauaaaaccagccgacccaagaugaguuuagugaugccagccauggcuccgaacgagacgcugucuggacggggcgccccuggugauuacgaggaaaugaugcagaucgagugugaagucauggacacucgugugauucacauaaaaacauccaccguacccccaagccuuagaaagcaacccucgccuacuccagggaaugcaacaggcggacccuugccugugucagccgcuucucaggcccaucaggcaagucaccagccgcucuaucugaaccauccauga

SEQ ID NO: 53110 - RNA, 2013 nt, Artificial Sequence
  derived and/or modified sequence opt3 from ATF6__Homo_sapiens__NP_031374
augggcgagcccgccgggguggcuggaaccauggaaagcccuuucuccccaggucuguuucacagacucgacgaggauugggacucugcacuuuucgccgaacugggcuacuuuacagauacugacgaguugcaguuagaagcggcuaacgagacguaugagaauaacuucgauaaucuggacuuugaucuagaccucaugccgugggaaucagauaucugggacauuaacaaucaaauaugcaccgucaaggauaucaaagccgagccccagccucugaguccagcaagcuccucuuacucgguuucaagccccaggaguguggacuccuauucuagcacacagcauguaccugaggaacuugaucuguccucaaguagccagaugucuccauugucccucuacggggagaacucaaauagccugaguucugccgaaccccugaaggaggacaaaccugugacuggaccacggaacaagaccgaaaauggccucacaccgaaaaagaagauucaagucaacuccaaacccagcauccagccuaagccauuacugcuucccgcugcaccuaaaacccagacuaauucgucugugccagccaagacaauuaucauacagaccguucccacguugaugccgcuggcuaaacaacagccuaucauuucccuacagcccgccccaacuaagggucagaccgugcuccugucacaaccuacagucgugcagcuucaggcgcccgggguacugccaagugcacaacccguuuuggccguggcuggaggcgucacucagcucccuaaccacguggugaaugucguuccagccccgagcgcaaacucccccgugaauggcaagcugucuguaaccaaaccuguguuacagagcacaaugcgcaacgucgggucagacaucgcugugcugcgacgucagcaaagaaugauuaagaacagggagagugccugucagucccggaaaaagaaaaaggaauauaugcucggacuugaggcgcgccugaaagccgcauugagcgagaaugaacagcuaaagaaggagaacgguacccugaaaagacagcucgaugaaguugugucugagaaucaaaggcugaaggucccaucacccaaacggcgcgugguaugcguuaugaucgugcuugcuuucauaauucugaacuacggcccuaugaguauguuggaacaggacagccgaagaaugaauccauccgucucucccgccaaccagaggcggcaucuccugggguuuucggcuaaggaggcccaggauacgagcgacggaaucauucagaaaaauuccuaucguuacgaucacucagugaguaacgacaaggcauuaaugguccugacugaggaaccgcuacucuacaucccuccacccccuugucaaccccugaucaauacaaccgagucucuucgcuugaaccaugaacugagaggcugggugcacaggcacgagguugaacggacuaagagccgacgcaugacaaauaaccagcagaaaaccaggauucuccaaggugcccuggagcagggguccaauucacagcuuauggcugugcaauauacggagaccacaagcucuauauccagaaacaguggaagcgaacugcagguauacuaugcgucuccacgguccuaccaggauuucuuugaggcaauccgcagaaggggcgacacuuucuaugucgugucauuucgucgggaucauuugcuccugccugccaccacacacaauaagacuacccgacccaaaaugaguauuguuuuaccagcuaucaacauaaacgaaaaugugauuaacggccaggacuacgaggucaugaugcaaaucgauugccaggugauggacacaagaauccugcauauuaagagcucguccguaccgccuuaucuaagggaccagcagcgcaaucaaaccaacacuuucuuugggucucccccagccgcaacggaggccacacacgugguuagcaccauccccgaaucacuccaguga

SEQ ID NO: 53111 - RNA, 1389 nt, Artificial Sequence
  derived and/or modified sequence opt3 from ATF7__Homo_sapiens__NP_001123532
augggcgacgauagacccuucgugugcaacgccccuggguguggacagagguuuaccaaugaggaccaccuggcuguccauaagcacaaacaugaaaugacacucaaguucgguccagcacggacugauagcguuaucauugccgaccaaacgccgacccccacacgcuuucuuaaaaacugcgaggaagugggccuguucaaugaguuggcguccucuuuugaacacgaguucaagaaagcugccgaugaggacgaaaagaaggcagccgcugggccuuuagauaugucacugccaaguacucccgacauaaaaaucaaggaggaagaaccuguagaggaagugaccccaaaacccguccuaauuagcacaccuaccccaacuaucgugcgaccgggaucccucccccugcaucuuggcuacgauccucugcacccaacauugcccucuccuaccucgguuauuacgcaggcaccacccucaaaccgucagauggguagcccgacugggagucucccucuggugaugcaccuggccaauggacagaccaugcccguccucccaggcccucccgugcaaaugccauccguaaucucuuuagcuagacccguuagcauggugccuaacauaccaggcaucccggggcccccugucaauuccucaggaaguauuagcccaucuggucaucccaucccuuccgaggccaagaugaggcugaaagcgacacuuacucaccaggugucaagcauuaacggcggguguggaaugguggucggcaccgcaaguacaaugguuaccgcccggccagaacagucucagaucuugauacaacaucccgacgcuccguccccugcccagccacaggugagccccgcacagccuacgcccucgacuggugggcgcagaaggcggacaguagaugaggacccagaugaacgccgacaaagauuucuggagaggaaucgggcugccgcgucucguugccgccagaagagaaagcuauggguguccucacucgagaaaaaggccgaggagcugaccagucagaacauucaacuuagcaaugaagucacucuguugaggaacgagguggcacagcucaaacagcuguuacuggcucacaaggacuguccuguuacagcccuccagaaaaagacccaaggauaucuugaaucccccaaagagucuagcgagccaacgggcucaccggcuccugugauccagcacaguuccgccaccgcacccagcaauggccugucuguccggucagccgcugaagcgguggcaacaaguguauugacucagauggccagccagcgaaccgagcuauccaugccaauucaaucucauguuaucaugacaccccagucgcagagcgcugggcgcuga

SEQ ID NO: 53112 - RNA, 3318 nt, Artificial Sequence
  derived and/or modified sequence opt3 from ATF7IP__Homo_sapiens__NP_001273444
auggacagccuggaggaaccccagaagaaaguguucaaggccagaaaaaccaugagggucuccgaucggcaacagcucgaggcuguuuacaaggugaaagaggaacuucugaagacagacguaaaguuguuaaacggcaaucacgaaaacggggaucuggacccuacuucuccacuagagaauauggauuauaucaaagacaaggaggaagugaacggaauugaggaaauaugcuuugauccggaggguucaaaagcagaguggaaggaaacgcccuguauccucagugucaaugugaaaaacaagcaggacgaugaccugaauugcgagccucuuagcccacauaacauuacccccgaaccuguuuccaagcugccagccgagcccgugucuggcgauccugcgccaggggacuuggaugcuggagacccggccucgggcguccucgcaucaggugacagcacaaguggggaucccacuuccucugaaccuagcuccucagacgccgcuaguggagaugcaaccagcggcgacgccccaucuggcgaugugucccccggggacgcuacaucaggagaugccaccgcggacgaucugagcaguggugacccuacuucuuccgauccaauccccggcgagccgguaccuguugagcccauuagcggggacugugcagccgacgauaucgcuucgucugaaauaacauccguggaccuggccucaggagcaccagcuaguaccgauccugccagcgacgaucucgcguccggcgacuuaucuagcucagagcuggccagugaugaccuugcaacgggugaauuggcuuccgaugagcugacuagcgaaucuaccuucgaccgcacauuugagcccaaaucagucccagugugcgagcccgugccugaaaucgauaauauugagccaaguagcaacaaggacgaugacuuccuagagaaaaauggggccgacgaaaagcucgaacagauccaauccaaagauucucuggacgagaagaacaaagcugauaauaacauugacgccaaugaggaaacucuugagaccgaugacacaaccaucuguucggaucgaccgcccgaaaacgagaagaaggucgaggaagacauaauuacggagcuggcauugggagaagaugccaucagcuccucaauggagauugaccagggcgagaaaaacgaagaugagacaagugcugaccucguugaaacuaucaaugagaacgugaucgaagauaauaagucugagaacauucuggaaaauaccgacagcauggagacugacgagauaaucccuauuuuagaaaaacuggcgccauccgaggaugaacucacaugcuuuucaaagaccagccuucugcccaucgacgagacgaacccugauuuggaagagaaaauggagucuuccuucggcaguccaagcaagcaggaaucuuccgagucacuacccaaggaagcauuucugguacucagugacgaggaggauauaagcggggaaaaagacgagucggaagugauuucccagaaugagaccuguucuccggaagucgagagcaacgagaaggauaauaaaccugaagaggaggaacaagugauccacgaagacgaugagcguccaucagagaagaacgaguucaguagaaggaaacgguccaagucugaagacauggauaauguucagagcaagcgcagaagguacauggaagaggaauaugaggccgaguuucaggugaaaaucacagcuaagggagacauuaaccagaaacugcaaaaggucauccaguggcuucuggaagagaaauugugcgcccuccagugugcaguguucgacaagacucuggccgaauuaaagacccggguagagaaaauugagugcaauaagcgccauaaaacaguucugacugaacuacaagcuaagauagcccgacucaccaaaagauuugaggcagcgaaggaagaucugaaaaagaggcacgagcaucccccuaaucccccaguguccccugguaagacagucaacgacgugaacucaaacaauaacaugagcuaccggaaugcuggcaccguccgucagaugcuugaaaguaaacgcaacgugucugaguccgccccacccagcuuccagacuccgguuaauacggugucgucaacaaacuugguaaccccucccgcagucgugucuagucagccaaagcugcaaacucccguuaccuccgggagccucacagccaccucugugcugccugcuccaaauacugccacagucguggcaacgacccagguacccagcggaaacccucagccgacuaucucccuucagccacugcccgugauuuugcacguuccugucgcugugucaagucaaccacagcuccugcagagccaccccggcacauuagugaccaaucagccuucugguaacgucgaguuuaucuccguucaaucaccgcccacagugagugggcugacuaaaaauccagugagccuaccuucccuccccaacccaaccaagccuaauaacguacccucugucccaucgccgagcauccagagaaauccuacggccucagcggcuccccugggcaccacacuugccgugcaggcaguuccaacugcccauuccauugugcaggcuaccaggacaaguuugcccacugucggaccuucuggccuguauagcccauccaccaaccgggggcccauacaaaugaaaaucccuauuucagccuucucuacgagcagugcagcggaacagaacuccaauacaaccccgcgaaucgagaaccagacuaauaagacaauugaugccagcgugucuaagaaagcugccgacucaaccucccaauguggaaaggcaacugguagugauagcucgggcguuaucgaccucaccauggaugacgaagagucuggggcuucccaggaucccaaaaagcugaaccacacaccagugagcacgaugucaaguucucagccuguaucccgccccuuacagccaauacaaccugcacccccacugcagccuagcggagucccgaccucaggccccagucagacuacaauccaucuuuugccaaccgccccuacaacugugaaugugacccacagacccgucacgcagguuacaaccaggcucccagugccucgggcccccgcuaaccaccaaguaguguacacuacccugccggcgccuccagcccaggcaccccuacgcgguacagucaugcaggcuccagccgugagacagguuaauccccaaaacagcaaaagguucuuucuguauauggccccucguuacauguga

SEQ ID NO: 53113 - RNA, 663 nt, Artificial Sequence
  derived and/or modified sequence opt3 from ATG10__Homo_sapiens__XP_005248667
auggaggaagacgaguucaucggcgaaaagaccuuucagagauacugcgccgaguucauuaaacacagccaacagauaggggauuccugggaauggaggcccucuaaggacuguucagauggauauaugugcaaaauccauuuucagauuaagaacgguagugugaugagccaccugggcgcuuccacacaugggcagacuugucucccuauggaggaggcauucgaacuuccacuggacgauugcgaggucaucgaaacggccgcggcuucugagguuauuaaauacgaguaucacguguuguacucguguucauaucaaguaccgguguuauacuuucgggccagcuuccuggacggacgcccccuaacccucaaggauaucugggaaggcguccaugagugcuauaagaugcgacugcuucaggguccuugggacacaauaacucagcaggaacacccaauccuggggcaacccuuuuucguguugcacccuuguaaaaccaaugaguuuaugacaccaguucucaagaacagucagaaaauuaauaagaacgugaauuacaucaccuccuggcugucuauugucggacccgugguaggccugaaccucccuuuaagcuacgcaaaagccacuucccaggaugaacguaauguuccauga

SEQ ID NO: 53114 - RNA, 225 nt, Artificial Sequence
  derived and/or modified sequence opt3 from ATG12__Homo_sapiens__NP_001264712
auggccgaggaaccccagagcgugcugcaacucccuaccuccaucgcugcaggcggggagggacuuacagacgucucuccagaaacuacgaccccggagcccccuucaagugccgcgguuagcccagguacagaggaacccgcuggcgauacuaagaaaaagauuuaccugugcgaguccguguuguguucuuucccuagaccaaggucguggaacucauuauga

SEQ ID NO: 53115 - RNA, 1767 nt, Artificial Sequence
  derived and/or modified sequence opt3 from ATG16L1__Homo_sapiens__NP_060444
augagcuccggccugagagccgcugacuuccccagguggaagcggcacaucucugagcagcuccgccgacgugauagacuucaaaggcaggcauuugaagagauuauacugcaguacaacaaauuguuagaaaagucagaccugcauagugugcuagcccagaaacuccaagcggagaagcacgaugucccuaaucggcaugaaaucagcccagggcacgacggaaccuggaacgauaaucagcugcaggagauggcucagcuucgcauuaaacaucaagaggaacugacagaguugcacaagaagagaggugaacucgcccagcugguuaucgaccugaacaaucagaugcagaggaaagaucgggagaugcaaaugaacgaggcaaagauugccgaaugccuccagacuaucuccgacuuagagacggaaugucuggaucuucgcaccaaauugugcgaccuggagcgagcuaaucagacacuaaaggaugaauaugacgcacuccaaauaacuuucaccgcccuggagggcaaacuuagaaagacaaccgaggaaaaccaggagcuggugacuagguggauggcugaaaaggcccaggaggcgaaucgguugaacgcagaaaaugagaaagauucucgucgcagacaggccaggcuccaaaaggagcuggcugaagccgcaaaagagccguuacccguagaacaggacgacgauaucgaggugauugucgacgaaacaucggaucacaccgaggagacgucaccugugcgggcuaucagccgagccgcgacucgcagaaguguuuccucuuuuccagugccccaggacaacgucgauacccauccugggagcggaaaggaagugaggguaccagccacagcacuguguguuuucgacgcucacgauggcgaggugaaugccguccaguuuucccccgguucacggcuccuugcuacugggggaauggaccgcagagugaaacugugggaaguguucggcgagaagugcgaguuuaaaggcaguuugagcgggucuaacgccggaauuaccuccaucgaguucgauucagcagguagcuaccuacuggccgcuaguaaugacuuugcgucuaggauauggacagucgaugacuaucgucuccggcauacccugacgggccacuccgggaagguucuuagcgcaaaguuccuguuggacaacgcccgaauugugucgggaucucacgauagaacucucaaacugugggacuuaagguccaagguauguaucaaaacaguguuugcuggcucaaguugcaacgauauugucuguaccgaacaaugcgugaugagcggucauuucgacaagaaaauccgcuuuugggauauccgguccgaaucuauuguuagagagauggaacugcuagggaagauaacugcccucgaccugaauccugagaggacagagcuuuugagcuguucacgcgaugaccugcucaaggugaucgaucugcgaaccaacgcaauuaaacagacguucagugccccaggauucaagugcggcuccgacuggacccgggucguguuuagcccggauggcucuuacguagcugccgggucagcagaaggaagucuuuauaucuggagcguucugacagguaaaguggagaaggucuuguccaaacagcacucuucgagcauaaaugcgguggcuuggucccccucaggcagucaugucgugucuguugacaagggguguaaggccgugcucugggcacaguacuga

SEQ ID NO: 53116 - RNA, 6237 nt, Artificial Sequence
  derived and/or modified sequence opt3 from ATG2B__Homo_sapiens__NP_060506
augcccuggccuuucagcgaauccaucaagaaacgagccugcagguaccugcuccagcgguaucuuggccacuuucugcaagaaaaguugucuuuagaacagcugucacuagaccucuaccaggggaccggaagucuggcucaggugccacuugauaaauggugucugaacgaaauuuuggaaagcgcugacgccccgcucgaagucacagaggguuucauacaauccaucucucugucgguucccuggggcucacugcuccaggauaauugcgcguuagaggugcgcgggcuggaaauggucuuucgaccucguccaagacccgcuacuggaagcgagccuauguauuggaguuccuucaugacgucuagcaugcagcuugccaaggaauguuugucccagaaacugaccgacgagcaaggcgaggguucacagccauuugaagggcuagagaaguucgcagaaacaauugagacugugcucaggcgggucaaggugaccuuuaucgauacaguucugcgcauugaacaugugcccgagaacaguaaaaccggaacugcccuugagaucagaauagaaaggacagucuacugcgacgagaccgcugaugaaagcucuggcaucaaugugcaccagccuacggcauucgcccauaagcuguugcagcucuccggcguaucacuguuuugggacgaguucagcgcuagugccaaaucuuccccaguuuguagcacugcgccgguggaaaccgagcccaaguuaucgccuucuuggaacccaaaaauuaucuaugagccccacccucaacugacacggaaucucccagaaauugcacccuccgauccgguccagaucgggcgccuuauaggacgacuggaguugucacuaacucugaagcagaacgaagugcucccuggugccaagcuggacguggauggccaaauugacaguauccaucuucuguugagccccagacagguccaccuccuguuagauaugcuggcugccauugcagggccagaaaacuccucuaaaaucggacuagcuaacaaggacaggaaaaaucggccuaugcagcaggaagacgaguaccguauccaaauggagcucaaccgcuauuaccugagaaaggauagccuuucaguuggcgugaguuccgaacagagcuuuuacgagaccgaaacagccaggacccccucuucacgggaggaggaaguuuucuuuaguauggcggacauggauaugagccacuccuugucuucgcugccaccccucggugacccuccaaauauggaucuggagcuuagccugacguccacuuauacaaacaccccggccgggucacccuugagugcaacugugcuccagccuacauggggagaguuccuggaccaucacaaagagcagccaguccgaggcucuaccuuccccagcaauuuagugcauccuacgccacugcaaaagaccucccuacccucacgcagcguuucuguggaugaauccagaccggagcucauuuuuaggcuggcugucggcacauucaguauaagcgugcuucacaucgacccuuugucuccacccgagacuucccagaaccugaauccucucacccccauggccguagcauuuuucacaugcauugagaaaaucgauccagcccgguuuucaacugaggacuucaagaguuuucgcgcaguuuucgccgaggcuuguagccacgaucaucugagauuuauagggaccggaauuaaggugucguacgagcagaggcagcguuccgcgucucgguauuucagcacagacaugucaaucggucaaauggaauuuuuagagugccuguucccuaccgacuuucacaguguacccccacauuacacugagcuuuugacguuccacuccaaagaagagacaggcucucauagcccggugugucuccagcugcacuauaagcacuccgaaaaccgagggccucagggaaaccaggcaagacuaucaagcgucccccauaaagccgagcugcaaaucaagcucaauccagugugcugugaacuggauauuaguaucguugacaggcuuaacucuuugcugcagccccagaaauuagcuaccguggagaugauggccucccacauguacacuagcuauaauaagcauauuucgcuccacaaggcauucaccgagguauuucuggaugacucacacucuccugccaacugccgcauaaguguccaaguggcuacaccagcccuuaaucuguccguucgguuccccaucccugauuugagaagcgaccaggaaaggggcccgugguuuaaaaagucucuccagaaagagauucuguaccuagcauucaccgaucuggaauuuaagacugaguucaucggugggagcacaccagagcagaucaaacucgaacugacguuucgcgagcuuauuggcuccuuccaagaagagaagggagaccccucaauaaaguuuuuccaugugaguagcggcgucgauggggacaccacuucuuccgaugacuuugauuggccucgaaucguguugaaaauuaacccacccgcgaugcacucaauccuggaacggauugcugccgaggaggaagaggaaaaugacggacauuaccaggaggaagaggaggguggcgcacacaguuuaaaggacguaugcgaucuccguagaccugccccgagccccuucuccucuaggcgcgugauguuugaaaacgagcagaugguuaugccaggggacccugucgaaaugacagaguuccaggauaaagcuaucucgaauagccauuaugugcuggaacuuacccugcccaacauauacgugacacuaccaaauaagucauucuaugagaaacucuacaaccggaucuuuaaugaccuguugcugugggagccuacugcccccuccccagucgaaaccuucgagaacauuaguuauggaaucggcuuaucuguugcaagccaacucauuaauacguuuaacaaggauuccuucucagcuuuuaagucugccgugcacuacgacgaagagagcgguagugaggaagagacccugcaguauuucuccacaguggauccgaacuacagaagcaggcgcaaaaagaaacuugacucucagaauaagaacucacaguccuuucugaguguauugcucaauaucaaccacgggcugauagcggucuucacugaugugaaacaagacaauggcgaucuacuggaaaacaagcauggagaguuuuggcuugaguucaauagcggcucgcucuuuuguguuaccaaauacgagggguucgacgauaagcacuauauuugccugcauucuuccagcuucucauuguaccacaagggaaucgugaacggugucauucugccuacagagacuagauuacccaguucuacccggccacauuggcucgaacccacgaucuauuccagcgaggaagacggccugucaaaaacaaguagcgacggggugggaggcgauucccuuaauaugcugucuguugccgugaagauauugagcgacaaauccgagucaaacaccaaggaauuucucaucgcuguaggucugaaaggggcaacucuacagcacagaaugcugccuucuggccuuaguuggcacgagcagauucucuacuuccugaauaucgccgaugagccagucuugggauauaaucccccuacaucguuuaccacuuuccaugugcacuuauggagcugugcucuggacuacaggccgcucuaucugccaauucguucccuucugaccguggaaacauuuucugucucaagcuccguugccuuggauaagaguucuagcacgcuacgcaucauacuggacgaggcagcgcuccaucugucagauaagugcaauaccgugacuauuaaccuuucccgggacuacguaagagugauggauaugggcuuacuggaacucacaaucaccgccgucaaaagugacagcgauggggagcaaacagaacccagguucgaguugcacuguucuuccgacgugguucacauccgaacuugcucagacagcugugcugcccugaugaaucucauucaguacaucgcaucguauggagaucugcagaccccuaacaaggcugacaugaaacccggcgccuuucagcggcgcucuaagguggauaguuccgguagaagcucauccagggggccaguccuuccugaggcagaccaacagaugcugcgggauuugaugucugacgccauggaagagauugauaugcagcagggaacgagcagugugaaaccccaagcuaacggcguucuagacgaaaagucccagauacaggagccaugcuguagcgaucuguuccucuuuccugacgagucugguaaugugucacaggaaaguggcccgacauacgcguccuucagccaucacuuuaucucugaugccaugaccgggguccccacugagaacgacgauuucugcauuuuauuugcaccaaaggcugccaugcaagaaaaagaggaagaaccuguaaucaagauuaugguggacgacgccaucguuauacgagauaauuauuucucgcugcccgugaacaaaaccgacacaucaaaggcuccacuucauuucccuauccccgucauuagauacgugguaaaagaggugagccuggucuggcaccucuauggaggcaaggauuuugggacuguuccgccaaccuccccugcaaagaguuacaucucuccccauagcuccccaucacacacacccacgcgccacggaaggaauaccguguguggcgguaaagggcguaaccaugacuucuugauggaaauucagcugaguaaggugaaauuucagcacgaggucuauccuccgugcaagcccgauugcgacucuagccucuccgaacauccagugucacggcagguuuucaucguacaagaucuggagauaagagacaggcuugccacuagccagaugaauaaauuucuauaccuguacuguucuaaggaaaugccucgcaaagcgcacuccaacauguugacagugaaggcuuuacacgucugccccgagaguggacgaagcccucaggaguguugccugagagugucgcucaugccacugcggcuuaauauugaucaagacgcccuguucuuucucaaggauuucuuuaccuccuugucugcagaaguugagcugcagaugacucccgacccugaagugaaaaagucaccaggcgccgaugucacauguagccuacccaggcaucugaguaccuccaaagagccgaaccucgugaucucuuucagcgguccuaagcagccaucacagaaugacuccgcuaacaguguagaagucgugaauggcauggaggagaaaaacuuuagcgcagaagaggccucuuuccgcgaccaacccguauuuuuccgugaguucagauuuacgucagaggugccuauccggcuugauuaucacgggaagcaugucuccauggaccagggaacucuggcgggcauuuuaauaggguuggcucagcugaauugcagcgagcucaagcugaaaaggcuuucuuaccgccacggacugcucggcguggauaaguuguucaguuaugccaucaccgaauggcugaacgacauuaaaaagaaccaguuaccagguauccuagggggaguuggccccaugcauucgcuggugcaacucguccagggucuuaaagaucuggugugguugccgauugagcaguaccgaaaggacggcagaaucguacggggguuucagaggggagcagccuccuucggcacaagcaccgcuauggccgcacuggaacucacuaaucgcauggugcaaacaauacaggcugccgcggagaccgccuaugauaugguuucaccugggacacugucuaucgaacccaagaaaacuaagagauuuccacaccacaggcuugcacaucagccugucgaccuccgggagggaguggcuaaagccuacagcguggucaaggagggcauuaccgauacggcucaaacaaucuaugaaaccgcagcccgugagcacgaaucccgcgguguaacuggggccgugggagagguucugcgacagauucccccagcuguggucaaacccuugaucguggcgaccgaagcaacaaguaacguucugggcggcaugagaaaucagauaaggccugacgugcggcaggaugagucacaaaaguggcgccauggggacgacuga

SEQ ID NO: 53117 - RNA, 945 nt, Artificial Sequence
  derived and/or modified sequence opt3 from ATG3__Homo_sapiens__NP_071933
augcagaacgugaucaauaccgucaagggcaaagcccuggagguugcugaauaccucacacccgugcuuaaggagagcaaauucaaggaaacugggguaauuacgccugaggaauuuguggcagccggagaccaccugguccaucacugcccaaccuggcaaugggcgacaggugaggaguugaaagugaaggcuuauuuaccgacuggcaagcaguuccugguuaccaaaaacgugcccuguuacaagagaugcaaacagauggaauauuccgaugagcuagaagccauaaucgaggaggacgauggggacggaggcugggucgauacauaccauaauaccgguauuacugggaucacagaagcagugaaggagauuacccucgaaaacaaagacaauaucaggcugcaggauuguucugcccuuugcgaggaagaggaggacgaagaugagggagaagcugcagacauggaggaauaugaggagucaggccuguuggaaacggaugaggccacucucgacacccggaagauaguagaggcuuguaaggccaaaacagaugcgggcggggaagacgcaauccugcaaacucgcaccuacgaccuguauauuacauacgauaaguacuaucagaccccucgacucugguuauuuggauacgacgaacagcgucagccacugacgguugagcacauguaugaggauaucagucaagaccaugugaaaaagacugucacaauugaaaaccacccccaccuuccuccacccccuaugugcagcgugcauccauguagacacgccgaggugaugaaaaagaucauagaaaccgucgcugaggguggcggggaguugggaguucauauguaccugcuaauuuuccucaaauuugugcaggccguaaucccgacuauugaauaugauuacacaaggcacuucaccauguga

SEQ ID NO: 53118 - RNA, 1197 nt, Artificial Sequence
  derived and/or modified sequence opt3 from ATG4A__Homo_sapiens__NP_443168
auggagagcgugcuguccaaguacgaagaccagaucaccauuuucacagauuaucucgaggaauaccccgacacugaugagcuugucuggauacugggcaaacaacacuuguuaaagacggaaaaaucuaagcugcuaucagacaucagugccagacucugguuuaccuauaggcggaaauucagcccuauugggggaacagguccauccucugaugcuggcugggggugcaugcugcgcuguggacagaugaugcuugcacaggcccugaucugccgacauuugggccgugacuggucgugggagaagcagaaggagcaaccgaaagaauaccagaggauucuccaguguuuucuggauagaaaggacugcuguuauucaauccaccagauggcgcaaauggguguuggggagggaaaaagcauaggcgaaugguucggccccaacacuguggcucagguacugaagaaacucgccuuauuugaugaguggaauagucuggcaguguacgucuccauggacaacaccgugguuaucgaggauauuaagaagaugugccgggugcuuccuuugucugccgacacagcuggggaucgcccacccgacagccugaccgcauccaaucagucaaaaggaacuuccgccuauuguagcgcuuggaagccucuacuccugaucgucccacuuagacuggguauuaaccagaucaaucccguguacguagacgccuucaaagaaugcuuuaagaugccucaaucuuugggcgcgcucgggggaaaaccaaacaaugcauacuauuucauaggcuuucugggugaugaguuaauuuuccuggacccgcauacaacccagacguuuguugauacugaagagaacgggaccgugaaugaccagacauuccacugucuccaaaguccccagaggaugaacauccuuaaucuggauccuucagucgccuugggauuuuucugcaaggaagagaaagacuucgauaacugguguagccuagugcagaaggagauucugaaggaaaaucuccggauguuugagcuggugcagaaacauccaagucacuggcccccuuucgucccacccgcuaagccggaaguuacuaccacaggcgccgaguuuaucgacucuaccgaacaacuugaggaguucgaucuggaagaggacuuugaaaucuuguccguguga

SEQ ID NO: 53119 - RNA, 1182 nt, Artificial Sequence
  derived and/or modified sequence opt3 from ATG4B__Homo_sapiens__NP_037457
auggacgccgcuacccugacauacgauacucucagauucgcagaguuugaagacuuccccgagacgagcgaaccuguguggauccuuggcaggaaguauuccauuuuuaccgagaaagaugaaauacugucugacgucgccucacgguugugguucacauaccgcaagaacuuuccagcgaucgggggaacugguccgaccagugauacaggcugggggugcauguuacgauguggacagaugauuuucgcucaagcccugguuugccgucaccuaggcagagacuggagguggacccagcggaaacgccagcccgauagcuauuuuuccgugcucaaugcauucaucgacagaaaggauucuuacuauucgauucaucagaucgcccaaauggguguaggggagggaaaaucaauaggccagugguacggcccuaacacuguggcucagguccugaagaaacuugcaguguuugacacauggagcagucuggccguucacaucgcuauggauaauaccguggucauggaggaaauuaggcgguugugucgcacguccgugccaugcgccggggcgacugcauuccccgccgacucugaucgacauuguaacggauuuccugcuggugccgagguaaccaauagaccaagccccuggaggccucucguucugcugaucccacuccgguuaggccugacagacauuaacgaagcauauguggagacucuuaagcacugcuucaugaugccgcaguccuugggggucaucggaggcaagcccaauucagcucauuacuuuauagguuacgugggggaggaacugauuuaucuagacccucacaccacacaaccagccguggagcccaccgauggauguuucaucccugacgaaaguuuccacugccagcauccacccugucguaugagcauugcggagcucgauccgucuaucgccgucggcuuuuucugcaaaacggaagacgauuuuaacgacuggugucagcagguuaagaaacugucccuucugggcggggcauugccuauguucgagcucguggagcugcaacccucacacuuagcuugcccagauguacugaaucucagccuugacaguucugauguggaacgccuggagagauuuuucgacuccgaagaugaggacuuugaaaucuugagccuauga

SEQ ID NO: 53120 - RNA, 1272 nt, Artificial Sequence
  derived and/or modified sequence opt3 from ATG4C__Homo_sapiens__XP_011540615
auggaggccaccggcacagacgaaguggauaagcugaaaacuaaguucaucagcgcuuggaacaauaugaaauacuccuggguccucaagacgaaaaccuauuuuucuagaaacucacccguucuucuguuggggaagugcuaccacuucaaguaugaggacgaagauaaaacauuaccugcagagaguggauguacuauugaagaccaugugauagccgguaauguagaggaguuuaggaaggauuucaucagccggauuuggcugaccuaccgcgaagaguuuccacagaucgaaggcuccgcgcuaacaaccgacugcggguggggauguacucuccgaacaggccaaaugcugcuugcucagggucugauuuugcacuuccucgggcgugccuggaccuggccggaugcacugaacaucgaaaauucugacucggagucauggacgagccauacugugaaaaaguuuaccgccaguuucgaggcuucccugucuggagagagagaauuuaaaacacccacuauaagccucaaggagaccaucggcaaguauuccgaugaccacgaaaugaggaacgaggucuaccaucggaaaauuaucucaugguucggcgauaguccuuuagcacuguuugggcuucaccaguugauugaguauggaaagaaaagcgguaagaaagccggcgacugguacgggccagcugugguugcccacauccugcgcaaggcgguggaagaggcaagacaucccgaucuacagggaauaacaauuuacgucgcccaagacugcaccguguauaauucugacguaaucgauaaacaguccgcuucaaugacgagcgacaacgccgaugacaaggcaguuauuauccucgugccugucaggcugggcggugaacggacuaauacagauuaccuugaguucgugaaggggauccugaguuuggaauauugugugggaauuauaggcggcaaaccaaagcagucuuacuauuuugcuggguuccaggacgauucccucaucuacauggacccccacuauugccagagcuucgucgauguuucgauuaaagacuuuccucuggagaccuuccauuguccaucuccgaagaaaauguccuuucgcaagauggaucccucaugcacuaucggauucuacugucgaaacgugcaagacuuuaagagagccagugaggaaauaaccaaaaaucagauuaugaucaaggcggccaucauuaacauccacguacaggacuucauguggacauga

SEQ ID NO: 53121 - RNA, 828 nt, Artificial Sequence
  derived and/or modified sequence opt3 from ATG5__Homo_sapiens__NP_001273035
augaccgacgauaaggacgugcugagagaugucugguucggcaggauccccacaugcuuuacucucuaccaggacgagauuacggaacgggaggccgaaccuuauuaccuucuguugccacgcguuagcuauuuaacccuggugacagauaaaguaaagaaacacuuccaaaaggugaugcgacaggaggacauauccgaaaucugguuugaguacgaggggacuccgcuaaaauggcauuaucccauuggacuccuguucgaucuucuggcuucuucaagugcauugccuuggaacaucaccguccacuuuaagagcuucccagaaaaggaccuccugcauugucccuccaaagaugccauugaggcgcacuuuaugucuugcaugaaggaagcugacgcccugaaacauaagucacaggugaucaaugagaugcagaaaaaggaucacaagcaacucuggauggguuuacagaacgaccguuucgaucaguuuugggcaauaaauagaaaacugauggaguacccugccgaagagaacggcuucagguauaucccauuucggauuuaccagacaaccacugaacgccccuucauccaaaaacuuuuuagaccuguugcugcagacgggcaguugcacacacugggagaccuacucaaggagguguguccaucggccauugauccggaagacggcgagaagaaaaaucaggucaugauccaugguauagagcccaugcuggaaaccccucuucaguggcugagcgagcacuugaguuacccagauaacuuccuccauauuuccaucauuccccaaccuacggacuga

SEQ ID NO: 53122 - RNA, 2031 nt, Artificial Sequence
  derived and/or modified sequence opt3 from ATG7__Homo_sapiens__NP_001129503
auggccgcugcaaccggcgaccccgggcugagcaagcuccaguucgccccuuuuuccucugcgcuugaugugggauucuggcacgagcugacacagaaaaaguugaacgaauacagauuagacgaggcuccaaaagauaucaaggguuauuacuauaauggcgacucagccgggcugccggcaaggcuaacucucgaauuuagugccuucgauaugagcgcucccacgccugcacggugcuguccagccauuggaacccuguacaacacaaauacucuugaguccuuuaaaaccgcugacaagaagcuguugcucgaacaagccgcgaacgagauaugggagucuaucaaaucgggcacagcacuggaaaaucccguccugcucaacaaguucuuacugcuuaccuuugccgauuugaaaaaguaucauuucuacuauugguuuugcuacccugcucugugucuaccagagucacucccccugauucaggguccuguugggcuugaccagcgcuucagccugaaacaaaucgaagccuuggagugcgcauacgauaaucucugucagacugagggagugacagcucugccauauuuucuaauuaaguacgacgaaaacaugguacuggugagucuccuuaagcacuauuccgauuucuuucagggccagcgaaccaaaaucacgauaggcgucuacgacccgugcaaucuggcccaauaucccggguggccuuugcguaacuuccuagugcuggcggcccauagauggucuagcuccuuccagucaguugagguggucuguuuuagggaucggacuaugcagggagcacgcgacguggcucacaguaucauuuucgaaguaaagcucccagagauggccuuuagccccgacugcccuaaagcuguugguugggaaaagaaucagaaaggcgggaugggaccaagaauggugaaccugucugaguguauggaucccaagaggcuugccgaguccucagucgaccugaauuugaaacucaugugcuggcggcuggugccgaccuuagaucuggacaagguggucagcguuaagugucuacuccugggcgcagguacacuugggugcaacguggcccgcacuuugaugggauggggcguacgacauaucaccuucguggauaaugcuaaaauuaguuacucuaacccugucagacaaccccuguaugaauuugaggacugccucggcgggggaaagccaaaagcgcuggcagccgcugauaggcuucagaagaucuucccuggugugaacgcccggggcuuuaauauguccauacccaugccagggcaccccguuaacuucagcucggugacacuggaacaggcacgucgcgacgucgagcaauuggaacagcucauugagucucacgaugugguauuucuguuaauggacaccagagaguccagguggcugccugccguuaucgcugccucaaaacggaagcuagugauuaaugcagcgcucggauucgauacguuugucgugaugcgacauggccugaagaaaccaaagcagcagggugcuggggaccuuuguccgaaccaccccgucgccagugcagacuugcugggcagcucccucuucgccaauaucccuggauacaaacugggcugcuacuuuuguaacgaugugguugcuccaggggacucuacucgcgauagaacauuagaccaacagugcaccgugagcaggcccggacuggccguaaucgcuggugcacuugccgucgaauugauggugucaguucuccagcauccugagggcggguaugcgauugccaguuccagcgaugaccggaugaaugaaccacccacuucucugggauuagugccgcaccagguccuggaucaauacgagcgcgaaggcuucaacuuccucgcuaagguguuuaauucaagucacagcuuccuggaggaccuuacagguuugacccuguuacaucaggagacgcaggcagccgaaauaugggauauguccgacgaugagaccaucuga

SEQ ID NO: 53123 - RNA, 2520 nt, Artificial Sequence
  derived and/or modified sequence opt3 from ATG9A__Homo_sapiens__NP_001070666
auggcccaguucgacaccgaguaccaaagacuggaagcuagcuauuccgauucucccccuggcgaggaagaccuccuugugcacgucgcagaggggucaaagaguccauggcaucacaucgaaaaccuggauuuguuuuucagcaggguuuacaauuuacaucagaaaaacggauuuacaugcaugcugauuggugagauauucgagcuaaugcaguuucucuucgugguagccuuuacuacguuccugguguccugugucgacuaugauauccuuuuugcgaauaagauggugaaccacucucugcauccgaccgaacccguuaaagugacauugccugacgcuuuccucccagcccaggucugcucggcacggauucaagagaauggcucacugaucacuauucuggugaucgccgggguauuuuggauacaccgccucaucaaguucauuuacaacaucuguugcuauugggaaauucacagcuuuuacuuacaugcucugcgaauccccaugagugcacuuccuuauuguaccuggcaggagguucaggcccguauagugcagacacaaaaagagcaccagauuugcauccauaagagagaauugaccgagcuggauauuuaccacaggauccuacgguuccagaauuacauggucgcucucgugaacaagucccugcuuccacugcgcuucagauugcccggacucggcgaagccguguuuuucacuaggggucugaaauauaauuuugaguuaauccuguucugggggccuggaucucucuuucuuaacgaauggagccugaaggcggaguacaaacggggcggccagcgcuuggagcuagcacaacgacuguccaauagaauuuuauggauagggaucgccaacuuccugcuuuguccacugauuuugaucuggcagauacucuaugccuuuuucucauacgcugaaguccugaagagggagccgggagcauuaggugcucggugcuggagucuguauggccguuguuaccuacgccacuuuaaugaacucgagcaugaacugcagagcagacuuaacaggggguauaaacccgccucuaaguacaugaauugcuucuuguccccucugcucacacugcuugcgaagaacggagccuuuuucgcaggcucaauucuggcuguuuugaucgcccucaccaucuacgacgaggaugugcuggcuguagagcacguguuaacgacugucacccugcuaggugugacaguuacugugugucggagcuuuauuccagaccaacauauggucuucugccccgaacagcuccugcgagugauccuugcccacauucauuauaugccugaucacuggcaggggaacgcacaccgcagucagaccagagacgaguucgcccaauuguuucaguacaaagcuguauucauacuggaggagcuccugucuccaaucguuacacccuuaauucugaucuuuugccuuaggccgcgggcguuggaaaucauugauuucuuucgcaauuucaccguggaggucgugggagucggcgacacguguuccuuugcacagauggacgugagacagcauggccacccucaauggcucagcgccgggcagacugaggcuucgguuuaucagcaggccgaagauggaaagacagagcugucucuaaugcauuucgcaauaaccaaccccgguuggcaaccaccuagggaauccacugccuuucugggcuuccucaaagaacaggugcagcgugacggggcugccgcaucacuggcgcagggaggccuuuugcccgagaaugcucuguuuacaaguauccaaagccuccaguccgaaucugagccacucagccugauugccaacguagucgcagguucaaguugccgggggcccccucuuccacgagaucugcagggcuccagacacagggccgaaguggcuagcgccuugcgcucuuucucaccgcuccaacccggacaggcaccuaccggccgggcucacaguacgaugaccgggagcggaguugacgccagaacagcguccucugguucgagcgugugggagggccagcugcagucccuaguccugucagaauacgccaguacugagaugucucuccaugcucuguauaugcaccaacuucauaagcagcaggcacaggccgagccagaaaggcacguguggcaucgccgagagagcgaugaauccggggagucagcucccgacgaaggaggcgagggugcccgggcaccucaaagcaucccacguucugcguccuaccccugugccgcuccgagaccuggggccccagagaccacagcauugcacggcggauuucagaggcgcuauggcgggauuacugaucccggaaccguaccucgggugcccagucacuucagcagacugccauuagguggcugggcugaagacgggcagucugccuccaggcauccugagcccguuccagaagagggaucagaagaugagcucccgccucagguccacaaaguguga

SEQ ID NO: 53124 - RNA, 1779 nt, Artificial Sequence
  derived and/or modified sequence opt3 from ATIC__Homo_sapiens__NP_004035
auggcccccggccagcuggcucucuucagcguguccgacaagaccgggcuugucgaguuugcaagaaaccugacagccuugggauuaaaucugguugcgucugguggcacugcuaaagcccuaagggaugcagggcucgccgugcgggacguaucagaacugacgggauucccugagaugcuuggcggucgcgugaagacccugcacccagcuguccaugcagggaucuuggcccgaaacauuccggaagauaaugcugacauggcccgucucgauuuuaaccugauaagagugguugcgugcaaucuguaccccuucgugaaaacagucgcaaguccuggagugacuguagaggaagccguugagcaaaucgacauuggcggcgugacccucuuaagggcugccgcaaagaaccacgcucgggucacaguggugugugagccagaagauuaugucguugugagcaccgagaugcaguccucugaaucgaaagacacuucacuggagacacgcagacagcuugccuugaaggcguuuacccauacggcccaguacgaugaggcaaucagcgacuauuucaggaagcaauacaguaaagggguaucccagaugccccugcgguauggaaugaauccucaccagacuccagcucagcuauacacccuccaacccaagcugccuauuacagugcuuaacggugccccaggcuuuaucaaucugugcgaugcuuugaacgccuggcagcucgucaaagaacugaaggaggcauuagggauaccggccgcugcgucuuucaaacaugugagccccgcaggagccgcuguuggcaucccucuguccgaagacgaggccaagguguguauggucuaugaucucuacaagacucuuaccccaauuucagcagccuacgcucgcgcccgaggugcagacagaaugaguagcuuuggggacuucguggcgcugucugauguaugcgacguucccacagcuaaaaucauuuccagggaagugucagauggaaucauagccccuggcuaugaggaggaagcauugaccauucuaagcaagaaaaagaauggcaacuacuguguccugcagauggaccagaguuauaaaccagaugagaaugaagugcggacgcucuuugggcugcaccuuucucaaaagcguaacaauggagucguggacaaaucccuguucagcaacguugugacuaagaacaaggauuugcccgagucggcccuccgcgaccugaucguagcuacaauugccgucaaauacacccagucuaauuccgugugcuaugcaaagaacggucagguuaucggcaucggggcuggacaacagucaaggauucacuguacuagauuagccggcgauaaagcgaauuacugguggcugcggcaucacccucaggugcuaaguaugaaguuuaaaacaggugucaagcgagccgaaauaagcaacgcuaucgaccaguaugugaccgggacgauuggcgaggaugaggaccucaucaaguggaaagcacuguucgaagagguaccggaacuuuugaccgaggccgaaaagaaagaguggguggagaagcugacagaaguuuccauaucuagcgacgcuuucuuucccuuccgcgauaaugucgacagagccaaaaggucaggaguggcauacauugcggccccaaguggcuccgcugccgauaagguggucaucgaggcaugcgacgaacucgggaucauucuggcucauacuaaccuucggcuguuucaccacuga

SEQ ID NO: 53125 - RNA, 1662 nt, Artificial Sequence
  derived and/or modified sequence opt3 from ATL1__Homo_sapiens__NP_001121185
auggccaagaacagaagggaccggaauagcuggggcggguucuccgagaaaaccuacgaauggucuucagaggaagaggaacccgugaagaaagcuggaccuguccagguucugaucgugaaggaugaccacaguuuugagcucgaugagacagcacuuaaccgcauucuguugagcgaagccguacgagacaaagagguggucgcgguguccguugcuggugccuuccguaagggcaagucuuucuuaauggauuucaugcugagauauauguacaaucaagaaucgguggacugggucggggauuauaacgagccacuaacuggauuuucauggaggggcgguagcgagcgggaaacgaccgggauacagaucuggagugagauuuuccucaucaauaaaccggacggaaagaaaguggcaguacugcuuauggauacacagggcacuuuugacucccagucuacccugcgcgauagcgccacaguuuucgcuuuguccaccaugauuucaaguauccaaguguacaaccucagccagaauguccaggaagacgaucugcagcaucugcaacucuuuacugaguauggcagauuagcaauggaagagacauuccugaagcccuuucagucucuuauauucuuggugagggacugguccuuuccuuacgaguucucauauggggccgacggaggugcuaaauuccuggaaaagcggcuaaaggugagcggcaaccagcacgaggaacuccagaauguccgcaaacauauccacaguugcuuuaccaacauuucuuguuuccugcuuccacaucccgggcugaagguugccacgaauccuaacuuugauggaaaauugaaggagaucgacgaugaauuuauuaaaaaucucaagauccugauaccaugguuacugucccccgagagccucgacauuaaagagaucaacggcaauaagauuacuugccgaggucuuguggaauacuuuaaggcguacaucaaaaucuaucaaggggaggaacugccucacccaaagucgauguugcaggcaaccgccgaggcuaacaaccuagccgcaguagcuacagccaaagauacuuacaauaagaaaauggaagagauuuguggaggcgacaagccguuccuggcgcccaacgaucuccagaccaagcaucugcaacuuaaagaggaaucugugaagcuguuuagaggcgucaaaaagaugggaggggaggaguucuccaggcgguauuugcagcagcucgaaucagagauagacgaacuguacauccaguauauuaaacacaaugauaguaagaacaucuuucacgccgcacguaccccugcuacauuauucgugguuauauuuauuacguacgugaucgccggugucacuggcuucaucgggcuggacauuaucgcuagccuaugcaauaugauuaugggacucacacugauaacccuuuguacuugggccuauauccgcuacuccggcgaguacagagaauugggugcagugauugaucaaguagccgcugcgcugugggaccaggcacucuauaagcuguacucugccgcugccacacauaggcaccuuuaucaccaggcauuuccaacccccaaaagcgagucaacggaacagagugagaagaaaaagauguga

SEQ ID NO: 53126 - RNA, 1752 nt, Artificial Sequence
  derived and/or modified sequence opt3 from ATL2__Homo_sapiens__NP_001129145
auggccgagggcgacgaagcugcaagagggcagcaaccccaccagggacuguggaggcggcgccgaaccagcgauccuuccgccgcggugaaccaugucucuucaacaacgagucucggugagaauuacgaagacgaugaccuuguuaacagcgaugaggugaugaagaaaccaugcccgguacagaucgugcuggcucacgaagacgaucauaauuucgaguuggacgaggaagccuuagagcagauucugcuacaagaacacauacgugaucucaacaucgucgugguuuccguggcaggcgccuuuagaaaggggaaaucuuuccugcuugacuuuaugcugagguauauguacaauaaggauucgcagucauggauuggaggcaacaaugagcccuugacugguuucaccuggcgcgggggaugugagcgggaaacaacuggcauccaggucuggaacgagguguuuguaauugacagaccuaauggcaccaaaguugcugugcuccugauggauacacagggggcauucgacagccaaaguaccaucaaggacugcgccacugucuuugcucuguccacaaugaccucuagcguccagguguauaaccucucccagaauauacaggaagaugacuuacaacaucugcagcuuuucacggaguacggaagguuggccauggaagagaucuaucagaagccauuucaaacucugauguuccuaauucgggauuggucauaccccuaugagcacaguuacggucucgaaggcgggaaacaguuucuggagaagcgccuucaggugaaacagaaccaacacgaggaacugcagaauguucgaaagcauauccacaacuguuucagcaauuugggaugcuuucuccugccucauccaggcuuaaaaguggcgaccaaccccucuuucgacgguagacugaaggauauugacgaagauuucaagagggagcuccggaaccuuguaccucuguugcuagcaccagagaaucugguggaaaaagagaucuccgggucaaaggucacaugucgugaccucguggaauacuuuaaagccuauauaaagauuuaccagggagaggaacugccgcaccccaaaagcaugcuucaggcuacugccgaggcaaacaaucuggcugccguugcgggcgcccgcgauaccuauugcaagaguauggagcaaguguguggcggggacaaaccuuacaucgcaccaucugauuuggaaagaaagcaccucgaccugaaggaggucgcuauuaaacaguucagguccgugaagaaaaugggaggugacgaauuuugccggcgauaucaggaucaguuagaggccgagaucgaagagacauacgcuaacuucaucaagcauaaugacggcaaaaacauuuucuaugccgcacgcacccccgccacgcuguucgcuguaauguuugcgauguacauaaucagcgggcuaacuggauucauuggccucaauucgaucgcaguucuguguaaccuugugauggguuuggcccugauauuucucugcacaugggcuuacgucaaguauucuggggaauuuagagagauuggcaccgugaucgaucaaaucgccgaaacucugugggagcagguccuuaagccucugggagacaauuugauggaggaaaacauuaggcaguccgugacaaauucaaucaaagcaggccucaccgaucagguuagucaccaugcccggcugaagacggacuga

SEQ ID NO: 53127 - RNA, 1572 nt, Artificial Sequence
  derived and/or modified sequence opt3 from ATL3__Homo_sapiens__NP_001276977
auggagagcuccaagcccggcccugugcaggucguucuggugcaaaaagaccagcacucuuucgaacucgaugagaaggcccuugcuucaauccuguugcaggaccauauuagagauuuagacguaguggucgugaguguugcaggggccuuuaggaaaggaaagagcuucauacuggauuuuaugcuacgguaccucuauucccagaaagaaucuggucacucgaacuggcugggcgacccagaggaaccgcuuaccggguucucauggcgcggaggcagcgaucccgagacaacugguauccaaauuuggagugagguguuuacggucgaaaagccugggggaaagaaaguggcgguaguucugauggacacccagggcgcuuucgauucccagucuacagugaaggacugcgccacuaucuuugcauugagcaccaugacauccucaguccagauuuacaaucucagucaaaacauccaggaggaugaccugcagcagcugcaacucuucaccgaauauggccgauuagccauggaugagauauuucagaaaccauuccagacucugauguuucuugugcgugacuggagcuuccccuacgaguauucuuacggguugcaaggagguauggcuuuucuggacaagagacuacaggugaaagaacaucagcacgaggaaauccagaaugucaggaaccauauucacuccuguuucucagauguuacaugcuuccuccugccucacccaggccuucaaguggcaaccagccccgacuuugaugggaagcugaaggacaucgccggagaguucaaagaacaguugcaggcucucauuccuuauguacugaauccaaguaaguuaauggagaaagagaucaacggcucuaaggugacgugucggggucugcucgaauacuuuaaagccuacauaaagauuuaucagggggaggaucuuccgcaucccaaauccaugcugcaagcgacugcagaagccaauaacuuggcugccgcagcuagcgccaaggacaucuacuauaauaacauggaggaagucugcggaggcgagaagccuuaccuaucgccagauauucuggaggaaaaacacugugaguucaagcagcucgcgcuggaccauuuuaaaaagaccaaaaagaugggcgggaaggauuucucuuuucgcuaucagcaggaacuugaggaagagaucaaagagcuguacgaaaauuucugcaagcacaacggauccaaaaauguguuuucaacauucagaacucccgccguuuuguuuaccgguaucguggcacucuauauugcuaguggccugacaggguucauaggauuagaggucguggcccaacuguuuaacuguaugguaggccuacuccugaucgcucuuuugaccugggguuacauuagguacagcgggcaguaucgggaacugggcggagccaucgacuucggcgcagccuacguucucgagcaggcuuccucucacauagggaauagcacgcaggcgacugugcgcgaugcagucgugggacgaccuucaauggacaagaaagcccaauga

SEQ ID NO: 53128 - RNA, 9171 nt, Artificial Sequence
  derived and/or modified sequence opt3 from ATM__Homo_sapiens__XP_006718906
augagccuggugcucaacgaccuucugaucugcuguagacaguuggagcacgauagggccaccgaacggaagaaagaggucgaaaaguucaaacgcuuaauucgagaccccgagacaauaaagcaucuggaucgucacuccgacucuaaacaaggcaaguaccuaaauugggaugcuguuuuuagauuccuccagaaguauauccagaaagaaacugagugccugaggauugcaaagccuaacgugucagccaguacgcaggcgagccggcaaaaaaagaugcaggagaucuccucucuuguaaaauacuuuauuaagugugcuaaucgcagagccccaaggcugaagugccaggaauugcucaacuauaucauggacaccgugaaagauucgucaaauggggcaauauacggagccgacuguagcaacauccugcugaaggauauucucaguguccggaaauauuggugcgagaucucccagcaacagugguuagaacuguucucuguguacuuucgccuuuauuugaagccgagccaggacguucaucgagugcuggucgcuagaauuauccacgcagugacaaaagguuguugcucccagacugauggccuaaauucaaaguuccucgacuuuuucaguaaagccauacaaugugcuaggcaggagaagagcucuuccgggcugaaccauauucuugccgcgcugaccaucuuuuugaagacacucgcaguaaauuuccggauucguguuugcgagcugggagaugaaaucuuacccacccugcucuacaucuggacucagcaccgccuuaacgacucacugaaagaggugauuauagaauuguuucaacuacagaucuacauucaccauccuaagggcgccaaaacacaggagaagggugcuuaugaaagcaccaaauggagaaguauccuguacaaucucuaugaccugcuugucaacgagauaucucacauuggguccaggggaaaguacagcucgggcuuccggaauaucgccgugaaggagaaccugaucgaauugauggcagauauuugucaucagguguuuaaugaggacacgcgaucucucgaaaucucccaaucauauacuaccacacagcgcgagaguagcgauuacuccgucccaugcaaaagaaagaaaauugaacugggcugggagguuauaaaggaccacuuacagaaaucucagaacgauuucgaccuggugcccuggcuacaaaucgcuacucagcucauuagcaaguauccugccucacugccaaacugcgagcuuagucccuugcugaugauccucucccagcugcuuccucagcaaaggcacggggaacggaccccauacguacugcgcuguuugacagagguggcgcucugccaggauaagagaagcaaucuggaaucuucacagaaaagugacuuacugaagcuauggaacaaaaucugguguauuaccuucaggggaauaagcuccgagcagauccaagccgaaaauuuuggucuccugggcgcaauuauccaggggucucuugucgagguggaucgugaguucuggaaguuguuuacgggaucggcuugccggccgagcugucccgccguuugcugucugacucucgcucugacaaccuccauugugccuggcacugucaaaauggguaucgaacagaacaugugcgaggugaaucgaucauucaguuuaaaggaaucuauaaugaaguggcugcuuuuuuaccaauuggagggggaccucgagaacagcacagaaguaccacccauccugcauuccaauuucccucaccuaguucuggagaaaauucucgugucacugaccaugaagaacuguaaagccgcaaugaauuuuuuccagagcgucccagaaugcgagcaucaccagaaggauaaagaagagcuuucuuuuuccgagguggaagaguuguuccugcagacgaccuuugacaagauggacuucuuaacaaucgucagagaauguggaauugagaaacaucaaaguagcaucggcuuuucugugcaccagaaccucaaggaaucccuggauaggugccuucugggcuugucagagcagcuccugaauaacuauaguagcgagauaacuaauucggaaacccuaguucgcugcucccggcugcucguggggguacugggauguuacugcuauaugggugucauugccgaggaagaggcuuacaagucugaacuuuuccagaaagcgaagagcuugaugcaaugugcaggcgagucaaucacacuguucaaaaacaagacuaaugaggaauuuagaauugggaguuuaaggaacaugaugcagcucugcacccgcugucuguccaacugcacaaaaaagucucccaauaagaucgccagcggauucuuucuucgacugcuaaccuccaaacucaugaacgacauagcugauaucuguaagucacuggccagcuucauuaaaaagccguuugaccggggcgagguggaaaguauggaggaugacacuaaugguaacuugauggagguugaagaucagucuuccaugaaucuguucaacgacuauccugauagcucggugucagacgcaaaugagcccggggaaucucagaguacgaucggcgccauuaacccauuagcugaggaauaccucuccaaacaagaucugcuuuuucuggacauguugaaguuccucugccugugugucacaaccgcccagacuaauaccgugagcuuucgugcagcggauaucagaaggaagcuacugaugcuuauagacucuagcacacucgagccuaccaaaucccugcacuugcauauguaucugauguuacucaaggagcugcccggagaagaguacccacuucccauggaagacguacuggaguugcucaaaccucugucaaacgugugcagucuauaccgccgggaucaggacguuuguaagacuauucugaaucacguccuucauguggugaaaaaccucggccaaagcaauauggauucugaaaacacaagagacgcucaggggcaguuccugacggucaucggagccuuuuggcacuugaccaaggagaggaaguauaucuucuccguucgaauggcauuagugaauugccugaaaacucuccuggaggccgauccauacucaaagugggcuauucuuaacgugauggguaaagacuuuccgguaaacgaagucuucacacaguuccuggccgauaaucaccaucaagugcgcauguuggcagcugagaguaucaaccggcuauuucaggacaccaagggcgauagcuccagacugcucaaagcccugccccuuaaguuacagcagacagcguucgaaaaugccuaucugaaagcucaagaggggaugagggaaaugucucacucggcagagaacccugagacucucgacgaaauuuacaaucguaagagcguuuugcugacccucauagccgugguccugucaugcuccccaaucugugagaagcaggcucuuuuugcccugugcaaaagugugaaggaaaacggauuggagccccaucuaguuaaaaaggugcuggagaaaguaucugaaacguucggcuaucgccggcucgaggauuuuauggcaagccacuuagacuaccugguccuugaauggcugaaucuccaggauaccgaguauaacuuguccucauucccuuuuauucugcucaauuacacaaacaucgaagacuucuacagaucuuguuauaaggugcugauuccacaucuugugaucaggagccacuuugacgaggucaagaguauagcgaaucagauccaagaggauuggaaaucccuacugacugacugcuuccccaagauuuugguuaacaucuuaccguacuuugccuaugaagguacccgagauagcgggauggcucagcagcgggagacagccacuaaaguguacgacaugcugaagucugaaaaucuccugggcaaacagauugaucaccuuuucaucucaaaccugccugagauaguaguggaacucuugaugacccugcaugagccagcaaauuccagugcuagccaaucgacggaccuaugugauuucucuggagaccuggaucccgccccuaaccccccacacuuuccuucccaugucauuaaggcaacauucgccuauaucagcaacugccacaagaccaaacucaagucaauccuugagauucugaguaaaucucccgacuccuaccagaagauauuauuggcuaucugugaacaggcggccgagacuaauaacguguauaaaaagcaucgcauucugaagaucuaccaccucuuuguuagccugcuucugaaagauauuaagucaggccucgggggagcaugggcuuucguguugagagacgucaucuacacacugauacacuauaucaaucaaaggccaaguugcauuauggacgugagcuuacgguccuuuucucuauguugcgaucugcucagccagguuugucagaccgccgugacuuacugcaaagacgcccuugaaaaccaucugcacgucaucguagguaccuugauuccgcugguguaugagcagguugaagugcaaaagcagguccucgaucugcuuaaauaccucgugaucgacaauaaggauaacgagaaucuguauauaacaauuaaguugcuggacccuuuccccgaucauguaguguuuaaagacuuacgaaucacgcagcagaagaucaaauacuccagaggcccauucucacuacuggaggaaauuaaccacuuucucucugucaguguuuaugaugcucuuccccugacccgcuuggaggggcugaaggaccucaggcgucaacuggaacuucacaaagaucagaugguggacaucaugcgggcaucgcaggauaauccucaggacggaauaauggugaaguuagucgugaaccugcuccaauugagcaaaauggccauuaaucauacuggcgagaaggagguucuggaagcgguagguuccugccuaggggaggugggcccaaucgacuucucuacaauugcuauccagcacucaaaggaugccagcuacaccaaagcacugaagcucuuugaagacaaagagcuucaguggacauucauaaugcugacuuacuugaacaauacccuggucgaagauugugugaagguuagauccgccgcugugacgugccucaaaaacauucuggcaacaaagaccggacauaguuuuugggagaucuauaagaugacuaccgaccccauguuagccuaccuucaaccuuucaggacaucucgcaaaaaguuccuggaggucccgcgauuugauaaagaaaauccauucgagggccucgacgauaucaaccuauggauuccccugagcgaaaaucacgacaucuggauuaagacuuugaccugugcguuucuggauucagggggaacaaaaugcgagauacuccagcuucugaagccuaugugugaagugaagacggacuucugccagaccguauugccauaucugauccaugauauucucuuacaggacacuaacgaguccuggagaaaccugcuuaguacacacguccaaggcuuuuucaccagcugucugcggcacuuuucucagacuuccaggucaacaacccccgcuaaucuagauagcgagucggaacauuucuuucgcugcugucucgacaaaaagucucagcguacgaugcuggccgugguugacuacaugagacggcagaaaaggccuaguuccgguacuaucuucaacgaugcauuuugguuggaccugaauuaucucgagguggccaaggucgcucaaagcugcgccgcacacuucaccgcucuucuguacgccgaaaucuaugcggauaaaaagucaauggacgaucaggagaagcgcuccuuagccuuugaagaggggucucagagcacaaccauuaguucccugagcgagaaaucuaaggaagagacuggaauaucauugcaggaccuccugcuagaaaucuaccgaaguauuggcgagccggauucccuuuacgguuguggcgggggaaaaaugcugcaacccaucacaagacuccggaccuaugagcaugaagcaauguggggcaaggcucuggugacauacgacuuggagacugccauuccaagcucuaccaggcaggcugggaucauacaggcacugcagaaccucggacuuugccacauccugucgguuuauuuaaaaggccuggauuacgaaaauaaggacuggugcccugaguuggaagagcuccacuaucaagccgccuggcgcaacaugcagugggaucauuguacgucagugagcaaagaggucgaagguacauccuaccacgagagucuguauaaugcucuacagucucuuagagacagggaauucagcaccuucuacgagucccugaaguacgcgcgggugaaggaaguagaggagaugugcaaacguucacucgaaaguguguauucucuguaccccacuuugagccgcuuacaagcaauuggggagcuggaauccaucggagagcucuuuucacgaagcguuacccauagacagcuuucugaagucuauauuaaguggcagaaacacucccagcugcuaaaggacagugauuucagcuuucaagagccaaucauggcccugaggacagugauacucgagauuuugauggaaaaagagauggacaacucgcagcgggaauguaucaaggauauucugacuaagcaucuuguggagcuguccauccucgcucgcaccuucaaaaauacgcaguuaccugagagagccauauuucagaucaagcaauacaacucugucucaugcggcguaagcgaauggcagcuggaggaagcacagguguucugggccaaaaaggagcagaguuuggcucuguccauucucaaacaaaugaucaagaagcuugacgcgucuugugccgcaaauaaccccagccugaaacuaacauauaccgaaugccugaggguuugugguaauuggcucgcugagacuugcuuggagaacccagccgugauuaugcagacauaccuggaaaaggcagucgagguggccggcaauuaugauggggaaucauccgacgagcuucggaacggaaaaaugaaggcuuuucugaguuuagcccgauucagcgauacccaguaccaaagaaucgaaaacuacaugaaaucuucagaguuugagaauaagcaggcgcuccugaagcgcgcaaaagaagagguuggcuugcugagggaacacaagauacagacuaaccgguauacagugaaaguccagcgugagcucgaacuugacgagcuggcccuaagagcucugaaggaggauaggaaacgcuuccucuguaaggccguggaaaauuacauuaacugcuugcuguccggggaggaacacgacauguggguauuucgguuauguagccuuuggcuggagaauucuggagugagugagguuaacggcaugaugaaacgagaugguaugaagaucccgaccuauaaguuccucccucugauguaccaauuggcugcaagaauggggacgaaaaugaugggaggccuggguuuucaugaaguccucaauaaccuuaucucgaggauuuccauggaccacccccaucacacucuguucaucauacuagcccuggcuaaugccaaccgcgaugaguucuuaaccaagccagaaguggcacggagaagccguauuacaaaaaaugugcccaagcagucaucucagcucgacgaggacaggaccgaagcggccaaccggaucauuugcacaauccgcagccgaagaccucagauggucagguccguugaggcucugugcgaugccuauauaaucuuggcaaaucuugacgcuacucaauggaaaacccagcggaagggcauuaacaucccagccgaucagcccauuacgaagcugaaaaaucucgaggacgugguagugccuacaauggaaaucaaggucgaucacacuggggaguacggaaaccuggugaccauucagaguuuuaaagcagaauuccgcuuggccggcgggguuaaccugccgaagaucauagacugugugggaucagauggcaaagagagaaggcaacuagucaagggucgagacgaucuccggcaggacgcuguaaugcagcaaguguuucagaugugcaauacacuucugcagcguaacaccgaaacuagaaagcgcaaauuaaccauuuguacauauaagguugugccacugucucagaggagcgggguccucgaguggugcacgggaacugugcccaucggcgaguuccuggucaauaacgaagauggcgcgcauaaacgguacagaccuaaugacuuuuccgccuuccaaugucagaagaaaaugauggaggugcagaagaagaguuuugaagagaaauacgaaguuuucauggacgugugccagaacuuucaacccguauuccgcuauuuuuguauggagaaguucuuggauccagcaaucugguuugagaaaaggcuugcuuacacccgaagcguggccacauccucuauugucggguauauacugggacucggugaccggcacguucagaauauccugauuaacgaacagucagccgagcuagugcauaucgauuugggcgucgcauucgaacaggggaagauucugccuacccccgagacugugccauucagacucacaagggacaucguagauggaaugggcauaaccgguguggaggggguuuuucgccguugcugugaaaaaacgauggaggugaugcggaauagccaagaaacucuucugacaaucgucgagguguuacuguacgacccucucuucgauuggaccaugaacccgcugaaggcuuuguaucuucagcagagacccgaagacgagaccgagcugcacccaacucucaaugccgaugaccaggaaugcaagaggaaccugucggauauugaccaauccuuuaauaaagucgcggagcgcgugcuaaugcgauuacaggaaaagcugaaaggaguugaggaaggcacaguauugagugugggcgggcaggucaaccuccugauccaacaggcuauugauccuaagaaucuuucucggcuguuccccggauggaaagccuggguguga

SEQ ID NO: 53129 - RNA, 3573 nt, Artificial Sequence
  derived and/or modified sequence opt3 from ATN1__Homo_sapiens__NP_001007027
augaagaccagacagaacaaagacagcauguccaugaggucuggccggaagaaagaggcccccgggccucgcgaggaacugcgaucacgugggagagcuaguccagguggcgugagcacauccucuucggaugggaaggcagaaaaaucaaggcaaacugccaagaaggcgcgggucgaggaagcuagcacgccgaaaguuaauaagcagggacgcagugaggagaucuccgaaucugagagcgaagagaccaacgcccccaaaaagacaaaaacugagcaggaacucccuagaccacagucccccucagaccuugauagucuggacggcaggagcuugaaugaugacgguucuuccgauccucgggacauugaucaagacaaccgcucaaccagcccaaguauauacucucccggguccguggagaaugauagcgacucgucuuccggauuaucacagggcccugcacgaccauaucacccgcccccucuguucccacccaguccucagccacccgauagcacaccgagacagccugaagccuccuuugagccccauccaucuguaaccccuacuggcuaccacgcucccauggaaccacccacaagcaggauguuccaagcaccuccaggggccccgcccccucauccacagcuauaucccggagguaccggcggggugcucucaggaccuccaaugggccccaagggugggggagcugccaguuccgucggcggcccgaacgggggaaagcagcacccuccacccacgacuccuaucagcgugucuucaaguggugcgagcggcgcacccccaaccaaaccucccacaacuccaguugggggaggcaaucugccguccgccccucccccagcuaacuuuccccaugugaccccuaaucuuccacccccuccggcccugcggccauugaacaaugcaucugcuucgcccccuggucucggggcccagccacugcccggccaccucccuagcccgcacgcgaugggacaaggcaugggaggacugcccccagguccugagaagggccccacauuagccccauccccucauucacugcccccagcaaguucuagcgcuccggccccucccaugcguuucccauacuccucaucuagcuccaguagcgcugccgcaucuuccucaaguagcucguccucuagcucagccagucccuuuccugcuucccaggcgcuuccaucuuauccccacagcuucccuccgccaaccuccuugucagucagcaaccagcccccuaaauacacgcaacccagucugccaucucaggcaguguggucccaggggccucccccaccuccgcccuauggacgccuacucgccaauagcaacgcucauccaggcccuuuucccccaucgacuggugcccagucaacagcacacccucccguaucuacccaccaucaccaucaccaacagcagcagcaacagcagcagcaacagcagcagcaacagcagcaacagcagcagcaucacgggaauaguggcccgccaccucccggagccuucccacacccccuggagggcggguccagccaucacgcucauccuuacgccaugucuccgagccuuggaucccugagacccuacccaccuggucccgcacacuugccuccaccccacucacaaguuaguuauagccaggcgggcccuaacgggccacccgugucuuccucaaguaacagcuccucuucgacuagccagggaucauacccgugcucccauccuaguccaucucagggcccccaaggugcuccuuauccauuucccccggucccuacagugaccacgagcuccgccacccucucaacagugauugcaacugucgccucuagccccgcuggguacaagaccgccaguccaccuggcccaccacccuauggaaaaagggcaccuuccccaggcgcuuacaagacagccacuccgcccggguauaaaccuggaagcccacccucuuuccggaccggcacaccuccagguuaccgagggaccucacccccugcgggaccgggcacuuuuaagccagguucccccacgguuggcccugggccccugcccccugccggacccaguggcuuaccaagccugccgccucccccagcugcacccgccucggggccuccacucucugcuacacagaucaagcaggaacccgccgaggaauacgagaccccugaauccccggugccacccgcacgcagcccuucaccacccccuaaaguaguggacguccccagucacgcgucucaguccgccagauucaauaagcaucuugacaggggauuuaacagcugugcucggucagaucuguauuucgugccauuggagggcaguaaacuagccaagaaacgcgcagaccugguugagaaggugagaagggaagcugagcaacgugcccgggaagagaaggaacgagagagagagagggaacgcgagaaagaacgggagagagagaaggaaagggagcucgaacgcagcgucaaacuggcacaggagggucgagccccgguggaaugcccuucccuugggcccguaccacaccggccucccuucgagccaggaucugcuguugcgacugugccucccuaccugggcccggauaccccagccuugcguacacucagcgaguaugcaagaccucaugucaugucccccgguaauaggaaccacccauuuuacgugccccugggcgcugucgacccuggguuacugggauauaaugugccggcccuauacucaucugauccagccgcucgcgaacgggagagagaagcaagggagcgagaccuccgcgaucggcugaagcccggcuucgaaguuaaaccuagugagcuugagcccuugcacggggugccaggaccuggccuggaccccuuuccaagacauggugggcucgcccugcagccuggaccgcccggccuucacccauucccuuuucaucccucgcuggguccauuggaaagggagcgucucgcgcuggcugccggcccugcauuacgccccgauaugagcuaugccgaacggcuggcugcagagagacaacacgccgaaaggguagcggcucuagggaacgacccgcucgcccgacugcagaugcuuaaugucaccccacaucaccaccagcauucccacauucauucucacuugcaucugcaccagcaagaugcaauccacgccgcuucagccagcgugcauccucucauagacccccuggcauccggaagucacuuaacucggaucccauaccccgcuggcacacugccuaacccccuuuugccacauccucuccacgagaaugagguucugcgccaccagcuauucgccgcgccguacagagaccugcccgccucucucagcgcaccaaugucagcugcccaucagcugcaggcuaugcacgcacaauccgccgaacuucagagguuggcccuggagcagcagcaaugguuacaugcucaccacccucuccauagugugccccugccagcgcaggaagauuauuacagccaccuuaagaaggagucugacaaaccucuguga

SEQ ID NO: 53130 - RNA, 1065 nt, Artificial Sequence
  derived and/or modified sequence opt3 from ATOH1__Homo_sapiens__NP_005163
augagcagacugcuccacgccgaggaaugggcugaggugaaggaacuuggcgaccaucacaggcagccccaaccucaucaucugccacagccgcccccuccaccccagccuccagcaaccuugcaggcccgggagcaccccgucuacccuccagaauuaucccugcuagauucuacagacccgcgcgcguggcucgcucccacucugcaagggaucugcacggcccgagcagcccaguaucuucugcacucaccugaguugggagcuagugaggcagccgcuccacgugaugaaguugacgguagaggcgagcucgugaggcggagcuccgggggagccucuucgucaaaaagccccggcccuguaaaggugcgcgaacagcuguguaaacugaaggguggggucgugguugaugagcucggaugcaguagacagagggcgccauccucuaaacaagugaacggcguccagaagcagcggcgcuuagcagccaaugcucgagagagaaggcggaugcacggccugaaccaugccuucgaccagcuucguaaugugauucccagcuuuaacaaugauaagaaauuguccaaguacgaaacccugcaaauggcacagauauauaucaacgcucuaucagagcuccugcagacaccgagugggggagaacaaccucccccaccucccgccagcuguaaaucugaccaccaucaccuucgcacugcggccuccuacgaggguggcgcagggaaugcuaccgccgcuggagcccagcaggcaucaggcgguagccagagaccaacacccccugggaguugcaggacccgguucucugccccagcuuccgcgggaggcuauagcguacaacuggaugcauugcacuuuucgacuuucgaagacucugcccucacagcuaugauggcccagaagaaccuguccccgucauuacccggcaguauucugcagccuguucaggaggagaauagcaaaaccuccccacgaucucaucgcagcgauggggaauuuucaccccacagucauuacuccgacagcgaugaggcaucuuga

SEQ ID NO: 53131 - RNA, 459 nt, Artificial Sequence
  derived and/or modified sequence opt3 from ATOH7__Homo_sapiens__NP_660161
augaaaagcugcaagcccuccggcccuccagccggggcuaggguggcaccgcccugugccggagguaccgagugcgcgggcacaugugcuggggccggaaggcuggaaucugcagcccggcgccgacucgcugcaaacgcccgugagagaaggcggaugcagggccuuaauacugcuuucgaccgccugagaagggucguuccucaauggggucaggauaagaaauugucaaaguacgaaacguuacagauggcccugaguuauaucauggcgcuaacccggauucucgcagaggccgaacgcuuugggagcgagcgagacugggugggacugcacugcgagcauuucggcagagaucacuaccuuccauuucccggcgcuaaacugccuggggaauccgaguuguauucucagagacucuucggauuucaaccagaacccuuccagauggccacauga

SEQ ID NO: 53132 - RNA, 207 nt, Artificial Sequence
  derived and/or modified sequence opt3 from ATOX1__Homo_sapiens__NP_004036
augcccaagcacgaguucagcguggacaugaccugcggcgggugugccgaagcugucuccagaguucugaacaaacucggaggugugaaguacgauaucgaccuuccuaauaaaaagguaugcauugagucugaacauucaauggauacacuguuggcaacucugaaaaagacgggcaagaccgugaguuauuuagggcuagaguga

SEQ ID NO: 53133 - RNA, 4500 nt, Artificial Sequence
  derived and/or modified sequence opt3 from ATP10A__Homo_sapiens__NP_077816
auggagagagaacccgccggcaccgaggaaccugggccaccgggaaggcggcgccgacgugaggguagaacaaggacugugcggagcaaccugcuucccccuccaggcgcugaagaccccgcagccggggcggcuaagggagagcgcagaaggcggcgcggcugcgcccagcaccucgcagauaaucgacugaaaacgaccaaguacacauuguuauccuuccugccuaaaaaccuauuugagcaauuccauagaccagccaaugucuauuuuguuuucaucgcucuccugaacuuugugcccgcaguaaaugccuuccagccuggucuugcucuggccccaguguuguuuauucucgcgauaacugcauucagggaccugugggaagauuacucucggcaccguucagaccauaagaucaaccaccuggggugucucgucuuuagucgcgaggagaaaaaguaugugaauagauucuggaaggaaauucauguuggagauuuugugagguuacggugcaacgagaucuucccggccgacauucugcuuuugagcuccucugaucccgacggccugugucacaucgaaaccgcuaaucuagauggcgagacaaaccucaaacgacgccaggucgugagaggguuuucggaacugguaucagaguucaauccucuuaccuucacuagcguuauagaaugcgagaagccaaacaaugaccugaguagguuucggggauguaucauucacgauaacgguaaaaaggccggcuuguacaaagagaaucuccuguuacgcgggugcacacugagaaacaccgacgcaguggucggaaucgugauuuaugcuggccaugaaacgaaggcccuccuuaacaauuccggucccagguacaagcguucuaaacuggagcggcagaugaacugugauguguuguggugcguccuacugcucguuuguaugagccuguucuccgcgguggggcacggacuuuggaucuggcgauaucaagaaaagaaaucacuguuuuacguaccuaagagugacggcagcucuuuguccccagugacugccgcagucuacucauuccucaccaugauaauugugcugcagguuuuaauccccauuagccuguaugugaguaucgagaucgucaaggcuugccagguguacuuuauuaaucaggacaugcaacuauaugaugaagagacagacucucagcuccaguguagagcccugaacauaacugaggaucuuggccagauccaauacauuuucuccgacaaaaccgggacauugaccgaaaauaaaaugguauuuaggcgcugcacgguuagcggaguggaguauucgcaugaugcuaacgcccagcggcuggcaagauaccaggaagccgacucugaggaagaggaggucgugccgagggguggcuccgucucacaacgcgggaguaucggaagccaccaguccgugcgaguugugcaccggacucagucuacaaagagccaucguagaaccggcucaagggcugaagcgaagcgcgcaaguaugcucuccaaacacacugccuucagcucuccuauggagaaggauauaacacccgacccaaaacugcuugaaaagguaucagagugcgauaaaagucuggcugucgcccggcaucaggagcacuugcucgcacaucugagcccugaauuauccgacguguuugauuucuuuauugcccugaccaucuguaauacgguuguggucaccucucccgaccaaccaagaacaaaggugaggguacgauucgagcuaaagucgcccgugaaaacuaucgaagacuuucuccgccgguucaccccuagcugccugacauccgguuguucaaguauugggucucuugcugccaacaagagcucccacaaauugggcagcucauucccaucuacuccguccagugauggaaugcugcucagacuggaggaaagguuaggccagcccaccagcgcaaucgcgucuaauggguauuccucacaggcugacaacugggccagugagcuggcacaggagcaagaaagcgagcgugaacuucgcuacgaggccgaaucgccugaugaggcugccuugguuuacgcagcucgggccuauaauugcguccucguggagagacugcacgaccagguguccgucgaacuaccacaucugggaaggcucacauuugagcugcuucacaccuuggguuucgauucuguucgaaagcggaugagcguggugauucgccauccccugacugacgaaauaaacguauacacgaaaggcgcggauucagucgugauggacuuacuccagccuuguaguuccguugaugccagagggaggcaccagaagaagauccggucuaaaacacaaaauuaucugaacguguacgcugcagagggacuucgaacccugugcauugccaagagagucuugagcaaagaagaguaugcuuguuggcuccagucccaccuggaggccgaaucaagccuagagaauagugaggaacugcucuuucagucugcaauccgccuggagacuaaccuucauuugcugggcgcgaccgguaucgaagacagguuacaggauggggugccagagacaauuuccaagcuccgucaagccggccugcagauauggguucuuaccggagacaaacaggaaacugcugugaacaucgccuacgcaugcaagcugcuagaucacgacgaggaaguaauuacacucaaugcuacgagccaagaggccugugcagcccuguuggaccagugccuguguuauguccagucgcggggcuuacagagagcucccgagaagaccaaagggaaggugucaaugagguucucuagucucugcccgccuuccacuagcacagcgucuggacgccgaccaagccuggugaucgaugguagaucccuugccuacgcacuggagaaaaacuuggaagacaaguuucucuuccuggcuaaacaaugccggucaguccuauguugcaggaguacaccccugcaaaagagcaugguugugaaacuuguacgcucuaagcucaaggccaugacccuggccauuggcgauggggcuaaugacguguccaugauccaggucgcagaugugggaguuggcauaucaggucaggaagggaugcaggccgugauggcgagugacuuugcugucccuaaauuccguuacuuggagagacuguuaauccuccauggccacugguguuauagccggcuggccaacauggugcuuuacuuuuucuauaagaauacuauguuuguuggacuguuguucugguuucaguucuucugcggcuuuuccgcaucuaccaugauugaucagugguaccucaucuucuuuaaccugcuauucucgagccugcccccacuugugacggggguccucgacagggauguaccugccaaugugcuguugaccaacccccaguuauauaaaucaggacaaaauauggaagaguaccgcccacgaacauuuugguucaacauggcugacgcagccuuucagucccugguuuguuucaguauuccguaucucgcguacuacgauucuaauguggaccuguuuacuuggggcaccccuaucgucacaauagcccuucugacuuucuugcuacaucuggguauugagaccaagacguggacauggcucaacuggauuaccugcggguuuagcgugcugcuuuucuucacuguagcuuuaaucuauaaugcauccugugccacaugcuaucccccaucaaaccccuacuggaccaugcaggcucugcucggagauccuguguuuuacuugacuugucugaugaccccagucgccgcacuccugcccagacuuuucuuucggucucugcaaggcaggguuuucccuacacaguugcagcuagcucgccagcugacgagaaaaagcccgaggcggugcagugccccaaaggaaaccuuugcgcaaggucgucuccccaaggacuccggcacugagcacagcucugggcgcacagugaaaaccucagugccuuuaucccagccaaguuggcacacacagcagcccgucuguagccuggaagccucgggagagccuucuacuguggacauguccaugccgguucgagaacauacccuucuggagggccucagcgcacccgcuccaaugucaagugccccuggggaggcuguauugagaucucccggaggcugcccagaagaguccaaggugagggcagccagcacgggucgggucacaccucugucaagucucuucagccugcccaccuuuucccuucuaaauuggaucucuagcuggucccuggugucacgcuuggggucuguuuuacaauucaguagaacugaacagcuggccgauggacaggcuggcaggggucucccagugcagccgcacucgggccggagcgggcugcaaggaccugaccaucgacuucugauaggcgcguccucuagacgcucacaguga

SEQ ID NO: 53134 - RNA, 4386 nt, Artificial Sequence
  derived and/or modified sequence opt3 from ATP10B__Homo_sapiens__NP_079429
auggcccugagcguggacuccucuuggcacagauggcaguggaggguccgggauggcuucccccauugcccuucagagaccacaccacuccuuaguccggaaaaggggcgccaaagcuacaaccugacucagcagcgaguuguguuucccaacaacuccaucuuccaccaggacugggaggaaguaucucguagauauccuggaaauaggacguguaccacaaaauacacuuuguuuaccuucuuaccacggaaccuguuugagcaauuccaucgcugggcuaaucuauauuuucucuuccuggugauucuuaacuggaugcccucgauggaagucuuucacagagagauaacaaugcugccuuuggcaaucguucucuucgugauuaugaucaaggaugguauggaggacuuuaaaaggcaucgguucgauaaggccauuaauugcucaaacauccgcauauacgaacgaaaagagcagaccuaugugcagaaguguuggaaggacgucagagugggcgauuuuauccagaugaaaugcaaugaaauuguaccagcggacauccugcuacucuucagcagugaucccaacgggauuugucacuuagagacugcuucccuggacggagagacaaaucuuaagcaaaggugcguugugaaaggcuucucucagcaggaaguccaguuugagccugaauuguuccacaacaccaucgugugugagaagccaaauaaccaucugaauaaauuuaaggguuacauggaacacccggaucaaacgcggacuggguucggaugcgagagccuacuccugcguggcuguaccauacgcaacacagagauggccgugggcauugucaucuaugcagggcaugaaacuaaggccaugcuuaacaauuccggacccagauacaaaaggucaaagauugagcggcgaaugaacaucgacaucuuuuucugcauugguauacugaucuugaugugucucauuggcgcuguugggcacaguaucuggaauggaaccuuugaggaacacccuccauucgaugugcccgacgcaaacggcagcuuucugccuucugccuuagguggguucuacauguuucugacaaugauaauucuccuucagguacugaucccaaucuccuuguaugugucaauugaacuggucaaacugggacagguguucuuucucagcaaugaccuggaucuuuacgacgaggagaccgaucugaguauccaaugccgcgcuuugaacauugccgaagaccucggccagauacaguauaucuucucugauaagacgggcacucugacagagaauaaaaugguuuucagaaggugcaccauuaugggguccgaauacagccaucaggagaacgcgaagcgguuagaaacucccaaagagcuggacucggauggagaggaauggacacaauaucagugucuaucuuuuuccgcacgcugggcccaggacccggcuaccaugagaucacagaagggugcccaaccucucaggcguagucagagcgcacgggugcccauccagggccacuaccgacagagauccauggggcauagggagucuagccaaccaccugucgcuuucucaaguuccaucgaaaaggaugugacgcccgacaaaaaucugcuuaccaagguacgcgaugccgcguuguggcuggagacacucagcgacucucggccagccaaagcaucacugaguacuaccagcuccauugcugacuuuuuccuugcccugacaauaugcaacucuguuauggugucgacuaccacagagcccagacagagggucaccaucaagccuagcuccaaggcuuugggaacuucacucgaaaagauucagcagcuguuucaaaaguuaaaacugcuaagucucucucagagcuucuccucaacggccccaagcgauacagaccugggcgagucucuuggugcaaauguggccaccacugauuccgacgaacgcgaugacgcuagugucuguagcgggggcgauucuaccgacgauggaggcuaucgauccucaaugugggaccagggggauaucuuggagaguggaagcgguacaucgcuggaagaggcgcucgaggcaccggccaccgaccuggcucggcccgaauuuugcuacgaggccgaauccccugaugaggcagccuuagugcacgcugcccaugcauacucuuucacucugguuagccguacaccagaacaagugacgguaagacuuccccagggcaccuguuugacuuuuucacuccugugcacacuaggguucgacagugucaggaagcgcauguccgugguugugcggcacccucugaccggagagauugucguguauacaaaaggcgcggacucuguaaucauggaucuccuggaggacccagcuugugugcccgauauaaacauggaaaagaaacuuagaaagaucagggcccgaacucagaagcacuuggaccuguacgcacgcgaugguuuacggacccucugcauugccaaaaagguugucagcgaggaagacuuuagaaggugggcuuccuuccgucgcgaggccgaagcaucacuggauaaucgggacgagcuucugauggagacggcucagcauuuggaaaaccaacucacccugcuaggggccacaggcaucgaggauagacugcaggaaggagugccggacacuauugcgacccucagggaggccggcauccagcugugggugcuuacaggggauaaacaggagacugcugucaauauagcacacagcugucgauugcugaaccaaaccgacacgguuuauacaauuaacaccgaaaaucaggagacuugcgaaaguaucuuaaacugugcccucgaggaacugaagcaguuucgggagcuucagaaaccugaucgcaagcuguucggauucagacuaccaucuaagacacccuccauuaccagcgaggcuguggugccugaagccggucucguaaucgacggcaaaacucugaaugcaauauuucaagggaaguuggagaaaaaguuccuggaauuaacccaguacugcaggucgguccucugcugucggucaacaccccugcagaaaucuaugaucgugaaacuuguucgagacaaacugagagugaugacguugaguauuggagauggcgcgaacgacgucuccaugauccaagccgcugauauugguaucgggauaagcggccaggagggaaugcaggccgugaugucuagcgacuuugcaauuacccgcuucaagcaucucaagaaacugcuacugguucacggccacuggugcuauuccaggcuugcucguauggugguauacuaucucuacaagaaugucuguuacgugaaccuguuguuuugguaucaguucuuuugcggguucucaaguagcacuaugaucgauuacuggcaaaugaucuuuuucaaucuguuuuucacaucuuuaccaccucucguguucggaguccuggacaaagauauuuccgccgaaacccuucuggcauugcccgagcucuauaagucaggccagaacagugaguguuacaaucugagcacauuuuggaucuccaugguugacgccuucuaucagucucuaauuugcuuuuucauaccauaccuggcuuauaaagguucggauaucgacguguuuacuuucgggaccccgauuaacacgaucagccuuacaaccauucuccugcaucaggcgauggaaaugaagacuuggaccaucuuucacggaguaguguuguuaggcucauuccugauguacuuucucgucucccugcuuuacaaugccacaugugugauaugcaacaguccuacuaaucccuauuggguuauggagggucaacugucuaacccaaccuucuacuugguguguuuucuaacacccgucguggcacugcucccucgguauuucuuucugagccuucagggcacgugcgggaaguccuuaaucucaaaagcucagaagauugauaaacugccacccgacaagagaaaucucgaaauccagucuuggaggagccgccaacgaccugccccgguuccagagguggccagacccacccaucacccugucaguuccauuacuggacaggacuucagcgcuucuacaccaaaaucauccaaucccccuaagcggaagcauguagaagagaguguguugcacgagcagagguguggcaccgaaugcaugcgcgaugacagcugcucgggggauucuuccgcacagcugagcucaggagagcaccuccugggcccgaaccguaucauggccuacaguagaggucaaacugacaugugucggugcucuaaaagguccagccaucgccgaucacagaguagccuuacaauauga

SEQ ID NO: 53135 - RNA, 4281 nt, Artificial Sequence
  derived and/or modified sequence opt3 from ATP10D__Homo_sapiens__NP_065186
augaccgaggcccugcagugggcuagauaccacuggaggcggcucauccgcggcgcaacacgagacgaugacagcgggcccuauaacuacuccucucuucuggccugcggacguaagucaagucaaacuccuaaauugagcgguagacauaggauuguggucccacacauacagccguucaaggaugaauaugagaaauuuuccggcgcguacguuaauaaccggauccgcacgaccaaguauacauuacugaauuucgugcccagaaaccuauuugaacaguuccauagggcugccaaucucuacuuucuguuccuuguagugcugaacugggucccuuugguggaggcauuucagaaagaaauuacuaugcucccacugguugugguccugaccaucauugccaucaaggacgggcucgaggauuaucggaaguacaaaauagacaagcaaaucaauaacuuaauuacaaaaguguacucucgcaaggagaaaaaguauaucgaucgauguuggaaggacguaaccguuggagauuucauuagacugucgugcaaugaagugauccccgcugacaugguccuuuuguuuucaacugauccugacggcauaugucacauugagacaagcggucuggauggggaaaguaaccuaaaacagcgccagguggugcggggauacgcagagcaggacuccgaggucgacccagaaaaguucucuagccguaucgagugcgaaucccccaauaacgaucucucacgcuuuagaggcuuccuggagcauaguaauaaagaaaggguuggccuuagcaaggagaaccuguugcuccggggguguaccauucgaaauacggaggccgugguaggaaucguggucuaugcuggucacgaaacuaaagccaugcugaacaacucuggcccucgcuacaagagauccaaauuagagaggcgggcgaauaccgacgugcuguggugcguuaugcuccuugugaucaugugucugacaggggcagucggacacggcauuugguugucacgcuaugaaaagaugcacuuuuucaacgugccagagccggauggucauauaaucagcccccuacuggccggguucuacauguuuuggacuaugauuauccuccugcaaguacuuauaccuauuagucuguauguuucuaucgaaaucgugaaguugggacagauuuacuucauccaguccgacgucgauuuuuacaaugagaaaauggacagcauugugcagugcagagcucucaacauagccgaggaucugggccaaauccaguauuuauucucggacaagaccggcacacugaccgaaaauaaaauggucuuuaggcguuguucuguggcaggguucgauuacugccaugaggaaaacgcucggcgacuagaguccuaucaggaagccguuucagaggacgaggauuuuauugacacggugaguggaagccucuccaauauggcgaagccaagagcccccucuuguaggacuguacacaacgguccucugggcaauaaaccaagcaaccaccuugcagggucaaguuucacauugggauccggcgaaggugcuagcgaggucccccauucucgccaagccgcuuuuucaaguccgaucgaaaccgacgugguuccugauacucggcugcucgacaaguucagccagaucacacccagacuguuuaugccacuugaugagaccauucagaauccucccauggagacgcuguacauaaucgacuucuuuauugccuuggcaaucugcaacaccguggucguguccgccccaaaucagcccaggcaaaagauucgccacccuucucucgggggccugccaaucaaaucguuagaagagauaaagagccuguuccagcgaugguccguacggcguucaaguucuccgagccuaaacuccggaaaagaacccucaagcggcgugccuaaugcuuucguuucuagacucccacuguuuuccaggaugaagcccgcgaguccugucgaggaagaggugagccaggugugcgagucuccacaguguuccucaaguagcgcaugcuguacagaaacugagaaacaacauggggaugccggacuuuugaacgguaaggcugaaucgcugcccggccagccgcucgccugcaaccuguguuaugaggcagaauccccugacgaggccgcuuuagucuacgccgcacgcgcguaucagugcacccugcggucuagaacaccagagcagguuaugguggauuucgcugcccuugggcccuugacuuuucaacuccugcacauccuaccuuucgacagcgugaggaagcgaaugucaguagucgugcgccauccccugaguaaucagguuguggucuacaccaaaggagcagauuccgugauuauggaacuccugucuguugccagcccagacggcgcuucccuugagaagcagcagaugaucgugcgggaaaagacacaaaagcacuuggaugacuacgccaaacagggucugagaaccuuauguauugcaaagaagguaaugucagauacugaguaugcugaauggcucaggaaccacuuucuggccgagacgagcaucgacaaucgugaggaacuucuguuggagagugcgaugcgccucgaaaacaaacugacacuacugggggccaccggcauagaggaccggcuccaggagggagucccugaaucuauugaggcucugcauaaggcaggcaucaaaauuuggaugcuuacuggggauaagcaagaaaccgccgugaauaucgcuuacgccugcaaauugcuggagcccgacgauaaguuauucauacucaacacacaguccaaagacgcauguggaaugcugaugagcaccauccuuaaggaacugcagaagaaaacucaggcgcuaccagagcaagugucgcucucagaggaucuguugcagccgccuguccccagagacucuggucugagggccggcuuaauuaucacagggaagacgcucgaauuugcucugcaggagagucuucagaaacaauuccuggaauugaccuccuggugccaggccguuguguguugccgagcaacuccacuccagaaaagcgagguagugaaacugguccggucucaccuacaggugaugacacuggcuauuggagauggcgccaaugacguuagcaugauccaaguggcagauauagguauuggggucuccggccaggaaggaaugcaggccgugauggcuucagacuuugcgguuagucaauucaagcaucuuagcaagcuccuguuggugcacggccacuggugcuauacccgccugucuaacaugaucuuauacuuuuucuauaaaaaugucgccuacguaaaccuccuguuuugguaucaguucuucuguggguuuuccggaacaucaaugacugauuacugggugcuuaucuucuuuaaucuguuguucaccagugcacccccuguuauuuacggcgugcucgagaaggacgucagcgcugagacgcugaugcagcuaccagaacuguauagauccggucagaaaucugaggccuaccuuccccauaccuuuuggaucacacuccuggaugccuucuaucaaucguuggugugcuuuuucguaccuuacuuuacuuaucaggggagcgacaccgacauuuucgcuuuuggaaacccguuaaauacagcagcccuguucauagugcuccugcaccuugucaucgaaucaaagucccugacuuggauucauuugcuaguuaucauuggcaguauccugucuuacuuccucuuugcgauaguguucggugcuaugugugugaccugcaacccacccagcaauccuuauuggaucaugcaggagcacaugcuggauccagucuuuuaccuuguguguauuuuaacgacauccaucgcccugcuccccagguucguuuaccggguauugcagggcucacuguuuccuucuccgauucuccgagcaaaacauuucgacagacugacccccgaagagaggacuaaggcccuuaagaaauggcguggggcuggaaagaugaaccaagugacaagcaaauaugcaaaccagagugccggcaaguccgggaggcggccaaugccuggacccagcgcggucuuugcuaugaaaucugccucauccugcgcaaucgagcagggcaaucugaguuugugugaaaccgcccuagaucaggguuacagcgagacuaaggcuuucgaaauggccgggccaucgaagggaaaagagucuuga

SEQ ID NO: 53136 - RNA, 3405 nt, Artificial Sequence
  derived and/or modified sequence opt3 from ATP11A__Homo_sapiens__NP_056020
auggacugcagccuggugagaacccucguccacagguacugugccggcgaggaaaacuggguugauucccggacaaucuauguggggcaucgcgagcccccuccaggagcugaagcauacauuccgcagcgauaucccgacaaucguauaguaucuucaaaguacacuuucuggaacuuuaucccuaaaaaucuuuucgagcaauuuagaaggguggccaacuucuauuuucugauuaucuucuugguccaguuaauuaucgauacgccaaccagucccgugacaagcggucugccucuauuuuucguuauaacugugaccgcgaucaagcagggcuacgaagacuggcuccggcacaaagcugauaaugccaugaaccagugcccaguccauuuuauucaacacgggaagcuggugcgcaaacaguccagaaaguugaggguaggagacaucguuauggugaaggaggaugagacauuccccugugaccugauuuuucuuucuucgaaucggggcgaugguaccugccaugucacuacagcaucacucgacggggaaagcagucacaaaacccacuaugccgugcaggauacgaagggauuccauacugaggaagacaucggcggccugcacgcuaccauagagugugagcagccucaaccagaucuguacaaauuuguggggcgcauuaacgucuacuccgaccucaaugacccgguugugcgacccuuaggaucugaaaaccugcuuuugagaggugcaacacugaagaauacugagaaaaucuucggcguagccauuuauaccgggauggaaacaaagauggcucuaaacuaccagagcaagucccagaaaaggucagccguggagaagaguaugaaugcguuccucaucgucuaucugugcauccuuauuagcaaagcacugauaaacaccguguugaaguacauguggcagucugaaccuuuucgggaugagccaugguauaaucaaaagacggaguccgaacgucagcgcaaccucuuccugaaggccuuuacugacuucuuagcuuuuaugguucuguucaacuacaucauucccgugucaauguaugucacaguggagaugcagaaauuucucggaagcuacuucaucaccugggaugaagacauguuugaugaggaaacuggcgaggguccucuuguaaauacaagugaccugaacgaggaauuggggcaaguugaguacauauucaccgauaagacgggaacccuaacagaaaauaacauggaguuuaaggaauguugcauugagggccauguguaugucccacacgugaucuguaauggccagguccugcccgagucuuccgggaucgacaugauugauagcucgccgucugugaacggaagagaaagggaggaacucuucuuucgggcccugugccuuugucacacuguucaggugaaagacgaugacuccguagacgguccucgaaagucacccgauggcgggaaaaguugcgucuacaucagcuccucuccagacgagguggcacugguugagggagugcagcgcuugggcuucaccuaucucagacugaaggauaauuacauggaaauuuuaaacagggagaaucauauagaacgguucgagcugcuagaaauccucagcuuugacucaguccgcagaaggaugagugugauuguaaaauccgcuacaggugagaucuaucuguucugcaagggggccgauagcucuaucuuuccucgugugauugagggcaagguugaccaaauacgggcgcgagucgaaagaaacgccguggagggacuuaggacuuuguguguggcauacaaacgccugauccaggaagaguaugaaggcauuugcaagcuccugcaggcugccaaagucgcacuucaggaucgggagaagaaacuggccgaggcauacgaacaaaucgagaaggacuugacccuccugggggccacagcuguugaagauagauuacaggagaaggcggcagacaccauugaagcccugcagaaagcuggaaucaaggugugggugcuaacuggugauaaaauggagacggccgcagccacauguuacgcuugcaaacucuucaggcgcaauacccagcugcuugaguugacuaccaaacgaauagaggaacaaucacugcacgacguacucuuugaacugaguaagacagucuuacggcauagcggcucccugacccgugauaaccuuucuggguugucggccgacaugcaggacuauggacucaucauugauggcgcagcgcugagccuaaucaugaagcccagagaggacgguuccucagggaauuacagggagcuguuccucgaaauuugucgcaguugcucugcugugcuguguugccggauggccccacuucagaaagcacagaucguuaaguugauaaaauuuagcaaggagcaccccauuacucuggccaucggcgauggagcuaacgacguguccaugauuuuagaagcccaugucggcaucggggugauaggaaaagaggguagacaagcagcucgaaauucagauuaugccaucccuaaguucaaacaccucaagaagaugcugcuuguucacggccauuuuuacuauauuaggaucagcgaacuggugcaguacuucuuuuauaaaaacguauguuucauuuuuccacaguucuuguaccaauucuuuugcggguucucucagcagacacucuacgacacggcguaucugacccuauacaacaucuccuuuacaagucugccgauacuccuguauagccuuauggagcagcacgucggaauugauguguugaagcgcgaccccacucuguaccgggauguggccaaaaaugcuuuacucagauggagggucuucaucuauuggacccugcuuggccuguuugacgcucuaguuuucuuuuucggugccuacuuuguguucgagaacacaacuguaaccucuaaugggcaaaucuuuggcaacuggacguucggaacccucguguucacagucaugguguuuacuguuacccugaaguuggcucuggauacacauuauuggacuuggauuaaucacuucgugaucuggggcuccuuacucuuuuacgucguguucucacugcuuuggggagggguuauuuggccuuuucugaacuaccagcguauguauuacguguucauacagauguugaguagcggcccagccuggcucgcaaucguccugcuaguaaccauuucgcugcuucccgacgugcucaaaaagguucugugucgccaguuguggccuacggcgacagaacgggugcaaaccaagucccagugccugucugucgagcagagcacuaucuuuauguuaucacagacaaguuccucucucagcuucuga

SEQ ID NO: 53137 - RNA, 366 nt, Artificial Sequence
  derived and/or modified sequence opt3 from ATP11AUN__Homo_sapiens__NP_997323
augaacagccccgaggccagacugugcguggcucaguguagggacuccuacccuggcugccaaccacucaaggauacccgggcaugggccucuucacuuaaaauggacccggcggggcuggaaggagguccccgcgaugagagucgagacgaaccuccaauccgugcucaggccgcaagcugggaucagccccagggcuguuugacauauaaggggagaagguccgccucuggaacucaaaaacaguuacagcugccugacacgcuaucgucacuccugugcuggcggggcgcuauuauggucuacauaaagguuaccgugcagacagaugacagcaauaaacuucugaguuugcucuaucgcuga

SEQ ID NO: 53138 - RNA, 3534 nt, Artificial Sequence
  derived and/or modified sequence opt3 from ATP11B__Homo_sapiens__NP_055431
auguggagauggaucaggcagcaacugggcuucgaucccccucaccagagcgacacccggacaauuuacguggccaaccgcuuuccacagaaugggcucuauacuccgcagaaguucauagacaaccgaaucauuuccucuaaauacacggucuggaauuuuguucccaagaaccuuuucgagcaauuucguagaguggcuaauuucuauuuucugaucauuuucuugguacaguuaaugaucgauaccccuacaucaccagugacaaguggacugccccuauuuuucgucauaaccgugacagcaaucaaacaggguuacgaagacuggcucaggcauaacagcgauaaugagguuaacggcgccccuguguaugucgugcgguccgggggacugguaaagacccgcucuaaaaauauuagaguuggcgacaucgugaggauugcgaaggaugaaaucuuuccagcugaccuuguccuguugucgucagaucggcucgacgguagcugccacgugacuacagccagucuggauggggagaccaaccugaagacgcauguggcaguccccgaaacugcccucuuacagaccguugcuaaucuggacacacuuguggcaguaauagagugucaacagccugaggccgauuuguaccgcuucaugggacgaaugauuaucacucagcagauggaagagauugugagaccacugggcccggaaucccuacuccugaggggcgcucggcuuaaaaacaccaaggagaucuuuggggucgccguguauacaggaauggagaccaaaauggcgcugaauuacaagucuaaaagccaaaagcguuccgcaguugaaaagucaaugaacacguucuugaucauuuaccucgugauacugaucagugaggccgucauuagcacuaucuuaaaauauacauggcaggcugaagagaagugggacgaacccugguacaaucagaaaaccgagcaccaacgcaacucuuccaagauacugagauucauuucagacuuucucgccuuccuugugcuguauaacuuuaucaucccuauuagcuuguacguaacuguugagaugcagaaauuccuagguaguuucuuuaucggcugggaucuggaccucuaucaugaagagucugaucagaaggcacaggugaauacauccgaccugaacgaggaacuugggcaagucgaauacguguuuaccgauaaaacgggaacccugacagagaaugagaugcaguucagggaaugcagcauuaacggcaugaaguaucaggagauaaauggucgguuggucccagaagggcccacuccugacucgucugagggaaaccucuccuaccugucaaguuuaagccaccugaauaaccuaucccaccucaccacaucuagcucauuucgaaccaguccagaaaaugagacugagcugaucaaggaacaugaucuuuucuuuaaagcuguguccuugugucacacaguucagauuagcaacgugcaaaccgacugcacuggcgauggccccuggcagucuaaucuggccccgucacagcucgaguacuaugcgaguagcccugacgaaaaggcccugguagaggcagcugcccgcaucgggaucgucuucauuggaaacuccgaggaaacgauggaggugaaaacacuugguaagcuggaaagauacaaauugcuccauauacuggaguuugauucugacaggcggcgcaugucgguuaucgugcaggcucccagcggcgaaaaguuacuguucgccaagggggcagaguccucaauucuaccaaaauguaucggaggcgagauugaaaagaccagaauccacgucgacgaguucgcccucaaaggucugaggacucuuugcauagcuuaucguaaguuuaccaguaaagaauacgaggaaaucgauaagcggauuuucgaggcgcgaacagcauugcaacagagagaggaaaagcuggccgcuguguuucaguucaucgagaaagaccucauucuguuaggggccaccgcaguagaagauaggcugcaggacaaggugcgcgagacuaucgaagcccuucggauggcuggcauaaaaguuugggucuugacaggagauaagcacgagacggccgugucugugagccucuccuguggccauuuucacagaaccaugaauauucuggagcuaaucaaccaaaaaucagacagcgaaugcgcagagcagcugaggcagcucgcgcgccgaauuacugaagaucaugucauccaacacgggcugguuguggacggaacaucucuuuccuuggcucugcgggagcaugagaaguuauucauggaagugugucguaauugcagugccguacucuguugcagaauggcaccucugcagaaggccaaagucauaaggcuuaucaagauuagccccgagaaaccaaucacccuggcugugggugauggcgccaacgacguuucuaugauucaggaagcacacguggggaucggaauaaugggcaaggagggucgccaggcugcccggaacuccgauuaugcgauugccagauuuaaauucuugucaaagcuccuguuuguccacgggcauuucuacuauaucaggaucgcuacucuagugcaauacuuuuucuacaaaaauguuugcuuuauuacuccccaguuccuguaucaguucuacugucucuuuagucagcaaacccuguaugacagcguguaccuuacguuguauaacaucugcuucaccucgcugccuauuuuaauauacucccuccuggaacagcacguagauccacauguccuucagaauaagccgacacuguaucgagacaucucuaagaaccgccuacucagcauuaaaacuuuucuguacuggaccaucuugggcuucucacacgcauuuauuuucuuuuucggaaguuaccuguuaaucggcaaggacacaucccuccuggggaauggacagauguuugguaacuggacuuucggcacccuuguguuuacggugauggucauaacaguuaccgugaaaauggcccuggagacucacuucuggacauggaucaaucauuugguaaccugggggucuauuaucuucuauuuuguguucagccucuuuuacggaggcauucuguggcccuuccuagguucccaaaacauguauuuugucuucauccagcugcuuucaagcgggagugcuugguuugccauaauucucauggugguuacuugucuguucuuggauaucaucaagaaaguguuugaccggcaucugcacccuaccucuacagagaaggcacaguuaacggaaaccaaugcgggcauuaagugccucgauuccauguguugcuucccagagggagaagccgcuugugccagcgucggcagaaugcuggagagggugauagggcguugcucgcccacucacaucucacgcucuuggagugcauccgacccuuuuuacacaaacgaucggagcauucuuacccugucuacaauggacagcuccacuuguuga

SEQ ID NO: 53139 - RNA, 3138 nt, Artificial Sequence
  derived and/or modified sequence opt3 from ATP12A__Homo_sapiens__NP_001172014
augcaccagaagacccccgagaucuacagcguggaacuguccggcacaaaagacauugucaagacugauaaaggggacggaaaggagaaauauagaggucucaagaacaauugccuugaacugaagaaaaagaaccauaaagaggaguuccaaaaggaauugcacuuagaugaccauaaacugucuaauagggagcuagaagagaaguacggcacggauauaaucauggggcucucaaguacccgggccgcugaacugcuugcacgcgacggaccuaacagccugacaccaccgaagcagacucccgagauuguuaaauuuuugaagcagauggugggcgguuucuccauccuccuguggguaggggccuuucuguguuggauugcguauggaauccaguacucuucggauaaaucagcuagccucaauaacguguauuuaggcugcguccugggccuugugguuauauugaccgggaucuucgccuacuaucaagaggcaaagaguacaaauauuauguccucuuuuaacaaaaugaucccucagcaggcccuggugauucgagacagcgaaaagaaaaccaucccauccgagcagcuagucgugggagauauaguagaaguuaaggguggcgaccaaauucccgcugauauccgugugcucucaagucagggguguagagucgacaauagcucucugacuggagaguccgaaccucagccaaggucaagcgaguucacacacgagaacccccuugaaaccaagaauauuugcuuuuacaguacgacuugucuggaggcaucuaccuccccugugggcacagugacugguauggucaucaacaccggggaucggacaaucauuggacauauagccagcuuggcuucgggcguuggcaaugagaaaaccccaaucgccauugaaaucgaacacuucgugcacauaguagcggggguggcagucucuauuggaauccucuuuuucaucauugccgugucccugaaguaccagguuuuagacucaaucauuuuucugauagguaucauuguggcuaacgucccggagggccuccuugccacggugacuguaacacugaguuugaccgcaaaacgcauggcuaagaaaaauugccuaguuaagaaccuggaggccguggaaacucucgggagcacauccaucaucuguucugacaagaccggaacgcugacccaaaacagaaugacagucgcgcaucuuugguucgauaaucagauuuuuguggccgacacuagcgaggaucacucaaaccaggucuucgaccaaaguuccaggaccugggcaagccugucuaaaauaaucacauugugcaaucgggcugaguucaagcccggccaggaaaacgugccuauuaugaaaaaggccguuaucggugaugcuucagaaacugcccuccugaaauuuagugaggugauuuuaggggacguaauggagauccgcaagcgaaauagaaaggucgcagaaauaccauucaacagcaccaauaaauuucagcuguccauccaugagauggaugacccccacggcaagagguuccuaauggugaugaaaggagccccugaacggauucucgagaaguguucuacaaucaugauuaacggcgaggaacacccacuggauaaaucgaccgcuaagacuuuucauacggcguauauggagcuugggggauugggugaacguguucugggcuucugccaccucuaccugcccgcagacgaguuuccggaaacauauagcuucgauaucgacgccaugaauuuuccuaccuccaaccuuuguuucguggggcuguugucaaugauagaucccccacgcaguacugucccugacgcugugaccaagugcagaucugccggaauuaaaguaaucauggugacaggcgaccaucccauuaccgcaaaggccaucgcuaaaagcguugguauaaucuccgccaauucagagacugucgaggauauugcacacaggcucaacaucgcgguggaacaggugaauaagcgggacgcuaaagccgcagucguuacagggauggagcugaaggauaugagcucugaacaauuagacgagauucuggccaacuaccaggaaaucguguuugcucgaacguccccacagcagaaacuaauaauuguggagggcugccaacgccaggaugccguagucgcagugaccggagacggcguuaaugauagucccgcucucaagaaggccgacaucgggaucgcgaugggaauugccgguagcgaugcugccaaaaacgcagcugacauggugcugcuugaugacaacuucgccucuaucgucacuggcguggaggaagggagauugauuuuugacaaucugaagaaaacaauagcauauucccucaccaagaacaucgcggagcuguguccuuucuuaauuuacaucauuguuggacugccacuuccgaucggcacaauaacuaucuuguucauugaucucgguaccgacaucauucccucaaucgcccuggcuuaugaaaaagccgagagugauauaaugaauaggaagccucggcauaagaacaaagaccgccuagugaaucagccacuggcaguauacagcuaccuccacauugggcugaugcaggcucuuggcgccuuuuuggucuauuucacgguguacgcacaagaaggauuucugcccagaaccuuaaucaaccucaggguggagugggagaaggauuaugucaaugaccugaaagauucguacggccaggaauggacacguuaucagcgggaguaccuugaauggacuggguauaccgccuucuuuguuggaauccuggugcagcaaauugcugacuugauaauccgaaagacaagaaggaacuccauuuuccagcagggccucuuucgcaauaaaguaaucuggguggguauuacuucucaaaucauaaucgggcugauucuaagcuacggacugggcucagucaccgcgcucaguuucacgaugcugcgggcccaguacugguuuguggcaguuccucacgcuauccuuauuuggguguaugaugaggucagaaaguuguucaucaggcuguacccagguuccuggugggacaagaacauguauuacuga

SEQ ID NO: 53140 - RNA, 3681 nt, Artificial Sequence
  derived and/or modified sequence opt3 from ATP13A3__Homo_sapiens__NP_078800
auggacagagaggaaaggaagaccaucaaccagggccaagaggaugaaauggagauuuacggguauaaucugagccgguggaaacucgccauagugucccuuggagucaucugcucugguggcuuccuguuguuacugcuauacuggaugcccgaauggcgcguuaaggcuacaugugugcgagcagccauuaaagacugcgagguagugcuccugcguacuacggaugaguuuaagaugugguucugugcgaaaaucagaguccuuucacuggaaaccuauccugugaguagcccaaaguccaugucuaacaaguugucgaaugggcacgcuguuugccucauugagaacccgacagaagagaauaggcaucggaucucaaaauacagccagacugagagucagcagauacgcuauuuuacccaccauuccgugaaguacuucuggaacgacacaauccacaauuuugauuuccugaaaggacuggacgaaggcgucucuuguaccagcauuuaugagaagcauuccgccggucucacuaaagggaugcacgcauacagaaaguuacuguacggagugaacgaaaucgccguaaagguucccucaguguuuaaacuuuugauuaaggagguccugaauccuuucuauaucuuucaacuauucagugugauacucuggagcacagaugaauacuauuacuaugcucuggcaauuguggucaugucuaucguuuccauugugucaagccuuuacaguaucaggaaacaguauguaaugcugcacgacaugguggccacccauucuacgguccggguguccguuugccgcgugaacgaggagaucgaagagauuuuuagcacugauuuggucccaggcgacgugaugguaauaccccucaauggcaccaucaugccuugugaugcuguucugauuaacgggacaugcaucgugaaugaaucgauguuaacuggagagucugucccagugaccaagacaaaccugcccaauccuuccgucgacgugaaagguauaggcgaugaacucuacaacccagagacccacaagcgacauacgcuuuucugugggacuacaguuauucagaccagauuuuacacuggagagcuggugaaagccaucguagucaggacaggcuucucaaccaguaagggucaguuggugcggagcauccuauauccgaagcccacggacuucaaacuguaccgugacgcguaucucuuucugcuuugccugguugcaguggccgggauuggauucaucuacaccauuauaaacuccaucuugaaugaaguccaagugggcguaauuaucaucgagucucucgauauuauaacaaucacugugccuccagcucugcccgccgcaaugaccgcuggcauuguuuaugcccagcgcagauuaaagaaaaucgggaucuuuuguauuagcccucagaggauaaacaucugcggacagcugaaucuagucugcuucgacaagacagguacucucaccgaagauggccuggaccuuugggggauucaacggguggagaacgcgcgauuuuugucaccagaagagaauguguguaacgagaugcuggucaaaagucaguucguugccugcauggcaacaugucacucccucaccaagaucgaaggagugcugagcggcgauccccuugaccugaagauguuugaggcuauugguuggaucuuggaagaggccacugaggaagagacggcucuccacaaucgcauaaugccgacagugguaagaccucccaaacagcuguuaccagaaucuaccccugccgggaaccaagagauggaacuguucgagcuacccgcaacuuacgagauuggcaucgucaggcaguuuccauucucaagugcccuccagcggaugagcgugguugcucgcgugcugggagauagaaagauggacgcguauaugaaaggcgcacccgaagccauugcugggcuuugcaagccugagaccgucccaguggauuuucagaauguuuuggaagacuucacaaaacaaggauuuagggugaucgcccuggcacaucguaagcucgaguccaagcugaccuggcacaaaguacagaacauaucucgggaugccaucgaaaauaacauggacuucauggguuuaauuaucaugcagaauaagcugaaacaggagacuccggcuguccuugaggacuugcauaaggccaacauucgaacagugauggugacgggcgauucgaugcucaccgcagucagcguugcgagagacugugggaugauccugccccaagauaaagugauaauugcugaagcccuaccuccaaaggacggaaagguagcaaaaaucaauuggcacuacgccgauucccugacucagugcucacaucccagugcuaucgacccugaggccauuccagugaagcucguccacgauucucuggaagaccuucagaugacaagguaccacuucgcaaugaacggcaaaaguuuuuccgugaucuuggagcauuuccaggaucugguucccaaguuaaugcuccacgguaccguguuugcucgcauggccccggaccagaaaacacaacugauugaagcgcuucagaacgucgauuauuucguggggauguguggcgacggagccaaugauugcggcgcucugaagcgggcacaugggggaauaucauugagcgagcucgaggccucuguugcuuccccuuuuacuagcaaaaccccaagcaucucuugugugcccaaccugauuagagaagguagggccgcacuaaucacguccuucugcgucuuuaaguucauggcgcuguacucaauuauccaguauuuuaguguaacccuccuguacagcauacuuucgaauuugggcgacuuccaauuucuguucaucgacuuagccauuauccucgugguuguguuuacaaugucccugaacccugcuuggaaggagcuugucgcccagcgacccccaucugggcugauuagcggagcacuacucuucucagugcugagucagaucauaauuuguaucggcuuccaauccuugggguuuuucuggguaaaacagcagccuugguaugaaguguggcaccccaagucugaugcuugcaauacuaccgguagcggcuuuuggaacuccucacacgucgacaaugagacagagcuggaugaacauaacauccagaauuacgagaacacuaccguuuucuuuauuagcaguuuccaauauuuaauaguggccaucgcauuuucuaaaggaaagccauuccgccagccgugcuacaaaaauuacuuuuucguguuuuccgucauuuuccucuauaucuucauucuguuuaucaugcuuuacccuguggccagcguugaccagguacugcagauaguguguguccccuaucaauggcgggugacgauguugaucauuguucucgugaacgcuuucgucucgaucacaguggaagagucaguagaucguuggggcaagugcugucugccaugggcgcuagggugcagaaagaaaacccccaaggccaaauacauguaucuggcacaggaacuucucgucgacccugaguggccacccaagccucagacuacaaccgaggcuaaagcccuggugaaggaaaauggaucuugucagauuaucacuauaaccuga

SEQ ID NO: 53141 - RNA, 3591 nt, Artificial Sequence
  derived and/or modified sequence opt3 from ATP13A4__Homo_sapiens__NP_115655
augggccacuucgagaaggggcagcaugcccugcucaacgaaggagaggaaaaugagauggaaaucuuugguuacagaacccaaggcugcaggaaaagccuuugucuggcuggguccauuuucucuuuuggaauauugcccuuaguguucuauuggcggccugcauggcacgucugggcccauugcguuccauguucacugcaggaggcggacacagugcuacuccgcacuacggaugaguuucagaucuacaguuggaagaaaguaauuuggaucuaucugagcgcucuuaacuccgccuucggccugaccccggaccaccccuugaugacagaugaagaguacauuaucaaucgagcaauacguaagccugaccucaaagugagaugcaucaagguccagaagauuagguauguguggaacuaccuggaaggucaauuucagaaaaucgggucucuggaggauuggcucucgucagccaagauucaucagaaauucggaagcggcuuaacucgggaggaacaggagauccgcagacugauauguggcccaaauaccauugacguugaagugacacccaucuggaaacuuuugauuaaggagguccugaacccuuuuuauaucuuccaacuauuuagugugugccucugguucuccgaagauuacaaggaguacgcuuuugcaaucauuauaaugucuaucauuagcaucucccugaccguauaugaccuuagggagcagucaguuaagcugcaccacuugguggaaagucauaauagcauaacugucucugugugugggcggaaagccggagugcaggagcucgaaucccgcguccugguuccaggugauuuacugauucucacaggcaacaaggugcuuaugcccugcgacgcuguacugaucgaggggucauguguggucgaugaaggaauguugaccggcgagagcaucccugugacgaaaacuccacuaccgaagauggacaguucuguucccuggaaaacccaguccgaggccgauuacaagcgacacgugcuguucugcgguacagaagucauucaagcgaaagcagccuguagcgggacugugagagcuguaguucuccagaccggauucaauacagccaagggcgaccuggugaggucgauccuuuauccuaagccagucaacuuucagcuguaccgggacgcaauucguuucuugcucugccuggugggcaccgcuacgauagggaugaucuauacuuuaugcgucuacgugcugucuggagagcccccugaagagguugugcgcaaagcccuagauguaauuacaaucgcggucccacccgcccucccggcagcucugaccacugguaucauuuaugcccaaagaaggcuuaagaaacggggcauauuuuguaucuccccucagcgaauuaaugugugcgggcaguugaaccugguuuguuucgacaagacaggaacccucacgcgcgauggccuggaccuuugggguguggucucaugcgauagaaauggguuucaggaagugcauaguuucgcuagcggccaagcccugcccuggggaccauugugugcagccauggcuuccugccacucucucauccuguuagacggcaccauucagggggauccucuggaccuaaaaauguuugaggcgacaacuugggagauggcauucagcggagaugacuuucacaucaaggguguacccgcccaugcuauggugguuaagccauguaggaccgccucacagguccccguggaaggcauagcaauccuccaccaguucccuuuuaguuccgcccugcaacggaugacagugauuguccaggagaugggaggggaucgccuugcuuucaugaaaggcgccccagaaagaguugcgagcuuuugccagccggagacugugcccaccucuuucgugucagaguugcagaucuacacaacccaagguuucaggguaauugcacuggcuuacaagaaacucgaaaacgaccaucacgccacuacgcugacacgugagaccgucgaaagugacuuaaucuuucuggggcuuuugauacucgagaaucggcugaaggaagagacuaaaccugugcuagaggaacugauuagcgcacgaaucagaaccguuaugauuacaggcgauaaccuccagaccgccaucacuguggcuaggaaguccggaauggucucugagucgcagaaggugauacugaucgaagccaacgagacaacgggcagcuccucagcaaguauuucuuggacccuuguugaagagaaaaagcauaucauguaugggaaucaggacaacuacauuaauauccgcgaugaggugagcgacaaaggacgggaagguuccuaucacuucgcuuugacuggcaagucauuucacguaauaagccaacauuucucuucccuguuaccaaaaauucucaucaacgggacaaucuuugccagaaugagucccggacaaaagagcucucuggucgaggaguuccagaaacuugauuacuuugugggcauguguggugacggggcgaaugauugcggcgcccugaagauggcucacgugggaauuuccuugucagaacaggaagcaagugucgccagcccuuucaccucgaagacaccaaacaucgaguguguuccccaucucauuaaagagggcagggcugcccuggugacuuccuuuugcauguucaaguauauggcacuauacucuaugauacaguauguaggggugcugcuccuguacugggaaaccaauagccuuucaaacuaccaguuuuuguuccaggaccuggcgaucacgaccuuaauuggagucacaaugaaucucaacggcgccuauccgaaacuggugccuuuucgcccagcuggucgacuuaucagucccccucugcuacucuccguuauuuucaauauccuguugucucuggccaugcacauagcaggguucaucuuagugcaacggcagcccugguacagcgucgagauucacuccgcuugcacugugcagaacgaaucaaucagcgagcucaccaugaguccaacagccccugagaagauggaaucuaauuccacuuuuaccagcuucgagaacacgacaguuugguuucugggaaccauuaauuguaucacuguggcacuugucuucucgaaaggcaagcccuuucgucagccaacauauaccaacuacauauucguacugguguugauuauccaacucgguguuugccuguuuauccuauucgccgauauuccggaacuguauagaaggcuugaccuccuguguacuccuguguuguggcgcgcuucaauagucaucaugcugucuuuaaacuuuauugugagucucguagcggaggaagccgugaucgagaaucgggcacuguggaugaugauuaagagaugcuucggcuaccaguccaaaagccaguauaggaucuggcagcgagaucuugcuaacgaccccucuuggccaccccugaaucaaaccagccauuccgauaugccugagugugggcgcggagucucauacaguaacccaguuuuugaaagcaaugaggaacaguuguga

SEQ ID NO: 53142 - RNA, 3063 nt, Artificial Sequence
  derived and/or modified sequence opt3 from ATP1A2__Homo_sapiens__NP_000693
augggcagaggggccggaagggaguacagccccgcugcaaccacagccgaaaacgguggcgggaagaaaaagcagaaagagaaggaacuggacgagcucaaaaaggaaguggcgauggaugaccacaaacuuucccuggaugaguugggacggaaauaucaagucgacuuaucuaagggccugacuaaucagcgcgcucaggauguucuagcccgagacgguccuaacgcacucacgccaccgcccaccacaccugagugggugaaauucugccgucagcuguuugggggauucucaauccuucuguggauuggcgccauauuguguuuucucgcuuacggcauccaagcagccauggaagaugagccaaguaaugacaaccuguaucuggggguagugcucgcugccgucgugauuguuacuggaugcuucagcuacuaucaggaagcgaaguccucuaaaaucauggauucguuuaagaauauggugccccagcaggcauuagucauuagagagggugagaagaugcaaaucaacgccgaagaggugguaguuggcgaccugguggaagucaaagggggagauagggugccugcugaccuucggauaaucucaagccauggcuguaagguggauaauaguuccuugaccggugagucugaaccacagacacgcagccccgaguucacccacgagaacccucuggaaacuagaaauauuugcuuuuucuccacaaacugugucgaggggaccgccaggggaaucguuauugcaacgggcgaccggacugugaugggccgcaucgcuacccuagccucagggcucgaaguaggacgaacaccaauagcgauggagauugaacauuuuauccagcugauuacugguguggccgucuuccuuggcgugaguuucuucguucugagcuugauccucggguacucuuggcuggaggcagugaucuuuuuaauuggaauaaucgucgcuaaugugccggagggccugcucgccaccguaacaguuugccuuacccugacggcuaaaagaauggccaggaagaacuguuuggugaaaaaucuagaagcagucgagacucuggguuccacaucaaccauuugcagcgacaagacugggacacucacccagaaccggaugacgguggcccacaugugguucgauaaucaaauccaugaagcugacaccacagaggaucagaguggcgcgacuuucgacaaacguucucccaccuggacagcacugucccgcauagccggacuuuguaacagagcugucuuuaaggccggccaggaaaacauuagcgugucgaagagggauacugcaggggacgccucugaguccgcucuguugaaaugcaucgagcucucauguggaaguguucggaagaugcgagaucgcaauccuaaaguggccgaaaucccauucaacagcaccaauaaguaucaacuguccauucacgagagagaagacucuccccagagccacguauuagucaugaaaggugcaccugagaggauccuggaucggugcucaacaauucuagugcagggcaaggagauaccacucgacaaggaaaugcaggaugcguuucaaaacgcuuacauggagcuagggggacuuggcgaacgcguuuuggguuucugccagcugaaucuccccagugggaaauuuccgagaggcuucaaguuugacaccgacgagcugaacuucccuacugaaaaacuuuguuuugugggacugauguccaugaucgaucccccaagggccgcagucccugacgccgugggcaagugccguagcgcugggauuaaaguaaucauggugacgggagaucaucccaucacagccaaggcaauugcuaaggguguuggcauaaucucugaggggaaugagaccgucgaagacauugccgcgcgguugaacaucccaaugucacaggugaauccccgagaggccaaggcuugugugguccacggaagugaucucaaggacaugacuagcgaacagcuggaugagauucugaaaaaccauaccgaaaucguuuucgcaagaacauccccucaacagaaguuaauaaucguggagggcugccagaggcagggugccauuguggcuguaaccggggacggcgucaaugauucuccagcccugaaaaaggcagacaucggaauugcgaugggcaucucggggagcgauguguccaagcaagccgcugacaugauacuccuggaugacaacuuugccucaauuguuacuggaguggaggaaggccgccuuaucuucgacaauuugaaaaagaguauugcauacacacugacgucuaacaucccggagauaacccccuuucuccuguucaucauugcuaauaucccuuuaccacuggguacugucacaauucuuuguaucgauuuggggaccgacauggugcccgccauaagccucgcauaugaagccgcugaguccgauauuaugaaacggcagccuagaaacucacagacagacaagcugguuaacgaaaggcuaaucagcauggcguacggacagaucggcaugauucaagcccuggguggcuucuuuacuuauuucgugauccucgcagagaauggguuucugccaucucgccuuuugggcauucgacuggauugggacgaucggaccaugaacgacuuagaggauuccuacggacaggaauggacguaugagcagcguaaaguagucgaauuuaccugccacacagccuuuuucgcuaguauaguggugguccaaugggccgaccucaucauuuguaagacuagaaggaauagcguuuuucagcaggggaugaaaaacaagauccugauuuucggacuucuggaggagaccgcuuuggcagccuuucucucuuacugccccggcauggguguggcgcugcgcauguauccgcuaaagguaacauggugguucugugcuuuuccuuacucccugcucaucuucauauacgaugaagugcggaaacugauccuuagaagguauccagggggaugggucgagaaggaaacuuacuauuga

SEQ ID NO: 53143 - RNA, 3075 nt, Artificial Sequence
  derived and/or modified sequence opt3 from ATP1A3__Homo_sapiens__NP_001243142
augggcgggugggaggaagagagaaacaggcgggccaccgacaagaaagaugacaaggauagccccaaaaagaauaaaggaaaggaacgccgagaccuggaugaccucaagaaagagguggcuaugacagaacacaagauguccgucgaggagguuugccguaaauacaacacugauugugugcagggucuuacgcauucuaaggcacaagaaauccuggccagagacggcccuaaugcguugaccccaccgcccacaacuccugaguggguaaaauucugcaggcaguuauuugggggauucucaauucugcuauggauaggcgcuauccucuguuuucuggccuaugguauucaggcagggaccgaagaugacccaaguggagauaaccuuuaccugggcaucguguuggccgcugucgugauuaucacaggcugcuucagcuauuaccaggaggcaaaguccucuaagauaauggagucguuuaaaaauaugguuccccaacaggcccucgugauccgggaaggggagaagaugcaggucaacgcugaagaggugguaguuggagaccugguggaaauuaaagguggcgaucgcgucccugccgaccugagaaucauuucagcgcacggguguaagguggacaauagcagucucaccggagaguccgagccacagacuaggucucccgauugcacacaugacaacccuuuagaaacccggaauaucacguucuuuagcacuaacuguguggagggcaccgcacgcggugucguuguggccacaggggaucgaacuguaaugggaagaauagcuacccuggccuccggccuugaagugggcaaaacaccaauugcaaucgagauugaacacuucauccaauugaucaccggggucgcuguguuucugggaguuucauucuuuauucuaagucucauacuggguuauacguggcuugaggccgugaucuuccugauuggcaucauagucgcgaaugugccggagggguugcucgccacuguaacaguuugccugaccuuaacugcaaagaggauggcucggaaaaacugucuggugaagaaucucgaagccgucgagacacuuggaagcaccucuacgauuugcuccgacaagaccggcacacugacucagaaccguaugaccguggcucauaugugguuugauaaucagauccacgaagccgacacaacugaggaucagucagguaccagcuucgacaaaaguucucacacaugggucgcauugucccauaucgccgggcuauguaaccgcgcuguguucaagggcggacaagauaacauucccguucugaaaagagacguggcgggcgaugcaagcgaaucggcccuccugaagugcaucgagcuuucuuccgggucaguaaaacugaugagggagcggaauaagaaggucgcugaaauuccuuuuaacaguaccaauaaauaccaguugagcauacacgagacugaagacccaaacgacaaucgauaucuccuggugaugaagggagcccccgagcgcaucuuagauagaugcuccacgauucugcuacaggguaaagagcaaccucucgacgaagagaugaaggaagcauuccagaacgccuaccuggagcuuggcggguugggagaaaggguucugggcuuuugucauuacuaucucccagaggagcaguuccccaaagguuuugcuuucgauugcgacgaugugaauuuuacaaccgacaaccuguguuucgucgggcuuaugucuaugaucgauccgccucgggccgcagugcccgacgcgguaggcaagugccgcagcgcuggaaucaaggugauuaugguuacuggcgaucacccaauaaccgccaaagcaaucgccaagggggucggaauuaucucagaagguaaugagacaguggaagacauugcugccagacugaacaucccugugagucaggucaaucccagggaugcaaaggcuuguguuauacacggcaccgacuugaaagauuuuacuuccgagcaaaucgacgaaauucuccagaaccauacagagaucguguucgcccguacgagcccacagcagaaacugauuaucguggaggggugccaacggcagggagcgauaguagccgucaccggcgacggugugaaugauucucccgcuuuaaagaaggcagacauugggguugccaugggcaucgcuggaucagaugugaguaaacaggccgcagacaugauucugcuagaugacaacuuugcgagcaucgucacuggcguggaagaggggcgacucauauucgauaaucugaagaaauccaucgccuacacacuuaccucuaacauuccugaaaucacaccauuuuugcuguucauuauggcuaacaucccgcucccccugggaacuauaaccauuuuauguaucgaccugggcacggauaugguuccugccaucucgcuugcauaugaggcugccgaaagcgacauuaugaagagacagccaaggaauccccgcaccgauaaauuggugaacgagcggcucaucuccauggcauacggucaaauugggaugauacaggcccugggaggcuucuuuucauauuucguaauccuagcugagaaugguuuucugccuggcaaccucgucgggauuagacugaauugggacgauaggacagugaacgaccuugaagacaguuacggacagcaguggacuuaugagcaacgcaagguggucgaauuuaccugccacacagcguucuucguuucuaucgugguagugcagugggccgauuugauuaucuguaaaacucgacggaauagcgucuuucagcaaggcaugaagaacaagauacugaucuucggguuauuugaggagaccgcacucgcugccuuccuguccuacugcccaggaauggacguggcccuucguauguacccccugaaaccgucauggugguuuugugcuuucccuuauagcuuuuugauuuucguuuacgaugaaaucagaaagcucauucugaggcgcaauccaggcgguuggguggagaaagaaacguauuacuga

SEQ ID NO: 53144 - RNA, 498 nt, Artificial Sequence
  derived and/or modified sequence opt3 from ATP1A4__Homo_sapiens__NP_001001734
augauccaggcccuggcuggcuucuuuaccuacuucgugauucucgcagagaacggguuuagacccgucgaccuucugggaauaagguugcacugggaagauaaguauuuaaaugaccuggaggauagcuacggucaacaguggacauaugaacagcggaaaguuguggaguucacuugccagacggccuuuuucguaaccaucguggucgugcaaugggcggaccuaauuaucuccaagacacgccgaaacucucucuuucagcagggcaugcguaauaaaguucugauuuucgggauccuugaagagacucuguuggcugccuuucucucauacaccccuggaauggauguggcacugagaauguauccacugaagauaacaugguggcucugugccaucccguacaguauuuuaaucuucgucuaugacgagauuaggaaacugcuuauccggcagcaucccgauggcuggguggaacgcgagaccuacuacuga

SEQ ID NO: 53145 - RNA, 912 nt, Artificial Sequence
  derived and/or modified sequence opt3 from ATP1B1__Homo_sapiens__NP_001668
auggccagaggcaaggcuaaagaggaagggagcuggaagaaauucaucuggaacuccgagaagaaagaauuucugggaaggaccgguggcucuugguucaagauucuccuguuuuacgugauauucuaugggugccuugcaggaaucuuuauuggcacaauccaggucauguuguuaacuauuucagaguucaagcccacguaccaagaccggguugccccuccaggucugacccagaucccgcagauacagaaaacagaaaucaguuuucgccccaaugauccuaagagcuaugaggcguacgugcuaaacauuguacgauuccucgagaaauauaaggacuccgcucaacgugaugacaugaucuuugaagauuguggggacgugccaucugagcccaaagaaagaggagauuucaaucacgagaggggcgagcggaaggucugccgcuuuaagcuggaauggcuuggcaacuguucggggcugaaugacgagacuuacggauauaaagaagguaagccuugcauuaucauaaaauugaacagagugcucggcuucaagccaaaacccccuaagaaugagucacuggaaaccuacccaguuaugaaauacaacccgaaugugcugcccguccaguguacagggaagagggaugaggacaaggauaaagugggaaacguagaguauuuuggccucgguaauagcccuggguucccauuacaguacuaucccuacuauggaaagcugcuucagccuaaauacuugcaaccacugcuagccguucaguucaccaaccucacuauggacacagaaauucggaucgagugcaaggcauauggcgaaaauauuggcuacagugagaaagaucgcuuucaggggcgauucgacgugaagaucgaagucaaguccuga

SEQ ID NO: 53146 - RNA, 873 nt, Artificial Sequence
  derived and/or modified sequence opt3 from ATP1B2__Homo_sapiens__NP_001669
auggugauccagaaggagaaaaagagcugcggccaagucguugaagaguggaaagaguucguguggaaccccagaacccaccaguuuauggggaggacaggaacuuccugggccuucauucugcucuuuuaccuuguauucuaugguuuucugacggcuauguucaccuugacaaugugggugauguuacagacugucucugaccauaccccuaaguaccaggaucggcuggcaacaccaggccuaaugauacgcccgaaaaccgaaaaucucgacgugaucguuaacgugucagauacugaaaguugggaccaacacguccagaagcugaauaaguuucuugagcccuauaacgauagcauucaggcccagaaaaaugacgugugucgaccugggcguuacuaugagcaaccagauaacggaguacugaauuaccccaagagagcgugccaguucaacaggacacaguugggcaauuguuccgguaucggggacucuacccauuauggauacucgacgggccagccuugcguuuuuauuaaaaugaaccgggugaucaauuucuacgcuggcgccaaccaaucaaugaaugucacuugugcagggaagcgcgaugaagacgccgagaaccucggaaauuuugugauguucccagcuaacgguaacauagaucugauguauuuucccuacuauggcaaaaaguuccacgugaauuacacccagccucuggucgcaguuaaguuccucaacgugacaccaaauguagaagugaacgucgagugcagaaucaaugccgcuaacauugccacugacgaugagagggacaaauuugcggggcggguggcauucaaguuacgcaucaauaaaaccuga

SEQ ID NO: 53147 - RNA, 2610 nt, Artificial Sequence
  derived and/or modified sequence opt3 from ATP2A1__Homo_sapiens__NP_001273004
augggcaagguguacagagccgacaggaaaagcguccagcggaucaaggcucgcgauauuguucccggggacauaguggagguagcagugggagauaaagucccugccgacauccggauucuggcgaucaaguccaccacacuccguguggaucaaucuauucuuacuggugaaucaguuagugugaucaaacacacggagccagucccggaccccagagcugugaaccaggauaagaagaauaugcuguucagcggcaccaacauagccgcagggaaagccuugggaaucguagcuacaacuggcguugguaccgaaauugggaagaucagggaccagauggcagccacagagcaggauaaaaccccuuuacaacagaagcuggacgaauuuggagagcagcuauccaaagugauuucucucaucugcgucgcuguguggcugauaaauauuggccauuucaacgauccagugcacggcgggucgugguuucggggagccaucuauuacuucaagauugcggucgcacuugccguugcugccauccccgagggucugccugcagugaucacuacauguuuggcucucggcacccgcagaauggccaagaaaaaugcgauuguaaggucacugccaagcguggaaacgcuggggugcaccagugucauauguuccgacaagacuggaacacucacuaccaaccagaugucugugugcaaaauguuuaucauugauaagguugacggcgacaucuguuuacugaaugaguucagcauaacagguuccaccuaugcccccgaaggggaggugcuuaaaaacgauaagccuguccggccaggacaauacgacggcuugguggagcuggcaacgauuugcgcucuauguaaugauucaagucucgacuuuaacgaagccaaaggcguauaugagaagguuggggaagcuacugagacagcccugaccacucuuguggaaaagaugaaugucuucaacacagaugugcgcagccugucuaaagucgagcgagcaaaugccugcaacuccgugaucagacaguugaugaagaaagaguuuacccucgaguucucaagggaccgaaagagcaugaguguuuacuguucuccggcuaaauccagccgugcggcagugggaaauaagauguuuguaaagggugcccccgaaggcgucaucgaucgcugcaacuaugugagaguugggacgaccagggugccucugacaggaccagucaaagaaaagauuauggcugugaucaaagaguggggcacuggucgggacaccuuacgaugucuggcccucgcaacacgcgauacucccccuaagagagaagagaugguacuugacgauucggccagguuccuggaguacgaaaccgacuugacauuuguggggguugucggcaugcuagacccaccccggaaagaggugaccggaucuauucagcugugccgcgaugcuggcauaagagugaucaugauuacuggggacaacaagggaacggccaucgcaaucugcaggcguauugguauauucggcgaaaaugaggaagucgcggaucgggcuuacacagggcgagaguucgacgaucucccgcuggccgagcagagagaagcauguaggcgcgccugcuguuuugcucggguugagccuucccauaagucaaaaaucguggaauaucuucaaaguuacgacgagauuaccgccaugacuggagauggcgugaacgacgcacccgcucugaagaaagccgagaucgguauugcgauggggagcggcaccgccguagcuaagacagcauccgaaauggucuuggccgaugacaauuucucuaccaucguggcugccguugaggaaggcagagcaauauauaacaauaugaaacaguuuaucagguaccucauuagcucaaacgugggagaggucgugugcaucuuccugacugcggccuuagggcugccagaagcucuaauuccuguucagcuccugugggugaaucuuguaacagauggauugcccgccacggcacuggguuuuaacccacccgaccucgauaucauggaccgcccuccacgaaguccgaaggagccccugauauccggcuggcuuuucuuucgguauauggcuauugggggauacgucggcgccgcaaccgugggugccgcugcguggugguuccuguaugccgaggacgggccucacgugaauuacagccaauugacucauuuuaugcaguguacagaagauaacacccacuucgagggcaucgacugcgaagucuuugaggcaccagaacccaugacaauggcucucucuguucuggugacuauugagauguguaaugccuuaaacucacugagugagaaucagagccuacuccguaugccuccauggguaaacaucuggcugcuuggauccauaugcuugucuaugucgcugcacuuccucauccuguacguggaucccuuaccgaugauuuuuaagcugagagcccuugacuugacccaguggcucaugguccugaaaaucagccuaccugugauuggccuggaugaaauccucaaguucguugcuaggaauuaucuggagggguga

SEQ ID NO: 53148 - RNA, 2994 nt, Artificial Sequence
  derived and/or modified sequence opt3 from ATP2A2__Homo_sapiens__NP_001672
auggagaacgcccacaccaagacaguggaagagguccugggccauuucgggguuaaugaaagcacuggacucucccuugaacaggugaaaaagcugaaagagagaugggguucuaacgaguugcccgcugaggaaggcaagacguuacuggagcuaguaaucgaacaauuugaggaccuccuggugaggauucuucuguuggcagccugcauaucauucguccucgcgugguuugaggaaggggaggaaaccaucacagcuuucguggagccuuuuguuauucugcugauccucguggccaaugcaauugucggaguguggcaggaacggaacgccgagaaugcuaucgaggcauuaaaagaauacgagccagaaaugggcaagguauaucgccaggaucgaaagaguguucagcguauaaaagccaaggacaucgugccgggugauauugucgagaucgcugugggggacaaagugcccgccgauauuagacugacuagcaucaaguccaccacacuuagggucgaccaaucuauauugaccggagaaucgguuucagugauuaaacacacugauccuguaccagacccccgggcggugaaccaggauaagaagaauaugcuguucagcggcacaaacaucgcagccggcaaagcuaugggggucgugguugccaccggagugaauacggagauugguaagauccgcgacgagauggucgcaacugaacaggagagaaccccucuacagcaaaaacucgaugaauuuggcgagcagcugaguaaggugaucucccuuauuuguauagcuguauggaucauuaacaucgggcauuucaaugacccaguucacggaggcucuuggauaaggggugccauuuacuauuuuaaaaucgcgguggcccuggcagucgcugccauccccgaaggguugccugcugugauuacaacuugccucgcccugggaacccggcgcauggcaaagaaaaacgccaucguccgaagccugccauccguggagacacugggcuguaccucaguuauuugcagugauaagacgggcacucucacaaccaaucagaugagcguguguagaauguucauacuugacaggguagagggggacacuugcucucugaacgaauuuacaaucaccggauccacguacgcuccgauuggugagguccauaaggaugacaaacccgugaauugucaccaguaugauggcuugguugaacuagcgaccaucugcgcacuguguaacgacucagcccucgauuacaacgaggcuaaggggguguaugagaaagucggagaagccacagagacugcacugaccugccuuguggaaaagaugaauguauucgacacagagcugaaaggcuugagcaagaucgaacgggccaacgcuuguaauagugugauuaagcaacucaugaaaaaggaguuuacucuggaguucucucgugaucgcaaauccaugagcguuuacugcaccccuaacaagccaucgagaacaucuauguccaaaauguucgucaagggugcccccgaaggggugauagacaggugcacccacauccgggugggcucaacuaaggucccuaugacgaguggaguuaaacagaagauuaugagcgugauccgagaguggggcuccgggucugauacauuacgcugucuggcacuagcgacccaugacaauccacucagaagggaagagaugcaccuggaagauagcgcuaacuuuauuaaauacgagacuaaucuuaccuucgugggaugcguagguauguuggaucccccgcggaucgaggucgccucaagugugaagcugugucgccaggcaggcauaagaguuaucaugauuacaggggacaacaaaggaaccgccguggcuaucugcaggcguauuggcaucuuuggucaagacgaagacgucacuuccaaggccuucacagggcgggaguuugaugaacucaauccuagcgcacagcgagacgcuugucugaacgccagaugcuucgcgaggguggagcccucucauaagucaaaaauaguugaauuucuucagaguuucgaugagauuacggccaugaccggcgacggagugaaugaugcuccagcacugaagaaagccgagaucggcauugcuauggggagcggaacugccguagcaaagacagcguccgaaauggucuuggccgacgauaacuuuucuaccaucguggcugccguggaggaaggucgcgcaauauauaauaacaugaaacaguucauccgguaccucauuucgagcaaugucggcgagguuguguguaucuuucugacagcugccuuaggguucccugaggcacugauucccguacaacuacucugggugaaccuggucacugacggacuuccagccaccgcuuugggcuuuaaucccccugaucuggacaucaugaacaagccaccgagaaaccccaaagaaccucucauauccgguuggcuguucuucagguauuuagcgauugggugcuacgugggcgccgcaacgguuggagcugccgccuggugguuuaucgcugcagauggcgggccacgcgugucauucuaucagcugagucacuuucuucaguguaaggaggacaaucccgacuucgaaggagucgauugcgccaucuuugagucuccuuacccaaugaccauggcguugagcgugcucguuacaauugaaauguguaacgcuuuaaauucccuaucagagaaccagagccugcuccgaaugcccccgugggagaauaucuggcuggugggcucuauuugccuuuccaugaguuugcacuuccugauauuauaugucgaaccucucccacugaucuuucaaauuacuccccuuaacguaacccaguggcugaugguguugaagaucagccucccuguuauucugauggacgagacacuaaaauucguggcccggaauuaccuggaacccgcaauccucgaguga

SEQ ID NO: 53149 - RNA, 3159 nt, Artificial Sequence
  derived and/or modified sequence opt3 from ATP2A3__Homo_sapiens__NP_777613
auggaggccgcucaucugcuccccgcagccgacgugcuuagacacuucagcgucaccgcggaaggcgggcuguccccugcucagguuacaggagccagggagcgguacgguccaaacgaauugccgucugaggaaggcaagucauuaugggagcuggugcuagagcaauuugaagaucuccugguacgcauccuucuguuggcagcccucgugaguuucguccuggcuugguuugaggaaggggaggagacuacgaccgcauucguggaaccccugguuauuaugcucauauuaguggccaaugcuaucgucggaguguggcaggagcgaaacgccgaaagcgcgauugaggcacugaaagaauaugagccugagaugggcaagguaauccguuccgacagaaaagguguucagaggauucgggcccgcgauaucgugccaggggacauagucgaaguggcugugggagauaagguccccgccgaccuuagauugaucgagauuaaaucuacaacucugaggguugaucagucgauccuaaccggcgaaucagugagcguaacaaagcacaccgaggcaauuccugacccacgggcugugaaucaagauaagaaaaacaugcucuuuaguggcacuaauaucacauccgggaaggccgucggaguggcgguugccaccggucugcauacggaacuuggcaaaauacgcucucagauggcagcuguggagcccgagcgaacuccucugcagagaaaguuggacgaguucgggaggcagcucagccacgccauuuccgucaucugcguggcuguauggguuauuaacaucggacauuuugccgauccagcacacggcgguucauggcugcguggggccguguacuauuucaaaaucgcugucgcguuagcaguggccgcuauuccggaaggacugcccgccgucauaaccacaugucucgcacuuggcacucggcgcauggccagaaagaaugcuaucgugaggagucugccuagcguugaaaccuugggcugcacaucugugauuuguuccgacaagaccgggacgcuaacuacaaaccaaaugucaguaugccggauguuugucguggccgaggcagaugcgggaagcugucugcuccacgaguucaccaucagugguacuacauacaccccagaaggcgagguucgacagggggaccagcccgugcgcugcggacaguuugacggccuggucgaacuugcuacgauaugugcccugugcaaugauucugcauuggacuauaacgaggccaaagguguguacgaaaagguaggggaggcuaccgagacagcccucacuugucugguggagaaaaugaauguuuucgauaccgacuuacaagcacuguccagagucgaaagggcuggcgccugcaacacagugauuaagcagcuaaugcggaaagaauuuacucucgaguucagccgcgauagaaagucgaugucuguguauuguaccccuacaaggccacaucccaccggacagggcuccaaaauguucgucaagggggcgccggaaucaguuaucgagcguugcaguagcgugcgggugggaucccgaacugccccucugacgcccacaucuagagagcaaauccuugcuaagauuagggacugggguagcggcucagauaccuugcgcugccuggcacucgccacucgggacgcuccaccuagaaaagaagauauggagcuggacgauuguaguaaguuuguacaguacgaaaccgaccuuacauucgucgggugcgugggaaugcuggaucccccaaggcccgagguugccgcauguaucacccgcugcuaccaggcgggcauucgaguggucaugauaacuggugacaauaaagggacagccguggcuaucugucggcguuugggcauuuuuggagacacggaagauguugccggcaaggcauauaccgggagagaguucgacgaucucuccccugagcagcaaaggcaggcuugccgcacugcccgguguuuugcaagaguggaaccagcccacaaaagcaggaucguagagaaccugcagucuuucaaugaaaucacagcuaugaccggagacggugucaacgaugcgccggccuuaaagaaggcagagauuggcauagcuauggggucaggaacagccguggccaaaagugcugcagaaauggugcugagcgacgauaacuuugccuccaucgucgcggcuguugaggagggccgagccauuuacucuaauaugaagcaguucauccgcuaucuaauuucgagcaacgugggugaaguagugugcaucuuucucacugcaauacuggggcuucccgaggccuugaucccuguccaacugcucugggugaaucugguuaccgacggcuuaccagcuacggcacugggauucaaucccccugaucuugacauuauggaaaaauugccacggucccccagagaggcccucaucucaggcuggcuguuuuucagguaccuagcgauugggguguaugucggacuggcuaccguggccgcagccacauggugguuuguuuacgaugcugagggcccgcauaucaacuucuaucagcuccguaacuuccugaaguguagugaagacaauccucuuuuugccgguauagacugcgagguguucgaaucucgcuuuccaacuaccauggcauugagcguccugguaacaauugagauguguaacgcuuuaaauuccgugucagaaaaccagagccuccugcggaugcccccuuggaugaaucccuggcuucugguugccguggcgaugucuauggccuugcacuuccucauccugcuagucccaccucugccccucauuuuucaggugacuccacuguccgggagacaauggguagugguccuucagaucaguuugccgguuauacuguuagaugaggcacucaaauaccugagcaggaaccacaugcaugcuugccuuuacccuggacugcuacgaaccgugucucaggccuggucccggcagccccucacgacaucauggaccccagaccacacuggccuggcuaguuugggucaaggccauagcaucgugucgcuguccgaguuacuccgcgaagggggaucuagagaggaaaugagccagaaguga

SEQ ID NO: 53150 - RNA, 3663 nt, Artificial Sequence
  derived and/or modified sequence opt3 from ATP2B1__Homo_sapiens__XP_011536710
augggcgacauggccaacaauagcguggcuuacuccggggucaagaacucucugaaagaggcaaaucacgauggagacuucgguaucacccucgccgaacuuagagcgcugauggaguugaggucaacagaugcuuuacggaagauucaggaaaguuauggcgacguuuacgggauaugcacuaaacugaagacgagccccaacgagggacuauccggcaauccugccgaucucgaacgccgagaggcaguguuugguaaaaacuucaucccaccgaagaagcccaaaaccuuucugcaacuuguaugggaggcccugcaggacgugacauugauuauccucgaaauugcugcaaucgucucucuggggcugucguucuaucagccuccagagggagauaaugcccucuguggcgaagugucaguuggcgaggaggaaggggagggagaaacugguuggauagagggcgcugccaucuuacugagcguggucugcgugguacuuguuaccgcguuuaacgacuggaguaaggaaaaacaguuccguggguugcaauccagaauugagcaggagcagaaguuuacagugaucaggggaggccaggucauucaaauccccguggcagauauaaccgugggugacauugcccaggucaaauacggggaucugcuaccugcugacggaauccucauucagggcaaugaucugaagaucgacgaaucuagccuuacuggcgaguccgaccauguuaagaaaucacuggauaaggacccauugcuccugagugggacacacgugauggaaggaagcggucggaugguagugaccgccgucggcgugaacucucagacggggaucauuuucacuuuacugggagcaggcggugaggaagaggagaaaaaggaugagaaaaagaaagaaaagaagaauaaaaagcaagacggggcuauagaaaaccgcaauaaagccaaggcgcaggauggcgccgcaauggagaugcagccccucaaauccgaagagggaggcgacggggaugagaaggacaagaaaaaggcuaaccuuccuaaaaaggaaaaaucaguucugcaaggaaaguugaccaagcuagccgugcagaucgguaaagcuggccugcucaugagcgccauuacagucaucauacuggugcuuuauuuuguaauugauacuuucuggguucagaagagaccauggcuggcagaguguaccccgaucuacauccaguauuuugugaaauucuuuauuaucggggucacaguguuggucguggccguucccgaaggacucccucuggcugugaccauuaguuuagcguacucuguaaagaaaaugaugaaggacaauaaccuggucaggcaucuagaugcaugcgagacgaugggcaacgccacugcuauauguuccgacaagacagguacccucacuaugaaucggaugacagugguucaagccuacaucaacgagaaacacuauaagaaagugccagaacccgaggcaauuccuccaaauauccugagcuaccuugucaccgggaucucggugaacugcgccuauacgucuaagauuuugcccccggaaaaagagggcggacugccucgccauguaggcaauaagaccgaaugugcucuccuggggcuucuguuggaccucaaacgagauuaccaggacgugagaaacgagauacccgaggaagcccuguauaagguuuacacauucaauuccgucaggaagucaaugaguacuguguugaaaaacagcgauggauccuaucggaucuucucuaagggugcaagcgagauuauccugaaaaagugcuuuaaaauucuaucagcgaauggcgaagcuaagguguuccguccacgcgacagagaugacaucgucaagaccguuauagagccuauggccagugaagggcucaggacaaucugucuggcauuucgggauuuccccgccggagagccagagcccgaaugggacaacgagaaugauauugugacuggccuuaccugcaucgcugugguagguauugaagacccuguccgaccagaggugccggaugccaucaaaaagugucagcgcgcagggauaacaguuagaauggugaccggcgacaacauuaauacugcuagggccaucgcgacgaaaugcggaauuuugcaccccggcgaagauuuucugugccucgaggggaaggacuucaaccggcgcaucagaaaugagaaaggagaaauagagcaggaaaggaucgacaagauuuggccuaagcugcgugucuuagcccgguccagcccaacagauaaacacacccuggugaagggcaucauugacucuacuguuucagaucaacgacaggugguagcugucaccggugacgggacaaacgauggacccgcacuuaaaaaggccgacgugggcuuugcuauggguaucgccggcaccgauguggcaaaagaggcgagugacauaauuuugacugaugacaacuucacaagcaucgucaaggccguuaugugggggagaaauguguacgauuccaucucuaaguuucuccaguuccagcugacgguaaacguggucgcugugauuguugccuuuaccggagcauguaucacucaagacucgccucuaaaagcugugcagaugcugugggucaaucucauuauggauacacuggccagccuugcauuggccaccgagccacccacagaaucccuguuacucaggaagccguacggccgcaacaaaccucugauaucacggacuaugaugaagaauauccuugggcaugcuuucuaucagcuggugguuguguuuaccuuacucuucgcgggagagaaauucuuugacauugacaguggcagaaacgccccacugcacgcacccccuucugaacauuacacgaucgucuucaauaccuuuguacuaaugcagcuguucaacgagauuaaugcuaggaagauccacggugaacgcaacguguuugaggggauauucaauaacgccaucuuuugcacaauuguucucggaacuuucgugguccaaaucauuaucgugcaguuuggcgguaaacccuucagcuguuccgagcugucaauagaacaguggcuuuggagcaucuuuuugggcauggggacccuguuauggggacaacucauuucuacaaucccaacuucccgacugaaguuccuuaaggaggccggccacgggacccagaaagaagagauuccugaagaggagcuggcugaagauguagaggaaauagaccaugcagagcgggaacuacguagaggacagauccucugguuuaggggccugaaucgcauucagacgcaaauccggguggucaacgccuucagaaguagcuuguaugagggucuggagaagcccgaaucuagguccucaauucacaauuucaugacacauccagaguuucgaaucgaagauagugagccgcacauaccuuuaaucgacgauaccgacgcggaggaugacgcucccacuaaacgcaacagcucgccacccccuuccccaaacaagaauaacaaugccguugauucugggauucaucucacaaucgaaaugaacaaaagcgcaaccucaaguucccccggaucuccucugcacagccuugagacuucccuguga

SEQ ID NO: 53151 - RNA, 3732 nt, Artificial Sequence
  derived and/or modified sequence opt3 from ATP2B2__Homo_sapiens__NP_001001331
augggcgacaugaccaacagcgauuucuacuccaagaaucagagaaacgagucuucacacgggggagaauuugguugcacaauggaggaacugaggagucucauggagcuucggggcacugaagccguggucaaaaucaaggagacguauggggacaccgaggcuauuugucgccgacugaaaacaagccccguugaaggauugccuggcacugcaccagauuuagagaagcguaaacaaauauucggucagaauuuuaucccgcccaagaagccuaaaaccuuccugcagcuagugugggaagcccuccaggacguaacacugauuauccuugagauugcggcuaucauaucccugggguugucuuuuuaccauccacccggagagggcaacgaaggcugcgccaccgcacaagggggagccgaggaugaaggugaggcugaagcaggcuggaucgagggggccgcuauucuccugucggugaucugugucgugcugguuacugccuucaaugacuggucaaaggagaaacaguuuagaggacuccagagcaggauugaacaggagcaaaaguucacagugguccgggcgggccaggugguacagaucccuguugcagaaauaguggucggugauauugcccaggugaaauauggggacuuacugccagcugauggacuuuuuauccaaggcaacgacuugaagauugaugagaguucccugaccggcgaaucugaccaggugcgcaagagcgucgauaaagaccccaugcuacucuccgggacgcacguuauggagggaucagguagaaugcuggugacugccguaggcgugaauagucagaccgggaucaucuucacacuucugggagcaggcggugaggaagaggaaaagaaagacaagaaaggggucaagaaaggcgauggauugcaacucccugcugccgacggcgcggccgcaagcaacgcugccgauucugcuaaugccucccuggugaacgggaagaugcaggacggaaauguugaugcaucacagagcaaggccaaacagcaagacggugcugcggcaauggagaugcagccauuaaagagugccgaaggcggggaugcugacgauaggaaaaaggccucuaugcauaaaaaggagaaguccgugcugcagggaaaacucacuaaacuugcaguccagauuggcaaggccggucuggugaugagcgcuauaaccguaaucauuuugguucuauacuuuacaguggacaccuucgucgugaacaagaaaccguggcugcccgagugcacgccugucuaugugcaauacuuuguuaaguucuucaucauaggggugacuguacucgucguggccguuccagaaggccugccccuugcagugacaauuucgcuggcguauucugucaagaaaaugaugaaggauaauaacuuggugcggcaccucgacgcuugugagaccaugggaaaugccacugcaaucugcuccgacaaaacaggcacccugacgaccaaccgcaugacaguagugcaggccuacguuggggauguccauuacaaggaaaucccugacccaucaaguauuaacacuaaaaccauggaguuacugaucaaugcuauugccauaaacagcgcauauacaacuaagauccuacccccggagaaggaaggagcucucccucgacagguggguaauaaaaccgaguguggccugcuuggguuuguguuggaucugaagcaggacuacgaacccgucagaucccaaaugccagaggaaaaacucuauaagguuuacacauucaacucugugaggaaaagcaugucaaccgugauuaagcugccugaugagaguuuucggauguauuccaaaggagccagcgagaucguacuuaagaagugcuguaaaauccugaauggcgcgggugaaccccgugucuuccgcccaagagacagggaugagauggugaagaaaguuauugaacccauggccugcgacggguugcggacuauauguguggcuuaccgagauuuuccuucuucaccagagccggacugggauaacgaaaaugacauccucaacgagcugacgugcauuugcgucgugggcaucgaggaucccguucgcccugaagugccagaggcaauuagaaagugucagagggccggaaucacaguacggauggucaccggcgacaauauaaacacugcucgcgccaucgcaauuaaaugcgggaucauucaccccggagaagacuucuuaugucuggagggcaaggaauuuaauagaaggauccguaacgagaagggugagauagaacaggagcggauugauaaaaucuggccuaagcuacgagugcucgcgagaaguagcccaaccgacaaacacacacuggugaaggggauuaucgauuccacccauacugaacagaggcaagucguugccgugacaggagacggcacgaaugauggucccgcucuuaaaaaggccgacguaggcuucgcaauggggauagcuggaaccgauguggccaaggaggcaucugacaucauuuugacugaugacaacuuuucgagcaucgucaaagccgugauguggggccgcaauguuuaugauuccauuucaaaguuccugcaguuucagcucacagugaacgucguggcuguuaucguggcguucaccggggccugcauaacacaagacaguccgcugaaagcaguccagauguuauggguaaaccugauuauggauacuuuugcuucucuugccuuggccaccgagccuccaacggaaacccuccugcuacggaagcccuacggaagaaauaaaccucugaucagcaggacaaugaugaagaacauccucggccacgcuguguaccagcuggcacuuauuuucacuuugcuguucguuggugagaagauguuucagaucgacuccgggcgcaaugcccccuuacauucaccaccuagcgaacacuauaccauuauauucaacacauuugugaugaugcaacucuucaaugagaucaacgcgcgaaaaauucacggagaacggaaugucuuugacggcaucuuccguaaccccaucuuuuguacuauugugcuggguaccuucgcuauacagaucguaauugugcaguuuggcgggaagccauucucuugcuccccgcuucagcuggaucaauggaugugguguaucuuuauuggauugggcgagcucgucugggggcagguuaucgccacgauaccuacaaguagacugaaauuccuaaaggaggcaggaaggcugacccagaaagaagagauucccgaagaggaacucaaugaggacguggaggaaaucgaucaugccgagcgcgaacugcggagaggccagauccuuugguuuagggguuugaaccgcauucaaacucagauacgaguggucaaggcuuuccggagcucucuguacgagggguuagaaaaaccagaguccagaacaucaauccacaauuucauggcacaucccgaguuuaggauugaagacagucagccucacaucccacucauugaugacaccgaucuggaggaagacgccgcgcuuaagcaaaacagcucgcccccuuccucucugaauaagaacaauagcgcuaucgauucaggaauaaaccuaacuaccgacacaaguaaauccgccacgucuagcuccccgggcucaccaauccauagccucgagaccagucuguga

SEQ ID NO: 53152 - RNA, 3663 nt, Artificial Sequence
  derived and/or modified sequence opt3 from ATP2B3__Homo_sapiens__XP_005274747
augggcgacauggccaacagcuccaucgaguuccaccccaagccucagcaacagagagaugugccacaggcugggggauuugguugcacccuggcagaacucaggacacuuauggagcugcggggcgccgaagcguugcagaaaauugaggaagcauacggggacgucucuggauuaugucgccgacugaagacuucaccgacggagggccuagccgauaauaccaacgaccucgagaaacguagacaaauauauggucagaauuucauucccccuaagcagccaaaaacauuucugcagcuuguuugggaagcacugcaagaugugacuuugaucauccucgagguagccgcuauugugagucuggggcugagcuucuacgcacccccuggagaagaguccgaggccugcggcaacgucucuggcggggcugaagacgagggagaagccgaggcggguuggaucgaaggcgcagccauacucuuaucggugaucuguguugugcuggucaccgcuuuuaaugauuggucaaaggagaagcaguucagggggcuucagagccggauugagcaggaacaaaaauuuacagugauccgcaacggacaguugcugcagguaccaguugccgcucuaguggucggcgacauugcucaagugaaguauggugaucuccugcccgccgacggggugcuuauccaggcgaaugaucugaaaauagacgagaguuccuugaccggagaaucugaucaugucagaaagagcgccgacaaagacccuaugcuccuguccggcacucacguuauggagggcucagggaggauggugguaacagcagugggagucaacagucagaccgguauuaucuucacguuacugggcgcugggggagaagaggaggaaaagaaggauaaaaagggcaaacagcaagacggugccauggagagcucucagacuaaggcuaaaaagcaggauggggccguggcaauggaaaugcagccacucaaauccgccgagggcggagaaauggaggagcgggaaaagaagaaagcuaaugcgccgaagaaagagaagucaguucuucaaggcaaacugaccaaguuggcagugcagauugggaaggccggucuagucaugagcgcuaucacagugaucauucugguacucuacuuuguuauagaaacuuucguggucgagggacgcaccuggcuggccgagugcacacccguguauguccaguacuuugugaaauucuuuaucauuggcguuaccgugcuuguagucgcagugccugaagggcugccauuggccguuacgaucagucucgcuuauucugugaagaaaaugaugaaggacaacaaucugguccgacauuuagaugccugugagacuaugggaaacgcaacagcgauaugcuccgacaaaaccggcacucugacaaccaauagaaugacggugguacagagcuaccuaggugauacccacuacaaggaaauucccgcuccuucggcccucacaccaaagauccuggaccuuuuggugcaugcaaucucuauuaacuccgccuauacuaccaaaauccugcccccggagaaggaaggggcucucccuaggcaaguuggcaauaaaacagagugugcccugcuuggauucguccuggauuugaagcgggacuuccagcccgugcgugagcagauuccagaagauaaacucuacaagguguauacuuuuaacucaguccgcaagaguaugagcaccguuauaagaaugccugacggcggguucaggcuguuuuccaaaggagcaucugagaucuuacugaagaaaugcacaaacauucuaaauagcaacggugaacuccggggcuuccgaccccgcgacagagaugacauggugaggaagaucaucgagccaauggcuugugaugggcugcggaccauuugcauagccuaccgcgacuuuucagcgggacaggaacccgauugggacaaugagaacgaggugguaggcgaucuuacuuguaucgccgucguggguauugaagacccuguuagaccagaggugccggaagcuaucaggaaaugccaacgugcagggauuacgguccggauggugacaggcgauaauaucaacaccgcccgagcuauagccgcaaagugcggaaucauucagcccggcgaggacuucuugugucuggaagggaaagaguuuaauagaaggauccgcaacgagaagggagaaauugagcaggaacggcucgauaagguuuggccuaaacugagaguguuagcgaggaguuccccaacugacaagcacacccugguaaaaggcaucauagauagcacaaccggugagcaacgccaggucguggccgugacuggggacggaacaaaugacggccccgcucuuaagaaagccgaugucgguuucgcaaugggcauugcugggacggacguugccaaggaggcaucugauaucauuuugaccgacgauaacuuuacuucaaucgugaaggccguaauguggggacgaaauguguaugacaguauaagcaaauuccuccaguuucagcugacagucaacgugguugcugugaucgucgcguucaccggcgccugcauuacacaagauuccccucuaaaggcagugcagaugcuguggguuaaucucaucauggacacuuuugcuucucuggcccuugccaccgaaccacccacggagucguugcuguuacggaaaccguacgggcgugauaagccucucauuagcagaaccaugaugaaaaacauccugggacacgcuguguaucagcuugcaauaauuuucacacuguuguucgucggcgaacucuuuuucgacaucgauuccgguaggaaugccccacugcauucacccccuagugagcacuacacuaucauuuuuaacaccuucguaaugaugcagcuauuuaacgaaaucaaugcgcgcaagauucauggggagcggaacguguucgacggaauauuuucuaaucccaucuucuguacaauuguucugggcacuuuugguauccaaauugugaucguccaguucggcgggaagccauuuagcugcuccccucucucaaccgagcaguggcuguggugucuuuucgugggaguaggcgaauuggugugggggcaggucauagcuacgauccccacaagccaacugaaaugcuuaaaggaggccggacacggcccagguaaagaugaaaugaccgacgaggaacucgcagagggggaggaagagauugaccacgccgaaagagagcugaggcgaggacagauccuuugguuucgcggccugaaccggauucagacucaaaucagaguugugaaggcuuucaggucuucccuauacgaaggucucgagaaaccggagaguaagacaagcauacauaauuucauggcaaccccugaauuucugauuaacgauuauacucacaauauccccuugaucgacgauaccgacguggaugagaacgaggaacgucugcgcgccccacccccuccaucucccaaucagaacaauaacgcgauugacuccggcauauacuuaacaacgcaugucaccaagucagcuacuagcaguguguucucguccucuccugggagcccgcuccacucaguugagacaagucuguga

SEQ ID NO: 53153 - RNA, 3513 nt, Artificial Sequence
  derived and/or modified sequence opt3 from ATP2B4__Homo_sapiens__NP_001001396
augaccaaccccagcgacagagugcugccugccaauuccauggcugagucuagggaaggcgauuucgggugcacagucauggagcuccggaaguugauggaacugcgcucacgagacgcauugacucagaucaacguucacuacggaggugugcaaaauuuauguagucgucugaaaacgagcccaguagagggccuauccgggaacccggccgaucucgaaaagagaaggcaaguguuuggacauaaugucauucccccuaaaaagccaaaaaccuuccuggagcuugugugggaggcgcugcaggacguuacauugauaauccucgaaauugcugccaucauuucucuggugcugucguuuuaucggcccgcaggcgaggaaaacgagcucugcggucaggucgccacuaccccugaggaugaaaaugaggcucaggcaggguggaucgaaggagccgcuauauuauucucagugaucauuguaguucuggugacagccuuuaacgacuggagcaaggagaagcaguuccgcggccuucaguguagaaucgaacaggagcaaaaauuuaguauuaucaggaauggccaguugauacagcugccagucgcggagauuguggugggggauaucgcacaggucaaguacggagaccuacuccccgccgaugguauucugauccaaggcaacgaccuuaaaaucgaugaauccucucugaccggggagagcgaccacguuaagaaauccuuggauaaggacccuaugcuccugucaggaacucaugugauggaaggcaguggucggaugguagugacagcugucggggugaauagccagaccggaauuauauuaacgcugcucggcguuaacgaggacgaugaaggcgagaagaaaaagaaagggaagaaacagggagugccagagaaucgcaacaaggccaaaacucaagacggugucgcacuugaaauccagccgcugaauagccaggagggcauugauaacgaagagaaggacaagaaagcugugaagguacccaaaaaggaaaaauccguuuugcaggggaagcuaacccgacuggccgugcaaaucggaaaggcgggccuccugaugucagcccuuacagucuucauacugauuuuguauuuugugaucgauaacuucgucaucaauagaaggccuuggcucccagagugcacucccauuuacauccaguauuuugugaaauucuuuauuauagguaucaccguucuggugguagcagucccugagggguuaccacuggcugugacaauuagccuagccuacaguguuaagaaaaugaugaaggacaacaaucucgugcggcaccuggaugcuugugaaaccaugggcaacgccacggcaaucugcucugacaaaacuggaacacuuaccaugaaucguaugacugucgugcaggccuauaucggcgggauucauuaccgccagauacccuccccggauguauucuugccuaaggugcuggaccucaucguuaacggaauuagcaucaauucggcuuacacaucuaagauucugcccccagagaaagaagguggccuuccuagacaagucgggaacaagaccgagugugcgcuguugggauucgugacggaucucaaacaggacuaucaggcagugaggaaugagguccccgaagagaagcuguacaaaguuuauaccuuuaacuccgugcggaagucaaugaguacagugauccgaaauccaaacggcgguuuccgcauguacagcaagggggccuccgaaauaaucuuaagaaaaugcaauaggauucuggaccggaagggcgaggcuguacccuuuaaaaacaaggaucgcgacgauauggucagaacugugaucgaaccuauggccugugacggacuaaggaccauuugcaucgcauaucgugauuucgacgauacagagccaucuugggacaaugagaacgaaauacucacugagcugaccuguauugccguugugggcaucgaagauccgguccggcccgaggugccugacgcuauugccaaaugcaagcaggcagggaucacaguucgaauggugaccggagauaacauaaauacugcgagagcuaucgccacgaaaugcgguauucuuacaccaggcgacgauuuucuuugucuggaagggaaggaguucaacaggcucauccgcaaugagaagggagaaguagagcaagaaaaacuggacaagauuuggcccaaauuacggguccuggcaagaagcucaccuaccgacaagcacacucuugugaaaggcaucauagauaguaccgugggugagcacaggcaggucguugccgugacaggggacggcaccaacgauggaccagcuuugaagaaggccgacguaggcuuugcaauggggauugcuggaacugauguggccaaagaagcguccgacaucauccucacagaugacaauuucacgagcauugucaaggccgugauguggggccgcaacguuuacgauucuaucucaaaauuucugcaguuccagcuaaccgugaaugucguggcuguuauuguggcauuuacuggugccugcauaacacaagacaguccccugaaggcuguccagaugcucuggguaaaccugaucauggauaccuucgccagccuugcauuggcgacagagccgccuacugagucccuguuaaaacgacggccauaugggcguaauaagccccucauuucuagaaccaugaugaagaacauccugggacaugccuuuuaccagcuuauugugaucuucauacugguuuucgcuggcgaaaaauuuuucgacaucgauucggguaggaaggccccuuugcacucucccccaucccaacauuacacgauuguguuuaauaccuucguccucaugcagcuguuuaacgagaucaauucacgcaaaauucacggcgaaaagaacguguucagugggaucuaucggaauauaaucuuuuguucuguagugcuaggaacauucauuugccagaucuuuauugucgaguucggcgggaaaccuuuuagcuguacuucccugucacucagccaguggcuguggugccuuuucauaggaaucggcgaguugcuguggggucaauuuauuucugcaauccccaccagauccuuaaaguuccucaaggaagcugggcacggaacaacuaaagaggaaauuaccaaggacgccgagggccuggacgaaaucgaucaugcagagauggagcuuaggcgaggucagauacugugguuccgcggccuaaaccggauccagacgcagauugacguuaucaacacauuucaaaccggggccaguuucaaaggagugcucagaaggcagaauaugggccagcaccuggaugugaaguuggucccaucuagcuccuacguggcuguugcgccgguaaaaucaaguccuacuacaagcgugcccgccgucucguccccacccauggggaaccagucuggacaaagcgugccuuga

SEQ ID NO: 53154 - RNA, 2850 nt, Artificial Sequence
  derived and/or modified sequence opt3 from ATP2C1__Homo_sapiens__NP_001001486
augaagguggccagauuccagaaaauccccaacggcgagaaugaaaccaugauuccuguccugacaagcaagaaagccuccgagcucccaguuucugaaguggcaucaauacuucaagccgaccugcagaacggguugaauaagugcgagguaagucacaggcgggcguuucauggauggaacgaguucgauaucagcgaggacgagccguuauggaaaaaguacauuucccaguuuaagaauccccugaucaugcuacuccuggcuucugccgugauuucgguccuuaugcaccaguucgaugacgcagugucaaucacuguugccauacugaucguggucacgguggcuuuuguacaagaauaucgcagcgagaaaaguuuggaagaacucuccaagcugguuccuccagagugucauugcgugcgagaagguaaacuggagcacacccucgcacgugauuuaguccccggcgacacagugugucugucugugggggauagagucccugccgaccuuagguuguucgaagcuguugaucugagcauugacgaguccucacuaacuggagaaaccacaccaugcaguaaggugaccgcuccccagccugcggcaacuaacggcgaucucgccagccggucuaauaucgcuuuuauggguacacugguacgcugugggaaagccaagggaguggucauuggcaccggcgagaacuccgaguucggggaaguguuuaagaugaugcaggcagaggaagcuccaaaaacgccgcuucagaagucaauggaccuguugggaaaacaacucagcuucuacaguuuugguaucauaggcauuaucaugcugguugggugguuacugggaaaggauauucucgagauguucacuaucucugugucccuugccgucgcggccauccccgaaggccugccuauugugguaaccguuacauuggcacuaggugugaugagaauggucaaaaagagggcuauagugaaaaagcugccaaucgucgagacucucgggugcuguaaugugauuugcagcgacaagaccggaacacugaccaaaaacgagaugacgguuacucauaucuuuacaucggacggccuucacgccgaagugaccggcguaggguauaaucaguucggagaggucauaguggauggugacguugugcacggcuucuacaaccccgcugucucucggauuguggaagccggguguguaugcaaugaugcagugauccgcaacaauacucugaugggaaagccuacagagggcgccuugaucgcucucgcgaugaaaaugggucuggacggguuacagcaggauuauauucgaaaggcagaauacccauuuuccucagagcaaaaauggauggccguuaaguguguccauagaacccagcaggacaggcccgagaucugcuucaugaagggcgcuuaugaacaagugauuaaauacugcacgaccuaccagaguaagggacagacacugacucuaacccagcaacagcgggauguguaucagcaggagaaagcccguaugggcagcgcagggcuccgcguccuggcccuugcuuccggaccggaauugggucaacugacauuucucggccugguugggauaaucgacccucccagaacuggagugaaggaggccgugaccacacuuauugcaucuggcguaagcaucaaaaugaucaccggugauucacaggagacugcggucgcuauugccaguaggcugggguuguacuccaagacgagccagucugugucaggcgaagagauagacgcaauggauguucagcaacucagucagaucgugccaaaggucgccguguucuaucgggcuagcccucgacacaaaaugaagauuaucaaaucccugcagaagaacggaucuguuguggccaugacaggcgacgggguaaacgacgcagucgcuuuaaaagccgcggauauuggaguggccaugggucagaccggcacugacguguguaaggaagcugcagauaugauccuggucgacgaugacuuucaaaccauaaugucggccaucgaggaagggaagggaauuuacaauaacaucaaaaauuucguucgcuuucagcuaagcacauccauugcugcccucacccugaucucacuugcaacuuugaugaacuuccccaauccacugaacgcgaugcagauacucuggauuaauaucauuauggauggucccccugcccaaagucugggcguggagccaguagacaaggaugugaucagaaaaccgcccaggaacuggaaggacucuauauuaacgaaaaaucugauccuuaagauuuuggucagcuccaucauuaucgugugcgggacacucuuuguuuucuggcgggagcugcgcgauaacgugauaaccccuagagacacuacaaugaccuuuacauguuucgucuuuuucgauauguucaaugcucuaucaagcaggucucagacuaaauccguguuugaaauuggccugugcaguaaccguauguucuguuaugccguucucggaagcaucaugggccagcugcuugugaucuacuuuccacccuugcagaaggucuuccaaaccgagucucuguccauuuuagaccuccuguuucuucugggguugacgucaaguguaugcaucguggcagaaauuauaaagaaaguugagcggagccgagaaaagauccagaaacaugugucguccaccucuagcucauuccucgaggucuggcugugggagagaaguggacagcagcuaguggaaauucacccucaccuggagacaggccucccacugacugaagacguauccuguguguga

SEQ ID NO: 53155 - RNA, 2928 nt, Artificial Sequence
  derived and/or modified sequence opt3 from ATP2C2__Homo_sapiens__NP_001273456
augguggagggcagagucagcgaguuccugaagaaacucggguuuuccggagguggcaggcaguaccaagcccuugagaaggacgaagaggaagcucugaucgaugagcagucugaguugaaagcaauugaaaaggagaaaaagguuaccgccuuacccccuaaggaagcgugcaaaugucagaaggaggaccuggcucgggccuucugcguggaucuacacacagggcucucagaguuuaguguaacucagcgccgacuggcacauggauggaacgaguucguggccgacaauagcgaaccagucuggaaaaaguaucuugaucaauuuaaaaacccgcugauauugcuccugcugggcuccgcucucgugucuguuuuaacgaaggaauacgaggacgcagugucgaucgccaccgcuguccuggugguaguuacaguggccuucauucaggaauaucguucagaaaagagccuugaggaauugacuaaacuggugcccccugaguguaauugccuaagagaagguaagcuccagcaucugcuugcgagggagcuggucccaggggauguggucaguuuguccaucggagaccggauucccgcagauauccgccucaccgaaguuacagaccuguuaguggaugagucuagcuuuaccggcgaggccgaaccuuguuccaaaacugacucaccacugacaggcgggggagaucucaccacgcuuaguaacauaguauucauggguacucuggugcaguacggcagagggcaaggagucgugaucggcaccggugagagcucucaguuuggggaaguuuucaagaugaugcaggcugaggaaacacccaaaacuccuuugcagaaguccauggacaggcuaggaaaacaacugacccucuuuucauucggcauuaucggccugauuaugcuuaucggguggagccagggaaagcagcuguugaguauguuuacaauaggugugucucucgccgucgcagcuauuccagagggccugccgaucgugguaaugguuaccuuagugcuggggguccuacggauggccaagaaacgcgugauugucaagaaacuccccaucguggagacgcugggaugcuguuccguucuuugcagcgacaagacuggcacauugaccgcgaaugaaaugacugugacacaacugguaaccucggauggucuccgagccgaggucucuggggugggcuaugacggacagggcacgguuugucugcuuccuuccaaagaagugaucaaggaguucucaaacgucaguguggggaagcugguagaggcaggaugcguggcuaauaacgccguuauuaggaaaaaugcugucaugggucagccaaccgaaggcgccuugauggcacucgccaugaagauggaucugagcgacauuaaaaacuccuacaucagaaagaaagagauucccuucucuagcgaacagaaguggauggcugugaaguguucauuaaaaacagaggaucaagaagacaucuauuuuaugaagggggcgcuggaggaggugauacgguacugcacuauguacaauaacggaggcauuccucuaccacucacaccccagcagcguaguuucugccugcaggaagagaaacgcauggguucccuuggguugagaguccuggcacucgccagcggcccggaacugggaagguuaaccuuucugggccuuguugggaucaucgauccuccccgggugggagugaaggaggcuguacaagucuugucugaaucaggugugaguguuaaaaugauuacuggcgacgcccucgagaccgcacuggccaucgggcgaaauauuggacuauguaacggcaagcugcaggcuaugagcggugaggaaguggauuccgucgagaagggggaacucgccgaccgcgugggcaaaguuucuguguucuuuagaacaucgccaaagcacaaacugaagauaaucaaagcacuucaggagagcggagcgauuguagcuaugaccggcgauggggucaaugacgccguggcauugaaguccgccgacaucggaaucgcuaugggccagacugguacggaugugucaaaagaagccgcaaacaugauucuggucgacgaugacuucagugcuauaaugaacgccguugaggaggggaagggaaucuuuuauaauauuaagaacuucgugagguuucaauuaucuacaagcaucuccgcgcucucacugauuacccuuagcacuguauucaaucugccuucucccuugaacgccaugcagauccucuggauaaauaucauuauggauggcccacccgcucagcgguccagucagaaaaccgaagugugcuguacagcaguccgccuggguguggagggcagaggggaaagcaccugggccggaagggcuggccuagggguugagccuguggacaaggaugccuuucgucaaccaccgcggucuguccgagacacuauccuguccagagcacucauucugaaaauccuuaugucagcggccauaauuaucaguggaacauuguucauauuuuggaaggagaugcccgaagauagggcuagcacgccucgcaccacuacaaugaccuucacaugcuucguguuuuucgaccuguuuaacgccuuaacuugucggucgcagaccaaacucaucuucgagauaggcuuucugagaaaucacauguuccuuuacuccguucuggguucuauccuagggcagcucgcagugauuuauaucccaccccugcaaagggucuuucagacggaaaacuugggagcucuggauuuacucuuccugaccggccuugccagcucaguauuuauucugagugaguugcucaagcugugcgaaaaguacuguugcuccccuaaacgcgugcagaugcauccagaggacguuuga

SEQ ID NO: 53156 - RNA, 3108 nt, Artificial Sequence
  derived and/or modified sequence opt3 from ATP4A__Homo_sapiens__NP_000695
augggcaaggccgagaacuacgaacuguauagcguggagcucgggcccggaccugguggcgacauggcugcaaaaauguccaagaaaaagaaagccgggggaggcggugggaagagaaaggaaaaacuugagaauaugaagaaagaaauggagaucaacgaucaccagcugucugucgcggaguuggaacaaaaguaccagaccucagcuacaaaaggauuaagugccagccuggcagccgagcuacuccugagggacggcccaaaugcucugcggccgccccgcggcacuccugaauauguuaaguucgcacgacagcuggccgggggauugcagugccucauguggguggcugccgcgauuugucugauagcauuugccauccaggcuuccgagggugaucugacgaccgacgauaaccucuacuuagccauugcacugaucgcuguaguggucgugacaggcugcuucggguauuaccaagaguuuaagucuacuaauauuaucgccucguucaaaaaccuuguuccacagcaggcgaccgugauacgugacggagauaaguuucaaaucaaugccgaccaguuggucgugggcgaucugguagaaaugaaagguggggacagaguucccgcagauauuaggauccuagcugcccagggauguaagguggacaacucaagccucacaggcgagagugaaccucagacccgguccccagagugcacucaugaaucuccccuggagacacgcaauauugcuuucuuuagcaccaugugucuugagggcacgguccaagggcugguggugaacacuggagauagaaccaucauagguaggauugccuccuuggcaucaggcgucgaaaaugagaaaacaccuaucgccauugaaaucgagcacuucguugacaucauugcugggcucgcgauacuguuuggagcaacuuucuuuaucguggccaugugcauuggcuauaccuucuuacgggcuaugguauuuuucauggccaucguggucgcauacgugccagaaggucugcucgccacaguuaccgugugucuuagucugacggcuaagcgcuuggccagcaaaaacugcgucgugaagaaucuagaggcaguagagacucuggggucuacauccguuauauguucagacaagaccggcacucucacacagaaccgaaugaccgugagccaucugugguucgauaaucacauucauacggcggacaccacagaagaucagaguggacaaacuuuugaccagucuuccgagaccuggagagcucuuugcaggguccugacauuguguaaccgggccgcauucaaaagcggccaggaugccgugccgguccccaagcguaucgugaucggggacgcuucggaaacugcccuccugaaauuuucugaguuaacccugggaaacgcaauggguuaccgcgauagauucccuaagguuugcgaaauuccauuuaauuccacaaacaaauuccagcuaucaauccacacccucgaggaccccagggauccucggcaccuucuugugaugaagggcgcuccagagcgaguauuggaacgcugcaguagcauucugauaaaggggcaagagcucccccuggacgaacaguggagagaggccuuucagacugcguaucuuucccugggaggcuugggugagaggguccucggguucugucagcuguacuuaaaugaaaaagauuauccgccuggcuacgccuuugacguggaggcuaugaacuuccccucuagcggacugugcuuugcaggccuaguuucaaugaucgacccaccucgggccacggugcccgaugcuguccucaagugucgcacagccgggauuagagugaucaugguaaccggagaccauccaaucacugcaaaagcgauugccgcuaguguggguauaaucuccgaaggcagcgagaccguugaagauauugccgcaaggcugcguguccccguggaccaagugaaucggaaggaugcucgagccugcgucaucaacgggaugcagcuuaaagacauggauccuucugaguugguugaggcacugagaacacacccagaaaugguguucgccaggaccucaccgcagcagaagcucgugauuguagagaguugucaacgccugggagcuaucgucgcggugacuggcgacgguguuaaugauagccccgccuuaaagaaagcagacauagggguggcuaugggcaucgccggauccgaugccgcuaagaacgcagccgacaugauucugcuugaugacaauuuugcgucuaucgucacaggcguggaacaggggcgguugauuuucgacaaccucaaaaagucgaucgcuuauacgcugaccaaaaauauaccugagcuaacuccauaccugauuuauaucacaguuagcgugccccucccucugggaugcauuaccauccuuuucauagaauuguguacagauaucuuuccauccguaucacuggccuacgagaaggcagagagugacauuaugcauuuaagacccaggaacccgaagcgcgaucgacucgucaaugaaccucuggccgcuuacucuuauuuccagaucggcgcaauucagagcuuugccgguuucacugacuacuuuaccgcgauggcucaagaggggugguucccacuucugugcgugggauugcgggcccagugggaagaucaccaccuccaggaccugcaagauuccuauggccaggaguggacguuuggucagcgucuauaccagcaauauaccuguuacacaguguucuuuaucucaauagaagucugccagauugcagacguucugaucagaaaaacuaggcgccucagcgccuuccagcagggcuuuuuccggaacaagauccuggugauugcuaucguauuucaaguguguauugggugcuuccuuugcuauugucccggaaugccuaauauauucaacuuuaugcccaucagauuccaguggugguuggucccacugccuuacggcauuuuaaucuuuguguacgaugagauuaggaaacucgggguucgaugcugucccggaucuuggugggaccaggagcuguauuacuga

SEQ ID NO: 53157 - RNA, 876 nt, Artificial Sequence
  derived and/or modified sequence opt3 from ATP4B__Homo_sapiens__NP_000696
auggccgcucugcaggagaagaaaaccugcggccaaagaauggaagaguuccagagguacuguuggaaccccgacacagggcagaugcucggacggacucuuagccgcuggguguggaucucccuguauuacgucgcauuuuauguugugaugacggguuuguucgccuuaugccuguacguacuaaugcagaccguggauccuuauacaccagacuaccaagaucagcuccgaucuccgggcgucacucugcgucccgacguguauggggaaaagggacuugagauuguuuacaaugugucagauaacagaaccugggcggaccugacacagaccuugcacgcuuuucucgccggcuacaguccugcagcccaggaagauagcauaaauuguacuuccgagcaauauuucuuucaggagucuuucagggcuccaaaccauacaaaauuuucgugcaaguucaccgcagacaugcugcagaauuguucaggucuggccgaucccaacuuuggguucgaagagggaaaaccuugcuuuaucauuaagaugaaucggaucgucaaguuccucccaagcaacggcagugcuccccgcguggacugugccuuuuuagaucagccuagagaacugggccaaccacuucagguaaaauacuauccgcccaaugggacguucuccuugcacuacuucccuuauuacggaaagaaagcgcagccacauuauucuaacccccugguugcagccaagcuacucaauauuccuaggaacgcugagguggccaucgucugcaaagugauggcagagcacgugacuuuuaauaacccacaugaccccuacgaagguaaggucgaguucaagcugaaaauagaaaaguga

SEQ ID NO: 53158 - RNA, 1662 nt, Artificial Sequence
  derived and/or modified sequence opt3 from ATP5A1__Homo_sapiens__NP_001001937
augcugagcgugagagucgccgcugcaguugugagggcccucccccggcgcgcgggccuuguaucccgaaacgcucuggggucuucauucaucgccgcacguaauuuucacgccaguaacacccauuugcagaagacaggaacugcugagaugagcuccauuuuagaagagagaauacugggugcagacacgucuguggaucuagaagagaccggcaggguccucucgaucggggacggaauugcccgggugcacggccugcgcaauguucaagcugaagagaugguggaguucucaagcggucuuaaagggaugagucugaacuuggaaccugauaaugucggagugguaguuuuuggcaacgacaagcucaucaaagagggcgauauugugaagagaacaggggccaucgucgacgugccagugggagaggagcugcuggguagggucguugaugcgcucggcaaugcaauagacgggaaaggaccgaucggcuccaagacucggcgccgaguggguuuaaaggcccccgggauuaucccuagaauuucuguaagggagccaaugcagaccggaaucaaagcuguggauagccugguccccauaggccggggccagcgugaacuuauuaucggggaccgccagacaggaaagaccuccauugccaucgauacuaucauuaaccagaaaagauucaaugacgguucagaugagaagaaaaaguuguacugcauauauguggcaaucggccaaaagaggaguacaguugcucagcuggugaaacggcuaaccgacgccgacgcgaugaaguacacgauugucgugagcgccacugcaucugaugcugccccucuccaguaucuggcuccauacuccggguguucaaugggagaauauuuucgagacaacggcaaacaugcccuuaucauauacgaugaccugagcaagcaagcaguagccuaucgccagaugaguuugcuccugagaaggcccccuggucgggaggcuuacccaggggauguuuucuacuuacacucucgccugcucgaaagagcggcaaaaaugaaugacgccuuuggcggaggcucccuuaccgcucugccggugauugagacacaggccggggaugucagcgcauauauccccacuaacgugaucucgauuaccgacggacagaucuucuuggagacagaacuauuuuacaaggguauuaggccugccauaaaugucggccugucugugucccguguugggucagcugcccaaacccgggcaaugaaacagguggcgggaacgaugaagcucgagcuggcucaguaucgagaaguagccgcauucgcccaauuuggcagugaucuugacgcugccacucagcagcuguugagcagaggugucaggcucacagagcuguuaaagcaggggcaauacuccccaauggcaaucgaagaacagguggcuguuauuuaugccggcgugcgcggauaccuggauaaacuagagcccucuaagaucaccaaauucgaaaacgcguuucucagccaugucgugucacagcaccaggcccugcuuggcacuauccgggcugacgggaagauuagugagcaauccgacgcaaaauugaaggaaauaguaacaaauuuccuggccggauucgaggcuuga

SEQ ID NO: 53159 - RNA, 1590 nt, Artificial Sequence
  derived and/or modified sequence opt3 from ATP5B__Homo_sapiens__NP_001677
augcugggcuucguggggagagucgccgcugcacccgccagcggagcgcucaggcggcuuaccccuuccgcuucucugccaccggcccaguuguuacugcgcgcagcccccacagcuguucacccugugcgagacuacgcagcccaaacuucaccaagucccaaggcuggugccgcgacgggccguaucguagcagugauuggggccgucguggauguucaguuugacgagggacuaccuccaauacucaacgcucuggaagugcagggcagagagaccaggcuuguccuggaaguggcccagcauuugggugagagcacaguacggacuaucgcaauggaugggaccgaaggacucguucgcggccaaaaagugcuggacuccggcgcucccauuaagaucccugucgggccagagacacugggaagaauuaugaaugugaucggugagccgauagaugaaaggggccccaucaaaaccaagcaguucgccccuauucacgcggaggccccagaauuuauggagaugucuguggagcaggaaauccucgucacugggauuaaaguuguggacuuacuggcacccuaugcuaagggaggcaagaucggucuuuucgggggagccggcguaggcaaaacaguguugauaauggagcugauuaacaaugucgcuaaggcccaugggggauacucgguguuugccgguguuggcgaacggacccgcgaggggaacgaucuauaucacgaaaugaucgagucaggagugauuaaucucaaagacgcaacgagcaaggucgcucugguguacggccagaugaacgagccuccaggugcgcgagcaagaguagcccuuacugggcugaccguugcugaauauuucagggaucaagagggccaggacguguugcucuuuaucgauaauaucuuccgguuuacacaggccggaagugaagucuccgcacuguuaggccguauucccucugccgugggguaccagccgacucuggcuaccgacaugggaacaaugcaagagcgcauaaccacgacuaaaaaggguagcaucacauccguccaggccauuuaugugccugcagaugaccucaccgaccccgcgccagcuacuacauucgcccaucuugaugcaaccacgguucugucaagagccaucgcugaauugggcauauacccugccguggacccccuagauaguaccagcaggauuauggacccaaacaucguagggucugagcacuacgaugucgcacggggagugcagaagauccugcaagacuauaaaucccuccaggauauuaucgcuauucugggcauggacgagcuuucagaagaggauaagcugacaguuagccgagcccgcaaaauacagagauuuuugagucagcccuuccaaguggcggaagucuuuacuggucacauggggaagcucgugccucugaaagagaccaucaagggcuuccagcagauuuuagccggagaauacgaccaucugccagagcaggcuuucuauaugguaggcccgaucgaggaagcaguggccaaagcugauaagcuagccgaggaacacucuuccuga

SEQ ID NO: 53160 - RNA, 897 nt, Artificial Sequence
  derived and/or modified sequence opt3 from ATP5C1__Homo_sapiens__NP_001001973
auguucagcagagccggcguggcugggcuguccgcauggacccuccagccccaauggauccaggucaggaacauggccacacuuaaggacauuacucggcgccugaaaucuauaaagaauauccagaaaauuacgaagucaaugaaaaugguugcggcugccaaguacgcacgagccgagcgugaauugaagccugcuagaaucuauggauuagguagucuggcacuauacgagaaagccgauauuaagggcccagaagacaaaaagaaacaccuccugaucggggugagcuccgauaggggacuuugcggcgcuauacauucuucgaucgccaagcagaugaagucagagguagcgacccugacagcagccgguaaagaagugauguuggucgggauuggagacaagauccggggcauucucuaucgcacucacagcgaucaauuucugguggcuuucaaagagguuggcagaaagccgcccaccuuuggggacgccagugugaucgcacuggagcucuuaaacuccggauacgaauuugaugaggguucuauaauuuuuaauaaauucaggagcgucaucuccuauaagacagaagagaaaccuauuuucucacugaacaccguggcuagugccgacagcaugucuaucuacgaugacaucgaugcggacguacuucagaauuaucaggaguacaacuuggccaauauuauauacuauucccugaaggaaucaacuacaagcgagcagagugcacggaugaccgcuauggauaacgccucuaagaaugcuuccgaaaugaucgacaaacuaacgcucacuuucaaccgcacccgacaagccguuauuacaaaggagcugaucgaaauaauuagcggcgcagccgcucuugacuga

SEQ ID NO: 53161 - RNA, 507 nt, Artificial Sequence
  derived and/or modified sequence opt3 from ATP5D__Homo_sapiens__NP_001001975
augcugcccgccgcucuccuuagaaggccuggccuggggcgguuggugcgccacgcacgagccuacgcggaggcugccgcagccccagcugcagccagcggaccgaaccagauguccuucaccuuugcuucucccacacaagucuucuuuaauggugccaacguucgucagguggacguaccuacuuuaacgggcgcguucgggauccuggcagcccaugugccaacccuacagguccucagacccggacuggugguugugcacgcugaagauggcacaacuucaaaguauuuugucaguagcgguuccauugccgugaaugcagacucuucgguacagcuucuggcugaggaagccguuaccuuggauaugcucgaccugggggcggccaaagcaaaccuggagaaggcucaagccgaacucgugggaacagcugaugaggccaccagggcagagauacagauccggauugaagccaaugaggcuuuagucaaagcgcuggaauga

SEQ ID NO: 53162 - RNA, 156 nt, Artificial Sequence
  derived and/or modified sequence opt3 from ATP5E__Homo_sapiens__NP_008817
augguggccuacuggagacaggcuggccugagcuauaucagguacucccaaauuugcgcaaaggccguccgggacgcgcucaaaaccgaguucaaggcuaacgccgagaaaacaucugggucaaauguuaagauagugaaaguaaagaaggaauga

SEQ ID NO: 53163 - RNA, 411 nt, Artificial Sequence
  derived and/or modified sequence opt3 from ATP5G1__Homo_sapiens__NP_005166
augcagaccgccggcgcucuguucaucagccccgcacucauuagaugcuguacaagggggcuuauacggccuguguccgccucuuuucugaacucaccagucaauaguagcaagcaaccguccuacucuaacuuccccuugcagguugcgcgccgagaguuucagacuucggugguaucacgugacaucgauacggcugccaaauucauuggagccggugcagcuaccgugggcgucgcagggagcggagccggcaucgguacaguguuugggaguuuaauuaucggauaugcuagaaauccuucccugaagcagcaacuauucucuuacgccauacucggcuuugcgcugagcgaagcaaugggccuuuucugccugaugguugccuuuuugauccucuucgcuauguga

SEQ ID NO: 53164 - RNA, 474 nt, Artificial Sequence
  derived and/or modified sequence opt3 from ATP5G2__Homo_sapiens__NP_001002031
augcccgagcugauccucagcccugccaccgcuccacacccgcuuaagauguucgcaugcuccaaauuugugucuacacccucacuggucaagaguacuagccaguuguuauccagaccucugucugccguugugcuaaaaaggccagaaauucucacggacgagucgcugucaagccuugcgguaaguuguccccugaccuccuuggugucuagccgguccuuccaaacaucagcuauaagucgcgauaucgacacugccgcaaaguuuauuggcgccggggcugcaaccgucggaguggccgguagcggcgcugggaucggaacaguuuucggcucucucauuaucgguuacgcccgaaacccuucccugaaacagcagcuguuuucauaugcgauacucggguucgcauuaagcgaagccaugggacuguuuugccuuaugguggcuuucuugauccuguuugccauguga

SEQ ID NO: 53165 - RNA, 429 nt, Artificial Sequence
  derived and/or modified sequence opt3 from ATP5G3__Homo_sapiens__NP_001002258
auguucgccugcgcuaagcuggcauguacccccagccucaucagagccggcuccaggguggcguaccggccuauuucugcuucaguccuuagucgcccagaggccagccgaacaggggaaggauccacuguuuuuaacggugcacagaauggcgugucucaacugauacagcgugaguuccagacgucggccaucucaagagacauugauaccgcugcaaaauuuaucggggccggagcugccacaguaggcguggcggguagcggggcaggaauuggcacugucuucggcaguuugaucauaggguaugccaggaacccguccuuaaagcagcaacuguuuucuuacgcuauccuaggauucgcccucagcgaagcaaugggucuguuuugccuuaugguggcuuuccugauuuuguuugccauguga

SEQ ID NO: 53166 - RNA, 414 nt, Artificial Sequence
  derived and/or modified sequence opt3 from ATP5H__Homo_sapiens__NP_001003785
auggccggcagaaagcuggcucucaaaaccaucgacuggguggcauucgccgagauuauaccccagaaccaaaaggcgaucgcuagcucccuuaaaucuuggaaugaaacacugacuucaagguuggccgcauuaccugagaacccaccggccauugauugggcuuacuauaaggcaaaugucgccaaagcugggcugguugacgauuuugaaaagaaggugaaaaguugcgccgaguggguaagccuauccaaggcgcggaucguggaauacgagaaagagauggaaaagaugaaaaaccucauucccuucgaccagaugacgaucgaggaucugaaugaagcauuuccugagaccaaacuugacaagaagaaguauccauacuggccccaccagccuauagagaaccuguga

SEQ ID NO: 53167 - RNA, 267 nt, Artificial Sequence
  derived and/or modified sequence opt3 from ATP5J2__Homo_sapiens__NP_001003713
auggccagcgugguccccguuaaggacaaaaagcugcucgaggugaaacuuggcgaacugccuuccuggaucuugaugagagauuucucuccaucagggauuuuuggagcuuuccagagggguuacuaucgguacuauaacaaguacauaaaugugaaaaagggcaguaucagcgggauuaccaugguauuagcaugcuauguccuguuuuccuacucuuucucguauaagcaccuaaaacaugagcgccuccgaaaguaccacuga

SEQ ID NO: 53168 - RNA, 327 nt, Artificial Sequence
  derived and/or modified sequence opt3 from ATP5J__Homo_sapiens__NP_001003696
augauccugcagagacucuucagguuuagcuccgugauucggucugccgucucaguucaccuucgccgaaacauaggcgugaccgcuguagcauucaauaaggagcuggaccccauccaaaaauuguuuguggauaagauucgugaauacaaaaguaagagacagacaagcgggggaccugucgacgccuccucugaguaucagcaggaauuagagagggaacuguucaaacuaaagcaaauguuugguaacgcggauaugaauacuuucccaacguuuaaguucgaggacccgaaauuugaggugaucgaaaagccccaggcuuga

SEQ ID NO: 53169 - RNA, 312 nt, Artificial Sequence
  derived and/or modified sequence opt3 from ATP5L__Homo_sapiens__NP_006467
auggcccaguucgugagaaaccuggucgagaagacccccgcucucguuaaugcagccgugacauacagcaaaccuaggcuugcgacuuuuugguauuacgcuaagguagaacuggugccaccgacgcccgccgagaucccucgggcaauucaauccuugaaaaagauagucaacucugcccagaccggcucauucaaacaguuaacagugaaggaagcuguucugaaugggcuaguggcaacugagguccucaugugguuuuaugugggagaaaucauugguaagcgcggcaucauuggguacgacguauga

SEQ ID NO: 53170 - RNA, 642 nt, Artificial Sequence
  derived and/or modified sequence opt3 from ATP5O__Homo_sapiens__NP_001688
auggccgcucccgcagugagcggccuguccagacaggucaggugcuucucuaccucaguugugcggccuuuugccaagcucguacgcccaccggugcaagucuacgggaucgagggacgauaugcgacagcucuuuacagugccgcaagcaaacagaacaagcuggaacagguggagaaagaauuguuacguguugcccagauucugaaggagcccaaaguggcugcauccguccuaaauccuuaugugaagagaucuauaaagguaaaaucgcucaacgacaucacugccaaggaaagguucucaccacugacgaccaaucuuauuaaccuguuggcugagaauggucggcucagcaacacacaaggcguugugagugccuuuuccacuaugaugucuguccaccgcggggaggugcccuguaccgugacaagcgcguccccucuggaagaggcaacccugucagaacucaaaacugucuuaaagaguuuccugagccagggacagguucuuaaauuggaggccaagacagauccaucuauccugggcgguaugauugugagaaucggggagaaguacguagacauguccgugaaaaccaagauacagaaacuaggaagggcuaugcgggaaaucgucuga

SEQ ID NO: 53171 - RNA, 1413 nt, Artificial Sequence
  derived and/or modified sequence opt3 from ATP6AP1__Homo_sapiens__NP_001174
augauggccgcuauggcaaccgccagagugaggaugggcccccggugcgcgcaggcucuguggcgcaugccuuggcucccagucuuccuuagccuggccgcagccgcugcagccgcugccgcggagcaacagguuccguugguguuaugguccucugaccgagaucugugggcacccgccgcugacacacacgaagggcauaucacuucagaucuacagcucaguacguaccuggacccugcccuugagcugggaccacguaacguauugcucuuucugcaggauaagcugagcauugaagacuucaccgcauaugguggcguguuugggaauaaacaagauuccgcuuucucuaaccucgagaaugccuuagaccuggcgcccucgucacuugucuugccugccguggauugguacgcaguuagcacacugacuaccuaucuacaggaaaagcucggagcuaguccacugcacguggaccuugccacacugagagaguugaaacucaacgcuucccugcccgccuuacugcucauaaggcuuccuuacaccgcaucuagcggccugauggccccacgggaggucuugacugguaaugaugaagugaucgggcagguacuauccacacugaagucagaggacguuccguauaccgcugcgcucacggcagugcgccccaguagagucgccagggauguggcuguggucgccggaggccugggccggcagcuucugcaaaaacagccuguuagcccagugauucaucccccuguaucuuacaacgacacugcaccacgcaucuuguuuugggcccagaauuucuccguggcuuauaaggaccagugggaagaucucacaccccugaccuuugggguccaagaguuaaaccugacuggaucauucuggaaugacagcuuugcccgacuaagucucaccuacgagagacuguucgguacaaccgugacguuuaaguucauucuugcaaacagguuguacccgguuucugcgcggcacugguuuacuauggaacgucuggaggugcauuccaauggcagcgucgcuuauuucaacgccucucaggugacagggccuucgaucuacuccuuccacugugaauauguaucaagucucagcaaaaagggaucccugcuuguugcacgcacccagcccucuccauggcaaaugaugcugcaggauuuucagauacaggccuucaaugugaugggcgagcaauuuagcuacgcuucagacugcgccaguuucuuuuccccugguaucuggaugggguugcucacuagccuguucauguuauuuauuuucacauauggacugcacaugauccuaucucucaaaaccauggauagauuugacgaucauaagggccccacgauuucacugacccagaucgucuga

SEQ ID NO: 53172 - RNA, 675 nt, Artificial Sequence
  derived and/or modified sequence opt3 from ATP6AP1L__Homo_sapiens__XP_011542025
augagacuguggaaggccagggugcucaaacuuguccugaagaccgcuaaagacagccgguugggcuuaaacuccaaguggcugucucuaaaacucggggaugcaggaaauccccgcucacuggccauccgauucauucuuacaaacuacaauaagcugaguauacagagcugguuuuccuugcguagaguugagaucauuucuaacaauucgauccaagcgguguucaacccuacugguguauaugcuccaucaggcuacagcuauaggugccagcggguggggagucuccagcaggaccaagcccugcugcucccguccgauacggacgauggaucuagcuuaugggaagucaccuuuauugacuuccagauccagggcuuugcaauaaagggugggcgcuucacaaaagcccaggauugugcuuccucauuuagucccgcauuccugaucggacuugccaugagcuugauucugcuacucgugcuggcuuacgcccuucacaugcugaucuauuugagauaccucgaccaacaguaugaucugauugcgucuccugcacauuuuucccaguuaaaggccagggacacugcugaggaaaaagagcugcuccggucacagggcgccgaaugcuacaaacuucgcagccaacagaucaguaagauauacguuuga

SEQ ID NO: 53173 - RNA, 1053 nt, Artificial Sequence
  derived and/or modified sequence opt3 from ATP6AP2__Homo_sapiens__NP_005756
auggccguguucgucguucugcucgcucuuguggcaggcguacuggggaacgaguuuagcaucuugaagucccccggaucuguggucuucagaaaugguaacuggccuauuccaggcgaaaggauaccggacguggccgcguuaucaaugggguuuaguguuaaagaggaucugagcuggcccggacuagcugugggcaaucucuuccaccggccucgcgccaccgucauggugaugguaaaggguguuaacaaacuggcacuuccacccggguccgugaucucuuacccucuggaaaaugccgucccauuuucguuggacucaguggcuaacagcauucauagucucuucuccgaggaaacacccgugguccugcagcuggcaccuucugaggagcgaguuuauauggugggaaaggccaauagcguauuugaagaucucuccgugacuuuacgucaacugagaaacaggcuuuuccaggaaaauucagucuugaguagccugccacuaaacucucucucccggaauaacgagguggaccugcuuuuucugucagaguugcagguucuccacgauaucagcagucuguuaucucgccauaaacaccuggcuaaggaccauuccccggaucucuacagccuugagcuggccggcuuggacgaaauuggcaagagauauggggaggauucggaacaguucagggacgcgucuaaaauccuaguggaugcacugcaaaaguuugccgacgauauguacucccucuauggagguaaugcugucguggagcugguaacgguuaaaucauucgacaccagucuuauacggaagacacgcacuauccuggaagccaaacaggcaaagaaccccgcuagcccuuacaauuuggccuauaaguacaacuuugaguacuccguggucuucaacauggugcucuggauuaugaucgcgcuggccuuagcagucauuaucaccucuuauaauauauggaacauggacccaggcuacgauagcauuaucuaucgaaugacaaaucagaaaauuagaauggacuga

SEQ ID NO: 53174 - RNA, 2517 nt, Artificial Sequence
  derived and/or modified sequence opt3 from ATP6V0A1__Homo_sapiens__NP_001123492
augggcgagcuguucagaagcgaagagaugacccucgcccagcuuuuucugcaauccgaagcugcauacugcugugugucugaguugggggaauuaggaaagguccaguucagggaccugaaccccgauguuaauguguuucagcggaaauucguaaacgaggugcgccgaugcgaggaaauggaccguaagcuaagauuugucgagaaagaaaucaggaaggccaauauuccuauaauggauacaggugagaacccagaggugccguucccccgggacaugaucgaucucgaagcgaauuuugagaaaauugaaaacgagcugaaggaaaucaauacuaaccaggaggcucuuaagcgcaauuuccuggaguugacggaacucaaauuuauucugagaaagacccaacaguucuuugacgaggccgaacugcaccaucagcagauggcagauccugaccucuuagaggaaucaaguagccugcuugagccauccgagaugggcagggggacacccuugcggcugggauucguugccggcgugaucaaccgcgaacgaauaccuacuuuugagagaaugcuauggagggucugucgggguaauguguuccuccgucaagcugaaaucgagaacccacuggaagaucccguaaccggggacuauguucacaaaucuguguucauuaucuuuuuccagggagaucagcuuaagaaucgcgucaaaaagauuugcgagggcuuuagagcaucgcuguacccuuguccagagacaccgcaggaaaggaaggagauggccucaggcgugaacacccggaucgacgauuugcaaauggugcucaaucagacugaagaccaucgacagcgcguccugcaagcugccgcgaaaaacauaagaguuugguucauuaaggugaggaaaaugaaggcaaucuaucacacauuaaaccugugcaauauugacguaacccagaaaugucucaucgccgagguguggugccccgucacggaucuugacagcauccaguuugcucugcggcgcgggacugagcauaguggauccaccgugccuucuauuuugaacagaaugcagacaaaucaaacuccacccaccuacaacaagacaaauaaauucaccuaugguuuucagaacauaguugaugccuacggcaucgggacguauagggaaauuaauccugcaccauacacuaucauaacauuccccuuucuauucgcugugauguuuggagacuucggccacgguauucugaugacccucuuugccgucuggauggugcugcgugagagccggauccuuucccagaagaacgaaaaugagauguucucaacuguauucagugggcgauacaucauucuguugaugggaguuuuuagcauguauacaggccucaucuacaacgauuguuucucuaagucccugaauauuuuuggcucaagcuggagugugagaccgauguucaccuauaacuggacggaagagaccuuaagggggaauccuguccugcagcuaaaccccgcgcucccaggaguguuugguggcccuuaccccuucgggauagacccaaucuggaauauugccacaaacaaacugacuuuucuuaacucuuucaagaugaaaauguccgucaucuugggaaucauucacaugcuguuuggcgugagccucucgcuguucaaucauauauauuuuaagaaaccccuuaacaucuacuucgguuuuauuccugagaucauuuucaugaccucucuguucggguauuugguuauccucauauuuuacaaguggacagcauacgaugcucacacuuccgaaaaugccccaucacuguuaauccauuucauuaacauguuucuguucaguuauccggagagcggcuacuccaugcuauauucuggacaaaagggcauccagugcuuucucgugguagucgcucugcuuugugugcccuggauguugcuguucaaaccucucguucugcgccggcaguacuuaagaaggaagcaccuggggacccuuaauuuuggagguauucgcgugggcaacgggccaacagaagaggacgccgaaaucauacagcacgaucaauugagcacccauucagaggacgcagaugaguucgacuuuggagacacuaugguccaccaggccauucauacgaucgaauauugccucggcugcauuaguaauacagcuuccuaccugcgacuaugggcgcugagccucgcacacgcccagcugucugaggugcuuuggaccaugguaauccauauagguuugucagugaaaagucuggcugggggcuuaguucucuucuuuuucuucacugccuuugcaacccugacagucgccauccuucugauuauggaaggauugagcgcuuuccuccacgcccugcggcuacacuggguggaguuucagaacaaguucuauuccggcaccggguuuaaauuccugcccuuuucuuucgaacauauccgugagggaaaguuugaggaauga

SEQ ID NO: 53175 - RNA, 2571 nt, Artificial Sequence
  derived and/or modified sequence opt3 from ATP6V0A2__Homo_sapiens__NP_036595
augggcagccuguucagauccgagaccaugugccucgcccagcuuuuucugcaaucugggacagcuuacgaauguuugucagcauuaggagagaagggucuggugcaguucagggaccuaaaccagaaugucaguagcuuucagcggaaauucguuggcgaagugaagcgcugcgaggaacucgagcgaauccugguauaucuugugcaagagauuaaccgugccgauauaccccugccugaaggggaggcguccccaccggcucccccuuugaaacagguccucgaaaugcaggagcagcugcaaaagcuggagguggaacucagagagguuacuaaaaauaaggaaaaguuaaggaaaaaccugcuugaguugaucgaauacacgcacaugcugcgggugaccaagacauuugucaaacgcaauguggaguucgagccaacuuaugaagaguuucccucucuagaaucggacucacuccuggauuacagcuguaugcagagacuuggagccaagcugggcuucguaagugguuugauuaaccaggggaaaguugaggcauuugaaaagaugcucuggagggugugcaagggauauaccaucgucuccuacgccgagcuggacgagucuuuagaagauccugagacaggcgaagugauuaaaugguauguguuccugaucagcuuuuggggcgagcagauagggcauaaggucaaaaagaucugugacugcuaccacugucauguuuacccauaucccaauaccgcugaagaacggcgcgagauucaagaaggacucaacacucgaauccaggaucuuuacacagugcugcacaaaaccgaggacuauuugagacagguacuaugcaaggcagccgaauccguguacucaagggucauucaagugaaaaagaugaaggcuaucuaucauaugcugaauauguguaguuucgauguuacgaacaaaugccucauagccgaggugugguguccugaggcggaccugcaggaucuucggcgugcacuggaagaggguagccgcgaaucuggcgccacuauuccauccuuuaugaauaucauuccgaccaaggagacacccccuacuagaaucaggaccaacaaauucacagaaggguuccagaauaucgucgacgcuuacggagugggcucauaucgggagguaaacccagccuuguuuaccauuauaacguuccccuuucucuucgcaguuauguuuggugauuucgggcacggauuugugauguuccuguuugcuuuacugcuaguccucaaugagaaccacccucgacugaaccagagccaagaaaucaugcgcauguucuuuaauggcagauacauucuuuugcugaugggccucuucaguguguacacugggcugaucuauaacgacugcuuuucuaaguccgucaaucuuuucggaagcgguuggaacgugucggccauguacucuuccucacauccacccgcggagcacaaaaagaugguucuguggaaugacagugugguaaggcauaacagcauauugcagcucgauccguccauuccuggcgucuuccgggggcccuauccacugggaaucgacccuaucuggaauuuagccacaaaccgccugaccuuucuaaauucuuucaagaugaaaaugagcgugauucucggcaucauucacaugacuuuugguguuauacuggggaucuucaaccaccuucauuuuagaaagaaauucaauauuuacuuggugucaauccccgaacugcucuuuaugcugugcaucuucggcuauuuaauuuuuaugauauucuacaaguggcuggucuuuagugcagagacauccaggguggcuccaagcauccuuauugaguucaucaacauguuuuuguuccccgccucuaaaaccucaggacucuauacgggccaggaguacguacagcgugugcugcuaguugucaccgcucugagugugccugugcuuuuccuggggaagccacucuuuuugcugugguuacacaauggacggagcuguuucggugucaaccgauccggcuacacacucauuagaaaggauucugaggaagagguuucgcugcuugggagccaagacaucgaagagggaaaucaucagguggaagauggcugcagggagauggccugugaggaauuuaacuucggugagauacugaugacucaggugauccacuccauugaauauugcuugggguguaucucaaacaccgcaaguuaccuccgccugugggcccuaucucuggcucaugcgcagcucagcgacguacugugggcaaugcuuaugcgggucggcuugagaguggauacaacuuauggaguucuguuacuccugccggugauugcccuuuuugcuguccugaccaucuucauacuacucauuauggagggccuguccgccuuuuugcacgcaaucaggcugcacuggguggaguuccaaaauaaauuuuacguuggggccggaacaaaguucgugcccuuuucauucagcuuacucucuuccaaauucaacaaugacgauaguguagcuuga

SEQ ID NO: 53176 - RNA, 2523 nt, Artificial Sequence
  derived and/or modified sequence opt3 from ATP6V0A4__Homo_sapiens__XP_005250451
auggugagcgucuucagauccgaggaaaugugccugucucagcucuuucuucaaguugaggccgcuuacuguugcguggcagaacugggcgaguugggguuaguacaguucaaggaccugaacaugaaugugaacucauuucagaggaaauucgucaaugaagugcggcgcugugagagucuagagcgaauccuccguuuucuggaagaugagaugcagaacgaaauuguugugcaacuucuggaaaagagccccuugaccccucucccaagagagaugauaacacuggagacuguccuggagaaacucgaaggagaguuacaggaagccaaucagaaccagcaagcgcugaagcaguccuuccuugaguugacggagcugaaauaucuacucaagaagacccaggacuuuuucgaaacagagacuaaucuggcugaugacuuuuucaccgaagauacaucuggucuucuggaguugaaagccgugccggcauacaugaccggcaagcucggguuuaucgccggaguaauuaacagggaacggauggcuucguucgagcgccuguuauggagaaucugcaggggcaauguuuaucugaaauuuucagagauggacgcaccccucgaagauccugugacuaaggaggaaauucagaaaaacaucuucauaaucuucuaccaaggugagcagcuucggcagaagauuaagaaaaucugugacggguuucgcgccacagucuauccaugccccgaaccugcuguggagcgaagagagaugcuggaaagcgugaaugucagguuggaggaucuaauuaccguuaucacgcaaacugaaagucaccggcagcgucugcuccaggaggccgcggcaaacuggcauuccuggcugauaaaggugcagaaaaugaaggccguauaccacauucuuaauauguguaacaucgacgugacccaacagugcgucauugcugagaucugguucccaguggccgaugcaacacgcaucaaaagagcucuggaacagggaauggaguugucuggcagcuccauggcccccauuaugacuaccguucagucaaagacagcgccuccaaccuuuaauaggacgaacaaauucacugccggcuuucaaaacauaguggacgcauauggggucggaaguuaccgggaaaucaauccggcucccuacacaauuaucaccuucccuuuucucuucgccgugauguuuggugauuguggccaugggacuguaaugcuguuagcugcccuguggaugauacuaaacgagcgacgccuccugagccagaagacagacaaugaaauuuggaacaccuucuuucacggaagauaucuuaucuugcugaugggcaucuucucuauuuacacgggucucaucuauaaugacugcuuuuccaagucacugaacauuuucgggagcaguuggucuguucagccaauguucaggaauggaaccuggaacacacaugugauggaggagucccuuuaccugcaguuggaucccgcaauaccuggcgucuauuuuggcaauccauaccccuucgggaucgacccgauuuggaaccucgccagcaauaaacugaccuuuuuaaacucguauaagaugaaaaugucugugauccugggaaucguccaaaugguguucgguguuauucuaucccucuuuaaucacauauacuuccggcgcacucugaacaucauucuucaguuuaucccugaaaugauuuucaucuugugucuguuuggcuaccucguguucaugauaaucuuuaaguggugcugcuucgauguacacgucucacagcaugcucccaguauucugauccacuuuauuaauauguucuuauucaacuauagcgacuccucuaacgcgccacuguacaaacaucagcaagaggugcagagcuuuuucguugugauggcacuuaucucagucccuuggauguugcucauaaagcccuuuauucugagagccagucacaggaagucccagcuacaagcuagccguauccaggaagaugccacagagaauauugaaggggacucuucaaguccaagcucccggucuggacagcgaacuucggcagauacccacggcgcccuggacgaucauggugaggaguucaacuuuggggacguguucguacaccaggcuauccauacaauagaauauugucucggcugcaucagcaauaccgccuccuaccugagacuuugggcauugucacuggcgcacgcucaauuaagugaggugcucuggacuaugguuaugaacucuggacugcagacgaggggcuggggagggauugucgguguguuuaucauuuucgccguguuugcaguccuuacaguugccauccuguugauaauggaaggccucagcgcuuuccugcaugcccuacgccugcacuggguggaguuucagaauaaauucuaugugggggauggauacaaguucucccccuuuucauucaaacacauucucgacggcaccgcagaagaguga

SEQ ID NO: 53177 - RNA, 468 nt, Artificial Sequence
  derived and/or modified sequence opt3 from ATP6V0C__Homo_sapiens__NP_001185498
augagcgaguccaagucuggccccgaauacgccucauucuuugcugugaugggggcaagugccgcgauggucuucagcgcucugggagccgcauaugguaccgccaaauccggcacagggaucgcugcaaugucuguuaugagaccugagcagauuaugaagucgauaaucccagugguaauggccggaauuaucgcuauuuacggccucguggucgccgugcuuaucgcgaacucacugaaugacgauaucagcuuguauaaauccuuuuuacaacugggugcagggcuaaguguuggacucucuggccuggccgcuggcuucgccauagggauugugggagacgcuggugucaggggcacugcacagcagccgcggcuuuuuguggggaugauccugauuuugaucuucgccgaaguacucggacuguacggccugauaguugcgcucauuuuaagcacgaaguga

SEQ ID NO: 53178 - RNA, 1056 nt, Artificial Sequence
  derived and/or modified sequence opt3 from ATP6V0D1__Homo_sapiens__NP_004682
augagcuucuuucccgagcuguacuucaacguggacaauggcuaucucgaagggcuugucagaggacugaaggccgguguuuugucccaggcugauuacuuaaaccuggugcaaugcgagacccuagaagaccucaaacugcaccuucagucuacagauuauggcaauuuucuggcaaacgaggccucaccuuugacuguaagugugaucgacgauaggcucaaggaaaagauggucguggaguuccggcauaugcgcaaucacgcguacgagccacuggcuagcuuucuggacuucauuacguauuccuacaugauagauaacguuauccucuuaauuaccgggacacugcaucagcgaucuaucgccgaacuugugccgaaaugucaccccuugggaucguuugagcagauggaagcagucaauauugcccaaacuccugcugagcuguauaacgcaauccuaguggacaccccacucgccgcuuucuuucaggauugcauaucagagcaggaccuggaugaaaugaauaucgagauuauccguaacacacuuuacaaagccuaccuggaaaguuucuauaaguuuuguaccuugcucggcgguacuacagcggacgcaaugugccccauucuggaguucgaagccgauagaagggcuuuuaucauaaccauuaauagcuucgggacggaguuauccaaggaggaccgggccaaacuguucccucauuguggacgccucuacccagaaggccuugcacagcuggcuagagccgacgauuaugagcaaguaaagaacguugcggacuacuaucccgaauacaaauugcuauuugagggcgccgggucuaauccuggagauaagacucuggaagacagguucuuugagcacgaggugaaacucaacaagcuggcauuccuuaaucaguuucacuucggugucuuuuaugcuuucgugaagcugaaagaacaggagugccggaacaucguguggauugccgaauguaucgcucagcgccaucgagccaagaucgauaacuacauuccaauauuuuga

SEQ ID NO: 53179 - RNA, 246 nt, Artificial Sequence
  derived and/or modified sequence opt3 from ATP6V0E1__Homo_sapiens__NP_003936
auggccuaccacggccugaccgugccccucaucgucaugagcguuuucuggggguuugugggauuccuuguaccuugguuuauuccaaaggguccgaacagaggcgugauaaucacaaugcuggucacuugcuccguguguugcuauuuguucugguuaauugcuauccuggcacagcuaaauccccucuuugggccucaacugaaaaacgagacgauuugguaccuuaaguaucauuggccauga

SEQ ID NO: 53180 - RNA, 642 nt, Artificial Sequence
  derived and/or modified sequence opt3 from ATP6V0E2__Homo_sapiens__NP_001094062
augagagugaggggccccgcccggcugaucgcuagcggggcacgccuccuucugcgaauguuguccgccuuaccuggaugggguccagcgcaucugcagcguccgcuacucggccccgcuucuugccuggggauucuuagaccugccaugaccgcacacucauucgcccugccagucauaaucuuuacaacuuucuggggauugguuggcauugcuggucccugguuugugccuaaggggccaaacaggggaguaaucauuacgaugcucguggcaaccgccgucuguugcuaccugcugugucccgcucucggcaugacaguggccccuuuaagucugacuaccccaagcuccggcccgucucccacacaacuuugcuugguuaccucgucacugcuacucgcgccucgggacccagauccccaggggcugccuggaagcuggaaaaguucccagucuagccagccagcacgcgcccuugguucccccggccacucaagugggagaggagacgugcuguugcaauauccgcauuguagcggcgucugcccucucucucagggugaugcugccggggagcugguguggguaggauccuuccccuuacagacuggccagaugccaggccugucaccuagcuga

SEQ ID NO: 53181 - RNA, 1542 nt, Artificial Sequence
  derived and/or modified sequence opt3 from ATP6V1B1__Homo_sapiens__NP_001683
auggccauggagaucgacagcagacccggcgggcugccuggauccucuugcaaccucggugcugcaagggaacacaugcaggccgugacccggaauuacauuacacauccacgcgucacuuaucgaacgguuuguucagugaacggcccgcuuguagugcuggaucgugucaaguucgcgcaauacgcugagauagugcacuuuaccuugcccgacgggacacagagaaguggacagguuuuagaaguggccggcacuaaagcaaucguccagguguucgaggguaccagcgggauugaugccaggaagacaaccugcgaauuuacuggagacauccugcggacaccuguauccgaggauaugcuaggccgcguuuucaauggcucugggaaaccaauugacaagggacccguggucauggcugaggauuuucucgacaucaacggucaaccuauaaauccacauucgagaaucuaucccgaagagaugauucagaccggcaucucaccuauugaugugaugaacagcaucgcaagggggcagaaaauaccaauuuucagugccgcuggacugccgcacaaugaaaucgccgcgcagauuugucggcaagcaggccuugugaagaaguccaaagccguccuggacuaccaugaugacaacuuugcuaucguuuucgccgcaaugggugugaauauggagacggcucgcuuuuucaagucugauuuugagcagaacgggacuaugggaaauguaugcuuguuccucaaccuggccaaugaccccaccaucgaacgaauuauaacaccuagacuggcgcucacuaccgccgaguuuuuagcauaucagugugaaaaacacgugcuggucauccuuacagacaugagcuccuacgcugaggccuugagggaagugucagcugcccgggaggagguuccaggccgucgcggcuuccccggguauauguacaccgaucuggcaacgauuuacgaaagagccggaaggguggagggucggggcgggaguaucacucagauaccuauucuaacaaugccaaacgacgauaucacccaccccaucccggaccucacuggauucauuacagaaggccaaaucuaugucgaucgacagcugcauaaucgccagauuuacccucccauaaacgugcuuccaagccugucuagauugaugaaguccgcuaucggugaggggaugaccaggaaagaccacggcgauguaucaaaccaacucuaugcgugcuacgcaauuggaaaggacguucaggccaugaaggcuguggucggcgaagaggcccugacgagcgaggauuuacuguaucucgaauuucuucagaaauucgagaagaauuuuaucaaccaggggccuuacgaaaaucggaguguguucgagucucuggacuugggauggaaacuacugcgcaucuuucccaaggaaaugcucaaaaggauuccacaagcagucauagaugaguucuauuccagagagggugcccugcaggaccuugcucccgacaccgcccuguga

SEQ ID NO: 53182 - RNA, 1536 nt, Artificial Sequence
  derived and/or modified sequence opt3 from ATP6V1B2__Homo_sapiens__NP_001684
auggcccugagagcuaugaggggcaucgugaacggggcagcccccgaacucccugucccaaccggagguccggcgguuggcgcucgggaacaggcccuugcagugagccgcaauuaccugucccaaccccgauugacauauaagacuguaucuggggugaacggaccuuuagucauucuggaccacgugaaauucccacguuacgccgagauaguucaucuaacgcuccccgauggcaccaagagaucaggucaggugcuggaagucagugggagcaaagcugugguacagguuuuugagggaacauccggcaucgacgcaaagaaaacuucuugcgaguucaccggcgauauucuuaggacaccugugucggaagacaugcuggggcgggucuuuaauggaucagguaagccaaucgaucgcggccccgugguguuggccgaggacuuccucgauauuauggggcagccuaucaacccacaauguagaauauauccggaagagaugauccagaccggaauuagcgcuaucgacggcaugaauaguauugccaggggucagaagauccccauauuuuccgcggcagggcugccucacaacgaaauugccgcucagaucugccggcaagccggacuggucaaaaagucuaaagauguuguggacuacagcgaggagaauuucgcaauuguauuugcugccaugggcgugaacauggaaacugcgcgcuucuuuaaguccgauuucgaggaaaauggcucaauggacaacgucugucucuuuuuaaaucuggccaacgauccaacaaucgagcgaaucauuacccccagacuugcauugacgacugcugaguuccuggccuaucagugcgaaaaacaugugcuaguuauacucaccgacaugaguagcuacgcugaggcccugagggaagugucugcagcccgggaggaagucccugggcgucgcggauuuccagguuauauguacacagaccuugcuacuaucuacgagagagcgggcaggguggaagggcggaauggauccauuacccagauccccauacugacaaugccgaacgaugacauuacccacccuauccccgauuugacgggcuauaucacugagggucagauuuacguagaccgacaacuccauaaucgccagaucuauccaccuauuaacguucugcccucauuaagcagacugaugaagagugcaauaggggagggcaugacaaggaaggaucacgccgacgugucuaaccagcucuacgcuuguuaugccaucggaaaagauguccaagcaaugaaggccguggucggcgaagaggcucuuaccuccgacgaucuguuguaccuagaguuccugcagaaauucgaacggaauuuuauugcccaggggccauaugaaaaccgcacuguguucgagacacucgacaucggauggcagcugcuuagaaucuuucccaaggagaugcugaaaaggauuccucaaagcaccuugucggaguucuacccacgugauucugcaaagcacuga

SEQ ID NO: 53183 - RNA, 1149 nt, Artificial Sequence
  derived and/or modified sequence opt3 from ATP6V1C1__Homo_sapiens__NP_001686
augaccgaguucuggcugaucagcgcccccggcgaaaagacaugccagcaaacuugggagaaacuccacgcugcaacguccaagaacaauaaccuugccgugaccucuaaauuuaauauuccugaccugaaggucgggacauuggauguuuuagugggacugucagacgaacuagcgaaacucgaugcuuucguagaggguguggucaagaagguggcccaguacauggcagacguucuggaagauaguaaagacaaggugcaggagaaccuucuggccaauggcgucgauuuggugacuuauauaaccagauuucagugggacauggcuaaauacccaaucaagcaaagccucaaaaacauuuccgagaucauugcaaaggggguaacacagaucgauaaugaccugaagucuagggccucggcuuauaacaaucugaaaggaaaccuccagaauuuagaacggaagaacgccggcucacugcuuacccgcagcuuggcggagauaguuaaaaaggaugacuucgugcuggauagugaauaccuagucacucuccuggugguggucccgaaacuuaaucauaacgacuggaucaagcaguaugagacacuggcagagaugguugugccccgauccucuaauguauugagcgaagaccaagauuccuaccucuguaacgugacccuguuucguaaagccgucgacgauuucagacacaaggcuagggagaacaaguuuauugugcgggacuuccaguauaaugaagaggaaaugaaagccgauaaggaggagaugaaccgcuuaucaacggacaaaaagaaacaguuugguccucugguuagauggcucaaggugaauuucagugaagcauuuaucgcuuggauucaugucaaggcccuuaggguguucguagagagcguucugcgguacggguugccagugaacuuucaggcgaugcuacugcaacccaauaaaaagacucucaaaaagcugcgcgaaguccuucacgagcuguacaaacauuuggauucuuccgccgcagcuaucauagacgccccuauggauauuccaggacucaaccugucacagcaggaauauuaccccuauguguacuauaagaucgacugcaauuuacuggaguucaaguga

SEQ ID NO: 53184 - RNA, 744 nt, Artificial Sequence
  derived and/or modified sequence opt3 from ATP6V1D__Homo_sapiens__NP_057078
augagcggcaaggacagaaucgagauuuuccccuccaggauggcccagaccauaaugaaagcucggcugaagggggcacaaacaggacgcaaccuccuuaaaaagaaaucugaugcccugacuuugcgauuucgucagaucuuaaagaagauuaucgaaacgaaaaugcugaugggugaggugaugagagaagcggcuuucucacuagccgaggcaaaguuuaccgccggcgacuucaguacaacugucauucagaauguuaacaaagcucaggugaagaucagggccaaaaaggauaauguagcaggggugacccucccugucuuugaacacuaccaugagggaacagacagcuaugagcugaccggccuugcucgggguggggaacaacuggccaaguugaaacgcaacuacgcgaaggcaguggagcuccugguugaacuggccucccuccagacuucuuucgugacauuagaugaggcuauaaaaaucaccaauagaagggucaacgccauugagcacgugaucauuccacggaucgaacgcacgcuggcauauauaauuacugagcuugacgaacgagagagagaagaguuuuacagguugaagaaaauccaggagaagaaaaagauucugaaggaaaaaucggagaaggaucuagaacagcggcgugcugccggagagguacucgaaccggcgaaucugcuugccgaggagaaagacgaagaucuguuguucgaguga

SEQ ID NO: 53185 - RNA, 615 nt, Artificial Sequence
  derived and/or modified sequence opt3 from ATP6V1E1__Homo_sapiens__NP_001034455
auggcccugagcgacgcugaugugcagaagcaagcagaggaagaguucaacaucgaaaaaggcagacucguccagacccagaggcuuaagauuauggaguacuaugagaaaaaggaaaaacagauagagcaacagaagaagauccagauguccaaucugaugaaccaggcccgguugaaaguuuuacgcgcgcgagacgaucugauuacagaccuacucaaugaagcuaagcaacgucugucuaaagugguaaaggauacuacgagauaccaggugcuucuggacggguugguccuccagggacuguaucagcugcucgagcccaggaugaucgugcggugccgcaaacaagauuuuccuuuaguuaaggccgcagugcagaaggccauuccaauguacaaaaucgcuaccaagaacgacgucgaugugcagauagaccaagaaucauaucugccggaggauaucgccgguggcguagagauuuacaauggggacagaaaaaucaagguuaguaacacacuugaaagcagguuggaucugauugcacagcagaugaugcccgaggugcggggagcucuauucggcgccaaugcgaaccgcaaauuucucgacuga

SEQ ID NO: 53186 - RNA, 444 nt, Artificial Sequence
  derived and/or modified sequence opt3 from ATP6V1F__Homo_sapiens__NP_001185838
auggccggcagagggaagcugaucgcugugauuggagacgaggauaccgucacagguuuccuccuuggcgggauaggagaacugaacaaaaauaggcaccccaacuuuuugguuguggagaaggacacuacgaucaaugaaauugaggauaccuuccggagcuuaggcucccugccugguucuguaguggaagcaaacccaaaucagcgcgacccgccccuaugggaugagaucgacucacgacaauuucucaaccgugaugacauugggaucauacugaucaaucaguacauugccgagauggucagacaugcgcuugaugcucaccagcagaguaucccugccgugcuggaaauuccaagcaaagagcaucccuaugacgcagccaaggauuccaucuugaggcgggcucgcggaauguucacagcagaagaccucagauga

SEQ ID NO: 53187 - RNA, 357 nt, Artificial Sequence
  derived and/or modified sequence opt3 from ATP6V1G1__Homo_sapiens__NP_004879
auggccagccagucccaaggcauccagcagcugcuccaggcugagaagagagcagccgaaaaagugucugaggcgaggaagcggaaaaaccgccgacuuaagcaagcuaaagaagaggcccaggcagaaauugagcaguaccgucugcagagagagaaggaguucaaggccaaagaagcugcagccuuggggucaaggggaaguugcagcaccgaagucgagaaggagacacaagagaaaaugacuauauuacagacguauuuucggcagaaucgcgacgaaguucuggauaaccuacucgcuuucgugugugacaucagacccgaaauucacgagaauuacaggaucaacgguuga

SEQ ID NO: 53188 - RNA, 237 nt, Artificial Sequence
  derived and/or modified sequence opt3 from ATP6V1G2__Homo_sapiens__NP_001191007
auggccagccagucccaaggcauccagcagcugcuccaggcugagaagagagcagccgaaaaaguggcggacgcuaggaagcggaaagcccgccgacuuaagcaagcaacccguagacagguccaggggaugcagucuucacaacagaggaaccgggagcgcguucuggcccaguuguuaggaauggugugcgauguaagaccccaggugcacccuaauuacaggauuagugcuuga

SEQ ID NO: 53189 - RNA, 357 nt, Artificial Sequence
  derived and/or modified sequence opt3 from ATP6V1G3__Homo_sapiens__XP_006725021
augaccagccagucccaaggcauccaccagcugcuccaggccgagaagagagcuaaagacaaacuugaagaggcaaagaagaggaaagggaagcggcugaagcaggccaaagaagaggcgaugguggaaauugaucaauaccgcaugcagcgagacaaggaguuccguuugaaacagucuaagauaaugggaucacagaacaauuuaagugaugagaucgaggaacaaacacuggguaaaauucaggaacuaaacggccauuauaauaaguacauggagagcgucaugaaccagcuccuguccaugguuugcgacaugaagcccgagauccacgugaauuauagagcuacuaacuga

SEQ ID NO: 53190 - RNA, 4503 nt, Artificial Sequence
  derived and/or modified sequence opt3 from ATP7A__Homo_sapiens__NP_000043
auggaccccagcaugggcgugaacuccgucaccaucucuguugaggggaugacaugcaauucauguguguggacuauugaacagcaaauaggaaagguaaacggugugcaccauaucaaagucagucuggaggaaaagaaugccacgauuaucuacgauccuaaacuccagaccccaaagacacuucaggaggcuauugacgauaugggcuucgacgcagugauccacaacccggauccccugccuguuuugacugacaccuuauuucugacagugaccgccagccuaacucucccaugggaucauauacaguccacacugcuuaaaaccaagggggucacggacaucaagauuuauccccaaaagagaacuguggcgguaaccaucauuccuucuaucguuaaugcuaaccagauaaaggaacuggugccagaguugucgcucgauacaggaacucuggagaaaaagucaggcgccugcgaagaccacagcauggcacaggccggugaggucgugcugaaaaugaagguggaagggaugaccugucauaguugcacauccaccauugagggaaagaucggcaaacuccagggcguccaaaggauuaagguuucuuuagauaaucaggaggcuacgaucguguaccagccccaccugaucagcguagaagagaugaaaaagcagauugaagcaaugggguucccugccuuugugaaaaagcaaccaaaauaucuuaaguugggagcuauagacgucgagcggcugaagaacacuccggugaaauccucagaagguagucagcagcgcagccccucuuacacaaaugauuccaccgccacuuucaucauugacggcaugcacuguaagucaugcguuagcaacaucgagaguacacuaucugcgcuccaauauguguccagcauagucgugucgcuggagaaucgaucugcaauuguaaaauacaacgccuccucaguuaccccugaaagucuucguaaggcuaucgaggccgugagcccagggcuguauagagucuccaucacgucugaaguggagagcaccucaaauagucccuccucuagcucauugcagaaaauuccucucaacgucgugagucagccacugacacaggaaacuguuaucaauauugacggaaugaccuguaacagcugcgugcaauccauagagggcguaaucucuaagaagcccggugucaaaucgauuagggugagcuuagcaaacuccaaugggacaguugaguacgauccgcugcucacuucaccugaaacccuucggggagcuaucgaggacaugggcuuugaugccacacugagugacaccaacgaacccuugguggucaucgcgcagccaucuagcgagaugccucuacugacuuccacgaaugaguucuacacaaagggcaugacccccgugcaggauaaagaggaggggaagaacucaagcaaauguuauauucagguaacuggaaugaccugcgccucuuguguggcaaauauagaacgcaaccucagaagggaggaagguaucuacuccauucugguugcucuuauggccggcaaggcugagguccgguauaauccagccgugauccaacccccuaugauugcagaguuuauccgcgaacugggguucggagccacagugauagagaacgcugacgaaggcgauggugucuuggagcucguugugcgagggaugaccugcgcgaguugcgugcauaagaucgaaagcucucugacuaaacacagaggcauuuuauacuguuccguagcacuggccacaaauaaggcucauaucaaauaugacccagagauuaucggaccgagggauauaauucacacgaucgagucacuaggcuuugaagccagucucgucaagaaagaccggagcgcaucgcaccuggaucauaagcgugagauucgccaguggagaagguccuuccuugugucuuuguuuuucugcauccccguuauggggcugaugauauacaugauggugauggaccaccauuuugccacccuccaccauaaccagaauaugagcaaggaagagaugaucaaccugcacucaaguauguuccuugaacggcagauucugccuggauuguccgucaugaaucuccugucuuucuuacugugugugccaguucaauuuuucgguggcugguauuuuuacauccaggcuuacaaagcccuaaagcacaaaacugcaaacauggacgugcucauuguacuggcgacaaccaucgcuuucgccuauagccuuauaauuuugcuggucgcaauguacgagcgagccaaggugaaucccaucacauuuuucgauacuccuccaaugcucuuuguguucaucgcucuggggcgcugguuagagcauauugccaaaggaaagaccuccgaagcacuggcuaaacuuaucucauugcaggccacggaggcgaccauugucacacucgacagcgauaacauacugcuaagugaagaacagguugacguggaacugguacaaagaggcgauaucauuaaggugguccccggugggaaguuuccgguggacggcaggguuaucgagggacacucuaugguggaugagucccucauuacuggcgaagccaugccugucgcuaaaaagccagggagcaccgugaucgcaggaucgauaaaccagaaugguucacugcuuaucugcgccacacauguuggcgcugacacuaccuugucucagauugugaaacuggucgaggaagcccaaacgaguaaggcacccauccagcaguucgcggauaaauuauccggguauuuuguaccuuucauuguguuuguuagcaucgccacacuccugguguggauagucauuggauuccuuaacuucgagaucguggagaccuacuuucccggcuauaaucggucuaucagccgcacugaaacaauuauaagauucgcuuuucaggccuccaucaccguacuguguauugcaugcccauguucauugggucucgcuacuccuaccgccgugauggucgggacaggcguuggagcacaaaacggcauccugauuaaagggggagagccccuagaaauggcccacaaggugaaaguggucguguucgacaagacgggcaccaucacucacgguacaccaguuguaaaucaggugaaaguccugaccgagaguaacaggauaagccaucacaagauccucgcuauuguggggacagcggaaucuaauuccgagcauccgcugggaacugccaucaccaaauacugcaagcaggagcuugauacggaaacauugggcaccuguauugacuuucagguugugccugguugcggcaucucauguaaggucacuaacauagaggggcuguuacacaaaaauaacuggaauauugaagauaacaauaucaagaacgcaagucucgugcaaaucgacgcuagcaaugagcaguccucuaccucgagcucaaugauuaucgacgcccagauauccaacgcccugaacgcucagcaauauaaaguacuuauuggaaaucgugaauggaugauccggaacggccuggucauuaauaacgaugugaaugacuucaugacagagcaugagcgaaaggggagaacugcaguucuaguggccgucgaugacgaacucugcggacugaucgcgauagcugauaccgugaaacccgaggccgaauuggcaauucacauccugaagaguaugggcuuagagguugugcucaugacaggugacaacucuaagacggccaggagcaucgcuucccaggucgggauuaccaaaguguuugcagaaguacugccaucacacaagguggccaaaguuaagcagcuucaagaggagggaaaacgcgucgcgauggugggcgaugguaucaaugacucucccgcucuggccauggcaaacgugggcauugccauagggacuggaacagaugucgcuaucgaagccgcagacguaguguugauucggaaugaucuccuggacguuguggcuagcaucgaucuaaguagaaagaccgucaaaaggauccgcauuaacuucguguuugcccugauauacaaucuuguuggcaucccuauugcggccgggguguucaugccaaucggacucguccugcagcccuggaugggcuccgcagcuauggccgcuagcucugugucaguaguguuguccagucuguuuuuaaagcucuaccgaaagccuacuuaugagagcuacgaacugccggcacggucgcagauuggucagaaaucuccauccgagaucagcguucaugucgggauagacgacacaucacguaacagucccaaacuuggacuguuggauagaaucgugaauuauucuagggccuccauuaacagccuccugucagacaagcgcagucuaaauagcguggucaccuccgagccugauaagcacucucugcuuguuggcgacuuccgggaagaugacgauacggcccucuga

SEQ ID NO: 53191 - RNA, 3777 nt, Artificial Sequence
  derived and/or modified sequence opt3 from ATP7B__Homo_sapiens__NP_001005918
augcccgagcaggaaagacaaaucaccgccagggagggcgcuagccggaagauucuguccaaacucucucuuccuacacgcgcaugggaaccagccaugaagaaaucauucgcguuugacaacgugggguacgagggaggucuggauggcuuggggccgaguagccaggucgcuacuuccacgguucgaauauuaggaaugaccugccagucuugugugaagucgaucgaagaccguauuucaaaucugaaaggcaucauuagcaugaagguaagucuagagcaggguuccgccacagugaaguauguccccucugugguuugccuccaacaggugugucaccagaucggggauaugggauucgaggcaagcauagccgaaggcaaagcugcauccuggccuucaagaagucugccagcccaggaggcugucgugaaacuuaggguagaaggcaugacuugccaaagcuguguuucuuccaucgaggggaaagugcggaagcugcagggagucgugcgcgugaaagucucauugagcaaccaggaggccguuauuaccuaccagcccuaucucauccaaccugaagaccugagagaucaugugaaugacauggguuuugaggcggcaauuaagaguaagguagccccacugucucucggccccaucgauauagaaagguuacaguccacaaacccuaaacggccacugagcucggcuaaucagaacuucaauaacucugagacccuugggcaccaaggaucccauguggucacuuugcagcugcgcauugacggcaugcacugcaagucaugugugcuaaauaucgaagagaacauuggucagcuccuggggguucagaguauccaagugagccuugagaauaaaacagcccaggucaaguacgauccguccugcaccucucccguggcacugcagcgagcuaucgaagccuugccuccaggaaacuuuaaaguaagccuccccgacggcgcggagggcucagggacggaucauagaaguuccagcucucacucaccuggaaguccacccaggaaucagguucaagguacuuguagcaccacacugauugccauagcaggcaugacuugcgcuuccugugugcacucuaucgaagggaugauuucgcaguuagagggaguccagcagaucagcgugucccuggccgaaggcaccgcuacaguccucuauaacccgucagugauaaguccugaggagcuucgggccgcaauugaagacauggguuucgaggccucuguugugagcgaauccugcucaaccaauccccuggggaaccauagcgcuggcaacucuaugguacaaacgacugauggaacaccaaccuccguccaggagguggcgccucacacuggccguuugcccgcaaaucaugccccagacauccuagcuaagaguccccagagcacacgcgccguugcaccucagaaaugcuuucugcaaaucaaggggaugaccugugccucuugcguguccaacauugaaagaaaucuccagaaggaggcuggaguccugucagugcuuguagcccugauggcagguaaagcggagaucaaguacgacccagaagugauucagccguuggagauagcucaauucauccaggaucucggcuuugaagccgcaguuauggaggacuaugccgggagugauggaaacauugagcugacgaucaccggcaugacaugugcuagcugcguccacaauaucgaaucgaaauuaacuaggaccaacgguauuacauacgccuccguggcacuggcuacuucuaaggcccuagugaaauucgaccccgagauaaucgggccucgggauauuaucaagauuaucgaaagcaagaccucagaggcgcucgccaaacugaugagucuucaggcuacagaagcaaccgucguuacuuugggcgaggacaaucugauaauccgagaggaacaggugccaauggagcucgugcaacgcggagauauuguaaaggucgugcccggcgggaaauuuccuguugacggaaaggugcuggaagguaacacgauggccgaugagucccuuaucacaggcgaagcuaugccagucaccaaaaagcccgggucuacugugauugccggaagcaucaaugcacacggcuccguucugauaaaggcgacccauguggguaacgacacaaccuuggcccagauuguaaaacucgucgaggaggcucagaugucaaagaauccgaacaaacacaucagccagacugaagugauuaucagauucgccuuucaaacaaguauaacggugcuguguaucgcaugcccuuguucuuuagggcuggcuaccccaacugccgucaugguuggcacaggaguggcagcccagaauggcauucuaaucaaagggggaaagccccucgagauggcucauaagauuaagaccguaauguucgauaaaacaggcacuaucacccacggugugccuagggucaugcgggugcugcuuuugggggacguugcgacgcugccccuccgcaaggugcuggccgucgugggaaccgcagaggcuuccagcgagcauccauuaggcguugccgugacaaaauacugcaaggaagaacuggguacugagacccuuggcuauuguacagacuuccaggccgucccugggugcggaauaggcuguaaaguaucgaacguggaagggauuuuggcucacucagagagaccccucucugcaccagccagucaccugaaugaagcgggaucccuaccggcugagaaggaugccguuccucagacuuuuagcgugcugaucggcaacagggaguggcuccgucggaacggucugaccaucucuagcgacgucuccgaugcaaugacggaccaugaaaugaaagggcaaacagccauucuuguggcuaucgauggaguauugugcggcaugauugcaauagccgacgcggugaagcaggaggcugcccuggcaguccacaccuuacagucaauggguguugauguggugcucaucacuggcgacaaucgaaagacagccagagcuauugccacccaagucgggaucaacaaaguguucgcagaaguucugcccagucauaagguagcuaaagugcaggagcuucagaauaagggaaagaaggucgccauggugggcgaugggguuaacgacagcccagcgcuggcccaggcagauaugggaguggcuauuggcacugguaccgacgucgccaucgaagcugcagaugugguauugauaaggaaugaccuccuggacgucguggccucuauccaccuauccaagcgcacaguucggagaauuaggaucaaccuggugcucgcccugauuuacaaucuugucgggauccccauagcugcgggaguguuuaugccuauuggcaucguuuugcaaccauggauggguucagcagccauggcugccaguagcguguccgucgugcugucuucguuacagcucaaaugcuauaagaaacccgaucuggagcgcuacgaggcacaggcccacggccauaugaagccucuuacggcuagccagguaucagugcacaucgggauggacgaucgauggcgggacuccccgcgugcgaccccaugggaucaaguuaguuaugucucucaggugagccuguccucacuaacuucugacaaacccagcagacauagugccgcagcugaugacgauggagacaaguggucccuccuguugaacggcagggaugaggaacaguacauuuga

SEQ ID NO: 53192 - RNA, 3450 nt, Artificial Sequence
  derived and/or modified sequence opt3 from ATP8A1__Homo_sapiens__NP_001098999
augcccaccaugagaaggacagugagcgagauccggucccgcgccgaaggcuacgagaagacugacgaugucucugagaaaacgucacuggcugaccaggaagaaguucgaaccauuuucauaaaccaaccucagcucacaaaguuuugcaauaaccacgugaguacugcaaaauauaauaucauuaccuuccuuccacguuuucuguacagccaguucagaagggccgcgaacuccuuuuucuuguuuaucgcuuuacugcagcaaauuccggauguaucucccacagggcgguauaccacucuagugccucuccuguucauccuugccgucgcagccauaaaggagaucauugaggacaucaaacgccauaaggcugauaaugcagugaacaagaaacagacacagguucugagaaauggagccugggaaauugugcacugggagaaggucaacgugggugacaucguaauaauuaaaggcaaggaauacaucccagcugauaccguuuugcucucgucaagcgagccccaggccauguguuauauugagacgaguaaucuggacggggaaacuaaccugaaaaucaggcaaggacucccugcgaccuccgauaucaaggacguggauucuuuaaugcggauuagcggccgcauagagugcgaauccccaaaucgacaucuguacgacuuugucgguaacaucagacuugaugggcacggaacagugcccuugggcgcagaccagauucugcuaaggggcgcccagcuccggaauacucagugggugcaugggaucgucguuuauaccggacacgacacaaagcugaugcaaaacucaaccaguccuccacuuaaacugagcaauguggagcguauaacgaacguacagauuuugauccucuucuguauccugauugcuaugucuuuagugugcuccgucgguucagccaucuggaaccgcagacacagcggcaaggauugguaccugaaucucaacuacgggggagcaaguaauuuuggccuuaacuuccugacuuuuauuauauuguucaauaaccuaaucccgauuucucugcucgugacacuggaaguugugaaauucacccaggcuuauuuuaucaauugggaccuugauaugcauuacgagcccacugacacagccgcgauggccaggaccuccaaccugaaugaggaauugggucaagucaaguauaucuucagcgauaaaacggggacccucacauguaacgugaugcaguuuaagaaaugcacuauugcaggaguagcuuacggccaaaauucgcaguucggcgacgagaagaccuuuucugauuccucacuguuagaaaaccugcagaauaaccacccuacagccccaauaaucugugaguuccuaacuaugauggcuguuugccauaccgccgugcccgaacgggagggggacaagauuaucuaucaggcagccaguccugaugagggagcucucguccgagcggcaaaacagcugaauuuuguguucacaggucgcaccccagacagcgucauuaucgauucccuuggccaggaagagagauacgaauugcugaacgugcucgaguuuacuucugccaggaagcggaugagcguuauagugcgcacgcccucagggaaacugagacuuuauuguaagggagcugacacaguaaucuacgacaggcuggccgaaaccaguaaauacaaggagauuacuuugaagcaccucgagcaauucgcaaccgaaggccugcguacauuaugcuuugccgucgcugagaucuccgaaagcgauuuccaggaguggcgggccguguaucagcgagcaucuaccucaguucagaacagacugcuaaaacucgaggaaaguuacgagcugauugaaaagaaucuucaauugcugggugcgacugcuaucgaggacaaacuccaggaucaggugccggaaacaauagagacgcugaugaaggccgacauuaaaaucuggauuuuaaccggggauaagcaggagacugcaaucaacauaggccacagcuguaagcugcuuaaaaagaauaugggaaugaucgucauuaacgaaggcuccuuggacgggacaagggagacccucucucgccauugcacaacucugggagaugcccuacggaaagaaaaugacuuugcucugaucauugaugguaagacccucaaauaugcccugacguucggcgugagacaauacuuccuugacuuggcacugucgugcaaggcuguaaucuguugcagggugagcccuuuacagaaguccgagguugucgaaauggugaaaaagcaagugaaagucguuacccucgccauaggggauggagcgaacgacgugucaaugauucagacagcccacgugggcguagguaucagugggaaugagggccugcaggcugcaaacucuagcgauuauuccaucgcccaguuuaaguaccuuaaaaaucuguugaugauucauggagcuuggaacuauaaucgcgucucaaaguguauccucuacugcuucuacaaaaacauugugcuguauauaaucgagauuugguuugccuucguuaauggcuuuagcgggcagauccuauucgaacgaugguguauuggacuguacaacgugauguuuacugcaaugcccccacucacccuggguaucuucgagcggucuugccguaaggaaaauaugcuuaaguauccugaguuguacaaaacaucccaaaacgcgcuggacuuuaacacuaaggucuucugggugcacuguuuaaauggccucuuucauaguguuauacuguucugguuuccccuuaaagcccugcaguaugggaccgcuuucggaaacggcaagacgagcgacuaccuacuccuggguaauuucguguauacauuuguagucaucaccgugugcuugaaagccgggcuggaaacuucuuacuggacaugguucucccacauugcaaucuggggcucaauugcuuuauggguggucuuuuucggaaucuacaguagccucuggccagccauacccauggcaccugauaugucgggcgaggccgcuaugcuguuuuccucugggguuuucuggaugggacuucuguuuauuccaguggcgagcuugcuccuggacguaguguauaaggucaucaagagaaccgccuucaaaacucuaguggaugagguucaggaacuggaggcaaagucacaggacccgggcgcugugguccuugguaaaagucucaccgaaagggcccaacuguugaagaacguguuuaaaaagaaucacguuaaccuguaccgcuccgagucuuuacagcagaaucuccugcauggguaugccuucagccaggaugagaacggaaucgugucccaaucagaagucauucgggcuuacgacacaacgaagcagagacccgaugagugguga

SEQ ID NO: 53193 - RNA, 3567 nt, Artificial Sequence
  derived and/or modified sequence opt3 from ATP8A2__Homo_sapiens__NP_057613
augcugaacggcgccgggcucgacaaggcucuuaaaaugagccugcccagaaggucccggauccgcuccucagugggaccuguccgaaguagcuuggguuacaagaaagcagaggaugaaaugucccgugccaccucuguuggcgaccaguuagaggcgccagcuagaacaauuuaucugaaucaaccgcaccuaaacaaguucagggauaaucagauaucgacugccaaauacucagugcucacguuucugccccgguuccuuuaugaacagauccgcagagcagccaacgcauuuuuccuguuuauugcuuugcuccagcaaaucccugacguaagcccaaccgggagguacacaacucuggugccccugauuaucauacucaccaucgccggaauuaaggagaucgucgaagauuucaagcggcauaaagcugacaaugccgugaacaagaaaaagacaauuguuuuacgcaauggcauguggcacaccaucauguggaaagagguggcggucggugauauagugaagguaguuaacgggcaguaucugccugcagacgugguccuuuugaguuccucugagccacaggccaugugcuacguggaaacugcuaaucuggauggagagacaaaccuaaagauucgacagggccucagccauaccgccgacaugcaaacgagagaagugcugaugaaacuuuccggcacuaucgagugugaggggcccaauaggcaccuguaugauuuuaccggaaacuugaaucucgacgguaagucacuggucgcauuaggcccugaucagauucugcuccgggggacacagcuucguaacacucaguggguuuucggaaucgugguauacaccggccaugacacaaaacugaugcaaaauaguaccaaggcuccauugaaacgcagcaacguggaaaaggucacgaacgugcagauccuaguucuguuugguauucuccuggugauggcccuugucucuuccgcgggggcccuguacuggaauagaucacacggagagaaaaacugguauauaaagaagauggacacuacaagcgauaauuucggcuacaacuugcucaccuuuaucauucuguauaauaacuuaaucccgauaagucugcuagugacucucgaaguaguuaaauacacacaggcacuguucauuaauugggacaccgauauguauuacaucggcaacgacacgcccgcuauggccaggaccucuaaucuuaacgaggaauuggggcaagugaaguaucuguuuuccgauaaaacaggaacucucacaugcaauaucaugaacuucaagaaauguagcauugcuggugucacauacggccacuucccugagcuggcccgggagccaucgucugacgauuuuugccgaaugcccccuccauguuccgacucaugcgauuucgacgauccccgccuucugaagaauaucgaagacagacauccgacugcaccuuguauucaggaguuuuugacccuccuggccgugugccacacagucgugcccgaaaaggacggggauaacauaaucuaccaggcuaguagcccagacgaggcggcauuaguuaaaggagccaagaaacugggcuucguguuuaccgcuaggacuccuuucuccguaauuaucgaagccaugggucaggagcaaacguuugggauccuaaauguccucgaguucucuagcgaucggaagcgcaugucagugauuguuagaacacccaguggcaggcugcgucuuuauuguaaaggagcagacaacgugauauuugaacgguuguccaaggauagcaaguacauggaggaaacccugugccaucucgaguauuucgccacugaaggccugcgaaccuuaugugucgcuuacgccgaccugucugagaacgaguaugaagaguggcuuaaaguguaccaggaagcaucaacaaucuugaaggauagagcgcagaggcucgaggagugcuaugaaauuaucgagaaaaaucugcuacugcucggggcuaccgccauugaagaccgccugcaggcaggaguaccagagacuaucgccacacuuuugaaggcugaaauaaaaaucugggugcugacgggugauaagcaagagaccgccauuaacaucggcuacaguugccgguuaguuagccagaauauggcacucauucugcuuaaggaggacucccuggaugcuacuagagccgcgaucacacagcacuguaccgacuuggggaaccuccugggaaaagaaaaugaugucgcccuaauaauugacggccacacacugaaguacgcucucucuuuugaggugaggcgcucguuccuggaccuugcauugagcugcaaagccgugaucuguugccgagucucuccccugcagaagucagaaauuguugauguggugaaaaagcggguaaaagcuaucacuuuagccauaggugacggggcaaacgaugucggcaugauccaaaccgcgcaugugggaguuggcauuagugggaaugagggaaugcaggccacgaacaauucugacuaugcuaucgcccaguuuagcuaccucgaaaagcugcuucuggugcacggugcaugguccuauaaccgugucaccaaguguauucuauacugcuucuauaaaaaugugguucucuacaucauagagcugugguucgcuuuugugaacggcuucucagggcagauuuuguuugagagaugguguaucggacuguauaauguaaucuucacagccuuaccuccauuuacucucggcauuuucgaaaggagcugcacccaagagucuaugcugcgcuuuccgcagcuuuacaagaucacacagaacggugaaggguucaauacuaaagucuuuuggggccauuguauuaacgcacuggugcacuccuugauacucuucugguuucccaugaaggcccuggagcaugauaccgugcuaacgaguggacacgcuacagacuaccuguucgucggcaacaucguuuauaccuacgugguagugacugucugccuuaaagcggggcucgaaacaaccgccuggacuaaguuuagccaccuggcaguguggggaucuauguugaccuggcugguuuucuucggcauuuauuccacaaucuggccuacgauuccaaucgcucccgauaugcggggucaagccaccaugguguuaucaagugcccauuuuuggcucgggcuguuccuugucccuacugcuugucugauagaggacguggcauggagagccgcgaagcacacaugcaaaaagaccuugcucgaggaaguucaggagcuggaaacaaaaagcagggugcuaggaaaggcuguccugcgagauucgaauggcaaacgccuuaacgagcgggacagacucaucaagaggcugggucguaagacuccacccaccuuguuucgcggcuccucuuuacagcaggggguaccgcauggauacgccuucagccaagaggaacacggcgcagugucacaggaggaaguuauucgggccuaugauacgaccaaaaagaaaaguagaaagaaauga

SEQ ID NO: 53194 - RNA, 3756 nt, Artificial Sequence
  derived and/or modified sequence opt3 from ATP8B1__Homo_sapiens__XP_011524324
augagcaccgagagagacuccgaaacaacuuucgaugaggacucucagcccaacgaugaaguggucccuuacucagacgaugagacggaagacgagcuggaugaccaaggcagugccguugagccagaacagaauagggugaaccgggaggcugaagagaaucgcgagccguuucgaaaggaaugcaccuggcagguaaaagcaaacgaucguaaguaucacgagcagccccauuucaugaauacaaaauuucucuguaucaaggaaagcaaauacgccaacaaugcgauuaagacuuauaaguacaacgcuuucaccuuuauaccuaugaaucuuuucgagcaauuuaaaagagccgcaaaccuguauuucuuggccuuacugauccuacaggcugugccacagauuuccacacucgcaugguacaccacucuggucccccuucuggugguuuugggggugacagccaucaaggaccucgucgaugacguggcuaggcacaaaauggauaaggaaauuaauaaccggaccugcgagguaaucaaagacggacgcuuuaagguugccaaguggaaagagauacaggugggugacgucaucagacugaagaaaaaugauuucgugccugcggacauucugcucuuaucuucgucagaaccaaacagccuguguuauguggagacggcagaacuugauggcgagacuaauuugaaguuuaaaaugagucuggaaaucaccgaccaauaccuacagagggaggauacacucgccacuuucgacggguuuauugagugcgaagaacccaacaaccggcuggauaaguucaccggaacacuuuucuggcgcaauaccuccuuuccucuggacgcugauaaaaucuugcuccgaggcugugucauaagaaacacggacuucugccauggucugguuauuuuugccggggcagauacuaagaucaugaaaaauucuggaaagacaagguucaagcggaccaaaauugacuacuuaaugaacuauaugguguacacuaucuuuguagugcugauccuccuuagcgcuggccuggccauuggccacgcguauugggaagcccaggucgggaauaguucaugguacuuguaugacggagaggaugacacaccaaguuaccgugguuuccuaauauuuuggggcuauaucauugugcugaacaccaugguuccgaucagccucuacgugucugucgaagugauacgccuggggcagucccauuucauuaauugggaucuucaaauguacuaugcagagaaggacacgcccgcuaaagccagaaccacaacucugaacgagcaguugggacagauccacuacaucuuuucagauaagaccggcacacucacucaaaauauuaugaccuucaagaaauguugcaucaacggucagauuuauggggaccacagggaugcuagccagcauaaucacaacaagauagaacagguagacuuuaguuggaauacauacgccgauggaaaacuggcauucuaugaccauuacuuaaucgagcaaauucagucuggcaaggaaccugagguucggcaguuuuucuuccugcuagccgugugucacaccgucaugguggaucgaacugacggccagcucaacuaucaagcugcguccccagaugagggggcacuggucaaugccgcucgcaacuuuggauucgccuuucuugcaagaacgcagaacacaaucaccaucagcgaauuggguacugagaggaccuacaaugugcuggccauucucgacuucaacucggaccggaaacgcaugucuauaaucguuagaacacccgaaggcaauauuaagcuguacugcaagggggcugauaccgugaucuaugagaggcuucaccguaugaacccuacuaaacaggaaacacaggacgcccuggauauuuuugcaaaugagacguugcggacccucugucugugcuacaaggagaucgaagagaaagaguucacugaguggaacaagaaauuuauggcggcuuccguagccucaacaaaucgagacgaagcauuagauaaggucuaugaggagauagaaaaggaccugauccuacucggagccaccgcuauugaggauaaacugcaagacggcgugccagaaacaaucaguaaacuugccaaggcagauauuaagaucuggguuuugacuggugacaaaaaggagaccgcugaaaacauaggguucgccugcgagcugcucacggaggauaccacaauuuguuacggcgaagacaucaauagccuguuacaugcgagaauggagaaccagaggaaucgcggaggcguguaugccaaauuugcucccccgguccaggaauccuucuuuccucccgggggaaaccgggcacugauuaucacugguucuuggcuuaaugagauauugcucgagaagaagaccaaaagaaacaagauccugaaacuaaaguucccaaggacagaagaggaacgccgaaugcggacucagagcaaacguagacuggaggccaagaaggaacaaaggcagaaaaauuuuguggaucucgcuugcgaguguucagccguaauuugcugucgcgugaccccuaagcagaaagcaaugguugucgaccuggugaagcgguacaaaaaggcgaucacgcuugccauuggcgacggggcuaacgaugugaacaugaucaagacagcccacauaggagucggcauuaguggucaagaggggaugcaggcaguuauguccagcgacuauucuuucgcucaguucagauacuugcagaggcuguuacucgugcauggccgauggucauacauccgcaugugcaaauuucugcgguauuucuuuuacaagaauuucgccuuuacccuugugcacuucugguauuccuuuuucaacggauacagcgcacaaacugccuaugaagauugguuuaucacacuguacaauguauuguauaccucccuccccguccugcuaaugggccugcucgaccaggaugugucugacaaacugucgcuuagauucccaggguuguacauuguuggacagagggaucuguuauuuaacuacaagcguuucuucgugagccuccugcaugguguccuuacuuccaugauccuguuuuucauuccccuaggcgcuuaucuccagaccguggggcaagacggagaggcgccuucagauuaccagaguuuugccguuacaauagcaucugcucuggugaucacgguaaauuuccagauuggcuuggacaccagcuauuggacuuuugucaacgccuucuccaucuuugguucaauugcccuguacuucgggaucauguuugauuuccacagcgcuggcauacacguguuauuuccaucugcauuccaguuuacaggaaccgccuccaaugcgcuccgccaaccguauaucuggcugacaauuauccuugcuguggccgucugucuguugcccguuguggcaauucgguuccucaguaugacuaucuggccuagcgaaucugacaaaauacagaagcauagaaagaggcugaaagccgaggaacaguggcaacgacggcagcagguauuccgcagaggcguguccaccaggcggucagcuuacgcauuuagucaccagcgaggguaugccgaccuaauuagcucgggaagauccauccgcaagaaaaggucuccacuggaugcgaucgucgcugacggcacggccgaguaccgucggacaggugauagcuga

SEQ ID NO: 53195 - RNA, 3792 nt, Artificial Sequence
  derived and/or modified sequence opt3 from ATP8B3__Homo_sapiens__NP_001171473
augggcgacagccccgggagaggagccccugagaggcggcacaaggcucagccaggucgcgcacgaaaauacgaauggcguccggagggccccaccuccauggggucucugggacaaagagaagaucuccaggacgaggauaggaacucagccuucacauggaaggugcaggcgaauaaccgggcuuauaauggccaguuuaaagaaaaggucauccuuugcuggcaacgcaaaaaguacaagacuaacguuauuagaacggccaaauauaauuucuacaguuuucugccuuugaacuuauaugagcaguuccauagggugagcaaucuguuuuuccuaauaaucauuauccuccaguccauuccagacaucucuacccugcccugguuuucgcuuucaacaccuaugguaugucuguuguucauacgggcaacucgcgaucucguggacgauaugggucgacacaagagcgacagagccaucaacaauaggccaugccagauucugauggggaaaaguuuuaagcagaaaaaguggcaagaucugugugucggagacgugguuugccuccggaaggauaacaucgugcccgcugacauguuacugcuugcauccaccgagccuucuagcuuguguuacgucgaaacaguggauauugacggcgagaccaaucugaaauuccgucaggcccuaaugguaacucauaaggaacucgcuacaaucaaaaagauggccuccuuucagggcaccguuacgugcgaggcgccaaacucacgcaugcaccauuucguggggugucuggaguggaaugacaaaaaguauagucuugauauaggaaaccuguugcucagagguugcaggauucggaauacugacaccuguuacggccuggucaucuacgcagauggguauauguuugugggauucgacacaaaaauuaugaagaacugcggcaagauccacuuaaaacgaacuaagcuggaucuccuuaugaacaaacugguggucguuaucuucauuagcgugguauuggugugucuaguccuggccuuugguuucggguuuucugugaaggaauuuaaagaccaccauuacuaucucuccggaguucacggcucaagcguggcugccgagaguuucuucgucuuuuggucuuuccugauacuucuguccgugaccaucccgaugagcauguuuauuuugucggaauuuaucuaccucggcaauucuguauuuauagauugggacguucaaauguauuacaagccccaggaugugccugcaaaggcucgcuccacaucacugaacgaccauuuagggcaggucgaguauauuuucagugauaaaaccggaacgcugacucaaaauauccuaacauuuaacaagugcugcaucagcgguagaguguacggcccagacuccgaagccaccacuaggcccaaagagaauccuuaccucuggaacaaguucgcggacgggaaacugcuuuuccacaaugccgcauugcugcaccucguccggacaaacggagaugaggcugugcgcgaauuuuggagacugcuugccauuugucauaccguuauggugagggagucuccacgugaacggcccgaccagcuguuguaucaggcugccagcccggaugagggcgcacucguaacggccgcucgaaauuucgguuacgucuuucugucaagaacccaggacacagugacuaucauggaauuaggggaggagaggguuuaucaagugcuggcgauuauggauuucaacaguacccgcaagcggauguccguccuagugagaaagccugaaggcgcaauaugccucuacacaaaaggagccgacacuguaaucuuugagaggcugcaccgccgaggcgcuauggaguucgccaccgaagaagcacuugccgcuuuugcccaggagacauugcggacccugugucucgcauaucgugagguggcggaagauauuuacgaggacuggcagcagagacaucaagaagcuagccuguuacugcagaauagggcccaggcacuucagcaaguuuauaacgagauggagcaggauuugcgccuccugggggccacugcuaucgaagaccggcuacaggauggaguccccgagacgaucaagugccugaaaaagucuaauauuaaaauaugggugcucacaggugacaagcaggaaaccgccgugaacaucggcuucgcaugugagcugcuuucagaaaauauguugauucuggaggagaaggaaaucaguagaauuuuagagacuuacugggaaaacagcaacaaucuccugaccagggagucccuuucucaagucaaacuggcuuugguuaucaacggggauuuucucgacaagcugcuagugucgcugcgaaaagaaccacgcgcccucgcgcagaaugugaacauggacgaggccuggcaggagcugggacaaagccggagagauuuccuuuacgcuaggcguuugucccuguuaugccgccgguuuggccucccucuggcagcucccccagcccaggacucaagagccaggcgaaguucugaaguacuucaggagcgggcauucgucgaucuggcgagcaagugucaggccgugauaugcugucgcguuacacccaaacaaaaggcucuaaucguggcccucgucaaaaaguaucaccaggugguuacccuggcaauuggugacggggcuaaugauaucaacaugauuaagacugccgacgugggcguaggauuggcaggccaggaagggaugcaggccguccaaaauuccgauuuugugcugggacaguucugcuucuuacagagacuccugcuugugcaugguagguggucauacguccggaucuguaaauuucugcgauauuucuuuuacaagagcauggcuucuaugaugguucaggugugguucgcgugcuauaacggcuuuacagggcaaccuuuguacgagggaugguuccucgcccuguuuaaucuacuguauuccacgcuuccaguacucuacauaggccuguucgaacaggacgugagugcagagcagagcuuggagaaaccggaacuguacgucgugggucaaaaggaugaguuauuuaacuauuggguuuucgugcaggcuauugcccacggggucaccacuucucucgugaauuucuucaugacacuguggaucuccagagacaccgccggccccgcuucauucagugaucaccagagcuuugcaguuguggucgcccuuucgugccuguuguccauuacaauggaaguaauccucauaaucaaauacuggacugcgcuguguguggcuaccauucuacugucucuuggauucuaugccaucaugacgaccacaacucagagcuuuuggcuguuccgcguuucaccuaccacauuuccauuccucuacgcagacuugagugugauguccucucccagcauuuuacuggucgugcuccuguccguaucaaucaacacuuuuccugugcuugcccugagggucauauucccagcuuugaaggagcuacgugcaaaggaggaaaaaguugaggaaggccccagcgaggaaauuuuuaccauggagccgcugccucaugugcaccgggagaguagagccaggcgaucuuccuaugcguucagccaucgcgaaggguacgcuaaucucaucacgcaaggaacaauccugagacggggcccaggugugucgucagauauugccucugagagucuugaccccuccgacgaagaggcagccagcucuccuaaggaaagccaguga

SEQ ID NO: 53196 - RNA, 3579 nt, Artificial Sequence
  derived and/or modified sequence opt3 from ATP8B4__Homo_sapiens__NP_079113
auguucugcagcgagaagaaacugagagaaguggagaggaucgucaaggccaacgaccgggaauacaaugagaaauuucaguaugcugauaaccgcauucacaccuccaaguacaauauacucacauuccuucccaucaaccuguuugaacaauuccagcgaguugcaaaugccuacuuuuuguguuuacugauucuacagcucaucccugagauuucuucacugacuugguucacgaccaucgugccacuuguacuggugauaacaaugacugcggucaaagacgcuaccgaugacuauuuucgucauaagagugauaaccaggugaauaacagacaaagcgagguuuugaucaauuccaagcuccagaacgaaaaauggaugaaugugaaggucggcgacauuaucaaacuggagaacaaucaguucguggccgcagaucugcucuuacugucuucgucagaaccgcacgggcuuugcuauguagagacagccgaguuggacggagaaaccaaccugaagguuaggcaugcucuaagcgugacaagugagcucggugcagauauuucccggcuggccggcuuugacgggaucgucgugugugaagugcccaauaacaaacuugauaaguucaugggaauacugucuuggaaggacagcaaacacuccuugaacaaugagaagauuauccuccgcggcugcauucugagaaacacuucaugguguuuugguauggucaucuucgcugggccugauaccaaauuaaugcagaauaguggaaagacgaaauuuaagaggacuagcaucgaccggcugaugaacacccucguucuuuggauuuucggcuuccugauaugcuugggcaucauucuagccaucgggaacucuauaugggaaucccaaacaggagaccaguuucgcacuuuccuguuuuggaacgagggugagaaaucaagcguguucaguggcuuucucaccuucuggucuuacauuaucauccugaauacaguagugccaauuucccuuuaugucagcguggaaguuauccgacuggggcauucguacuuuauuaacugggauagaaagauguacuauucuaggaaggcgauacccgcaguggcccggaccacgacuuugaaugaggaacucggacagaucgaguacauuuucuccgacaaaacaggcacccugacucagaacaucaugacauuuaagcguuguucaaucaauggucgcauuuauggggaaguccacgaugacuuagaucagaaaaccgagauaacgcaagagaaggaaccuguggacuucaguguaaaaagccaggcugauagagaguuucaauucuuugaccaccaucugauggaauccaucaagaugggagauccaaagguucacgaguuccuaaggcuccuggcccuuugccauaccgugaugucugaagagaacagcgcaggcgaguugauuuaccagguccagucacccgacgaaggcgcucuggugacagccgcgcggaauuucggguuuaucuucaaaagucgaacuccugagaccauuacaaucgaggaacucggaacucuggucaccuaucagcuucuggccuuuuuggauuucaacaauacacgcaagagaauguccgugauaguuaggaacccagagggucaaaucaaacucuacagcaagggcgcagacaccauucuguuugaaaaauuacacccgucuaacgaggugcugcuaucacucacgagugaccaccugagcgaguucgcuggggaaggacuucggacuuuggccaucgcuuaucgcgaucuggacgauaaguacuuuaaggaauggcauaaaaugcucgaggacgccaaugcagccacagaggaaagagaugagaggauugcuggccuguacgaagagaucgaacgugacuuaaugcugcuuggugcgaccgcaguagaggauaaguugcaggagggggucauagaaacugugaccucccucucucuggccaacauuaaaaucuggguucuaacaggcgacaagcaggagaccgcuauuaauaucggauaugccuguaacaugcugacugaugacaugaaugauguguucgucauagcaggcaacaaugccguggaaguacgggaggaacuccgaaaagcuaagcagaaccuguuugggcaaaauagaaacuucucgaauggacacgugguuugcgagaagaaacagcagcuugaguuggacagcaucgucgaagagacaauuacgggugauuacgcccugaucauuaacggccauuccuuagcacacgcgcucgaaucagacgugaagaaugaccugcuugagcuggcuuguaugugcaaaaccgugaucugcuguagggucacucccuugcagaaggcccaaguuguggagcucgugaaaaaguaucgcaacgcaguaacacuggccauaggggauggagcuaaugacgucaguaugauuaaaucugcccauaucggcguggguaucagcgggcaggaaggccuacaggcaguucuggcuuccgauuacucauuugcccaguuccgguaucuccaaagacugcuuuuggugcacggaagguggagcuacuuucgcaugugcaaguuccuguguuauuucuuuuacaagaacuucgcguuuaccuuaguccacuucugguuuggcuucuuuugcggguucucugcccagacaguguacgaccagugguuuauuacucucuucaacaucguuuauaccucccugccugugcuugcuaugggaauuuuugaucaagacguaagugaucagaauagcgucgacuguccacagcuguacaaacccggucagcuaaaccuccuguucaauaagcgaaaauucuuuauaugcguguugcauggcaucuauacgucucugguguuauucuuuauuccuuacggggcauucuauaacgucgccggagaggauggccaacacaucgcugacuaccaguccuuugccguuaccauggcaacaucacucgugauuguagugaguguccagaucgcgcuggauacuagcuauuggaccuucauaaaucauguguuuaucugggguucgauugccaucuacuucuccauucuuuuuacaaugcacucuaacgggaucuucggcauauuuccaaaucaguuccccuuuguuggaaacgcucggcacagccugacucaaaaguguauuugguuggugauccuccugaccacggucgccucagugaugccgguuguggcauuccguuuccuaaaagucgaccuguacccuacacuuagugaucagaucagaagguggcagaaggcucagaagaaagcccggcccccauccucucgcagaccuaggacccgacgcagcuccucacggagaagcggcuaugcauuugcccaucaagaaggguacggagagcucauuacaaguggcaagaauaugagggcuaaaaaucccccacccacuucuggucuggaaaagacccacuauaauuccacuagcuggauagagaacuugugcaaaaagaccacagacacgguaucgucauucucucaggacaagaccgugaaacuguga

SEQ ID NO: 53197 - RNA, 3444 nt, Artificial Sequence
  derived and/or modified sequence opt3 from ATP9B__Homo_sapiens__NP_940933
auggccgaccagaucccccuguacccugugagaagcgcugcagccgcggcugccaacaggaagcgggcagccuauuacuccgcugcaggcccacgcccgggggccgaucgacacucucguuaucaacucgaggacgaaucagcucaucuugaugagaugccccugaugaugagugaagagggauucgaaaaugaggagagcgacuaccacaccuugccuagagccaggauuaugcagcggaaacgcgguuuagaaugguuugucugcgauggcuggaaguuccuguguacauccugcuguggguggcuaauaaacaucugcagaaggaaaaaggagcucaaagcgcggacuguuuggcugggauguccagaaaagugcgaggagaagcauccccgcaauucuauuaaaaaccagaaguauaauguguuuacguucaucccuggcguacuuuacgaacaguuuaaauucuuucugaacuuguauuuccucgugauuucguguucacaauuugucccagcacugaagaucgguuaccuguacaccuauugggcuccccucggguucguguuagcuguuacaaugacucgagaggccauagacgaauuuagaagguuccagcgggauaaagaggugaauagccagcuguacaguaaguugaccguccguggaaaggugcagguaaaauccucugacauccaaguuggcgauuugauuaucguggaaaagaaccagcgcauuccuagcgacauggucuuucugagaacauccgagaaagcaggcucaugcuucaucaggaccgaucagcuagacggggagacugauuggaagcucaaaguggcugugaguuguacacagcaacugccagcccuuggagaccuguucagcauaucugcguaugucuacgcccagaagccgcagauggacauucacuccuuugaagguaccuucacgcgggaggauucagaucccccuauccaugaaagccuuaguauugagaauacucucugggcaucuaccaucguugcuuccggcacagugaucgggguagugauuuauacuggaaaagaaacccgaagcgucaugaacacaucgaauccaaagaacaaggugggccuguuagaccuggagcucaaucgccuuaccaaagcccuguuuuuggcucuaguugcccugucuauagugauggucacgcuccaagguuucguggggcccugguacagaaaccuguuuagguuccuucuguuguuuuccuauaucauuccuaucucacuccggguaaaucuggacaugggaaaggcaguuuacggcuggaugaugaugaaagaugagaacauaccaggcacugugguccgcacaaguaccauucccgaagaguuagggagacugguguaccuacucacugacaagacaggaacccugacgcagaacgaaaugaucuucaaaaggcuucacuuggguaccgucagcuauggcgccgauacaauggacgagauccagucccacgugcgugauucuuacagccagaugcaaucacaggcugggggaaauaacacuggcaguaccccgcugcggaaggcgcaguccagcgcaccuaagguucgaaaaucugugucaaguaggauucaugaagccguaaaggcuaucguccucugccacaaugugacacccguuuaugagagcagagccggugugacugaggaaaccgaguuugcagaagccgaccaggauuucuccgacgagaaccgcacauaccaagccucuucgccagacgaggucgcccuggugcaguggaccgaaagcguagggcuuacucuggugucccgggauuugacgucaaugcagcucaaaacaccuaguggccagguucugucuuuuuguauuuuacaacuguuccccuuuaccagcgaguccaagagaaugggagucauagugagggacgaaucaacugcagagaucaccuucuauaugaaaggcgcggauguggcuaugagcccaauuguccaguacaaugacuggcuagaagaggagugcgggaacauggcccgcgaaggacuccgaacacugguuguggcaaagaaggcccuuaccgaggaacaguaucaggauuucgagucucgguacacucaagcuaaauuguccaugcaugaccguagucugaagguggccgcaguagucgaaagccucgagagagagauggaacuguuaugccugacagguguggaggaucagcuucaggcugacguuaggcccacguuggaaaugcuccgcaaugccggcaucaaaaucuggaugcugaccggggauaagcuagagacugcgacauguauugccaaaucuucccaccuggugucacggacccaagacauacacaucuuuagacaggucacaaguaggggagaagcucaucucgagcugaacgcauuccgacgcaagcacgauugcgcccuugugauuagcggcgacucguuggagguuugucugaaguacuaugaacaugaguuuguggaauuagcuugccaguguccugccguagucugcugucggugcuccccaacucagaaagcaagaaucgugacccuccugcaacagcacacggguaggcguaccugugcgauuggggauggcggaaaugacgugucuaugauccaggccgcugacugcggcauagggaucgagggaaaggaggguaaacaggccagccuugcagcugauuucucaauuacacaauuucgccauaucggccggcuguugaugguccacgggagaaacaguuacaagagguccgccgcacucggacaguucguuaugcaccgaggccugauuaucucuacuaugcaggccguguuuagcuccguauucuauuuugcuucagugccgcuauaccaggguuuccugauggucggguaugcgaccauauacacaauguuucccguguucagccucguucuggaccaagaugugaaaccugaaauggccaugcuuuauccagaguuguacaaggaccugacuaaaggccggaguuuaucuuuuaagaccuuccucauuuggguccugaucuccauuuaccagggaggcauccuuauguauggggcacuggugcuauucgaaagcgaguuuguucauguggucgcuauaucguucacggcccucauccugacagaauugcugaugguagccuuaaccgugcgcacuuggcacuggcucaugguuguggcugaguuucugucacuuggauguuacgucucuagucuggcauucuugaaugaguauuuuggcauugguagaguguccuucggggccuuucucgauguagcguucaucacaaccgugacuuuucuguggaaggucagcgcuauuaccguugugucuugccuaccccuguacgugcuuaaauaucucaggcggaagcugagcccuccauccuacugcaaauuggccucauga

SEQ ID NO: 53198 - RNA, 870 nt, Artificial Sequence
  derived and/or modified sequence opt3 from ATPAF2__Homo_sapiens__NP_663729
auguggagaagcugccugaggcuccgggacggcgggcgccgacuucugaaccgucccgccggagguccuuccgcuucuaugucaccaggcccgaccauccccaguccugcaagagccuacgcgccacccacagagaggaagcgguucuaucagaaugugagcauuacucaaggggaaggaggcuuugagauaaacuuggaucaccgcaaauuaaagacgccucaggcuaaacuguucaccgucccauccgaagcccuagcaaucgccguugcuacagagugggacucucagcaggauacuauuaaguacuauaccaugcaucucacaacccuguguaauacuucgcuugacaaccccacacaaagaaauaaagaucagcugaucagggcagccgugaaguuuuuggacaccgauacgauuugcuaccggguagaggaaccugagacucucguggaacugcagcgcaacgagugggacccaaucauagaaugggcugagaagcgauauggugucgagaucucaagcaguaccuccauuauggggccgucuauccccgccaaaacaagagaagugcugguuagccaccucgcguccuacaauacuugggcauuacagggaauugaguucguggccgcucaacugaagucaaugguccuuaccuugggccugaucgaucuaaggcucacaguggaacaggccguacugcuuagucggcuggaggaagaguaucagauacagaaauggggcaacauugagugggcacaugacuacgaauugcaagagcuccgugcucgcaccgccgcggggacgcuguuuauccacuuauguagcgaaucuacuacaguuaagcauaaacugcucaaggaguga

SEQ ID NO: 53199 - RNA, 690 nt, Artificial Sequence
  derived and/or modified sequence opt3 from ATRAID__Homo_sapiens__NP_001164266
auggcuccccacgacccuggcagccugaccacacucgugccaugggccgcagcccuucuguuggcguuaggggucgagagagcucuggcccuaccggaaaucugcacucagugucccggauccguucaaaaccucucuaagguggcauucuacugcaaaacgaccagggagcugaugcuucaugcccgguguugccugaaucagaaggguacaauuuugggccucgaucugcagaacuguucacuggaagacccugggccaaauuuucaccaggcucauacuaccguaauaaucgaucuccaagcaaaccccuuaaaaggagaccuggccaauacauuccgcggcuuuacccagcuucagacuuugauucugccucagcacgugaacugcccaggugggaucaaugcuuggaacacaauuaccaguuauaucgauaaucaaauaugucagggacagaagaaccuaugcaauaacacgggcgaccccgagauguguccugaaaauggcagcugcgucccagaugggccgggacuccugcagugugugugcgccgacgguuuccauggcuacaaaugcaugcgacaaggguccuuuucucuucugauguucuuuggaaucuugggcgcgacuacccucucgguuucaauucuguuaugggcaacacagcguagaaaggccaagacuagcuga

SEQ ID NO: 53200 - RNA, 7935 nt, Artificial Sequence
  derived and/or modified sequence opt3 from ATR__Homo_sapiens__NP_001175
augggcgagcacgggcuggaacucgccaguaugaucccagcucuuagagagcugggauccgcuaccccugaagaguacaacacagugguccagaagccaagacagauuuugugccaguucauagaccggaucuuaacugauguuaaugugguagccguggaacuggucaagaagacggacucucagccgaccucagugaugcuacucgauuuuauucagcauaucaugaagaguucuccccugauguucguuaacguguccgguucucacgaggcgaagggcucguguauugaguuuucaaauuggaucauaacacgccuucugcgaaucgcugccacuccuagcugccauuugcuccacaagaagauuugugaagucaucugcagucugcuguuccucuuuaaguccaagucuccagcaauuuucgggguguuaaccaaggagcugcuucaguuguuugaagaccugguauaucuacaucguagaaacguuaugggacacgccguggaguggcccgucgugaugagcagguuccucucccagcuggaugagcacaugggcuaccuucagucagcuccucugcaguugaugaguaugcaaaaucucgaauuuaucgaggugacacuguuaaugguccugacccggauaauugcaaucguuuucuuucgcagacaggaacuccuucuguggcagauugguuguguguugcuagaguaugggagcccaaaaaucaagucucuggccaucuccuuccucacugaacuguuucagcuuggaggccugcccgcucaaccugccucaacauucuucagcagcuuuuuggagcuccugaaacauuuaguagagauggacaccgaucagcugaagcuauacgaagaaccacucucuaagcugauuaaaacgcuuuucccguuugaagcggaggcauauaggaacauagaacccguguacuugaauaugcugcucgagaagcugugcgucauguucgaggacggcgugcuuaugcggcugaaauccgauuugcucaaggccgcucugugucacuuacugcaguauuuucuaaaauucguuccugccggguacgaaagcgcacuccaagugcgcaaggucuacgugcgaaacaucugcaaagcucugcuugacguauugggaauugagguugaugccgaauaucugcucgguccacuguacgcggccuuaaagauggagucgauggaaaucauagaggagauucagugucagacucagcaagaaaaucugucuuccaacucagacggcaucagucccaagagaaggcggcuuagcuccucuuugaauccuagcaaacgugcaccaaagcagaccgaggaaaucaaacauguggauaugaaccagaagucaauucucuggagugcucugaaacagaaggccgagucccuacaaaucagccuggaguauucugggcucaagaaucccgucauugaaaugcuggagggaauagcugugguccuucaguugacagcccugugcacugugcacuguucacaccagaacaugaauugccgcaccuuuaaagacugccagcauaagaguaaaaagaaaccgagcguugugaucacauggauguccuuagacuucuacaccaagguacucaagucuuguagaucgcugcuugaaagcguccaaaaacuggauuuggaggcaacgauugacaaggugguuaaaaucuaugaugcccucaucuacaugcaagugaacuccucauuugaagaccacauucuggaggaucuaugcggcaugcugagucucccuuggauauauucucauagcgacgaugguugucugaaacuuacuacauucgcugcgaacuugcugaccuuauccugcaggaucucagacagcuacucuccccaggcacagucccggugugucuuucuccugacucuuuucccacgacgcauuuuucuggaguggagaacagccguguacaauugggcucuacaaaguagccacgaaguaaucagggccucuugcguguccggguucuucauucuccugcagcagcaaaacucauguaaucggguuccuaaaaucuugauagauaaggucaaggacgauagugacaucgugaaaaaggaguuugcaagcauucugggacaguuagugugcacccuccauggcauguucuaucugacgucgucccuuaccgaacccuuuucugagcacggccacgucgaccuguucugucgcaacuugaaagccacaagccagcaugaaugcucaaguucccagcucaaggcuucuguuuguaaaccauuucuguuccuacugaagaaaaagauccccagcccugugaaacuugccuuuauugauaaucuccaccaucugugcaaacacuuggacuucagagaggaugagacugacgugaaggcaguacuggggaccuuacucaaccugauggaagauccagacaaagaugucaggguggcguuuuccggaaauaucaagcacauacuugagucacuggacagcgaagaugguuucauuaaagaguuguuuguucuccguaugaaggaggcuuacacacaugcccaaaucagucggaacaaugagcugaaggacacucuaauucugaccacaggcgauaucgggcgagcagccaaaggagaccuugugccguucgcucuccugcacuuguuacauugccugcucucuaaguccgccagcgucucgggcgcagcuuauaccgagauaagagcccugguggcggccaaaucaguuaaacuucagagcuuuuucagucaguacaaaaagcccaucugucaguuccugguggaauccuugcacagcucucaaaugacugcucuaccuaacacgccaugccagaaugcagauguaaggaagcaggacgucgcccaucagcgcgagauggcucugaacacacucagcgaaauugccaauguguuugacuuccccgaucugaaccgguuucuuaccagaacuuuacaagugcugcucccugacuuggcagcgaaagccuccccagcugccucagcacugaucaggacccucgguaagcagcugaaugucaaccgccgagagauucuuaucaacaauuucaaauauauauuuagucaccugguuuguagcugcucuaaggaugaguuggaacgggcucuacacuaccugaaaaacgagacagaaauugagcucggguccuuacugcgucaggacuuccaaggccuucauaaugaacugcucuugagaaucggagagcacuaucaacagguguuuaacggccugucaauccucgccaguuucgcaagcuccgaugaccccuaccaggggccgagggauauuaucucuccugagcugauggccgacuaccuucaaccaaagcuacugggaauuuuggcauuuuucaauaugcaguuacugucgagcucaguagguauagaagauaagaaaauggcgcucaacucccugaugagucuuaugaagcugaugggccccaaacaugugucuagcguccgcgugaagaugaugaccacucuccggacaggguugagauuuaaagacgauuucccugagcuguguugcagggccugggacuguuucguucgaugccuagaucacgcaugucugggaucccuccuuucacaugugaucgucgcucuguuacccuugauucacauccagccaaaggaaacggccgccauuuuucacuaucugaucauagagaaucgcgacgcugugcaggacuuccuccaugaaaucuacuuucugccugaucaccccgagcuuaaaaagauuaaggcaguucugcaagaguaucggaaagaaaccucugagagcacugaccuccagacaaccuugcagcugaguaugaaggccauccagcaugaaaacguggaugucaggauucacgcguuaacaucccuaaaagagacucuguacaagaaucaagaaaaacucaucaaguaugcuaccgacagcgagacgguagagccaauaauuucucagcuugugaccguucuguugaagggcugccaggaugccaacucacaggcaaggcugcucuguggugaaugccugggggagcuuggcgccaucgacccgggacgucucgauuucuccacaacugaaacccaaggcaaagacuuuacauucgugacuggggucgaggauaguagcuuugcuuacggacuguugauggagcugacccgcgcauauuuagccuacgcggacaauucgcgggcucaggauucugccgcauacgccauccaggaacuacuguccauuuaugacugcagagagauggaaacgaacgguccuggccaccaacucuggaggcgauuccccgagcaugugcgggaaauacuugagccacaccugaauacacgcuacaagagcucacagaaaaguaccgacuggucugggguaaagaaacccaucuauuuguccaagcugggaagcaacuuugcugaguggucagccaguugggcaggcuaccucauuacuaaggugagacaugaucuggcuagcaaaaucuucacauguugcuccauuaugaugaagcacgacuuuaaagucaccaucuaucuuuuaccucauauacugguuuacgugcucuuggguuguaaucaggaagaucagcaagagguguaugccgaaaucauggcgguccugaagcacgacgaucagcacacuauuaacacccaggacaucgccucugaucuaugccagcugagcacacaaacgguguucuccaugcucgaccaucuuacccagugggcaaggcacaaauuucaggcucugaaggccgagaaguguccacauucaaaaucuaaccggaauaagguugauaguaugguaucgacuguggacuacgaagauuaccagagcgucacacgauucuuggaccugauuccccaagauacccucgcuguggcauccuucagaucuaaagccuauacacgcgccguuaugcacuuugagucauucaucacugagaagaaacagaacauacaggaacaccugggguuuuuacaaaaacuuuacgcugcgaugcaugagccugacggcguggcaggagucagcgccauuaggaaggcugaaccgucccugaaagagcagauccucgaacacgagagucuaggccuguugcgugacgccaccgcaugcuaugaucgggccauccagcuggagccagaccagauuauccauuaccacggggugguaaagucuaugcucggacuuggccaacugagcacggucauaacacaggugaaugguguucaugcuaacagaucagaauggaccgaugaguugaauacuuauaggguggaagcggccuggaaacugucccagugggaccucgucgagaacuacuuagcagcugaugggaagaguaccacauggagcgugcgccugggacagcuucugcuaucugccaaaaagcgagacauuacugcauucuaugauucccucaaacugguuagagccgagcaaaucgugcccuugucagcugccagcuuugaacggggcucguaccagagggguuacgaguauauuguccgccugcacaugcucugugaacuugagcacucuaucaagccucuguuccagcauaguccaggcgacuccagccaggaagauucauuaaauuggguggcgcgucuggagaugacccaaaacuccuacagagcaaaggagcccauauuggcccuccggagggcucugcuaucucuuaauaaacgcccugacuauaacgaaaugguaggggagugcuggcugcagagcgcccgaguggcuagaaaggcaggacaccaucagacagccuacaaugcucuccugaacgccggcgaaagucgguuggcagagcuguauguugaaagggcgaaauggcucugguccaagggggauguccaccaggcccuuauugugcugcaaaaaggaguggaguuauguuuuccggagaaugaaacgcccccagagggcaagaacaugcugauccacggucgcgcuauguugcucgucgggagauucauggaagagaccgccaauuuugaaagcaacgcaaucaugaagaaauacaaggacguaacugcuugccugccugagugggaggauggacauuucuaucuagccaaauacuacgacaaacuuaugcccauggugacagacaacaaaauggaaaagcagggcgaucugauuagguauaucguucuccacuuuggucggucucugcaguacggcaaucaauucauuuaucagucaaugccacguauguugaccuuauggcuggacuacgggacuaaggcauaugagugggaaaaagccggacgcagugaucgagugcagaugagaaacgaccucggcaagauaaauaaagucaucacagagcauaccaacuaccuugcuccuuaucaguuucugacggcguucucccaacuaauuagcaggaucugucacucucaugaugagguguucguugugcugauggaaaucauugccaaggucuuucucgcauacccccagcaggcuauguggaugaugacugccgugucgaaaucaagcuacccaaugcggguaaaucgcugcaaggagauauugaacaaggccauccacaugaaaaagucccuggaaaaauucgugggggacgcaaccagacuuacagauaagcugcucgaguuaugcaauaaaccgguugacggaaguucuagcacccuguccaugucaacucacuuuaagauguugaaaaagcuggucgaagaggcuacauucagugagauucucaucccucuucagucugugaugauucccacccugccaagcauccuaggcacacaugccaaccacgcgucccaugaacccuuuccuggucacugggcuuauauagccggguucgaugacaugguggagauccuggcaucacuccaaaagcccaagaagauuagcuugaaaggaucugauggcaaguuuuacaucaugauguguaaacccaaggacgaccugaggaaggauugccggcuuauggaguucaauucccugauuaacaaauguuuacgaaaggacgccgaaaguagacgcagggaacuccauauccggacuuaugcugucauaccucugaaugaugagugcgguauuaucgaguggguuaacaauaccgcaggcuugcguccgauucugacgaaacucuacaaggaaaaagggguguauaugacaggaaaggagcuuagacaguguaugcugccaaagagcgccgcgcuaucggaaaaacugaagguauuuagggaguuccucuugccccgccacccucccaucuuucacgaaugguuccugcggaccuuuccagacccuacuuccugguacucuucacgaagcgcuuauugcagaaguaccgccgugauguccauggucggcuacauauuagggcuuggagauaggcauggcgagaacauccuguucgacucucucacaggugagugugugcacguugauuucaauugccuguuuaacaaaggggaaacuuucgaggugcccgaaauugucccauuucgcuugacccauaauaugguaaacggaaugggcccuaugggcacggaggggcuguuccggagagcaugugaggugacaaugcgucucaugagggaccagcgggaaccgcuuaugagcguucugaagaccuuucuacacgauccccugguggaguggucaaaaccagucaagggacacuccaaggccccuuuaaacgaaacuggugagguggucaaugaaaaagcuaagacacaugugcucgacaucgagcagcgccugcaaggcguuauuaaaacccgaaacagagugacuggguugccccuuaguaucgagggacacguacauuaccugauacaggaagccacagaugagaaucuccugugccagauguauuugggcuggaccccauacauguga

SEQ ID NO: 53201 - RNA, 2097 nt, Artificial Sequence
  derived and/or modified sequence opt3 from ATRIP__Homo_sapiens__NP_001257952
augagcaagaaccccuccggcaaaaauagagagaccgugccuaucaaggacaacuucgaacuggagguccuccaggcccaauacaaagaacuuaaggagaaaaugaagguuauggaagaggaggugcugauuaagaauggggaaauaaaaaucuugagggauucuuuacaccagacagagucaguacuggaagaacagcggcgcagucauuuucuacucgagcaggaaaagacucaagcucugagcgacaaagagaaggaguucuccaaaaagcugcagucucugcagucggaguugcaguuuaaggaugcagaaaugaacgagcuccgaacgaaacugcaaaccucagagcgugccaauaagcuggcggcuccaagcgugagucacgucuccccgcggaaaaaccccucugugguuauuaagccugaagccugcagcccacaguucggaaaaacauccuuucccacuaaggagucauucagugcaaauaugagccucccucauccaugucagaccgaaucugguuauaaacccuuagugggcagggaggacuccaagccucacucacugagaggggauagcaucaagcaggaagaggcccagaaaaguuuugucgacucuuggcgccaaagauccaacacacagggaagcauucuuaucaauuugcugcuaaagcaaccacucauaccgggcucgucucugucccuuugccaucuguugucaaguagcuccgagucucccgcugguaccccucuccagccacccggguucggaagcacucuggcaggcaugucaggcuuaaggacaaccgggaguuacgauggauccuuuagccugucugcccuccgggaagcucagaaccuugccuucacgggucugaauuugguggcgcgcaacgaguguucacgagacggcgauccugcagaagggggaagaagggccuuuccacuaugccagcugcccggcgcuguacacuuccucccgcugguucaauuuuucaucggucuucacugucaggcccugcaggacuuggcagcugccaaacggaguggggcgccuggagauagccccacucauuccucuugcgugucgagcggcgucgagaccaauccagaagacuccguguguauucucgagggcuucucagugacagcccugaguaucuuacagcaccuggucugccauucuggggcaguugugagccuacuccuguccggaguaggugcugauucagccgcuggcgaggggaaccguagccuugugcaccgcuugucugacggagacaugacuuccgcccugagaggcgucgcagaugaccaaggucagcacccucuccugaagaugcuucugcauuugcucgccuuuaguagcgcugcgaccgggcaccuucaggcaucuguguuaacacagugucugaaaguucuagugaagcucgccgaaaauaccuccugcgauuuccugcccagguuucaaugugucuuccaggugcuuccaaagugcuugucacccgagacgccucugccaaguguacuccuggcuguugaauuacugagccuuuuggccgaccaugaucagcucgcaccgcagcugugcucgcacuccgagggcugucuacugcuccugcuuuauauguacauuacuucucggcccgaccgaguggccuuggagacacaauggcugcaguuagaacaggaggucguguggcuccuggcuaaacuuggaguccaaagcccucugccacccgugaccggcucaaacugccaguguaacguugaagugguacgcgccuugacugucaugcuccauagacaguggcugacagugaggcgggcagggggaccuccacgcaccgaucagcaaagaaggacgguucguugccuacgggacaccgugcugcuccugcacggucuuagucagaaggauaaauuguuuaugaugcacugugucgaggugcugcaucaguucgaccagguaaugcccggcguguccauguuaauccgagggcucccggauguuacagacugcgaagaggcggcucuggacgaucuuugugccgcagagacugacgucgaagauccugagguggaaugcggauga

SEQ ID NO: 53202 - RNA, 4290 nt, Artificial Sequence
  derived and/or modified sequence opt3 from ATRN__Homo_sapiens__NP_647537
augguggccgcugcagccgcgaccgaggcuagacugaggcggcgcacagccgcaacugccgcucucgcaggccgaagcgggggaccccacugggacugggaugucacgcgugccgguagaccuggccuuggggcuggacugagguugccacgguuacuguccccgccccuacgcccuagacuccugcuucuguugcuccugcugucuccaccccucuuacugcuuuugcugccuugcgaagccgaggcggcagccgcugccgcagcuguuucaggcagugccgcggccgaagcaaaggagugugacaggccaugcgugaacggugggcgguguaaucccggaaccggccagugcguauguccugcuggcugggugggggaacaaugccagcauuguggaggucgcuuccgacuaacaggcagcuccggguuugucacugauggaccaggcaacuacaaauauaagaccaaaugcacauggcucaucgagggucagccgaauagaauuaugaggcugcgguucaaccacuuugccaccgaguguucuugggaccaucuuuacguguaugauggggacucgauauacgcuccccugguugccgcauucucaggauugaucgugccugaacgugauggcaaugagacugucccagaagugguagccacaagcggcuaugcucuccugcacuuuuucagugacgcggcauacaacuuaaccggguuuaauauuacguauuccuucgauaugugccccaacaauuguucuggacgcggugagugcaagaucagcaacuccucagacacuguugagugcgaauguagugagaauuggaaaggcgaagccugcgauauuccucauuguaccgacaacugcggguuuccacacagaggaaucuguaauagcucugaugugaggggcugcuccuguuucucagacuggcagggucccgggugcagcgucccggugccugcuaaccaaaguuuuuggacacgggaggaauacucuaaucugaagcucccccgagccucccacaaggcaguggucaacggcaacauaauguggguugugggaggcuacauguucaaucauagcgacuauaacaugguacuugccuacgaucuggcuucgcgcgagugguugccacuaaauagaucugugaacaaugucgugguuagguaugggcacucccuggcccucuacaaagacaagaucuauauguacggagguaaaauugauucaacuggcaacgugaccaaugagcugcgggucuuucauauccacaacgaaaguugggugcuucugacaccuaaggcaaaagagcaguaugcgguaguugggcacagcgcucauauugugaccuugaagaauggacgcgucgugaugcucgucaucuucggccacuguccccuguacgguuacauauccaacgugcaggaauaugacuuagauaagaauacguggucuauucugcauacucagggggcccuaguucaaggcggauacggccacagcucaguguaugaccauagaacaagggcacucuacguacacgggggauauaaagccuucagugcuaacaaguaccgucuggccgaugaccuuuaucgguacgaugucgacacccagauguggacuaucuugaaagauucccgauuuuucagauaccugcacacagcagugauuguuagcgguaccaugcucguguuuggcgggaauacgcauaacgacaccucuaugucacacggagcuaagugcuucaguagcgacuuuauggccuaugauaucgcgugugacaggugguccguccugccacgccccgaucuucaucacgacgugaaucgguucggccacucugccguacugcauaacucgacaauguacguguuugguggguucaacagcuugcuccuguccgauaucuuaguuuuuacuucagagcagugcgacgcucacagaagugaagcagccugccuggcugccggcccuggaauuaggugugucuggaauaccggcucuagccagugcauauccugggcacuagcgacagaugagcaagaggaaaaacucaagucagaguguuucagcaaacgcacucuggaccaugaucgaugcgaccagcacaccgauuguuauucuugcacagccaacaccaaugacugucauuggugcaacgaucacugugugccacggaaucacuccugcagugaagggcagaucagcauuuuucguuacgagaacuguccgaaggacaaucccauguauuacugcaacaagaaaacuucuugcagauccugugcucuugaccaaaauugccagugggaaccuaggaaccaggaguguaucgccuugccagagaauauaugcggaauuggcuggcaucugguggguaacucaugucucaagaucacgacagcaaaagaaaauuaugauaacgcuaagcuguucugccgcaaucacaacgccuuacuggcaagucuuaccacucagaaaaaggucgaguuuguuuugaagcaacuccggaucaugcagagcucgcaguccaugucuaaacugacccuaacacccuggguggggcugagaaagauuaacgugagcuacugguguugggaagacaugucaccuuucaccaauagucuccugcaguggaugccauccgagcccucugaugccggauucugcggcauccuuagcgagccguccacuagggguuugaaagcugcgacauguauuaacccucugaauggcucaguaugcgaacgaccagccaaccauagcgcaaagcaaugucgcacgcccugcgcuuuacggaccgccugcggggacuguacaaguggaucuuccgagugcaugugguguagcaauaugaaacagugcgucgauucgaacgccuacguggcuucauuuccuuucggccaguguauggaaugguauacuaugucuaccugucccccagagaauugcaguggguacugcacauguucccacugccucgaacagccuggauguggcuggugcacugaccccagcaacaccgguaaggggaagugcauagagggaucuuauaaaggcccaguuaagaugccgagccaagcaccuacggguaauuuuuacccccagccacugcuuaacuccucaaugugucuggaggauaguagauauaauuggagcuucauccauugccccgccugucagugcaacggccacucuaaauguauuaaucaguccaucugcgaaaagugugagaacuugaccacagggaaacacugcgaaacuuguaucucaggauuuuacggcgacccuaccaaugggggaaagugccaaccauguaagugcaacggccaugcgagucucugcaacacaaauacugguaaauguuucugcaccacgaagggggugaaaggagaugagugucagcugugcgaagucgagaacagguaucagggcaauccccuacgugguacauguuacuacacccugcucauugacuaucaauuuacuuucagccugucccaggaggaugaccgcuacuauacagcuauaaacuuuguggccaccccugaugaacagaaucgggaccuugacauguucaucaacgcaucuaagaauuuuaacuugaauauuacuugggccgcuucguucagcgcaggcacccaggccggggaggaaaugccgguugugucaaaaacaaacaucaaggaguacaaagauuccuuuaguaaugaaaaguucgacuucagaaaccacccaaauauuacguuuuucguauaugucucuaacuuuaccuggcccaucaagauacaaaucgcguucagccagcauuccaauuuuauggaucuggugcaguucuuugugacuuucuuuucaugcuucuuaucucuccugcuugucgcugccguuguguggaaaauuaagcagagcuguugggcaaguaggcgacgggagcaacugcuacgcgagaugcagcagauggccuccagaccuuuugcuagcguaaacguggcccucgaaacagacgaggaaccacccgaucugaucggaggcucuauuaaaaccgucccuaagccgaucgcauuggagcccugcuucgggaauaaagcugccgugcugucaguuuucgugagguuaccacggggacucggcgguauaccucccccagggcaguccggacuggcggucgccagugcacuuguggacauuagccaacagaugccuaucguuuacaaggagaagucgggcgcugugcgaaacagaaaacagcaacccccagcccagccgggcacauguauuuga

SEQ ID NO: 53203 - RNA, 4140 nt, Artificial Sequence
  derived and/or modified sequence opt3 from ATRNL1__Homo_sapiens__NP_997186
auggagaccggcgggagagccaggacaggaacuccccagccugcugcaccagguguguggcgggcccgcccggcgggcgggggaggcgguggggcuagcuccuggcugcucgacggaaacucuuggcuucugugcuacggcuucuuguauuuagcccuguacgcacaagucucacagaguaagcccugugaacgaacgggcagcugcuuuuccgggcguuguguuaauucuaccugccuaugugauccuggaugggugggugaccagugccagcacugucaaggcagauucaaacucacagagccaucgggguaucugacugauggacccaucaacuacaaguauaaaaccaagugcacauggcuuauugaaggcuacccuaaugccguacugagguugcgguuuaaccauuucgcuaccgaguguucaugggaccacauguauguguacgauggugacagcauauacgcaccacucaucgccguccugagugggcugauugugcccgaaauccgcggaaaugagacuguuccugagguggucacaaccuccggcuaugcucucuuacacuuuuucucugaugccgcguacaaccugacgggcuuuaauauuuucuauagcaucaacuccugcccaaauaacuguucagggcauggaaaaugcacuaccagugugagcguaccgucucagguuuacugcgaaugugacaaguauuggaagggugaggcaugcgauauacccuacuguaaagccaauugcggcuccccugaccauggguauugugaucuuacaggagaaaaguugugcguguguaacgacucauggcagggcccagauugcagccugaauguccccaguacugagucuuacuggauccuaccuaacgugaaaccauuuucccccagcguggguagagcuucgcacaaggccguccuccacgggaaauucauguggguuauuggcggauacaccuuuaauuauucuuccuuccagauggugcugaacuacaaccuugagucaaguaucuggaauguaggcacaccgagcagggggccucugcaacgguauggacauuccuuggcacucuaccaggaaaacauuuuuauguaugguggccgcaucgagaccaaugacgggaacgugacggacgaacugugggucuucaauauacacucucagagcuggucaacuaagacacccaccguguuaggacauggccagcaauacgcuguugagggucacagugcccacauuauggaacuggauucccgagacguggucaugaucauuaucuucggguauagcgcgaucuacggcuacacuucuucaauucaggaguaucauauaaguagcaacacauggcucgugccagagaccaagggagccaucguacagggcggguacggacacacguccguuuaugaugaaauuaccaaaucuaucuacgugcaugguggcuauaaggcacuuccugggaauaaauacggacuggucgacgauuuguauaaguacgaggugaacacaaaaacuuggaccauacuaaaggaaucgggcuuugcuagauaccugcacagcgccguccucauuaauggugcuaugcugaucuucgggggcaacacacauaaugacacuucccuuucaaacggagccaaauguuuuagugcagauuuccuggccuaugacaucgcuugcgaugaguggaagauuuugcccaagccaaaucuccacagggacgugaaccgguuuggccacucugcgguugugaucaaugggagcauguacauuuucggaggcuuuuccucaguacuguuaaacgauauacuggucuauaaacccccuaacuguaaggcauuccgugacgaggaacuaugcaaaaaugccgguccagggaucaagugcguguggaacaaaaaucauugugagagcugggaaucuggaaacaccaauaacauucuccgcgcuaagugcccgcccaagacagccgcauccgacgauagauguuacagguaugccgacugcgcuaguuguaccgccaauacuaacggcugccaauggugugaugacaaaaagugcaucagcgcaaauucuaacuguuccaugucaguuaaaaauuacacgaagugccacgugcggaacgagcagaucuguaauaaacugacaaguugcaagagcugcucgcuuaacuugaauugucagugggaucagcgacaacaggaaugccaggcgcugccugcucaucucuguggugagggcuggucccacauuggggacgccugccugcgcgucaacucuagcagagaaaacuaugauaaugcaaaacuuuacuguuacaaccugucaggaaauuuggccagucucaccacuuccaaggagguggaguuuguacuggacgaaauacagaaguauacccaacagaaagugucuccauggguuggcuuaaggaagaucaacauuagcuacugggggugggaggauaugucccccuucacaaauaccacucugcaguggcuaccuggagaaccaaacgacucaggcuuuugcgcuuaucucgagcgggccgcagucgcuggucugaaagccaaucccuguacaagcauggcgaacgggcuugugugcgagaagccgguggucaguccuaaucagaacgcccgcccauguaagaaacccugcucuuugagaacguccuguagcaauugcaccucgaacggaauggaaugcaugugguguucaucuacuaagaggugcguugauaguaaugcuuacaucauuuccuucccuuauggccaaugucuggaguggcagacagcaaccugcagcccccagaacuguucuggucuccguacaugcggccagugucuggaacaaccagggugcggaugguguaaugacccuagcaacacuggccgggggcacugcaucgagggauccucacgaggccccaugaaauuaauagguaugcaucacagugaaauggugcuggauaccaaccuuuguccaaaggagaaaaauuacgaguggagcuuuauccagugcccggccugccaguguaacgggcauucuacgugcauuaauaacaaugugugugaacaaugcaagaacuugaccacaggaaaacagugucaggacugcaugccuggcuauuacggugaccccacuaauggcgggcaguguaccgcuugcacauguuccggacacgccaacaucugccaucuccacacuggcaaguguuucugcaccacgaaggggauuaaaggagaucaaugccagcugugugacucagagaauagauacguaggcaacccacuaagggguacaugcuauuacagucugcucaucgauuaucaguucaccuuuagccugcuucaggaagacgaucgccaccauacugcaauaaauuucauugcgaaccccgagcaauccaauaagaacuuggacaucucuauuaaugccucgaacaauuuuaaccugaacaucacauggagcgucgggucaaccgcuggaacuauauccggcgaagagaccaguaucgugucuaaaaauaacauuaaggaguaccgggauagcuucuccuaugaaaaauuuaauuucagaucaaacccuaauaucacauuuuacguuuaugugucuaacuucagcuggccaauuaagauccagauagccuuuagucagcacaauacgauuauggacuuaguccaguucuuugugaccuucuuuuccuguuuccucagccugcuucugguugcagcugugguauggaagaucaaacaaacuugcugggccucuaggcgccgagagcaguugcuccgggaacgucagcaaauggcaucaagacccuucgccuccgucgauguggcucuggaggugggcgcggaacagacagaguuucuaagggggccucuggagggagccccgaagccaaucgcaauugaacccugugcugguaaccgcgccgccguccucaccguuuuccugugccuuccucggggcaguagcggggcuccacccccuggacagucgggcuuggcaaucgccucugcgcugauugacauaucccagcaaaaagcuagcgauucaaaggacaaaacaaguggugugagaaauaggaagcauuuaucuacucgacaggggaccuguguauga

SEQ ID NO: 53204 - RNA, 7479 nt, Artificial Sequence
  derived and/or modified sequence opt3 from ATRX__Homo_sapiens__NP_000480
augacagccgaacccaugagcgaauccaagcugaauacacucgugcagaaacuucacgacuuccuggcucauucuucagaggaaagugaggaaacuagcuccccuccaagauuggcaaugaaucaaaacacggauaagaucucuggcucggggucaaauagcgacaugauggagaacaguaaagaggaaggaaccuccucuagcgagaaguccaaaucaagugguagcucuagauccaagcggaagccgucaauuguaacaaaauacguugaaagcgaugacgagaagcccuuagaugacgagacugugaaugaagaugccaguaacgaaaauucugaaaacgacauaaccaugcagucccugccuaaaggcacaguaaucgugcagccagagcccguccugaaugaagauaaggacgauuuuaaagggccugaguuccgcagccgaucgaagaugaagaccgagaaccucaaaaagcguggagaagacggccugcacgguauugugucuugcacugcgugugggcagcaaguuaaucauuuucagaaagauuccaucuauagacacccaucacuucaggugcugauuugcaagaacuguuucaaauacuauaugagugacgacaucagcagggauuccgacggaauggaugagcagugccgguggugugcugaaggcggcaauuugauaugcugugacuuuugccauaacgccuucuguaagaaaugcauccuccgcaaucuggggagaaaggagcugucuacaauuauggaugaaaacaaccaaugguacuguuauaucugccaccccgagccucucuuagaccuggucaccgcaugcaauagcguguuugagaaccuugaacaguugcugcagcagaauaagaaaaagauuaaaguagauucagagaagaguaacaaaguuuacgaacacacguccagguucagcccaaagaagacuucuucaaauuguaacggagaggagaaaaagcuagacgauaguugcagcgguuccgugaccuauucuuacucggcccucaucgucccgaaagaaaugauaaagaaagcuaagaagcugauugagacaacugcaaauaugaacagcuccuacgugaaauuucuuaagcaagccaccgacaauucagaaaucaguucugcuacaaaacugcggcaguugaaggccuucaaaagcgugcucgcggauauuaagaaggcacaucuggccuuagaggaagaccugaacuccgaguuucgcgcuauggacgccgucaauaaagagaagaacaccaaagaacacaagguuaucgaugcaaaauucgagacgaaggcucgaaaaggcgaaaagcccugugcccucgagaagaaagacaucucaaagagcgaagcgaaacuuucuagaaagcaaguggauuccgagcauaugcaccaaaauguaccuacugaggaacagaggacaaacaaaaguaccgggggagagcacaagaagucagaccggaaagaagaaccacaguaugaacccgccaauacuucugaggaucuggacauggauauuguguccgucccuucaagugugccagaggacauauuugaaaacuuggagacagcaauggaaguucagagcucgguggaucaucaaggcgacgguuccucugggaccgagcaggaagucgagagcucaagugugaagcuaaacaucuccucuaaagauaaucguggaggcauuaagagcaaaacgaccgcuaagguaacaaaggagcuguacguuaaacucacucccgugucccugucaaacagcccgaucaagggcgccgacugccaggaagucccucaggauaaagacggguauaagaguuguggacuuaaucccaaacuggagaagugcgguuugggccaagaaaacucugacaaugagcaccucguggagaacgaagucucccuguuacuggaggaaagcgaucuacgcagaucgccaagggugaagaccacaccucuccggcgacccacugagaccaauccaguuacaucaaacucugacgaagaguguaaugagaccgugaaagaaaagcagaaacugaguguacccguccgcaagaaagauaagagaaacuccagcgacucugcuauagauaauccuaaaccaaacaaacuuccgaagucaaaacaguccgagacuguggaccaaaauucagauagugacgaaauguuggccauucugaaggagguuagcaggaugucucauuccucaaguagcgauacggacaucaacgaaauccacacaaaucauaaaacccucuacgaucugaagacucaagcagggaaagacgauaagggaaagcggaaacgcaaguccucuaccucgggcagcgacuucgacaccaagaaggguaaaucagccaaguccaguauuaucucuaagaaaaagagacagacccagagcgaguccucaaacuaugauucugagcuugaaaaagagauuaagagcaugaguaaaauaggggcugcgaggacuacaaagaagcguauccccaacacgaaagacuucgauuccagcgaagacgagaagcacucuaaaaagggcauggauaaucagggacacaaaaaccugaagaccucacaagaaggcuccagugacgaugcagagcggaagcaggagcgagaaacuuuuagcucggccgaggggacaguggacaaagauaccacaauuauggaauugagagacaggcucccuaagaaacagcaggcuucugccuccacugauggagucgacaagcugagcgguaaagaggagucauucaccaguuuagaagugcgcaagguagcagagacgaaagaaaagucuaagcaucugaaaaccaagacaugcaaaaaggugcaggacggccuauccgauaucgccgagaaauuucucaagaaggaccagagcgaugaaacuucagaggacgauaaaaagcagaguaaaaaggggaccgaggagaagaagaagccaagcgacuucaaaaagaaaguuaucaagauggagcaacaguacgaauccucuagcgauggaacagagaaacugcccgaacgggaggagauuugucacuuuccuaagggcauaaagcagaucaaaaaugguacuaccgacggggaaaagaaauccaagaaaauuagagauaagacgagcaagaagaaggacgagcuuucugauuaugcugagaagaguacaggcaagggagacucgugcgauagcuccgaggacaaaaagucuaaaaacggcgccuacgggagggaaaagaagcgcuguaaauugcugggaaagucaagccgaaaacggcaggacugcuccaguucugauaccgagaaguacagcaugaaagaggacgguugcaauucauccgauaagcgucucaagagaaucgaacugagggagcgccggaacuuaaguagcaaaagaaauacuaaggaaauucaaucuggcuccucaagcucggacgcagaggagucuagugaagauaacaaaaagaaaaagcagaggacauccagcaagaaaaaggcggucaucgugaaagagaagaaacgaaauucacugcgcaccuccacuaagcggaaacaggcugacauaaccucuagcaguuccagcgauaucgaagacgaugaccagaacucuauuggggagggaucaagugaugaacaaaagaucaagccagugacagagaaucuugucuuguccagccauacgggcuucugucagucuucgggugacgaggcccucucaaaaagcguucccgugaccguggaugacgacgaugacgauaacgacccggaaaauagaauugcaaagaaaaugcugcuagaggaaaucaaggccaaccuguccagugaugaggacgggucuagcgaugacgaaccugaggagggcaaaaagaggacuggaaagcagaaugaagagaacccaggcgaugaagaggcuaaaaaccaaguaaauuccgaaucagacagugauucugaggagagcaagaaaccccguuaucgccaccggcuccugagacacaaacuuacagucuccgacggggaaucaggagaggagaagaagaccaagccuaaagagcauaaggaggugaaaggcaggaaccgacggaagguuagcucugaagacuccgaggauagugacuuucaggaaagcggugugucggaggaagucuccgagucugaggaugaacagcgccccagaacaaggucagccaaaaaggcagaguuggaagagaaucagcggagcuacaagcagaaaaagaaacgaagacgcauaaaggugcaggaagacaguuccucugagaacaaaagcaauucagaggaagaggaagaggaaaaggaggaggaagaggaagaggaggaagaggaagaggaagaggaggaagaugagaacgacgauuccaagaguccagggaaaggaaggaagaaaauucguaagauccugaaagacgauaaguuacggacugaaacccagaaugcucucaaagaggaagaggagagaaggaagcgcauugccgaacgagagagagaacgggagaagcugagggaaguuaucgagauagaggacgcgagcccuacgaaaugccccaucacaaccaaacuugugcuggaugaagacgaggaaacuaaagagccauugguacagguccaccgcaacauggugauuaagcucaaaccgcaucaaguggauggcguccaguucaugugggacuguugcugugagucuguuaagaagaccaaaaagucaccugguuccggcugcauccuggcccacuguauggggcuaggaaaaacacuacagguggucagcuuucuccauacugugcugcuuugcgacaaguuggauuucucuaccgcucuggucgugugucccuuaaauacagcacucaacuggaugaaugaauuugagaaauggcaggaaggccugaaggacgaugagaaacuugaaguuagugagcuggccacggugaaacguccacaagagagaucguauaugcuacagcgguggcaggaagacgggggagucaugauuaucggcuacgagauguauaggaaccucgcucagggucgcaaugugaagucccgaaaacugaaggaaauauucaacaaagccuugguugaucccgggccugacuuuguggucugcgaugagggacacauucugaagaaugaagcaagcgcgguaucaaaggccaugaacucuaucagaagccggaggcgcaucauuuuaaccggcacuccacuccaaaauaaccugaucgaguaccacuguauggugaacuucauuaaagagaaucuucuggguuccauaaaggaguucagaaacagguuuaucaaucccauucagaacggccagugcgcugacaguacaaugguugaugugcgggucaugaaaaagcgugcccauaucuuguaugagaugcucgcagggugcgugcaacgcaaagacuacaccgcucugacuaaguuccuaccuccgaaacacgaauacguacuggccgugcgaaugacaucaauucaguguaaacuuuaucaguacuaucucgaucaucugaccggagucggcaauaacucugaagggggaagaggcaaggccggugcaaaauuguuucaggacuuccaaaugcugagcaggaucuggacgcacccauggugcuuacagcucgacuacauauccaaggaaaauaaaggguauuuugaugaggacaguauggaugaguucaucgcuagcgacuccgaugaaacuucuaugucacugagcucggacgauuacaccaagaaaaagaagaaaggaaagaaaggcaagaaagacuccaguucuagcgguucaggcuccgauaacgacguugaggugauuaagguguggaacucucggagucgcgggggaggcgaagggaacgucgaugagacaggaaauaaccccagcgugucccuuaagcuggaggaaucaaaagcgaccagcucuaguaauccuuccagcccagcccccgacugguauaaggauuuuguuacugacgcagacgcugagguauuggaacauucaggcaaaauggugcuccuguucgagauccuaagaauggccgaagagauuggugauaagguccugguguuuucucagucccuuaucucgcucgaccugauagaggauuucuuggaauuagccagcagggagaaaacagaagacaaggauaagccucugauuuacaaaggggagggaaaguggcuccggaacaucgacuacuaucgacuggauggcaguaccacagcucagucuaggaaaaagugggcagaagaguuuaaugacgagacuaacguucgcggcaggcuuuucaucauuuccaccaaagccgggagccugggaauaaacuugguggcggcuaaucgggucaucauuuuugaugccucauggaacccgaguuacgacauccaauccauuuuccguguguauagauucggucagacgaagcccguauacgucuauagguuucuagcacagggcacaauggaagauaaaaucuacgaccgccaggugaccaagcaaagccugucuuuccggguuguggaucagcagcaagucgagcgacacuuuacuaugaaugaacucaccgagcuguauacauucgaaccagaccuuuuagacgauccuaacucagagaagaaaaagaaaagagacacucccaugcugccaaaggauaccauacucgccgaguugcugcagauccacaaagaacauauugugggguaccacgagcaugacagccuccuggaucacaaggaagaggaggaacuuacggaggaagagaggaaggcugcaugggccgaauacgaggcggagaaaaagggacugacaaugcgcuuuaauaucccuaccggcacuaacuugcccccaguuuccuucaauucucagacaccguauauuccuuuuaaccuaggugcucugagugccaugucgaaucagcaacucgaagacuuaaucaaccaggggcgggagaaaguggucgaagcaaccaauagcgugacugccguaagaauacagccccuggaggauauuaucuccgcuguguggaaggaaaacaugaaucuuucagaggcccagguucaagcacuggcucucucucgucaggccagccaggaguuggacgucaaaaggcgggaagcgaucuacaacgaugugcugacaaagcagcaaaugcucauuaguugugugcagcgcauccugaugaaucgaagacuucagcagcaauauaaccagcagcaacagcagcagaugaccuaccaacaggccacgcuaggacaccugaugaugccaaagcccccuaacuugauaaugaauccauccaacuaucagcagauugacaugaggggcauguaccaacccgucgcaggcgggaugcagccuccgccauuacagcgggcucccccucccaugcgcagcaaaaauccaggaccuucucaggguaagagcauguga

SEQ ID NO: 53205 - RNA, 1236 nt, Artificial Sequence
  derived and/or modified sequence opt3 from ATXN10__Homo_sapiens__NP_001161093
auggccgcucccagaccuccaccggcaaggcugagcggcgugaugguccccgccccuauccaggaccucgaggcgcuucgggcucugaccgccuuguucaaggaacaacgcaaccgaaauuuagauacaauugggguugcaguggaccugauacuacucuuucgugagcugagaguagaacaggagucccuucugacugccuucaggugcggauugcaguuucucgguaacaucgcuucucggaaugaagauucacagaguauuguguggguccacgcauucccagagcuguuucugagcugucucaaccaucccgacaaaaagaucguggccuacuccucuaugauuuuauucacgucgcugaaucacgagcgcaugaaagaacuugaggaaaacuugaauaucgcuauagauguuaucgacgccuaucaaaagcauccugagucagaguggccauuucugauuaucaccgaucuauuccucaaaagccccgaacuggugcaggcgauguuuccuaaacuuaacaaucaggagagagucacacuguuggaccucaugauugcaaagaucaccagugaugaaccacugacuaaagacgauauaccgguguucuuaaggcacgccgagcugauugcuuccacauuuguagaccagugcaagaccguucucaaacuugccucugaggaacccccugaugacgaggaagcacuggcuacuauccgguugcuagacgugcugugugagaugacagucaacaccgaacuccugggcuaccuucaaguguucccagggcuguuggagcgcgugauugaucuccugcgagucauccauguugccggaaaggaaacgacuaauaucuuuagcaacugcggcugugugagagcggagggugacauuuccaauguagccaacggguucaaaucacacuuaauaaggcugaucggaaaucuaugcuauaagaacaaggauaaccaggacaaagugaaugagcucgauggcauuccccugauccuugacaacuguaauauaagugauagcaacccuuucuugacccagugggucauuuacgcaauccggaaucugacagaagacaacucucagaaucaagaucucaucgcuaagauggaggaacagggccuggccgacgcuucccuucugaaaaaggugggguuugagguugaaaagaagggagagaaauugauucucaagucaacucgugauaccccaaagcccuga

SEQ ID NO: 53206 - RNA, 2448 nt, Artificial Sequence
  derived and/or modified sequence opt3 from ATXN1__Homo_sapiens__NP_001121636
augaaaagcaaccaggagagauccaaugaaugccugcccccuaagaagagggagaucccagccaccucucggucaagugaagagaaagcuccgacacuccccagcgacaaccaccgcguggaaggcacugcauggcuuccugggaauccaggaggucgaggccaugggggaggccgucacggucccgccgggacguccgucgagcugggauugcaacagggcauuggcuuacauaaggcgcugucuaccgggcuagauuacucgccuccaucagcucccagaagcguuccuguggccacaacucucccagcagccuaugcuaccccgcagcccggaacaccuguaaguccagugcaguacgcacaucugccccacaccuuccaauuuauagguuccucucaguauagcggcacuuacgccuccuucaucccuucacagcuuauuccacccacagcuaacccggucaccagugccguggcgagcgcagccggggcuacgacuccuucucagaggucccaacuggaggccuauucaaccuugcucgcaaauaugggaagccugagucagacacccggccacaaagcugaacagcagcaacagcagcaacagcagcagcaacagcagcaccagcaucaacagcagcagcaacagcagcagcaacagcagcaacagcagcaccugucucgggccccaggucucaucacuccuggguccccuccacccgcgcagcaaaaccaguacguucauauuagcucgucuccucagaauaccggacgcacagccuccccaccggcaauccccgugcacuuacacccucaucagaccaugauaccacacacgcugacucuugggcccccuucacaagucgugaugcaguaugcugacaguggcagccauuuuguaccaagagaggccacaaagaaggcugaauccucuagguugcagcaggccauccaagcaaaagagguucugaacggggagauggaaaagagccggcgcuacggagcccccucaagugcugaucuaggucucggcaaagcgggcggaaaguccgugccgcacccuuacgagagccgacaugucguggugcacccaucucccucagacuauaguagcagagauccuuccggcgucagggcaucuguuauggugcugcccaauucgaacaccccagccgcugaccuugaaguacagcaggccacucaccgggaggcaagcccuuccacacugaaugauaaaucagguuugcaucucgggaagcccggccaccguaguuacgcccugucuccacauaccgugauucaaacgacccacagcgcuuccgaaccguuaccugucggacugcccgccacagcauucuaugcgggcacucagccacccgugaucggguaccucucaggacagcagcaagcuauuaccuaugccgguagccuuccucagcaccugguuaucccaggcacacagcccuugcuaauaccuguggggucuacugacauggaggcauccggagccgcuccggccauugucaccaguagcccacaguuugcagcugugccccauacauucguaaccacugcccugccuaagucugagaacuuuaauccagaagcgcucguuacgcaagccgcuuaccccgcaauggugcaggcccagauccaucugccugucgugcaguccgucgcuucaccggccgcagcgcccccaacacuuccucccuauuucaugaaaggcaguauuauccaacuggccaacggugaguugaagaaaguggaagaucucaagaccgaggacuuuauccagagcgcugaaauuucgaaugaucugaaaauagacuccucuacuguugagcgcaucgaggauagccacucaccagggguggccguaauucaguucgcagucggcgaacacagagcucaggugaguguugagguguuagucgaauaccccuuuuucguguuuggacaaggcugguccucuuguugccccgagaggaccagccagcuguucgaccuaccauguuccaagcucucaguaggggacgugugcaucagccugacacuuaaaaacuugaagaacggaaguguuaagaaaggucagccggucgauccugccucugugcugcucaagcauuccaaagcagacggccuggccgggagccggcaccgauacgcugaacaagagaauggaauaaaccagggcucggcgcagaugcuuucagagaauggugaacugaaguuccccgagaaaaugggguugccagccgcacccuuucucaccaagauugaaccuucuaagccagcugccacucgcaaaagaagguggagugcccccgagucccggaagcuggagaaaagcgaagaugagccuccguuaacacugccaaagcccucucuaaucccucaggaagugaaaaucuguauugagggccgcagcaacgucggaaaguga

SEQ ID NO: 53207 - RNA, 2070 nt, Artificial Sequence
  derived and/or modified sequence opt3 from ATXN1L__Homo_sapiens__NP_001131147
augaagcccgugcacgagagaagccaggaaugccugccucccaaaaagagggaccucccggucaccuccgaggauaugggccggacaacuucuuguucaacgaaccauacccccaguagcgacgccuccgaauggucucgcgggguugugguagcuggacaaucgcaggcuggugcccgagugucacuuggcggggauggagcggaggcuaucacaggccugacugucgaccaguacgguauguuguauaaaguggccguuccuccagcaaccuucagccccacaggguuaccuaguguggucaauauguccccacugcccccuaccuuuaacguggccucuagccuaauucagcacccaggaauacauuacccgccccuccacuaugcucaacugccuuccacuucacuucaguucaucggcaguccauacagccugcccuaugcaguaccuccaaacuuuuugcccucuccgcuccuguccccuucagccaaucuggcuacaagccaucucccccacuucguuccauacgccaguuuacuggcggaaggcgcaaccccucccccacaggcccccucuccugcucacuccuuuaauaaggccccaagcgcaacgucgccgucugggcagcuuccccaucacuccucaacucaaccuuuggaucuggcuccaggacguaugcccauuuauuaccagaugaguagacuaccugccgguuacacccuccaugagacaccacccgcgggcgccagcccggugcugacuccucaggagucccagucugcacuugaagcugccgcugccaacgggggacaaaggccacgggagcgcaaucuggucagaagggaaagcgaggcauuggacucacccaacaguaaaggcgagggucaggggcucgugccuguggucgaaugcguuguggauggacagcuguucuccggcagccaaaccccacggguagagguggccgcuccagcgcaccgcggcacaccugacaccgauuuagaaguccagcgagugguuggggcacuggccucucaggacuauagaguggucgcugcccagaggaaggaggaacccucaccacucaaucuuagucaccauacgccggaucaccaaggagagggucggggcagcgcacguaacccugccgagcuggcugaaaagucccaggcccgcggguuuuacccccagucucaucaggagccagugaaacacagacccuugccuaaggcaaugguaguugcgaauggaaaccuagugccaacuggcacagacucgggucugcuccccgucgggagcgaaauccugguggcuuccucacuugauguccaagccagggcaaccuucccugacaaagagccgacuccacccccuauuacaaguucucaucugccaagccacuuuaugaagggcgccaucauacaguuggcuaccggagaacucaaacggguggaggaccugcagacgcaggauuucguucgauccgccgaggugucaggcggguuaaagaucgacagcucuaccguagucgauauucaagaaucccaguggcccggauuugugaugcugcacuucguugugggugagcagcagaguaaggucagcaucgaagugccuccggagcaucccuuuuucguauauggccaaggguggucuuccuguucaccaggacgcacaacucagcuauucagucucccuugccacagacuucaggugggcgacguuuguauuagcaucucgcugcaauccuugaacucuaauagcgucucacaggcaaguugcgcucccccaucccagcuggguccucccagggaacggccagagcgcaccgugcucgggucuagagagcugugugauagcgaaggcaaaucccagccggccggagagggcucaaggguggucgaaccuagccaacccgagaguggggcgcaggccugcuggccagcucccucuuuucagcguuacuccaugcagggagaggaagcacgggccgcacuucugcgaccuagcuucauaccacaagagguuaaguugucgauugaagguagaucaaaugccggcaaauga

SEQ ID NO: 53208 - RNA, 3942 nt, Artificial Sequence
  derived and/or modified sequence opt3 from ATXN2__Homo_sapiens__NP_002964
augagaagcgccgcugcagcccccagguccccugcgguggcuaccgagucucggcgcuucgccgcagcccgauggccaggcuggcguucacugcagagaccggcuaggcggagugggcgcggagguggcggggcagcccccggaccuuacccaagcgcugccccgccuccacccggcccugguccaccgcccuccagacaaucuucgccuccaucagcgagcgacugcuuugggaguaacggaaauggcggcggggcauucaggcccggaucccggcgccuccuuggucugggcgggccuccacgacccuuugucguuuuguuacugccgcuagccucuccuggagcucccccagccgcaccuacaagagcuagcccccucggcgccagggcguccccaccccggucaggugugagucuggcccguccugcaccaggguguccgcgccccgcuugcgaaccuguauauggaccacuuacuaugagccugaagccccagcagcagcaacagcagcagcaacagcagcagcaacagcagcaacagcagcagcaacagcagcagcaaccuccacccgccgcugccaacgugagaaaaccgggcggcucuggguugcucgcauccccugccgcugcgccaucacccagcaguucuuccgucagcucgucuuccgcaacggccccuucaagugugguugcugccaccagcggagguggcaggcccgggcugggacggggccgaaauuccaacaagggucugccacagucuacaaucagcuucgaugggauuuacgcaaauaugcgcauggugcacauacucacuucagucgugggcaguaaaugugagguacagguuaagaacggaggcaucuaugaagggguguuuaaaaccuacuccccuaagugcgacuuaguccuggaugccgcucaugaaaagagcacagaaucuucaaguggacccaaaagagaggagauuauggaaagcauccuuuucaaguguuccgacuuuguggugguccaguucaaagauauggacucuucguaugccaagagggaugcauuuaccgacagcgcgauuuccgcuaaaguuaauggugagcacaaggaaaaggauuuggagccaugggacgccggcgagcugacugcaaacgaggagcuagaagcccucgagaaugaugugucaaacgggugggacccgaaugauauguuccgguacaacgaagagaauuauggaguagugaguacauacgacucuagccuguccucauacaccgucccucuugagcgcgacaacagcgaagaguuucugaaaagagaagcuagggccaaucaauuggcagaggaaaucgagucuuccgcucaguauaaggcccguguggcgcucgagaacgaugaccggagugaagaggaaaaauacacggccguucagcgaaacagcucugagagagaaggccauuccauaaauacuagggagaacaaguauauucccccaggucagcgcaaucgggaggugaucucaugggggaguggcagacaaaacagccccaggaugggacagccuggcucgggguccaugccaucucgcagcaccucacacacaagugauuucaaucccaacuccggaucugaccagcgagucgugaaugguggcguaccuuggccgagcccaugccccuccccuucaagccggccacccagucguuaccaaucugggccuaacucccugccgcccagagcugcaacuccaaccaggccucccagccgcccaccuucgcggcccucaagaccaccgucucauccuagugcccacggaucccccgcuccaguuagcacaaugcccaaaaggaugucuagcgaaggcccuccacgaaugucccccaaggcccagcgccacccucggaaucauagagugucagcagguagggggaguaucagcucuggcuuagaguuugucucccacaacccgccaucagaagcggccacacccccuguggcucguacgagucccagcggaggcacuugguccucugucgugucggggguuccacgccugagcccuaaaacacaucggcccagaucaccaaggcaaaauuccauuggaaacaccccuaguggcccggugcucgccucuccccaggcagguaucauaccaacugaggcuguagccaugccuauucccgcagccagcccaaccccugcuucccccgcgucaaaucgagccgucaccccgucuagcgaggcaaaggauagucggcuucaggaccagcgccagaacuccccagcugggaauaaggaaaacaucaaaccuaacgagacgagccccucuuucucaaaggccgaaaauaaaggaauuuccccagugguuagugagcacagaaagcagaucgaugaccugaaaaaguucaagaacgauuuuagguugcaacccagcucgaccucugaauccauggaccagcuacugaauaaaaaccgggagggcgaaaagagccgagaucucaucaaagacaagauugagccuucagccaaagacaguuucauagaaaauucuuccagcaacuguacaucagguaguagcaagcccaauucccccucuaucagcccauccauucugucaaacacugagcacaagagaggcccugaggugaccucucaggggguccagacaaguucgcccgcuugcaaacaagaaaaggaugacaaagaggagaagaaagaugcagccgaacaggugcgcaagagcacucuuaauccuaacgcgaaggaguuuaauccaagguccuucucucagcccaaaccuucaaccacaccaaccagcccccguccgcaagcucagccuuccccaaguaugguaggacaucagcagcccacuccuguguauacgcaaccaguuuguuuugcccccaacaugauguacccggucccugugucucccggcgugcagccacuguauccuauccccaugacaccaaugcccgucaaucaggcaaagaccuaccgggccguuccuaacaugccacagcaaagacaggaccagcaccaucagagcgcuaugaugcacccggcaucagccgcggggcccccuauagcugccacuccacccgcauacuccacccaauauguggccuacaguccucagcaguucccaaaucagcccuuggugcaacauguaccucacuaucagagccagcacccgcaugucuacucuccagugauucaaggaaacgcuaggaugauggcacccccuacacacgcccagcccggccucguuuccucaagcgcuacccaguauggugcccaugaacagacucacgcgauguacgccugcccaaaacugccuuauaacaaggagacaucgcccucuuuuuacuucgcaaucaguacgggguccuuagcucaacaguacgcccacccaaaugcuacccugcauccgcacacuccucauccccagccaagcgcaacacccaccggacagcaacagucacagcacggcgguucccauccugccccaucucccgugcagcaccaccaacaucaggccgcucaggcgcuacaccucgcaagcccucaacagcagagugccaucuaucaugcuggccuggccccgacaccacccuccaugacuccugcaagcaacacccagucuccacaaaauucauuucccgccgcucagcagacggucuucaccauucacccuagucaugugcagcccgcguacacaaacccaccgcacauggcccacguuccucaagcacaugugcaguccgggaugguacccagccacccaacugcucaugccccuaugaugcuuaugaccacacagcccccaggaggcccucaggcagccuuggcucaaucugcccugcagcccaucccggucucgacuaccgcgcacuuuccauauaugacgcacccuucagugcaggcacaucaccagcaacagcucuga

SEQ ID NO: 53209 - RNA, 3228 nt, Artificial Sequence
  derived and/or modified sequence opt3 from ATXN2L__Homo_sapiens__NP_009176
augcugaagccccagccucuccaacagccaagccagccgcagcaacccccuccaacccagcaggccguggcuagaaggcccccuggcgggacauccccacccaacggaggucuuccuggcccacuggcaacuucugccgcgccgcccgggccuccagcugccgcaucacccugcuugggaccugucgccgcugcaggcagugguuuacggcgcggggccgagggaauccuggcuccacagcccccgccuccccaacagcaccaggaacgaccaggcgccgcggcaauuggcagcgcccgugggcaguccacgggaaaagguccuccccaaucuccaguuuucgagggcguguacaauaacucgagaaugcuacauuuucucaccgcuguaguggggucaacaugugacgucaaggugaaaaauggaacuaccuaugaaggcauauucaagacacugagcaguaaauuugagcuugccguugaugcagugcacaggaaggcuuccgaacccgccggugggccucggcgcgaggacaucgucgauaccaugguguucaagccaucugacguaaugcugguucauuuuagaaacguggauuucaauuacgcgacuaaagacaaguuuacagauagcgccauugcaaugaacuccaaagucaauggagagcacaaggaaaaaguguugcagaggugggagggcggcgacucaaacagugaugacuaugaucucgaaagcgacaugucuaaugggugggauccgaacgagauguucaaguuuaaugaggaaaacuacggagugaagaccacguaugacuccucacugagcaguuacacugucccccuggagaaagacaauucugaagaguuccggcagcgcgaacuccgagcugcccaauuagcuagagagaucgaguccagcccucaguauaggcugcggauugccauggaaaacgaugacggucguaccgaggaagagaagcauucggcaguucagcgccagggcucugggagagaauccccaucacuugccaguagggagggaaaauacauccccuugccucaacgggugcgagagggcccacgcggugggguaagaugcagcuccucuaggggcggacggcccggccugagcucacuaccgccucgcgggccacaccaccucgauaauaguucccccggaccugguagcgaagcuagaggcauaaacgggggacccucuaggaugucaccaaaggcgcagcguccucugcggggcgcaaaaacacuuaguagccccuccaaccgaccaucuggugagacuucggugccgccucccccagccgucgggagaauguaucccccuaggagcccaaaguccgcugcccccgcaccuaucucagccaguuguccggaaccacccauuggcucugcugugccuaccagcuccgccucaaucccaguuacaagcucuguguccgaccccggagucggcaguauuagcccugcaucuccgaaaaucucccuggcgcccaccgaugugaaggaguugucaacgaaggaaccagggcgcacucucgagccucaggagcuggcucggauagccggaaaaguacccgguuuacagaaugaacaaaagagauuucagcuggaggaacucaggaaauucggcgcacaguuuaaacuucagccaaguagcucgccugagaacucccuggaccccuucccaccgcgcauuuugaaggaggaaccuaaggggaaggagaaagaaguugauggacuacugacaucugagcccaugggcagcccagugucaaguaagaccgaauccgucucugacaaagaggauaagcccccucucgccccaagcggugggacugagggccccgaacaaccuccgccacccugcccuucccagacaggaucacccccagugggccugaucaaaggggaggacaaggaugaaggaccugucgcugaacaggugaagaaaagcacccuuaaucccaacgccaaggaguucaauccaacgaaaccucuguugaguguuaacaagucuaccuccacaccgacuagccccggcccacgaacccauucgacaccuucaauucccgugcucacugcaggucagucugggcuguacaguccacaauacaucuccuauaucccucagauucacaugggacccgcuguacaggccccgcaaauguacccauauccugucagcaauucugugcccggccagcaggguaaauaccggggcgcgaaggggagcuuaccaccccagcguuccgaccaacaucagccugccucagcuccgcccaugaugcaggcagccgcugccgcaggaccaccucugguugcggccacccccuauaguagcuacauaccuuacaacccacagcaauuucccggccagccugcuaugaugcagccaauggcccacuaucccucucagccgguguucgcaccuaugcuacaauccaauccaagaaugcucacaucagggagucacccccaggcuaucgucagcuccucuaccccucaguacccaucggccgagcaacccacuccgcaggcacuguaugccacggugcaucagagcuacccucaccaugcuacacagcuucacgcgcaucaaccccagccagccaccacuccuaccggaucacagccccagucccaacacgcagcuccaagucccguacagcaccaggccggccaggccccucauuuggguucugggcaaccacagcagaaccuguaucacccgggagcucucacaggcacucccccuagccugccacccgguccuuccgcacagucaccacaaucuagcuuuccccagccugccgcgguguacgcuauucaucaccagcaacuuccgcacggcuucaccaauauggcccauguuacacaggcacacguccagacggggaucaccgccgcuccacccccucaucccggagcaccacacccuccccaggugaugcuguugcauccaccgcaaagucacggcgggccuccccagggagccgugccacaguccggcguccccgcgcucagcgcuucuacuccuucaccauaucccuacauaggucacccucagggggagcaaccgggacaggccccaggcuuucccgguggcgcagacgauaggauucgcgaguucucccuggccgggggaaucuggcauggccgggcugaaggguuacagguuggacaggacgccagagugcugggcggugaauga

SEQ ID NO: 53210 - RNA, 1041 nt, Artificial Sequence
  derived and/or modified sequence opt3 from ATXN3__Homo_sapiens__NP_001121168
auggagagcaucuuccacgaaaagcaggagggcucccugugcgcccaacauugucucaacaaucuucugcagggggaauacuuuucucccguggaguugucaaguauugcucaccaguuagacgaagaggagagaaugaggauggcagaaggaggugucaccagcgaggauuaucggacauuccugcagguuauauccaacgcccuaaaaguguggggccucgaacugauccuuuuuaauucuccugaguaccaacgccugcgaauugacccaaucaacgagcguucguucauuugcaauuauaaggaacauugguuuacuguaagaaaauuggggaagcagugguucaaccucaauucacugcugacgggaccggagcucaucagcgauaccuacuuagcgcuguuucuugcucaguugcagcaagaaggcuauaguauauucguggucaaaggugaccugcccgauugugaggccgaccagcuacuccagaugaucagggugcagcaaaugcaccggccuaagcugauuggggaagaacuugcacagcugaaggagcagcgcguucauaaaacagauuuggaaagagugcucgaggccaacgacggauccggcaugcuggaugaagacgaggaagauuuacaaagggcucuggcacucucucggcaggagaucgacauggaggaugaagaggccgaccuucgccgagcuauucagcugagcaugcagggcuccucaagaaauaucagucaagacaugacucagaccagcgggacaaacuugaccucugaggagcuaaggaagcggcgugaagccuacuuugagaaacagcagcaaaagcagcagcagcaacagcagcagcaacagcagggagaucuguccggucaaucaagccacccaugcgagcgccccgcgacaaguucuggcgcacucggguccgaccugggagaugccaugagcgaagaggacaugcuucaggcugccgucacuaugucgcuggaaaccgugagaaaugauuugaaaacggagggcaagaaguga

SEQ ID NO: 53211 - RNA, 2679 nt, Artificial Sequence
  derived and/or modified sequence opt3 from ATXN7__Homo_sapiens__NP_000324
augagcgagagagccgcugacgaugugaggggcgaaccccggcgcgcagccgcggcugccgggggagcagccgcugcagccgcucgacagcaacagcagcagcaacagcagcagcaaccuccaccgccccagccucagcgucagcaacacccacccccuccacccagaaggacccggccugaggacgguggcccaggggccgcguccacaucugcagccgcuauggccacugucggagaacgcagaccgcugcccucaccugagguuaugcucggccagaguuggaaccuuuggguggaagcaagcaagcugccagguaaagaugggacggaguuggacgaguccuucaaggaauuuggaaagaauagggagguaaugggcuuaugccgggaagauaugcccaucuucggcuuuuguccugcucaugacgauuucuaccugguggucugcaacgacuguaaucaggugguuaagccacaagccuuucagucucacuaugagcgccgacauucgucaagcaguaaacccccgcuagcggugccucccaccuccgucuucagcuuuuucccaagccucuccaagucaaaagggggaagugccagcgguucuaacagauccucaagcggcggggugcugagugcaucuuccagcucgucuaaacuucugaaguccccuaaagagaaguugcagcucaggggaaauacacggcccaugcacccaauucagcaaucacguguaccccauggccgcauaaugacuccuaguguuaaaguggaaaagauccacccaaagauggaugguacccugcugaaaagcgcugucgggccgacaugccccgccaccguguccucucucgugaagccuggauuaaacuguccaagcauucccaaaccuacucugccaucacccggccagauccuuaauggcaagggguugccggcuccuccaacacuggagaaaaagcccgaagacaacaguaauaacagaaaauuucuaaauaagaggcucuccgagcgggaguucgauccugacauucacugcggagucaucgaucuggacaccaagaaacccuguacgcgaagccuuacuugcaagacccauucucugacacagcgcagagccguucaggguaggcggaaacgcuuugacguguugcucgcagaacacaagaacaaaacuagagagaaggaacugauaaggcauccagauucacaacagccuccccagccauuacgugacccgcacccugcucccccacggaccagucaggagccccaccaaaauccucauggcguaaucccaagcgaauccaagcccuucguggccucuaaaccuaagccgcacacaccaucgcugccccgaccuccagggugucccgcgcagcagggaggcagcgcaccuauugauccgcccccaguccaugaguccccucaucccccacucccugccaccgaacccgcuucaagacuuaguucugaggagggugaaggggacgauaaagaggaaagcguggagaagcuggacugccacuacuccggccaccacccacagccggccucauuuuguacguucggaagcaggcaaaucggccgcggguauuacguuuucgauucucgguggaacagauugaggugcgcacuaaaucugaugguggaaaaacaucucaacgcccagcuguggaagaagauuccucccgucccauccacuacaagucccaucagcacccgcauaccucaccgaacuaacucugugccaacaucccagugcggaguaucauaucuugcugccgcaaccguuaguacgagccccgugcuguugucguccaccuguauuucuccuaauagcaaaucagucccggcgcaugguacaacucucaacgcucaaccagccgcaaguggcgccauggaccccgugugcuccaugcagucucggcaggucagcuccucaagcaguucuccuuccacccccagcgggcugucgucagugccaucuaguccuaugucccguaagccccagaaauuaaagagcucuaaaagccugagaccaaaggaguccucaggaaauaguacaaacugucaaaaugcuucuucuuccacuucaggcgguagugggaagaaaaggaagaacagcuccccucuacucguucacucuucgagcucauccaguucuagcuccucaucuagccacaguauggaguccuuucgcaaaaauugcguggcccauagcggcccgcccuacccaucuaccguaacaucaucccacaguaucggacugaacugugucaccaauaaggcaaacgcugugaauguucggcaugaucagagcggcagagggccucccacuggaucgccagccgaaucuauuaaaaggauguccgugauggucaacagcucagacaguacgcuuucuuuggguccuuucauccaccaguccaaugagcugcccgugaacagccauggcucauuuagucacagccacacaccgcucgauaagcugaucgggaaaaagcgaaagugcuccccaucuagcuccucaauuaauaacucuaguucgaaaccuaccaagguagcgaaagugcccgccguuaacaauguccauaugaagcacacuggaaccauaccaggcgcucagggucuuaugaacagcucccuguugcaucaacccaaagcacgcccuuga

SEQ ID NO: 53212 - RNA, 294 nt, Artificial Sequence
  derived and/or modified sequence opt3 from ATXN7L3B__Homo_sapiens__NP_001129734
auggaggaaaucagccuggccaaccucgacaccaauaaacuugaggcuauugcacaggaaauauacguggaucugaucgaggacuccugcuugggcuucuguuuugaaguccacagagccguuaagugcggguauuucuacuuagaguuugcggagacaggaucugugaaggauuucgguauucaacccguagaagacaaaggcgcuuguaggcugccucuaugcucacucccaggggagccgggaaacggccccgaucagcagcugcagcggaguccuccagaauuucaauga

SEQ ID NO: 53213 - RNA, 1020 nt, Artificial Sequence
  derived and/or modified sequence opt3 from AUH__Homo_sapiens__NP_001689
auggccgcugcaguggccgcggcucccggcgcccuggggagccuccacgcaggaggugccagacuugucgcugcaugcuccgccuggcuguguccuggcuugagguuaccagggucucuggcuggacggcgcgccggcccggcgaucugggcacaggguuggguucccgccgcugggggaccugccccaaagcgaggcuacucaagugagaugaaaaccgaagacgagcuacgugugagacaucucgaagaggaaaacaggggcauuguagugcuggggauaaaucgggcauauggaaagaacagccuuuccaaaaaucugaucaagauguugucuaaagcugucgaugcccucaagucggacaagaaagugcgcacaauuaucauuagaucagagguucccgguaucuucugcgcgggcgccgaucugaaggagagggcaaaaaugagcaguuccgaaguggggccuuuugucucuaagauacgggcugugaucaacgacauugccaaucugccaguacccacuaucgcugccauugauggacucgcauuaggcggugggcuggagcuugccuuggcuugugacauccgcguugcggcaagcuccgccaaaaugggacugguggaaacgaagcuagcuauaauuccuggcggcgggggaacccaacgacucccaagagccaucgguaugucacuggcaaaggagcuuauuuucagugccaggguccuggauggcaaagaggcuaaggccgugggguugaucagccacgugcucgaacagaaccaggagggagacgcagcguaccggaaagcucuggauuuagcccgugaauuucugccgcagggccccgucgcaaugcgcguugccaagcucgcuaucaaucaagguauggagguggaccuuguaacagggcuggccauugaagaggcaugcuaugcucagacuauaccuaccaaagauagauuggagggccuacuggccuucaaggagaaaaggccaccccgguacaagggagaauga

SEQ ID NO: 53214 - RNA, 1212 nt, Artificial Sequence
  derived and/or modified sequence opt3 from AURKA__Homo_sapiens__XP_006723935
auggacagaagcaaggagaacugcaucuccggccccgugaaagccaccgcuccugucgggggaccaaagaggguucuggugacacagcaauucccgugucagaauccccucccuguaaacucuggucaggcacagcgggugcuuugcccaucaaauaguagccaacgcauuccccugcaggcccagaaauuggucuccucucacaagccugugcagaaccaaaaacagaagcaguuacaggcgacuucgguuccacaucccgugucacgaccucugaauaacacgcaaaagagcaaacagccacuaccgagugcucccgaaaauaacccugaggaggaacucgccuccaagcagaaaaaugaagagucuaagaaacgucaaugggcacuggaggauuuugaaauaggcagaccacuugggaagggaaaguucggcaacgucuaccuggccagggagaaacagagcaaguuuaucuuggcucucaaagugcuguucaaggcacagcuggaaaaagccgguguagagcaccagcuccggcgcgagguugaaauucaaucccauuuaagacaccccaauauccugaggcuuuauggguacuuucaugacgcuacccggguguauuugauucuggaguacgccccucuaggaacagucuaucgcgaacuccagaagcugucaaaauucgaugagcagcgaacugcgaccuacaucacagaacuugcaaacgcccugaguuauugucacagcaagagagugauacacagggacaucaagccagagaauuugcuccugggcucugcuggcgaguuaaaaauugccgauuuugggugguccgugcaugcacccucaagccggcguaccacucugugcggaacacucgacuaccuuccgccugaaaugaucgagggucgcaugcacgaugaaaaggucgaccuguggaguuugggcguucuauguuacgaguuccugguggggaaacccccauuugaagcuaacaccuaucaggagacguacaagagaauuucuaggguagaguucacuuuuccugauuucgugaccgaaggagcccgggaccucaucucccgacugcuuaaacauaaucccagccaacgcccaaugcugagagaggucuuggaacaccccuggauaacagcgaacucgucuaagccuuccaacugccagaauaaggagucagccaguaaacagagcuga

SEQ ID NO: 53215 - RNA, 1038 nt, Artificial Sequence
  derived and/or modified sequence opt3 from AURKB__Homo_sapiens__NP_001271455
auggcccagaaggagaacagcuaccccuggccuuauggcagacaaaccgcuccauccgggcugucuacacucccgcagagggugcuucggaaagaacccgucacuccuucagcacugguuuugaugagucgcagcaaugugcagccaacggccgcgcccggacagaagguaauggagaacuccucugguaccccugacaucuuaacacgacgucacuucacuauugaugacuuugaaauaggcagaccacuggggaaaggaaaguucggcaauguguaccuagcuagggagaaaaagucgcauuuuaucgucgcccucaaggugcuguucaaaucacaaauugaaaaggaggguguugagcaccagcuucggcgcgaaaucgagauucaggcacaucugcaccaucccaacaucuugagacucuauaauuacuuuuaugauaggcggcgcauauaccugauccuggaauaugccccucgaggggagcucuacaaagaguuacagaaaagcugcaccuucgacgaacaaagaacagcuaccauuauggaggaacuggcagaugcccuuauguacugucacggaaagaaggugauccacagggacauuaagccagagaacuugcugcuaggccucaaaggcgaacugaagaucgcugauuuuggguggaguguccaugccccgucccuucggcguaaaacuaugugcggaacacuggacuauuugcccccugagaugauagagggucgcaugcacaaugaaaagguggaucucugguguauuggcguacugugcuacgaguuacugguugggaacccacccuucgaaucugcgagccauaaugagaccuauagaaggaucgugaaagucgaccucaaguuuccugcauccgugccaaugggagcccaggaucuuauuucaaaacuguugcggcacaaccccagugaacgacuaccgcuggcucaggugagcgcccacccuuggguccgcgcaaauucuagaaggguucugcccccauccgcucuccagucaguggccuga

SEQ ID NO: 53216 - RNA, 930 nt, Artificial Sequence
  derived and/or modified sequence opt3 from AURKC__Homo_sapiens__NP_001015878
augagcucccccagagccgugguccagcugggcaaggcucaaccugcaggggaggaacucgccaccgcgaaccagacagcucagcagccaucuucaccggccaugaggcggcuuacuguugacgauuucgagaucggacgcccccuggguaaaggcaaguuugggaauguguacuuggcacgauuaaaagaaagucacuucauuguagcccugaaggugcuauuuaaaagccaaauagagaaggaaggacucgagcaucagcugcguagagagaucgaaauucaggcucaccuucagcauccuaacauccugagguuguauaauuacuuccacgacgcacggcgcgucuaucucauucuggaguacgccccaagaggcgaacuguauaaggagcuccaaaaauccgagaaguuagaugaacagaggacggcuaccaucauagaggaacuggccgacgcgcuuacauacugccaugauaaaaaggugauccaccgggacauuaaacccgagaacuugcugcuagguuuucgcggggaaguuaagaucgcagauuucggauggucugugcacacuccuucgcuccgaagaaagaccauguguggcacacuggacuaucuuccacccgagaugauugagggcaggaccuacgaugaaaaagucgaccuguggugcaucgggguguuguguuacgagcuccugguaggauauccuccauuugaaucagccagccauagugagacuuaccggcguauauuaaagguugaugugcgcuucccgcuguccaugccccucggugcuagagaccuuauuucuaggcuguugcgguaucagccucuagaacgacugccacucgcccagauccugaaacaccccuggguccaagcacauagccgcagagugcuuccuccaugcgcucagauggccuccuga

SEQ ID NO: 53217 - RNA, 3708 nt, Artificial Sequence
  derived and/or modified sequence opt3 from AUTS2__Homo_sapiens__NP_001120703
auggacggccccaccagagggcacggacugaggaagaaacggcgcagccgaucccagcgugauagagagaggcggucucgcgguggccucggggccggagcugcaggcggugggggagccggcagaacaagggcgcuuucacuggcuaguagcuccggcucugacaaggaagauaacgggaaaccuccaucgucagccccgagccggccccgcccuccacgaagaaagaggcgggagaguacuuccgcagaagaggacaucauugauggauucgccaugacgucuuuugugaccuucgaggcuuuggaaaaagacgucgcauuaaagccccaagagcguguugaaaagcgccagacaccucugacuaaaaagaaaagagaggcccuaaccaauggucucagcuuucauuccaagaaaucaaggcugagucacccacaucacuacagcucugaucgggaaaacgaccgaaaucuuugccagcaucugggcaagcgcaagaaaaugcccaaggcuuugagacagcucaaaccugggcaaaacuccuguagggauucagacagcgagagugccucuggagaguccaagggcuuccaccggagcucgucucgcgaaagacuguccgauucaagugcgccaagcucccuggguacaggguauuuuugcgacucugauagcgaccaggaggaaaaagcaucagacgccaguuccgagaaacucuucaauaccgugauaguaaacaaagauccggaauuaggagugggcacucugcccgagcacgacagccaggaugcuggcccuaucgucccaaagauuucugggcuugagaggucacaggaaaagagucaagacuguugcaaagagcccaucuuugaaccugugguuuugaaggauccauguccccagguggcccagccgauuccucagccccaaacagagccacagcugcgugcaccuagccccgacccagaucuaguccagcggaccgaagcucccccucaaccaccgccccucuccacgcagccuccacagggacccccugaggcccagcugcaaccagcgccccagccccaggugcagcgaccuccaagaccccaaucuccuacucagcuucugcaucagaauuugcccccaguacaggcccacccuucggcacaaagccucucccagccccugucagcuuacaacaguucuagcuuaucccucaauucacucucuagcuccaggaguagcaccccagccaaaacacagccggcuccuccccauaucucucaccacccauccgccucacccuucccucuuagucugccaaaccauagccccuugcacucguuuacuccuacccuacagccgccagcacauucccaccaucccaauauguucgccccuccaacagcucugcccccuccgcccccacucaccucugguagccugcaaguugcgggccacccugcagggucaacguauagugagcaggacauacuucgccaggaacugaacacucgguuuuuggccucccaaucugcugauagaggagccagccucggcccgccaccuuaccugaggacagaguuccaccagcaucagcaccagcaucaacacacccaccagcauacucaccagcauacauuuacccccuucccacacgcaaucccgccuacggccauuaugcccaccccagcucccccuauguucgacaaguauccaacaaaaguggaucccuuuuaccgccauuccuuauuccacucauauccuccggccgucagcgguaucccacccaugauuccucccacugggccauuuggcagucugcagggagcauuccaaccuaagcuaaccgaccccuuucgaccaaugcuccggaagccuggcaaauggugcgcgaugcacgugcauaucgcuuggcagauauaccaccaucagcagaaggugaaaaagcaaaugcagucugacccgcacaaacuggauuucgggcuuaagcccgaauuuuugucccguccaccuggacccagccuguucggugccauucaucacccacacgaccucgcaagaccuucgacacuguuuucagccgcuggcgccgcacaucccacugggaccccguucggaccaccuccccaccauucuaauuuucuuaacccagcugcccaccuggagcccuucaauaggccuaguacauuuaccggcuuggcggccgucggugggaacgcuuucggcggacucggcaacccguccguuacucccaauagcauguucgggcacaaggauggaccaucugugcagaacuuuagcaauccucaugaacccuggaaccgccugcaccggacgccuccauccuuccccacaccuccacccugguuaaaaccgggugagcuggagagaucagcaagugccgcugcccaugacagggaucgagacguagauaagcgcgacagcucuguguccaaagaugacaaggaacgggagucagucgaaaagagacacaguagccauccuuccccagcacccgugcuaccuguuaaugcgcucggccacaccaggucuucgacugagcaaauccgugcccaccugaacaccgaggcucgcgaaaaggauaagccaaaagagcgggaaagagaccauagcgagucaaggaaggaucuugccgcagacgaacacaaagcuaaggaggggcauuugcccgagaaagacggacacggccacgaaggucgagccgcaggggaggaagccaagcagcuggcucgggugccguccccuuacguccgcacacccgugguagagagugcgagaccaaauucuaccagcuccagggaagccgagccucggaaaggcgagcccgcauaugaaaacccaaagaagucaucugagguuaaagugaaggaggaacgaaaagaagaucaugaccugcccccugaggcuccacagacucacagagccagcgagccgcccccuccaaauaguuccagcucuguccaucccggaccucuggccucaaugccaaugacagugggcgucacggggauucaccccaugaacuccaucaguagcuuagaucgcaccaggaugaugacuccuuuuaugggaaucucgccgcugccaggcggugaacguuuccccuacccuucuuuucauugggaccccauucgggauccacuuagagacccuuauagggaguuggauauacaccgccgagacccccucgggagagauuuccugcuacggaaugacccacugcacaggcucuccacaccgcgccuguacgaagcugaucguagcuuuagagaccgggagccucaugauuauucacaccaucaccaccaucaccaucacccccuuaguguggacccaaggcgcgagcaugaacgaggaggccacuuggacgagagagaacggcugcacauguuaagggaggauuacgaacauacccgccuccacucuguucaucccgcaucccuggacggucaccuuccucauccaagccugaucacacccggcuugccuucaaugcacuauccgagaauuaguccaacugccgggaaccagaauggacuccugaacaagacgcccccuaccgcggcucuaagcgccccacccccucugaucuccacccucggcgggaggcccgugucuccacggcguacaacuccgcugagcgcagagauacgcgagcgaccucccucccacacccuuaaagauauugaagccagauga

SEQ ID NO: 53218 - RNA, 1089 nt, Artificial Sequence
  derived and/or modified sequence opt3 from AVEN__Homo_sapiens__NP_065104
augcaggccgagagaggcgcuaggggagggcggggucgccgacccggccgugggagaccuggaggcgacaggcacagcgaacggccaggugcagccgcggcuguggcccgcgggggaggcggcgggggagguggcgaugggggaggcagaaggggucgggggcgcggacgaggcuucagaggcgcaaggggagggcgggguggcgggggagccccgcguggcucccgcagagagcccgguggguggggcgcuggagcaucugccccugucgaagacgauucagacgcugagaccuacggcgaagagaacgaugagcaagggaauuauaguaagaggaaaaucguuagcaacugggaccgguaccaggauauugaaaaggaggugaauaacgaauccggagagucucagcgagguacagacuuuucgguacugcucucaagcgccggcgauaguuucucccaguuucgcuucgcggaggaaaaagagugggacucugaagcaagcugcccaaagcaaaauuccgccuuuuauguggauucagagcuucuggucagagcuuugcaggaauuaccccugugucuaaggcucaacguggccgcagagcugguucaggggacugugccucuugaggucccacaggugaaacccaagcggacggacgauggaaagggccuggguaugcaauugaaagggccucucggcccaggaggccgcgggccgauauucgaacugaagaguguagcugccggaugccccguucugcucgguaaagacaauccuagcccaggccccucuagagacucccagaagccuaccucaccauuacagagcgcgggggaucaucuggaggaggaacuugacuugcugcuaaaccucgaugcccccaucaaagaaggagacaauauucugccggaucagacaagucaagaccuuaagucuaaggaggauggcgaggugguccaggaagaggaagugugugcaaaaccuuccgugacugaggaaaagaacauggagcccgagcagccaagcaccucgaaaaaugucacagaagaggaacuggaggacugguuggauucuaugaucuccuga

SEQ ID NO: 53219 - RNA, 495 nt, Artificial Sequence
  derived and/or modified sequence opt3 from AVP__Homo_sapiens__NP_000481
augcccgacaccaugcugccugccugcuuccucggccuucuggcuuuuagcuccgcauguuacuuccagaacugcccaagagggggaaagagggccaugucugauuuggaguuacggcaaugucugccgugcggucccggcgggaaaggacgcuguuuuggcccuucaaucugcugugcggacgaacuagguugcuucguggggacagcugaggcccuccgaugucaggaagagaauuaucugccaagucccugccagagcggacagaaggcauguggcuccggcgggcguugcgccgcuuuuggagucugcuguaacgaugaaucuugcguuacugagccugaguguagagaagguuuccacaggcgggcacgcgccucggacagaucaaaugcuacgcaacuugauggcccagccggggcgcuguugcucaggcuggugcagcuggcaggagcccccgagccuuuugaaccagcucagccggacgccuacuga

SEQ ID NO: 53220 - RNA, 444 nt, Artificial Sequence
  derived and/or modified sequence opt3 from AVPI1__Homo_sapiens__NP_068378
augggcacccccgccagcguggucuccgagccuccaccguggcaggcucccaucgaagcaagagggaggaagcaagccucugcgaacauuuuccaggacgcugagcugcuccagauacaggcccuuuuucaacggucaggagaucagcuggcagaggaacgcgcccagaucauuugggaaugcgcuggugaccaccgaguugcagaggccuugaaacguuuaagaaggaagcggccuccacgccagaaaccccugggccauagucuacaccauuguagcagacucaggauccuggagccucacuccgcucuugccaauccacaaucugcgacagaaacugcaucgucagagcaguaccugcauagccggaagaaaagugcccgcauucgaagaaacuggaggaaguccgggcccacgucuuauuugcaccagauccggcacuga

SEQ ID NO: 53221 - RNA, 1257 nt, Artificial Sequence
  derived and/or modified sequence opt3 from AVPR1A__Homo_sapiens__NP_000697
augagacugagcgccggccccgacgcugggccuuccggaaacucuucaccaugguggccgcucgcaaccggugccggcaauacaaguagggaggcggaagcucuuggggagggaaacggcccuccucgggaugugcgcaaugaggaacuggccaaguuggaaaucgcagucuuagccguuacuuucgcuguggcaguacuggguaacagcuccgugcuacucgcccugcaccgaacgccacguaaaaccucuagaaugcaucuuuuuauuaggcaccugucguuggcugaccucgccgucgcguucuuucaggugcugccccaaaugugcugggauauaacauaccgguuccgcgggccugacuggcuguguagaguugugaagcaucuccaggucuuuggaauguucgcaucagccuauauguuagugguaaugacugcugauagguacaucgccguuugccacccacugaaaacccuucagcagcccgcacggcgcagccgauugaugauugcugccgcgugggugcugaguuuuguccuauccacaccucaauauuucguguuuucuaugaucgaggugaauaacgucaccaaggccagagacuguugggcaacuuucauucagccauggggcagcagggcuuacguuacauggaugaccggcgggaucuuuguggccccgguagugauacucggaacgugcuaugguuucaucuguuacaauauuuggugcaacguccggggcaaaacugcuucccgucagucaaagggggccgagcaggcaggaguggccuuucaaaagggcuuccugcuugcucccuguguuaguagcgugaaaucuaucucccgcgcgaagauuagaaccgucaaaaugacauucgugaucguaacugcauauauaguuugcugggcccccuuuuucauuauccagauguggucagugugggauccaaugagcgucuggaccgaaagugagaaucccacaauuaccaucacggcucuguuggguucucucaacuccuguugcaauccuuggaucuacauguuuuucagcgggcaucuguuacaggacugugugcagucguuuccaugcugccaaaacaugaaggaaaaauucaauaaggaggauacugacucuauguccaggcggcagacauuuuacucaaacaaucgaagucccaccaacagcacuggaauguggaaggauuccccgaaaucuagcaagucaauuaaauucauaccugucaguacauga

SEQ ID NO: 53222 - RNA, 1275 nt, Artificial Sequence
  derived and/or modified sequence opt3 from AVPR1B__Homo_sapiens__NP_000698
auggacagcggcccccugugggaugccaacccuaccccaagagggacacucuccgcuccgaaugcaacuacgcccuggcuuggaagggacgaggaacuggccaagguggagaucggugucuuggcgaccguuuuagugcuggcuacaggcgggaaccuagccguacuccugacucuuggacagcugggccggaaacgcucucgaaugcacuuguucgugcuccaucuggcacugaccgaucucgccgucgcuuuauuucaagugcugccucagcuuuugugggacauuacauaccguuuccaggguccagaucugcuaugcagagcaguuaaguaucuccaggugcugucaauguuugccaguaccuacaugcuucuggcuaugacuuuggacagguaucucgccgucugucacccccugcggagcuuacaacagccugggcaguccacauaccugcucauagcggcaccauggcuucuggccgcuaucuucucuuugccccagguguuuauuuucucgcuacgcgaaguaauccaaggaucaggcguucuggauugcugggccgacuuuggcuucccuugggggccaagagcauaucucaccuggacgacucuggcuauuuuugugcuuccggucaccaugcugacagccuguuacagcuugaucugccaugagauauguaaaaaucucaaggugaaaacucaggcguggagggugggagguggcggguggcggaccugggaucgccccaguccuuccacacuggccgcaaccacgcgaggauuaccaucuagagucagcuccaucaacacuauuucaagggcuaagauccggacaguuaagaugaccuucgugauuguacuggccuauaucgcuugcugggcccccuuuuucagugugcagauguggagcgucugggacaaaaaugcaccugaugaagacucuacuaacguggccuuuacaauauccaugcuacucggcaaucugaacucauguugcaauccauggauuuacauggguuucaacagccaccuuuugccccguccgcugcgccaucucgcuuguugcgggggaccucagcccagaaugaggcggcgacugagugauggcucucuuuccagccgccacaccacgcuguugaccagaucgucuuguccagcgacacucucccugucauuaagucugacucuaagcggcaggccucggcccgaggaguccccacgcgaccucgaacuggcagacggggagggaaccgccgaaacaaucauuuucuga

SEQ ID NO: 53223 - RNA, 930 nt, Artificial Sequence
  derived and/or modified sequence opt3 from AVPR2__Homo_sapiens__NP_001139623
augcugauggccagcaccacauccgccgugcccggccacccuucucucccaucacuuccgaguaacagcucccaggagagaccccuggacacuagggauccuuuguuagcacgggccgaacuggcgcuacucucuaucgucuucguugcuguggcccugucgaaugggcuuguacuggcagccuuggcucgccgaggacguagaggucauugggcaccaauucacguguuuauaggccaucucugccuggccgaccuggcugucgcccucuuccaaguguuaccccagcuggcguggaaggcaacggauagguuucgggggccugacgcccuuugucgcgcuguuaaauacuugcagauggugggaauguaugccucaagcuacaugauccuggcaaugacccuagauagacacagggcuauuugccggccaaugcucgccuaucgccauggcaguggugcgcacuggaaccgacccguccugguggccugggcauucucccuucuguugucucucccucagcuguuuaucuucgcucaaagaaauguagaagggggaagcggcguuacagacuguugggccugcuuugcugagccauggggcaggcggacuuacgugaccuggauugccuuaauggucuucguggcaccgacacuggggaucgccgcuugucaggugcucauauuucgugagauccacgcgucccuuguccccggaccuucagaacgcccagguggcagaaggcgggggcgacgcaccggaagucccggcgagggugcacauguuagcgccgcuguggccaagacuguaagaaugacacuggugauugucgugguuuauguguugugcugggcaccuuucuuucuaguccagcugugggccgcuugggauccagaggcuccccucgaagggggauguucuaggggcuga

SEQ ID NO: 53224 - RNA, 987 nt, Artificial Sequence
  derived and/or modified sequence opt3 from AWAT1__Homo_sapiens__NP_001013597
auggcccacagcaagcagcccucccauuuccaaucucugaugcuccuucaguggccucugucauacuuggcuaucuuuuggauuuuacagccacuguucguguaucuacucuuuaccagucuguggccgcuucccguccuguacuucgcaugguuguuucucgacuggaaaacaccugagagaggcgggaggcggagcgccuggguucgcaacuggugcguguggacucacauacgagauuauuucccaaucacgauucugaagaccaaagaccugucccccgaacauaauuaccucaugggaguacacccucaugguuuacugacauuuggcgcguucuguaacuuuugcacugaggcuaccggguucucuaagacauuuccaggaaucacuccccaccuugccaccuugucgugguucuuuaaaauuccuuucgugcgugaauaucugauggcaaagggcgucuguucagugagccagccagccaucaauuaccuacucagucacgguacagggaaccugguuggaauaguggucggcggcgugggggaggcacuucaauccguaccgaauaccacgacucugaucuugcagaagagaaaaggauucguuaggaccgcucuccagcauggugcccaccuggugcccacauuuacuuucggcgaaaccgaggucuaugaucagguguuauuucauaaggacucucggauguacaaauuccaaagcugcuuucgcagaauuuucggguuuuacuguugcguguucuauggacaguccuuuugucagggcucaacaggucugcucccuuacaguaggccaaucgucaccguugugggggagccccuuccucugccacagauugaaaagcccagccaagagaugguagauaaauaucacgcuuuguacauggacgcccuacacaagcuguucgaucagcauaagacgcacuauggaugcucugaaacucagaaacucuuuuuccuguga

SEQ ID NO: 53225 - RNA, 3039 nt, Artificial Sequence
  derived and/or modified sequence opt3 from AXDND1__Homo_sapiens__NP_653297
augagccugcccaagaccccuuccacaccacucaacucuacuucaacgagugagagcaaaaagcugaaaguguccgucgccaaggaaggcaccagagggcuuccggaguugaaagaaaagaagaauaugguugacaggucuaaauuacugcccacaucgcuacagaacgaguucaucccuaaggaagugcuccugucacuuacuuacgcugcaaaugccggaccaugccccgagaaccuguugccuccaaagaagauuaaaacccccaaggguacacucccucggcugguagaucacguguggcaucacccaguccgccgaaauaaguuuaaauaucugauagaccauccggugagccucaccggcgcggggcgugauaucaguuucuuauacgacguuacuuaugcuaagggacaaacaagagagaaagccgugugucccccucaccuggcaaggucccuucagucucaugauggcgucauugugccacacaagcccaaaaccuugacggacacucugaucccugaagaguuucacauuguaagcuccaccgguguuucagggcuagaaugcuacgaugacaaguauacaacucuccugaccgauagugagaaccggcuucuguuguucccaagcaugaaacccaauaagcgcguggaggucgcccagcucaacgacgugauggauacaaugcuggaaagagcuggaguggagaaucaggaauacaccggcccgacgaagaugcauaaauuacugcacauccucaagaaagagcaaacuauauauaacaugaucuuucaugaacuuauuaggcaggucucuguugacugugcagaucggggcgagcuguuguccaaggugcgcgagcgauacguacagaugcuagaccagaucgccagacaaaugauugacuucuacaaagaucuggugacacagagggucauggaccagcggauccucgaagaacuguauaauuuuaagcacgugauagaagaacuuacccgugaacugugcuugguucgcgcucacgaugugaagcucacuaaagagacagagaaggcccauaaagaccuggcgcaggcauuacugaacgccgaaaagaaugcuaaaauugucgaggaauaccacgaucuauauacccuccaaagagagaggauggaaaacgacaugaagaagcugguggccgagcgggauaucuggucaagcgcaacguacgagcuugcuuugaaaguaauugaacgaaaucgcguuauccuggccagaaggcucuaucugaacgagaagggguggaacaaauacaccaagcauuucaucauucuucugaguaauaaagacacagaagauuuggcgcuccugcagaaguuaacucagaaguggcggaaccuggugaauaaacuaaagcaagaggucgagcagauggaagagucuaccuccgaaacacucaaaauagugaaggacggacugaucaaauggcaggaguuuuucaacgaaaaggauauucuuagcccuaauaaagguaacaucuuuaauucggucuugcuggacuucaagcaguggcaaaagauacucaacgagaaaaaggaggaauuuacuggcgacgugcuguuaucuaaauaugauacccugaagauuaucaaacaccuucaggagaauugggccgacaucggguugggaauuuucaaccgccauaagucccucgaaggcgagaugcccucagaaagacaguacauggaggagaucauuaagaauauacagaaacuguacaaggaauaugagaucaggauuaacggugauaauggguacaguaaaauccuaccaagccugaucuccucucucgacuucuguagcuuuaagcuggaaaaccuugaguucccugauacacccuuggaagaguggcaagagauugacgagaaaauaaaugagaugaagucacaccuggauaucuuacucaaccugaccggaauuguuccacagcacaucgacguggauaguguauccguccuucaggcauauauuuuuaacaugauccagcaauggcuguugaagauaggcaaugaaaucaacaauggcaacauugagcuccagcaucacauggacgagcugcauaucagcaugauucaguggauggugaaucuacugauccucaugauacccaacuucacugaucaggacugccugcuuaaauuggaagaggaaucugcugagaagcacgauauugggguugcccgucuggaauuagacgcuaucgagcucacgcggaaacuguaccaauauucaaguuaccuuagcuccuguugcaagggaauggugacagccauggcacugucuaaaucgaccaauagccacaagaacgccacugaggaccuauaugaagucgauaagcucaaaaaggaguguuacgaauggauuaauaccugcuccugucuguugucaaacaucaaaggucgaaagauaacacuguuaaccuacgaggaaaucgagagacuccuggaggaagaggcugugaaagaauuuauugagccugaaaucgacgagaguuucaaggaggaugaagaggaaucuaaagaggacaggaaacuucaggaggaaaauaaggagcgcgcggaggagcagccaagcacuuccacagaaaaagagaagcugauucgguuuaucggcgaggaugaaaacguacauucaaaaccguuguucgagacggacgugcucagcucuuggagagaauccgcaaagcaagggacccuggcccagaaauaucuagaggcuauggccguuauagaacacaugcaggagaagcugcuugaggucgaaaauagggcacgccaggccgaggaaaaguuugaggaugcuuacgaaaaacuccaucacacucugauuaagaacaaagacuuggaggagcuggugaugacaagucgaaaggaaagcaaagaggaaaaggagaaucaagaugagcgggaagugaaggaggaagaggaacagcaggaggaggaagagguccguucugccgaaaacuccucaaaaagucccaagaaaggacauuga

SEQ ID NO: 53226 - RNA, 2589 nt, Artificial Sequence
  derived and/or modified sequence opt3 from AXIN1__Homo_sapiens__NP_003493
augaacauccaggagcaaggcuucccccuggaccucggggccagcuuuaccgaagaugcuccuagaccaccggugcccggagaggaaggugagcuugucuccacagacccuaggccagcaucuuacucauucugcaguggcaaggggguuggaauuaaaggcgaaacuagcacggccaccccucggcgcuccgaucuggacuuggguuaugagcccgaggggucugcgucgccaacacccccuuacuuaaagugggcugaaucacugcacagccuacucgaugaccaggauggaauaagucuguuucgaacuuuccuuaaacaggagggcugugccgaccuguuggauuuuugguucgcaugcaccggcuuucguaagcucgaaccaugugacuccaaugaggagaaaagacugaagcuggccagggcuaucuaucggaaguacauucucgauaacaaugggaucgugucucgccagacaaaaccggcaaccaagagcuucauuaaaggaugcaucaugaagcaauuaauagaccccgccauguuugaucaggcucagacugaaauccaggccacaauggaggaaaacaccuauccuuccuuccugaaaucagacauuuaccuugaguauacgagaacugguagugaaagcccaaagguauguucugaccaauccucaggcagcgggaccggaaagggcaucagugguuacuugcccacacugaaugaggaugaggaauggaaaugcgaccaggauauggacgaggaugacgggagggaugcggcaccuccaggacggcuaccccagaagcuccugcuugaaacugccgcuccgcgcgugucuuccagccgaagauacucggagggcagggaauuucgguauggcucuuggcgugagccugucaaccccuacuaugugaaugccggguacgcacuggcuccagccaccuccgcgaacgacucagagcagcaaaguuugagcuccgaugccgacacacucucucugaccgauagcucaguugacggcauuccucccuaucgcaucagaaaacagcauaggcgggaaaugcaggagagugugcaagucaauggucgagugccauuaccccacauaccucgcacguacagaguaccaaaggaaguuaggguggagccgcagaaauucgcagaagaacugauucaucggcucgaggcuguccagcgcacuagagaagccgaggaaaaacuugaggagaggcugaaacgugugcggauggaagaggaaggcgaggacggggaucccuccagcggaccuccaggccccugucacaaguugccuccagcucccgccuggcaucacuuuccgccucgaugcguggacauggguugugcagggcuaagagaugcccacgaagagaacccagagucuauccuggacgaacauguccagaggguucuccgcacacccggccggcaaucaccuggacccggccacagaaguccagauagcgggcauguggcuaagaugccuguagcgcugggaggugcagccuccggccacgggaaacacgugcccaagucuggagcuaaacuugacgccgcaggccugcaucaccauaggcacguccaucaccacgugcaucacucgaccgcccgcccaaaggagcagguugaagcugaggccacucgacgggcacagagcuccuucgcgugggguuuggaaccgcauucacacggggcucguaguagaggcuauucugagagcgugggagccgcaccuaaugccuccgauggccucgcucacucagggaaagucggaguggccugcaagaggaacgcaaagaaagcugagagcgguaagucugccuccacagaaguacccggcgcgagugaggacgccgaaaagaaucagaagauuaugcaauggaucaucgagggggaaaaagagauuagccgccaucggagaaccggacacggaucuuccgguacgaggaagccacagccccaugagaacucacgaccucugaguuuagaacacccaugggcugggccccagcugcgcaccagcguucagccuucgcaucuauucauacaagauccgacaaugccaccccacccugcaccaaauccccucacucagcuggaggaagcccggagaaggcuugaggaggaagagaagcgugcuucccgcgccccuucuaaacagcgguacgugcaggaagucaugagaaggggccgagcaugugugcggccggcgugcgcccccgucuugcacgugguuccagcugugagcgacauggagcugucagaaaccgagacacgcagucaaagaaagguaggaggcggguccgcccagccuugcgauucuaucgucguggcauacuauuuuuguggagagcccauuccauacaggacucucguucggggccgagcugugacccugggucaguucaaagaacuucugacaaagaaagggagcuauagauacuauuuuaagaaggucuccgacgaguucgauugcggagugguauuugaagaggugcgcgaagacgaggccguuuugccugucuucgaggagaaaaucauaggcaagguggagaaaguggacuga

SEQ ID NO: 53227 - RNA, 2532 nt, Artificial Sequence
  derived and/or modified sequence opt3 from AXIN2__Homo_sapiens__XP_011523623
augagcuccgccaugcuggugaccugccuccccgacccuucuucaaguuucagagaggaugcuccaaggccgcccgucccuggcgaagagggggaaacaccacccugucagccuggaguugguaagggccaagugacuaaaccaaugcccguaagcuccaacacgcggcgcaaugaggacgggcuuggagaaccugagggccgagcaucuccagauucgccgcugacccguuggacaaagucauugcacagcuuacugggugaccaggauggggccuaccuauuuagaacuuuccucgagagggaaaaaugcguggacacccuggauuuuugguucgcguguaacggauuucggcagaugaaucuuaaggacacaaaaacccugcgcgucgcuaaggccaucuauaagagauacauugagaacaauaguauaguguccaaacaguugaagcccgcaacuaaaacauauaucagggauggcauuaagaaacaacagaucgacucuauuauguucgaucaggcccagaccgaaauccaaagcguuauggaggagaacgcuuaccagauguuucucacguccgacauauaucuggaauacgugcggucaggcggggagaauacugcauauaugaguaacggaggucugggcagccucaaggucgugugcggguacuuaccuacccugaaugaagaggaagaguggacaugugccgauuucaagugcaaacuuucuccaacuguaguuggauuguccucaaagacccugcgcgcuacagccagcgugcgaaguaccgagacggucgacucuggcuacagauccuuuaaaaggagcgaccccgugaacccuuaucauaucgguucgggguacguguucgcgccagcaacuucugccaaugauuccgaaauuucaagugacgcucuaacagaugacagcauguccaugaccgauucuagcgucgacggaaucccgcccuaucggguuggcucaaagaaacagcuccagcgugagaugcaccgcagugugaaggccaacggccaaguaucccugccucauuuucccagaacucacaggcuuccaaaagaaaugacaccuguggagcccgcaaccuucgcugccgaacugauuagccgguuggagaagcucaagcuggaguuagaaucucgacauucacuggaggaacgccuccagcagaucagagaggaugaagagagggaggggagugaacuuacgcugaauagccgggagggagcgccaacccaacaccccuugucccuacugccuucugguucguacgaagaggacccacagacaauacucgaugaccaccugagccgcguccuuaaaacuccgggcugucagucccccggggugggaagauauucaccuaggagucguucuccagaucaucaccaucaccaccauagccaguaccacucccuguugcccccuggcgguaagcucccacccgccgcagcuucaccgggggccugcccucuguuaggcggaaaaggcuuuguuaccaagcaaacaacuaaacaugugcaccaucacuauauucaccaucacgcugucccaaagaccaaggaggaaaucgaggccgaagcaacacagcgggugcauuguuucugccccgggggaagcgaguacuacuguuauucuaaaugcaagucccacaguaaagccccugaaaccaugcccagcgagcaguucgguggcucucgaggguccacucugccaaagagaaacggaaaaggcacggagccuggucuagcucuccccgcgagggaagggggcgcaccaggaggcgccggggcucugcagcuuccgcgcgaggaaggagaccggucacaagacguauggcaguggauguuggagagugaaagacagagcaagccuaagccccacucggcccaguccaccaaaaaggcauacccacuggagucugccaggagcucacccggugagcgcgcuagucgacaucaccucuggggcgguaauuccggacauccucggacaacuccacgugcccaccuguuuacccaagaucccgcaaugccuccgcuuacaccacccaacacccuggcgcaguuggaagaggcuugcagaaggcucgccgaaguuucuaaaccuccaaagcagcgcuguugcguggcaagccagcaacgggacagaaaccauuccgccacuguccagacaggcgcuacgcccuucucaaauccuagccuggccccggaggaucacaaagaacccaagaaguuagcaggggugcacgcucugcaggccagugagcuagucgugaccuacuuuuucuguggggaggaaauuccauauaggcgaaugcucaaagcgcaaucucugacucuuggccauuuuaaggagcaguuguccaaaaagggaaacuaucgcuacuauuucaaaaaggccagcgacgaauuugcuugcggcgcaguuuucgaggagaucugggaagaugagacagugcugccuauguacgaagggcggauccucggaaaaguagagagaauugacuga

SEQ ID NO: 53228 - RNA, 2658 nt, Artificial Sequence
  derived and/or modified sequence opt3 from AXL__Homo_sapiens__NP_001690
auggccuggagaugccccaggaugggccgggugccucuggcuuggugucucgcacuuugcgggugggccuguauggcgccacgcggaacccaggcugaggaaagcccguucgucgguaaccccggcaauaucacaggggcccgaggacugacuggcacguugcguugccaauuacagguucagggugagccuccagaagugcacuggcugagagacgggcagauucuagagcucgcagauuccacccaaacacagguaccccugggagaagacgagcaggaugacuggauaguggucucucagcuuaggaucacuucacugcaauugagugauaccggccaguaccagugucucguguuucugggccaucagacauucguuagccaaccuggguaugugggacuggagggucucccauacuuuuuagaggaacccgaagaccggaccgucgccgcuaacacuccuuucaaucuguccugccaggcacagggcccaccggagcccguggaucuuuuguggcugcaagacgccguaccucuagcuacagccccagggcacggaccccagcgcucucuccauguuccuggccugaacaagaccucgucauuuagcugugaggcgcacaaugcaaaaggugugacgacaaguagaaccgccacaauuacuguccuuccacagcagcccaggaaccugcauuuggugucccggcaaccgaccgaacucgagguggcuuggacaccugggcugucuggaaucuaucccuuaacccacugcacgcugcaggccguccucagcgaugacggcaugggcauucaggcaggggaaccagauccucccgaggaaccacuuacuucccaggcuucaguucccccucaccaacugcgcuugggaagucuacauccacacacaccguaccauauccgaguggccuguaccagcucucagggucccuccucauggacucacuggcugccuguagagacaccagagggcgugccccucgggccuccagaaaauauaagcgcgaccagaaacggaagucaggccuucguccacuggcaggagcccagggcaccgcugcaaggcacgcuucuggguuaucgguuggcuuaccaggggcaggacaccccugaagugcucauggauaucggccugcgucaggagguuacauuagaacugcaaggagacggcucuguguccaaucuaacugucugcguggccgcuuauaccgccgcaggggacggaccauggagccuccccguaccucuggaggccuggcgccccguuaaggagccaucgacuccugcuuuuucuuggcccuggugguacgugcuuuugggugcggucguggcagccgcuuguguccugauucucgcccuguuccuugugcauagaaggaaaaaggaaacucgguacggcgagguuuuugaaccaaccguggagcgaggggaacugguaguccgcuauagagugaggaaauccuacucacggcgcacaaccgaggcaacuuugaacagucucggaaucagcgaggaacugaaggagaaguuaagagauguuaugguggacaggcacaaagucgcccugggcaagacgcuaggugaaggggaguucggcgcugugauggagggacagcucaaucaggaugacuccauucugaaaguagccgugaagacaaugaaaaucgcaauaugcacccguucugaacuugaggacuuuuugagcgaagcgguuugcaugaaggaguucgaucauccgaacgucaugcggcugauuggcguguguuuucaagggucagaacgagagaguuucccugcucccguggucauccucccauucaugaagcacggagaucugcauuccuuuuuacuguauagcagacuuggugaccagcccguuuacuugccuacucagaugcucgugaaauucauggccgauauugcaucuggcauggaguaucugucaaccaagagguuuauccaccgcgaccuagccgcucggaauugcaugcugaacgaaaauaugaguguguguguagccgauuucgggcucagcaaaaagaucuacaacggagacuauuacagacagggcaggauugcaaaaaugccagucaaguggauagcuaucgagucccuggccgaccgcguguacacaucuaaaucggauguuuggagcuuuggugugaccaugugggaaauugcgacucgagggcaaacacccuauccuggcgucgagaacuccgaaaucuacgacuaucuucggcagggaaaucguuugaagcagccggccgauugccuggacggcuuauacgcucucaugucaagauguugggagcugaacccacaggauaggcccaguuucacggagcuucgcgaagaccuggagaauaccuugaaggcacucccuccagcccaagaacccgaugagauacuguaugugaacauggacgaagggggaggcuacccugagccgcccggugcugccgggggagcagauccaccuacucagcccgacccaaaagauucuugcagcugucuaacagcggccgagguucacccugcuggccgguaugugcugugccccuccaccacaccaucaccggcccagccugcagacagagguagccccgcugccccaggccaggaagauggggcauga

SEQ ID NO: 53229 - RNA, 897 nt, Artificial Sequence
  derived and/or modified sequence opt3 from AZGP1__Homo_sapiens__NP_001176
auggugagaaugguccccguucugcucagccuucuguuguuacugggcccugccgugccacaggagaaccaagacgggagguacucccuaaccuauaucuacacaggacucucuaagcacguagaagaugugccggcuuuccaggcacuggguucacuuaaugaccugcaguuuuuccgguauaacaguaaagaucgcaagagccagcccaugggcuuguggcgacaagucgaggggauggaagacuggaaacaggauucccagcuccagaaggcccgugaggacauuuuuauggaaacucugaaagauauaguggaguacuauaaugacucuaacggaucgcauguucugcaaggcagauucgguugcgagaucgaaaauaacaggucaagcggggcguuuuggaaguacuauuacgauggaaaggacuacauugaguucaauaaagaaaucccugcuugggugccauuugaucccgccgcacagauuacgaagcagaaaugggaggccgagccugucuaugugcagcgggcuaaggcauaccucgaagaggaauguccagccaccuuacgcaaauaucugaaguacaguaagaacauccuugacagacaagaucccccuuccguaguugugacaucucaccaggcuccaggcgagaaaaagaaauugaagugccuggccuaugacuucuacccgggcaaaauagacguccauuggacuagggcgggggaagugcaggagcccgagcuacggggagaugugcuccacaaugguaacggcaccuaucaaagcugggucguuguggcaguaccuccacaggacacagcccccuacuccugucaugugcagcacucaagucuggcucagccucuugucgugccaugggaagccagcuga

SEQ ID NO: 53230 - RNA, 732 nt, Artificial Sequence
  derived and/or modified sequence opt3 from AZI2__Homo_sapiens__NP_001127904
auggacgcccugguggaggaugacaucugcauucucaaccacgaaaaggcucauaaaagagauaccgucacacccguuagcauauacuccggcgacgagucuguggcaucacacuucgcccuuguaacugcguaugaagauaucaagaaaaggcugaaggacagugagaaagaaaauagcuuguuaaagaagcggauucgcuuucuggaggagaaacuaaucgcucgauucgaagaggaaacguccucuguggggcgugagcaggucaacaaggccuaccaugcauauagagagguguguauugauagggacaaucucaaaucgaagcuggauaaaaugaacaaggacaauucagaaagccuuaagguucugaacgagcaauugcagaguaaagaaguggagcuccugcagcugcggaccgaagucgagacacagcaagugaugcgcaaucucaacccuccauccucuaauugggagguagaaaaguuaagcugcgaucugaaaauccacggacuugagcaggaauuggagcugaugagaaaggaauguuccgaccuaaaaauagagcuccagaaggccaaacagacugauccguaccaagaggacaaccugaagucaagggaccuucagaagcugaguaucagccggcagucuauuugcuccaccgcuuggucagcaguugcccagagcugggauaguaugaauuuugaagacuguucuuuguucgcuuga

SEQ ID NO: 53231 - RNA, 1092 nt, Artificial Sequence
  derived and/or modified sequence opt3 from AZIN1__Homo_sapiens__NP_001288597
augaagggcuucaucgacgaugccaacuacagcguggggcugcucgacgagggaaccaaucuugguaacgucauugauaauuauguuuacgaacacacacugacuggcaaaaacgcuuucuucgugggggacuugggaaagauagugaaaaagcauucccaguggcaaaauguagucgcacagaucaaacccuuuuauacggugaagugcaacucugccccugcgguuuuagagauucuggcugcccuaggcaccgguuucgcauguucaaguaagaaugaaauggcccucgugcaggagcugggggucccaccggaaaacaucauuuacaucagccccugcaaacaggugucccaaauaaaguaugcugcaaaaguaggaguuaauauccuuacaugugauaacgagauugagcugaagaaaaucgccagaaaucacccuaacgcuaagguguugcuccauauugccacugaagacaauaucggcggcgaggaagggaacaugaaguuuggaaccacacugaaaaauugcaggcaucugcucgagugugcgaaggaguuagauguccagauaauuggugugaaauuccacgugucuucggcaugcaaggaaucacaggucuacguucacgcccugagcgacgcucgguguguguuugauauggccggcgagaucggguucaccaugaacaugcuugacauuggaggcgguuuuacugggacagaauuucaguuggaggaaguaaaccacgugaucaguccacugcuagauaucuauuuucccgagggauccggcgucaaaauuauaucugagccuggcagcuacuacguguccucagcauucacccucgcuguuaauaucauugccaagaaaguggucgaaaacgacaaguuuccaagugggguggagaagacgggaagcgaugaacccgcguucauguauuacaugaaugacgguguauauggcucuuucgccuccaaacugucagaggaccuuaacacuaucccugaaguucauaagaaauacaaggaggaugagccacuguuuaccagcaguuugugggggccgucuugcgacgaacucuuccgcuga

SEQ ID NO: 53232 - RNA, 1443 nt, Artificial Sequence
  derived and/or modified sequence opt3 from AZIN2__Homo_sapiens__NP_001288754
auggccggcuaccugagcgaguccgacuucgugauggucgaagagggguuuucuaccagagaucuccuuaaggaacugacauugggagcuucacaggcaacuacggacgagguugccgcguucuuuguggcugauuuaggugccaucguaaggaaacacuucugcuuucugaagugucuaccccgggugcgcccuuucuaugcagucaaaugcaacaguagcccaggcgugcucaagguucuggcccaacuugggcugggauuuuccugugcuaauaaagcagaaauggaguuggugcagcauauuggcauaccggccucuaagaucauuugcgcuaaccccuguaagcagaucgcccagauuaaauacgcggcaaagcacgguauccaacuccugucguucgacaaugagauggaacuggccaaagucgugaagucacauccuagcgcuaaaaugguacucugcauagccaccgaugacagucacuccuuaucuugucugagccuuaaguuugggguuuccuugaagucaugccgacaucugcuagagaacgcuaaaaagcaccacguggaagucgugggagugaguuuccauaucggcagcggcuguccagauccccaggcauaugcccagucuauugcggacgcccgucucgucuuugagauggggacagagcugggacacaaaaugcauguucuugaucuggguggcggguucccuggaacugaaggcgcaaaggugagauuugaggaaaucgcuuccguaauuaauucagccuuggaccucuacuucccagaggguugcgggguggauaucuucgcugaacugggaagguauuacgucaccagcgccuuuacaguggcaguuaguauaauugccaaaaaggagguguuacuggaccagcccggccgggaggcuccucucccaccgccccacaucgcgaccugugcagccucugaaccuuccccacccgcugaggaaaacggcagcacuucgaaaacaauugucuaucaccuugaugaggggguguacggaaucuucaauucuguacuguuugacaacaucugcccuaccccaauuuugcaaaagaagcccuccacggaacagccgcuauacucaaguagccugugggguccugccguugacggcugcgauuguguggcagaggggcucuggcugccccagcuucaugucggagacuggcugguguucgauaauaugggcgccuauacugucgguaugggguccccauuuuggggcacccaggcuugccacauaacauacgccaugucucgcguggcaugggaggcguugagaaggcaacucauggcugccgaacaggaggacgauguugaaggaguguguaaaccucugagcugcggcugggagaucacugacaccuuauguguagggcccgucuucacaccagcaucaauuauguga

SEQ ID NO: 53233 - RNA, 756 nt, Artificial Sequence
  derived and/or modified sequence opt3 from AZU1__Homo_sapiens__NP_001691
augaccagacugacagugcucgcccuucuggcuggcuuguuagcaagcuccagggccgggucuucaccccugcuagacaucgucggaggucggaaggcgcgcccucgacaguucccauuucucgcuaguauucaaaaccagggccgucacuucugcgggggagcccugauacaugcaagauuuguuaugacugccgcuagcuguuuccagucccagaauccgggcgugucuacgguagugcuuggugcauacgaucugaggcggcgcgagagacaaucgaggcagaccuuuucaaucagcaguauguccgaaaacggguaugacccccagcagaauuugaacgaucucaugcugcugcaacucgaccgggaggccaauuuaacaucuagcgucacuauucugccucuuccauugcagaacgcuaccguggaagccggaacacgcugccagguugcgggcuggggcucccagcgaucagggggaagacugaguagguucccccgguuugugaaugucaccgugacuccugaggaucaaugucguccaaacaauguaugcacagguguucuaacccgcagaggcgggaucuguaacggagacggcgguacgccccucgugugcgaagggcuggcacacggagucgccagcuucucucuuggcccuuguggcagggggccagacuuuuucacucggguggcucuguuucgagauuggauugauggaguguugaauaacccgggucccggcccugccuga

SEQ ID NO: 53234 - RNA, 360 nt, Artificial Sequence
  derived and/or modified sequence opt3 from B2M__Homo_sapiens__NP_004039
augagcagauccguggcccuggcuguccucgcacuucugucuuugucaggcuuagaggccauccagaggacccccaagauucaaguuuacagucggcacccugcggaaaacgggaaaagcaauuuccugaacugcuauguguccggauuucauccaucugacauagagguagaucuacucaagaauggugaacgcaucgagaaaguggaacacucggaccugucauucagcaaggauuggaguuuuuaccuucuguauuacacagaguucacuccgacggagaaagacgaauaugcuugucgagucaaccaugugaccuugucccagcccaagauuguuaagugggaucgugacauguga

SEQ ID NO: 53235 - RNA, 996 nt, Artificial Sequence
  derived and/or modified sequence opt3 from B3GALNT1__Homo_sapiens__XP_005247921
auggccagcgcucuguggaccgugcuccccuccagaaugucucuuaggucacugaaguggaguuuguuacugcuaagccuccuguccuucuuugucaugugguaccuuucucugccucacuauaacguuaucgagcgggugaauuggauguacuucuaugaauacgagccaauuuaucgccaggacuuucauuucacauugcgagaacacucgaacugcucacaucaaaauccguuucucguaauacuggugacuagccaccccagugaugucaaagcacgucaggccaucagagugacguggggcgagaagaaauccugguggggguacgaaguucugaccuucuuucucuuaggacaggaggcggagaaggaagacaaaaugcuggcucuuucuuuggaggaugaacaucugcuauauggugacauuaucaggcaggauuuccucgacacauacaacaaucugacucuuaagaccauuauggccuuucggugggugacagaguucuguccuaacgcaaaguacgucaugaaaaccgauacugacguguuuaucaauacaggcaaccugguaaaguauuugcucaaucugaaccacagcgagaaauucuuuaccggguacccauuaauagauaauuauuccuaccgcggauucuaucaaaagacgcacaucucauaccaggaauaucccuucaaaguuuuuccuccauacugcaguggccuggguuacauuaugagcagagaccucgugcccaggaucuaugagaugauggggcaugucaagccuauuaaguucgaagauguguacgugggaaucugucuuaaccuguugaaagucaauauacacauuccagaggacacuaaccuauuuuuccuguaucggauccaucucgauguuugccagcugcgccgagugauugccgcucacggcuuuucuuccaaggaaaucaucaccuucuggcagguaaugcuuagaaauacaacuugucacuacuga

SEQ ID NO: 53236 - RNA, 981 nt, Artificial Sequence
  derived and/or modified sequence opt3 from B3GALNT2__Homo_sapiens__NP_001264084
augagaaacuggcuggugcuccuuugccccuguguccugggcgccgcuuugcacuuauggcugaggcuacggagcccuccaccggcaugcgccuccggggcgggacccgcugguggcguuucucuccugcuuccucgccuggaguguaauggggccgugucagcacauccaaacuugcaccuccccggaagucgagacagcccugccuccgcuucucagguagcaggcaucaccgaucaacuggcccuguucccacaguggaagucgacacauuacgacguggucguggguguucucucagcucguaauaaccacgaauuaagaaaugugauuaggagcacuuggaugcggcaucugcuucagcaccccacguugagucagcgcguccuggugaaauuuauaaucggggcccacggaugcgagguaccuguugaagauagagaggacccauauuccuguaagcuacucaacauuaccaauccggugcugaaccaagaaaucgaggcguucucucuuagcgaggauacauccucaggccugcccgaagacagggucgugagugugagcuuucgggucuuguacccuauuguuaucacuucucucggcguguucuaugaugcaaaugacguaggguuucagcgcaacauaaccgugaaacuguaccaggccgagcaggaagaggcuuuauucaucgcccgauuuuccccacccucaugcggaguccaagugaauaagcugugguauaaaccuguugagcaguucauucucccagagagcuuugaagguacaaucgugugggaaagucaggaucuucauggccuggucucuagaaacuugcacaaggugaccguaaaugacgggggaggcguucuaagggugauuacugcuggugagggggcacugccccaugaguuccucgaaggagucgagggcguggccggcggguuuaucuacacaauacagggaaaguucgcguccuga

SEQ ID NO: 53237 - RNA, 1269 nt, Artificial Sequence
  derived and/or modified sequence opt3 from B3GALT2__Homo_sapiens__NP_003774
augcugcaguggagaaggcggcacugcuguuucgccaagaugaccuggaacgcuaaacgcagccucuuucgaacacaucuuaucggcgugcuguccuuggucuucuuauuugcaauguuccuguuuuucaaucaccaugacuggcuacccgggcgugccggauuuaaggagaacccuguuacuuacacguucagagguuuuaggucuaccaaaucagaaacaaaucacaguagccuccggaacauuuggaaggagacugugccacaaacccugcgcccgcagacagcgaccaauuccaacaauacugaucuuucuccccagggcguaacagggcuggaaaacaccuugucggcuaauggaucaauauauaacgagaaaggcacgggucauccuaauagcuaccacuucaaguauaucauuaacgaaccagagaagugccaggagaaaagucccuuucucauccugcugauugccgcagaaccugggcaaaucgaggccagaagggcuauacggcagacuuggggaaaugaaucccucgcaccaggcauccagauuacccgcaucuucuuacugggccuuucuauuaaguugaacggguaccugcagcgagccauccuagaggagagcagacaauaucacgacauaauucagcaggaauaccucgauacauauuacaaucugacuaucaaaacccuuaugggaaugaacuggguggcuacauacuguccccauauuccuuaugucaugaagaccgacuccgauauguuugugaacacggaguaccugaucaauaaauugcucaagccagaccugccgcccaggcacaacuauuucacugguuacuuaaugcggggcuaugccccuaaucguaacaaggauucaaaaugguacaugccacccgaccuguauccuagugaacgcuacccaguuuucugcagcgggacaggauacguguuuucuggcgaucucgcggagaagaucuucaaagucucccuugguauuagaaggcugcauuuggaagacguguauguagggauaugucuagcaaagcugcggaucgaucccguuccgccucccaaugaguuuguguucaaccacuggcgagucucauacagcaguugcaaauauucucaccucauuaccucccaucaguuucaaccaagcgagcugaucaaguacuggaaucaccuucagcagaacaaacauaaugccugugcuaacgccgcaaaggaaaaggcuggacgcuauagacacaggaaacugcauuga

SEQ ID NO: 53238 - RNA, 1137 nt, Artificial Sequence
  derived and/or modified sequence opt3 from B3GALT4__Homo_sapiens__NP_003773
augcagcugagacucuucaggcggcuucuguuggccgcuuuacugcuagugaucgucuggacccucuuuggccccagcgggcugggagaggaacuucuguccuugucucucgcaucacugcugccugccccagcgaguccgggucccccucucgcuuuaccacgccugcuuauucccaaccaagaggccugcagcggcccuggggcaccacccuucuugcugauacuuguuuguacagccccugaaaaucucaaccagcgaaaugcuauccgugcauccuggggaggccugagagaggccaggggucuucgggugcagacucuguuuuugcucggggaaccaaacgcucagcacccgguauggggaucucaaggcucggaccuggccucagagagcgcggcacagggcgauauuuuacaggccgcuuuccaggacaguuaccgcaaucugacgcucaagacccuuuccgggcugaacugggccgagaaacauugccccauggcaagauauguguugaagacagaugacgaugucuacgugaauguuccugaacuugugucugagcugguccucaggggaggucgguggggccaaugggaacgcagcacugagccacagcgagaggcugaacaggaagggggacaggugcugcacuccgaagagguaccccuucuguauuugggcagaguucauuggagggugaacccuucacggaccccaggugggcgucaccgcgucagugaggagcaauggccccauacauggggaccguuuccucccuacgccagcggcaccggcuaugugcucucugcguccgccgugcagcugaucuuaaaagucgcaucaagagcuccacugcuaccucucgaggacguuuucguggggguaagcgccaggcggggaggucuggcucccacucagugugugaagcuagccggcgcaacacacuacccauuggaucgaugcuguuaugggaaauuucugcucaccagucaccgccuggaccccuggaagaugcaagaagccuggaagcuagucggaggcucugauggugagagaacggcuccuuucugcuccugguuucagggggugcugggcauuuugaggugucgggcgaucgcauggcuccagagcuga

SEQ ID NO: 53239 - RNA, 933 nt, Artificial Sequence
  derived and/or modified sequence opt3 from B3GALT5__Homo_sapiens__NP_149361
auggccuuccccaagaugagacugauguacaucugccuccuugugcugggcgcuuuguguuuauauuuuagcauguacucccugaacccuuucaaagagcagucuuuugucuauaagaaagacgggaauuuccuaaagcucccagauaccgacugcaggcaaacaccgcccuuucugguucuucuggugacuucaagucacaaacaguuggcagaacggauggccauucgccagacguggggaaaggagcgaaugguaaaggguaaacagcucaagaccuucuuucugcugggcacaacuagcuccgcggcugaaaccaaagagguggaucaagaaucucagcgucauggggacauaauccagaaggauuuccucgacgucuacuauaacuuaacacugaaaaccaugaugggaauugagugggugcacagauuuuguccucaggccgcauucguuaugaagacugauucggacauguuuaucaauguggauuaccuuacagaguugcugcuaaagaaaaacaggaccacgcgguucuuuacuggcuuccucaagcugaaugaguucccaauucgccaacccuuuucaaaaugguucgucagcaagagugaauauccuugggacagauacccacccuuuugcuccgguaccggguacguguucucuggagauguagccagccagguuuauaacguguccaaaucagucccuuacaucaaacuugaagacguguuugugggccuguguuuggagaggcucaauauacggcuggaggaauuacauagucagccaacauucuuuccgggcgggcugcgcuucagcgucugccucuuucgaagaaucguugcuugucacuucauuaagcccaggacucuucuggauuauuggcaggcauuggagaacucucggggagaagacugcccuccaguguga

SEQ ID NO: 53240 - RNA, 1497 nt, Artificial Sequence
  derived and/or modified sequence opt3 from B3GALTL__Homo_sapiens__NP_919299
augagacccccugccugcugguggcugcucgcuccaccggcacuucuggccuuguuaaccuguagccuggcguucggccuagcuuccgaggacacaaagaaagaagugaagcagucucaagaucucgagaaaucagggaucaguaggaagaacgacauugaucugaaaggaauagucuuuguuauccagagccaguccaauucuuuccacgccaagcgggcagaacagcuuaagaaaucgauucugaagcaagccgcugacuugacucaggagcuccccucagugcugcugcuccaucaguuagcaaaacaggaaggugccuggacgauccugccucuuuugccacacuuuagcguaaccuacagucgcaacuccucuuggauuuucuuuugcgaggaggaaacacgaauccaaauacccaagcugcuagagacucuccguagauaugauccuagcaaagaaugguuccugggcaaggcccuucaugacgaggaggcuaccaucauucaccauuacgcguuuuccgaaaauccaacaguguucaaguaucccgauuuugcagccgggugggcucugucaaucccuuuggucaacaaacucaccaagaggcugaaaagugagagcuuaaagucugacuucacuauugaucugaaacacgaaaucgcccucuacauaugggacaagggaggcgguccaccgcuuacacccgugccugaguuuuguaccaaugauguugacuucuauugcgcaacgacuuuucacuccuuccugccauugugucggaaacccgugaagaagaaagauauuuucgucgcugugaagaccugcaaaaaguuucauggggaccgcaucccuauuguaaaacagacaugggaaucacaggccagccuaaucgaguacuauagugacuacacugagaacucuaucccaaccguugaucugggcauucccaauacagacagaggacacuguggcaagaccuucgcgauacucgaaagguuucugaaccggucccaggauaagacggccuggcuugugaucgucgacgaugacacucugauuagcaucucgcgcuugcaacaucuccugucuugcuacgauuccggggagccgguguucuuaggagaacgauaugguuacggccuggggacaggaggcuauucauacauaaccggugggggaggcaugguguuuaguagagaggcagucaggcggcuacucgcuagcaaaugucguugcuauuccaaugacgccccugaugacaugguucugggcauguguuucucugggcuugguauucccgugacucacagcccauuguuucaccaggcucgcccuguagauuaccccaaggacuaucugucacaucaggugccaaucaguuuccacaaacauuggaacaucgaccccgucaagguguacuuuacauggcucgccccuuccgaugaagacaaagcaagacaagagacccagaagggauucagggaggaacuguga

SEQ ID NO: 53241 - RNA, 1044 nt, Artificial Sequence
  derived and/or modified sequence opt3 from B3GAT1__Homo_sapiens__XP_011541055
augggcaacgaggaacccugggugcagccugcccuggagaugccaaagagaagggacauccucgcuauuguccuuauaguucugccguggaccuuguuaaucacaguguggcaccaaagcacucuggcaccccuacucgccguacauaaagaugaaggguccgacccucggcgcgagacgccacccggagcggauccucgagaauacugcaccucugaccgugauauuguggaggucgugagaacagaguauguuuacacuaggccacccccuuggucagacacccugccaacaauccacguggucaccccgacuuauagucggcccgugcagaaggcugaacuuacacgcauggccaauacccuguugcauguaccuaaccuccacuggcugguuguggaggaugcaccaagaaggacgccccugacugcccggcucuuacgcgacaccggucugaauuacacacaucuucacgucgaaacuccucgaaacuauaaauugagaggcgaugcuagggacccacggauuccccgugggaccaugcagcgcaaucuggcacuaagauggcucagggagacauucccgcggaacagcucccagccuggagugguguacuuugccgaugacgauaauaccuauucucuggagcuuuucgaagagaugcgaucgacgcgcagagucucaguuuggcccguggcuuuuguaggcggucugagguacgaagccccacgggugaacggggcgggaaaggucgugggcuggaaaacuguuuucgacccucaccgccccuuugcaaucgacauggccggcuucgcugugaauuugagacucauacugcaaaggagccaggccuacuuuaaguuacguggggucaagggagguuaucaggagaguucccugcuccgggaacuugugacacugaacgauuuggagccaaaagcagcuaauuguaccaagauccuaguauggcauacucgaacagagaaacccguucuggugaacgaaggcaagaaaggguucaccgacccuucugucgagauuuga

SEQ ID NO: 53242 - RNA, 972 nt, Artificial Sequence
  derived and/or modified sequence opt3 from B3GAT2__Homo_sapiens__NP_542780
augaaaagcgcccuguucaccagauuuuucauccuccuucccuggauucugauagugaucauuauguuggacgucgauacaaggcggccuguuccaccguuaacuccccgcccuuacuuuuccccauaugcugugggccgagggggagcacgucugccccuaagaagggguggcccugcccacgggacgcagaagcggaaccaaucucgcccacagccccagccugagccacagcucccgaccaucuacgcgauuacacccacuuauucaagaccuguacaaaaggcugaacugaccaggcuugccaauacauuccgccagguggcacagcugcauuggaucuuggucgaggacgccgcugcacggagugaacucgugagccgauuucuggccagagcuggacugccauccacccaccuccauguucccacuccuaggcgguacaaacguccaggcuuaccccgcgccacagagcagagaaacgcgggucuggcauggcuuaggcaacggcaccagcaucagcgagcccagccggggguguuguucuuugcugaugacgauaauaccuauucucuggaacuauuccaagagaugcgcacgacuagaaaggucucgguguggccuguaggacucguuggcggcaggcgguacgagcgcccccugguggaaaacgggaaagucgugggaugguauaccgguuggagagccgacaggccauuugcaauagauauggcuggcuucgccgugucacuucaggucauccugagcaauccuaaggcgguuuuuaagcgucgggggagucagcccggaaugcaagaguccgacuucuugaaacagauuacaacuguggaggaacucgagccaaaggccaacaauugcaccaaaguacugguguggcacacacgaaccgaaaaggucaacuuagcaaaugagcccaaauaccaccuggauacggugaagaucgaaguuuga

SEQ ID NO: 53243 - RNA, 948 nt, Artificial Sequence
  derived and/or modified sequence opt3 from B3GAT3__Homo_sapiens__NP_001275652
augaagcugaaacucaagaacguguuccuugccuacuuucuggucagcaucgcuggcuuguuauaugcacugguucagcuagggcaacccugcgacugucucccuccacugagagccgcggcugagcagcuuaggcagaaagaucugcggauuucccaguugcaagccgaacuccgccgaccgcccccugcaccagcccagcccccugagccagaagcucugcccaccauauacgugguaacaccuacuuaugcacgucuggugcagaaggccgagcucgucagauuaucucagacgcugucacuugugccaagguugcacuggcugcuaguugaagacgcugagggaccgacaccccucgugaguggucugcuugccgcgagcggccuguuguucacccaucucgucgugcugacuccuaaagcacaacgguuacgcgagggggaaccaggauggguacaccccagaggcguugagcagaggaauaaggcccuggauuggcuccggggucgcgggggagcugugggcggcgaaaaggacccuccacccccggggacccagggagucguguacuuugccgaugacgauaacacauauucccgagagcuuuucgaggaaaugagauggaccaggggugugucugucuggccuguuggccugguagggggauugcgguuugagggcccccaggugcaagacggucguguggucggguuccauacugcaugggaaccaucgcgcccuuuucccguggauauggcuggauucgccguugcgcuaccacugcuccuggacaaacccaaugcccaguuugauucaacagcaccuagaggccaccuugagagcagucuguugucccaucucguggacccaaaggaucuggaaccgagggcugccaacugcacccggacggagucucgaugugucacucaggcuggcgugcaauga

SEQ ID NO: 53244 - RNA, 1194 nt, Artificial Sequence
  derived and/or modified sequence opt3 from B3GNT2__Homo_sapiens__NP_001306004
augagcgugggcagaaggcggaucaagcugcucgggauucuuaugauggccaacgucuucauauacuuuaucauggagguuuccaaaucuucaagucaggaaaagaauggaaaaggugaggugauuauccccaaggaaaaauucuggaagauuagcaccccuccagaggcuuauuggaaccgcgaacaagagaagcugaaucgacaguacaacccgaucuuguccauguuaacaaaucagacuggcgaggcagggcgucugucuaacauaucgcaccuaaauuauugcgaacccgaccucagaguaacgucaguggucaccggauuuaacaaucugccugauagguucaaagacuuucuucuguacuugcggugucgcaacuauagccuccugaucgaucagccagacaagugcgccaaaaagcccuuccugcucuuagcgauuaaaagucugacaccucauuuugcuagaaggcaagccauccgggaguccuggggccaggaaucuaaugcagguaaccagacugugguucgcguguuccuuuuggggcagaccccacccgaggauaaucacccugaccugagcgauaugcuaaaguuugaguccgaaaagcaucaagacauucucauguggaacuaccgagauacauucuuuaaucugucacuuaaagagguccuguucuugagaugggugaguaccagcuguccagacacugaauuuguauucaagggagaugacgauguuuucgugaacacacaccauauccucaacuaucuuaauucuuuauccaaaaccaaggccaaagaccuguuuauaggcgacgucauucacaacgcuggcccgcacagggauaagaaacucaaguacuacauccccgaggugguguauucagggcuuuacccuccauaugcaggagguggcggguuccuguacagcggacauuuggcccuacggcuguaucacauuacggaccagguccaucucuaccccaucgaugacguuuauacuggcaugugccugcagaagcugggucuggugccugaaaaacacaagggguuucguaccuucgauaucgaggagaaaaauaagaacaauauuuguaguuacguagacuugaugcucgugcacucucgcaaaccacaggaaaugauagauaucuggucccaacugcagagcgcucauuuaaagugcuga

SEQ ID NO: 53245 - RNA, 1119 nt, Artificial Sequence
  derived and/or modified sequence opt3 from B3GNT3__Homo_sapiens__XP_011525929
augaaguaccugagacacaggcggcccaacgccacccucauccuugcuauuggcgcauucacacuguuguuauuuagccugcuaguguccccuccaacuugcaaaguccaggagcaaccgcccgccauaccugaagcgcucgcuuggccaacgcccccuacccgcccagcccccgcaccuugucaugccaauacaucuaugguuacucacccagacuucgcuacccagccgcagcaugugcagaacuuucugcuuuaucgacacugccgucauuucccccuguugcaagauguaccuccaucaaagugugcacagcccguguuucuccugcuggucaucaaaaguagcccuuccaauuacgugagaagggagcucuuacggcgcacaugggggagagaaaggaagguucggggacugcagcuucgcuugcuguuccuaguggguaccgccucuaacccacacgaggcucgaaaagucaauagacuccuggaacuugaggcccagacucacggcgacauucugcaaugggauuuucaugacucguucuuuaacuugacacucaaacaggugcuguucuuacaguggcaggagaccaggugcgcgaaugcaucauuuguacugaacggggaugacgauguuuucgcccacacggacaauaugguguuuuaucuccaagaucaugaccccggacggcaccuuuucgucggccagcugauccagaacguggguccgauucgugcuuucuggagcaaguacuaugugccugaagucguuacucaaaaugagcgcuaucccccauacugugggggaggcggcuuuuugcuaaguagauucaccgccgcagcucugaggcgggccgcgcacgugcucgauaucuuuccuauagacgauguauuccuggggaugugccuugaacuggagggauugaagcccgccucccauucugguauccgaacaagcggcgugcgcgcaccaucccagagacucucaaguuuugaccccuguuucuacagggaccuguuacugguccaccgguuucuaccuuacgagaugcuccugaugugggaugcucuuaaccagccaaauuugacuugcgggaaccagacccaaauuuauuga

SEQ ID NO: 53246 - RNA, 1137 nt, Artificial Sequence
  derived and/or modified sequence opt3 from B3GNT5__Homo_sapiens__XP_011511531
augagaaugcuggugagcggcaggcgggucaagaaauggcagcucaucauucaacuuuucgcuaccugcuuucuggccuccuugauguucuuuugggagcccauagacaaccacaucguuucucauaugaagucauacaguuaucgcuacuuaauuaauagcuaugauuucgugaacgacacacugucccuaaaacacacuucugcagggccucgauaccaguaucucaucaaucauaaggaaaaaugucaggcccaggauguacugcuucuguuguuugugaagacggcgccagagaacuacgaccguagaucgggaauuaggcggaccugggguaaugaaaacuauguccgcucacaacucaaugcuaacaucaagacacuguucgcccugggcacuccgaauccccucgagggggaagaguuacagagaaaacuggcaugggaggaucagagguacaacgacauaauccagcaagauuuuguggacagcuucuacaaucuuaccuugaagcugcuaaugcaguuuaguugggccaacacauauugcccucacgcuaaauuccucaugaccgcagaugacgauauuuuuauccauaugccaaaucugauugaauaccuucagucccuggagcagaucggaguucaagacuucuggauaggccgggugcaccgcggugcucccccuauucgagauaagucuagcaaauauuacgucuccuaugaaauguaccaguggccagccuaucccgacuacacugccggggcggcauacgugaucucaggagacguagccgcuaagguuuaugaggccagucagacauugaacagcucucucuacauugaugacguguuuaugggccugugugcaaauaagaucggcaucgucccucaagaucacguguucuucuccggggagggaaaaaccccauaucauccgugcauuuacgaaaagaugaugacgucacacggucauuuagaggaccugcaggaucucuggaaaaacgcuacugaccccaaggugaaaaccauaagcaagggcuuuuucgggcagaucuauuguagacuuaugaaaauuauccuguugugcaagauaaguuacgucgauacauauccuuguagggccgcguuuauuuga

SEQ ID NO: 53247 - RNA, 1155 nt, Artificial Sequence
  derived and/or modified sequence opt3 from B3GNT6__Homo_sapiens__NP_619651
auggccuuccccugcagaaggagccugaccgcuaagacacucgcaugucuucuggugggcgucuccuuuuuggccuuacagcaaugguuccugcaggcgccucggucuccacgcgaggaacgaucaccgcaggaggaaacucccgaggggccuacggacgcuccagccgcagaugaacccccuagugagcuaguuccaggacccccuugcguggccaacgcuagcgcaaaugccaccgcugacuuugagcagcucccagcccguauccaagauuuccugagauacaggcacugucggcauuuuccgcuucugugggacgcgcccgcaaaaugcgccgguggccgcgggguauucuugcuccuggcugugaaguccgccccugaacacuaugagagaagggaacugauucggcgcacauggggacaggagcgaucuuacggcgguagaccagucaggcggcucuuuuuacuggggacucccggaccugaggaugaagcacgugcugagcgccuugccgaauugguggcgcuggaggccagagaacauggcgacguucuacagugggcauucgcugauaccuuucucaaccugacacuuaaacaccuucauuugcucgacuggcuggccgcuagguguccacacgcccgguucuuacugucgggcgaugacgauguguuuguccacaccgcaaaugugguacgauuccuccaggcccaacccccggggcgccaucuguuuucaggacagcugauggaggguagcguuccuauaagagacaguugguccaaguauuucgugcccccacaguuguucccuggcucugcuuaccccgucuauugcagcgggggaggcuuucuacuguccgguccaacugcgagggcacuccgggccgcugcccgccacacaccccuguucccuaucgaugacgcauacauggggaugugucuugagagagccggacuggcuccaucaggccaugaaggcauuaggccguuuggggugcaguugcccggagcccaacagaguagcuucgacccuugcauguaucgugagcuccuguuagugcaccgguuugcaccauacgaaaugcugcuaauguggaaagcgcuccacucucccgcucuguccugugaucgaggucauagagucucauga

SEQ ID NO: 53248 - RNA, 1194 nt, Artificial Sequence
  derived and/or modified sequence opt3 from B3GNT8__Homo_sapiens__NP_940942
augagaugccccaagugucugcucugccuuagcgcccuguugaccuuacugggccuaaaaguguacaucgaguggacauccgaaucuaggcucucaaaggcuuauccuaguccacgggggacuccgcccagcccuacgccagcaaaccccgagccuacccugccagccaaucuuuccacacgccugggacagacuauucccuugccuuucgcguacuggaaccaacagcaguggcgacucgguucucugccaucgggcgacucaaccgaaacagggggaugucaggcuuggggcgccgcagccgcuaccgagauaccggauuuugcaagcuaucccaaagaccugcguagauuccucuuaagugccgcuugcagguccuuuccucaauggcugccaggugggggaggcucucaggucagcuccuguucagauacugacguucccuaccuuuugcuggccgugaagagugaaccuggccgguucgcggagcgccaggcaguaagagagacaugggggagcccagcccccggaaucaggcuacucuuucugcuugguucuccggugggcgaagcugggccugaucuggacuccuuggucgccugggagucacggcgcuauagcgaucuccuguuaugggacuuccuggaugugcccuuuaaucagacccucaaagaccuucuguugcuagcauggcugggacgacacugcccaacgguuaguuucgugcucagagcucaagaugacgccuuuguccauacuccugcgcugcuugcccaccugagggcauugcccccagcuucugcccggucccucuaccugggcgaaguguucacccaggcuaugcccuuacguaagccuggugggccauuuuauguaccggagagcuucuuugagggaggcuaccccgccuacgcaucgggcgggggauauguuauugccggucgccuggcuccuuggcuacucagagcggcagccaggguggcuccauuccccuucgaagaugucuacacaggccuguguauccgggcccuuggguuggugccucaggcacauccaggauuucugacugccuggcccgcugaccgaaccgccgaccacugcgcauuccgcaaccuccugcuugugagaccgcugggcccucaggcgucuauuagguuguggaagcaacuccaggauccacggcugcaguguuga

SEQ ID NO: 53249 - RNA, 1086 nt, Artificial Sequence
  derived and/or modified sequence opt3 from B3GNTL1__Homo_sapiens__XP_006722335
augagcggcgccggggugggaggugcuuccgaggaaucucaggcaaugcaagcccacgucucaaucauucugcccguucauaacgcggagccuuggcucgacgaaugccuuagaagugugcugcagcaggauuucgagggcaccauggaauugagcguauuuaaugacgcuuccaaggauaaaucuggggccauaaucgagaaguggagggugaaauuagaggacucgggaguccacgugauuaucggcggucaugauucaccaagcccgcgcgggguuggauacgcaaagaaccaggccguggcucaaaguuccggcucuuaucuguguuuccuagacagcgaugacgucaugaugccccagcgggugcgacuccagcacgaagcagccguacagcauccuuccucaauuaucggcugccguguuagaagggauccacccaauaguacagagcgguacacucgcuggauaaaccaacugacgccugaacagcuucugacccagguguuuacaagcaaugggccaacugucaucaugcccaccugguucuguucuagagcuugguuuucccacgugggaccuuucaacgaggguggccagggggugccagaggacuugcucuuuuucuaugaacaccugaggaaaggaggcggugucauucggguugaucaaucacugcucuuauaccgccaucacccgcaggccgcgacacauugcgugcuggagaccacuaucuggacacaccgaguaagauuucuugaggaacaggcauugcccaggugggccgcuuucaccauuuggaaugccgggaagcaaggacggcgucuguaucgcagccuaacggcaggcagucagagaaagguggucgcuuuuugugacguggaugaaaacaaaaucaggaagggcuucuacugccacgaggacucucaggagcggccuaaaccacgaauacccauucuccauuuucgcgccgcgagaccuccauucguuaucugugugaagcuggaccuuacugggggagccuucgaagauaaucugagguccuugcaccuccaggagggucaagacuuucugcauuucagcuga

SEQ ID NO: 53250 - RNA, 987 nt, Artificial Sequence
  derived and/or modified sequence opt3 from B4GALNT1__Homo_sapiens__NP_001263398
auguggcugggcagaagggcccucugcgcucuugugcuguuguuagcaugugccagccuggggcuacucuacgcguccacccgggacgcucccggacugcgccuuccucuggccccaugggcaccgccccagucuccucgacguccagaguugcccgaucucgccccugaaccaagauaugcucacauccccgucaggauuaaggagcaaguugugggucugcuggcauggaacaauugcucaugugaaaguagcggcgggggacucccuuuaccauuccagaaacagguacgggccauagaccugacaaaggcuuuugauccggccgagcuucgcgcggcauccgccacuagagaacaggaguuccaagcauuuuugucuaggucgcagucacccgccgaccagcugcuaaucgcuccugcuaacagcccacuccaguacccccugcaaggcguggagguccagccucuucggaguauucuggugccagguuugucccuccaggccgcgucugggcaggaaguuuaucaagugaaucugacggccagcuuaggaaccugggaugucgcaggcgaggugacaggcguaacucugaccggggaaggacaggcugaccucacacuuguuucccccggucuggaucaguugaaccgccaacuacagcuggugaccuacucaagucgaagcuaucagacuaauacagccgacaccggcgcuagaccgggguggagggauggacaggccggccaaacggagaaaaaccagaaggguuggucugggcagauggcagagggaaugggcggcaucugggccauggcucgggcgguccagccucauaaugggugcuucaacuggacuucccgugcacgcggaagaaaaggugccuuugugcaccucggccuggaacaagcuagggggaagcccgagccaugggugugucuuccuuuccggcccaccgucggaggcccacgaaagcgccugguuuga

SEQ ID NO: 53251 - RNA, 1521 nt, Artificial Sequence
  derived and/or modified sequence opt3 from B4GALNT2__Homo_sapiens__NP_001152859
augaccagcggcggguccagauuccuguggcuccuuaagauccuggugauuauauuggucuuaggaaucguugguuuuauguucggcucuauguuucugcaggccguguucucaagucccaaaccugagcuaccaagcccggcucccgggguacaaaagcucaaacugcuuccugaagagaggcugcggaacuuguuuuccuacgacggaauuuggcuguucccaaagaaucagugcaaaugugaagcaaacaaggagcagggcgguuauaauuuucaggaugccuacgggcaaucugaccuccccgcggugaaggcucgccgacaggccgaguucgaacacuuucagcguagagagggacugccuaggccacuccccuuacugguccagccuaaccuuccauucggcuauccggugcauggcguugaagugaugcccuugcacacagucccuaucccagggcugcaauuugagggacccgaugcaccuguguacgaaguaacucuaacggccucgcucgguacccugaauacacuugcugacguuccagauucagugguccagggccgggggcagaaacagcugauuaucagcaccagugaccgcaaguugcucaaauucauacugcaacaugugacuuauacauccaccggauaccagcaccagaagguggauaucgucucuuuagagagcagauccucaguugcaaaauuucccgugacuauuaggcauccgguaaucccuaagcuguaugaccccggcccagagcggaagcuccgcaaccuugugacaauugccaccaaaacguuccugcgaccucacaaguugaugaucaugcuaagaaguauaagggaauacuaccccgaucugacugucauuguggcugacgauagccaaaaaccacucgagaucaaggacaaucacguugaauauuacaccaugcccuucgguaaagggugguuugccggacggaaccuggcgauuucucaggugacaacuaaguauguccuuuggguggaugacgacuuccuguuuaaugaggaaaccaaaaucgagguauugguugaugugcucgagaagacagaacuggacgucgugggcggcuccgucuuagggaacguguuccaguuuaagcugcuacucgagcagucagaaaauggagcaugccugcauaaacguauggguuucuuucaaccucuugauggcuucccaagcuguguugugaccagugggguagucaacuuuuucuuggcccacacggagcgccugcagagagugggauuugacccgaggcuccagcggguugcucauucugaguucuuuaucgauggccuggguacucuucuggugggguccugccccgaagucauuauaggccaccagagccgaucgccugugguagacucugaguuggccgcacucgaaaagacauacaauaccuaucgcuccaacacucugacaagagugcaauucaaauuagcucugcacuacuucaagaaucaucuacagugugccgcguga

SEQ ID NO: 53252 - RNA, 2997 nt, Artificial Sequence
  derived and/or modified sequence opt3 from B4GALNT3__Homo_sapiens__NP_775864
augggcagccccagagccgcuaggccuccacugcuccuucggccggugaagcuguugcgccgacguuucagauuacugcuagcacucgccgucguuuccguggggcuguggacccuuuaccuggaguugguagcgucugcucaggugggagguaacccccucaauaggcgguauggcucauggcgcgaacuggccaaagcacuggccaguagaaacaucccugcugucgacccacaccuccaauuuuaccauccccagagguuaagccuggaggaucacgacauugaucaggggguguccucuaauucgucauaucuuaaguggaacaaaccuguuccaugguugagcgaguuccggggacgcgcaaaucugcauguguuugaagacuggugcggcaguuccauacagcaacuacgaagaaaccuccacuucccccuguacccucauaucaggacaacucuucggaagcuggccgucucuccaaaauggacgaauuaugguuugcguauuuuuggguaccuccacccguucaccgauggaaagauccaguuugcuauugccgcggacgauaacgcagaguucuggcugagcuuagacgaucagguguccggccugcagcuccuugccucaguaggcaagacagggaaagaauggacugcucccggagaguuugguaaguuccgcagucaaaucagcaaaccuguuucucuguccgccucacacagauauuacuuugaaguguugcauaagcagaaugaggaaggcaccgaccacgucgagguggcauggaggcggaacgauccaggggcuaaauucacaauaaucgacagccuaagucugucucucuuuaccaaugagacuuuccugcagauggaugaagugggacauauuccccagacagccgcgucccacgucgacagcucgaacgcccuuccucgagacgagcaaccacccgcagauaugcugcgcccggacccuagagauaccuuguacaggguuccccucaucccaaagucucaucugcggcacguguuaccugacugucccuauaagccauccuaccugguagauggccuaccccuccagcgcuaucagggucugagauucgugcaccuuucauuugucuacccuaaugacuauacgagguugagucauauggaaacucacaacaaaugcuucuaccaagagaaugcuuauuaccaggaucguuuuagcuuccaggaauacauuaagaucgaccagccagagaaacaagggcuggagcagccgggauuugaagagaaccuccuggaagagucccaguauggcgaaguggccgaggagacccccgcuucuaacaaucagaacgcccggaugcuugaaggccgacaaacuccugcaagcacacuggagcaggaugccaccgacuacagauugaggucacuccgcaagcuguuagcucagccacgggaagggcugcuagcgcccuucaguaaaagaaauuccacagccagcuuuccuggaaggaccucucauauaccaguucagcaacccgagaagcgcaaacagaagccgucaccugaaccaagucaggauagcccccacuccgacaaguggccucccggucacccagugaaaaaccucccucagaugcgaggcccccggccacguccggcaggggacucuccuagaaagacgcaauggcugaaucaggucgagucguauauugcugagcagaggcgcggagaucggaugagaccccaagccccaggcagggguuggcauggggaagaggaagugguagcagccgcuggccaggagggacagguugagggcgaagaggaaggggaggaagaggaggaagaggaagacaugagcgagguguucgaauacguccccguguuugauccugucgugaacugggaccagacuuucuccgcccgaaaucuugauuuucaagcauugcgcacagacuggaucgaucugucauguaacaccaguggaaaucuccuguuaccagagcaggaggcgcuggaaguuacucggguguuccuuaaaaaguugaaccagagaucuaggggucguuaucagcuccaacgcauuguaaaugucgagaaacggcaggaccagcugagaggcgggagguaccuacuggaacucgagcugcuugaacagggacaacgagugguucgguugagcgaguauguguccgcucgcggcuggcaggguaucgaucccgccgggggcgaggaagucgaggcaagaaaccugcagggauuagugugggacccucacaauaggcggcgacaaguacucaacacaagagcccaggaaccgaagcugugcuggccacagggcuuuucauggagccaucgcgcugugguucacuucgucgugcccgugaagaaucaggccagguggguccaacaguucaucaaagauauggagaaccuuuuucagguuaccggggacccucacuucaacauugugauaacggauuacucuuccgaggacauggacguggaaauggcacugaagcguaguaaauugcggagcuaccaguauguaaagcucucuggaaauuuugagagauccgcuggucugcaagccggcaucgaucuagucaaagacccacauucaauuaucuuccugugugaucuccacauacauuuucccgcgggggugauugacgccaucaggaagcacugcguugaaggaaagauggcuuucgcaccuauggugaugcgccugcauuguggcgccaccccgcaguggcccgaggguuacugggaagucaacggguuuggccuuuugggaaucuauaaaagugaucuggaccgaauuggcgggaugaauacaaaggaguucagagaucgguggggaggcgaggacugggaauuacucgauaggauccugcaggcuggucuugacguggagcgccugagccuacguaacuuuuuccaccacuuucauucgaaaagagggauguggucccggaggcagaugaagacucucuga

SEQ ID NO: 53253 - RNA, 1197 nt, Artificial Sequence
  derived and/or modified sequence opt3 from B4GALT1__Homo_sapiens__NP_001488
augagacugagggagccccuccuuagcggcuccgccgcuaugccuggggcaucucugcagcgggccugccgcuuguuaguggcggucugugcucugcaccuaggaguuacccucguguacuaucuggccggucgagaccuuucacgucugccacaauugguaggcgugaguacaccgcuccaagggggaagcaacuccgcagccgcuaucggccagucuucgggugaacugagaacugggggagcaaggcccccuccaccccugggcgccucaagccagccucggccaggcggggauaguucccccgucguggacucuggaccugguccagcuagcaaucucacguccguuccggugccccauaccacagccuuaucacugccugcgugcccagaggaaaguccccuuuuggucggcccuaugcugauugaguucaacaugccaguggaucuagaacucguagcaaagcagaaucccaacguuaaaaugggagggcgcuacgccccgagagacugugugagcccucacaaggucgcuauaaucauucccuuuaggaaucggcaggagcaucugaaauauuggcuuuacuaucugcacccaguguugcagcgccagcaacucgauuacggcaucuaugugauuaaccaggccggugacacuaucuucaaucgagcaaagcuguuaaacgucggguuucaggaggcucugaaagauuacgacuauaccugcuucguguuuucugauguugaccucauaccuaugaaugaucauaacgccuacagauguuucucccagcccaggcacaucucaguagcgauggacaaguuuggauucagccuuccauacgugcaauauuuuggcggcgucagugcccugucuaagcagcaguucuugacaauuaauggguuucccaacaauuacuggggaugggguggcgaagaugacgacaucuucaaccggcuaguguuucgugggauguccauuagccgcccuaaugcaguugugggaagaugcaggaugauccggcacucgcgagauaaaaagaacgagccaaacccgcaacgcuucgacagaauagcucauaccaaagaaacuaugcugucugauggccucaauucccugacauaucagguccuugacgugcagagguacccccuguauacccagauuacgguagauaucgguacuccuucauga

SEQ ID NO: 53254 - RNA, 1182 nt, Artificial Sequence
  derived and/or modified sequence opt3 from B4GALT3__Homo_sapiens__NP_003770
augcugagaaggcuccuugagcggcccugcacccuggccuuguuagugggcagccagcuggcugucaugauguaccuaucccucgggggauuccgcucucugucagcacuuuuuggucgagaccaaggcccuacauucgauuacagucacccacgugacguuuacagcaaccugucccauuugccgggggcccccggaggcccuccagcgccccagggucucccuuauuguccagaaagaucuccccugcugguggggccuguaucggugucauuuagcccagucccgagucucgcugagaucguggaaaggaauccccggguugagccuggaggccgcuacagaccagccggcugcgaacccaggucccggacugcaauuauagugccucaccgcgcccgagagcaucacuuaagacugcuuuuguaucaucugcacccauuccuacagaggcagcaacucgcuuacgggaucuaugucauucaccaggcaggaaacgguacguuuaaucgggccaagcugcuuaacgugggcguacgugaggcucugcgcgaugaagagugggacuguuuguuccuccaugauguugaccuguuacccgaaaaugaucacaaccuguacgugugcgacccgagagggccuaggcaugucgccguggcgaugaauaaauuuggauacucucuccccuauccacaguacuucggcggugugagcgcacuuaccccugaucaguaucugaagaugaacggguuucccaaugaguacuggggauggggcggcgaggacgaugacaucgccacacggguccgauuggcugggaugaaaauuucccgcccacccacuucaguuggacacuauaagauggugaaacacagaggugauaagggcaacgaagagaauccucauagguucgaccuacugguacggacccaaaacaguuggacacaggacgggaugaauagccucaccuaccagcugcuugcccgcgaacugggaccauuguauacuaacaucacagcagauauaggcaccgacccgagaggucccagggcuccuucugggccacguuaucccccuggcuccucacaggccuuucggcaagagaugcuccagcgaagaccacccgcgaggccgggaccucugagcacggccaaucacacugcauuacgcggcagucauuga

SEQ ID NO: 53255 - RNA, 1035 nt, Artificial Sequence
  derived and/or modified sequence opt3 from B4GALT4__Homo_sapiens__NP_997708
augggcuucaaccugaccuuucaccucagcuacaaguucagacuucuguuguuacugacacuaugccucacuguggucgggugggccacguccaauuauuuuguuggagcuauccaggagauucccaaagcaaaggaguucauggccaacuuucauaaaacccugauacuugguaagggcaaaacacugacuaaugaggcgucuaccaagaagguggaauuggacaacuguccuucaguaaguccauaccucagggggcaaagcaaacugaucuucaagccggaucugacacucgaggaagugcaggcugagaaucccaaagucucccggggacgcuaucgaccucaggagugcaaggccuuacagcguguggcaauucugguuccacacagaaacagggaaaaacaucuuauguacuugcuggagcaccuacaucccuuucuccaacggcagcagcuggacuauggcaucuacgugauucaccaggccgaagguaagaaguucaaucgcgcuaaacuucugaacgucggguauuuggaggcacucaaggaggaaaauugggauuguuuuaucuuccacgacguggaucugguaccugagaacgacuuuaauuuauacaaaugcgaagaacauccaaagcaccugguugugggaagaaacucuaccggcuacaggcuccgguauucgggcuacuucgggggagucacugcccuuucacgcgaacaauuuuucaaagugaaugguuucagcaacaauuauuggggcuggggaggggaggaugacgaucugcgauugagaguggagcuacagaggaugaagauaagucggccccugccugaagucggcaaauacacaaugguuuuucauacccgugacaaggguaacgaggugaacgcugaacgcaugaagcuccugcaccagguauccagaguguggaggacggaugggcuuucuagcuguuccuauaaacuggucucaguggagcacaauccauuguacaucaacauuacuguugacuucugguuuggagccuga

SEQ ID NO: 53256 - RNA, 1167 nt, Artificial Sequence
  derived and/or modified sequence opt3 from B4GALT5__Homo_sapiens__NP_004767
augagagccaggcggggccugcuccgccuuccccgacguagccuguuggcugcauuauucuuuuucucccugucuucaagucuacucuacuuuguguaugucgccccugggaucguuaacaccuaccuguucaugaugcaggcgcaagggauucuuauaagagacaaugugaggacaaucggugcucagguauaugaacaggugcugcggagcgccuacgcaaagcgcaacuccucugucaaugauucggacuauccauuggaucucaaccacucagaaacuuuucugcagacgaccacauuccugccggaggacuuuacuuacuucgccaaucauaccugccccgaaagacucccuagcaugaaaggcccaauugauaucaacaugagugagauugggauggacuauauccacgaauuauuuuccaaggaucccacaauaaaacugggaggccauuggaagccuucugacuguaugccaagguggaaaguggcuauccuuauucccuuccggaaucgccacgagcauuugccuguucuguuucgacaccuacucccaaugcugcaaagacagaggcuucaguucgcauuuuacguggucgaacagguggguacccaaccguucaaccgggccaugcuguucaauguaggguuucaggaggcuaugaaggauuuggacugggauugccucaucuuccacgacguugaucauauucccgagagcgaccguaacuacuauggauguggccagaugccucgccacuuugccacuaagcuggacaaauacauguauuuacugccauacacagaguucuuuggcgggguguccggacucaccgucgagcaguucagaaagaucaaugguuuucccaacgcguucuggggcuggggaggagaggaugacgaucuuuggaauagggugcaaaacgcaggcuauucagugagucggccugaaggugacacggggaaauacaagagcauaccacaucaccaccgaggagagguccaguuucugggccgcuaugccuugcuaagaaaaucuaaggaaaggcagggccuggaugggcucaauaaccugaacuacuucgcuaauauuacuuacgacgcccuuuauaagaacaucaccguuaaucugacacccgaguuggcacaagugaacgaauacuga

SEQ ID NO: 53257 - RNA, 1149 nt, Artificial Sequence
  derived and/or modified sequence opt3 from B4GALT6__Homo_sapiens__NP_004766
augagcgugcugagaaggaugaugcgggucuccaaccgcucucuccuugccuucaucuuuuucuuuucacugaguagcuccugcuuguacuucauuuauguugcucccggcauagcaaauaccuacuuauuuauggugcaggcccgagggaucaugcugcgugagaacguaaagacaauuggacacaugaucagacuauauacuaauaaaaacucuacgcucaaugguaccgacuacccugaaggcaacaauucgucagauuaucuggugcaaacaacuaccuaccuuccagagaacuucacauauagcccguaccugcccuguccugaaaaguugccauacaugaggggguuucucaaugucaacgugagugagguuuccuucgacgaaauucaucagcuguuuucuaaagaucuggacaucgagcccggaggccacuggcggccuaaggauugcaaaccacgcuggaagguggcgguccucauacccuucagaaauaggcaugagcacuuaccuaucuuuuuccugcaucuuauuccaauguugcagaagcagcggcuggaauuugcuuucuaugugaucgagcaaaccgguacucagccguucaaccgcgccaugcuauuuaauguaggguucaaagaagcaaugaaggacagcguuugggauugugugauuuuucacgacgucgaucaccuccccgagaacgaccgaaauuacuauggaugcggcgagaugccuagacauuucgccgcuaaacuggauaaguacauguauauccuuccauacaaagaauuuuucggcgggguguccggacugacaguggagcaguuuaggaagauaaacgguuuccccaacgcauuuuggggcuggggaggggaagacgaugacuuguggaaucggguccacuaugccggcuacaacguuacccguccugagggugaccucgggaaguacaaaucaauuccacaucaccaccgcggagaagugcaguuccugggcagauauaaguuacugagguacaguaaagagcggcaauauaucgauggccucaauaaccuuauuuaccgacccaagauccugguagaccgcuuguauacgaauaucagcgugaaccuaaugccggagcuggcuccuauugaagauuacuga

SEQ ID NO: 53258 - RNA, 984 nt, Artificial Sequence
  derived and/or modified sequence opt3 from B4GALT7__Homo_sapiens__NP_009186
auguuccccagcagaaggaaggccgcucagcugccuugggaggacggccgguccgggcuccuuucuggaggucugccacgcaaaugcucaguguuucacuuguucgucgcauguuuaagucugggcuuuuucagccuacucuggcugcaacuuuccugcucuggggauguugcccgagcggugcguggacagggccaggaaaccucggguccgcccagagcuuguccuccagagcccccuccagaacauugggaggaagacgccucaugggggccccacaggcuggcaguauuggugccuuuucgggagcgcuucgaggaacuccuggucuuugugccacauaugagaagguuccugagccggaagaaaauccgccaccauauuuacguucucaaccagguggaucacuuucgauucaauagagccgcuuuaauaaacgucggauuucuggagaguuccaauucuacagacuauaucgcaaugcacgauguggaccuuuugccgcugaacgaagaacuagauuacggcuuccccgaggccggcccuuuucauguagcuagcccagaacuccacccccuguaucauuacaagacuuauguuggggguauucuucuguuguccaaacaacacuacaggcucugcaauggaaugucaaaccgguucuggggcugggggcgugaggacgaugaguucuaucgcagaaucaagggagccggccugcaguuauuuaggccuagugguauuacgaccggguacaagacauuccggcaucugcacgacccagcguggcgaaaacgcgaucagaagagaaucgcagcccagaaacaagagcaguuuaagguggacagggaaggaggccucaauacugucaaauaccacguggcuagccggaccgcccuuucugugggcggggcacccuguacaguccugaacauaauguuggauugcgacaagaccgcuacuccgugguguacauucuccuga

SEQ ID NO: 53259 - RNA, 1248 nt, Artificial Sequence
  derived and/or modified sequence opt3 from B4GAT1__Homo_sapiens__NP_006867
augcagaugagcuacgccaucagaugcgcuuucuaucaacugcuccuugcagcccugauguugguggcgauguuacagcugcuauaccucucccugcuuucuggccugcacgggcaggaggaacaggaccaauauuuugaguucuuucccccuucaccaaggagugucgaucagguuaaggcucaguugcggaccgcccucgcaagcggaggugugcuggacgccuccggcgauuaccgcguauaucgagggcugcucaaaacaacuauggacccgaacgaugugauuuuagcuacgcaugcaucugucgacaaucugcuucacuugucgggacugcuagaacguugggagggcccccucucagugagcguuuucgccgcuaccaaggaagaggcccagcuggcgacagugcuugcauacgcccugaguucccauuguccugauaugagagcuagggucgccaugcacuuggugugcccaucucgguaugaggcagcuguacccgacccucgcgaaccaggugaguuugcccuccugagaagcugucaagaaguuuucgauaaauuagcgaggguggcccagcccgggauaaacuacgcacugggaacuaaugucuccuacccuaacaaucuccuucggaaccuggcucgcgagggcgccaauuaugcuuuggugaucgacguggauauggucccaucagagggccuauggcgagggcugagagaaaugcucgaccagaguaaccaguggggagguaccgcccugguugugccggcauuugagauuaggcgggcccgucgcaugcccaugaauaagaacgaacuuguacaacuguaccaggugggcgaggucagaccuuucuauuacggguugugcacaccaugucaggcucccaccaauuauucuaggugggugaaccucccugaagagagccuguuacggccagcguacguugugcccuggcaagauccgugggagccuuuuuaugucgcaggaggcaaagugcccacuuucgacgaacgauuucgccaguacgguuucaauagaaucucccaggccugcgagcugcauguagcuggguuugacuucgaaguucuaaacgagggauuccucgugcacaagggcuuuaaggaagcccugaaauuccacccacagaaggaggcagagaaucaacauaacaaaauucuuuacaggcaguuuaagcaggaauugaaagccaaguauccuaacucaccccggcgcuguuga

SEQ ID NO: 53260 - RNA, 444 nt, Artificial Sequence
  derived and/or modified sequence opt3 from B9D1__Homo_sapiens__NP_001230404
augaugaccagcacagccuccacugcucugugcacggcaagaaccgggcccccucagaggguguggcggcgcggcucucaccgaucacauccacgugccaagauguguggaaaacacuggugcgguacaaguccgcucaugagcccccuuaaggcgccuacuccaaccgcuggccauagauccuguucugccugcauggaccaaauguguucggggacaaugugguucgaggcaaugggacccugcaccuguccuucacaccuggccggcacuaaagguccaagccccugcuugagucagaacuuaaggcugaauugucggucccuacaggcugggucuuggggaggcggcccuagcacacagaccccacgcugguggcucagagucaaggcagggaaaccgcccuccggacugucaguuaaggauaguagcgugucuagguga

SEQ ID NO: 53261 - RNA, 528 nt, Artificial Sequence
  derived and/or modified sequence opt3 from B9D2__Homo_sapiens__NP_085055
auggccgaggugcacgucaucggccagauuauaggggcuagcggauucuccgaaucuucacuguuuugcaagugggguauccauaccggcgcagccuggaaacuccuuagugggguuagagagggacaaacacagguggacacuccccagauuggcgauauggcguacuggagccacccuaucgaccugcauuucgcuacgaaggguuugcagggguggccaagguuacacuuucaaguauggucccaggauucuuucggacggugucagcuggccggcuauggcuuuugccaugugccgucgucacccgggacccaccagcuagcauguccuacauggcgcccacucggaagcuggcgagaacaacuggcccgugcuuucgucgguggcgggccccagcuucugcacggagacacuauuuacaguggcgcagauagauauagguugcauaccgccgcuggugggacagugcaccucgagaucggacugcugcuccggaacuuugaccgcuacggcguugaaugcuga

SEQ ID NO: 53262 - RNA, 165 nt, Artificial Sequence
  derived and/or modified sequence opt3 from BAALC__Homo_sapiens__NP_001019543
augggcugcgggggaagcagagccgacgcuaucgagcccagguacuaugaauccuggacccgggagacagaaucuacuuggcugacguacaccgauucagacgcaccuccaagugccgcggcuccggauagcggucccgaggccggcgggcuccacuccggauga

SEQ ID NO: 53263 - RNA, 1257 nt, Artificial Sequence
  derived and/or modified sequence opt3 from BAAT__Homo_sapiens__NP_001692
augauccagcugaccgccacacccgugagcgcucucgucgacgagccuguucacauuagagcaacuggccuuauaccauuccaaaugguguccuuucaggccucucuggaagaugagaacggggacauguucuacucacaggcgcauuauagggcuaaugaauuuggagagguagauuugaaccacgccaguagcuuagguggcgacuacaugggggugcauccgaugggacuguucuggucccuaaagcccgaaaaacuccugacgcggcuucugaagcgcgaugucaugaaucgaccuuuucaggugcaaguuaaauuguaugaccucgagcugaucgugaacaauaaggucgcaucugccccaaaggcuucgcugacccucgagcguugguacguggcacccggcguaacaagaauuaagguuagggaaggucgguuacgcggggcccuguuccuuccuccaggagagggcuuguuucccggcgugaucgaucuguucgggggacuagguggccuccuggaauuuagagcuucacuucuggccagcaggggguucgcgaguuuggcacucgccuaucacaacuacgaggaccugccucggaagccagaggucacugauuuagaauauuuugaggaagcugccaauuuccugcuccgccauccgaaaguguuuggauccggcgugggugucguuucugugugccaggggguacagauuggacuuagcauggcaaucuaccugaaacaggugaccgcuacagucuugauaaacggcaccaauuuccccuucggcaucccucaaguguaccacgggcagauucaccagccacuaccccauuccgcccagcugaucucaacuaacgcgcucggacugcuugagcuguaucgaacauuugaaaccacgcaaguuggugccagucaguacuuguucccuauugaggaggcacagggccaauuucucuucaucgugggggaaggagacaaaacuauaaauagcaaggcucacgccgagcaggcuauuggccagcugaaaagacaugguaagaacaauuggaccuuacugucuuauccaggggccggccaccuaaucgaacccccguacuccccucucuguugcgcaucaacaacucacgaucugaggcuucauuggggaggcgaggucauuccccacgccgcugcgcaggaacaugcauggaaggagauccaacgguuuuugcguaaacaccugaucccagacgugaccagccagcucuga

SEQ ID NO: 53264 - RNA, 990 nt, Artificial Sequence
  derived and/or modified sequence opt3 from BABAM1__Homo_sapiens__NP_001275685
auggagguggccgaacccagcuccccuaccgaggaagaggaagaggaggaggaacacucugcugaaccaagaccgaggacacggucaaaccccgagggcgcagaggaccgcgccgucggggcgcaggcuaguguuggaagccgauccgaaggugagggcgaagccgcaucugccgaugacgggucgcugaauacuucaggagcuggcccuaagagcuggcaagugccacccccugcaccagagguacagauccguacgcccagagugaacugcccugaaaaagucauuauaugucucgaucuuagugaggagaugucccugccaaaguuggaaucuuucaaugguagcaaaaccaacgccuuaaaugugucccagaagaugaucgagauguuuguuaggacaaaacauaagauugacaagucacacgaauuugcucugguggucgugaacgaugacacugccuggcuaagugggcucaccagcgauccgcgggagcugugcucuugucuuuacgaccuggaaacagcguccugcucaaccuuuaauuuggagggacucuucagccugauccagcagaaaacugagcugcccguaacagaaaacguucaaaccauuccuccacccuaugugguccgcacgauccucguguacaguagaccuccaugucagccccaguuuucuuuaacugagccgaugaagaaaauguuccaaugcccuuauuucuucuuugauguggucuacauacauaauggcaccgaagagaaggaagaggagauguccuggaaagacauguucgcauuuaugggcagccuggauacaaaggggacuucguauaaguacgaaguugcccuugcuggacccgccuuggagcugcacaacuguauggcaaaacuacucgcucauccacugcagaggccuugccagucucacgccuccuauucacuucuggaagaggaggacgaagcgaucgagguggaagccaccguauga

SEQ ID NO: 53265 - RNA, 1131 nt, Artificial Sequence
  derived and/or modified sequence opt3 from BACE1__Homo_sapiens__NP_001193978
auggugcccuucaucuaccugcaggcccacuuuacccucugcagcggcugguccucuacauauagagaccuuaggaagggggucuacguuccuuauacucaaggaaaaugggagggugaacugggcacggauuuggugucaauuccacaugggccgaacguaaccgugcgggcuaauauagcagccaucacagagagugacaaguucuuuauuaacggaagcaauugggaaggcaucuuaggucuggcguacgcugagauugcccgccuauguggggcaggauucccccucaaccaguccgaaguccuggccucugugggcggcucgaugaucauagggggaaucgaucacucacuuuauacugguagccugugguacaccccuauucgacgugagugguauuacgagguuaucauugugagagucgaaaucaauggccaggacuugaaaauggauugcaaggaguacaacuaugacaaaaguauaguggauuccgggacaaccaaucucaggcugccaaagaagguauuugaagcugcaguuaaaucuauuaaggccgcuagcuccacugagaaauuccccgacggauuuuggcugggcgagcagcucguguguuggcaagccgguacaaccccuuggaacaucuucccagucauuucauuauaccugaugggggaagugacgaaucagaguuuucggaucacuauccuuccccagcaguauuugcgcccuguggaggaugucgcgaccagccaagacgauugcuacaaguucgcaauuucucaguccucaacaggaacuguuaugggcgccgugauaauggaaggcuuuuauguaguguucgacagagcuaggaaacggaucggguuugccgucagcgcaugucaugugcacgaugaguuccgcaccgcugccguugaaggaccauucgugacacuggacauggaggacugcgguuacaacauuccgcagaccgaugagaguacgcuaaugacuaucgcguaugucauggccgcaauaugugcucucuuuaugcugccccuuugccugauggugugucaguggcgaugcuugagaugucucaggcaacagcaugacgauuucgccgacgauauuucucuguuaaaguga

SEQ ID NO: 53266 - RNA, 1557 nt, Artificial Sequence
  derived and/or modified sequence opt3 from BACE2__Homo_sapiens__NP_036237
augggcgcccuggcuagagcacuccuucugcccuuguuagcccaguggcugcuaagggcggcuccugagcucgccccagcaccguucacccugccccuucggguggccgcugcaacaaaccgcgucguugccccuacuccagggcccggaacgccugcugaacgacacgccgacggucuggcguuggcacucgagccagcccuggcuagccccgccggcgcagcuaauuuucuggccaugguggauaaccuccaaggggacuccggacguggcuacuauuuagaaaugcugaucgguaccccuccacagaaacuucagauuuugguagauacagggucuucaaauuucgcgguggccggaacuccgcauaguuacauagacaccuauuuugauacagagagaagcuccaccuacaggucuaaaggcuucgacgucacugugaaguauacacagggcucguggaccggguuuguuggagaagaucuggugacgauccccaaagguuucaacacuucauuucuagucaauauugcaaccaucuucgagagcgagaacuuuuuccucccuggcauuaaguggaaugggauccugggacuugcuuacgccacacuggcuaaaccaaguuccucuuuggaaaccuuuuucgacagccucgugacucaagccaacauacccaauguauuuuccaugcagaugugcggcgcaggucugccuguugccgggucaggaacaaacggcggcaguuuagugcuggguggaaucgagccaagccucuauaagggugauauuugguacacccccaucaaggaagagugguacuaucagauugagauccuuaaacuggaaauaggcgggcagucuuugaaucuagacugucgggaguacaacgcugauaaggcgauugucgacuccggaacgacucugcuccgccugccgcaaaaaguguucgaugcaguggucgaagccguugcuagagccucacuuaucccugaguucagcgacggcuuuuggacagguagucagcuggcaugcuggaccaauucugaaacucccugguccuauuucccaaagauuagcaucuacuugagggacgagaacucgucucgguccuuucgcaucacaauucucccucagcuguauauacagcccaugaugggggccggcuuaaauuacgaguguuaucgauucggaaucucaccaaguaccaacgcucuggugauuggcgccacgguaauggaaggguuuuacgugaucuucgauagagcacaaaagagggucggauuugcggcuagccccugcgccgagauagcaggggccgcuguguccgaaauuucuggcccuuucagcaccgaggacguugccucaaacugugugccagcacagagucuauccgaaccgauccucuggaucgucagcuacgcucugaugucugugugcggggccauucuuuugguacugaucguucuccugcuucugcccuuucggugucagcgucgcccuagagauccagagguggucaaugacgagucaaguuuggugaggcaccgguggaaguga

SEQ ID NO: 53267 - RNA, 2211 nt, Artificial Sequence
  derived and/or modified sequence opt3 from BACH1__Homo_sapiens__NP_996749
augagccuguccgagaacucuguguucgccuacgaaucaaguguccacagcaccaauguucuccuuucccugaacgaccagagaaagaaagauguguugugcgacguaacaaucuuuguggagggccaaagguuccgggcucaucgcucugucuuagcagccuguucgucauauuuucacagccgaauuguggggcaggcggauggagaacugaauauaacucuacccgaggaaguuacggugaaggguuucgagccucucauccaguuugcuuacaccgccaaacugauucuuaguaaggagaacgucgacgaagugugcaaauguguagaguuccuguccguucauaauaucgaagagucuugcuuucaguucuugaaguuuaaguuccucgauagcacagcagaccaacaggaguguccacguaaaaagugcuuuuccucacacugucagaaaacugaucugaagcugagucucuuagaccagagagaucuggaaaccgacgagguggaagaguuccuugaaaacaaaaauguccaaacaccgcagugcaaguugaggcgguaucagggcaacgccaaggcuucucccccucugcaggauagcgcaucccaaaccuacgagucaaugugucuagagaaagacgccgcucucgcccugccaagccuuugccccaaguaucgcaaauuucagaaggcguucgggacugauagagugaggacaggagaaaguucugugaaagacauucaugcauccguccagccuaaugagcggagcgaaaacgagugucugggcgguguuccagaaugccgcgacuugcaagugaugcucaagugcgaugagucgaaacuggccauggagcccgaagagaccaagaaggacccugcuucucaguguccaacggaaaaauccgagguaacuccguucccccacaauucaaguaucgauccucacggguuauacagccugucccuccuucauaccuaugaccaguacggagaucugaacuuugccggcaugcagaauacaacuguguugaccgaaaagccacuaucuggcacagacguccaagagaaaaccuucggggagagccaggaucugccccucaagucagaccugggaacgcgagaagauaguuccguggcaagcucugacagaucaaguguugagagggaaguggcugagcaccuugccaaagguuuuuggagcgauauaugcuccacugacacaccuugucagaugcagcugucuccagcggucgccaaggacggcucggagcaaaucagccagaagcgguccgaaugccccugguuggggauucguaucucagagaguccggaaccuggacagcgcaccuucacuacacucucuagcgugaacugucccuuuauuuccacccugucaacggagggcugcagcucuaauuuagaaaucgguaacgaugacuacguauccgagccacagcaagagccuugucccuaugcaugcguuauaagucugggggaugacagcgaaaccgauacagagggagacucugaauccuguucagcuagagagcaggaaugcgaggugaaacuaccauucaacgcccagaggauuaucagucucagccggaaugauuuucagucgcugcuuaagaugcauaaauugacucccgagcaacuggacuguauucacgauauccgacgcagauccaagaacaggaucgcugcccagcggugccgcaaaagaaagcucgacugcauucagaaucuggaaucugagauagaaaaacuucaaagcgagaaggaaucacuguugaaggagagggaucacauccucaguacccugggcgagacaaaacagaacuuaacuggccugugucagaaggucugcaaagaagcagcccuaucccaggagcaaauucagauccucgcuaaguacucugcggcagacuguccucugagcuuccuuauauccgaaaaggauaaaucaaccccagacggggaguuggcccugccgagcauuuuuagucucucugaccgucccccugcugugcugccacccugcgcccggggaaauuccgagccugguuaugcacgaggccaggaaagccagcaaaugucgacagccaccucagagcaggcugggccagccgaacaguguagacagucuggaggcaucagugauuucugccaacagaugacugacaaguguacgacagaugaguga

SEQ ID NO: 53268 - RNA, 2634 nt, Artificial Sequence
  derived and/or modified sequence opt3 from BACH2__Homo_sapiens__XP_005248815
augagcagacacaccggcaagaggcggaaaacacagguggaggaaacuucccaaaucucucgcaacuggaaugucuucaagucauggcagagucaggggguuaacggaaugagcguggacgagaaacccgauuccccuauguacguauaugaaucuacggugcauugcaccaauauucugcucggucuuaacgaccagcgaaagaaagauauacugugugacgucacauugaucguggagcguaaggaauuuagagcccacagggcuguuuuagcagccugcucggaguacuucuggcaagcgcuggugggccagacuaagaaugaucuagucgugucacucccagaggaaguaaccgcucggggguuuggaccgcugcuucaguucgccuauacagcaaaacuguugcucagccgcgagaacauuagagaaguuaucaggugugccgaguuucugcggaugcauaaucuggaggacaguugcuucuccuuucuccagacccaauuacugaacucugaagauggccuuuucgugugucgcaaggacgcugcaugccagcgaccccacgaggauugugaaaauagcgccggugaggaagaggacgaggaagaggaaacuauggauuccgagacagcuaaaauggccugcccuagagaccagauguugccagaacccauuucauuugaggcggcagccaucccugucgcugagaaggaagaggcccugcuaccagaacccgaugugccuaccgacacgaaagagaguagcgaaaaggacgcacucacucaguacccaagguauaagaaauaccaacuggcuuguaccaagaacguguauaaugccucuucccauucaacaagcggguucgcgaguacuuuucgggaggauaacucuuccaauagccuuaaaccgggacuggcccguggccagauaaagucggagcccccuucugaagagaacgaagaggaguccaucaccuugugccucucaggcgacgaaccagaugcaaaagaccgcgcuggggaugucgagauggacagaaagcagcccaguccugccccaacacccaccgcuccggccggagcagccugucuggaaaggagccgguccguugcuucuccuagcugcuuacgaucacuguucaguauuacgaaauccguggagcucagcggucuucccucuacuucacaacagcacuuugcgcgcaguccagcaugcccuuucgauaagggcaucacacagggggaccugaagaccgauuacacucccuucacaggaaauuacggccagccacacguaggucaaaaagaagugagcaacuuuaccauggggucccccuugagaggaccuggccuagaggcccuguguaagcaggagggcgaacucgacaggcggucugucauuuucucgagcuccgcuugcgaucaggugucaacgaguguucauucuuauagcgggguguccucacuggacaaagaccuuagcgagccagucccgaagggacugugggugggugccggccagucuuugcccuccagucaagcauacagccacgggggacucauggccgaucaucugccuggccgcaugagaccaaacaccucuugucccguaccuaucaaaguuugcccaaggucacccccguuagaaacacguacucggaccuccaguagcuguucguccuauucuuacgcugaggacgguagcgggggcucaccuugcagucugccacuaugugaauuuuccucuagccccugcucccagggagcccgauuccucgcaacagagcaccaggagccuggccugaugggggauggaauguauaaucaggugagaccccaaauaaagugugaacagucauacgguacuaacagcagugacgagucuggcuccuuuagcgaagcggauucggagucaugcccaguccaggacagggggcaggaagugaaacuuccuuuccccgucgaucaaauuaccgacuugccacgcaaugauuuucagaugaugaucaagaugcacaagcugacaucugagcagcucgaguucauucaugacgugcggagaaggaguaaaaaccgcaucgcugcccaacgaugucggaagcguaaacuggauugcauccagaaucuugaaugcgagauuagaaagcugguuugugaaaaggagaaauugcucuccgagaggaaccagcugaaggcaugcaugggagaauuacuggacaauuuuagcugucuaucucaggaggugugccgcgauauacaaagcccggaacagauccaggcccuccaccgguauuguccuguacugagacccauggaccuuccaaccgcuuccucaauuaaccccgccccuuugggcgcagagcagaauaucgcugccagucaaugcgcggucggugaaaacgugccauguugccuggagcccggggccgcuccuccgggcccacccugggcaccuagcaauacuucugagaacuguacguccggaaggcgacucgaaggcacagacccagggaccuucucagagcgcggacccccucuggaaccgcggagucagacuguuaccguggauuuuugccaggagaugacagacaaauguaccacugaugaacagcccagaaaggacuacacauga

SEQ ID NO: 53269 - RNA, 507 nt, Artificial Sequence
  derived and/or modified sequence opt3 from BAD__Homo_sapiens__NP_004313
auguuccagauccccgaguuugaaccuagcgagcaagaagacuccucuucagccgagagaggccuggggccaaguccggcuggagauggucccagcggcuccgggaagcaccauaggcaggcaccuggacuccuuugggacgccucucaccagcaggaacaaccaaccucgucaagccaucacggcggugcgggggcuguggagauucggagucgccauuccucuuaccccgccggaacagaggaugacgaaggcaugggcgaggaaccuagcccauuccgagggcguuccagaucagcacccccuaaccugugggccgcucagagguauggacgggaguugcgcagaaugagugaugaguuugucgacagcuucaaaaaggguuuaccaaggccgaaaucugcaggcacugccacgcagaugcggcaguccucaagcuggacccgcguuuuucaaaguuggugggaucgaaaucuggggagaggaucuuccgcucccagccaguga

SEQ ID NO: 53270 - RNA, 693 nt, Artificial Sequence
  derived and/or modified sequence opt3 from BAG1__Homo_sapiens__NP_001165886
augaacagaagccaggaggugaccagggacgaagaguccacacggucugaagaggucacucgcgaagagauggccgcugcaggccugacgguuaccgugacacacucaaaugagaagcaugaucuccacguaaccagucaacaggggagcuccgaacccgugguccaggaccuugcccaggugguugaggaagugaucggagucccucaaucuuuccagaaacugauuuuuaaggguaaaucguugaaggagauggagacuccauuaucagcgcugggcauacaggaugggugccgagugaugcuaaucggcaaaaagaacagcccgcaggaagagguagaacucaagaaacugaagcaucuugagaaaaguguugaaaagauugcugaccaacuggaggaguugaauaaagaacucacaggaauccagcaggguuuccugcccaaggaucugcaggccgaggcacucuguaaguuagaccguagagugaaagccaccauugaacaauuuaugaagauccuggaggaaauagauacucuuaucuugccugagaacuucaaagacuccaggcugaagcggaaagggcuagucaagaaagugcaggcuuuucucgcagagugcgauacaguggaacagaauauuugucaagagaccgaacgccugcagucuacgaacuucgcccuugcugaguga

SEQ ID NO: 53271 - RNA, 1728 nt, Artificial Sequence
  derived and/or modified sequence opt3 from BAG3__Homo_sapiens__NP_004272
augagcgccgcuacccacucccccaugaugcaaguggcaucuggcaacggggacagagauccucugccaccgggaugggagaucaagauugacccccagacagguuggccuuucuuugucgaucauaauucaaggacuacgaccuggaacgacccacggguucccagugaaggcccuaaagagacaccaagcuccgccaaugggcccucucgcgaaggaucgcgacucccuccagcgcgugagggccacccgguguacccccagcuuagaccugguuauauaccaauccccguacugcaugaaggggcugagaaccgccaggugcacccuuuccaugucuacccacagcccggaaugcaacgguuucgcacugaggccgcagccgcugcaccgcagagaucacagagcccuuugaggggcaugcccgaaaccacacagccagauaagcaaugcggccagguggccgcugccgcggcagcccagccucccgcuagucacgggccagagcggucccagucucccgccgcaagcgacugcuccucaaguucuagcuccgcuucauuaccuagcaguggaaggucuucccuggguagccaccaacuaccacgaggcuauauuucgaucccgguuauucaugaacagaaugugaccagacccgccgcgcagccuucuuuccaccaagcccagaaaacucauuacccagcacagcagggggaguaucaaacacaccagcccgucuaccacaagauccagggagaugacugggagccuaggccacuccgggcugccucccccuuucguucaagugugcagggcgcuagcucccgcgaagguucuccggccagaagcucaaccccucugcauaguccaucccccauaaggguacacacgguuguggaucggccucaacagcccaugacucaucgagagaccgcaccagucagccagccugaaaacaaacccgagucuaagccagggccggugggaccugaacuucccccaggccacauccccauucaggugauccgcaaggaggucgacucaaaaccuguuagucaaaagccacccccuccgagcgagaaaguggaaguaaaggugccacccgccccugucccaugucccccuccgucccccggcccaucugcugugccuucgagccccaaauccguugcgacagaggaaagagcagccccaucaacugcuccugccgaggcaacacccccaaagccgggggaagccgaggcuccucccaagcauccaggagugcugaaagucgaggccauuuuggaaaaggugcagggucucgagcaggcaguagauaauuucgaaggcaaaaagaccgacaaaaaguaucugaugaucgaggaauaccugaccaaagagcucuuagcgcuggauaguguugaccccgaggggagggcugacgugcggcaggcccgcagagauggagucaggaaggugcaaacgauacuugaaaaguuggagcagaaagcaauugacgucccuggccaggugcaaguuuacgaacugcagccaucuaaccuagaggccgaucagccccuccaggcuaucauggagaugggugccguggcagcugacaaggggaaaaagaaugccggcaacgcggaagauccucacacugagacacaacagccggaagccaccgcugcagccacuagcaauccauccucaaugacagacacccccggaaacccugcugcccccuga

SEQ ID NO: 53272 - RNA, 1266 nt, Artificial Sequence
  derived and/or modified sequence opt3 from BAG4__Homo_sapiens__NP_001191807
augagcgcccugagaagguccggcuacgggcccucugacggaccuucauauggucgguacuauggcccagggggaggcgaugugccgguccaucccccuccaccccucuacccucuucgcccagagcccccucagccaccgaucaguuggcgaguucguggugggggacccgcugaaaccacauggcugggcgagggcgggggaggugacggcuauuacccuagcgggggagcauggccagaacccggcagagccggugggucccaccaaucuuugaacucguauacuaauggagcguacggcccuacguacccacccggcccgggggcuaacaccgccucauauagcggagcauacuaugccccugguuacacacagaccaguuauuccacugaggugcccucuacauacaggagcuccggcaauucaccaaccccuguaagucgguggauuuauccccagcaggauugccaaacugaagcuccacccuuacgcggacaggugccuggguacccaccgagccagaaccccggcaugacacugccucacuacccauauggugacgggaauagaucugucccccaguccggcccuaccgugaggccacaagaggaugcaugggccucacccggagcuuacggcaugggagggcgguauccguggccuagcagugccccaucugcgcccccugguaaccuauacaugacggaguccacuagccccuggccaucgucuggcuccccucagucacccccaaguccgccuguucagcagcccaaggacagcuccuauccauacucucaaagcgaucagucaaugaaucgccauaacuuccccuguagugugcaccaguaugaauccagcgggaccgucaauaacgacgauucugaccuccuggauucacaagugcaguacagugcagagccucagcuuuacggaaaugccacaagcgaccauccaaacaaucaggaucaauccucuucgcugcccgaagagugcguaccuagcgacgaguccacuccgccaucaaucaaaaagauaauucacguuuuggaaaaagugcaguaucucgagcaggaagucgaggaauuugugggcaagaaaaccgacaaggcuuacuggcugcuggaggagaugcucacaaaggaauuacuggagcuugauaguguggaaaccggugggcaggacucuguccgacaagccagaaaagaggcaguuuguaagauccaggcuauuuuggaaaaacuggagaagaaaggccuauga

SEQ ID NO: 53273 - RNA, 1467 nt, Artificial Sequence
  derived and/or modified sequence opt3 from BAG5__Homo_sapiens__NP_001015049
augagauuccacuggcugcccacccucagcgagccuuuugacaggaaccaggaacuugagacaugcauccggccacuguggacuccguccggcucugccugugaaacggagcauaauaagucaauggauauggggaaccaacaccccaguauuagccgcuugcaggaaauacagaaagaggugaaguccgucgagcagcaaguuaucggauucucugguuuaucggacgauaaaaauuacaagaaacuggaacguauucuaaccaagcagcucuuugagaucgacucaguggauacagaaggcaagggggacauucagcaggcucgaaaaagagcagcccaagagacugagaggcugcuuaaggaacuggagcagaacgcgaaucauccucaccggaucgaaauacagaacaucuucgaggaagcucagagcuugguacgcgagaaaauugugccauuuuauaauggaggcaacugcgucaccgaugaguucgaagaggguauccaagacauuauccucagacugacacaugugaagaccgggggaaaaauaagucugaggaaggcccgguaccacacucucacaaagauuugugcaguucaggaaaucauugaggauugcaugaaaaagcagcccuccuuaccucugucugaagacgcccacccaagcguggcuaaaaucaauuuugucaugugugaggugaacaaggcacgcggcguacuuaucgccuugcugaugggcguuaauaacaaugagaccugccgacaucuauccugugugcucucagggcugauugcugaucuugacgcccuggaugucugcggaagaacggaaauaaggaacuaucggcgugaggugguggaagacaucaauaaauugcucaaguaccuggacuuagaggaagaggcggauacuaccaaagcauucgaccugcgccaaaaccacaguauucucaagaucgagaagguccuuaaaagaaugagggaaauaaagaacgagcuguugcaggcccagaaucccagcgaacuauaucugucuuccaaaacagagcuccagggucugauuggccaacuugaugagguuucacuggaaaagaacccuuguauccgggaggcucgacgcagagccgugaucgaaguacagacuuugauuaccuacaucgaccucaaagaggcacuggaaaagaggaaguuauuugcuugcgaggagcauccaagccacaaagccguguggaauguccuggggaaccuaagugaaauucagggagaggugcucucuuucgauggcaaucggacagacaagaacuauauacgccuggaggaacuuuugaccaaacagcugcucgcgcuggaugccguugacccgcaaggugaagagaaguguaaagcagcuagaaagcaggccgugaggcuugcucagaauauccuguccuacuuggaucucaagagcgacgagugggaauacuga

SEQ ID NO: 53274 - RNA, 2712 nt, Artificial Sequence
  derived and/or modified sequence opt3 from BAG6__Homo_sapiens__NP_001186626
auggagcccaacgacagcaccuccacagccguggaagaaccugauucucuggaaguccucguuaagacucuugacucacagacgagaaccuucaucgugggcgcucaaaugaauguaaaagaguuuaaggaacacauugcagccagugugagcauaccauccgagaaacagaggcugaucuaccaggggcgggucuugcaggaugacaagaaauuacaagaguauaacgugggagguaagguuauucaucugguggaacgcgcgccgccccagacacaccuaccuucuggcgcuucgucagggacuggaagcgccagugcaacccauggcgguggguccccacccggaacacgaggcccuggcgccucuguccacgaucguaaugcuaacagcuacgugaugguagggaccuucaaucucccauccgacggaucagcaguugaugugcauaucaacauggagcaggcccccauucagagugaaccuagagucaggcuggugauggcucaacacaugauccgggacauacagacucuucugagccgcauggagugcagagguggcccacagccgcagcacucucaacccccuccacagcccccugccgugacaccagagcccgucgcguuguccucacagaccagcgaaccgguugagagugaagcaccucccagggagccaauggaagccgaggagguggaggagcgggcuccugcccaaaaucccgaacucacgccagggcccgccccugcuggaccaacuccggcccccgagaccaacgcgccuaaucauccaucucccgccgaauauguagaggugcugcaggagcugcagcgccucgaaucccgauuacagccuuuucugcaaagauacuaugagguccuuggcgcagcugccacaacugauuacaacaauaaccacgaagguagggaggaagaccagcgguugaucaaucuggugggggagagccuacgucuccugggaaacaccuucguugcucuuucggaucugcgcuguaauuuggccugcacaccacccagacaucuccacguggucaggccgaugucucacuauaccacgccuauggugcugcagcaggcagccauuccaauccaaauuaacguaggcacuacaguuaccaugacuggcaacgggacacggcccccucccaccccaaaugcugaggcgccucccccaggaccgggucaggcauccucaguggccccuaguagcacgaacgucgaauccucugcugagggcgcacccccacccgggccugcaccacccccugccaccagccauccgcgagugauccgcauaucacaccagagugucgaaccagugguuaugaugcauaugaauauucaggacuccggaacacaacccggcggugugccuagcgcuccaacugggcccuuaggcccuccgggacacggccagacccuggggcagcagguacccggauuuccaacagccccuacuagagucgugaucgcaaggcccaccccaccucaagcgcggcccucucauccagguggcccgccuguuucagggacacucggagcuggccuugguaccaacgccagucuggcacagauggugagcggguuggucggccagcuacugaugcaacccgugcucguagcccagggaacuccaggcucccccgggggacugggucuugagucucugucgccugaguucuuuacgagcgugguucagggcgucuuguccucacuccuggggaguuuaggagcucgcgccggcucuagcgaauccauugcagcuuucauccagagacugucagguagcucuaauaucuuugagccaggggccgauggcgcgcuaggauucuuuggcgcccuccugucccuuuugugucaaaacuucaguaugguggacguggucaugcugcuccacgggcacuuucagccccugcagaggcuucagccucaacugcguagcuucuuccaucagcacuacuugggaggccaggaaccgacaccaucuaauauucggauggcuacccauacucucauaaccggucuggaggaauacguucgagaguccuuuucauuaguacaggugcaacccgggguggacaucauuagaacaaaccuggaguuccuacaggaacaguuuaauaguaucgcagcccacguccuccacugcaccgauagcggauucggcgcuaggcugcuugaguuguguaaccaaggucuguuugaaugccucgcccugaauuuacauugucugggcgggcagcagauggagcuugcagcggugauaaacggacgcauucggagaaugucgaggggcguuaauccuuccuuggugucuuggcucacuacaaugauggggcugcgccuacaggucgugcuggaacacaugcccguuggaccagacgccauccuccgauaugugcggcguguaggcgauccuccccaaccacugccugaggagccgauggaaguccagggugcugagagagccagccccgaaccacaggagugggugccuaucauucagcaagacauccagucacagaggaaggugaaaccccagccaccucuuagugaugcauacuuguccgggaugcccgcuaagcgccggaaacugagaucugacauucaaaagagguuacaggaagauccgaacuauagcccacagcgauucccuaaugcccagcgcgcauuugccgacgaucccuga

SEQ ID NO: 53275 - RNA, 1536 nt, Artificial Sequence
  derived and/or modified sequence opt3 from BAIAP2L1__Homo_sapiens__NP_061330
augagcagaggccccgaggaagugaacaggcugaccgaguccacauaccggaaugucauggaacaguucaacccugggcuccgcaaucuuaucaaccugggaaagaauuaugagaaagccguuaacgcuaugauuuuggcagguaaggccuacuaugacggcguggcgaaaauaggggaaaucgcuacuggaucuccaguaucaacggaguuaggccacgugcugauugagaucaguagcacccauaagaaacuaaaugaaucccucgaugagaacuuuaagaaguuccacaaagaaauuauccaugagcuggagaagaaaauagaacuugacgucaaguacaugaaugccacacugaaacgauaucaaacugagcacaagaacaaguuggaaucucucgagaaaucgcaggcagaacugaagaaaauccguagaaagucacaggguagcaggaaugcccugaaauacgagcauaaggagauugaauauguggagaccguuacaagucggcaguccgaaauccaaaaauuuauugcugaugggugcaaggaggcacucuuagaagagaagcgcagauucuguuuucugguggacaaacacugcggauucgccaaccacauccauuacuaccaccuucagucugcugaguugcugaauagcaagcuaccgagguggcaggaaaccugugucgaugccauaaaagugcccgagaagauuaugaacaugaucgaagagauuaaaacuccugcguccacaccaguaucaggcacgccccaggcaaguccuaugaucgaacggagcaauguugugcgcaaggacuaugauacccucucuaagugcuccccaaaaaugcccccugccccaucaggccgagcuuacacuagcccgcugaucgacauguuuaacaaccccgccaccgcagcuccuaauagucaaagagucaacaauucuacagggacuuccgaggauccaagccuucagaggucggugucuguggccaccggacugaacaugaugaagaaacagaaggucaaaacaauuuucccccauaccgcggguuccaauaagacguugcucucauuugcccagggcgacguuauaacucuguuaaucccugaggaaaaggauggguggcuguauggagagcacgacgugaguaaagcacggggcugguucccaagcuccuacacaaagcuccuugaagagaacgagaccgaagcuguaacugugcccacaccgucuccuacccccguccguagcauuucaacggugaaucugagugagaacuccagcguugugaucccaccucccgauuauuuggaaugucuaucuaugggugccgcugccgaccgcagagcagacucagccaggaccacaaguacuuuuaaagcuccagcgagcaagcccgagaccgcagccccuaaugaugcuaacgggacagccaaaccaccguuccuguccggagaaaaucccuuugcaacugucaagcuccggccuaccgugacaaacgaccgaucugccccaauaauucgcuga

SEQ ID NO: 53276 - RNA, 3351 nt, Artificial Sequence
  derived and/or modified sequence opt3 from BAIAP3__Homo_sapiens__NP_001186025
augagcacccugcucgacaucaaguccucuguacuuagacagguccaaguuugccccucauucaggcggcgcacagagcaggauccuggcagugccagcgcugacccacaggaaccggcaacuggggccuggaaacccggagaugguguggaguuuuucgcgcacaugcgacugauguugaagaaaggcgaagggcgucagggauuaccuugucuggagguaccacuaagauccggcucucccgcuccuccagaacccguggacccuucgcucggucugagggcccuugcaccagaggaggucgaaaugcuguacgaggaagccuuguauacggugcucuaccgggcugggaccaugggaccggaucaaguugacgaugaggaggcacugcugucauaucuccaacagguguuuggcacuagcuuagaagaacauacagaagccauugagcgcgucagaaaggcuaaagcccccaccuacgcgcugaaggugaguguaaugagggcaaagaaccuuuuggccaaagacccuaauggcuucuccgauccauauugcaugcuggggauacuacccgcuucugacgccacacgggaaccucgcgcacagaaggagcagcgauuuggauucagaaaagguagcaagaggggcgggccacuccccgcuaaauguauccagguuaccgaggugaaguccucaacucugaacccggucuggaaggaacacuuucuuuucgagauugaagaugugaguacagaccagcugcauuuggauaucugggaccacgacgaugacgugagccucgucgaggccugccggaaacugaaugaaguuauuggauuaaagggcaugggucguuacuuuaaacagaucgugaagucugcgcgcgccaacgggaccgcaggaccuacggaggaucauacugacgauuuccugggcugucucaauauacccguaagaagggacaccgcuaugucccaacggggccgaucaggguuucuuagccaccuguugcuacugagucaccuccugcgccuugagcauucugccgaagaaccaaacuccagcucguggagaggagaacugucuacuccugcugccacaaucuugugccuccacggugcacaguccaaucugucacccuuacagcuggccgugcuacauuggcaagucaguagcaggcaccaccagaccuguacacucgauuauuccuaccugcuuggcuugcuggaggacaugcaggcucauugggaagaggcgccaucucucccccaggagcaagaagagagccuggcagauucacuuagugccuucuccgaauuugggcugcaguugcuccggcagcugcgcgacuacuucccugcuaccaacagcacggccgugcacagauuagagcugcuacucaaaugccugggaaaacuucaguuguuccaaccaucuuuugagauuuguccguucgaaucagagcugaauauggauaucgcagccgcucucaaaaggggcaaccgugaaugguaugaccggauucugaaugacaagaguccccgagagcagccugguccacagagauuacccgggcugguugugcuugccgaugcagucuacgacgauuugcaguuuugcuauagcguguacgcgucccucuuccauucuauccugaacguagacguuuuuacucuaacauucaggcaacuggaacgccucguggcugaggaggccuggguccugaccgaggagcuuucgccuaagaugacuuuggaaguggcaagcggccuguuugaguuauaucucacacuggccgaucuucagcgguucugggacuccauaccaggaagagauucaaggagucuggcuuuggccggcauucacgcacccuuucucccggcugucaaacugugguuccaggugcuacgcgaccaggccaaguggcgacugcaaggggcgguugauauggacacccucgaaccuguggaugccucuagccggcauuccucaagcgcugcaacggccggacugugucuuucucacauccaggaguuguggguacgucuggcuuggccagaccccgcccaggcacaagguuuaggcacccagcucgggcaggaugucugcgaggcgacacuguuuuacacugaacuucugagaaagaagguggacacccagccuggagccgcuggcgaggccguuuccgaagcacuaugcgugguccucaauaacguggagcugguaaggaaagcugccggucaagcauugaaggggcuggccuggcccgaaggcgcuacaggaccagagggcguguuaccucgcccccuccugaguuguacucaggcgcuugacgaugaccugcagcgggaggcccacaccguuacagcacauuugaccagcaagauggucggggauauuagaaaauaugugcagcacaucucucucuccccagacucaauccaaaaugaugaagcuguggccccgcugaugaaguaccuagacgagaaacuggcccuucucaacgcuagucuggucaagggaaacuugagcaggguucuggaagcauuaugggagcuccugcuucaggccauucugcaggcguugggugcuaaucgagaugugucggccgacuucuacucccgcuuucauuucacucucgaggcacuggugucuuucuuucacgccgaaggccaggggcuaccucuggagagccuucgggauggaucauauaaaagacucaaggaggagcugagguugcacaagugcaguacgcgugaauguauagagcaauucuacuuagacaaacugaagcagcgcacacucgagcagaaccgguuuggcagacuguccguaaggugccauuaugaagcugcagagcaacgacuugccgucgaagugcugcacgcggcugauuugcuaccccuggacgccaauggucucucugauccauucguuaucguggagcuggggcccccucaucuuuuuccauuaguccggagccagcgcacccaggugaaaacuagaacccugcaccccguuuacgacgaacucuucuauuuuuccgugccugcagaggccuguaggcggcgagcugccugcguauuguucacagucauggaccaugauuggcugucaaccaacgacuuugcaggcgaggcugcccucggacugggcggggugacuggaguggcgagaccgcaggucggcgguggggcccgcgcaggacaaccaguuacacuucaccuguguaggccccgugcucaggugcggagcgccuugagaaggcuagaaggccgcacgaguaaggaggcucaggaguucgugaaaaagcugaaggaacucgaaaaaugcauggaggcagauccuuga

SEQ ID NO: 53277 - RNA, 636 nt, Artificial Sequence
  derived and/or modified sequence opt3 from BAK1__Homo_sapiens__NP_001179
auggccagcggccaggggcccggaccuccaagacaagagugcggugaaccggcucugcccuccgcaucugaggaacagguggcccaggacaccgaggaagucuucaggucauacguuuucuaucggcaccagcaagagcaggaggcggaaggcguggcugccccugcagauccagagaugguaacacucccccuucagccuaguagcacuaugggacagguggggcgccaacuggccaucauuggcgacgauauaaaccgacguuacgacuccgaauuucagacgauguugcagcauuuacagccaaccgcugagaaugcauaugaguacuuuacaaagaucgccacuucucuguucgaaucggguauuaacugggggagagucguggcucuacucggauuuggcuauaggcuggcccuucacguuuaccaacauggccugaccggguucuugggacaggugacacgguuugucguggauuucaugcuccaccauuguaucgcgcgcuggauugcacagagagguggcuggguagccgcucugaaucuggggaacggacccauccucaauguuuuagugguccugggcguggugcuuuugggucaauuugucguuaggcgguucuuuaaaucauga

SEQ ID NO: 53278 - RNA, 783 nt, Artificial Sequence
  derived and/or modified sequence opt3 from BAMBI__Homo_sapiens__NP_036474
auggacagacacagcuccuacaucuucauuuggcugcagcucgagcuuugcgccauggcugugcuguugaccaagggcgaaauaagguguuauugcgaugcagcccauugugucgcgacaggguacaugugcaagucugaguuaucagcuuguuuuagucggcugcuagacccccaaaacagcaauuccccucucacucacggaugccuggauucucuugccucgacgaccgacaucugucaggcaaagcaggcccgcaaccauucagguacaacuauuccaacccuggaaugcugucacgaggauaugugcaauuaucgaggcuugcaugacguucucagcccgccccguggggaagcuaguggacagggcaacagauaccaacacgaugguuccaggaaucugaucacaaaagugcaggagcugaccucuagcaaggagcucugguuccgggcagccguaauugcugugccuaucgccgggggauuaauacugguccuuuugaucaugcuggcgcuacgcaugcucagauccgaaaacaaaaggcugcaggaccagcggcaacagaugcuuucacgccugcacuauaguuuucauggccaccauagcaagaagggccagguggcaaaauuggaucucgaguguaugguuccagugucugggcacgaaaauugcugccugacuugugacaagaugcgacaggccgauuuauccaacgacaaaauucugucacucguccacuggggaauguacagcggucauggcaaacuugaguucguguga

SEQ ID NO: 53279 - RNA, 270 nt, Artificial Sequence
  derived and/or modified sequence opt3 from BANF1__Homo_sapiens__NP_001137457
augaccacaagccagaagcacagagacuucguggccgagcccaugggcgaaaaaccugucgggucccuggcuggaaucggugagguucucggcaagaaacuugaagagaggggguuugauaaggcauacgugguacugggacaauucuuggugcugaaaaaggacgaagauuuauuucgggaguggcuaaaggacacuugcggcgccaacgcgaaacagucucgcgauuguuucgguugccuccgagaguggugugacgcuuuucuguga

SEQ ID NO: 53280 - RNA, 2268 nt, Artificial Sequence
  derived and/or modified sequence opt3 from BANK1__Homo_sapiens__NP_001077376
augaucuacgaggaagacgccgaggaaugggcucuguaucucaccgagguguuccuucacgucguuaagagagaagcaauucuguuguacagguuagagaacuuuagcuuccggcaucuggagcuacucaaucugacauccuauaaaugcaaacuucugauauugucuaacucacuccugcgcgaucugacucccaaaaagugucaguuucucgagaaaaucuuacacaguccuaagagcgugguaacgcugcuuugcggcgugaaguccucugaccaauuguacgagcugcuaaauauuucgcagucacgaugggaaaucagcaccgagcaggagccagaagauuauauuagugucauccaguccauaaucuucaaagacucugaggauuacuuugaagugaacauuccgacagaccuccgugccaagcauagcggggagaucuccgaaagaaaagagauugaggaacugucagaggcgaguaggaauacuaucccccuugcuguugugcugccuaccgaaauaccaugugagaaccccggagaaauuuucaucauuuugcgggaugaggucaucggugacacaguggagguagaauuuaccagcucuaauaagcgcaucagaacuaggccugcccucuggaacaaaaagguuuggugcaugaaggcacuggaguucccagccggcuccgugcacgucaauguguauugugaugggauugugaaagcuacaaccaagauaaaauacuaccccacggcaaaggccaaagaaugcuuauuucggauggcugacucaggagagagccugugucaaaacaguaucgaagaacucgauggcguccuuacuucuauuuucaagcaugagaucccuuauuacgaauuucagucccugcagaccgagauaugcagccagaauaaauauacacacuucaaggaauugccaacucuacugcacugugccgcgaaguuuggucucaaaaaccuggcaauucaucuucugcaaugcucgggggccaccugggcuucuaagaugaaaaauauggagggauccgacccggcccacaucgcagagcgccauggccacaaggaauugaaaaagaucuucgaggauuucucaauucaggaaaucgacauuaacaaugagcaggaaaacgacuacgaggaggauauagcuaguuuuagcacauauauccccuccacccagaacccugccuuccaccaugaaucucgaaagacguacggccaaagcgcggacggggccgaggcaaaugaaauggagggagaagguaaacagaacggcucagggauggagacuaagcacaguccacucgagguuggauccgaaagcucugaggaucaguaugacgaucuguacguguuuauucccggcgcugacccugaaaauaacucacaagagccauuaaugaguagcagacccccgcugccucccccaaggccuguagccaaugcuuuccagcuagaacggccccauuuuacacucccagguaccaugguggaggggcagauggagcguucccagaacuggggacaccccggcguccgccaagaaacuggcgaugagccuaaaggggaaaaggagaaaaaggaggaagagaaggaacaggaggaagaggaggacccauacacauucgccgaaaucgaugacucugaguaugauaugauccuggcaaaucuuucgauuaaaaagaaaaccggaagcagauccuuuauaaucaacaggccgcccgccccuacgccacggcccaccucaauuccuccaaaggaagagacaacucccuacaucgcucagguguuccagcaaaagaccgcgcgacgccagagugacgacgauaaguuuagagguuugccgaagaaacaggacagggcacggauugaaucuccugccuucagcacacugcgcggcugucucacugaugggcaggaggagcugauccuucugcaagaaaagguuaaaaauggaaagauguccauggacgaggcuuuggaaaaauuuaagcauuggcagaugggcaaaucaggucucgagaugauacagcaggaaaagcugagacaauuaagggauugcaucauugggaagcguccagaggaggaaaacguguauaauaaacugaccaucguccaccaccccggcggaaaggagacagcccauaacgaaaauaaauucuacaacgugcacuuuagcaauaagcuaccugcacggccccagguagagaaagaguucggcuucugcuguaagaaggaccauuga

SEQ ID NO: 53281 - RNA, 1518 nt, Artificial Sequence
  derived and/or modified sequence opt3 from BANP__Homo_sapiens__NP_001167010
augaugagcgagcacgaccuggccgaugugguccagaucgcuguugaagaccucucccccgaucauccugugguacuugagaaccacguggucaccgacgaagaugagccagcacugaagagacaaagguuggaaauuaauugccaggacccgucuauaaaaucauucuuauacaguaucaaccagacaauuugucugcggcuagauagcaucgaggccaagcuccaggcgcuggaggcuacuugcaaaucccuugaagagaagcuggacuuggugacgaauaaacaacauucucccauucagguuccuaugguggccggcucgccacucggggcaacccagacauguaacaagguccgcugcgugguaccccagacuaccguuauccugaauaacgaucgacaaaaugccauaguggcuaagauggaagacccucugucaaaccgugcaccagauagccucgagaaugucaucaguaacgccgugcccggaagaaggcagaauacaauuguggucaaaguuccuggucaggaggacucccaccaugaagauggcgagucugggagcgaggcuuccgacucagugaguagcuguggacaggccggcucucaauccaucgguucaaacguaaccuuaauuacucugaauagcgaagaagacuauccaaacgggacauggcuuggagaugagaauaacccggagaugcgggugcgcugcgcgaucauacccagugacauguugcacauuucuaccaacuguagaacggcagaaaagauggcccugacucuacucgauuaccuguuucacagggagguccaggcuguguccaaucuuagcggccagggcaaacaugggaagaaacaacuggacccuuugaccaucuaugguauucggugccaccucuucuacaaguuuggaaucacagaaucggauugguaucgcaucaagcagucuauugacuccaaaugucgaacugccuggagaaggaagcagcggggccagucacuggcaguuaaaaguuucagccgucgcaccccaaacuccucuagcuacugccccucagagccuaugaugaguacaccacccccggcuuccgaauuaccucaaccccagccacagccucaggcccugcauuaugcgcucgccaaugcacaacaggugcagauacaccagaucggggaggauggacaaguccaggugggccaccuucauauugcucagguaccccagggugagcaaguucagaucacccaggacagcgaagggaaccugcaaauacaccaugugggacaggauggccaggucuugcagggcgcccaacuaauugcuguggccucuucagacccagcagccgcuggggucgauggaaguccccugcaggguagcgacauccaggugcaguacguucaacucgcgccuguguccgaccacacggcaggcgcccagacugcugaggcccugcagccaacacuucagccggaaaugcaacuggagcauggggcaauccagauucaguga

SEQ ID NO: 53282 - RNA, 2190 nt, Artificial Sequence
  derived and/or modified sequence opt3 from BAP1__Homo_sapiens__NP_004647
augaacaagggcuggcuggagcucgaaagcgaccccgggcuuuucacccuguugguggaggauuuuggagucaaagguguucagguggaagagaucuacgacuuacaauccaagugccagggcccuguauauggguucauuuuucuguucaaauggauagaagagagaaggucucggcgcaaggugucaacucuagucgaugacacaagugugaucgaugacgauauuguuaauaacauguuuuucgcccaccagcucaucccaaauagcugugcuacgcaugcacugcuuuccgugcuguugaacuguucuucggucgaccucggaccgacccugucacgaaugaaagauuuuacaaagggcuucagccccgagaguaaggguuacgccauugggaaugcgccugaacuggcuaaagcccacaacucccaugcacguccagagcccagacaccucccugaaaagcagaauggauuaucugccgugaggacuauggaggcuuuucauuucguaagcuauguuccaaucaccggccggcuguuugagcuugacggcuugaaaguguaccccauagaucacgggccuuggggagaagacgaggaauggacagauaaggcacgcagagucaucauggagaggauuggucuggccaccgcuggcgaaccauaucacgacauccgguucaaccuaauggccguggugccggaccgccgaauuaaauacgaggcgagacuccauguccugaagguuaauaggcaaacugugcuugaggcacugcagcaguugauccggguaacacagcccgaacucauacaaacccacaagucccaggagucacagcugccugaagagaguaaaagcgccucuaacaaguccccauuagugcuggaagcuaaucgugcccccgcagcuucagaggggaaccauacggauggagccgaggaagcggccggcagcugcgcacaggcuccuagucacucuccacccaauaaaccgaagcucgucgugaaaccucccgguuccagccuuaacgggguucacccaaauccuacucccauugugcaacgccugccagccuuuuuggacaaccauaacuaugcuaagucgcccaugcaggaggaagaggaucuagccgcaggagucggcagaucuagggugccuguacggccaccgcagcaauacuccgacgaugaagacgauuacgaggacgaugaggaagacgauguucagaauaccaacucagcccugcgauauaaaggcaaggggacaggaaagcccggugcucucaguggcagcgcggacgggcagcuguccgugcuucagccuaauacuaucaacguccuggcagagaaauugaaggaaucucaaaaagaccucagcauuccacugucaaucaagaccaguuccggagccggcagccccgcuguggccgucccuacacacucucagccaucacccaccccgaguaaugagagcacggauacugcauccgagaucgguucugccuucaacucgccuuuacgcagcccaauuagauccgcuaaucccacaaggccuucaagucccgugaccucucauauaagcaaaguucuguucggggaagacgauucccuacuccggguggacugcauccgcuacaacagagccguaagggaucugggcccagucauuucaacuggacuuuugcaccuggcagaggacggcgugcucagcccucuggcgcuuacagaagggggaaaggguucuucccccaguauccguccaauacagggcagccaggggucuuccucaccgguugagaaggaaguggucgaggcuaccgauagucgggagaaaacgggaauggugcgaccuggcgaaccccugagcggugagaaguauucgccaaaagaauugcucgcccuguuaaaguguguagaggcagaaauugccaauuacgaggcuugccugaaagaggaaguggagaagagaaagaaauuuaagaucgacgaucaaaggcgcacccauaacuaugacgaguucaucuguacauuuauuuccaugcuagcccaggaagggaugcucgcaaaucugguugaacagaacaucucuguccggagaaggcagggcgugagcauuggacgccuucacaaacaacgaaagcccgaucggcguaaaagaucaaggccuuacaaggcuaagcgccaguga

SEQ ID NO: 53283 - RNA, 2334 nt, Artificial Sequence
  derived and/or modified sequence opt3 from BARD1__Homo_sapiens__NP_000456
augcccgacaacagacagccuaggaaucggcaaccacgcauccgaagcggcaacgagccgcguuccgcccccgcuauggaaccugaugggagaggagcaugggcccacucuagggcggcucuggaccggcucgagaaacuucugcgcugcucaagauguaccaauauuuugagggaaccagugugcuuagguggcugugagcauauauucugcaguaacugugucagcgauugcaucgggacaggaugucccguuugcuacacuccugccuggauucaggaccugaaaaucaaucggcagcuagauuccaugauucagcucuguucuaagcugcgcaaccuucugcacgacaaugaauugucggaucucaaagaggacaagccacgaaaaucacuguuuaacgaugcaggcaauaagaagaacagcaucaaaaugugguucagucccagauccaagaaagugagguauguagugucuaaggccagcguccaaacgcagccugcuauaaagaaggacgcauccgcccagcaggauucauacgaguuugugaguccaagcccgcccgcugacguuucugaacgggccaagaaagcguccgcacguucagguaagaaacaaaagaaaaagacccuggccgagaucaaucagaaauggaaccucgaagcugagaaggaggauggggaguucgacagcaaggaagaaaguaaacagaaguuagugucuuuuugcucccagccuagcgucauuucgucuccacaaaucaauggagagauugaccugcuugccuccggcucauugacagaaagugaguguuucggcagccugacugaggugucccuaccccucgcagaacagaucgagucuccugauaccaaaagccgcaacgaaguaguuacaccagagaaggugugcaaaaauuaucugaccucaaagaagagucuuccccuggaaaacaacgggaaaagaggacaucacaauagguuguccagcccgauaucuaagcggugccgaacuucaauucucaguacaagcggugacuuugucaaacagaccgugccuuccgagaacaucccccugccagaguguucuucgccucccagcugcaagcgcaaagugggcgggacguccggaagaaagaauagcaacaugagugaugaguucauuucuuuaagcccaggcacucccccuuccacccugucaucaucuuccuacaggcgggucaugaguagcccaucugcuaugaagcuccuuccgaauauggccguuaaacgcaaccauagaggugaaacacuguugcacaucgcguccaucaagggggacauucccucaguggaauaucuacugcaaaauggaagugauccuaacguaaaagaccacgccggcuggacuccacuccaugaggcauguaaucacggccaucugaagguggucgaacuucuguugcagcacaaagcucucgugaacaccacaggguaccagaaugauagcccccugcacgacgccgcuaagaacggacauguugauauagugaaguuacugcuaucguauggugccuccaggaaugcagucaacaucuuuggccuccguccuguggacuacaccgaugacgagucuaugaaaagccugcuuuugcugccagagaagaaugaaucaaguuccgccucucacugcagcguaaugaacacggggcagcggcgagacggaccccucguucugauuggcuccggucuuucaagcgagcaacagaaaaugcugagugaauuggcugugauccucaaggcgaaaaaguacacugaguucgauucuacagucacccauguggucgugccgggggacgcaguucaguccacucugaaauguauguuaggcauacugaacggaugcuggauucuaaaguuugagugggugaaggccugucucagaaggaaaguaugcgaacaggaggaaaaguaugagaucccugaaggcccacgccggagcagacugaauagggagcaacuuuugcccaaacuguucgauggguguuacuuuuaucucuggggaacauucaagcaccauccuaaagacaaccugaucaaguuagucaccgcugguggcgggcagauucugucgcgcaagcccaaaccagauucagacgugacgcagaccaucaauacaguugccuaccacgcacgaccugauucugaccagcgguucugcacucaauauauuauauacgaggaucuuuguaacuaucaccccgaacgugugagacagggaaaggucuggaaagccccaaguuccugguuuaucgacugcgugaugagcuucgaguugcucccgcuggauucuuga

SEQ ID NO: 53284 - RNA, 984 nt, Artificial Sequence
  derived and/or modified sequence opt3 from BARHL1__Homo_sapiens__NP_064448
auggagggcagcaacggguucggaaucgacuccauucugucucacagagccgguucacccgcucucccuaagggcgauccacuucugggggacugcaggaguccguuggaauuaagcccccgguccgagucuucgucagauuguagcaguccugcauccccaggacgcgacugccuggaaaccggcacaccccgaccugguggggccucuggaccaggccuagauagccaucuccagcccggccaacuguccgcgccugcucagucacguacugugacgaguagcuuucuuauaagagacauccuggccgauuguaaaccauuggcagccugcgcuccguacucuuccucagggcagcccgcagccccugagccaggagguaggcucgcugccaaggcggcagaagacuuccgggauaaacuggacaagagcggcaguaaugccucuuccgauagcgaguauaaagucaaggaggaaggggaccgcgagauuucgucuuccagagauucacccccuguuaggcugaagaaaccacggaaggcucgcaccgccuuuacagaccaccagcucgcacaauuagaacgaaguuucgagagacagaaauaccugagcgugcaggacaggauggagcuugcugccuccuugaaccugacugauacccagguaaagacaugguaucaaaaucggcguaccaaauggaagcgccagacugcggugggacuagaacuccuggccgaggcaggcaacuacucugcccuucagagaauguuucccagcccguauuucuacccucagucacuggucaguaauuuggaccccggugcugcucucuaucuguacagggggccauccgccccucccccagcauuacaacggccccuggugccucgaauccucauucauggacuucagggcgccagcgaaccaccgcccccucugccacccuuggcuggcguucuaccucgcgcggcacagccaagauga

SEQ ID NO: 53285 - RNA, 765 nt, Artificial Sequence
  derived and/or modified sequence opt3 from BARX1__Homo_sapiens__NP_067545
augcagagacccggcgagccuggggccgcuagguucggaccaccggaagguugcgcagaccaccggccccaucgcuaccguagcuuuaugaucgaggaaauucugaccgagccuccaggccccaagggggccgcgccugcugccgcagccgcugcagccggagaacuccuuaaauucggcgugcaagcucuguuggccgcgcgaccauuucacucccauuuagcaguccugaaggccgagcaggcugccguuuucaaauuuccccuagcaccucucgguuguucugggcugucaagugcccuucuggcugcgggaccaggcuugccgggcgccgcaggggcuccccaccucccucuggagcugcagcucagaggaaaguuagaagccgcugguccaggcgagcccgggacaaaagccaagaagggaaggcggagccgcacuguguucacggaacugcagcuuaugggcuuggagaaaagauuugagaagcaaaaauaucuguccaccccugauaggauagaccuagcagaaucucucggucugucgcagcuucagguaaagacaugguaccagaaccggcgcaugaaauggaagaagaucgugcugcaagggggaggcuuggagucaccaacuaaacccaagggccgaccgaaaaagaauagcauuccuaccagugaacagcucacagagcaggaaagagccaaagaugcugagaagcccgcggaggucccaggggaaccuuccgacaggucucgggaggauuga

SEQ ID NO: 53286 - RNA, 840 nt, Artificial Sequence
  derived and/or modified sequence opt3 from BARX2__Homo_sapiens__NP_003649
augcacugccaugccgagcugagacucagcucccccggccagcuuaaggcugcaaggcggcgcuacaaaaccuucaugaucgacgaaauucugucuaaggagacaugugauuauuuugaaaaauugucauuauacagugugugcccuagccuggucguucgaccaaagccgcuacacuccuguacugggucucccucgcuccgugccuauccucugcuuucagugauaacgagacaaccaaccguaaucagccaucuggugcccgcgacaccuggaauugcucaggccuugaguugccaccaggucacugaggcaguguccgccgaagcuccagguggcgaggcacucgccucuagcgaguccgaaaccgagcagcccacaccuaggcagaaaaagccacggcgcucaagaaccaucuucacugaacugcaacugauggggcucgagaagaaauuucagaagcagaaauacuuaaguacaccggacaggcuggaucuugcucaaagccuuggacugacccagcuacagguuaagacgugguaucagaaccggcgcaugaaauggaagaagauggugcucaaaggcggucaagaggcccccacuaagccuaaagggcgaccaaagaaaaauucuauucccaccuccgaagagaucgaagcggaggaaaagaugaacucacaggcacagggacaagagcagcuggagccuagccagggccaggaagaguugugugaagcccaagagccaaaagcuagagacgucccccuggaaauggccgagccgccugaucccccacaggaguugccuauacccaguucugaaccacccccucucuccuga

SEQ ID NO: 53287 - RNA, 684 nt, Artificial Sequence
  derived and/or modified sequence opt3 from BASP1__Homo_sapiens__NP_006308
augggcgggaagcugagcaaaaagaaaaagggauacaacgugaaugacgagaaagccaaggaaaaggauaaaaaggcugagggugcagccaccgaagaggaaggcacacccaaagaguccgagccucaggcggcugccgaaccagcagaggccaaggaagggaaagagaagccggaccaagaugcugagggaaaggcagaagagaaagaaggcgagaaggacgccgcugccgcgaaagaagaggcacccaaggccgagccugagaaaacugagggugcugccgaagcaaaggcugagccacccaaagccccugaacaggagcaggcggccccagggcccgcagcuggaggcgaggccccuaaggcugccgaagcagccgcugcgccagcagagucugccgcuccggccgcaggcgaagaacccucaaaggaagagggggagccuaaaaagacggaagccccagcugcccccgcagcgcaggagaccaaaagugauggagcuccugccagcgacuccaagccagguucuucggaagcagcccccucaagcaaagagacaccggcugccacugaggcaccuaguuccacccccaaggcucaaggcccagccgcgucugccgaggaaccuaagcccgucgaagcuccagcagccaacagcgaucagacaguuaccgugaaagaguga

SEQ ID NO: 53288 - RNA, 825 nt, Artificial Sequence
  derived and/or modified sequence opt3 from BATF2__Homo_sapiens__NP_612465
augcaccugugcggcgggaacggacuccuuacccagacagaccccaaggagcaacagagacagcugaaaaagcagaaaaauagggccgcugcacaacggagccgccagaagcauacugauaaagccgacgcguugcaccagcagcaugaauccuuagagaaggauaaccuggcucuacgaaaggaaauccaaucucuccaggccgagcuggcaugguggucacguacgcuucacgugcaugaaagacuguguccuauggacugcgccaguuguagcgcuccagguuugcucggcugcugggaucaggcagaggggcugcugggaccgggcccccagggucaacacggguguagggagcagcucgaauuauuccagaccccuggauccugcuacccagcccaaccccugucuccuggcccacagccccacgacucgccuucacuuuugcaguguccacugccgagccuaagucucggccccgcugucguugccgagccuccagugcagcugucccccucuccucuucuguuugcgagccauacaggguccucauugcaaggaaguagcucuaaacucuccgcacugcagccaucauuaacugcccagaccgcucccccgcagccucuggaacucgagcaccccacacgggguaaacuuggcagcaguccagauaauccuucuuccgcccugggguuggcacgccuacaaagcagagagcauaagcccgcucugucggccgcgaccuggcagggacucguaguggacccaucuccccacccucugcuugccuucccacuguuguccucagcacagguccacuuuuga

SEQ ID NO: 53289 - RNA, 378 nt, Artificial Sequence
  derived and/or modified sequence opt3 from BATF__Homo_sapiens__NP_006390
augccccacagcuccgacucuucagauaguagcuucuccagaucuccuccaccgggcaagcaggacucgucagaugacgugaggcggguccaacgccgagagaaaaaccguaucgccgcucaaaagagcagacagaggcagacccagaaagcagauacacugcaucucgaaagugaggaccuugaaaagcagaaugccgcgcugcggaaagagauuaagcaguugacugaagaguuaaaguacuuuacguccguucugaacucucacgagccccuaugcagcgugcucgcugccuccaccccuucaccacccgaaguaguguauagugcacaugccuuccaccagccucaugucagcucuccacgcuuucaacccuga

SEQ ID NO: 53290 - RNA, 666 nt, Artificial Sequence
  derived and/or modified sequence opt3 from BAX__Homo_sapiens__NP_001278357
auggacggcagcggggagcagcccagaggagguggcccuaccuccucugaacaaaucaugaagacaggggcccugcuccuucagggauucauucaggauagggcuggccggauggguggggaggcaccagaacuggccuuggacccggugccccaggaugcgucaacuaaaaaguuaagugagugccugaaacgcauaggagacgaacuagauagcaacauggagcuccaacgaaugaucgcugccgucgacacggauuccccucgugagguguuuuucagaguugcagccgacauguuuucugauggcaauuucaacuggggcaggguaguggcucuguuuuacuucgcaucgaaacuuguccugaaggccuuguguaccaaggugccagaacucauucggacaaucaugggguggacucuggacuuucugcgcgagagacucuuaggauggauucaggaucaggguggcugggggcugccccuugcugaaucauugaagaggcugaugagccuaaguccuggacggccaccccuccugcuuugggacgcccacguugcggaucgcgaccaucugugcggcgguuccgcacaccgauugacccaucaccucgaggaggacgggcugagaccuccagccgcuuuagauuguguguucccgcccuga

SEQ ID NO: 53291 - RNA, 4671 nt, Artificial Sequence
  derived and/or modified sequence opt3 from BAZ1A__Homo_sapiens__NP_038476
augccccugcuccacagaaagccuuucgugaggcagaaaccaccggccgaccuucggcccgaugaggaagucuuuuacugcaagguuaccaacgagaucuuccgccauuaugacgacuuuuucgaacgaaccauucuguguaauagcuuggugugguccugcgcuguaacuggccguccuggguuaacguaccaagaggcacuggaaucugagaaaaaggccagacagaaccuacagucauuuccagagccccucauaaucccugugcuguaucuuaccagucugacacacaggagccgguugcaugaaauuugugaugauaucuucgcguacgucaaagaccgcuauuuuguggaggaaacuguugaggugauuagaaauaacggagcuaggcuccagugccggauccuggagguccugccacccucccaccaaaaugguuucgccaacggccauguaaauucuguggauggggaaaccauaaucauuucggacucagaugacagcgagacacagaguuguuccuuucagaacggaaagaagaaagaugcaaucgacccucucuuauucaaguacaaaguucagccaaccaagaaagaacugcacgagucugccauugugaaggcuacucaaaucagccgccgaaagcacuuguuuuccagagauaaacuuaagcuguuccuaaaacagcauugcgaaccgcaggacggcgucauaaagauuaaagcaucaagucucagcacauauaagaucgccgagcaggacuuuucuuacuucuuccccgaugacccuccaaccuuuauuuucucccccgcuaauaggcggcguggucgcccuccaaaaagaauccacaucucacaagaggauaacguggccaauaagcagacgcuggcgagcuacaggaguaaggcaacuaaagaacgggacaaacuucugaaacaggaggaaaugaagucuuuggccuuugagaaagcuaagcucaagcgagaaaaagccgaugcacuggaggcuaagaaaaaggagaaagaagacaaggagaagaaacgcgaagaguuaaagaaaauuguggaagaggagagacugaagaaaaaggaagagaaggaaaggcucaaagucgagcgggagaaggaacgcgagaaacuuagagaagagaagaggaaauauguugaauaccugaagcaaugguccaaaccccgugaggauauggagugugacgauuugaaggaacuaccggagccuacccccgugaagacacggcugccaccugaaauauucggggacgcccucaugguacuggaguuucuuaacgcguucggagaacuguuugauuugcaggacgaguuccccgacggcgugacucucgagguccuggaagaggccuuagugggcaaugauagcgaagggccacugugcgagcuacucuuuuucuuucugaccgcaaucuuccaggcuauugccgaagaggaggaagagguugcuaaagaacagcuuacagacgccgauaccaaggacuugacggaggcacuggaugaggacgccgaucccacuaaaucggcucucucugcgguggcaucccuggccgcugccuggccucaacuucaucagggauguucacugaagaguuuggaccucgauagcugcacacuguccgaaaucuuacgacugcacauacuagcaucuggugccgacgucaccagcgcuaacgccaaauauagauaccagaagaggggcggguuugaugcaacugacgaugcguguauggagcuccgccugucaaauccaagucuugugaagaaauuguccagcacaucuguauaugaccugaccccgggagaaaagaugaaaauucuccacgcucugugcggcaaguuacugacgcuuguuucaacccgggacuucaucgaggauuacguggacaucuugagacaggccaaacaagaguucagggaacucaaggcagagcagcaucgcaaggaacgagaggaagccgcugcccggauucguaaaagaaaggaggaaaaacugaaggagcaggagcagaaaaugaaggaaaagcaagagaaacuaaaggaagaugagcagaggaacaguacagcagacaucagcauuggugaagaggagcgcgaagauuuugacacuuccauagagucuaaagauaccgaacagaaggagcuggaccaggauauggucacagaggacgaagaugaccccgggucgcacaaacggggaagaaggggcaagcgaggccaaaacggguucaaagaguuuacucgccaggaacagaucaauugcgugacccgggagccucucacagcugaugaagaggaggcccugaagcaagaacaucagagaaaggagaaagaacuuuuggagaagauucagagcgcgaucgccuguaccaacaucuucccacugggaagggaccguauguaucgccgguacuggauuuuucccuccauaccugguuuauucaucgaagaggacuacucaggccucacugaggauaugcugcuuccaagacccaguucuuuucagaauaacguccaaagccaggacccccagguguccacgaaaacaggggaaccucugaugucagagagcaccucuaauauugaucagggaccaagggaccacuccguucaauugcccaagccugugcauaaacccaaccgauggugcuucuauaguagcugugaacagcucgaucagcugaucgaggcucuaaauucucggggccaccgcgaauccgcacugaaggagacucuccugcaggagaagucaagaauuugcgcccaacuugcuagguuuagugaagagaaauuccacuuuagcgacaagccacagccugauucgaaacccaccuacucccggggucgaucuagcaacgccuaugacccaucacagaugugugcagaaaagcaauuggagcugagauuacgcgauuuccuccuggacaucgaggauaggauauaccaggggacacuuggcgcgaucaaaguaaccgaccgucauauuuggcggagugcccuggaauccggaagauaugagcuacucucugaagagaauaaggaaaacggcaucauuaagacugucaaugaggacguggaggaaauggagaucgaugaacagacaaaaguuauagugaaggacaggcuguuggggauuaaaacggagaccccgagcacugucuccacaaacgcuucaaccccucagagcgugaguucuguagugcacuaccuggccauggcauuauuucaaaucgaacagggaauugagcgccgauuccucaaggcuccccuggaugccuccgacagcgguagaucguauaaaacaguucuugaucgguggagggagucacuguugucuagugcaucccucagccaggucuuccugcaucuaucuacucuggaccgcagcgugaucugguccaagucaauacuuaaugcccguugcaagaucuguagaaagaagggcgaugcugaaaacauggugcucugcgacgggugugaucggggacaccacaccuacugcgucaggccaaaacugaagacgguucccgagggcgacugguuuuguccugaaugccgcccaaaacagcgaaguagacgguugagcucuaggcaacgccccucccuggagucagaugaagacguggaggauaguauggguggggaggacgacgaaguggauggcgacgaggaagagggacagagcgaggaagaggaauacgagguagaacaggaugaggacgauucccaggaggaagaggaagucucuuuaccuaagagaggcaggccgcaagugcggcucccaguuaagacccgugggaaacugucgagcucauucuccagucgcggacagcagcaggagcccggucgauauccuucuagaagccaacaguccacaccaaagacuaccgugucaucuaaaacaggcaggagccuucggaagauuaauagugcgcccccuacugaaaccaaaucccugcgcaucgccagcagaucuacgaggcauucacacgggccguugcaggcagacgucuuuguggagcuccuguccccgcggcgaaagagacgcggaaggaaaagugcuaacaacacaccagagaauagcccuaacuuccccaauuuucggguuauugccaccaagucgucugaacaaucccguagcgugaacaucgccucaaagcuaagucugcaggagucugaauccaaaagaaggugccgcaagcggcagagcccagagccuucacccguaacucuuggccgaagaaguagcgguaggcaagggggcguccaugaacucuccgcuuucgagcagcuggugguggaguugguccgccacgaugacucuuggccauuuuuaaaacugguuagcaagauacaggugccggauuacuaugacauuaucaaaaagccuaucgcacucaauauuauccgggaaaagguaaacaaaugugaguacaagcuggccuccgaguucauugaugacauagaacuuauguuuucaaauugcuucgaguauaaccccagaaauacaucugaagcgaaagcuggaacccgucugcaggccuuuuuccauauccaggcacaaaaguugggccuacacgugacuccaaguaacgucgaucaggugucgacacccccugccgcuaaaaagagcaggauuuga

SEQ ID NO: 53292 - RNA, 4452 nt, Artificial Sequence
  derived and/or modified sequence opt3 from BAZ1B__Homo_sapiens__NP_115784
auggcuccccugcucggcagaaagccuuucccacuugugaaaccgcugcccggggaggaaccuuuguuuaccaucccacacacacaggaggcuuucaggacucgggaagaguacgaagcacgcuuagagcgauauagcgagcguauuuggacgugcaaguccaccggaucuucacaacugacacauaaagaagccugggaggaggagcaggaggucgcggaacuacucaaggaggaauuucccgcuugguacgagaaacugguucuugaaauggugcaccauaacacugccagucuggagaaguugguagacaccgcauggcucgagauaaugacaaaguaugccgugggugaagagugugauuucgaagucggcaaagagaagaugcugaaagugaagaucguuaaaauucacccucuggaaaagguggacgaggaggcuaccgaaaagaaaagcgauggggcaugcgacuccccaucuucggauaaggaaaauucaagccagaucgcccaggaccaucagaaaaaggaaacugucgugaaagaggaugaaggaagaagggagaguauuaacgaccgggcucgcagaucccccaggaagcucccuacaucucugaaaaagggcgagcggaagugggccccaccgaaauuuuuaccccacaaguacgauguaaaacuucaaaaugaagacaagaucauaagcaacguuccugcggauuccuugauccgcaccgagcgaccacccaauaaagaaauugugagauauuucaucaggcacaacgcacugcgggccgguacgggggagaaugcuccuugggucguggaggacgagcuagugaagaaguacucacucccaaguaaauuuagcgauuuccugcuugaccccuauaaguacaugacucugaacccgucuaccaaacguaagaauacaggauccccugaccgcaaacccagcaaaaagucaaagacugauaacaguucuuuguccagcccacucaauccuaagcuguggugucauguccaccugaaaaagucguuaucuggcucaccccucaaaguuaagaacuccaagaauaguaaaagcccagaagaacaucuugaggaaaugaugaagaugaugucccccaacaaacugcacaccaauuuucacauuccuaagaaaggcccaccggccaagaaacccgggaagcauucugacaagccuuugaaagcaaagggaagaagcaaagguauccuaaacggccagaagucaacagggaacaguaaauccccaaagaagggacugaaaacccccaagacgaaaaugaagcagaugacucuccuggauauggcuaaaggcacacaaaagaugaccagggccccucggaauagcggugggacuccacgaacaucuucaaagccccacaaacaucuuccgccugcggcccugcacuugauagcauacuauaaggagaacaaagaccgcgaggauaagagaagugcucucagcugcgugauuuccaaaaccgccaggcuguuaucuucggaagaccgggcucgccugccagaggaacuaagaagccucguacagaagagguacgagcugcuugaacauaagaaacguugggccuccaugucagaggagcagcggaaggaauauuugaaaaagaaacgagaggaacugaagaaaaagcucaaggagaaagcaaaggaaagaagggagaaagagaugcuggaacgccuugagaagcagaaacgguacgaagaucaagagcugacgggaaagaauuugcccgccuucagacucguggacaccccugagggccugcccaacacauuauuuggcgaugucgcuauggugguugaguuccugaguuguuauucugggcuacuccugccagacgcgcaguacccuaucacugcagugagccuuauggaagccuuguccgcugauaagggagguuuucuguaucucaauaggguccuggugauuuuacugcagacccuuuugcaagacgaaaucgccgaggacuacggcgaacucgggaugaaacugucagagaucccccuaacacugcacagcguaucugagcucguucgccugugccuucgacgguccgaugugcaggaagagagugaaggaagcgacacugaugacaacaaggauucugcagccuucgaggacaaugaaguccaggaugaguucuuggagaaacuggaaaccuccgaguuuuucgaauuaacaucagaggaaaagcuccagauucugaccgcucuuugucaccguauacugaugacuuacagugugcaagaccauauggagacgagacagcagaugagcgccgaguuguggaaagaaaggcucgcaguccugaaggaggaaaacgauaagaaacgcgcggagaagcagaaacggaaggagauggaagcuaaaaauaaggagaacggcaagguggaaaauggucuagggaaaacagacagaaagaaagagaucguuaaguuugaaccacaaguggauaccgaggccgaggacaugauuucggcaguaaaauccaggcgacugcucgccauccaggcuaagaaggaacgcgagauacaggaacgggagaugaaagucaagcuggaaagacaggccgaggaggaaaggauucguaaacacaaggcagcugccgagaaagcguuccaagaaggcaucgccaaggcuaaacuugugaugcgccggacuccgaucggaaccgauagaaaccauaauagguauugguuguuuucugacgagguuccuggccuguucauugaaaaggggugggugcacgacagcaucgauuaccgauuuaaccaccauugcaaggaccacacagucucaggagaugaggacuauuguccccggaguaaaaaggcaaauuuagguaaaaacgccuccaugaacacccagcauggcacugcuacagagguggccguagaaacgaccacuccaaagcaggggcagaaucucugguuccugugcgauucucaaaaagagcuugacgaacugcuaaacugucuccacccccagggcauucgcgagagccagcugaaggagagauuggaaaagagguaccaagauauaauccauuccauucaccuggcacggaaaccuaauuuaggacucaagucaugcgacgguaaccaggagcugcuuaauuuucugcgaagcgauuugaucgaaguggcgacaagacuccagaaagggggccugggauauguugaggaaaccagugaguucgaggcccgcgucaucucucuagaaaagcugaaagacuuuggcgagugcgugauugcccuucaggccuccgugauaaagaaguuccuccaaggguuuauggcaccaaaacagaagaggcguaaacugcagagcgaagauucggcuaagacagaggaagucgacgaggagaaaaagaugguugaagaggccaagguggcaucagccuuggaaaaauggaagacugcuauccgggaggcgcagaccuucucuagaaugcacgugcuguuaggaaugcucgaugccuguauuaaaugggacaugagugcagaaaacgcuaggugcaagguaugucgcaaaaagggugaggacgauaaacugauccuuugcgacgaguguaauaaggccuuccaucuguuuugcuugcgacccgcccucuacgaagucccugauggcgaguggcaauguccggcuugccagccagcaacggccagacggaacuccagggggcgcaauuauaccgaagagagcgcgucugaggacagcgaagaugacgaguccgaugaagaggaagaggaggaagaggaagaggaagaggaggaagacuacgagguggcuggacugcgucuaagaccccggaagacaauuaggggcaaacacucaguuaucccuccagccgcacgcaguggucgaagacccgggaagaaaccucauagcacucggaggucucagccgaaggcucccccaguggaugacgccgaagucgaugagcuggugcuucagaccaaacgcuccucaagaaggcaaagucucgaacugcagaagugugaggagauauugcacaagaucguuaaauaccgguucagcuggccuuuucgugaacccgugacacgcgacgaggcagaagacuauuacgauguaauuacucauccaauggacuuccagaccguccaaaacaagugcuccuguggcucuuaucgaucggugcaggaguuuuuaacggauaugaaacagguguucacaaaugccgaggucuacaacugcagaggaagccacguucugucaugcauggugaagaccgaacagugucucguagcgcugcuucacaaacaucugccuggccaccccuaugugaggcggaagcgcaagaaauuuccagacagauuggcugaggaugaaggggacuccgagccggaagccgucggacaaaguaggggccggcgacagaagaaauga

SEQ ID NO: 53293 - RNA, 5712 nt, Artificial Sequence
  derived and/or modified sequence opt3 from BAZ2A__Homo_sapiens__NP_001287834
auggaggccaacgaccacuucaauuuuaccggccugcccccugcuccagcagccagcgggcucaagccgucccccucuucaggagaaggucuuuacacaaacggcaguccuaugaauuucccacagcaagggaaaagccugaacggagaugugaaugucaacggcuuguccacuguuucucauacgaccacaucggguaucuuaaauucagcgccccacagcaguuccacuucucaucugcaccauccuagcguggcuuaugacugccuauggaacuacucccaguauccaucagccaaucccgggaguaaccucaaggauccuccacugcuuagccaguuuucuggaggccaguacccgcugaauggcauuuuggggggauccagacaacccucaagcccuagucacaacaccaaucucagggcagguucucaggaguucugggccaacggcacacaguccccaauggggcugaauuuugacagccaggaacuguaugauucguuccccgaccaaaacuuugagguaaugccuaacggaccacccucuuucuuuaccuccccgcagacuucaccuaugcucggcaguagcauacagacauucgcucccucccaggaaguggguucugggauccacccagaugaggcagccgagaaagaaaugaccagcgucguggcugagaauggaacgggcuuaguuggcucacuggaacuugaggaggaacaaccugaguugaagauguguggguacaacggaagugugcccuccgucgaaagccugcaucaggaggugucuguacuaguuccagaccccacugugucaugccucgaugacccuagucaccugccagaucagcuugaagacaccccgauucugagcgaggauuccuuggagcccuuuaauucucucgccccugaaccagucucggguggccuguaugggaucgacgacacagaguuaaugggagcggaagauaaacugccccucgaggacagcccugugauuuccgcacuugauuguccaucacugaacaaugccacugcuuucaguuugcuagccgacgauucucaaaccagcacauccaucuuugcaucacccaccagcccgccugugcugggcgaaucuguccuccaggacaacuccuucgaucugaauaacgguagugacgcugagcaggaggaaauggagacgcagagcucugauuucccacccucccuuacucaaccugcccccgaccagucaaguacaauacagcugcauccagcgaccagcccugccguuucgcccacuacauccccagcagugucuuugguagugagcccggcugccucaccugaaaucagucccgaggucugcccagcugccuccaccgugguuucucccgcaguguuuagcgucguguccccugccucaagcgcuguacucccagcgguuagucuggaagugcccuuaacggcaucugucaccuccccuaaggccagcccggugacaucgccagcugccgcauuccccacugccucaccugcuaauaaggaugucucuaguuuucuggagaccacagccgacguggaggaaauuacuggggagggccuaaccgcauccggaagcggcgacguuaugcggcgccgaaucgcgacaccagaagaggugcgucucccccugcagcacggguggagaagggagguacggauuaaaaagggaucucaccgcuggcaaggugaaaccugguacuacggcccuugugggaaaagaaugaagcaguucccggaggucaucaaauaucuuagcaggaacgugguucauuccgugcggcgcgaacacuuuucauucaguccccgaaugccagucggagauuuuuucgaggaaagagacacuccugagggcuugcagugggugcagcugagcgcugaggaaauacccucuaggauucaagccaucacggguaagcgggggcguccacgcaauacagagaaggcaaaaaccaaggaaguaccuaaagugaagagaggcaggggacggcccccaaaaguuaagauuacugagcuccugaacaaaaccgauaaucgaccgcuuaagaagcuggaagcccaggagacauugaacgaggaagacaaagcuaagaucgccaaauccaagaaaaagaugcgccagaagguccagagaggcgagugccaaaccacuauccaggggcaggcaaggaauaaacggaagcaagaaacaaaaucacucaagcagaaagaggcuaagaagaaaaguaaggccgaaaaagagaagggaaaaacgaagcaggagaagcugaaagaaaaggugaaacgcgagaagaaagaaaaggugaaaaugaaggagaaggaggaagucaccaaagcgaagccugccuguaaagcugauaagacuuuagcaacacagagaaggcuggaggaacgucaacggcagcagaugauucuagaggaaaugaaaaagcccaccgaggacaugugccucacagaucaucagccacugcccgacuuuagccgaguuccuggucuuacuuugccauccggcgccuucucugauugucugaccauaguggaguuucuccacucguucgggaaggugcugggauuugaccccgcuaaagauguaccuagcuuaggcguccugcaagaaggucuuuugugccagggggacucacucggcgaggugcaggaucugcuaguuagacugcucaaggccgcacugcaugacccgggauucccauccuacugucagagucuuaaaaucuugggcgaaaaggugucugagauuccccugacgagggacaacgucagcgaaaucuuacgcugcuuccucauggcguaugggguggagccugcccugugcgaucggcuuagaacccaacccuuucaggcucagccaccucaacagaaagccgcaguucuggcuuucuuggugcacgagcucaacggauccacacugauaauuaaugaaaucgacaagacucuagagucaaugucuagcuacaggaagaacaaauggaucguagaaggccgccugcgacggcucaagaccguccuggccaaacguacagguagaagugagguggaaauggaggggcccgaggaaugucuuggaaggcgccgguccagcagaauuauggaggaaacuucuggcauggaggaggaagaggaagaggaaucaaucgcagccgugccagguaggcgaggccgccgggauggggaggucgacgcuaccgcguccaguauuccugaguuggaaagacagauagagaagcugagcaaaaggcaguuauuuuuccguaagaagcuccugcacucgucucaaaugcuucgcgccguuucccugggacaggaucgguauagaaggcgauacugggugcuaccguaucucgcaggcaucuuuguagaagggacggagggaaaucuggugcccgaagaggucauuaaaaaggagacagacagcuugaaaguggcugcccaugccucacugaacccagcuuuauucaguaugaagauggaacucgcaggcucuaauaccacugccuccagcccugcgcgggcucgcgguagacccaggaaaacaaagccagggucaaugcagccucggcaccugaaaagucccguucgaggacaggauagcgagcaaccgcaggcccagcuucagccagaagcacaacugcaugccccugcucagccccagccacaguugcaacuccagcugcagucccacaagggcuuucuagagcaagaagguucuccccugagccuuggccagucccagcacgaccucucacagucugcauuccugaguugguugucgcaaacccagagccauuccucucuguuaucaagcuccgugcucacuccugauaguucuccggggaagcuggaccccgccccaagccagccucccgaggagccugaaccagaugaggcggaaucaucccccgacccucaggcucuuugguuuaacaucagugcccaaaugccaugcaaugcagcccccaccccgccuccagcugucagcgaggaucagcccacaccuucuccacagcagcuggccuccucaaaacccaugaacagaccgagcgcagcuaauccuuguucgcccgugcaauucucuaguacgccauuggccggacucgcgccuaagcgcagggccggcgaccccggggagaugccacagucccccaccggacugggccagccuaaacgucgggguagaccaccgagcaaguuuuucaaacaaauggaacagagguaccuaacucagcugacagcacagcccguuccuccagagaugugcucaggguggugguggauccgcgaccccgaaaugcuugaugcuaugcucaaggcccugcacccucgaggaauuagagagaaggcuuugcauaaacacuuaaacaagcaucgggacuuucugcaagaagugugucucaggccauccgcagaucccauauucgagccucgccagcugccggccuuccaggagggcaucaugucuuggagcccaaaagaaaagaccuacgagacagaccuugccguccugcaguggguagaagaguuggaacaacgugugauuaugagugaucuacagaucagagguuggacuugccccuccccugacagcacccgggaggaucuggcuuauugugagcaccucucugacucacaggaagauauuacguggaggggccgcgggcgagagggacuggcgccccagagaaaaacaaccaauccacuugacuuagcaguuaugcggcuggccgcucucgaacaaaacguggagaggcgcuacuugagagaaccucuguggcccacucacgaggucgugcucgagaaggcccugcuuaguaccccaaauggcgcaccggaagggacaacuaccgagaucuccuaugaaauaacaccuaggauccggguauggcgucagacgcuggagcgcugccgaagcgccgcucagguguguuugugccuaggacagcuggagagaucuauugcgugggaaaagucggucaacaaaguuaccugucucgugugcaggaagggcgauaaugacgaguuuuuacugcuuugcgacgguugugaucgggggugccauaucuacugucaccgccccaaaauggaagccgugccagagggagacugguucugcacugucugucuggcacaacagguggaaggcgaguuuacacagaagcccggcuucccuaaaagagggcaaaagaggaagucaggauauagccucaacuuuuccgagggugauggccggcgaagacgcguuuugcugagggggcgggaaaguccagcugccggaccccguuacucugaggaaggccucagcccuuccaaaagaaggcgccugucaaugcggaaccaucacagugaccuuaccuucugcgagauuauccuaauggaaauggagucucaugaugcagccuggccguuucuggagccaguaaauccccgauuggugagcgguuauagaaggauaauuaagaacccuauggacuucuccacuaugcgcgaacgguuacugagagggggauacacaucaagcgaggaauuugcugccgaugcgcuccuggucuucgacaauugucagaccuuuaacgaggaugacucugaagugggcaaagcaggccacaucaugcguagguucuucgagucccggugggaggaauuuuaccaggggaagcaggccaaucuuuga

SEQ ID NO: 53294 - RNA, 6399 nt, Artificial Sequence
  derived and/or modified sequence opt3 from BAZ2B__Homo_sapiens__NP_001276904
auggagagcggcgaaagacugcccuccucugcagcuucaaguaccaccccuacuagcuccucuacgccaucgguggccucagucguuagcaaagggggacucaguaccgguguggccucccuuucuagcacaaucaacccgugcggccaccuguucaggacugcgggggaccagcccuuuaauuuguccaccguaucaagugcuuucccuauggugagccauccagucuuuggauuacacucugccuccucaggccauagcgaguucggugggcugggaacacuaggcacccccacugcacucgccgcucacccucaacuggcaaguuuuccagaaugguggcggacaaccgaugcccauacgcgcacuggcgcuaccuucuuucccccucuucuggggauuccaccguuguucgcacccccugcgcagaaccacgacucuuccagcuuucacucgcgaacaucuggaaaguccaaucguaacgguccagagaagggcgugaaugggucaauaaacggaaguaauacuagcuccguuaucggcauuaacaccucugugcucagcacaaccgcaucaaguuccaugggucagacuaagagcacgucuucagggggaggcaauagaaaguguaaccaggaacaaaguaagaaucagccccuggaugccagggucgacaagaucaaggauaaaaagccucggaaaaaggcuauggagagcuccucuaacucggacagcgauuccggcacaucaagugacaccucuagcgaggggauuuccucaagcgauucugacgaucuggaagaggacgaagaggaggaagaucaguccaucgaggaaagugaggacgacgauagcgacucugaauccgaggcccagcauaaaucaaauaaccaagugcucuuacacggaauaagugauccaaaggcagacggucagaaggcuacugagaaagcccaggaaaagcgcauccaucagccccugccgcuugcgagcgagucgcaaacacacuccuuccagucucagcaaaaacagccucagguauugagccagcaacugcccuuuauuuuccagucaagucaggccaaggaagaguccguuaauaaacacaccucugugauccagagcacgggcuuagucuccaacgugaagccacucucacuggugaaccaagccaagaaagaaaccuacaugaaacuuauugucccuagccccgauguucugaaagcugggaauaagaacacaagugaggagucuuccuugcucacuagcgaacugagaucgaaaagggagcaguauaagcaggccuuuccaucacagcuaaagaagcaagaaucuaguaagucccugaaaaaggugaucgcugcccucagcaaucccaaagcaaccucuagcuccccugcccauccaaagcagacacuugagaacaaucacccgaaccccuuccugacuaaugcuuugcuaggaaaccaucagccuaauggcguaauacagucagugauucaagaagcgccacuggcacucaccacaaaaaccaagaugcagaguaagaucaacgagaauauugccgcugccagcucuacucccuucuccucaccugucaaccugaguacgagcggucggcgcacaccagggaaucagacccccgugaugccguccgcaucuccuauccuucacucgcaaggcaaagagaaggccguuagcaacaaugugaacccagucaaaacucagcaucacucacaccccgcuaagucccugguggaacaguuucgaggaaccgacagugauaucccuucuagcaaagacuccgaggauucaaacgaagacgaggaggaagaugacgaggaagaggacgaagaggaugacgaggaugacgaaucugaugacagccagagugaguccgauagcaauucugaaucagacacagagggcuccgaagaggaggaugacgaugacaaggaucaagacgaaagugacagcgauaccgagggggaaaagacuucgaugaaauugaacaagacaacgucuuccguaaaaagccccucaaugagucucaccggacauucuacuccaagaaaucugcacauugccaaggcaccugguuccgcgcccgcugccuuaugcagcgagucacagaguccagcauuccugggcacaagcuccucuacccuaacaagcuccccgcauucagggacuucuaaaaggcggcguguuaccgacgaacgcgagcucagaauaccucuggaguacggauggcagagggaaacgcggauccgaaacuuuggcggucgccuucagggggagguggccuauuacgcucccuguggcaagaaauugagacaauauccagaagucauuaagggaaugcaguggugccugcucaaggaggaggaugugauccccaggauacgggccauggaaggccgcagagggaggccuccaaaucccgaccgucagcgggcacgagaggaaaguagaaugaggcgccggaaaggaagaccuccgaacgucgguaaugcugaguuccuggauaacgccgacgcgaaacuucugaggaaauugcaggcccaagaaauugcucgccaggcagcccagaucaagcuccugcgaaaauuacaaaagcaggagcaggcucggguggccaaggaggccaagaagcagcaagcgaucauggccgcugaagagaaacguaagcagaaagaacagauuaagaucaugaagcagcaagagaaaauuaagagaauacagcagaucaggauggaaaaagagcugcgcgcccagcaaauucuagaggcaaagaaaaagaagaaagaagaggcugccaaugcaaagcuccuggaagccgagaaacggaucaaggaaaaagagaugagaaggcagcaggcuguucuuuugaagcaccaggagcgagaacgccggagacaacacaugaugcugaugaaagcgauggaggccaggaagaaggcagaagagaaagagcgucucaagcaggaaaaacgcgaugagaagcggcugaacaaagaaagaaaguuagagcagaggcgacuggaacuugagauggcuaaggaguugaaaaagccaaaugaagacaugugucucgccgaucaaaaaccccugccugagcuaccacggauccccggccuggugcucucggggagcaccuuuuccgacugccugaugguaguccaguuccuucgcaacuuuggaaagguguugggcuucgauguuaauauugacgugccuaaccugucugucuuacaggaaggucuccugaauauaggggauucaaugggcgaggugcaggaccuucugguaagauugcucagcgccgcugugugugacccgggacugaucacaggcuacaaagcaaagacugcccuaggggaacaucugcucaacguuggagucaacagggauaauguguccgagauucugcaaaucuuuauggaggcgcacugcggccagaccgaacuuacagagaguuugaagacuaaggcuuuccaggcccauacccccgcacagaaggccucugugcuggcuuucuuaauuaacgaacucgcauguagcaaaucagucguuuccgagaucgacaagaauauagauuauaugaguaaccugcggcgagacaaaugggugguggaagguaaacuuagaaagcugcgcaucauucacgccaaaaagacggggaaaagggauacaagcggaggcaucgaccuaggugaggagcaacauccacucggcaccccuacucccgggcguaagcggagaaggaaaggaggcgauucugacuacgaugacgaugacgacgaugacuccgaugaccagggggaugaagacgaugaggacgaagaggauaaggaggacaagaaaggaaagaaaacagauauuugcgaagacgaggaugaaggcgaccaggcggcuucaguagaggaacuggagaagcagaucgagaaauugagcaagcaacagucgcaguaccgccgaaaacuguucgacgccucucacaguuuaagauccgucauguuuggucaagaucgguauaggcgccguuacuggauacucccacagugugggggaauuuucguggaaggcauggagagcggugaaggccuggaggaaaucgcaaaggagagagagaaacuuaaaaaggccgaaucaguucagauuaaagaggaaauguucgagaccuccggggacucucugaauugcagcaacacugaucacugcgaacagaaggaggacuugaaagagaaggauaauaccaaccucuuucugcaaaagccuggaaguuucuccaaacuaagcaagcugcuugaaguggcuaaaaugcccccagagucugaagucaugacaccgaagccuaaugccggcgcaaacggguguacgcucucauaucagaauaguggaaaacauucccugggcagcgugcagucuaccgcuacucagucgaacguugagaaggccgacucaaauaacuuguuuaauacagguagcuccgggcccggaaaguucuacaguccacugcccaacgaucaauuacucaaaacccugacagagaagaaccggcagugguuuucucuucugccuaggacuccaugcgacgauaccagcuugacgcacgcggacauguccacagccucacucgugacaccccagagucagccuccgucuaaaagcccaucccccacuccugcaccccugggcucaagcgcucaaaauccaguaggucuaaacccuuucgcccugucuccccuucaggucaagggcgggguguccaugaugggacuccaguuuuguggcuggccaaccgggguggucacaaguaauaucccuuucacuagcucgguuccgucccugggaucuggcuuggguuuaucagaagggaacggaaauagcuuucugaccaguaacguggcuuccucuaaaagcgagucacccguaccacagaaugaaaaggcaacauccgcccaaccugccgcuguggaggucgcgaagcccguggauuucccaaguccuaaacccauaccggaagagaugcaguuuggcugguggcgcaucauugacccagaggaucucaaggcacugcuuaaaguucugcauuugcgaggcaucagagaaaaggcccuacagaaacaaauucagaagcaccuggacuauaucacgcaggcuugccucaaaaacaaggacguggccauaauugagcugaaugaaaacgaggaaaaucaggucacccgggauaucguggagaacuggagcguugaggaacaagcaauggagauggaccuuucuguguuacagcaggucgaagaucuggagaggcgcguagccucagcuucccuccaggugaagggguggauguguccugaacccgcgagcgagagagaggacuugguuuacuucgaacauaaaucuuuuacuaagcugugcaaagagcacgauggagaguuuacaggugaggacgagaguucggcccacgcacucgaaaggaaguccgauaauccacuggacaucgcugugacccggcuugccgaucuggagcguaacauugaacgccgaaucgaggaagacauugcacccggcuugagagucuggaggcgggcccuaagcgaggcucgcucagccgcgcaaguggcacuguguauacagcagcuccagaaaucuaucgccugggaaaagagcauuaugaagguauauugccaaaucuguagaaaaggggauaaugaagaguuacugcuucugugcgacggaugugacaagggcugccauacuuacugccacaggccuaaaauuacaaccaucccggauggugacugguucugucccgcuugcauagccaaggcuuccgggcagacgcucaaaaucaagaaguugcaugugaaaggaaagaaaacuaacgaaaguaagaaaggcaagaaggucacccugacaggcgauaccgaggacgaagauucagcaucuacuagcuccagucucaaacgggggaauaaggaccugaaaaagcgaaaaauggaggagaacacaagcauuaaccuuuccaagcaggaaucuuuuaccucaguuaaaaagccaaagagagaugacagcaaagaucuagcccuguguucgaugaucuugacagagauggaaacucacgaggacgcuuggccuuucuuacugcccgugaaucucaagcuggugccuggauacaaaaaggucauuaaaaagccaauggauuuuuccaccauccgcgaaaaacuuaguucuggucaauaucccaaccuggagacguucgcccucgacgugagguugguuuuugauaauugcgagacauucaacgaagacgacagcgauauaggccgggcagggcacaauaugcguaaauacuuugagaagaaauggaccgacacuuucaagguaucauga

SEQ ID NO: 53295 - RNA, 786 nt, Artificial Sequence
  derived and/or modified sequence opt3 from BBC3__Homo_sapiens__NP_001120712
augaaguucggcauggggagcgcccaggcuugccccugucaagugccuagagcagccuccaccacaugggucccaugccagaucuguggaccgagggagcggcacgguccccgcacuccuggcgggcagcugccaggagcgcgacguggccccgguccuagaaggccagcuccccucccugcccggccaccgggggcacuuggaucuguucugcgccccuugagagccaggccuggcugccggccacgccgaccccauccugcugcaagauguuuaccacugaggccccaccggccgacgcgucgccauagaaggccuggcggguuuccccuagccuggggaucaccacagccugcuccccggccagcccccggucgaaguagcgcgcucgcacuggccggcggggcugccccuggaguggcacgcgcucaaagaccaggcgguuccgggggaaggucucacccgggcggccccgggucgccucggggagguggcaccguagggccaggagaccgcggccccgccgcggccgauggugggagaccucagaggacagugcgugcagcugaaacucggggcgccgcugccgcaccaccccuuacccuggagggaccgguccagucacaucacggcaccccugccuugacacaggggccacaaagcccccgagacggagcucagcucggugcgugcacuagaccuguggauguuagggacaguggcgggcgcccccugccaccucccgauacacuggcauccgccggagacuuccucuguaccauguga

SEQ ID NO: 53296 - RNA, 312 nt, Artificial Sequence
  derived and/or modified sequence opt3 from BBIP1__Homo_sapiens__NP_001182233
augcugaaggccgcugcaaaaagacccgagcucagcggccuucugaaguucaacaauuacgggaucuuguccgaaucuccuuuaaccucacagaggacaacuuggcugcuauaucaaaguccgagcuuuauuccaggauucgccuaccccucccggugccucaaaacgauagguggcguguauaagcaggcgcgcaaaaagcacuacauccagcagcugcgauaugggcguucugaggucaacguuccuggaucgucaagcaaggcuagagccaccguguguggcagguacaaugacaacggugcaguauga

SEQ ID NO: 53297 - RNA, 1164 nt, Artificial Sequence
  derived and/or modified sequence opt3 from BBOX1__Homo_sapiens__XP_011518705
auggccugcaccauccagaaggcugaggcacuggacggcgcccaccucaugcaaauucuuugguacgaugaagaggaaagccuguaucccgcggugugguugagagacaacuguccuugcuccgauuguuacuuagacucugcuaaagccaggaagcugcuagucgaggcacucgauguuaauauagggaucaaaggacugauuuucgaccggaagaaaguguauaucacauggccagaugaacauuacucagaguuucaggccgacuggcuuaagaagcgcugcuucaguaaacaggcucgagcaaagcugcagcgugaguuguuuuucccggaaugucaauauugggguagcgagcuccagcugcccacucuggauuuugaagacguacucagauacgaugagcacgccuauaaaugguuauccacgcugaagaaagugggcauugucaggcuuaccggggcuucugacaagccuggagaggugucgaaguugggcaaacggauggguuuccuguaccuaacauuuuacgggcauacuuggcagguucaggauaagaucgacgccaacaauguggcguauaccacaggaaaacucucauuccacaccgacuacccagcacugcaucaucccccuggcguccaacuucugcacugcauaaagcagacugugacaggcggggauagcgaaaucguagacggauuuaacguuugucagaaauugaagaaaaauaacccacaggccuuccaaauucucaguuccaccuuuguggauuucacggacaucggugucgauuauugcgacuuuucugugcagagcaagcacaagauuaucgagcuggaugacaaaggccaggugguccgcauaaauuucaacaaugcuacuagagauaccauuuucgacguucccguggaaaggguacaaccuuuuuacgccgcauuaaaggaguucguggaucugaugaacuccaaagaaucaaaguuuacauucaaaaugaauccaggggacgucaucacuuuugacaacuggcggcuccuucacggacgccgaaguuaugaggcuggcaccgagauuagcagacaucuggaaggugccuacgcggauugggacgugguuaugucuagguugcggauccuacgucagcgcguggagaaugggaacuga

SEQ ID NO: 53298 - RNA, 2172 nt, Artificial Sequence
  derived and/or modified sequence opt3 from BBS10__Homo_sapiens__NP_078961
augcugagcuccauggccgcugcaggcucugugaaggccgcgcuccaggucgcugagguucuugaagccaucgugucaugcuguguagggcccgagggaagacaagugcugugcaccaaaccuacaggugaagucuuguuaaguaggaacggcgggcggcugcuagaggcacuccaccuggaacauccaauugcccgcaugauaguggacuguguuagcucccaccuuaagaaaacuggagauggcgcuaagacguucaucauuuuucugugccauuugcuccgaggucugcacgcaaucaccgaccgugagaaagauccgcugaugugugagaauauucagacacaugggagacacuggaagaacugcucuagguggaaguucaucucgcaggcccucuuaacuuuucagacccaaauacuggacggaaucauggaucaguaccuuucacggcacuucuugagcauuuuuaguuccgcuaaagaacgcacacuguguagaucuagccuagagcuccugcuugaagccuauuucugcggcagggugggccggaauaaccauaaguuuaucucccagcugaugugugacuacuucuuuaaaugcaugaccuguaagucagggauuggagucuucgaguugguggaugaccacuuuguagagcucaauguuggugugacuggccugcccgucagugauagccgcaucauagcgggguuagugcugcagaaagacuucucuguguaucgaccugcagauggagacaugagaauggucauuguuacagaaaccauccaaccacucuuuuccacgucaggcagcgaguucauucuuaacagugaagcccaguuccagacuucucaguuuuggaucauggagaagaccaaggcuaucaugaaacaucugcacucccaaaaugugaaguugcuaauuagcucgguaaaacagcccgaucuggugucuuacuaugccggugucaacgggauauccgugguugaaugccucucaagugaggaggugagccugaucaggcggauuaucggacuuuccccuuucgucccaccccaggcauuuucucaaugcgaaauaccuaauacagcucuggugaaguucuguaaaccauugauucuccguagcaagcgcuacguacaccugggcuuaaucucaacuugcgccuuuaucccgcauaguauuguucuguguggccccgugcacgggcuaaucgagcagcaugaagacgcgcuccacggagcccugaaaaugcuuagacaguuguucaaggaccuggaucucaacuauaugacccagacaaaugaccaaaacgguaccuccagccuguuuauuuacaaaaauucuggcgagucauaccaggcaccugauccagggaacggaaguauacagaggcccuaucaggacacggucgcugaaaauaaggaugcccuugagaagacucaaacauaccugaaagugcauagcaacuuggucaucccugacguggagcucgaaaccuauauuccauacuccacucccacacugaccccgacggauaccuuccagacaguugagacuuuaaccugccugucucuagaacggaaccgacucacagacuauuacgagccucugcuuaagaauaacucgacugcuuauagcacccgcggcaauagaaucgaaaucuccuacgagaacuugcaagugacaaauauuaccaggaaagguucaaugcugcccguaaguuguaagcucccaaacauggggacuucucagagcuaccuguccucaagcaugccugccggcugcgucuuacccgugggaggcaauuuugagauacugcuucacuauuacuugcucaacuaugcaaagaaaugucaccagucugaagagacgaugguuuccaugaucauugccaaugcucugcuagggaucccaaaggugcuguacaaaaguaagacaggaaaauauagcuucccccauaccuacauucgggcgguccacgcacuccagacuaaccagccucuggugucuucccagaccggucuugaaucaguaaugggcaaguaucaauugcugacaaguguguuacagugccucaccaagauccugacuauagauaugguuaucacagucaaacgccauccacagaaggugcacaaucaagacagcgaggaugagcuuuga

SEQ ID NO: 53299 - RNA, 2133 nt, Artificial Sequence
  derived and/or modified sequence opt3 from BBS12__Homo_sapiens__NP_689831
auggugauggccugcagagucguuaacaagaggcggcacaugggccugcagcaacucagcuccuucgcugagaccgggcgcacauuucuuggaccccugaaaucuucaaaguucaucauugacgaagagugucaugaaaguguguugauaagcuccacuguacgauuacuggagucucuagaucucacgucggcagugggucagcugcuuaaugaagccguccaggcgcagaacaauaccuaccguacaggcaucucaacucuguuguuucucgugggggcuuggagcagugccguugaggagugccugcaccugggagugccuauuuccaucauugucucugugaugagcgaaggccucaacuucuguuccgaggaaguaguuucauuacaugugccaguccacaauaucuuugacugcauggauaguaccaaaacauucagccaacuggagaccuuuucugugucccuuuguccguucuugcaagugcccucagacacugaucugauagaggaacuacauggucucaaggacgucgcaagccagacacugaccaucaguaaccuuucugggagaccucugaaauccuaugaguuguuuaagccacagacgaagguugaagccgauaauaacacuagcaggacccucaaaaauucgcuguuagcugacacaugcugucggcagucuauucugauccacucccgccacuucaacagaacugauaauaccgagggagugucaaagcccgacggcuuucaggaacauguaacagcaacccacaaaacguacaggugcaacgaucucguggagcuugccgucggccugagucauggggaccacagcuccaugaaguugguggaggaagcuguucagcuacaguaucaaaaugccugugugcagcagggaaacugcacuaaaccuuucauguuugauauuucucggaucuucacauguugccugccaggucuccccgagaccagcucaugcgucuguccuggcuacauaacugugguaaguguuuccaauaacccagugauuaaggaacugcaaaaccagccgguccgcaucgugcuuauugagggggaccugacagaaaauuaucgacacuugggauucaacaagagcgcgaauaucaaaaccguccucgacucuaugagacugcaggaggauucaagugaggaauuaugggcaaaccaugugcugcagguucuaauccaauuuaaggugaaucucguacugguccagggcaacgugagcgagaggcuuauugaaaaaugcauaaauuccaagcgguugguuaucgguucugugaacgggucggucaugcaggccuucgcugaggccgcaggagcugugcagguagccuacauuacgcaagugaaugaagacuguguuggcgauggcgucugcgugaccuuuuggcguagcucaccccuggacguggucgaucgcaacaauagaaucgcgauacuccugaaaacagaggggauuaaccuuguuacugccgugcugaccaauccugugacagcacagaugcagaucaaggaggacagguucuggacuugugcuuaucgguuguacuacgcccucaaagaagagaagguauuucugggagguggcgcugucgaguucuuaugccuguccugucuacacauccucgccgaacagagucugaagaaagagaaccaugcaugcucuggguggcuucacaauaccagcuccugguuggccucaagccuggcuauuuaucgaccaacagugcucaaguuucuggcgaacggauggcaaaaauacuuaucuacccugcuuuauaacacugcaaauuacuccagugaguucgaagccagcacguauauccagcaucacuugcagaacgcuacagauucuggcucccccucaaguuacauucucaaugaauauagcaagcugaacucgcgcauauuuaauuccgacaucucuaacaaacuagagcagauuccuagaguuuacgauguggucaccccaaagaucgaagccuggaggcgggcacuggaccucgugcugcuuguuuugcaaacugauagcgagaucauuaccggucacgggcauacacagauaaauucacaggagcugaccggcuucuuauuucucuga

SEQ ID NO: 53300 - RNA, 1782 nt, Artificial Sequence
  derived and/or modified sequence opt3 from BBS1__Homo_sapiens__NP_078925
auggccgcugcaagcuccucugacucagaugccugcggcgcggagaguaacgaagcuaauagcaaguggcuggacgcccacuacgaucccauggcaaacauccauaccuucuccgccugucucgcucuugcagaccugcacggggauggagaguauaaauugguggucggugacuuaggcccugggggacagcaaccaagacugaagguucuaaaaggcccgcucgugaugacagaaucuccccugccugcccuuccagcugccgcggcaacuuuucugauggagcagcaugaacccaggacgccugccuuggcucucgccucggguccaugcguauacguguauaagaaucugcggcccuacuucaaauuuucacugccucagcucccaccgaaccccuuagagcaggaucuguggaaucaagcaaaggaggaccgcauugauccucuuaccuugaaggaaaugcuggagagcauacgagaaacagcugaggagccacuaaguauccagucccuccguuuccugcagcuugaacugucugagauggaagccuuugucaaccagcacaaaagcaauuccauuaagagacaaacugugaucaccacaaugaccacuuugaaaaagaaccucgcggacgaggaugccguuucaugucugguguuagggacagaaaauaaagagcugcucguccuugaccccgaggcauucaccauucuggcuaagaugaguuugccuagcgugccaguauuucuagaaguuucuggacaguucgauguggaguuuaggcuggccgcugccugccggaacggcaauaucuauauacuccgcagagacuccaagcaucccaaauacuguaucgaacugucagcacagccggucggccuuauuagggugcacaaggugcuggucguugggagcacgcaggacaguuugcacggauucacucauaaagguaagaaacucuggaccgugcaaaugccugccgcuauccugacaaugaacuuacuggagcagcacucucggggccuacaggcgguaauggcagggcucgccaauggagaagugcgcauuuaucgagauaaggcucugcuuaacgucauccauacucccgacgccgugaccuccuugugcuuuggcagauacgguagggaggauaauacacugauaaugaccacgcgugggggaggccucauuaucaaaauucugaagcggacugcaguuuucguggagggcgggagcgaagucggaccaccucccgcccaagcuaugaaacuuaacgugccacgcaagacaagacuguacguagaccagaccuugagggagcgggaagccgguacugcaaugcaccgagcguuucagacagaucucuaucuguuacgccugagagcugccagggcauaccuacaggcccucgagucgucucugaguccccuuucaaccacggcucgggaaccuuugaagcugcacgccguugugcaaggccucgggccaaccuucaaacugacauuacaucugcagaacacuuccaccacacgcccgguccuuggauugcucguguguuuccuguauaaugaggcacuauacagccugcccagagccuuuuucaaggucccucuccuggugccaggccuuaacuaucccuuggagacuuuuguugaaucccugucuaauaaagguaucagcgacaucauuaagguguuaguacucagggaggggcagucagcuccucugcuuagugcgcacgucaacaugccaggcuccgaaggacuggccgcugcauga

SEQ ID NO: 53301 - RNA, 2166 nt, Artificial Sequence
  derived and/or modified sequence opt3 from BBS2__Homo_sapiens__XP_005256137
augcugcuccccguguucacccuuaagcugagacacaaaaucagcccuaggauggucgccauuggccgguacgacgggacacauccaugcuuggcugcagccacucagacgggaaagguuuuuauacacaacccgcauacccgcaaucaacacguguccgcgucucgaguauuccagucacccuuagagagugaugugagccugcuauccaucaaccaggcugucucuugucucacagccggugugcugaauccugaacuuggcuaugacgcacuguugguugggacucagaccaaccuccuggccuacgauguguauaauaacucggaccuguuuuaccgugaggucgcugauggagcaaaugccauugugcucggcacauuaggugacaucucaagcccacuggcuauuaucgggggaaacugcgcccuucaaggcuucaaucaugaaggcagugauuuguuuuggaccguaacuggggacaacguuaauucccuggcgcuaugugauuucgacggagaugguaaaaaggagcuccuggugggcucugaagacuuugauauaagagucuucaaagaggacgagaucguggcagaaaugacagagaccgaaauugugacgagccuuugccccauguauggguccagguuuggauacgcccugucaaacggcacugucgguguuuaugacaagaccagucgguacuggcgcaucaagagcaaaaaucacgcuaugucuauucacgccuucgauuugaacuccgacggggugaaugagcucaucacaggauggucaaacggcaagguagaugcaagaagcgacaggacuggcgaggugauauuuaaagauaacuucaguucugcuauugccggggucguggaaggagacuaccggauggauggucauauccagcugauuuguugcuccguugacggcgagauccgcggguauuuaccuggaaccgcggaaaugcgaggcaaucugauggauacaagcgccgagcaggaccucaucagagaacuuucgcagaagaaacaaaaccuguugcuagagcugaggaauuacgaggaaaacgcaaaggcugagcucgccucuccacugaaugaagcugauggucaccgggggauuauacccgccaacacccgucuucauacgacucuguccgugucauugggcaaugagacacagaccgcacacacugaacuccgcaucaguacaagcaacgacaccauuaucagagccguccugauauuugcugagggaauuuucacgggcgagucccacgugguacauccuucuauccacaauuuaagcucaaguaucuguauuccaaucguuccgcccaaggacgugccugucgaucugcaucuaaaagcguucgugggguauagguccagcacccaguuucacgucuucgaaucuacacggcagcucccacgauuuucaauguacgcacugaccagucuugaccccgccagcgagccuauuuccuaugugaacuucacuauagcugaacgcgcccaaagaguugugguaugguugggacagaauuuucugcucccagaggauacacauauccagaacgcacccuuccaagucugcuuuacuucucugaggaaugguggccaccuucacauuaagaucaaacugucgggggaaaucaccauuaacacagacgauauagacuuggccggagauaucauucagagcauggcuuccuucuuugccaucgaggaccuccagguggaggcagauuucccgguuuacuuugaggaacugcggaagguguuagucaaaguggacgaauaucauucaguacaccagaagcugagugcggauauggcugaccauucuaaucuaauucgcagccuccuggugggcgccgaggaugcaagacuuaugagggacaugaaaaccaugaagucccguuacauggaguuguacgaccugaaccgggaucuccugaacgguuauaagauccgauguaauaaccacacugaauuacuggggaaucuuaaagccguuaaccaagcuauacagagagccggcagguugcgcgucggaaagccuaaaaaucaggugaucacggcaugccgggacgcuauuagaucaaacaauaucaacacacucuucaagauuaugagggugggcaccgccagcucuuga

SEQ ID NO: 53302 - RNA, 1560 nt, Artificial Sequence
  derived and/or modified sequence opt3 from BBS4__Homo_sapiens__NP_149017
auggccgaggaaagaguggcuaccaggacacaguuccccgucagcacugagucccaaaagccucggcagaaaaaggcaccagaauuuccgauccuggagaaacagaacuggcucauucaccuucauuacauacgcaaggacuaugaagccugcaaagcgguuaucaaggagcagcugcaagagacgcagggcuugugugaauacgcuauuuaugugcaggccuuaaucuuccgacuggaggggaauauucaggaaucucuagagcucuuucaaaccugcgcaguacugucaccccagagugccgauaaccuuaaacagguggcucguagccuguucuugcucggaaagcacaaggcagccaucgaggucuacaaugaagcugccaaacugaaccagaaggacugggagauaucccauaaucuggguguguguuauaucuaccucaaacaauuuaacaaggcgcaggaucaguuacacaaugcacugaaccuuaauagacaugacuugacauauauuaugcugggcaagauccaccuacucgaaggggaucuggacaaagccauugagguuuacaagaaagcuguggaauuuucuccugagaacacugagcuucugaccacauugggacuccuguacuuacaacugggcaucuaucagaaggccuuugaacaccucgguaaugcacuuaccuacgauccaacuaacuauaaagcuauacuggccgcggggucgaugaugcagacacauggagacuucgaugucgccuugaccaaguacagggugguagcaugcgcuguucccgagucaccuccacuauggaauaacauuggcauguguuucuucggcaaaaagaaguauguggccgcuaucagcugccugaaacgggccaauuaccucgcacccuuugacuggaagauucuguauaaccuugggcugguccacuugacgaugcagcaauacgccagugcuuuccauuuucucuccgcggcaaucaacuuccagccuaaaaugggagaacuguacauguuacuggccguggcucuaacuaaucucgaggauaucgaaaacgccaagcgcgcauaugccgaggcugugcaccuggacaaauguaauccacuugucaacuugaauuacgccguucugcucuauaaccagggugagaagaagaaugcacuggcgcaguaccaagaaauggagaaaaaggugucucuucugaaagauaacagcuccuuggaguucgacucagaaaugguagaaauggcucagaagcucggcgccgcauuacaggugggggaggcccuggucuggaccaaaccggugaaggaccccaagaguaaacaccagacaacuagcaccucuaagccugcuuccuuucaacagccacugggaucaaaucaggcccuaggccaggcaaugagcagugcugccgcguauagaacacuccccucuggugccgggggaaccucccaauucacgaaaccuccaagccugccccuugagccggaaccugcuguugagucgucucccacugaaacauccgagcagauuagggagaaguga

SEQ ID NO: 53303 - RNA, 1026 nt, Artificial Sequence
  derived and/or modified sequence opt3 from BBS5__Homo_sapiens__NP_689597
augagcgugcuggacgcccucugggaggauagagacgucagguucgaucuuuccgcucagcaaaugaagacccggcccggcgaaguucugaucgacugcuuggauucuauugaggacacaaaagggaacaauggagaucgcggucgauuacuggugacuaaccuacguauacucuggcacucacuggcacuuaguagaguaaaugugagcgucggcuacaacuguauccugaauauuacgaccaggacagccaacuccaaguugcgggggcagacugaagcgcucuauauccugaccaaaugcaauucuacacgcuuugaguucauuuuuaccaaccuggugccuggaucgccaagacucuucacuucaguuauggcugugcauagggccuacgaaacaagcaagauguaucgggacuuuaaauuacgcagugcacugauccagaauaagcagcuucgauugcugccgcaagagcacgucuacgauaagauaaacggcguguggaaucuauccucugaccaggguaaccucgggaccuucuuuaucacgaauguaagaauuguuuggcaugccaacaugaaugauagcuucaacguguccauccccuaucugcagauuaggucaaucaaaauacgggacaguaaguuuggacuugcucuggucauugagagcucucagcaauccggcggcuacguguugggguucaaaaucgauccuguggaaaagcuccaggagucagucaaagaaauuaacagccugcacaagguuuauagugcaucuccaaucuuuggaguggacuacgagauggaggaaaagccccagccuuuagaggcccugacuguagaacagauccaagacgauguggagauugacuccgauggucauaccgacgcuuucgucgccuacuuugcggauggcaauaaacagcaggaccgugaaccaguguucagcgaggagcucgggcuugcaauagaaaagcugaaagauggauucacauugcaaggccuaugggagguuaugucguga

SEQ ID NO: 53304 - RNA, 2019 nt, Artificial Sequence
  derived and/or modified sequence opt3 from BBS7__Homo_sapiens__NP_060660
auggaccugauccucaacagaauggauuaccuucaggugggcgucaccagccaaaagacaaugaaacugauucccgccuccaggcaccgggcuacucagaagguugugauaggggaccaugauggaguagugaugugcuucgguaugaaaaagggcgaggcagccgcggucuuuaaaacguugccugggccaaagaucgcucgcuuagaacugggaggcgugauuaauaccccgcaggagaagaucuucauugccgcagccucugaaauccgagguuuuacaaaacgugggaagcaguuccuaucauuugagacuaaccucaccgaaaguauaaaagcuaugcacaucagcggauccgaccuguuccuuucugcaucguauauuuacaaucauuauugugauugcaaggaccaacacuacuaucugucaggcgauaaaaucaacgacguuauuuguuugcccguggagagacucagcaggaucacaccuguccuggccugccaggaucgggugcugcgcguacuccagggcagugacguuauguacgcuguggaggucccagggcccccuaccguguuagcccugcauaauggaaacgguggcgauuccggggaagaccuuuuguuuggaacuucugauggcaagcuggcgcuaauacagauuacaaccagcaagccagugagaaaaugggagauccaaaaugaaaagaaaaggggugggauucucuguaucgacuccuucgacaucgucggagauggcguuaaggaccugcuugugggccgggaugacgggaugguagagguguauucauuugauaacgcaaaugagcccguccugcgcuucgaccagauguugagugaaagcgugacgucuauucagggagguugcguuggcaaagauuccuacgacgagauaguggucucaacuuacagcgggugggugaccggacucacaacugaaccuauccacaaggagaguggcccaggugaggaacugaaaauuaaccaggagaugcaaaauaagaucucuuccuuacgaaacgaacuggagcaccuccaguauaagguacuucaggaaagagagaauuaccaacagagcucgcagucuuccaaagccaagucagcuguuccgaguuuugggauaaacgauaaauucacccugaauaaggacgaugccagcuauuccuugauucuagaagugcagacagcaaucgacaacguccugauccaaucugacgugcccauugaucuccuggacgucgauaaaaacagcgcugugguuucauuuaguuccugugacagcgagucuaaugauaacuuccuucuggccaccuacaggugccaggcggacacgacucgguuggagcucaagauccguucaauugaaggccaguauggaacacugcaggccuacgugaccccucgcauacaaccaaagacuugucagguaagacaguaucauaucaaacccuuaagucugcaccagaggacacauuucauugaucacgaccggccuaugaauacccuaacgcucaccggccaauuuagcuucgcagagguccacuccugggugguguuuugccugccagaaguucccgagaagccgccugcuggggaaugugucacauucuacuuucagaacacuuuccuugauacccaguuggagucuacauaccgaaaaggagaggguguguuuaagucggacaauaucagcacuaucuccauucugaaagauguacucucaaaggaagccaccaagcgcaaaauaaaccugaauaucaguuaugagauuaacgaagugucuguuaagcauacacuuaaacugauccaccccaaguuggaguaccagcuccuguuagcuaaaaagguccaacugauugacgcccuaaaggagcuccagauccaugaaggcaauaccaacuuccugauaccagaguaucacugcauccuugaagaggcagaucauuugcaggaagaguacaaaaagcaaccugcccaccuggagagacucuauggguga

SEQ ID NO: 53305 - RNA, 2559 nt, Artificial Sequence
  derived and/or modified sequence opt3 from BBS9__Homo_sapiens__NP_001028776
augagccuguucaaggccagagacuggugguccaccauccucggcgauaaagaggaauuugaccaggggugccuuugucuggcuaacguggauaauucuggaaacggucaagacaagauuauagucggcucauucaugggguacuugaggaucuuuaguccccacccugcaaaaacaggagauggcgcccaggcggaggacuuacugcuagaaguugaucuccgggacccagugcugcagguagagguggguaaguucgucagcgggacugaaaugcuucaucuggcuguguugcacucccgcaaacucugcguuuauucugugucgggaacgcugggcaaugucgagcauggcaaccagugucaaaugaagcugauguacgagcacaaucuccagcgaaccgccugcaacaugacauaugggucauuuggaggugugaagggccgugauuuaauuuguauccagagcauggacgggaugcugaugguauucgaacaggagaguuacgcauuuggaagauuccuuccgggcuuuuugcugcccgguccucuagccuauuccucuaggacugauagcuuccucaccguuuccucaugccaacagguggaaaguuacaaauaucagguccuggcuuuugcaacagacgccgauaagcggcaggagaccgagcaacagaaacuugggagcggaaagcgccuggugguggacuggacuuugaauauuggcgaacaggcucucgacaucuguauagucucuuucaaccaauccgccucaagcguuuuugugcugggcgagagaaauuucuucugcuuaaaagauaacgggcagaucagguuuaugaagaagcuggacuggaguccaucuuguuuccuccccuacugcuccguaagcgaaggaacaauuaauacccuuaucgguaaccauaauaacaugcugcacauuuaccaggaugugacguugaaaugggcgacucagcuaccucacaucccagucgcagugcggguuggcugucugcaugaccucaagggggugauagucacccugucggaugacggacaccuucaaugcucuuaucugggcacagaucccuccuuguuucaggccccuaaugugcagucacgcgagcucaacuacgacgaacuggauguagagaugaaagaguuacagaagauuaucaaagacguuaacaagagucaagguguguggccaaugacugaacgagaggaugaccugaaugucagcguggucguguccccgaacuucgacucuguuagccaggcuaccgauguggaaguagggacagaccuaguccccucagugaccguuaaagugacgcuccagaauagagucauucugcagaaggccaaacuuaguguguauguacaaccuccauuggagcugacuugcgaucaguuuacauucgaauuuaugaacaggaaucccgacggcaucccucgggugauccaguguaaguuccgucucccacugaaacuuauuugccugcccggacagccguccaagaccgcaagccauaagauaacuaucgauacaaacaaaucuccuguuucauugcucagucuguuucccggcuucgcuagccaauccgacgaugaccaggucaaugugaugggguuucacuucuuaggaggugcccgcauuaccgugcuggcgucuaagacgucgcagagauacaggauccaaagcgagcaguuugaggaucuauggcucauaaccaacgaacugauucuucgguugcaggaguauuucgaaaagcagggcgucaaagacuucgccuguuccuuuucagggaguaucccacugcaagaguacuucgaacucaucgaucaccauuuugagcugcgaauuaauggagagaaguuagaagaacugcuuucugaacgcgcaguucaguucagagcuauccagaggcgguugcucgcccgcuuuaaagacaagacuccugcuccccugcagcaccuagauacacugcucgacggcaccuauaaacaagugauugcccuggcagacgccguggaggagaaccaggguaaucuuuuccagagcuuuacaagauugaaguccgcuacucaucugguaauauuacucaucgcgcuguggcagaaacuuucagcagaucaagucgccauucuggaagcugccuucuugccacuccaggaggacacccaggaacuggggugggaggaaacaguggaugcagccaucagccaccuacugaagaccugccucucuaaguccaguaaagagcaagcucugaaccuuaauagccaguugaacauccccaaggacacuucucagcugaaaaagcauauuacguuacucugugauaggcuguccaagggcggacgucuuugccugucaacagacgccgcagcgccucagaccaugguuaugccaggcggguguacuaccauaccggagagugaucuagaggagcggagcguggaacaagacucgacagagcucuuuaccaaucaccgacaccugacugcugaaacacccagaccugaggucuccccauugcagggagugucugaguga

SEQ ID NO: 53306 - RNA, 2826 nt, Artificial Sequence
  derived and/or modified sequence opt3 from BBX__Homo_sapiens__NP_001136040
augaagggcagcaacagaaauaaagaccacuccgccgagggggaaggaguggguaagaggcccaaacggaagugccugcaguggcauccucuccuugcuaaaaagcuguuggauuucucugaggaagaggaagaggaggacgaagaggaagauaucgacaagguccaauuacugggcgcagaugggcuagagcaggacguuggagagaccgaagaugacgagucaccagaacagcgcgcccgacguccgaugaacgcguuucuccuguucuguaaaagacacaggagucuugugcggcaggagcauccccgccuggauaauagaggcgcuacaaagauuuuggccgacuggugggcaguacucgauccuaaagaaaagcaaaaauacacugacauggccaaggaguauaaggaugcuuuuaugaaagcaaacccagguuacaaguggugccccacgaccaauaaaccugugaaguccccaacacccacugucaacccuaggaaaaagcugugggccuucccauccgacucuucgcgggaccugccgucacccaaaaaggcuaagaccgaggaaaugccucagcucaauuuugggauggccgauccaacacagaugggaggcuuaagcaugcugcuuuuggcgggcgagcacgcacuggggacccccgaagugaguuccggaacuugucgcccugacguuucugagagcccagaacuacgacagaaaagcccccucuuccaauuugccgagauaucaaguagcacaucucauuccgaugcuucaaccaagcagugccagacgagcgcccuguuccaguuugcagagaucaguucuaacacuucccaacuugguggcgcugaaccggugaaaagaugugggaaguccgcccuguuccaguuggcggagaugugccucgccucggaaggaaugaaaauggaggaaucuaagcugauuaaggcaaaagaguccgacggcgguaggaucaaggaguuagaaaaagggaaggaggaaaaagagauuaagauggagaagaccgaugaaacacggcugcagaaagaggcugaauuugagaagucagccaaagaaaaucuccgugacaguaaggagcuucgcaacuucgaggcucugcaaaucgaugacauaauggccaucaaaauggaagauccuaaggagauuagaaaggaagaguuggaagaggaccacaaauguagccacuuucccgauuucuccuauucugcaagcucaaagaucauuaucagugacgucccauccaggaaagaccauaugugccacccucauggaauaaugauuaucgaggaucccgccgcucuaaauaagccagaaaaacugaagaaaaagaagaaaaagagcaaaauggaccggcacggcaacgauaagucuacucccaaaaagaccuguaagaaacgacagucaagugagagcgacauugaauccgugaucuacacaaucgaggcgguagcaaagggcgauugggggauugaaaaacucggagacaccccucgcaagaaaguuagaacgucuucgagcgguaagggcuccauacuggaugccaagccaccgaaaaagaaagugaagucaagggagaaaaagaugaguaaggagaaaucuagcgacacuacaaaggaaucccggcccccugauuucaucucaauuagcgcuucuaaaaauaucuccggggagaccccagaaggaauaaaggccgagccccuuacuccuauggaggacgcacugccacccaguuugagcggccaggccaaaccggaagauucugacugccaccgcaagauugagacaugugguuccagaaaaucagaaaggaguugcaagggggcucucuauaagacccuggucagcgagggcauguuaacgucgcugcgugccaacguggaucggggaaaacgauccucuggcaaggggaauagcucagaccaugaaggaugcuggaacgaggagaguuggaccuuuucccagucugguacaagcggcuccaaaaaguucaaaaagacuaagccuaaagaagacugucuacucgggucagcaaagcuggaugaggaauuugagaaaaaguucaacagccuuccacaauacagucccgugaccuuugacagaaaaugcgucccuguucccaggaagaagaaaaagacaggaaaugugucuuccgaaccaacuaaaaccagcaagggcccuuuccagucgcagaaaaagaacuuguuucacaagaucguaucaaaauauaagcauaaaaaggagaaacccaaugugccagagaaggguucuggggauaaguggaguaacaaacagcuguuccucgacgcgauccacccgacagaagcuauuuuuagcgaggaucgcaauaccauggaaccuguccauaaggugaaaaacauccccagcauuuucaauacuccagagcccacgacaacccaagaaccucugguuggcucucagaagcggaaagccagaaagacuaaaauaacccaccuugugaggacagcagacggacgcgucagcccagccggcgggacccuggaugacaagcccaaggagcaguugcagcgaucccucccuaaagcuacugagacagauuguaacgacaagugcucacacaauacggaagugggagagacccggaguagcacuccggaaaugccagccguaucugcauuuuucucccuggcugccuuagcggagguugccgcuauggagaacgugcaucguggucaaagaucaacaccccugacccacgauggccagccuaaagaaaugccacaggcacccguccuaaucaguugugccgaccaguga

SEQ ID NO: 53307 - RNA, 1767 nt, Artificial Sequence
  derived and/or modified sequence opt3 from BCAM__Homo_sapiens__NP_001013275
auggagcccccugacgccccagcucaggcaagaggcgccccgaggcugcuccuucuggcgguguuguuagcugcccaccccgaugcacaagccgaaguccggcugagcguuccuccucuaguggagguaaugcgcgggaaguccgugauccucgacugcacccccacaggaacucaugaucacuacaugcuggaaugguuccuuacggaccgaucuggugcucguccuagacuggcaucagccgagaugcagggcagugaauugcaggucaccaugcaugauacaagggggcggagcccacccuaucagcucgacucccaaggacgccuggugcuggcugaggcccagguuggcgaugagagagacuacgugugugucgugagggcgggugcagccgggacugcugaagccaccgcacggcucaacguauuugcuaagccugaggccacagaaguuucuccaaauaagggaaccuuaucggugauggaggauucagcgcaggagauugccacuugcaacagccgcaauggcaacccggcacccaaaauaacaugguaucgaaauggccagagacuggaagucccuguggagaugaacccagaaggguacaugaccaguaggacggugcgggaggcuuccggacuuuugucucugacuagcacccuauaucuccgucugcgcaaggacgauagagacgccuccuuccacugugcugcccauuacucacuucccgaagguaggcacggccggcuggauaguccuacauuucacuugacucuccauuauccaaccgagcacguccaauucuggguugggagccccucuacaccggcaggaugggugcgagagggcgacaccguacagcuguuaugccgcggugacggguccccuucacccgaauacacgcuguuuagacuccaggaugagcaggaagaggugcuuaaugucaaccuggaaggaaauuugacucuagagggcgugacaaggggccaaagcgggaccuacggaugucggguugaggacuaugaugccgcugacgaugugcagcugaguaaaacucucgaacugcgcgucgcguaccuugacccacuggaguugucugaagguaaggugcucucccugccuuuaaacagcucggcaguaguuaauugcucugugcauggccugcccacaccagcccuaagauggaccaaggauuccacgccccucggggacggaccuaugcugucacuuaguagcaucaccuucgauuccaacggcacauaugucugugaggcuucuuugccaacugugccgguccugagcaggacccagaauuuuacacuccuggugcaagguucacccgaacuuaaaacugccgagauugagccuaaggcagacgggaguuggcgugaaggcgaugagguuacccugaucugcuccgcccggggacacccagaccccaaauugagcuggucucagcucggcgggucaccagcugaaccaauucccggacgacaggguugggugaguagcucccugacauuaaagguaaccucugcccugucgagagacggcaucagcugugaggcauccaacccgcacgggaauaaaaggcaugucuuccacuuuggaacugugucaccucagacgagucaagcgggcguugcugugauggccgucgcagugucuguaggucuacuccugcuugugguugccgucuucuacugcgugcgccggaaagggggcccauguugcagacagaggcgcgagaagggagcucccuga

SEQ ID NO: 53308 - RNA, 2016 nt, Artificial Sequence
  derived and/or modified sequence opt3 from BCAN__Homo_sapiens__NP_940819
auggcccagcuguuccucccccuucuggcugcauugguguuagcccaagcgccugcugcccuggcagacguccuagagggcgauagcuccgaagacagagccuuuaggguucggaucgcuggggaugcaccacuccagggagugcuggguggcgcccuuaccauuccgugccacguacauuaccugcgacccccuccaucucgccgugcuguguuggggucacccagagucaaguggacauuccucaguaggggacgggaggccgaagugcugguugcgcgcggcgugagagucaaagugaacgaggcauauagguuucggguagcccugccugcuuacccagccagccucacugacguuuccuuagcacugucugaacuucgccccaaugauucggguauauaucgaugugaggugcagcacgggaucgacgauucaagcgacgcugucgaggugaaggugaaaggagucguuuucuuguacagagaaggcagugccagguaugcguuuuccuucucuggcgcccaggaggcaugcgcucggauuggggcccauaucgcuacgccugaacaacuguacgccgcauaucuaggagguuacgagcagugugaugccggcuggcucagcgaccagaccgugcguuacccaauucagacaccgcgcgaggcuugcuauggggauauggacggauuucccggcguaagaaacuacgguguggucgauccugacgaccuguaugauguguacuguuaugcggaagaccuuaauggggagcuguucuugggagauccacccgaaaagcucacucuggaggaagcaagggccuacugccaagagcggggcgcugagaucgccaccacaggccaguuauaugcagccugggacgggggacuggaucacuguuccccugguuggcucgcugacggcucaguucgauacccaauagugacccccagucagcgcugcgggggaggccuuccgggugucaaaacucuguuuuuguucccuaaccagacaggguuucccaauaagcauagcagauucaacguguacuguuuuagggauucugcccaaccauccgcaaucccugaagcgucaaaucccgcuagcaacccagccagugacggccuagaggcaauuguaaccguuacggaaacucuggaggaacuccagcugccccaggaggccaccgagucugaaucccggggagcuaucuauagcauuccuaucauggaggauggcgggggagguucgucuacaccagaagacccggccgaggcaccccgcacucuucuggaguucgaaacccaauccauggugccuccaacaggcuucucagaggaagaggggaaggcuuuggaagaggaggaaaaauacgaggaugaagaggaaaaggaggaggaagaggaagaggaagaggucgaggacgaagcccucugggcguggcccagugagcugagcuccccuggaccagaagccucuuuacccaccgagccggcugcacaggaagagagccugucacaggccccugcuagagccgugcuacagccaggcgcaaguccccucccugacggugaguccgaagcgagcaggcccccacguguccacgggccucccacggagacucugccaacaccgcgggaacgaaaucuugccucuccuucacccaguaccuugguggaggcuagagagguuggcgaagccacuggaggcccagagcugagcggggugcccaggggagaauccgaggaaacagguucuucggagggcgcaccuagccuccugccagcuacccgcgcccccgaggggacgcgggaacuugaggcaccuuccgaagauaacucaggaagaaccgccccggcuggcacaaguguacaagcgcagccaguccugcccacugacucugccagcaggggugggguggcaguugugccugcuuccggcaauucagcccagggaagcaccgccuugucuauacuccuguuauuuuucccacugcagcuaugggucacauga

SEQ ID NO: 53309 - RNA, 1047 nt, Artificial Sequence
  derived and/or modified sequence opt3 from BCAP29__Homo_sapiens__NP_001008405
augacccugcagugggccgcuguggcaacauuccucuacgccgagaucggccuuauucugauauuuugcuugcccuucaucccuccacaaagauggcagaagauuuuuagcuucaacgucugggggaaaaucgcgacuuuuuggaauaaggcuuucuuaacgauuaucauacugcuaaucguucucuuucuggacgccgugagggaaguacggaaauauuccucugugcacaccauugagaagucaaguacaagccgcccggaugcauacgaacauacucagaugaaacuuuuccgaucccagcguaaccuguauaucucuggauuuucguuguucuuuuggcucguccugagaaggcuggugacccucauuacacaauuagccaaggagcugucaaauaaggguguucuuaaaacccaggcugaaaacacuaauaaggcagccaaaaaguucauggaggagaacgaaaaauugaagcggauccuaaagagccacggcaaagacgaggaaugugugcuggaggcugagaauaagaaacucgucgaagaucaggagaagcugaaaacagaacuucgcaagaccagugacgcccuguccaaagcgcagaacgaugugauggagaugaagaugcaaucugaaagauugagcaaggaguacgaccagcuccugaaagagcauuccgaauuacagcacucaaguuuuggggaguuccugagcaagaggucucauaaaaauggauccauaggcaagcagacggguucacggaaagggagcuuccgcaagcgacaacaggaaaagacuguaaacuuuauuaaagauaccugcaauauccucugucagaacgacaauuucguuaugcuugcaaguagaaaguuuaaauucaggaagaugcacuaugaucgguuugugauuuuccugaugccccacaucggaugcaucgucauggccuugucuaaauaccuaaugauguuucaaauuuauuguaaggugugcauaccugcucugaagaaaaacaucuccaugcucaauacaauuuucacuuacuga

SEQ ID NO: 53310 - RNA, 942 nt, Artificial Sequence
  derived and/or modified sequence opt3 from BCAP31__Homo_sapiens__NP_001132929
augggcgccgaggcuagcuccucuuggugccccgggaccgcacugccugaagagagacucucagugaagagggccagugaaaucagcggauuccuuggucagggcuccucuggggaggcggcucuggacgucuugacacacguuuuagaaggagccggcaacaaacugacuucgucaugugguaagccaagcaguaaucggaugucccuacaauggacggcaguggccaccuuucucuacgcugagguauucgugguccugcuucugugcauuccguuuauaucucccaaacgcuggcagaagaucuucaaaagccgauugguggagcuccugguuuccuaugggaacacauuuuucgugguccugauugugauccucguauuacugguuauugaugcagugcgugaaaucagaaaguacgacgaugucacugagaaggugaaucuucagaacaauccuggagccauggaacauuuucacaugaaauuguucagggcucagcggaaccuguauauagccggcuuuucacuacuccugaguuuccuucugcgcagauuggugacccucaucagccaacaggcgacacuguuagcaucuaaugaggccuuuaagaaacaggcugaguccgccucagaagcagcuaagaaauacauggaggaaaacgaccagcugaagaagggcgccgcggucgaugggggaaaacucgacguugguaaugccgaggugaaacuugaagaggagaacaggagccugaaggcagauuugcaaaagcuaaaagacgaacuggcuaguaccaagcagaaacucgagaaggccgaaaaucagguacuggcuaugcggaagcagucugagggccuuacuaaagaauaugaucgccuguuggaggagcaugccaagcuccaagcagccguggacgggccaauggauaaaaaggaagaguga

SEQ ID NO: 53311 - RNA, 2751 nt, Artificial Sequence
  derived and/or modified sequence opt3 from BCAR1__Homo_sapiens__NP_001164185
augcccgccaagccuuuccugagcuccgugcuccuuucuuggaaaguccuggacuuuucaggcccagggccgcagggaaccggucaacccugcaguuguggccacugggcugaggggcagggaggcccuccagaacccgccggugggccuaacguuuuggccaaggcguuauacgauaauguggcugagagcccagacgaacuguccuucagaaaaggagauaucaugacaguacuagagcaggacacucagggccucgauggcugguggcugugcucucuucaugggaggcaaggaauugugcccgguaaccggcugaagauauuggucggcauguaugacaaaaagccugccgggccaggaccgggucccccugcaacgccagcccagccccagccuggccuccacgcuccagcacccccggccucgcaguacaccccuaugcugcccaauacauaucaaccacagccugauucaguguaccugguucccacuccaagcaaggcucagcaggggcucuaucaagugcccggaccuaguccacaguuucaguccccgcccgccaaacaaaccucuacauucagcaagcagaccccucaucacccauuucccuccccugcgacugacuuauaccaggucccacccggcccgggcgggccugcacaggauaucuaucaagugccacccucagccggaaugggucaugacauuuaccagguaccucccaguauggauacacgcagcugggaaggcaccaaaccaccagcuaagguugugguccccacgcgaguggggcagggauacguguaugaggccgcacagccagagcaagacgaauacgauaucccgcgucaucugcuugcuccuggcccccaggacauuuaugacgucccacccguuagagguuugcugccuucucaguacgggcaggagguguaugauacuccacccauggccguaaaaggcccuaacggaagggacccgcuacucgaaguguacgaugucccacccuccguggagaagggccugccuccaucaaaucaccacgcgguuuaugacgugcccccuagcgucaguaaggaugugccggacgggccccuucugcgggaggaaaccuacgauguaccuccugccuucgcaaaagcuaagcccuuugacccagcccgcacaccuuugguucucgcugcacccccaccggauucuccucccgcagaggacguguacgaugucccacccccugccccagaccuguaugacgugcccccuggauuaagaaggccggguccaggcacucuguacgaugucccccgggaacgcgugcucccucccgagguugcugacgggggagugguagauuccggcgucuaugcggugccaccucccgcagaacgagaggccccagcugaggguaaaagacuuagcgccucgucuaccggguccacaaggucaagucaaagcgcauccucucuggaaguugccggcccuggacgggagccguuggaacuagagguggcugucgaagcccuggcacgucuccagcagggcgugagcgcgaccguagcucaucugcuugaccuggccgggucagcaggagccacggguaguuggcgcucccccagcgagccacaggagccuuuggugcaagaucuccaggcugccguugcagcuguccagucugccgugcacgaacuguuagaguucgcgagaucagccgugggcaacgcugcacacacuucagacagggcccugcacgcuaagcuaagccggcaacuccagaaaauggaagauguccaucagacacugguugcccacgggcaggcacuugacgcgggacgaggcgguuccggggccaccuuggaggaucuggaccgccucguggcuuguucuagagccgugcccgaagaugcaaagcaacuggcuucguuucuucauggcaaugccagccuguuguucaggcggacuaaagcaacagccccaggaccugagggcgggggaacccuccaccccaacccgacggacaagaccuccucaauccagagucgcccacugccuucucccccaaaguuuacaagccaggauucccccgacggccaguacgagaauagugaagguggguggauggaggacuaugauuacguacauuuacaaggaaaagaagaguucgagaagacucagaaagaacugcuagagaagggcagcauaaccagacaggguaaaucucagcucgaacugcaacagcuuaagcaguuugagagguuggaacaagaggucucccguccuaucgaccacgaucuggcuaacuggacaccggcgcagccccucgccccaggccggacugggggacugggcccuagugaccgacaguuacugcuuuucuauuuggagcagugcgaagcaaaucucaccacacugaccaacgcuguggaugccuucuuuacugccguugcuacgaaucaacccccuaagauuuucguggcacacagcaaauuugucauccuaucugcccauaagcugguguucauuggggacacacucuccagacaggcgaaagcugccgauguuaggucacaggugacccacuacaguaaccugcuuugugacuugcugcgcggaaucguagcaacuaccaaggccgcugcauuacaguacccaagccccucggccgcgcaagauauggucgagcgggugaaagaacucggccauuccacacagcaguuuagaagggugcugggucagcuugcugccgcauga

SEQ ID NO: 53312 - RNA, 1755 nt, Artificial Sequence
  derived and/or modified sequence opt3 from BCAS1__Homo_sapiens__NP_003648
augggcaaccagaugagcgugccccaaagagucgaggaccaggaaaaugagccugaagccgagaccuaccaggauaacgcuuccgcacugaaugggguuccagugguagugucuacacacacuguccagcaucucgaagagguggaccuuggaaucucaguuaagacggauaacguggccaccaguagcccggagacaacugaaauuuccgcggucgcugacgccaaugguaaaaaccugggcaaggaggcaaaacccgaagccccugcugcaaagucuagguucuuuuugauguuaucgcggccagugcccgggcgcaccggagaucaagccgcugacucaagccugggcaguguaaaacuagauguuuccucuaauaaggccccugcgaacaaggacccaagcgaguccuggacacuccccguggcagccgguccugggcaggauaccgacaaaacuccaggacacgcuccggcccaggauaagguccugucagcagcucgagaccccacacuucugccuccagagaccggcggcgccgggggagaagcgcccaguaaaccuaaggauagcucuuucuuugacaaauucuuuaaguuggacaagggucaggagaaagugccaggcgauucccaacaggaagccaagcgugcagagcaucaggacaaaguggaugaaguccccgggcucucaggacagagcgacgauguuccggcuggcaaggacauaguggaugguaaagagaaggaggggcaagaacugggaacggccgacugcaguguaccuggcgaucccgagggccuggaaacugcuaaagacgauucucaggccgcagccaucgcugagaauaacaauuccauuaugagcuucuuuaagacccucgugucgccaaacaaggcggaaacuaaaaaggacccugaggacacaggggcagagaaaucucccaccacauccgccgauuuaaagucagacaaagcuaauuucaccagucaggaaacgcaaggagccgguaagaacagcaagggcuguaauccauccgggcacacucagucugucacaacccccgagccugcaaaagaaggaacuaaggagaaaagcggcccaacaucacugccgcuugguaaguuguuuuggaaaaagagugugaaggaagauuccguucccaccggggccgaggagaacguggucugcgaaagcccuguggagaucauuaaaucuaaggaaguagagucagcucugcagacgguugaccuaaacgagggcgaugccgcaccagaacccaccgaggcgaaacucaagagagaagagaguaaaccuaggacaagccugauggcuuuccuucggcagauguccgugaagggagacggcgggaucacucauucugaagagauaaauggaaaggauucgagcugucaaaccuccgacucaacagagaaaacuaucaccccacccgaaccggagccuacaggugccccacagaagggcaaagaagggaguucuaaggauaaaaagagcgcagccgagaugaacaaacagaaguccaauaagcaggaagcuaaagagcccgcccaaugcaccgagcaggcaacugucgacacgaacucacugcagaauggagauaaguugcagaaacgcccugaaaagagacaacagagccucggcggguuuuucaaaggucugggccccaagaggauguuagacgcucaggugcagacagauccagucucuauuggaccugugggcaaguccaaauga

SEQ ID NO: 53313 - RNA, 2787 nt, Artificial Sequence
  derived and/or modified sequence opt3 from BCAS3__Homo_sapiens__NP_001092902
augaacgaggccauggcuaccgacagccccagaaggccuucccggugcacaggcgggguggucguucgcccacaggcagugacugaacaaucuuacauggagucaguagugacguuccugcaggaugucgugccgcaggccuauaguggaacuccccucacagaagagaaggagaaaaucguuugggugcgauuugaaaaugcggaccuuaacgauacuagccguaaucuggaguuccacgaaauucauuccaccgguaacgagccuccauuguuaauaaugaucggcuacucugacgggaugcaggucuggucgauucccaucucaggagaagcucaagagcuguuuagcgugagacacggcccuauuagggccgcacggauccuaccagcuccccaguucggugcccagaagugugauaauuuugcagagaaacgcccucuccuggggguaugcaagaguauaggauccucuggcacaagcccaccguauuguugcguugaccuuuacucccugagaaccggcgaaauggugaaaucaauccaguucaagacucccauuuaugauuugcauuguaacaagaggauccucgucguggugcugcaagagaaaauugccgcuuuugacaguugcacauucaccaagaaauuuuucgucacgagcuguuacccuugcccagggcccaauaugaacccuaucgcccugggaucucgguggcucgcguaugcagaaaauaaguuaauacgcugucaccagucccgagguggcgccugcggggauaacauucagucauacacugcuaccguuaucagcgccgcaaaaacacugaagaguggacuuacuauggugggcaagguagugacccaguugacagguacccugccaucuggggucacggaggacgauguggcuauucauuccaauagcagaaggucgccccuaguuccgggaaucaucacugugauugacacagaaaccgucggcgagggccaagugcucguaucugaggauuccgacucagacgggauaguugcccacuuuccugcgcacgaaaaacccguguguugcauggccuucaacaccaguggaaugcugcuugucacaaccgauacgcugggucaugacuuucacguguuccagaucuugacccauccauggagcuccucucagugcgcaguccaccaccucuacacacugcaucggggcgagacugaagcuaaggugcaagauauuuguuucagccacgacugccguuggguugugguaucaaccuuacgcgggacaagucaugucuuuccuaucaaucccuauggaggccagccaugugugagaacucacaugucccccaggguugugaaccggaugagccgauuccagaaaucugccggucuggaggaaauagagcaggagcucaccucaaagcaagggggccgcugcaguccugucccaggacuuagcuccucuccgucgggcagcccccugcaugggaaacuaaauucccaggauucauacaacaacuuuacaaauaacaauccuggaaacccaagauugaguccccugccuucucucauggugguaaugccacuggcucagauuaagcagcccaugacccuugguacuaucacgaaaaggacaggcccguaucuguucggggccggauguuuuagcaucaaggcaccuugcaaggugaaaccacccccucaaauuucccccucaaagagcaugggcggugaguucuguguugccgcuaucuuugggaccucucgguccugguucgcgaauaacgcaggcuugaaacgcgaaaaggaccagaguaaacaggucgugguggaaagccucuacauuauaucuugcuauggaacucuggucgagcacaugauggaaccaagaccuuuauccaccgcccccaagaucucagaugacacaccacuggagaugaugaccaguccgagggcuagcuggacucuaguucguacaccucaguggaaugagcuccaacccccauuuaacgccaaucacccccugcuuuuggcagccgaugcugugcaguacuaucaguuccugcucgccggccuggugccuccagggucgcccggaccuauuacgcggcaugguuccuacgacucucuugcaagcgaucacucaggccaggaagacgaggaauggcugagucaaguagagaucgucacccauacugggccgcaccgaagauuguggaugggaccacaguuucaguucaagacaauccaccccuccggccaaaccacagugauuucuagcuccucaagcguucuccagagucaugguccuucugacacuccacagccccuguuagauuuugacaccgaugaccuggaucuaaacucccucaggauacagccugugcgcagcgacccggucucgaugcccgggucaucucggccagugagugauagaaggggcguuuccacggugaucgacgcggcuagcggaaccuucgaucgcucuguaacacugcuugaggucuguggcagcuggccugaaggguucggauugcgacacauguccucaauggagcauacugaagagggccugcgggaacgucucgccgacgcaauggccgagagucccagcagagaugugguggguucugggaccgagcugcaaagggaaggauccauugagacauuaucaaauaguagcggcuccacuucugguucgaucccacgcaacuuugacggcuaccggagcccucugcccaccaaugaaucacagccacuuuccuuguucccgacgggguuuccuuga

SEQ ID NO: 53314 - RNA, 477 nt, Artificial Sequence
  derived and/or modified sequence opt3 from BCAS4__Homo_sapiens__NP_001010974
augcagagaaccggcgggggagcccccaggccuggucggaaccacggccugccagggagccuccgccaaccggaccccguggcacuucugauguuguuagucgaugcugaccagccugagccaaugcgauccggagcccgugaacuggcgcuauuccucacacccgagccuggcgcugaagccaaggagguugaagagacuaucgaggguaugcugcuuagacuggaagaguuuugcucuuuggcagaucucauuaggucagacacgagucagauacuggaagagaauaucccagugcugaaagccaagcucaccgagaugcgggggauuuacgcuaaaguagaucgcuuagaaaagagccccgcaccugugccagucacauaugagcugccgacucuuuacagaaccgaagacuauuuccccguggaugccggagaggcucagcaucacccuaggacauguccacggcccuuguga

SEQ ID NO: 53315 - RNA, 1050 nt, Artificial Sequence
  derived and/or modified sequence opt3 from BCAT1__Homo_sapiens__NP_001171562
augaaggacugcagcaacggcuguuccgccgagugcaccggggaaggagguucuaaagagguggucggcacauucaaggcuaaagaucugaucguuacucccgcaacgauucucaaggaaaaaccugacccaaauaaccuuguguuugggaccguauucacagaucacaugcugacuguggaguggucaagugaauuuggaugggagaagccgcauauaaagcccuugcagaauuuaagccugcacccuggcuccucugcccuacauuacgcggucgagguguucgacaaagaggaacuccuggaauguauccaacagcuuguuaagcuggaucaggagugggugccauauucgaccucagcuagcuuguacauuagacccacauuuaucgguaccgagccuagucucggggucaaaaagccaacuaaagcccugcuguucgugcucuuaucccccguaggaccuuauuuuucuagcggcacauucaacccaguuucccugugggcaaauccgaaguacgugagggccuggaagggcgggaccggagacugcaaaauggguggcaacuaugggucaagucuuuuugcucagugugaagcagucgauaauggaugccaacagguguuguggcuguacggcgaggaccaccagauuacggaaguggguacuaugaaccuauuccucuauuggaucaaugaggauggggaagaggagcuggccacacccccucuugacggaauaauccugccaggcgucacccggcgcuguauuuuggaucucgcucaucaguggggcgaauuuaagguuagcgagcgauaccugacuauggacgauuuaaccacagcccuggaagggaaccgugugagagagauguucggaucugguaccgcgugcguagugugucccgucuccgacauccucuacaaaggcgaaacgauucacaucccuacuauggagaaugggccaaaacuugcaucaaggauacugagcaaguugacagacauucaauauggacgggaggaaagugauuggaccaucgugcuaucuuga

SEQ ID NO: 53316 - RNA, 903 nt, Artificial Sequence
  derived and/or modified sequence opt3 from BCAT2__Homo_sapiens__NP_001158245
auggccgcugcagcccugggccagcuuuucgaggggaugaaggcguuuaaaggaaaggaccaacaggugagacucuucaggcccuggcugaacauggaucggauguugcgcagcgcuaugcgauuaugccugccuuccuuugacaaacuagaacuccuggaguguauccguagacuuauugaagucgauaaggacuggguuccagaugccgcagguaccucucuguacgugaggccgguauugauaggcaaugagcccucacucggggugagucagccuacacgggcccugcuguucgucauccucugcccagugggagcuuauuuucccggcgguagcguuacuccuguguccuuacuggcagacccagccuucauucgcgcuugggucgggggagugggcaacuacaaacuuggcgggaauuauggacccacgguauugguucagcaagaagcccugaagagagguugugaacaggugcuauggcucuacggcccugaucaccagcugaccgaggucgggacaaugaacaucuuuguguauuggacucaugaagacggagugcuugagcuggucaccccaccguugaauggcguuauucuccccggugugguaaggcagucucuguuagauauggcgcaaacauggggagaguuccggguggucgagcgcaccaucacuaugaagcagcugcuccgagcacuugaggaagggagagugagggagguuuuuggcucgggcacagccugccagguguguccuguccaccggauacuguacaaagaccguaacuugcauaucccaaccauggaaaaugggcccgagcuaauucugcgcuuccagaaggaacucaaagagauccaauauggaauuagagcucacgaguggauguuuccuguguga

SEQ ID NO: 53317 - RNA, 969 nt, Artificial Sequence
  derived and/or modified sequence opt3 from BCCIP__Homo_sapiens__NP_057651
auggccagcagauccaagaggcgggcuguggagucuggcgucccccagccuccagacccgcccguucaacgcgaugaagaggaagagaaagaaguggagaacgaggacgaagaugacgaugacucagauaaggagaaagacgaagaggaugagguaaucgacgaagaggugaauauugaguucgaagcauacagucugagcgauaacgacuaugaugggauaaagaaacuccuucagcagcuguuuuugaaggccccugucaauaccgcggaauuaacagaccugcuaauccagcaaaaccacauuggauccgugaucaagcagacugacguuucugaggauucgaaugacgauauggacgaggaugaaguguucgguuuuauuucacuccugaaccuuacggagcgaaaaggcacccagugcgucgaacagauccaagagcugguguugcguuucugugaaaagaauugcgagaaaagcaugguagagcagcucgacaaguuucugaacgauacaacuaaaccaguugggcugcucuuaagugaaagauucauaaaugugcccccucagaucgcucugccaauguaccagcaacuucagaaggaguuggccggagcacauaggaccaacaagcccuguggcaaaugcuauuuuuaccugcuaauuuccaagacauucgucgaagccgguaaaaauaacucuaagaaaaagccuagcaauaaaaagaaggcugcacucauguuugccaacgcugaggaagaguucuuuuaugaggaacaggggaaaccagaggugcugggaggcccggacacccggcgcggccuugaacccgugccuauccaacacaaugggggauccagaggucaggucacugcccugguuucauugaaggcgggccucauucagaguaggagcacacugucugauuuccaggggaccuuuaugacggugggaaucgcauuauccuga

SEQ ID NO: 53318 - RNA, 879 nt, Artificial Sequence
  derived and/or modified sequence opt3 from BCDIN3D__Homo_sapiens__NP_859059
auggccgugcccaccgagcuggacggcgggagcgucaaggaaacagcugcagaggaagaguccagaguucucgccccuggagcggcuccauucgguaacuuuccgcacuacucuagguuccaucccccugaacagcggcuucgccuguugccacccgaguuacugcgacaacuauuuccugagucaccagaaaauggccccauccucgggcuggaugugggaugcaacaguggcgaccuuagcguagcccuguauaaacacuucuugucccucccugauggugagacuuguucugacgcaucgcgugaauuuagacugcugugcugugauauugacccagugcucgucaagagggccgagaaagagugcccguuccccgaugcuuuaacguuuauaacccuggacuucaugaaucagcggacacgcaaggugcuuuugagcucauuucugagucaguucgggagauccguuuuugauaucggauucuguaugucuauuacuauguggauccaucuaaaccacggcgaccauggccucugggaauuucuggcacaccuuagcucccugugccacuacuugcucguggagccucagccauggaaauguuauagggccgcugcccggcgccugcgaaaguuagggcugcaugauuucgaccacuuccauucacucgcgauuagaggagauaugcccaaucaaaucguccagauacuuacccaggaccacgguauggaacugaucugcuguuuuggcaacacaaguugggacaggagcuugcuacuguuccgggcaaagcagaccauugagacucacccuaucccagaaucucucauugagaaagggaaggagaaaaaucgucuguccuuucaaaagcaguga

SEQ ID NO: 53319 - RNA, 1809 nt, Artificial Sequence
  derived and/or modified sequence opt3 from BCHE__Homo_sapiens__NP_000046
augcacagcaaggugaccaucauuugcauaagauuccuguuuugguuccuccuucuguguauguugaucggcaaaucccauacagaggacgauauuaucauugccacuaagaacgggaaagucaggggaaugaauuuaacgguuuuugguggcaccgugacagcuuuccuggggauccccuacgcacagccuccacuaggacggcuccgcuuuaagaaaccgcaaucucugacuaaguggucagacauauggaacgccaccaaguaugcgaauaguugcugucagaacaucgaucagagcuuccccggcuuucacgguuccgaaauguggaauccuaacacagaccuuucugaggauugccuguacuugaauguauggauuccagcucccaaaccuaagaacgccaccgugcucaucuggauuuaugggggaggcuuccagacuggcacaucgucacugcaugucuacgacgggaaauuucuggcacgaguggaacguguuaucguggucagcaugaauuauagagugggagcccucgguuucuuagcucugccaggcaaccccgaggcaccugggaauaugggacuuuuugaucaacaguuggcccugcaguggguacagaagaacauagcugccuucggcgguaauccaaaaaguguuacccuauuuggggaauccgcgggagcagccucugugagccuccaucugcuuuccccgggcucacacagucuguucacgagggcuauuuugcaaagcggcucuuucaacgcccccugggcagucacuucccucuacgaggcucggaaucgcacccugaacuuagccaagcugacaggguguucaagagagaacgaaacugagaucauuaagugccucaggaauaaagacccucaggaaauccuucugaacgaggcguuuguggugccauauggaacccccuugagcgucaauuucgguccuacaguugauggcgacuuucuaaccgauaugccagacauccugcucgagcuggggcaguucaagaaaacgcagauucuugugggaguaaacaaggaugaaggcacugccuuucugguguacggugcacccggguucaguaaagacaauaacucuauaaucacacggaaggaguuucaagaaggcuugaaaauuuucuuuccgggagucuccgaguucggcaaggaaagcauccucuuucacuacaccgacuggguggaugaccagcgcccugagaauuaucgagaggcucugggggauguugugggagacuacaacuucauaugucccgccuuagaauuuacuaagaaauucucggagugggguaauaacgcuuucuuuuauuacuucgaacacagaucuuccaagcugccauggccugaguggaugggcgucaugcauggguaugaaauugaguuuguguucggacuaccccucgagaggcgggauaauuacacaaaagccgaagagauccugucacguaguaucguaaagcgcugggcaaacuuugccaaauauggcaauccaaacgaaacccagaauaacagcacguccuggcccguuuucaagucuaccgagcaaaaguaccuuacauugaacacugaaagcaccagaauuaugacaaaacugagggcucagcagugccgguuuuggacuucauucuuuccuaaggugcucgagaugaccgguaauaucgacgaggcggaaugggaguggaaagcaggguuccaccgauggaacaauuacaugauggauuggaagaaccaguuuaaugacuauacaaguaaaaaggaauccugugucggccuguga

SEQ ID NO: 53320 - RNA, 1338 nt, Artificial Sequence
  derived and/or modified sequence opt3 from BCKDHA__Homo_sapiens__NP_000700
auggccguggcuaucgcagccgcgagagucuggaggcugaaccggggccucagccaggcugcccuucuguuguuacgccaacccggggcacgaggacuggcccguucccacccuccaagacagcagcagcaauucucuucacuagacgauaagccgcaguuucccggugcuagugcagaguucauugacaaacucgaauuuauacagccuaauguuaucagcggcauuccaaucuacagggugauggaucggcaggggcaaauuaucaaccccuccgaggacccucaucugccaaaggaaaaaguacuuaagcuguauaaaucuaugaccuugcucaauacaauggaucgcauacuguacgagucgcagagacagggaaggaucucauucuauaugacuaacuacggcgaagaggguacgcacguggggagcgccgcugcccuggacaauaccgaucucgucuuuggacaguaucgggaggcgggcguguuaauguaccgcgacuauccccuggaacuuuucauggcacaaugcuacggcaacauuagugauuuggggaagggacgacagaugccuguucauuacgguuguaaggagagacacuuugugacaaucuccucuccacuggccacucagauuccgcaagcugucggcgccgcauaugcugccaaaagggcgaaugccaaccgggugguaaucugcuacuucggggaaggagcagcuagcgagggcgacgcccaugcugguuuuaauuucgccgcaacccuagagugucccauaaucuuuuucugccguaacaauggguaugccauuuccacaccuaccucagaacaguaccgcggagauggcauugcugcgagaggcccaggguauggaaucaugaguaucaggguugacgguaacgauguguuugcagucuacaaugccacuaaggaggcucggcgacgcgccguggcagaaaaccagcccuuccucauugaggccaugacauauagaauaggccaccacagcaccucugacgacuccucagcuuacaggagcguggaugaagucaauuacugggacaaacaggaucauccuaucagucggcugcgccacuaucuucugucucaaggguggugggacgaggagcaggaaaaggccuggagaaaacaguccaggcguaagguuauggaggcauucgaacaggcggagcggaagccaaaacccaacccgaacuugcucuuuagcgauguguaccaagaaaugccugcucagcugcgaaagcagcaggagucguuagccagacaucugcaaacguauggagagcacuacccccucgaccacuucgauaaauga

SEQ ID NO: 53321 - RNA, 1179 nt, Artificial Sequence
  derived and/or modified sequence opt3 from BCKDHB__Homo_sapiens__NP_000047
auggccguggucgcugcagccgcgggcuggcugcucagacuuagggcugccggggcagagggacacuggcggcgccugcccggugccggcuuggcucgaggguucuuacauccugcagccaccguugaagacgcugcccagcguagacaaguggcgcacuuuacauuccagccagauccggagcccagggaauacggacagacucagaagaugaaccuguuucaaagcguaacguccgcacuagacaauucucucgccaaagauccuaccgcugugaucuucggcgaggacgucgccuuuggugggguguuccggugcacaguuggacugcgcgauaaguauggcaaagacagaguguuuaacacuccacuuugugaacagggcauugucggguucggaauagguaucgcagugaccggcgcuacagccauugcggagauccaguuugccgauuacauuuuccccgcauuugaccagaucguaaaugaggcugccaaguauagguaccggucaggggaucuguucaacugcggaaguuugaccauacgcagcccuuggggcuguguuggucauggggcucucuaucacucccaaucuccagaagccuuuuucgcacauugccccggaaucaaaguggucauuccucgaucgccauuccaggccaagggccugcugcucucauguaucgaggacaagaauccgugcaucuuuuucgaacccaaaauuuuauacagagcugcggcagaggaggugccuauagaaccauauaacauuccccugagccaggccgaggugauccaggaaggcagugaugucacucuuguugcuugggggacacaagugcacguaauuagggagguggccuccauggcaaaggaaaaauugggagucucuugugaggugaucgaccugcggaccaucauuccuugggauguugacacgauaugcaagagcgugaucaaaacuggucgucuacucauuucccacgaggccccacugaccggcggguuugcuucagaaaucaguagcacaguccaggaggaauguuuccuuaaucuggaggcccccauaucucgcgugugcggauacgacacuccguuuccucauauuuucgaacccuuuuacaucccagauaaguggaaguguuaugacgcauugagaaaaaugaucaacuacuga

SEQ ID NO: 53322 - RNA, 1098 nt, Artificial Sequence
  derived and/or modified sequence opt3 from BCKDK__Homo_sapiens__NP_001116429
augauccuggccagcgugcucagauccggccccgggggaggucuuccucugaggccauuguuaggcccggcucuggcacuacgggcccgcucuaccucagcgacagacacucaccaugucgagauggcucgagaacguaguaagacgguuaccagcuucuacaaccaguccgccauugaugcagccgcugagaaacccucugugagacucacaccuacuaugaugcuguaugcagggaggucgcaagacggaucacaccuucuaaagagcgcccgguacuugcagcaggaacucccaguacgcauagcucauagaaucaaaggcuuuaggugccugcccuucauuaucgguuguaauccuaccauucugcacgugcaugagcucuauauccgggccuuucagaaguuaacagauuucccacccauaaaagaccaagcggaugaagcacaguacugccagcugguccgccagcuuuuggacgaucacaaggacgugguuacccugcuagccgaggggcuccgagagaguagaaagcacaucgaagaugagaaacuggugagguauuuucuugacaagacucugacaucccgguugggcauucguaugcucgcuacccaucaccuggccuuacaugaagauaaaccugacuucgucggaaucauuuguacgcgccugucuccaaagaaaaucauagagaaguggguggauuuugcaagaaggcucugcgagcacaaguacggcaacgcuccgcggguacgaauuaaugggcacguugccgcgcgcuuccccuuuaucccuaugccacuugacuauauucugcccgaauugcugaaaaacgccaugagagcaacuauggagagccaucuggacaccccuuacaaugugccagaugucgugaucacaaucgcuaacaaugacguggaucucauuauaaggaucuccgaccggggagguggcauugcccacaaggaucuggaccgcgucauggauuaccauuucacuaccgcugaagccucaacacaagaccccagaaucaguccgcuuuuugggcaccuggauaugcauagcggagcacagucuggcccuaugcacgguuga

SEQ ID NO: 53323 - RNA, 648 nt, Artificial Sequence
  derived and/or modified sequence opt3 from BCL10__Homo_sapiens__XP_011540701
auggcccuggagaaccucagaguguaccuuugcgaaaagaucauugcugagaggcacuucgaccaucugcgggccaaaaagauauugagccgcgaagauaccgaggaaaucuccugucgaacaucuucacguaaaagagcaggcaaguuacuggacuaucuacaggagaaucccaaagggcucgauacucuggucgagaguauuaggcgggaaaagacgcaaaacuuucuuauccagaagauuaccgacgagguucugaaauugcgcaauaucaagcucgaacaccugaaaggacugaagugcagcuccugugagccuuucccagauggugcgacaaacaaucucucuagaucgaacucagacgagagcaauuuuagugaaaaauuaagggcuuccacugugauguaccauccggagggcgaaucuagcaccacacccuucuuuuccaccaacucaagucugaaucuuccuguauuggagguggggcggacugaaaacacaauauucagcucuaccacgcugccacgccccggagauccuggcgccccaccccuaccuccagaccuccagcuggaggaggaagguacuugcgcaaauuccucagagauguuucuuccgcugcgaagcagaaccgucaguaggcaguga

SEQ ID NO: 53324 - RNA, 2322 nt, Artificial Sequence
  derived and/or modified sequence opt3 from BCL11A__Homo_sapiens__NP_060484
augagcagaaggaagcagggcaaaccccaacaccuguccaagcgggaguucucuccugaaccacucgaggccauccuuaccgacgaugaaccggaccaugggccccugggagcuccugagggugaucacgacuuguuaacaugcggccagugucagaugaacuuuccacugggggauauucuaauauucaucgaacauaaacgcaagcagugcaauggaucacucugucuggagaaagcaguggacaagcccccuaguccaagccccauugagaugaagaaagccuccaacccugucgaaguuggcauccaagugacuccagaggaugacgauugccuuucuacgucgucacgagguauuuguccgaagcaggaacacaucgcggacaaacuguugcauuggcgugggcucagcagucccagauccgcucacggagcccugauaccuaccccaggcaugucugcagaguacgcuccccagggcaucugcaaggaugagccuagcuccuauacauguacuaccugcaaacagccauuuacaucagccugguuccugcuccaacacgcacagaauacccauggguuaaggauuuaccuggaaagugagcacggaagcccccuuacuccgcggguagguaucccuucuggcuugggggccgaaugucccucccagccaccucugcauggcauucacaucgcugacaacaaucccuuuaaccuacuccgcauaccaggaucagugagcagagaggccaguggucuggcggaagggagguuucccccuacaccaccgcuuuucucucccccuccacggcaccaucuggauccccaccgcauugagcgauugggagcagaggaaauggcccucgcuacccaucacccuuccgccuucgacagaguccugagguuaaauccaauggcaauggagcccccggcuauggacuuuagccggcgucugcgcgaacucgccggcaacacgucgucuccuccacuuucccccggcagaccuucacccaugcagaggcuguugcaaccauuccagccugggaguaagcccccauuucuagcgacuccgccucugcccccacuccagagcgcacccccuccaucccaacccccugugaagucuaaaagcugcgaguucuguggaaagaccuuuaaauuccagucaaaucugguugugcaucggcgaagucacacaggugaaaagccguauaaaugcaaccuuugcgaucacgccuguacucaggcuuccaagcugaaacgccauaugaagacccacaugcauaagagcucuccaaugacagucaaaucagacgauggcuugaguaccgccagcucccccgagccugggacgucugaccucgugggaucggcuagcuccgcccugaagucaguaguugcaaaauucaagagugagaaugauccaaacuuaauccccgaaaauggcgacgaggaagaggaagaggaugacgaggaagaggaagaggaggaagaggaagaggaagaggagcugacugaaucugagagaguggauuacgguuuugggcuaagccucgaagccgcuaggcaccacgagaacuccucacggggcgcggucgugggagugggcgacgaaagccgcgcacugccugaugucaugcaggggaugguucuuucuuccaugcaacauuucagugaggccuuucaccagguguugggagagaaacauaagagaggucaccuggcugaagccgagggccauagggacacaugcgacgaagauagcguagcaggggagucugaccguauugaugacggaaccgugaauggccgggguuguuccccgggggaaucagccaguggcggacucagcaagaaacugcuucugggcucgcccuccucuuugagcccauucucaaagcgaaucaaacucgagaaggaguuugaucugccucccgcugccaugccaaacacugaaaacgucuauagucagugguuagcaggguacgcggcuuccagacagcugaaagacccuuuccuaucuuuuggagauagcaggcaaucccccuucgccucaagcagugagcacucuuccgaaaaugguagccuccgcuuuucgacaccaccgggcgagcuggacgggggaaucucaggccggucugguaccgggaguggcggauccacgccucacauuagcggccccgggccaggaagacccucuagcaaggagggcaggcgcuccgauaccugcucaagucauacaccuauacgacggagcacucagcgugcacaggacguguggcaguucucugaugguuccucaagagcccuuaaguuuuga

SEQ ID NO: 53325 - RNA, 2472 nt, Artificial Sequence
  derived and/or modified sequence opt3 from BCL11B__Homo_sapiens__NP_075049
augagcagaaggaagcagggcaacccccaacaccugucccagcgggagcucaucaccccugaagccgaccacguggaggcugcaauucuugaagaggaugaagggcuggagauagaggaaccaucuggauuggguuuaauggucggcgggccggaccccgaucugcuaacaugcggacagugucagaugaauuucccucucggcgacauccugguuuuuauugagcacaaacgcaagcaaugcggugggucacuuggagccuguuacgauaaagcgcuggacaaggauaguccacccccuagcucccgaucugaauugcguaaagugucggagccaguagagaucggcauucaggugacucccgacgaagaugaccaucuccugucaccuacgaagggcaucugcccaaagcaggagaacauagcugggaaagaugaaccgagcaguuauaucuguaccacaugcaagcagcccuucaauuccgccugguuucugcuccaacacgcacagaacacucauggauucagaauuuacuuagagccugguccagccucuagcucccugacccccaggcuuacaaucccuccacccuugggcccggaagcugucgcacagucaccucugaugaauuuucuaggggacaguaaccccuucaaucuccugcggaugaccggaccaauucuucgcgaucacccuggcuuuggugaggggagacugcccggaacuccacccuuguucagcccuccaccgaggcaccaucucgacccccaccggcugucugccgaggaaaugggcuuaguggcucagcauccuuccgccuuugaccgcguuaugcgacugaacccaauggcgaucgauucacccgcaauggacuucagcagaaggcuccgggagcuugccggcaauaguucuacaccuccacccguguccccggggcguggaaacccuaugcaccgccuguugaauccauuucaacccagcccuaaaucgcccuuccuaucuaccccaccucugcccccaaugccgccugguggcacgcccccaccccagccuccagcuaaguccaaaucaugugaauuuugcgggaagacuuucaaguuccagaguaaccucauaguccacagaaggagccauaccggagagaaacccuauaagugucaacugugcgaucacgccuguucccaggcaucuaaacuuaagcggcauaugaaaacacacaugcauaaggcuggcagccuggccggucgaucagacgauggguugagugcggccuccagcccugaaccgggcacuucugagcucgcaggagagggccugaaagcugccgacggggauuuucgccaccacgaaucagacccaaguuuaggacaugagcccgaagaggaagaugaggaggaagaggaagaggaggaagaguugcuacucgaaaaugagagcagaccugaauccucuuucucgauggacagcgagcuguccaggaaccgggagaaugguggcgggggagugccaggcguacccggugcugggggcggagccgcaaaggcccuugcugaugaaaaggcguugguucugggcaaagugauggagaacgucgggcucggagcacugccucaguacggugaacuucuggccgacaagcagaaacgcggcgcuuuucugaagagagccgcagggggaggcgacgccggugaugacgaugacgcugggggcugcggagaugccggcgcagggggagcggugaacggcaggggugggggauucgcuccgggcaccgagcccuuuccaggucucuucccucguaaacccgccccacugccuucacccggcuuaaauagugcagccaagcggauuaagguggaaaaagaccuggagcuaccaccggcugcccucaucccuucugagaacgucuauagccaauggcugguuggguacgcagcuucccgacacuuuaugaaggaucccuuccuuggauuuacagacgccagacagucaccauucgcgaccagcucugaacauuccagugagaauggcagcuugagguuuucuacgcccccuggggaucugcucgacggaggccuguccggucgcucagggacugccaguggaggcagcacaccacacuuagguggccccgggccuggacggccgucguccaaagaaggcagaaggucugauaccugcgaguauugugggaagguguucaaaaacugcagcaaucugacuguacaccgccgaucacauacaggagaacggccauacaagugugagcuuugcaacuacgcuugugcacagaguuccaaguugacccgucacaugaaaacgcauggccagauugguaaggagguguauagaugcgacaucugucaaaugcccuuuucugucuacagcacccucgaaaaacacaugaagaaauggcauggggagcaucugcuaacaaaugaugugaagaucgaacaggccgagagguccuga

SEQ ID NO: 53326 - RNA, 492 nt, Artificial Sequence
  derived and/or modified sequence opt3 from BCL2A1__Homo_sapiens__NP_001108207
augaccgacugcgaguucggcuacaucuauagacuggcccaggauuaccuccaaugugugcuucagauuccccagccugggagcggaccauccaagacaucuaggguccugcagaacguugcuuuuucagugcaaaaagaaguagagaagaauuugaaaaguugcuuagacaacgugaaugucgugagcguugauacugcacggacgcuguucaaccaggugauggaaaaggaguuugaagacgguauaaucaauuggggccgcauugucaccaucuucgccuuugaggggauucuaaucaaaaagcuccugcgacagcagauagcgccggauguggacacauauaaggagaucuccuacuucguagcugaauuuauuaugaacaauacuggagaguggauccgucaaaacggcgguugggggaaauggcacaaucauacccccaugcuuguugaaucuguggcccacaagaaaagaaagauggcacuguga

SEQ ID NO: 53327 - RNA, 720 nt, Artificial Sequence
  derived and/or modified sequence opt3 from BCL2__Homo_sapiens__NP_000624
auggcccacgcuggcagaaccggguacgacaacagggagaucgugaugaaguauauucauuacaaacugagccagcggggauaugaaugggaugccggugacgucggcgcagcgcccccuggggcugccccagcaccgggaauauucuccucucaacccggccacacaccucauccagccgcuucacgcgaucccguugcacgaacgaguccucuccagacuccagccgcucccggugccgcggcagggccugcccuuagcccagugccgcccguagugcaccugaccuugcgucaggcuggagacgauuuuuccagaagguaccggcgcgacuucgccgagaugucuucgcaguuacaucugacaccuuuuacugcaagaggcagguucgcuaccgucguggaagaacuauuucgggauggcguuaauugggggcgcaucguggccuucuuugaguucggaggugucaugugcguggagucaguaaaccgagagaugagcccacucguugacaauauugcgcuguggaugacagaauaucuuaacagacaucugcacaccuggauccaagauaauggcgggugggacgccuuuguggaguuguacggacccaguaugaggccucucuucgauuuuuccuggcugucucugaagacucucuuaagccuggcacuugucggcgcuuguauuacauugggugccuaucuggggcacaaauga

SEQ ID NO: 53328 - RNA, 615 nt, Artificial Sequence
  derived and/or modified sequence opt3 from BCL2L10__Homo_sapiens__NP_065129
augguggaccagcugagagagaggaccacaauggccgauccccuccgggaacgcacugagcuucuguuggcugacuacuuaggcuauugcgcacgagaaccugggacgccagagccggcccccagcaccccugaagcggcuguccugcguuccgccgcagccagacuaaggcaaauccaccggucuuucuuuucagcuuaccucggauauccagguaaccgcuucgagcugguugcacuuauggccgauagugugcugagcgacucccccggcccuacaugggggagaguagugacuuuggucaccuuugcuggaacacuccuggagaggggcccacuggugaccgcccgguggaagaaaugggguuuccagccccgccucaaggaacaggagggggauguugcgcgagacugucagagauuaguggcacugcuuucuucgagguugaugggacaacaucgggccuggcugcaggcucagggcggcugggauggguuuugccacuucuuucguacuccuuucccacuagccuuuuggcgcaaacagcucguccaagcauuccugucaugucuucugacaaccgcuuuuauuuacuuguggacgagacuccuguga

SEQ ID NO: 53329 - RNA, 258 nt, Artificial Sequence
  derived and/or modified sequence opt3 from BCL2L11__Homo_sapiens__NP_001191036
auggccaagcagcccagcgacguguccucugagugcgauagagaaggcaggcaacugcagccugcugagcggccaccgcagcuccgccccggggcaccuaccucacuucagacagaaccacaagccaguaugcgacaggcggagcccgcugacaugcguccugaaaucuggauugcccaggagcugagaaggauaggagaugaguucaacgcauacuaugcccggcgcuuggcuaaauuacuggcaagcuccacuuga

SEQ ID NO: 53330 - RNA, 1002 nt, Artificial Sequence
  derived and/or modified sequence opt3 from BCL2L12__Homo_sapiens__NP_001035758
augggcagacccgccgggcuguucccuccacucugcccguuucuuggauucaggcccgaggcuuguugggaacggcacaugcagaucgagcgcgcaccuagcgugccacccuuucugcgaugggccgguuaccguccuggcccagucagaaggcgggggaagguugaauugauuaaauucgugcgcguacaauggagaaggccccagguggaguggcggcgccgaagauggggaccuggcccaggugcguccauggcugggucugaagaguuaggacugagggaggacacccuacggguccucgccgcauuucugcgucgcggcgaagccgcuggcucaccggugcccacaccuccaagucccgcacaggaggaaccuacugauuuccuuagcagacugaggcggugcuugccauguucccucgggcgaggagccgcucccucugagucgccgcgcccuugcucacugcccauaagaccauguuauggucuggagccuggccccgccacgccagacuuuuacgcgcucguugcacagagguuagaacaacuggugcaggagcagcuuaagagucccccuagcccagaauugcaggggccgcccuccaccgagaaagaagccauccugcggcgccuagucgcucuccuggaggaggaagccgaggugauuaaccaaaaacuugcaucugauccugcucugagaagcaaguugguaaggcucuccucagacaguuucgcccgucugguugaauuauuuugcagccgggaugacucuucccgaccaucaagagcgugucccggaccuccacccccgagcccugagccacuggccaggcucgcacuugcuauggaacugagucgccggguggccggcuugggugggacacuagcuggacugucugucgagcaugugcacuccuucacucccuggauccaggcccauggcggcugggaggggauucucgcagugagcccugucgaucugaaucuuccccuggacuga

SEQ ID NO: 53331 - RNA, 1386 nt, Artificial Sequence
  derived and/or modified sequence opt3 from BCL2L13__Homo_sapiens__NP_001257656
augagcggcuccucugggcccgccccuaccccagcugugacaaaggcaagaaggggagaccugacucuccagcacgguggcgggggacggcuuggcccgcgcgucggugcccugacggcggcugggggacccugccgaaaacaauugccuccacccccuuuaucaagucugcuaggccagggcccagggcccggaguucagcucgauaucgccagccagucccuggaccaagagauucuucugaaggugaaaaccgaaauagaggaagaguugaagucucucgauaaagaaaucucggaggcauucacaucaacugguuuugaccgucauaccagcccuguauucaguccagccaacccggaguccucuauggaagauugucuggcucaccugggcgagaaggugagccaggaacucaaggagcccuuacauaaagcacugcagaugcuuuugucccagccugucacauaccaagccuuuagagagugcacccuggaaacuacagugcacgcuucaggguggaauaagggaaccguuuucagucuagagagcgaagaggaagaguauccaggcauuacggccgaggacucuaacgauaucuacauucuccccuccgacaauucaggucaggugagcccuccagaaagucccacugucaccacaucuuggcaguccgagagccugccggugucgcuuucugcgucccagucauggcauacugaaagucugccuguuagcuuggggcccgaguccuggcaacagaucgcaauggauccagaagagguaaaaucucucgacagcaacggagccggcgagaagucagaaaauaacaguuccaauagcgauauagugcacgucgagaaagaagaggugccugaaggcauggaggaggcugccguggcaucugucguucugcccgcuagggaauuacaggaggcccugccagaagcgcccgccccucuccuuccacacaucaccgcaacaucacuguuggggacccgggagccggacacggaggugauuacuguagaaaagaguagccccgcuacaucccuauuuguggagcuggaugaagaggaagucaaggccgcuaccacugagccuacagagguggaagagguugugccagcccucgaacccaccgagacgcugcuuucugaaaaagagaucaacgcacgcgaggaaucgcuggucgaggaauugagcccugccuccgagaagaaaccagugcccccgucagaaggaaagaguagacucucuccugcuggugagaugaaaccaaugccccugagcgagggcaaguccauuuuacuguucgggggagcggcagccguagcuauccuagccguugcaauaggcguggcccucgcucugaggaaaaaguga

SEQ ID NO: 53332 - RNA, 759 nt, Artificial Sequence
  derived and/or modified sequence opt3 from BCL2L14__Homo_sapiens__NP_110393
augugcagcaccuccggcugugaccuggaggaaaucccccucgaugacgaugaccuuaacacaauugaguucaagauacuggccuacuauacuagacaccauguguuuaaaucuacgccugcuuuguucucaccaaaguuacugaggacccggagucuaagccagcgcgggcucggaaauugcuccgcaaacgaaucuuggacagaggucucguggccgugucgaaauucacaaagcagugaaaaagccaucaaccuggguaagaaaaaguccucuuggaaggcguuuuucggcguuguggagaaagaggauagccaguccacucccgcuaagguaucagcccaggggcagcguacccuugaauaccaagacagucacagccagcaguggucuagaugccuguccaauguggagcaguguuuggaacaugaggcagucgauccuaaagugauuucaaucgccaacaggguugcugagauuguguauagcuggccacccccucaagcaacacaggccggaggcuuuaagaguaaagaaaucuucgucaccgagggucucucuuuucagcugcaggggcacgugccaguagcuuccagcucgaagaaggacgaagaggaacaaauacuggccaaaaucguugagcucuuaaaguacucuggagaucagcuggagcggaaagacacugcguucauucccaucccucuuguggauacauccauucagggcuuuccacaagacggcuugauggcaugcaucuga

SEQ ID NO: 53333 - RNA, 513 nt, Artificial Sequence
  derived and/or modified sequence opt3 from BCL2L1__Homo_sapiens__NP_001182
augagccaguccaacagagagcugguggucgacuuccucucuuacaaacuuucacaaaagggcuauaguuggagccaguuuuccgauguugaagagaauaggaccgaagcccccgaggggacagaaucugagauggagacuccuucggcuaucaacggaaauccaucauggcaccuggcagacagcccggccgugaacggugcgacgggccauaguuccucuuuggaugcucgggaaguaauucccauggccgcagugaagcaggccuuacgcgaggcuggggacgaguucgaacugcgauaccguagagcauuuagcgaucuaaccucccagcuccacauaacaccuggaacugccuaucaaucauucgagcaggacaccuuugucgaacuguacggcaauaacgcugccgcggagaguaggaaaggucaggaacgguucaaucgcugguuucuuacagggaugaccguggcaggaguugugcuguugggcagccucuucucuagaaaguga

SEQ ID NO: 53334 - RNA, 582 nt, Artificial Sequence
  derived and/or modified sequence opt3 from BCL2L2__Homo_sapiens__NP_004041
auggccacccccgcuagcgcaccugacacaagagcccugguggcggauuucgucggcuacaagcucaggcagaaaggguauguuugcggagcugguccaggcgaggggccggccgcagacccccuucaccaagccaugcgggcugcaggagaugaauuugagacucgcuuccgacguacguuuuccgaccuggccgcucaguugcaugugaccccuggcucugcccagcagagauucacacaaguaucagaugaauuauuucagggugggccaaacuggggaaggcugguggcguucuuugucuucggcgcagcccuaugugcugagagugugaauaaggaaauggagccccucguuggccaggugcaggaguggauggucgccuaccuggaaacucggcuugcagacuggauccacagcuccgggggaugggcugaguuuaccgcccuguauggugauggcgcguuggaagaggcccgcagacucagggaggggaacugggcaucugugcggacaguacugaccggagcuguugcccugggcgcucucgugacugucggugccuucuuugcaucgaaauga

SEQ ID NO: 53335 - RNA, 1002 nt, Artificial Sequence
  derived and/or modified sequence opt3 from BCL2L2-PABPN1__Homo_sapiens__NP_001186793
auggccacccccgcuagcgcaccugacacaagagcccugguggcggauuucgucggcuacaagcucaggcagaaaggguauguuugcggagcugguccaggcgaggggccggccgcagacccccuucaccaagccaugcgggcugcaggagaugaauuugagacucgcuuccgacguacguuuuccgaccuggccgcucaguugcaugugaccccuggcucugcccagcagagauucacacaaguaucagaugaauuauuucagggugggccaaacuggggaaggcugguggcguucuuugucuucggcgcagcccuaugugcugagagugugaauaaggaaauggagccccucguuggccaggugcaggaguggauggucgccuaccuggaaacucggcuugcagacuggauccacagcuccgggggaugggagcuggaagcuauuaaagcccgcgugagagagauggaggaagaggcggaaaaguugaaagagcuccaaaacgaaguagagaagcagaugaauaugucuccuccacccgguaacgccggcccuguuauaaugucgaucgaggaaaagauggaggcagaugcuaggucaauuuauguggggaaugucgacuacggagccaccgcugaggaacuggaagcccauuuucacggcugcgguagcgugaaccgggugacaauccugugugauaaauucagugggcauccaaagggauuugcauauauugaguucuccgacaaagagucuguccgcaccagccucgccuuagaugaaucccuguuucgaggcagacagaucaagguuauaccgaaaaggacuaaucggcccggcaucucaacaaccgaccguggguucccucgcgcuagauacagggcgcggacgacuaacuauaauaguagccgaucucgcuucuacuccggauuuaacucaagaccaaggggucggguguaccgcggcagagcaagggccaccagcugguauagucccuacuga

SEQ ID NO: 53336 - RNA, 1365 nt, Artificial Sequence
  derived and/or modified sequence opt3 from BCL3__Homo_sapiens__XP_011525499
augcccagaugcccugccggcgcuauggacgaggggccaguggaccugaggacccggccgaaggcagccggacuccccggugcggcccuuccucugcgcaaacgaccauugcgugcucccagcccugaaccagcagcccccagaggcgcugcaggguuagucguuccucuggacccacuaaggggaggcugugaucucccggccgugcccgguccuccacacgggcuggcucggcccgaggcccuuuacuauccuggagcgcuguugccacucuaccccacacgcgcaaugggcuccccguucccucugguaaaucugcccacuccacucuauccuaugaugugccccauggaacauccauuaucugccgacaucgcuauggccacgagagcagaugaggacggcgauacaccccugcacauugcugugguccaggggaaucuuccugccgugcauagguugguuaaccuguuucaacagggaggucgggaacuagacauauacaauaaccuccgccagaccccacugcaccuugcggugaucacuacccugccgucagucgugcgauugcucguaacagccggcgcaagucccauggcucuggauagacaugggcagaccgccgcucacuuagccugugagcacaggagcccuacuugccugcgggcacuccuugacuccgccgcuccaggaacacuggauuuggaggcgcguaauuaugacggccuaaccgcacugcauguugccgugaacacggaaugucaagagacuguccagcuccugcuugaacgcggugcugauauugacgccguggacaucaagucugggagaucgccccugauucacgcaguggagaauaacucauugagcaugguccagcuccuguuacagcauggagccaauguuaacgcucaaauguacaguggcuccucugcccugcacagcgcauccggcagggggcuacucccucuggugcggacccuuguacgaucaggagcggauaguagcuugaaaaauugccacaacgacacaccacugaugguggcucgcucuagaagggucaucgauauacuccgggguaaggccacucgccccgcauccaccucacagccggacccuagcccagauagaagugccaauacaucucccgaguccagcucgaggcugucuuccaacggccuucugucagcuaguccuagcuccucucccagccagucaccaccucgugaucccccaggguucccgauggccccucccaacuuuuucuugccaagucccuccccuccagcauuucuccccuucgcuggagugcugcggggcccuggucgaccgguuccacccagcccugccccagggggcucuuga

SEQ ID NO: 53337 - RNA, 1443 nt, Artificial Sequence
  derived and/or modified sequence opt3 from BCL6B__Homo_sapiens__NP_862827
augggcagccccgccgcuccugagggggcacugggauacgugagagaguucaccaggcacuccucugacguccucgguaaccuuaaugaacugcgguugcgcggcaucuuaacagauguuacucugcuaguagggggacagccacuccgagcccauaaggcggugcugauugcuugcucaggcuuuuucuauaguauauuucgugguagagccggggugggagucgacgugcuuagccugccgggcggccccgaagcaaggggguucgccccuuugcucgauuuuauguacacgucccggcugcgccugucuccagcuaccgcacccgccguucucgcugccgcgacauauuuacaaauggagcacgugguccaggcaugucauagauucauccaggccucguacgaaccucugggaauuucacuuaggccauuggaggcugagcccccuacuccaccgaccgcucccccuccagguagcccccggcgcagugaaggccacccugacccacccacagagucccgaucuugcagccaggggccgccuucccccgcaucaccagauccuaaagccuguaacuggaagaaauauaaguacaucgugcugaauagucaagccagccaggcgggaucucuaguaggcgaaagauccucaggucagcccugcccacaggccaggcuccccagcggggacgaggcaaguucuuccagcucgucuuccucaaguagcuccucugaggaaggaccuauuccaggcccgcaaagccggcugucacccaccgcugccacuguucaguuuaaauguggcgcuccugccaguacaccauaucuucugaccucccaggcacaggauacgagcgggucucccucagagcgugcccgcccuuugccaggaagugaguucuuuagcugccaaaacugugaagcuguggcggguugcuccucuggccucgacucgcugguccccggggaugaagacaagccguacaagugucaguuaugcagaagcuccuucagguacaaaggaaaucuggcaucacaucggacugugcacaccggcgagaagccuuaucacuguaguaucugcggugcccgauuuaaccgcccagcuaaucucaaaacacauucuagaauacacagcggggagaagcccuacaaaugcgaaacuuguggcuccagguucgugcaggucgcccaucuucgggcacacguucugauccacaccggagagaagccuuaucccugcccaacauguggcacccgcuuuagacauuugcaaacgcuaaagucacacgugaggauucauacuggggaaaaaccuuaccacugcgaucccuguggacugcauuuccgucacaagagccagcuccggcugcaccuucgacagaaacauggugccgcuacaaacaccaagguacacuaucauauccugggcgggccauga

SEQ ID NO: 53338 - RNA, 2121 nt, Artificial Sequence
  derived and/or modified sequence opt3 from BCL6__Homo_sapiens__NP_001124317
auggccagccccgcugacuccugcauccaguucaccagacacgcaucugaugugcugcucaaccuuaauaggcugcggucacgcgacauuuugacagaugucguuauagugguaagucgagagcaauuucgugcccauaagacuguguuaauggcguguagcggccuguucuacuccaucuuuacggaccagcuaaaaugcaaccucucugucauuaaucuggauccugaaaucaacccagagggguucuguauucuucuggacuuuauguauaccucgagauugaaucucagggaaggaaacaucauggcugugauggccacagcaauguaccugcagauggagcacguuguggauacuugccggaaguucauaaaagccucagaagcugagauggucagcgcaaucaagccgccccgcgaggaauuucugaauaguagaaugcucaugccucaggacauuauggccuauaggggucgggaggugguagaaaacaauuuaccacugcgcuccgcucccggcugugagucucgagccuucgcgccuagccuuuacuccggguugucaaccccacccgcaaguuauagcauguacucucaucugccuguuuccucacuacucuuuagcgaugaggaguucagagacgugaggaugccagucgccaacccguuucccaaagagcgggcucugccuugcgauagugcccguccagugcccggagaauauucucgcccuacacuugagguguccccaaaugucugucacagcaacaucuacucgcccaaggaaaccauuccggaggaggcaagaucugacaugcauuacuccguugcugaaggccugaagccugccgcgcccucagccaggaaugcaccauauuucccuugcgauaaagcuaguaaggaggaagaacggcccagcuccgaagacgagaucgccuugcacuuugagccacccaacgcuccucucaaucgaaaaggucuggugucuccacaaagcccgcagaagucagacugucagcccaacaguccuacugaauccugcagcucuaaaaacgccuguauauuacaggcaucagggaguccacccgccaagagcccuacagauccaaaggcuugcaauuggaaaaaguacaaauucauuguacugaacucccucaaucaaaacgcgaagcccgagggaccggaacaggcagagcuuggccgccugucuccuagagccuauaccgcuccacccgccugccagccucccauggaaccagagaauuuggaccuacagucgccuacgaaacugagcgcauccggcgaggauucaacuaucccccaagccaguaggcucaacaauauugugaaccggucuaugaccgggagcccacgcuccucaagcgaaucucacuccccgcuguacaugcauccucccaaguguacaaguugcggaagccagucuccacagcacgcugagaugugucuucauacugccggucccaccuucccugaagagaugggcgagacacaauccgaauauucagacaguagcugcgagaauggggcauuuuucuguaacgaaugcgauuguagauuuucggaggaagcgucccugaaaaggcacaccuugcagacgcacucugacaagccauacaagugcgaucguugucaggcuagcuuccgguauaaaggaaaucucgccucacauaagacuguccacacaggcgagaaacccuaccgaugcaacaucuguggugcacaguuuaauagaccugccaaccugaagacccauacuaggauccacaguggggagaaaccguacaagugcgaaacaugcggagcucgcuucgugcaaguugcccauuuacgggcacacgugcugauucacaccggcgagaagccauaucccugugaaauaugcggcacgagauuuaggcaucuacagacccucaaaucccaucugcgcauccacacaggggagaagccuuaccacugugaaaaaugcaaucuucacuuccgacauaagucucaguugcggcugcaccuccgucagaaacauggagcuauuacuaacaccaagguccaauauagagugagcgccacagaccugccacccgagcuuccuaaggcguguuga

SEQ ID NO: 53339 - RNA, 633 nt, Artificial Sequence
  derived and/or modified sequence opt3 from BCL7A__Homo_sapiens__NP_001019979
augagcggcagauccgugagggccgagacccggucucgcgcuaaggacgauaucaaacgagucauggcagccauugaaaagguucguaaaugggagaagaaaugggugacaguaggggacacuucacugagaauauacaagugggugcccgucacggaaccuaagguggaugacaaaaacaagaauaaaaagaaaggaaaggaugagaagugcgguagugaaguuaccacaccagagaacagcuccucuccgggcaugauggacaugcacgaugacaauucgaaccagucaagcaucgcggaugcuagucccauuaaacaagaaaauuccucuaacagcuccccugccccagagcccaauucagcagugccuagugacgggacugaggccaaggucgaugaagcucaggcagacggaaaagagcauccaggcgccgaggaugcuagcgacgaacagaacucucaguccucaauggagcacagcaugaauaguucugaaaagguggacaggcaacccuccggugauagcgggcucgccgcggagaccucggcaaucucucaggaccuugaaggaguaccuccauccaaaaagaugaaacuggaggccucacagcagaacagugaggaaauguga

SEQ ID NO: 53340 - RNA, 438 nt, Artificial Sequence
  derived and/or modified sequence opt3 from BCL7B__Homo_sapiens__NP_001184173
augagcggcagauccgugagggccgagacccggucucgcgcuaaggacgauaucaaaaaggucauggcagccauugaaaaaguucgaaagugggagaaaaagugggugacaguaggggacacuucacugcguauauucaagugggugcccgucacggauaguaaagaaaaggagaaaagcaaguccaacucuucggcggcuagagaaccuaauggauuuccaucagacgccagcgcaaacaguucccuccuucuggaguuccaggagccgucuuugcccagcuccgaaguggccgaugagccuccaaccuuaacaaaagaggaacccguuccucuggagacucaaguggucgaagaggaagaggacucaggugcuccaccccuaaagagguuuugcguggaucagccuaccguaccacagacagcaagugaaagcuga

SEQ ID NO: 53341 - RNA, 729 nt, Artificial Sequence
  derived and/or modified sequence opt3 from BCL7C__Homo_sapiens__NP_001273455
auggccggcagaaccgugagggcugagacacggagccgcgcaaaggacgauaucaaaaaggucauggccacuauugaaaaaguucgacguugggagaagagaugggugacgguaggggacaccucccugaggauauucaaaugggugcccgucguggauccucaggaagaggaacggcgcagagcgggagguggcgcugagaggucucgggggcgcgagcgaagaggaaggggcgccucaccacggggugggggaccgcucauccuucuggacuugaacgaugaaaauaguaaccagagcuuucacuccgagggcucuuuacaaaagggcacagaacccucgccugggggaacuccacagcccucacguccuguuagcccagcaggucccccugagggcgugccagaggaagcccagccgccccgccuggggcaagagagagacccuggaggcauuaccgcugguaguacagaugaaccacccaugcuaaccaaggaggaaccugucccagagcuccuggaggcagaagacuccggggugaggaugacucggcgagcccuucaugagaaaggacugaagacagaacccuugcgcagacuccugccgaggcggggccugcgcaccaauguaagaccuucuagcauggcuguucccgauacgagggccccaggcgggggauccaaagcgccucgugcaccccggacuaucccacaggguaagggccgauga

SEQ ID NO: 53342 - RNA, 4500 nt, Artificial Sequence
  derived and/or modified sequence opt3 from BCL9L__Homo_sapiens__NP_872363
augagaauccuggccaacaagaccaggcucccccacccucggcgccgagaggcuccaggcagcccgccccuuuccccucgugggcauugcccacccgccccugccaaaccaaugcaccccgaaaauaagcugacaaaccauggaaaaacugguaauggcggggcgcagucucaacaccagaacgugaaucagggaccuacguguaacgucggcucaaaggguguuggggcuggaaaucauggcgccaaagcaaaccagauuaguccaagcaauuccucuuugaagaacccgcaagccggcgugcccccuuucucgucauuaaaggggaaaguaaagagagacaggagcgugagugucgauuccggagagcagcgggaagcugguaccccaucucuggacagcgaggcaaaagaaguggccccucgcuccaagagaaggugcguucuagagcggaaacagccuuacucaggcgaugagugguguagugggccagacagcgaagaggaugacaagcccauaggagcuacacacaauugcaacguggccgauccggcgauggcagccccucagcucggccccggucaaacuacccagcugccacuuucugaauccucagucccuggggcuccccacggaccacccccuggccugcgcccagacgccccgggcgggggagguggcgggggaggcgugcccgguaagccuccaagccaguuuguauauguuuucacaacccauuuggcaaauacugcugccgaggcggugcuccaggggcgagccgauaguauccuggcauaccaccaacagaacguccccagagcuaaacuggaccaggccccuaaggugccacccacaccggagccucucccauuaucuacccccuccgcuggcacgccucaaagccagcccccaccucugcccccaccgccucccccagcccccggaucggcaccuccagcccuucccccugaaggcccgccagaggauucuucccaggacuuggcucccaauucagugggggcggcaaguacuggagguggcaccgggggaacacauccuaacacuccaaccgccacaaccgcuaacaauccccugccuccgggcggugaucccagcuccgccccagggccugcacuacucggcgaagccgcugcccccggaaacggccagaggucucuggucgggagcgagggacuuucaaaagaacaacuggagcaccgggagcguaguuugcagacgcuccgcgacauugaaagacuguuacugagguccggugagacugaaccauuucucaagggcccucccgggggagcaggcgagggugggccaccggcgcaggcuccucccccaccccagcaaccuccaacagcacccccuagcggccuuaaaaaguaugaggaaccgcugcagucuaugaucucacagacccagaguuugggaggcccaccccuagagcacgaaguuccugggcaucccccaggaggcgacaugggucaacagaugaauaugaugauucagcggcuggggcaggauagccucacuccugagcaaguggcauggcgaaaacugcaggaagaguacuaugaagagaagcgcagaaaggaggaacagaucggacuucacggcuccaggccccugcaagacaugauggguaugggcgggaugaugguacggggaccaccuccgcccuaccauucuaaaccaggcgaucaguggccucccgggaugggagcccaguugcgcggcccaauggacgugcaggauccuaugcaacucagaggugggcccccguucccaggaccuagguuucccggcaaccagauacagcgugucccagguuucggcgggaugcagucgaugcccauggaggugccuaugaaugcuaugcaacggccgguucgacccggaaugggcuggacagaagaccugccaccuaugggagggcccagcaacuuugcccagaauaccaugccuuauccaggcggucagggggaggcagagagauucaugacgcccagggugcgcgaagaguuacugcggcaccagcuacucgaaaagagauccaugggaaugcaaaggccucugggcauggcugguucaggcauggggcagaguauggagauggaacgcaugaugcaggcccaucgacaaauggauccagcgauguuucccggacagauggccggcggggagggacuugcuggcaccccgauggguauggaguucgggggaggccggggcuugcugucuccuccaauggggcagagcggacuccgugaagucgaucccccuauggguccaggcaaccugaauaugaacaugaaugugaacaugaauaugaacaugaaucuuaacguacagaugacaccccaacagcagaugcugaugucccagaaaaugagagggccgggagacuugaugggcccucaaggucucucacccgaggaaauggcaaggguucgcgcccagaacagcucuggggugaugggaggcccacagaagaugcugaugccuucccaguuucccaaucaaggccagcagggguucaguggaggucagggcccauaccaagcuaugagccaggacauggggaacacucaggauauguuuucucccgaccaauccucaaugccuaugaguaaugucggaaccacacgguuaagccacaugccacugccgcccgccucgaacccuccaggcacugugcacuccgcacccaauagaggucuagggaggcgaccuucugaccucaccaucagcauuaaccagaugggaucaccaggcaugggccaucugaaaagucccacacuuucccagguccacucuccuuuggugaccagcccguccgcgaaucugaagucaccacagacucccagccaaaugguuccucuccccagugccaacccaccugggccccugaagucuccacagguguuaggauccagccugucgguacgcucaccgacggguucuccuagucggcuuaaaucccccagcauggcugucccaucucccggcuggguggccagcccuaagacagcaaugccaucccccgggguuucacagaauaaacagccuccguugaacaugaauaguagcaccacucucucuaacauggagcaaggaacccugccacccuccggcccuagaucaaguagcuccgcuccacccgccaauccucccucuggucuaaugaacccaucgcugccguucacaagcucaccugaucccaccccaucccagaauccucucagucugaugaugacucagaugucuaaguacgcaaugcccagcuccacaccacuuuaucauaacgccaucaaaacgauugcuaccucagacgaugaauugcugccugacaggcccuuacucccgccaccucccccaccccaggggucuggaccuggcaucagcaacagucaaccgucccagaugcaccugaauagcgcggccgcacagucuccaaugggcaugaaccuucccgggcaacagccucugucacacgagcccccacccgcuauguugcccuccccaacuccucucggaaguaauauaccgcugcaucccaacgcccaggguacaggcgggccaccucagaauagcaugaugauggcccccggaggcccagauucgcuaaacgcuccuuguggucccgugccgucuuccagccaaaugaugccauucccuccccgucugcagcagccacacggggcaauggcccccaccggaggcggcgggggagguccuggccuccagcaacauuaccccucagggauggcgcugccaccugaggaccuuccgaaucagcccccaggaccuaugcccccacagcagcacuugaugggcaaggcuauggccggucgcaugggggaugcauauccucccggcguccugccgggaguggccaguguauuaaacgacccugaacucucugaggugauucggccaacacccacuggcaucccugaauuugaucuguccagaauuaucccaagcgagaagcccucaaguacccuucaauacuucccuaaaagcgaaaaucagccacccaaggcucagccgccuaaccugcaucuaaugaaucuccagaacaugauggcagagcaaacgcccuccaggccacccaaucugccugggcagcagggaguucaacgagguuugaacaugucuaugugccacccaggccagaugagccuguuagggcggaccggagugcccccucagcagggcauggucccacacggucuccaucaaggggugauguccccgccccagggccugaugacacagcagaauuuuaugcuuaugaaacaacgcggagucggcggggagguuuauucacagccuccacacaugcugucuccccagggaaguuugauggguccuccaccccagcaaaaccucauggugucgcauccgcugagacagaggagcgugucccuagacucucagaugggcuaccugccugccccagggggaauggcgaaccuucccuucuga

SEQ ID NO: 53343 - RNA, 2610 nt, Artificial Sequence
  derived and/or modified sequence opt3 from BCLAF1__Homo_sapiens__NP_001070908
augggcagaagcaacuccaggucucacucaagucggagcaagucccgcucucagucgucaagccgaagucguuccagaucucauagcaggaaaaagcgguaccgcuccagaucaaggaccuauagucggagccgcucucgagacagaauguacuccagggauuaucggcgugacuaccgcaauaacagagggaugaggcggcccuauggauaccgaggucgcggcagaggguauuaccaaggaggcggugggagguaccaccggggaggcuaucgcccuguguggaauagaaggcauucacguagcccacggcgaggcagaaguaggucucgcuccccgaaacggagaagcgucucgucucagaggucccgcucacgaagucggcguagcuacagauccucuaggagcccccgcucaaguuccagccggucuucaaguccuuauagcaaguccccaguuucuaaaagaagggggucgcaggagaagcagacaaagaaagccgaaggagagccccaagaagagagcccucugaaguccaaaucacaggaagaaccaaaggauacuuucgagcacgaccccagugaaucuaucgaugaguuuaacaaaagcuccgcuacgucaggugacauuuggccuggccucagcgcauacgauaauucuccacgauccccgcauagucccagcccuauagccaccccacccucucaguccucaaguugcagcgacgcgccuaugcuuucgacagugcacuccgcuaagaacacuccaucucagcacagccauucaauccaacacagucccgaacgcuccgggucuggaagcguaggcaaugguuccucacgguauagcccgagucagaacucuccuauucaucacauccccuccagaaggagcccagccaagaccauugcaccucagaaugcuccccgugaugagucgcgcgggcggucaucuuucuacccagacggaggcgaucaggagacagccaaaaccggcaaguuucugaaaagauucacugacgaagagaguaggguguuuuuguuagaucgagggaacacacgggacaaggaagcauccaaagagaagggaagcgaaaaaggucgcgccgagggcgagugggaagaccaagaggcucuggauuauuucucugacaaggaaagcgggaagcagaaauuuaaugauuccgagggagacgauaccgaagagacggaggacuacagacaguucaggaagucaguccuagccgaucaaggcaaaaguuuugcgacugcaagccaccggaacaccgaagaggaaggucucaaguacaaaucuaaggugucccugaaggggaaucgagagucagacggcuucagagaagagaaaaacuauaaacuuaaagagacaggauacguuguggaacgccccaguacuaccaaggauaaacauaaggaggaagacaagaauagcgagaggaucacagucaaaaaggagacccaguccccugaacaggugaaaucugagaagcugaaagauuuguuugacuauucgccaccgcuccacaagaaccuggacgcccgugaaaagagcacguuccgggaggaaucaccccugagaauaaaaaugaucgcuuccgauagucauaggccugagguaaagcucaaaauggccccaguucccuuagacgauucuaaccgcccugcaagccugacuaaggaccgacuuuuggcuuccacacuggugcacucagucaaaaaggagcaggaauuuagaucuauuuucgaucauaucaaacuaccacaagccagcaagaguaccuccgagagcuucauucagcacaucgugucucucgugcaccaugucaaggaacaguacuuuaaaucagcggccaugacucugaaugagcgguucacauccuaucagaaggcaaccgaggagcacaguacgaggcaaaagagccccgagauacaucgccguauugacaucucgccgucuacccuuagaaagcacacacggcuggcuggcgaagagaggguuuuuaaagaagagaaccagaagggggauaagaaauugcgcugugacuccgccgaucuccgacacgacauugauagacggaggaaggaacgcagcaaagagagaggagacucaaaggguaguagggagucuuccggcagccggaaacaggaaaagacuccuaaggauuacaaagaguauaagucauacaaagacgacaguaagcauaaacgugaacaggaucacagccgcuccucuagcuccucagcuucuccaaguucgcccagcucccgagaggagaaggaaucuaagaaagagagagaagaggaguucaagacccaucacgaaaugaaagaguacucaggguuugccggagugagcaggccucggggcacauuccaugacgaucgcgacgaugguguagacuauugggcaaagagagggaggggccggggaacuuuucaacgaggcagagggcgcuucaauuuuaaaaaguccggaaguucucccaaauggacccacgauaaguaccagggugacggcaucguggaagaugaggaagagacaauggaaaacaaugaggagaagaaagacaggcggaaggaagagaaagaauga

SEQ ID NO: 53344 - RNA, 1644 nt, Artificial Sequence
  derived and/or modified sequence opt3 from BCO1__Homo_sapiens__NP_059125
auggacaucauuuucggcagaaacaggaaggagcagcuggaacccgugcgggccaaagucaccgggaagauaccugcuuggcuccaaggaacacuucugcgcaaugguccaggcaugcacacuguuggggagagccgauacaaccauugguuugauggauuggcauuacugcacuccuucacgauccgugacggcgaaguguauuacagaucuaaauaucuaaggucagauaccuacaauacaaacauugaggccaaucggaucguagugagugaauuugguacuauggcguauccggaccccugcaagaacauuuucagcaaggcuuuuuccuaccucucucauaccaucccugauuucacagacaauugucugauaaacaucaugaaaugcggggaggauuuuuaugccaccucggagacuaauuacauucgcaagaucaacccacagacacuugaaacccuggagaaagucgacuacagaaaguauguggcaguuaauuuggccacgucacacccccauuacgaugaagcuggaaacgugcucaauaugggcacuagcauugucgagaaaggcaagaccaaauaugugaucuucaagauaccugcaacaguaccagaggggaagaaacagggaaagagucccuggaaacacacugaaguguuuuguuccauuccuucuaggagccugcuguccccaucauacuaucacaguuucgguguuaccgagaacuacgucaucuuucucgaacagccguuccgguuagacauucugaagauggccacagcuuauauccgccgaaugagcugggccucuugccuugcguuucauagagaggagaaaaccuacauccacauuauagaucaaaggacgcggcagcccgugcagacuaaguucuacacagacgcaaugguggucuuccaucacguuaaugccuaugaagaggauggcuguaucguguuugacguaauugcuuacgaagacaacuccuuguaucagcuguucuaccuagccaaccucaaucaagauuuuaaagagaacucacgucugaccagcgugccuacucuucgcagauucgcagucccacugcacguggacaagaaugcugaaguugggacaaacuugaucaagguggccaguaccacggcgaccgcccucaaagaggaagauggacaggucuauugccagcccgaguuucuguacgagggcuuagaacugccuagggugaauuaugcacauaacgguaagcaguaccgguacguauucgcuacagggguucaauggucuccaauacccacuaaaauuaucaaguaugacauccucaccaaauccagccuuaaguggcgagaggaugacuguuggccggccgaaccucuguuugugcccgcuccaggagccaaggaugaggacgauggcgucauuuugucggcaaucgugucuacagacccucagaaacuacccuuccugcucauucuggaugccaaguccuuuacugaacuugcucgcgcgucagucgacguggacaugcacauggaucugcauggcuuguucauaaccgacauggauugggacaccaaaaagcaggcagccagugaggagcaaagagauagggcuagcgacugccacggggccccacucacauga

SEQ ID NO: 53345 - RNA, 1620 nt, Artificial Sequence
  derived and/or modified sequence opt3 from BCO2__Homo_sapiens__NP_001243326
augggcaacacaccccagaagaaagccguguucgggcaaugcagaggacugccuugugucgcuccacuccuuaccacuguugaggaagcaccgagggguaucagcgcccggguguggggccacuuucccaaguggcugaauggguccuuguuacgcauuggaccuggcaaauucgaguuugguaaggacaaauacaaccauugguucgaugggauggcgcugcuacaccaguuucgaauggcuaagggaacgguaaccuaucguucuaaguuccuccagucagacacauacaaagccaauagugcaaagaacagaauagugaucagcgaauuuggcacucuggcccuuccagaucccugcaaaaaugucuucgagagguuuaugucccgguucgaacugccuggcaaggcugcagccaugaccgacaacacaaaugugaacuauguucgcuacaaaggggauuauuacuuguguaccgagacuaauuuuaugaacaagguggacauugagacacucgaaaagaccgagaaagucgauuggucuaaguucaucgcugugaauggagccacggcgcauccacacuaugaccccgaugguacugcauacaacaugggcaauucguuugggccuuacggauucucauauaaaguaauuagaguuccaccggaaaagguggaccugggcgagaccauccaugguguccaggugauaugcagcaucgccaguacagagaaagggaagcccuccuacuaucacucuuucggaaugacuaggaacuacauuaucuuuauugaacaaccucugaaaaugaaucucuggaagaucgcuaccagcaagauacggggcaaagccuucuccgauggcauuucaugggagccacaguguaacacacgcuuucacguggucgaaaagcgaaccgggcaguuacugcccggaagauauuacaguaaaccuuucguuacguuucaucagaucaacgcauucgaggaccaagguugcgugauuaucgaucuuuguugccaggacaauggcaggacuuuggaaguauaucagcugcagaaccuacggaaggcuggggagggacucgaccaagugcacaauagcgccgcgaaaucuuuuccacgucgcuucguccugccccuuaacgugucccugaaugccccggagggcgauaacuugucaccucucagcuacacaagugcaucugcuguuaagcaggccgacgguaccaucugguguucccaugaaaaucugcaccaggaggauuuagaaaaggagggaggcauugaauuuccccaaauauacuaugacagauucagcgggaaaaaguaccacuuuuucuauggcugcggguuuaggcaucuggugggagauucgcucaucaaagucgacgugguauggcgggaggaugguuucuacccaucugagccuguuuucgugcccgcuccaggcacuaacgaagaggacgggggagucauucuuuccguggucaucacacccaaucagaacgaaucaaauuuucuguuggugcuagaugccaagaacuucgaggaacugggccgagcagagguuccugugcagaugccauaugguuuucacgggaccuucauaccgauuuga

SEQ ID NO: 53346 - RNA, 5166 nt, Artificial Sequence
  derived and/or modified sequence opt3 from BCOR__Homo_sapiens__NP_001116855
augcuguccgccacaccccucuacggcaacgugcacuccuggaugaauagcgagagagucaggaugugcggggcuucagaagaccggaagauccuuguuaacgauggagacgcaaguaaagcccgccuggaguugcgagaagagaauccuuuaaaccauaaugugguugaugcgagcaccgcucaccguauugacggucuggccgcgcuauccauggauagaacuggccucaucagggaagggcugcgggugccaggaaacaucgucuauucuucgcuuuguggccuggguucagagaaggggcgcgaggccgcuacgagcaccuugggaggccucggcuucaguuccgaaagaaauccggagaugcaguuuaaacccaacacaccugaaacuguggaggcaucugccguuagcgggaagccacccaauggauucuccgcuauuuacaaaaccccuccagguauccaaaagucagccguggcgacagcagaggcccugggccuggacaggcccgcuagugauaagcagagcccucucaacauuaauggggccucuuauuuacggcugccaugggucaacccguacauggaaggagcaacccccgcuaucuauccuuuucuugacuccccaaauaaauacucauugaacauguauaaggcccugcuaccccagcagagcuacagucucgcgcaaccucuguacucuccagugugcacuaauggcgagcgcuuccuuuaucugcccccgccucauuacguagguccccacauaccauccagcuuggccucgccuaugcgacucucuacacccuccgcaucaccagcuauacccccucugguucauugugccgauaaaaguuuaccauggaagaugggggugagcccgggaaaccccgucgacucccacgcuuauccucacauucagaacucuaaacagccaagagugcccagcgccaaggcagugaccucaggccugccuggcgauacggcccuccuucugccacccaguccgaggccuuccccacggguccauuugcccacucagccugcugcggacaccuacagcgaauuucacaagcauuaugcacguaucucuacaucacccaguguugcccuaagcaaaccauacaugacuguguccucugaguucccugcugcccgccugucgaaugggaaguaucccaaagcaccagaaggaggugagggcgcccaaccgguaccugggcacgcuagaaagaccgccgugcaggauaggaaagacggaagcucucccccacuccuggagaagcagacagucaccaaagacgugacggauaagccccuugaccugucaaguaagguuguggaugucgacgcaucuaaagcggaucacaugaagaaaauggcuccuacuguguugguacauagccgggccggcuccggucucguucugucagggagcgaaauuccaaaggagacauuaucucccccuggcaacggaugcgcaaucuaccgauccgaaauaauuaguaccgccccgagcucuuggguggucccaggccccuccccuaaugaggaaaacaaugggaaaucaaugagucugaagaacaaggcucuagacugggccaucccacagcaacgcagcucguccugucccagaaugggagguacugaugcagugauuacaaaugucucuggcagcgugucaagugcugggaggccugccuccgcgucuccggcccccaacgcuaaugcagacggaaccaaaacgagccgguccucaguugagaccacaccaagcgugauccagcacguaggccagccucccgccacuccagcuaagcauaguucuuccaccagcucgaaaggugccaaggcaucaaacccugagcccucuuuuaaagcgaaugaaaacgggcucccaccgaguuccaucuuccugagcccuaaugaggccuuucgcucucccccaauucccuacccuagaagcuaucuuccauaccccgcuccugaaggcauagccgucuccccguugucacugcacggaaagggcccaguguauccccauccuguucuccugcccaacgggagucuuuucccaggacaccuggcaccuaagcccgguuugccauacggccucccuacagggaggccggaguuugugacuuaucaagaugcucugggauuaggcaugguccaccccaugcugaucccacauaccccuauugaaaucacaaaagaggagaagcccgaacgucggagccgaucucacgagagagccagguacgaagacccaacccuacgcaaucgguucuccgagauacucgagacuucaaguacgaaacugcauccugaugugcccacagacaagaaccuuaaaccgaacccaaauuggaaccaggguaagaccguaguuaagagcgacaaauugguguaugucgaucugcucagagaagaaccugacgcaaagacugauaccaauguguccaaacccucuuuugccgcugaaucgguggggcagagcgcggagccacccaagccuucagucgaaccggcccugcagcaacacagggacuucauugcauuacgcgaggagcugggccgaaucuccgauuuccacgaaacauacaccuuuaaacagcccguuuucacugugaguaaggacucugugcuugcuggaacaaacaaagagaauuugggccucccaguaagcacgccuuuucuggaacccccucuaggguccgauggaccagccgucaccuucggcaagacucaggaggaccccaagccuuuuugcguggguucagccccacccucuguugaugugacaccgaccuacacaaaagacggggcugaugaagcagagagcaacgacggaaagguccugaaaccuaagccaaguaaacucgccaagcggaucgcaaauuccgcuggcuaugugggugaucguuucaaguguguuacuaccgagcuguacgccgacagcucucagcuuucaagagaacaaagggcauugcagauggagggccugcaggaagacuccauuuuaugccuccccgccgcuuauugugagcgcgcaaugaugcgguuuagugaacuggagaugaaagagagagaagggggacauccugccacgaaggauagcgagaugugcaaauucucgccagcggacugggaaaggcuuaagggcaaccaggauaaaaagcccaagucugugacccuggaggaggcuaucgccgaacaaaaugaguccgaacgaugugaguacagcguagggaacaaacaccgcgacccguuugaagcaccugaggauaaggacuugcccgucgagaaauauuucguggaacggcagccagugucagagccucccgccgaucaggucgcuagugacaugccacauucucccacacucagaguugauaggaagcguaaaguguccggagacagcucacacacugaaaccacagccgaggaaguaccugaggauccacugcuaaaggcaaagcgccggagagugaguaaaggccugcauccgaagaaacagaggcaccuccugcaccuucgagagcggugggaacaacaggucagcgcugccgacgguaagcccgggcgccaguccagaaaagaggugacucaagcgacccagccugaagccauuccacagggaacgaauauaacagaggaaaagcccggcaggaaacgggcagaggcuaaggguaaccgaucuuggagcgaggaauccuugaagccuucagauaaugagcagggccugccaguauuuucugggagucccccuaugaaaucguuaagcuccaccucugccggaggcaagaaacaagcucagccgucaugcgcaccagccagcagacccccugccaagcagcagaaaaucaaggaaaaccaaaagacugacgugcucugcgcugacgaggaggaagauugucaggcggcaucccugcuucagaaauacacagacaauagugagaagcccucugggaaacgccugugcaagaccaaacaucuaauuccacaggaaagcaggcguggacucccucugacuggcgaguauuacgucgaaaacgccgaugguaaggugaccguucggagauucaggaagcgccccgagccaucauccgacuacgauuugaguccggcuaaacaagagccuaagcccuuugaccgacugcagcaguuacucccagccagccaaucuacacagcugcccuguuccucaagcccucaggaaacgacccagucgagaccaaugcccccugaggcacggaggcuuaucgugaacaaaaaugccggggaaacucuguugcaacgcgcugcgcgucucggauaugaggaagucguacuguacugccuagagaacaagaucugugaugugaaucacagagacaacgccggcuauugcgcacugcaugaggcuugugcccgggguuggcuuaauauuguuaggcaccuccuggaauacggcgcagaugugaacugcucugcccaggacgggacacgcccguugcaugaugcugucgagaaugaccaccuggaaauagugcgauuacuccugaguuauggagccgacccaacccuugcgacauacuccggcagaacuaucaugaaaaugacccacagcgagcugauggaaaaguucuugacggauuaucucaacgaccugcaggggcggaaugaugacgaugcaucaggaacaugggacuucuacggcuccucuguaugugagcccgaugacgagagcgguuacgaugugcuagccaacccuccagggcccgaagaccaggaugacgaugacgacgcuuauagugaugucuuugaguucgaauuuuccgagaccccucugcuucccugcuacaauauucaaguuagcguggcccagggaccaaggaacuggcuccuguugucugacguguuaaagaaacugaagaugucaagucgcaucuucagauguaauuuuccgaacgucgagauugugacuaucgcugaagcagaguucuauaggcagguuuccgccagccuccuguuuucuugcucgaaagaucuugaggcuuucaauccugagucaaaggaacuguuggaccuaguagaguuuaccaacgagauacagacacugcucggcagcuccguggaauggcugcaucccagugaucuugccucugacaacuacugguga

SEQ ID NO: 53347 - RNA, 5136 nt, Artificial Sequence
  derived and/or modified sequence opt3 from BCORL1__Homo_sapiens__NP_068765
augaucagcaccgcaccccuguacuccggcgugcacaacuggacaucuucagacagaauuaggaugugcgggauaaaugaggaacggcgcgcuccucucagugaugaggaaagcacuacgggagacugucagcauuucgguucccaagaguuuugcgucucuucgucauucagcaagguugaacuuaccgccgugggcaguggguccaacgcccgaggagcggauccagacggcucugcuacugagaaacugggucacaagagcgaggauaaaccggacgauccccagccuaagauggacuaugccgggaauguagcagaagccgagggauuguuagugccacuguccucacccggcgauggccuaaaacucccugcuagugacagcgcagaagccucuaacucccgugcugauuguucauggacuccacugaauacccagaugagcaagcaggucgacugcagucccgccggggugaaggcgcuugauucuaggcaaggaguuggugagaaaaacaccuuuauccuggcaaccuugggcacuggggugccugucgagggaacacucccacuggugaccacgaauuucuccccgcugcccgccccuauuuguccacccgcuccuggcagcgccucgguaccacauucuguucccgacgcauuucaggugccgcucuccgucccugcucccgugccacacucagguuuagugccuguccagguugccacaagcgugcccgcgccaagucccccucuggccccaguaccggcacuugcucccgccccuccauccgugcccaccuugaucucugacagcaacccucugucagucagugcuuccgugcuaguuccagugcccgccagcgcaccgccuucugggccagucccccucucagccccugcucccgcgccacugagugugccuguaagcgcacccccacuugcccugauucaggcuccgguuccucccuccgccccaacauuggugcucgcacccgucccuacuccagugcuggcccccaugccugcuucuaccccgccagccgcacccgcgccuccaucgguccccaugccuacaccgacccccagcuccggaccaccuucaacgcccacuuuaaucccagcuuucgccccuacacccgugccagcaccgaccccugcccccauauuuacuccagcucccacaccuaugccagccgcaacccccgcugccaucccuacgagugcgccgauuccagccucuuucagccuguccaggguuugcuuucccgcugcacaagccccugcuaugcagaaggugccccucucauuccagccaggcaccguacuuacaccuagccagccccuggucuacaucccaccuccgucuuguggccaacccuuguccguggccacucuaccaaccacacuggggguuaguagcacucucacccugccugugcuucccucuuaucugcaggaucggugcuugccaggaguccucgcauccccugaacugcgcucauaccccuaugcguuuaguguggccagaccguuaacaagcgacucgaaacugguaucccuagaggugaauaggcucccauguaccucuccuagcgguucaacuacgacacagcccgcuccagauggcguucccgggccucuggccgacaccagucuugucacugcauccgcuaagguguugccgacaccccaaccacugcucccugcccccucuggaagcuccgcaccuccacaucccgccaaaaugccuucaggcacagaacagcagaccgaggguacuagcgugacauucaguccacugaagucucccccgcagcuugaacgggagauggcuuccccuccagagugcagcgaaaugccccuggauuugucgucaaagucuaaccgccaaaaacucccucugccaaaucagcgaaagacgcccccgaugccugucuuaacccccguucacacaaguuccaaagcgcugcuaagcacagugcucucuagaagccagaggaccacacaggccgcagggggcaacgugacuuccugucugggaucaaccaguagcccauuuguaauuuucccugagaucguccggaauggcgaccccucuacgugggugaagaacuccaccgcucuuauaucaacaauuccagggacuuacguuggaguggccaaucccgucccugccaguuugcugcucaacaaagauccaaaccuggguuuaaaucgugacccgcgccaucugcccaagcaagaaccuaucagcauuaucgaucagggcgagccaaaagggaccggagcuacaugcggcaagaaggguucccaggcaggggccgaaggccagcccucuacugugaaaagauauaccccugcgaggaucgcuccaggacuucccggcugccaaacgaaggaguugucgcucuggaaaccuacagggccggccaacauuuacccacgguguagcguuaauggaaagcccaccucaacucaggugcugccuguagguuggucccccuaccaccaggcaagucuacugucuauaggcaucagcuccgccgggcagcucacaccaucacaaggagcuccuauucgacccaccucugucgugagcgaguucaguggcgugccaucccugucgucuucagaagcaguccacggucuuccggaggggcagccucgccccggcggauccuuuguuccagaacaggaccccgugacuaaaaacaagaccugcagaaucgccgcgaagccuuaugaggaacaaguaaauccaguguugcugacauuaaguccccagacgggcacccucgcucugagcguccagccuagcgggggagauauaaggaugaaccagggcccggaggagucugaaucccaucuuuguagcgacucaacuccaaaaauggaggguccccaaggggccugcggacugaaguuggcaggcgacacaaaaccuaagaaucaggugcucgccaccuacaugagucacgaacugguucuagcuacaccacagaaccugcccaaaaugccugagcucccccugcuuccacacgauucucauccgaaggaguugauucuggacguggucccuuccagccggcgcgguucaaguacugaaagaccccaguuaggcagccaaguggaucucgggaggguuaagauggagaaaguggacggagaugucguauucaaucuggccaccuguuuucgugcagacggccuuccaguggcuccucagcgggggcaggccgaaguucgagcgaaggccggacaggcaagagugaaacaagaguccgucggcguguucgcuugcaagaacaaauggcagcccgaugacguaacggaaucucugccaccuaagaagaugaaaugugguaaggagaaagauagcgaggaacagcaacuacagccccaggccaaggcuguggucagguccucacaccgcccgaaaugccggaagcucccaucugacccucaggagaguacuaagaagucgcccagaggggcaagcgauuccggaaaggaacauaauggcguuagggguaaacacaagcaucgcaaaccaaccaagcccgagucucaaucaccuggcaaacgagccgacagccacgaagaggggucccuggagaagaaggccaaaaguucuuuucgggauuucaucccggugguguugagcacucguaccagaucacaguccggaaguaucuguagcucuuuugcuggcauggcggacuccgacauggggucacaggaagucuucccaacagaggaagaggaagaggugacucccaccccugcaaagaggcgcaaaguucggaagacacagagagauacgcaauauaggagccaccaugcccaggacaaaucgcuguuaucucagggacgacgccaccucuggcgggcuagagagaugcccuggaggaccgaagccgcacgucagaugugggauacuaacgaggaagaggaggaagaggaagaggaaggccugcuuaagcgcaagaaacggagaaggcaaaagagucgaaaauaccagacaggugaguaucugaccgagcaggaagacgagcagcggcgcaaggggagagccgauuugaaagcuaggaagcaaaagacuuccagcucacagucccucgaacaucggcugcgaaauagaaaccuacugcuuccaaauaaaguacagggaauuucugacagcccuaacggcuuucuccccaacaaucuggaggaaccagcgugcuuggagaacagugagaagccuuccgguaaacgcaaguguaaaacaaagcacauggccaccgugagcgaagaggcaaaagaugucgugcuguacugcuuacaaaaggacucugaagauguuaaucacagggacaacgcuggcuauacggcccuccaugaggcaugcucacguggguggacugauauccugaauauucuucuggaacacggagccaacgugaauuguagugcucaggacggcacccggccgguccaugaugccgugguaaacgacaauuuggagacaauauggcuccugcuauccuacggggcggaccccacccuggcaacuuacagcggacagacagccaugaaacuugcuucuucggauaccaugaaaagauuccucucagaccaccugagcgauuugcagggcagggccgagggugacccaggggucuccugggauuuuuauaguucuagcguguuagaagagaaggacggauucgcuugcgaucugcuccauaacccucccggcuccucagaccaagaaggcgaugacccaauggaggaggaugacuuuauguucgaacugagugacaaaccucuucugcccuguuacaauuugcagguuucugugagccgcgggccgugcaacugguuccuauuuuccgauguccugaagcgacucaaacugucaagcagaaucuuccaggcacgguuuccacacuucgagauuacaacuaugccuaaggccgaauuuuauagacagguggcuucuucccaacuuuuaacccccgccgagcgcccaggaggucuggacgaucguagucccccuggcagcucggaaacgguugagcucgugagauacgagcccgacuugcugcggcuccugggguccgaagucgaguuccagucuuguaauucauga

SEQ ID NO: 53348 - RNA, 3816 nt, Artificial Sequence
  derived and/or modified sequence opt3 from BCR__Homo_sapiens__NP_004318
augguggaccccgucggcuucgccgaggcuuggaaggcacaguuuccugauagcgaaccaccgagaauggagcugagguccguuggggacaucgaacaagagcucgaacggugcaaagccucuauucgccgacuugagcaggaggugaaccaggaacguuucagaaugauauaccugcagaccuuguuagcgaaggagaaaaagucauaugauaggcaacgguggggauuucgcagagcugcccaggcacccgacggugccagugaaccuagggcuagcgcaucccggccacagcccgccccugcugauggcgccgacccacccccugcggaggagccagaagcacgcccggauggggagggaucucccggcaaagcccgaccugguacagcuagaaggccaggggccgcagcuucgggagaacgggacgaucgugggcccccugccucaguagcggcccugcgcagcaauuucgagagaaucaggaagggccacggccagccaggagcagacgcugaaaagcccuuuuacgugaacgucgaguuccaucacgagcggggucuagugaaaguuaaugauaaggaagugagugaccgaauuuccucucucggcagccaagccaugcagauggagcgcaaaaagucccagcauggggcuggaucaagugucggcgaugccagcagaccgccuuauaggggucggucuuccgaaucaagcugugggguggacggagacuacgaggaugcagaacugaacccccgcuuucuuaaagacaaucugaucgaugccaacggcggcaguagaccaccuuggcccccauuggaguaucagcccuaccaaucuauuuauguagggggaaugauggagggugaaggcaaggggccucuccugaggucccagagcacuucggagcaggaaaagcgucugacguggccacggcgaucuuacuccccgagaucauucgaggacugcggaggcgguuacacccccgauuguaguagcaaugaaaaccucacauccucugaggaggacuuuagcucagggcaaaguuccaggguuagcccuucuccaacuaccuaucgcauguuccgggauaaaucaagaagucccagccaaaauucccagcagucuuuugacucgagcuccccuccaacaccccagugccacaagaggcaucgccacuguccgguggucgugucagaagcuaccaucgugggcguccgaaaaacuggacagauauggccuaacgauggcgagggggcguuccacggagacgcagaugguaguuuuggcacaccacccggguacggaugcgccgcugaccgggccgaggaacagcguagacaucaggacggcuuaccuuauaucgaugacucucccagcuccucaccacaccugagcucuaaggguagggggucccgcgaugcacuuguuaguggcgccuuggagagcaccaaggcuucugaacuggaccuagagaaaggacucgaaaugcggaaaugggugcuguccggcauucuugccucagaggaaacguaccugagucauuuggaggcacuccuguuaccuaugaagccccugaaggcggcugccacuaccagccaaccaguacucacaucgcagcagaucgagacuauuuucuucaaagugccggaacuuuaugagauccacaaggaauuuuacgaugggcuguucccuagaguccagcaauggucccaccagcagagggugggagacuuguuucagaaacuagcaucucaacuggguguuuaucgagccuucguggauaauuacggcgucgcuauggagauggccgaaaaguguugccaggcaaacgcucaguuugccgagauaagcgagaaucuccgcgcgcggucaaacaaagacgccaaggaucccaccacaaagaauagucuggaaacccuucuguacaaaccaguggacagaguaacgagguccacuuugguucuccaugaucuguuaaagcacacacccgcuucucauccugaccacccacugcuacaagaugcacuccguauuagccagaacuuccuguccucaaucaacgaggaaauuaccccacgccggcagagcaugacugugaaaaagggggagcauagacagcuuuugaaagacaguuuuauggucgaacugguggagggagccaggaagcuccgacacgucuuccuguuuacagaccuucuguuguguaccaagcucaaaaagcaaucuggcgguaaaacgcagcaguaugauugcaagugguacaucccucugaccgacuuauccuuccagaugguggaugagcuggaagcuguuccgaauaucccccuagugcccgacgaggaacucgaugcccugaaaauuaagauaagccaaaucaagaacgacauucagcgggagaaacgcgcaaauaaggggucgaaagcgacagagagacuuaagaaaaaguugucagaacaggagucucugcuccuguuaaugaguccuuccauggccuuuaggguacacagccggaacggcaaaucuuauacuuuccugaucagcuccgauuacgaacgagcugaguggagagaaaauauacgcgagcagcaaaagaaguguuuuaggucauucagucuuaccagcgucgaguugcagaugcucacaaacucuugcgugaaacugcagacuguucauuccauuccacuaaccaucaauaaggaagacgaugagucacccggacuguauggcuuccucaacgugaucguccacagugccacaggguuuaaacaaagcuccaaucuguacugcacccuugaaguggacucuuucggauauuuuguaaacaaggcaaaaacucguguguaccgggauacggcugagccuaauuggaacgaagaguucgagauugaauuggagggcucgcagacacugagaaucuuauguuacgaaaagugcuauaauaagaccaaaauuccgaaggaggacggugaaagcacugauaggcucauggggaaaggacagguucagcuggacccccaagcccuucaggaccgcgauuggcagcgaaccgucauagcaaugaacggcaucgaggugaagcugucagugaaauuuaauuccagagaguucaguuugaagcggaugccaucuaggaagcagacaggugucuuuggcguuaaaauugccguggugaccaagcgcgaacguagcaaaguaccuuacaucgucagacaauguguggaggaaaucgagcggagggggauggaggaaguuggaauuuaucgcguguccggcgucgcuacugacauacaggcgcucaaggccgcauucgaugugaacaacaaagacguuucagugaugaugucugagauggauguaaaugcuaucgccgggacacugaagcuauacuuucgagaacugcccgagccacucuucacggacgaauuuuauccuaacuucgccgagggaauugcucugagcgaucccgucgcaaaggagaguugcaugcuuaauuugcuguuaucccucccagaagccaaccugcuuaccuuucuguuccuacucgaccaucugaaaagaguggcggagaaggaagcugugaauaaaaugagcuugcacaaccuggccacugucuucggcccgacauuacuccggccuucugagaaggaaucaaaacugcccgcaaauccaucccagcccaucaccaugacagauaguuggagccuugagguuaugucucaggugcaaguacuguuguacuuucuccagcuggaggccauuccugcuccagacucgaagaggcaguccauccuauucagcacugaaguguga

SEQ ID NO: 53349 - RNA, 1260 nt, Artificial Sequence
  derived and/or modified sequence opt3 from BCS1L__Homo_sapiens__NP_001073335
augccccugagcgacuucauccucgcccuuaaggauaacccuuacuuuggcgcuggguucggacuggugggugucggcaccgcauuggccuuagcgagaaaagggguucagcugggacugguggcuuuuaggcggcacuauaugauuacacucgagguaccagcccgcgaccgauccuacgcauggcugcuuucuuggcugacucgucauucaacgagaacccaacacuugaguguggaaacaagcuaucuccagcaugaguccggcaggauaucuacuaaguucgaauuugucccgucgcccgguaaucacuucaucugguaccgggggaaauggauucgcguggagagaucaagggaaaugcagaugaucgaucugcagaccggaacaccuugggagagcguuaccuuuacugcccugggcacagaccggaagguguucuuuaacauucucgaggaagcucgcgaguuagcacugcaacaggaagagggcaaaaccgucauguauacggccguggggagugaguggcgaccauucggauaccccagaaggcggcguccucuuaauuccguaguuuugcagcagggucuggcugaucgcaucgugagagacguccaagaauuuauagauaacccaaagugguauacugacaggggcauccccuaccggcgaggguaccuacucuauggaccuccaggcugcgguaagucuagcuucauuaccgcccuggcgggggagcuugaacauuccaucugucuguugucacucacagauaguagccugucugacgaucgcuuaaaucaccuacucuccguggcaccgcagcagucacuugugcuguuggaggacgucgaugccgcuuuucuaagcagagaccuggccguugaaaaccccgugaaauaccagggacucggcaggcugacuuucaguggccuucugaaugcauuggacgggguagcuucuaccgaggcccggauuguguucaugacaaccaaccacgucgaucgccucgacccugcgcugaucagaccaggaaggguggauuuaaaggaguauguugguuacugcucccauuggcaacugacgcagauguuucagcguuucuaucccggccaagccccuagccuagcagaaaauuuugcugagcacgugcuccgggccacuaaccagauaucgccagcucagguccagggguacuucaugcuguauaaaaaugaccccgugggagccauucauaacgcagaaucucuucgaagauga

SEQ ID NO: 53350 - RNA, 1032 nt, Artificial Sequence
  derived and/or modified sequence opt3 from BDH1__Homo_sapiens__NP_976059
augcuggccaccagacucagcaggccccuuucccggcugccuggcaagacauugucugcuugcgaccgcgagaacggggcacgacguccauuacugcuaggaucaacgaguuucaucccgauugguagaaggacuuacgccagcgcggcugaacccgugggcuccaaagccguccucguuaccgggugugauucuggauuuggcuucucgcuggcaaagcaccuucauucaaaagguuuucugguguucgccgggugcuugaugaaggacaaaggacacgauggcguaaaggagcucgacagccugaauagugaucggcugcgcacagugcagcucaacgucuguuccucugaagagguggaaaagguuguggagauagucagaagcuccuuaaaagacccugagaagggcaugugggggcuggugaauaacgcuggaaucucaacuuuuggugaaguagaguucaccagucuugaaacauauaaacaaguugcagaggugaauuuguggggcaccgucaggaugacuaagagcuuucugccacuaauucggcgcgccaaagggcgaguggugaacaucucuuccaugcucggaagaauggcuaaucccgccaggucaccuuacugcauuacaaaguucggcgucgaggcguuuagcgauugucugcgguaugaaauguacccacuugguguuaaggugaguguaguggagcccgggaacuucaucgcagccaccucucuguauuccccugaaagcauacaggcuaucgccaaaaagaugugggaggaauugccagaggucgugcguaaagacuacggaaagaaauauuuugaugagaagauugcaaaaauggaaacguacugcucgucuggcuccacugacaccucaccgguuaucgaugcugugacacaugcccucacugcgaccacacccuacacccgcuaucacccuauggacuacuauugguggcugagaaugcagauuaugacgcauuuaccaggcgccaucagugauaugauauacauuagguga

SEQ ID NO: 53351 - RNA, 624 nt, Artificial Sequence
  derived and/or modified sequence opt3 from BDH2__Homo_sapiens__XP_005263197
augggcagacuggacgggaaggugaucauucucaccgccgcugcacagggaauaggucaagccgcggcucuugccuucgcaagggagggcgccaaagucaucgcuacagauauuaacgaaagcaagcugcaggaguuggaaaaauaccccgggauccagacucggguuuuagacgugacgaagaaaaagcagauugaucaauuugcaaaugagguagaacgccuggacgugcuauucaacgucgccggauuugugcaccauggcaccguucucgauugcgaggagaaggacugggauuucuccaugaaucugaacgugcgaucuauguaucuuaugaucaaggcuuuucugccuaaaauguuggcccagaaaucagguaauauaaucaacaugaguagcgucgcguccucugugaaggggacaguagacacuccaucgcuccaggaacguauucaggcaagaggaaauccggaggaagccaggaacgauuuccugaaacggcaaaagaccggccgcuuugcuacagccgaggagaucgcaaugcuguguguuuaccucgcuucagacgaaagcgccuaugugaccggcaaucccgucauuaucgaugggggauggaguuuauga

SEQ ID NO: 53352 - RNA, 1062 nt, Artificial Sequence
  derived and/or modified sequence opt3 from BDKRB1__Homo_sapiens__NP_000701
auggccagcuccuggcccccucuggagcuccagucuucaaaccaaagucagcuuuucccacagaaugcuaccgcaugcgacaacgccccggaagcgugggaucuguugcacagaguguuacccacauuuaucauuagcauauguuucuuuggccugcuagggaaucucuucguccugcuuguuuuucuguugccuaggcggcagcucaacguggcugagaucuaccuggccaaucuggcagccuccgaccucguauucguguuaggacugccauuuugggcugaaaacauuuggaaucaauucaacuggcccuuuggugcacuuuugugccgcgucaucaauggcgugauuaaggccaaccuguucaucucuauauuucuaguuguggcuaucucgcaggaucgauaucguguccucgugcauccuauggccucaagaaggcagcagcggcgcagacaagcgaggguaacuuguguucugauuuggguggucgggggacuucugagcaucccaacguucuugcuccggaguauucaggcagugcccgaccugaauaucaccgccugcauauuacugcucccucacgaggcuuggcauuuugcccgcauuguggaacuuaacauccugggcuucuugcuaccacuggcagcuauugucuucuuuaauuaccacauccucgccucccugcgaacaagagaggagguuucuaggacucgguguggugggcguaaagauagcaagaccacagcgcuuauccugaccuuggugguagccuuccucgugugcugggcaccguaucauuucuucgcuuuucuggaauuuuuauuucagguccaggccgugcgcggauguuucugggaggacuuuauugaucugggccuacaacucgcuaacuucuuugccuucacuaauuccucacugaaccccguuauauacguguuugucggcagacuuuucaggacaaaagugugggaauuguauaagcagugcaccccuaaaagucuggcaccaaucucuagcucccaccggaaggagauuuuccagcucuuuuggcgaaacuga

SEQ ID NO: 53353 - RNA, 1176 nt, Artificial Sequence
  derived and/or modified sequence opt3 from BDKRB2__Homo_sapiens__NP_000614
auguucagccccuggaagaucuccauguuucugucugugagagaggacucagucccuaccacagccaguuucagcgcugauaugcucaacguuacucuucagggcccaacgcugaaugggaccuuugcacaauccaaaugcccccagguggaaugguugggaugguuaaacacaauucagccgccuuuccuguggguacuauuugugcucgccacucuggagaauauauucguccuuucuguguuuugucugcacaagucgucaugcaccguugcggaaaucuacuuggguaaccucgcugccgcagaccugauucuggccuguggccucccauucugggcuaucacaauuagcaauaacuuugauugguuauucggggagacccugugcaggguggucaaugcaaucauaaguaugaaccuuuauuccucuaucugcuuuuugaugcuggugagcauugaccgguaccuagcccucguaaaaacuauguccaugggacgcaugcgaggcguucguugggcuaagcuguauucacuugugaucugggguuguacacuguugcucaguagccccaugcuggucuucagaaccaugaaagaauacucugaugaggggcauaaugugacggccugugugauuuccuauccuucauuaaucugggaggucuuuacuaacaugcugcucaauguugugggauuccuucugccauugagcguaauaaccuucugcacaaugcagauuaugcaagugcuaaggaacaaugaaaugcagaaguuuaaggagauccagacugaacggcgcgcgaccguccuggugcucguugugcugcuucuguucauuaucuguugguugcccuuucagaucaguacauuccucgacacccugcacagauuaggcauucugucuuccugccaagaugagaggauaaucgacgucauuacgcagaucgccagcuuuauggcauacucgaacucuugucuaaauccucucguguauguaauaguuggcaaacgguuccgcaagaaauccugggagguguaccagggggucugccagaagggagguugccgaucagaaccaauucaaauggagaacaguaugggcacucugagaacaagcaucuccguggaaaggcagauccauaaacuucaggauugggcugggucucggcaauga

SEQ ID NO: 53354 - RNA, 744 nt, Artificial Sequence
  derived and/or modified sequence opt3 from BDNF__Homo_sapiens__NP_001137280
augaccauccuguuccucacaauggugauuagcuacuuuggcugcaugaaggccgcucccaugaaagaggcaaacauaagagggcagggaggucuugccuauccuggcgucaggacucacgggacgcuggaauccguuaauggaccaaaggcgggcucucgggguuugaccucauuagcugacacauucgagcaugugaucgaggaacugcuagaugaagaccaaaaaguacgcccgaacgaggagaauaacaaggaugccgaccucuacaccagucgagugaugcugagcucccaggucccccuugaaccuccacuguuguuucuccuggaggaauauaaaaauuaccuggaugcagccaacaugucuaugcgugugagaaggcacucggaccccgcucggcgcggggagcucucaguuugugauagcauuagugagugggugacugcagccgacaagaagacagcugucgauauguccggaggcaccgugacuguauuagaaaaaguuccugugucuaagggccagcugaaacaguauuucuacgagacaaagugcaauccaaugggguauaccaaagaaggauguagagguaucgacaagaggcauuggaacagccaaugccggacgacucaguccuacguccgcgcccuuaccauggauucaaagaaacgaauuggcuggagauuuaucaggauagacacaaguugugugugcacuuugaccaucaagcgggggcguuga

SEQ ID NO: 53355 - RNA, 7875 nt, Artificial Sequence
  derived and/or modified sequence opt3 from BDP1__Homo_sapiens__NP_060899
auguucagaagggcccggcugagcgugaagcccaacguccgcccuggcguuggggcucgaggauccaccgccucuaauccacagcgugguagagaaucaccgaggcccccugauccagccacugauagugcgagcaaacccgcugaaccuacugacgugccaacgguggauuuuggcggggccgaaccccaagaaaaggcaccucgguccucuaccgaaaagacuggaggcgacaacgauguggaagaaucgucacgcagcaguuccacugucucucagagaaggaaacggaucagcuccaccucaagucucgugaaaagcucuguuuccgugccaucagagagccacccgcuuaguaccauuaaucaggaagcaccccagccuaccgcuacuucuacaaaggagaagcaaccaugcuccgaccgcuaucgaauauauaaagcacagaagcugagagaaauguugaaagaggaguuaaggaaggagaagaagcaguggaagaacaaauacgccaucaaugagagccagcggcccccugaucguucgaagaugaccaugcgcgacuucauuuauuaccugccagauaacaaucccaugacgucuucccuagaacaagagaaaaagacugaaaaaccgucaaccccuguccagacaagagagcaggaggguaagaguacucccaacgcugaagacaaugagauggaagaggaaaccgaugacgggccacuccuggugccuaggguaaaaguugccgaggauggaagcaucauucuugacgaggaaucccugacaguggaggucuugcggaccaagggccccugugugguggaagagaacgacccaaucuuugaacgaggcucuacgacuacauauagcucauuccgcaagaauuacuauaguaaacccugguccaacaaggagaccgauauguuuuuccucgcgauaagcauggucgggacugacuuuucuaugaucggacagcuguucccucacagagcaaggauugagaucaaaaauaaguuuaaacgggaagagaagacaaacgguuggcgcauugauaaggccuuccaagagaagaggccauuugacuucgacuuuuucgcucaucugcuccagaagguuuuagccgaggaggagaaaagaaagcagaaaucagugaagaaucacagucugaaggagaaaaagagcaccaaaccgcguaagaacguaaaagugaagaaggucgcaugcgaaggcgugaacaaugaccccgaugaguccaugucuucgcggaucagcgacacggaacgaucccaaaaagaugcucagaccguugaggaggaaucacuuacauugaguagagaggacgccgaacagguggcgcuggaggucgaucuaaaccagaagaaaaggcgccggaagaaacaagacggggccaaugaacucggagugaacaaucugcuugagaacgcaacuguacaggcuggcccuucuaagggugagaaacacaagaauaagugucaggccauaagaccagaacugaaagagggggaaugcagcaaggagcagauguuguccuguacccaaaacauugacggaaucguuggcuucgcuucaacagaaaaaguggagaagaggacugaucccauucucagccugucuaaucagcaggacgccaccuccgucgcaacagagaguagcgaaucuuccaccucagauuuaccuaguuuugaggugggcauccgcgcccugugcgaagucaacaaugcugaggggagcuguaucgaggaacgaaacguggaccucaaaaauaacucgcuugagauugaucagacugaaaauguuaagccaaugcugcggggacguuuccaaagacccaagccgaacuuguccagggcggguaaaaagucugugcuaagccagggcaaaacggagucagaaaguaagaacucccauucuaaaacaagcguagagaagaaucacgucgagaaggacaaaaugaacacccuggauauacuccgcauggaaacuaccgagcgggaaaauccugaggcagaaacaguguccguucugggggagaagaacugccuucaggagggaucacagcugaaagccuugagaccagugcaagucaggggccgacuccagaagcccaaaccuaaugcugguaaggccgcagaacgcaaggagauccugauuagccaggaagagaucggggccaacguggagaaaaaugagaacgagaguugugcugaccgggauacaccccaacacauggaagaccagucuagaaaggauuuugaggaagaggacguaauauuacagccagagaaaaaugauuccuuccagaacgugcaaccugacgaacccaagguucugaaugagugccuaagcguccaggaaaacaauaaagccaacaagcucaaucaggugccaauucugaggacucguuuucagaaaccgaagccuaacaucggccgcggaacaggccggagagagaucucgucaaaggaagaggugcuugagaaaauuuuggucucuggggaaauggcagcggcucugagggagacgguucgacucgacaccagucccaaggaaauggugccagccgagaucaacacuaaagaaaugcaauccgaucugaaggagacaggacggcgcgcaauuagccccagagagaaaauacuugacgugaucgaugacaccauugaaauggagacaggucugaaggccaugggcagggaaaucuguuugcgggagaagacuccugaaguaaucgaugcuaccgaggagauugacaaagaucucgaagaggccgggcgaagagaaauaucuccacagaagaauggacccgaggaggucaaaccucugggcgaaguggagacggacuuaaaggcaaccgguaacgaaagcuccccgcgcgagaaaacaccagaaguuacugaugcuaccgaggagaucgacaagaaucuggaagagacagggaggcguaagauuucaccccgggaaaacggcccugaggaagugaaaccagucgaugagauggagacugaccuaaaugccaccggaagagaaaguagccccagggagaagacgccugaagugaucgaugcgacagaggaaauugaccucgaggagaccgaacgcgagguuucuccgcaggaaaacggccuggaggaggugaaaccccuuggggaaauggagacugacuugaaggccacaggacgagauuccuucccaagagguaaaaccccugaaguaaucgacgcuauagaggaaaucgagauugaucuggaggaaacugagcgggaaaucucaccccaggagaauggccucgaagaggucaagccacugggggagaugcaaaccgacuuaaaggcaacaggaagggaaauuaguccucgcgagaaaacgcccgaagugaucgaugccaccgaggaaauagacaaggaucuggaggagacuggccguagagaaauuagcccagaggaaaacgguccggaggaggugaaaccugucgacgaaauggagacagaucuuaagaccacagggcgggaaggcuccucuagggagaaaacucgcgaaguuaucgacgcugccgaggugauugagaccgauuuggaagagacggaacgagagaucucgccccaggaaaauggaccagaggagguaaagcccgugggcaagauggaaacagaccucaaagagauaagagaagagaucagccagcgggaaaagguccuggcagaguuuucagcgauuagggagaaagaaaucgaccuaaaggagaccgggaaacgcgauauuccuaucauggaaaagguguccggaaaaauggccguuguggaggagauggaagcugaccugaaggagacuggcaaggaaaacuucagagagagggguagugaagagauaugcgucaccgaggaaaaaguggccgagcucaagcaaacagggaaaacugauauuucuccacgggaaaaugagcuggaagagaccagcacaucccgucagacggacacccaucuuaugcagucaggaucuaacgauuuuagcgcaguucccaguuuggacauccagaauaucuccagcgaggugcugucuaugaugcacacuccugucgaagagaagcgcaacucagaaaaagagguauccagucauuucagccacuuuaagauuucgucucaaacacacgaauccgauaagaccgaggugcagggcauccagagcccggacguuccagagcaguucucagauauuaauuuaaguaaaucucucccccaagaacagaagccucuggagauaaaacccgcuccauuugugcgauccagauucaagaggccuaaacccaaccuugcccgggcagcccugaagcgcgaaacuacagagagcgagaaguacaucuacgagaaaaagucagagaccaaaaagauggaaacgauugucaugcaggagaacaaugaacagacugacaccuugccaagucaacaugaugaggcuagccucaugaucuccagagagaaagacacacugggucacaggaacgaagaggcggugauucuaccuugcacccagacugaacggaaucugucuccgagcaacuccugugagcccaaggaagagucacagucugccccaguacagaagaaugauaguguggucucgguuggcacaaacaaugugaacaccuuccaacaggagaugaaagaaagcgugauccagacagcacgacaagucagagggcgccuccagaggccucggcccaauauacguaagacuggacagagacagaucguggacaaaggcgaggcuaaggggauuaucaaagaaggaaggaccauucugccaaaggacgagacggagaaaaagguucuuacaguauccaacucucaaaucgagaccgagauagaagugccuucaagcgccguccccgagcaucgcauguaugaaaaucagucccaggugguuuugguggagaaccugcacgucaauaagacuaacgagaccauucggcaugaaaauaaaccguacgugccaaguucugcccagaugacacgaagaaaguuucaaaaagcuaagccuaacuuaggcagggcacacagcaaaaaggaggaacccguacucgagaaggucacuaccgaucagucaaaagaagguaagccagaggaccaucugcuucagaaaggggccuccaauacgcagcugcuacucaaggagaaagcggaacuguugacaagucuggaggugagcgcucgcaaggauugcguuggaucuaaggaauccgccuuagcaaaaaucgacgccgagcucgaagaggugggccccucacggagagucggugaggaaaccgugggcgauaacagcccuucgucuguuguggaggaacaauaucugaacaaacuuacaaguuguccgcagccccugaaugagacauccuacagcaaaaucgcuuuggacgggaagaccacuauuucauccacaucugaauaugagcguaacaggggagagcggcgcagccauaaaaaguucaagccaaaugucacccgaggcagagggaguaaaagggugcggggaaagacguccaaaaaggaaccucgcgcaagcaaagccaugcucguaacucugagagcgucucaggaggaagaugacgaugcugacgauuuugagucagacuacgaggaagagaguuaucaccuagcccccgaagaggugaacaaggcaccuguuuucgucccagugggccugaggucccccgaaccugugagcgcccaaauagaggagaccauggaagaacuugaaaucacagucaauguaccagauguggguugcauugcuguuguggagcaugaacuccccaacaccgacgucacaacugaggagaugaaacaggaagagaaucugucugugccguuugaaaugaccacgucggagcacauccaggacgaaccugggacaaacgauggaucaacugaggccgcaauuaccuugcugacaaugggcgacuuaguucuccagagcgagaucuccagugaacaaggugaugugggcgucuguauaaucccacacgugcauucuaaggacaagagccacauucccuccucacuggauaauguaaaccauaaaaucgugcacgagugccaggaacuuaguucuccuguuauuaccacuagcccagcuuccuucgaggagaauaagaucguccuggaagaacagucaagccgagaagagauaucuuugauggaaaaagugaaggagaacgccacccccacacggaauacgauuuccaaagugacaaguaaccuccguaucagaagccgccuggcgaagccgaagccuaaucuagagaaaacccuggggacaaacaggcuugacgauuaccaggaagucucgucccucuguguuaccaagggagccgagauggaaacucaacgggagacagagaaaaacgcaucuaaggcuaccgagcuggagaauaaaaacuugggccccgugacgacugccgaaaauaaggaccagucaaaguuagcuugcguacaugggaucaaaggaacaagcauuaguuccgaggugaaccugaccgaaagaaaugagaaccaggaagagucuagccaggagguccacaugcucucaguggcaccaguugccuccagugaaaccggcccuuguacucugggucuugaucgcgggcugggagagaauagcguggaagaaccccaaaucaaggacucuaaaggcgauucagucuugacacuaccaguacccgaguacaccccuacauccauaccagaagugcagcaggagaacauuaucaauccgcaggaccugacuguuaaccucguggccaaugucccccaagacggcgaagaugagcaggcuuuuauucugacgcuuguggaaaucccugcgaacgcagucgaggaguucaccgacgccacagcucaguuuaugccaaaucccuuacugccugccccaauacucguaaagagcguuaacacugaagagagaggggauaugucuauuugcuugcccgcaaccagugugggacaagacgccaugggucugucgaucuccggccgagauaauagcaaaaagccuccggacaaccucgaucugguaucacggaagagauuccaguguaggcuugacaaaaacgaucacaucccacccgcuaagaaacgcucucugacauugcgugacgauugccaggaauauaccacugaggugcauagcaaggaacuaacgaaugucuuugaggagaccggggaaucccacaaaggacaggacauuuuccugacaaguggcucaacucucaccacaccugagccccaacggcagcagguugaagcggccuuucagucuagagguagcagguccccagaugcaugcauggacaagaacgugccucaauuaccccaggacgagaugaucgucagugauaaggaagaacgcaccgacgcugccccaaaaagccagcagauggauucccgaacuucuucaagcaaggcaucgcugucccggccggggagaaggccucuuggauuccugagucucauuuguucuaaaaauagcuuggagucagacgaacccaugcaagugcauuccaagaaacgccugaagccacucauacccggccugaggaagaaacuuaaacggucuaacccuuucaaugagagucaggagaaaaacagggagagcuccgaucuacugccaucacccagcguaaucacaacgcagucugagaauauuaguuccagcgccacccaagugucaugcgaccagccuuuguuaaaggaaggcuacaaaucugcucagaagcgugccccgcagggggaggcgacuacaguuuccgaauacuuuuucaacgauaucuuuaucgagguggacgaaaccgaguga

SEQ ID NO: 53356 - RNA, 627 nt, Artificial Sequence
  derived and/or modified sequence opt3 from BEAN1__Homo_sapiens__NP_001184154
augagauacgccugcagcuccucugaggacuggcccccuccacuggauaucucaagugacggcgauguggacgcuaccguccucagggaacuuuauccggauagcccucccgggguuucccugucucgguugcgcuggucggcaaugauguacacaggaucauucacuuauugggugcgaagcauguuaagucgucacaagcuggacgccauucuagguagacucggcuacacggcgacccuggaguccgaauuuucucuuguacaggcuauaagcaaagagaacgugaagcaaauggucuucaaaaucuuucuggugaggguuuccugugaagccguguugcggacagcagggacucgcaugcucgagccaggaaccgagaagcuggccagaacacauucaaggcacaguagcgaaaaacggcuggucaagcccugcucuugucucgagggcgugcagccugguccaggguccggaggcccccagcagggcccuucagaagggguaggaagcgagaccgcuuuagcagaggguacugccggccaacgcagucugccaauggcucuuucuccguccgaaguuagcacagcccccaauucguugccuucuggguccccagugcuguga

SEQ ID NO: 53357 - RNA, 1782 nt, Artificial Sequence
  derived and/or modified sequence opt3 from BEGAIN__Homo_sapiens__NP_001153003
auggagaagcugagcgcccuccaggaacaaaaaggcgagcuuagaaagaggcuguccuacaccacacacaaauuggaaaaguuagagacugaguucgacucuacgcggcauuaucuggagaucgagcuacgccgagcucaggaagaacucgaaaaagugaccgagaagcugcguaggauucagucaaacuacauggcacuucagagaauaaaucaagagcuggaagauaaguuguaucggauggggcagcacuacgaggaagagaaacgcgcccucagucaugaaaucgucgcgcugaacagccaucugcucgaggcuaagguuacaauugacaaauuauccgaggauaaugaacuguauagaaaggacugcaaccuugccgcacaguugcugcaguguucucaaacuuacggaagggugcacaaaguaucggagcuacccucagauuuucaggaacgggugagccuccacauggagaagcacgguugcagucugccuuccccacuuugucauccggccuaugcugacucugucccuaccugcgugaucgcaaagguucuggaaaaacccgauccagccagcuuguccucacgccucagugacgcuagcgcccgagaucuggcguucugugacggcguggagaagcccgggccuagaccacccuacaaaggagauauuuacugcucugacacagcauuauauuguccugaggaaaggcggcgugaucgcagaccauccgucgacgccccggugaccgacguaggcuuucugagggcucaaaauucaacugauagcgccgcagaggaagaggaagaggcugaggccgcggccuuccccgcagguuuucagcacgaagccuucccuaguuacgccgggucucucccaacauccagcucguauucuuccuuuucagcuaccagugaggaaaaggagcaugcccaggcaagcacgcuuacugccucccagcaggcuaucuaccugaacucucgggacgaguuguucgaucgaaaacccccugcgaccacauaugaaggaagcccacgcuuugcaaaggccacugcugccguugcagcuccccuagaggcugaaguggccccgggcuucggcagaaccaugucaccuuaccccgcagagacauuuagguucccagcgaguccugggccccaacaggcucugaugccacccaaucucuggucccugcgggccaaaccuggaaccgcacgccuuccaggugaagacaugagaggccaguggaggccgcugagcgucgaggauauaggggccuauucuuaccccgugucagcugccggacgugcaaguccuugcagcuuuuccgagcgguacuauggcggugcugggggaucuccaggcaagaaggccgacggccgagcgucgcccuuguacgccagcuauaaagcugauuccuucucagaaggggacgaucucagucagggacaccuggcagagccuuguuucuuaagagccgguggcgaccugucucuaagcccagggagguccgcugauccccucccgggauacgccccuucagaaggcggugacggggaccgccugggcgugcaacuuugcggaacggcaagcucuccagagcccgaacagggcucccgggauaguuuggagccuagcucuauggaggcgucccccgaaaugcacccagccgcuagacugucaccucagcaggccuuucccaggacugggggaaguggucucagccgcaaggacucgcugacaaaagcacaacuuuauggcacccuguugaacuga

SEQ ID NO: 53358 - RNA, 2487 nt, Artificial Sequence
  derived and/or modified sequence opt3 from BEND3__Homo_sapiens__NP_001073919
augaacagcaccgaguucacagaagacguggaggaaguccugaaguccaucacuguuaaaguggagacggaagccgaggaugcugcacucgacugcucuguaaauucaagaaccagugagaagcacagcguggauuccguccuuacagcccugcaggacucuucgaaaaggaagcaauuggugucagauggcuuacuggacagcguucccggggugaaacggcgccgacuaauuccugaagcgcuccuggcuggaaugcguaacagagagaauaguuccccaugucaggguaacggcgaacaggccgggaggggacggucucuuggcaaugucuggccgggugaggaggaacccugcaacgaugcaacuaccccuagcuacaagaagccacuguaugggauaucccauaaaaucauggagaagaaaaaucccccuucaggagacuugcucaacguguacgaacuguuugagaaggccaaugcuaguaacagcccaucuucccugcgccucuuaaaugaaccccagaaaagagauuguggcucaacaggcgcagggaccgacaacgauccuaauauuuauuuccugauccaaaagauguuuuacaugcuuaacacuuugacaagcaauaugagucagcugcacucuaagguagaccuacucucccuggagguuagcaggauuaaaaagcaagugucgccaaccgagauggucgccaaauuccagccgcccccugaauaucagcuuacggcugccgagcugaagcagaucguggaucagucuuuguccggaggugaccucgcgugccggcuguuagugcagcuguuuccagaacucuucucagacgucgauuuuagucgcggcuguagcgcaugcggguucgccgcuaaacgaaaacuugagucccugcauuugcaacuaauaagaaacuacguugaaguguauuaccccucuguaaaagacacugccguguggcaggcagagugucugccucagcucaacgauuucuucagcagguuuugggcucaacgggagauggaagacucacagccaaguggacaggucgccuccuucuuugaggcggaacagguggaucccggccacuuccuggacaauaaggaucaagaggaagcccuuagccuggaccguucuucaaccaucgcaagugaucauguuguggacacacaggauuugacugaguuccucgacgaggcuagcuccccgggugaauuugccgucuuccuguuacaccgccuguuuccugagcuauucgaccacagaaagcucggggaacaguacucuugcuauggagauggcggcaaacaggagcuggacccccaaaggcuucagauuauccggaacuacaccgagauuuauuuuccagauaugcaggaagaggaggcuugguugcagcaaugugcccagcgaaucaaugacgagcuggaagggcucggacuggaugcagguucggagggcgacccuccccgcgaugacugcuacgauagcuccucacuuccagacgauauaagugugguaaagguugaggacucuuucgaaggggagagacccggaaggcggagcaaaaagauuuggcuggugccuaucgauuuugacaaauuggaaauuccacagccggacuucgagguccccggcgccgauugucuccuguccaaggaacaguuacgcucaaucuaugagagcucucuguccaucgguaacuuugcuaguagacuacucgugcaucuguucccugagcuuuuuacacacgaaaauuugaggaagcaauacaacugcagcgggucucugggcaaaaagcagcucgacccaucccguauuaaacugauacggcauuauguccaguuacuguacccccgagcgaagaaugauagaguguggacccuugaguucguuggaaaauuggacgaaaggugccgccggagagauacggagcaaaggcgcucauaccagcagcagcgaaaggugcacguaccuggcccagaaugucgggaccucacaaguuaugcaaucaaccccgagcguuuuagagaggaauuugaggggccgccucugccacccgaaaggagcucgaaggauuucugcaaaauuccucuagacgagcuggucgugcccuccccagauuuuccuguucccucuccauaccuccugagcgacaaggaggugcgcgaaaucguccaacagucacuuagugugggaaauuucgccgcucgguugcugguaagauuauuuccggaacucuucacugccgaaaaccugaggcuucaguauaaucacuccggugcauguaacaaaaagcagcuggauccuacccgauugcgccucauacggcauuacguggaggccguuuaucccgucgaaaagauggaggagguguggcacuacgaaugcauuccaucuaucgacgagagauguaggcgucccaaucgcaagaagugcgauauccugaaaaaggcuaaaaagguggaaaaauga

SEQ ID NO: 53359 - RNA, 1326 nt, Artificial Sequence
  derived and/or modified sequence opt3 from BEND4__Homo_sapiens__NP_001153019
auggaggaagagaugcagcccgccgaagagggcccuagcgugccaaagaucuacaaacaaagauccccguauucuguccugaagaccuuccccucaaaaaggccugcucucgcaaagcgguacgaacgcccaacacuuguugagcugccccacgugcgagccccuccacccccuccaccgcccuuugcgccucaugcugccguaaguauuagcuccucugagccacccccucagcaguuccaggcacaaucgucauauccacccgggccgggacgugccgcugcagccgcuagcaguuccucuccuagcugcacucccgccacgucccagggucacuugagaaccccagcgcagccucccccagcaucacccgccgcuaguucuagcuccucauuugccgcaguggucagguacggcccuggggcugccgcggccgcaggaacaggcgguacugggagcgacagugcuucuuuagaacuguccgccgagagccggaugauacuagaugcuuucgcccagcaauguucgcgcgugcucucucugcuuaacugcggaggcaaacuguuggacuccaaucauucacagaguaugaucagcuguguuaagcaggaaggcuccucuuauaacgagagacaggagcacugccauauugggaagggagugcacagccaaaccucagauaaugucgacaucgaaaugcaguacaugcagaggaaacaacagacaagugcauuucuccggguguucaccgauucccugcagaacuaucugcucagcgguucuuuuccaacuccgaaucccucaagugccagcgaguacggccacuuagcugacguagauccucuguccacaucuccaguucauacccuugggggauggacgucgcccgcgacuagcgaaucccacggccauccuucaaguucuaccuugccagaggaagaggaggaagaggacgaagaggguuacuguccccgcugccaggaacuggagcaagaggugauuagccuacagcaggaaaacgaggaacuccgaagaaagcuggaguccaucccggucccuugucagacagugcuugauuaucugaaaaugguguugcaacaccacaaucagcuccugauaccacagcccgcagaccagccuacugaagggucaaagcaauuacugaacaauuaccccgucuauaucaccagcaaacagugggaugaggccguuaacucuuccaagaaggacggaaggcggcuccuucguuaccugauucgcuucguguuuacaaccgaugaguugaaauauaguugcggccuaggcaagagaaaaaggauccauuga

SEQ ID NO: 53360 - RNA, 1815 nt, Artificial Sequence
  derived and/or modified sequence opt3 from BEST1__Homo_sapiens__NP_001132915
auguucgagaagcugacccucuacugcgacagcuauauccagcuuauucccauauccuuugugcugggcuucuacgucacauugguugugacuagaugguggaaccaauaugaaaauuuaccuuggccagauaggcugaugucucuaguaucaggguuuguggagggaaaagacgaacagggucggcuccugcgccgaacgcuuauccguuacgccaaccugggcaaugucuugauucucagaagugugagcaccgcuguuuauaagagguucccguccgcacagcaccuggugcaggccggguuuaugacacccgcggagcauaaacaacuggaaaagcucucuuuaccucacaacauguucugggucccaugggugugguuugcuaaucugucgaugaaagccuggcuuggaggccggauccgcgaucccauuuugcugcagucacuacucaacgagaugaauacucugagaacccaguguggucaucuuuacgcauaugacuggaucagcauaccucugguauacacacagguugugaccgucgccguguacaguuucuuuuugacuugccucguggggaggcaauuccugaacccagcuaaggcauaucccggacacgaguuagaucuggucguuccuguguuuacauuccuccaguuuuucuucuacguaggcuggcuuaagguggccgaacagcugaucaauccauuuggcgaggacgaugacgauuucgaaaccaacuggauugucgaccggaaucuacagguguccuugcuggcuguugaugagaugcaucaagaccucccgcgcauggagcccgauauguauuggaacaaaccugaaccacagcccccuuacacggccgcgucugcacaguuuaggagagccagcuucaugggguccacuuuuaauaucucacugaacaaggaggaaauggaguuccaaccaaaucaggaagacgaggaggacgcucacgccggaauuaucgguagguuucuuggccugcagagucacgaucaucacccuccgcgggcaaacagccguaccaaauugcucuggccuaagcgcgaaucucuguuacaugaggggcugcccaaaaaccacaaggcugccaagcagaaugugagaggacaagaagacaacaaagcguggaagcuaaaagccgucgaugcauucaaguccgcuccacucuaucagaggccuggcuacuauucagcuccccagacaccacugagccccacuccuauguuuuucccacuugagccgagugcccccucuaaauugcacuccgugaccgguauagacacaaaggauaaaagccugaagaccguaucgucuggggccaagaaauccuuugaacuccugucagagagugacggagcacuuauggagcauccugaaguuagccaggugcggcgaaagacggucgaguucaaucugacugauaugccagaaauucccgagaaccacuugaaagaaccucucgagcaauccccaacaaauauccauaccacucugaaggaccacauggaucccuacugggccuuagagaaccgcucugugcugcaucuaaaucagggccacuguauugcucucugcccgacacccgcgagccuggcacuuucauugccauuucugcacaacuuccucggcuuccaucacugucagaguacccuggacuuaagacccgcccuggcuugggggaucuaccuugccacguuuaccggaaucuuggguaaaugcuccggcccuuuccucacaagccccugguaucauccagaagauuuucuggggccuggagagggccgauga

SEQ ID NO: 53361 - RNA, 1530 nt, Artificial Sequence
  derived and/or modified sequence opt3 from BEST2__Homo_sapiens__XP_005260020
augaccgugacauacacugccagagucgcuaacgcaagguucggcggguuuagccagcugcuccuucuguggcggggauccaucuauaaguuguuauggcgcgagcugcuaugcuuccucgguuuuuacauggcccugucugcggcuuaucgauucguucuuacggaaggccaaaagcguuacuuugagaagcuggugauuuauugugaccaguacgccucauugauacccguaaguuucgugcucggguuuuaugucacccuggugguuaauagaugguggagccaguaccugugcaugccucucccagaugcauuaauguguguggucgccggaacagugcacggcagggacgaucggggucgccuguacagaaggacucuuaugcgguaugcuggguuguccgcaguacugauccuacgcucuguuucgaccgccguguucaaacgauuuccgacaauugaccaugucguggaagcuggauucaugaccagagaggaaaggaagaaauuugagaaccucaauucaagcuacaacaaguauugggugcccugcgucugguucaguaaucuggccgcgcaggcacggcgugagggccgcaucagagauaacuccgcccuuaagcuguugcucgaggaacugaauguuuuuaggggcaaaugugggauguuauuccacuacgacuggauuucugugccucugguauauacucaaguggucacaaucgcucucuacagcuauuuccuugccugccugauaggacggcaguuuuuggauccagcacaggguuacaaggaccaugaucuagaccugugugugcccaucuucacccuccugcaguuuuucuuuuacgcuggcuggcuuaaaguugccgaacaacugauuaacccuuucggggaggaugacgaugacuuugagacgaauuucuugaucgaccgaaacuuucagguguccaugcucgcggucgaugaaauguaugacgaucuggccguguuagagaaggaccuguacugggaugcagcugaagcccgcgcuccauauacugccgcaaccguauuccagcuaagacagcccucauuucaaggaaguacauucgacauuacucucgccaaagaggauaugcaguuucagaggcuggacggccuugaugguccuaugggggaagcuccaggagacuucuugcaacggcugcucccggcgggcgcaggcaugguugccgggggaccccugggucgcagacuuagcuuccuguugaggaaaaauucuugcguguccgaggcuucaaccggcgccagcuguaguugcgcagucgugccugagggggccgcuccagaauguucuugcggagauccccuccuggacccuggcuuaccagagcccgaagccccgccucccgcagguccagagccucugacacuaauccccgggccagucgaacccuuuuccauagugaccaugccuggcccacguggaccggcgcccccuuggcucccaagccccauuggcgaggaggaagagaaccuggcuuga

SEQ ID NO: 53362 - RNA, 357 nt, Artificial Sequence
  derived and/or modified sequence opt3 from BET1__Homo_sapiens__NP_005859
augagaagggccggccugggggagggagugcccccugguaacuacggcaauuauggguacgcuaacagcggauauuccgcaugcgaagaggaaaaugagcggcucaccgaaucucuucgcucaaaggucacagccaucaaaagucugagcauugagauaggccacgagguuaagacucagaacaaauuguuagcggaaauggacucccaauucgauucuacgaccgguuuucuggggaagacaaugggaaaacuaaagauccucucgcgaggcucacagacuaagcugcuuuguuacaugaugcuguucagcuuguuuguguucuuuauuaucuauuggauuaucaaacuccguuga

SEQ ID NO: 53363 - RNA, 336 nt, Artificial Sequence
  derived and/or modified sequence opt3 from BET1L__Homo_sapiens__NP_001092257
auggccgacugggcuagagcacagagccccggcgccguggaggaaauccuggauagggagaacaagcggauggcggacucccucgcuucuaaagucacccgccuuaagucacuggccuuggauauugaccgagaugcagaagaccaaaaucguuacuuagaugggauggacagugauuucacaagcaugacuucccugcuaacgggaucuguuaaaagauuuucgaccauggccaggucaggucaggacaaccggaagcuccugugcggcauggcuguggggcuuauaguagcauucuuuauccugagcuauuucuugagucgcgccagaacauga

SEQ ID NO: 53364 - RNA, 378 nt, Artificial Sequence
  derived and/or modified sequence opt3 from BEX1__Homo_sapiens__NP_060946
auggagagcaaggagaaaagagccgugaacucccugucuauggaaaaugcuaaccaggaaaaugaggaaaaggagcaagucgcaaacaaaggcgagccccucgcccuuccucuggacgcgggggaauacugcguuccaaggggaaaucggcgccgauuccgugugagacagccgaucuugcaguauaggugggauaugaugcaccgguuaggugagccccaggcucgcaugagagaagagaacauggagaggauuggcgaagagguacggcaacugauggaaaagcuacgcgagaaacagcucucacauagucugcgagccgugagcaccgacccuccacaccaugaucaccaugacgaauuuugucuuaugcccuga

SEQ ID NO: 53365 - RNA, 483 nt, Artificial Sequence
  derived and/or modified sequence opt3 from BEX2__Homo_sapiens__NP_001161871
augcagaagaugguggucugcggcgccaaauguugcggggacgcuccccacguugagaacagagaagaggaaaccgcaaggaucggaccuggugugauggagagcaaggaggaacgggcccugaauaaccucauuguagagaaugugaaccaagaaaaugaugagaaagacgaaaaggagcaggucgcgaacaaaggcgagccacuugcucugccguugaauguguccgaauacuguguuccccgcgggaaccgacguagauucagggugcggcagccuauauuacaguaucgcugggauaucaugcauagacugggagagccacaagccaggaugcgggaagagaauauggaacgcauuggcgaggagguccgacagcuaauggaaaagcucagagagaagcagcugucucacucacuuagggcagugaguacagaucccccucaucacgaccaucacgacgaauuuugccugaugccauga

SEQ ID NO: 53366 - RNA, 363 nt, Artificial Sequence
  derived and/or modified sequence opt3 from BEX4__Homo_sapiens__NP_001073894
auggagagcaaggaggaacuggccgcuaacaaucucaacggcgaaaaugcacagcaagagaacgaagggggagagcaggcccccacccagaaugaggaagaguccagacaccuugguggcggggaaggacagaaaccuggcgguaacaucaggcgggggcgcgugcgacgucuggucccaaauuucagaugggcgauuccgaacaggcauauagagcacaaugaggcucgggacgauguugaacgcuuugugggacaaaugauggagaucaagagaaaaacaagggaacagcagaugcggcauuacaugcgcuuccagacucccgagccugacaaccacuaugauuuuugcuugauuccauga

SEQ ID NO: 53367 - RNA, 1353 nt, Artificial Sequence
  derived and/or modified sequence opt3 from BFAR__Homo_sapiens__NP_057645
auggaggaaccccaaaagagcuacgugaacacgauggaccuggagagagaugaaccucucaaauccacaggcccacagaucucugucucagaguucaguugccacuguugcuaugacauucuuguuaauccgacuacgcugaacugugggcauagcuuuugcaggcacuguuuggccuuauggugggcuuccucuaagaaaaccgaaugccccgagugucgggagaagugggaaggauucccuaaagugucgauacugcuacgcgaugcaaucgagaagcucuuuccagacgccauucgacugcguuucgaagauauccagcagaauaacgacauuguacagucacuugcggcuuuucaaaaguacgguaaugaucagaucccccuggccccuaacacaggcagagcaaaucagcagaugggagggggcuucuuuagcgguguguugacugcccucaccggggucgcugugguucugcugguguaucauuggaguuccagggagucugagcacgaccucuuaguccauaaagcaguggccaaguggacagcugaagagguaguucuguggcuugaacaauugggaccaugggccagccuguaccgggagcgcuuccuauccgaaagagugaacggcaggcuccugcuuacccugacugaggaggaauuuucaaaaacacccuauaccauagagaauaguagccaccggcgcgcgaucuugauggaacucgagcgagucaaggcacugggcgugaaaccuccacagaacuuaugggaauacaaggccgugaauccggggagaucucuguuccuccuuuaugcucugaaguccucacccagguugagccuacuguaccucuaccuguuugauuauacggacacuuuccuuccuuuuauucacaccaucugcccacugcaggaggauaguucuggagaggacauugucacaaaauugcucgaucugaaggaacccacuuggaaacaguggcgggaguucuuaguuaaguacuccuuccugccuuaucaacuaaucgccgaauuugcaugggacuggcucgaggugcauuacuggaccagccguuuccugauaauuaacgcuaugcuuuugucgguacuggaacucuuuucuuucuggcgcaucugguccagaucagagcugaaaacagugccacagaggauguggagucacuuuuggaaggucagcacccagggucuuuucguggccauguuuuggccccugauuccgcaauucguuuguaauugcuuguuuuauugggcgcucuacuucaacccuaucaucaauauugaccugguggucaaagaguuacggcgacuggaaacccaggugcuauga

SEQ ID NO: 53368 - RNA, 1623 nt, Artificial Sequence
  derived and/or modified sequence opt3 from BFSP1__Homo_sapiens__NP_001155177
auguacgagaacgaaugcgagugucagcugcuccuuaaggaaaugcuggagagauugaauaaagaagccgacgaggcuuuacugcacaaccuaaggcuccaacuggaggcacaguuccuucaggaugacaucagcgccgcgaaggaucggcauaaaaagaaucuguuggaagugcagaccuauauuuccauacuccaacagaucauucacacaacucccccugcuucuaucgucacgucaggcaugcgcgaggaaaaacugcugaccgagcgagagguugccgcacuccguagucaguuagaagaggggagagaagugcugagccaucuucaggcccaaaggguagaguugcaggcucagacaacuacccuggaacaggcaauuaaguccgcccacgagugcuacgacgaugagauccaacuauauaacgaacagauagagacacuccggaaggaaaucgaggaaaccgagcgcgugcuggagaaaucuucguacgacuguagacagcuugcugucgcccaacagacucugaagaaugaauuggauagguaucaucggauuaucgagauugaaggaaaccgccucacaucagcguuuaucgagaccccaauaccgcuguucacgcagagccacggugugaguuuauccacuggcucugggggaaaagaccugacccgagcacuccaggauauuacagccgcuaagcccagacaaaaagcccuuccuaagaauguuccaaggcggaaggaaaucauuacuaaagacaagaccaacggcgcacuggaggaugcucccuugaaaggucuagaggacacaaagcuggugcaggucgugcucaaagaagagagcgaauccaaguuugagucagagaguaaagaaguaagcccucugacccaggagggggccccagaagauguucccgacggaggccagaucucuaagggcuucgggaaacuuuaccguaaggugaaggagaaaguccgcuccccuaaggaaccagagacgccgacugagcuguauacaaaagaaagacacguguuggugaccggagacgcgaauuacgucgaucccagguuuuacguuucaagcaucacugccaaggguggcguggcaguaaguguggcugaggacucuguccucuaugaugggcaaguggaaccuuccccagagagccccaagccuccacuggaaaacggacagguuggcuuacaggagaaagaggacggucagcccauugaucaacagccgauagacaaggaaaucgagccugauggggccgaacuggagggacccgaagagaaacgggagggcgaggaacgagacgaagagucgcgcagaccaugcgcuauggugacaccuggcgccgaggaacccucuauuccagagcccccuaagccagcagccgaucaggacggggcugaaguccuaggaaccaggucccggucacucccggagaaaggucccccuaaggcgcuggcauacaagacgguggaaguaguugagaguaucgagaaaauaagcaccgaauccauucagacauaugaggaaacugccgugaucgucgagaccaugaucggcaagacaaaaucugauaagaaaaagagcggggaaaagucaaguuga

SEQ ID NO: 53369 - RNA, 1248 nt, Artificial Sequence
  derived and/or modified sequence opt3 from BFSP2__Homo_sapiens__NP_003562
augagcgagagaaggguggucguugaccugcccaccuccgccucuucaaguaugccucuccagcggcgccgagcuagcuuccguggcccaagauccucuucgucacuugaaagcccgcccgcaaguaggacaaacgccauguccgggcuggugcgggcgccuggaguauacguggguacugcuccaucuggcugcaucgggggauugggcgcccgcgucacgagaagggcauuagguauuagcuccguguuucugcaagggcuacggucaaguggacucgccaccguucccgcuccuggccuggagcgcgaucacggcgcaguggaagaccuugggggaugucuggucgaguauauggccaaggugcaugcuuuggaacagguaagccaggagcucgagacacagcugcgaaugcaccuggaaucuaaagccacuagauccgguaauuggggcgcgcucagggcaucaugggccagcaguugccaacagguuggggaggcuguguuagaaaacgcccggcugaugcuucagaccgagacaauacaggcaggagcugaugacuucaaggagcguuacgaaaaugagcaaccauuucgcaaagccgcggaagaggaaaucaacucuuuguauaaggucauugaugaggccaaucugaccaaaauggaccuagagucccagaucgaaagccucaaggaggaacugggcucgcuuucuagaaacuacgaggaagaugugaagcuguugcauaaacagcucgcagguugugagcuggagcagauggacgcucccauugggacuggauuagaugacauccuggaaacaauaaggauccaaugggagcgggauguggaaaagaaucgagucgaggccggcgcucuccuucaggccaaacagcaagcagaaguugcccacaugucccagacccaggaggagaagcuggcugcggcauugcgcguggaacuacauaacacgucaugccagguacaaagucugcaggccgagacugaaagccucagagcucugaaaaggggccuugagaauacccugcacgacgccaagcacuggcaugauauggaguugcagaaccucggggcaguggucggacggcuggaagccgaguuacgcgaaauuagagcugaggccgaacagcaacagcaggagagggcacaucugcuagcgcguaagugucagcuccaaaaagacguggcuuccuaucacgcccugcuugaccgggaggaaucugguuga

SEQ ID NO: 53370 - RNA, 303 nt, Artificial Sequence
  derived and/or modified sequence opt3 from BGLAP__Homo_sapiens__NP_954642
augagagcccugacccuccuugcucuguuggcauuagccgcgcugugcaucgcuggccaggccggggcaaagcccagcggagccgaguccucuaaaggugcugcauucgugucaaagcaagaaggcagugaggucguuaaaaggccucggcgcuaccuauaucaguggcucggggccccagugccguaccccgacccucuggaaccacgacgugagguaugugaacuuaaccccgauugcgacgagcuggcugaucacauuggauuucaggaggccuauagaagguucuacggcccuguguga

SEQ ID NO: 53371 - RNA, 1107 nt, Artificial Sequence
  derived and/or modified sequence opt3 from BGN__Homo_sapiens__NP_001702
auguggccccuguggagacucgugagccuucuggccuugucccaggcuuuaccuuucgagcaaaggggcuuuugggacuucacccuggaugacgggccauuuaugaugaacgaugaagaggcaucuggagccgacacaucagguguccuagauccggacaguguuacucccacguacagcgcgaugugcccuuucggcugucacugccaucuccgggugguacaguguuccgaucuggggcuuaagucugugccaaaagaaaucucgcccgacaccacacuguuggaucuccagaauaacgacauuucagagcugcgcaaggaugacuuuaaaggacugcagcaccucuaugcuuuaguccuggugaauaacaagauaagcaaaauccaugaaaaggccuucaguccucuucgaaaguugcaaaaacuguacauuuccaagaaucaccuaguugagaucccacccaaccucccuucuagccugguggagcuucguauucaugauaauagaaucaggaaagucccaaagggcguguuuuccggucugcggaacaugaauugcauagaaaugggaggaaacccguuggaaaauucaggcuucgagcccggcgcauuugacgggcucaaacugaacuauuuacgcaucagugaggccaagcugacugggauuccuaaggaccucccagagacccuuaaugaacugcacuuggaucacaacaaaauccaggcuauugagcuagaagaccugcucagauacagcaagcuguauaggcuuggucugggccauaaucagauccggaugauagagaacgggucuuuguccuuccuccccacacugcgcgaauuacaccuggauaacaauaaacuagcacgaguaccuucaggacucccagaccugaaacuuuugcagguuguguaccugcauagcaacaauauuaccaaggucggcgugaacgauuuuugucccauggguuucggggugaagagagccuauuacaauggaaucagucucuuuaacaauccggucccuuacugggagguucaacccgcuacuuucaggugcgugacagaccggcuggccauucaguucggcaacuauaaaaaguga

SEQ ID NO: 53372 - RNA, 570 nt, Artificial Sequence
  derived and/or modified sequence opt3 from BHLHA15__Homo_sapiens__NP_803238
augaagaccaaaaacagacccccuaggcggcgcgccccagugcaggacacagaggcuacuccgggcgaagggacgcccgauggaagccugccuaauccaggucccgagccugcaaagggccuccgaucccguccagccagagcggcugccagggcacccggggaaggacggcgcagaaggccuggcccaucuggucccgggggacggcgcgacucaaguauccaacgaagacuugagagcaacgaaagggagcggcagcguaugcacaaacugaauaacgccuuccaggcuuugcgcgaggucauuccgcauguuagagcagauaagaaauuauccaagauagaaacccugacacuagccaagaauuacaucaaaucucucacugcuaccauucugacaaugucgucaagcaggcuuccuggccuggagggcccagggcccaaguuguaucagcacuaccaacagcagcagcaaguggccggaggugcgcucggcgcaaccgaagcccagccucaggggcaucugcagcgguauaguacucaaauccacuccuuucgagagggaacauga

SEQ ID NO: 53373 - RNA, 708 nt, Artificial Sequence
  derived and/or modified sequence opt3 from BHLHA9__Homo_sapiens__NP_001157877
augcugagaggcgcccccgggcucggacuuaccgcuaggaagggugcagaggacagcgccgaagaucugggcgggccuugcccagagccgggaggcgacuccgguguguugggggcgaacggagcuucuuguucacggggcgaagccgaggaacccgcaggccgccgacgugccagaccugucaggaguaaagcucggcgcauggcagccaauguuagagagaggaagcggaucuuagauuacaacgaggcuuucaaugcccugcgccgagcgcuaagacacgaccucgggggaaaaaggcugagcaagauugcaacacuucggcgugccauacaucgcaucgcugcccuguccuuggugcucagagcaucuccagcucccagggguccuugcggccaccuggaaugucaugggccagccgcgcggggagauacuggcgacacgggugccucgcccccuccaccggcagggcccucacuggcucgaccugaugccgcucgcccaagcguacccagugccccuagaugcgcauccuguccaccccacgccccgcucgcuaggccuucugcgguggcagagggacccggcuuagcccaggcuagcggcggguccuggcggcgcugcccaggagccucaagugcagguccucccccauggcccagaggcuaucugaggagcgccccugggaugggacauccacguucuuga

SEQ ID NO: 53374 - RNA, 1644 nt, Artificial Sequence
  derived and/or modified sequence opt3 from BHLHB9__Homo_sapiens__NP_001135999
auggccggcaccaagaacaaaacaagagcucaggcaaagacugagaaaaaggccgcgauccaagcuaaagccggggcagaaagggaggccacgggagugguccggcccguugcuaagacccgcgcaaaggccaaagcuaagacagguagcaaaacugacgccguggcggaaaugaaggcaguauccaaaaauaagguggucgccgagaccaaggaaggcgcucugucugagccuaaaacacucgggaaggccaugggagauuucaccccaaaagcaggcaacgagucaacuuccagcacaugcaagaaugaagcugguaccgacgccugguuuugggcgggggaggaagccacgauuaacuccugguucuggaauggagaggaggcaggcaacucuuuuucgacuaaaaaugauaagccggaaauaggcgcucaggugugugccgaggaacuugagcccgcugccggggcagacugcaaaccucgaucaggagccgaagaggaggaagaggaaaacguuaucgguaauugguucugggagggcgaugacaccagcuuugauccaaaccccaagccugugagucguauugucaagccacagcccguguacgaaaucaaugagaaaaacagaccuaaggacugguccgagguaacaauuuggccaaaugcuccggcgguuacucccgcagugcugggguucaggucucaggccccuagcgaagcuaguccacccucauauaucgucuuggccagugcagaggaaaacgccuguagcuuaccuguggcuaccgccugccggccaucucgcaauacaagauccuguucacaacccauaccggagugcagguuugauagcgacccuuguauccagaccauugaugaaauccggcgccagauucgaaucagagaggugaacggaauaaaacccuucgcaugcccauguaagauggagugcuacauggacagugaagaguuugaaaaacuggucucucuacucaaguccacgacugauccucugauucacaagaucgcgaggauugcuaugggcguucauaacgugcaccccuucgcccaggaguuuaucaaugagguagguguggucacacuuaucgaaagccuguugucguucccaucucccgagaugcggaaaaagaccgugauuacucucaacccuccauccggggacgaacgucaacgcaaaauagagcugcauguuaagcacauguguaaagaaacaaugucauuuccgcugaauagucccggacagcagagcggccucaagaucuuaggccagcugaccacggacuucgugcaucacuauauugucgcaaacuacuucuccgagcuuuuucacuugcugucuagcgggaauugcaagaccagaaaccuagugcucaaacugcuucugaauaugucagagaacccuacagccgcuagggauaugaucaauaugaaggccuuggcagcucucaaacugauauucaaccaaaaggaagccaaagcgaauuuaguaaguggaguugccauuuuuaucaacaucaaggagcauauucggaaggguuccaucguggucguggaccaccugagcuauaauacucucauggcuauuuuccgagaagucaaagagauaaucgaaaccauguga

SEQ ID NO: 53375 - RNA, 1146 nt, Artificial Sequence
  derived and/or modified sequence opt3 from BHLHE22__Homo_sapiens__NP_689627
auggagagaggcaugcaccugggggccgcugcagccggagaagacgaucucuuccuucauaagagccuguccgcgucuaccucaaaaagguuggaggcugccuuucggaguacacccccugguauggacuuaagccuggcaccaccgccccgcgaacgaccugccuccucuucgucaagcccacuaggcugcuucgagcccgcugauccugaaggggcaggacuccugcuuccacccccuggcggugggggaggcggcagugccggguccggagguggcgggggaggcggugugggggucccaggacuguugguuggcucugcuggcguagggggagacccgagccucuccucacugcccgccggugcggcacugugucucaaguacggcgagagugccagccgugggucuguggcugaguccucaggaggcgaacagagcccugaugacgauagugacgguagaugcgaguuagugcugagggccggggucgcagauccacgggcuucucccggcgccggaggcgggggagcgaaagccgcagaagguuguuccaacgcucaccuucauggcggggccagcgugccuccaggaggcuugggugggggcggaggcgggggaucgucuuccgguucaaguggcgggggaggcgguagcggguccggcucuggaggcagcucaaguuccagcagcucaaguagcaagaaauccaaggagcaaaaggcucugcgccuaaauaucaacgccagagagaggcggcgcaugcacgaccucaaugaugcacuggacgaacuucgagccguuauucccuaugcucauucuccgucggugagaaaacugagcaagauagcgacuuugcuccuggccaaaaacuacaucuuaaugcaggcacaggcucuggaggaaaugaggcggcucgucgccuaucuuaaucaggggcaagcaauuuccgccgcuucacugccuaguucugccgcagcggcugccgcagccgcugccuugcaccccgcacuaggagcuuacgagcaggccgcgggcuauccauuuagcgccggucugccucccgcugcauccugcccagaaaagugugcccucuucaacucagugucuucuucccugugcaaacaguguacggagaagcccuga

SEQ ID NO: 53376 - RNA, 726 nt, Artificial Sequence
  derived and/or modified sequence opt3 from BHLHE23__Homo_sapiens__NP_542173
augagcaucagacccccuggcgagccaccgucccccgggggagccgcuauggcagaacugaagucucucucaggugacgccuaccuugcgcugagucacggcuaugcugccgcagccgcuggguuggcauacggagccgcuagggagccugaagccgcgcggggcuaugguaccccagggcccggaggcgauuuaccugcagccccagcuccccgcgccccugcacaggcugccgagagcuccggcgaacaaucuggggacgaggaugacgcguucgagcagcgacguagaaggcggggaccagguucggccgcagauggccgcagaaggccgcgggaacagcgcucacugcgacuaagcauuaacgcuagagagaggcggcguaugcaugaccucaaugaugcccuggacgggcuucgcgcugugauacccuacgcccacaguccuuccgucagaaaacugucuaagaucgcaacauugcuccuggccaaaaacuauauucugaugcaggcucaagcgcucgaugaaaugaggcgguuaguugcauuucugaaucagggacagggccuugccgcuccagugaacgccgcacccuugacuccuuucggucaggccacgguaugcccauuuagcgcuggggccgcacugggacccuguccggacaagugcgcggcuuucuccggcaccccuucagcccuauguaaacauugccacgagaagcccuga

SEQ ID NO: 53377 - RNA, 1239 nt, Artificial Sequence
  derived and/or modified sequence opt3 from BHLHE40__Homo_sapiens__NP_003661
auggagagaauccccagcgcccagccuccaccggcuugccugcccaaggcaccuggccucgaacacggggaccuuccaggaauguaccccgcccauauguaucaaguguacaaauccaggcgggguauuaagcgcucugaggauucaaaagaaaccuauaagcugccucaccgauugauagagaaaaagcguagagacaggaucaacgaauguauugcgcaguuaaaggaucugcuaccagagcaucucaaacugacaacucuuggccaccuggagaaggcugucguuuuggaacucacgcugaaacaugugaaggcccugaccaaucucaucgaccagcagcaacagaaaauuaucgcauuacagagugggcugcaggccggagagcuuagcggccggaacguagaaacaggucaagagauguucugcuccggguuucagacuugugcucgcgagguguugcaguaccuggcaaagcacgaaaauaccagagaucuaaagucuucgcagcucgucacacaucugcacagggugguuucagagcuucugcaaggaggcaccagccggaaacccagugacccugccccaaaggugauggauuucaaagaaaagccguccucucccgcuaaaggcagcgaggggccuggaaagaacugcgucccagugauacagcgcacuuuugcccacuccucaggugaacagaguggcagcgacacagauaccgacucuggguauggaggcgaguccgagaaaggugauuugcgaucagaacaacccuguuucaagagcgaccaugggagaagguuuacgaugggagagcggaucggcgcgauuaagcaggaaagugaggaaccuccaacuaaaaagaaucguaugcagcucucugaugacgagggccacuucaccuccagcgaccugaucucgucucccuuuuuagggccgcacccucaucagcccccauucugccugccuuuuuaccucauucccccauccgcaacagccuaucuucccaugcuggagaaauguugguacccuacuucaguaccaguuuuguacccgggacuaaacgcuagugccgcagcucugagcuccuucaugaaucccgauaagaucucugccccucuccugaugccacaacgccuucccagcccucugccagcgcaccccucaguggacaguuccgucuugcuccaggcccugaaaccgauaccuccauuaaaccuggaaaccaaggauuga

SEQ ID NO: 53378 - RNA, 1449 nt, Artificial Sequence
  derived and/or modified sequence opt3 from BHLHE41__Homo_sapiens__NP_110389
auggacgagggcaucccccaucugcaggaaagacaacuccuugagcacagggauuucauugggcuggacuacagcuccuuguauaugugcaagccuaaacggucuaugaagcgcgaugacaccaaagauacauacaaguuaccacaccgacugauagagaaaaagcguagagacaggaucaacgaauguauugcccagcuaaaggaucuccugccggaacaucuuaaacugacuacguugggacaccucgagaaggcugugguccuggagcugacccucaaacauuuaaaggcacugacagcccuuacugaacagcagcaccagaaaaucauugcguugcaaaauggugagcggucacugaagagucccauccagagcgaccuagaugcuuuucacuccggcuuccagaccugcgccaaggaaguucuccaauaucugucucgcuuugagucguggacaccuagagagccaaggugugugcagcuuauaaaccaucugcacgcaguagccacccaguucuugcccacuccucagcuccugacacaacaggugccauuaucaaaagggaccggagcucccagcgcagccggcagugcugccgcgccuugccuggaacgggcaggucagaagcucgagccacuugccuacugugucccggugauccaacgcacgcagcccuccgcugaacuggccgcagagaaugacacugauaccgacucuggguauggaggcgaagcugaggcccgaccugauagagagaaaggcaagggggcgggagccagcaggguuacaauuaaacaggaaccacccggugaggacuccccugcaccaaagcggaugaaauuggacucacguggcgggggaaguggcggugggcccggaggcggcgcugccgcugccgcagccgcucuacuggggccggauccugcggcagccgcugcccuccugcgccccgacgcagcccuucugagcucuuugguggcuuuuggagguggcgggggagccccauucccucagcccgcagcggcugccgcaccauuuugccuccccuucuguuuucuguccccuucagccgcugccgcauacguccaaccauucuuagauaagagcggccuggaaaaguaucuauacccggcugccgcggccgcucccuuuccucuccuguacccagguauccccgcacccgccgcugccgcagcggccgcugccgcagcugccgcagccgcugcggccuucccaugccuuaguucuguguuguccccuccgccugagaaagcaggggcugccgccgcuacucugcucccacaugaaguagcaccccugggcgccccucacccccagcacccacauggaagaacccaccuuccuuuugcgggccccagggagccagggaacccggagagcucggcucaggaagacccuucucagcccggaaaggaggccccauga

SEQ ID NO: 53379 - RNA, 900 nt, Artificial Sequence
  derived and/or modified sequence opt3 from BHMT2__Homo_sapiens__NP_001171476
auggcccccgcuggcagaccuggggcaaagaaaggaauccuggagaggcucgaaagcggugagguggucauuggcgacggguccuuccuuauaacccuggaaaagcggggauacguuaaagccggcuuguggacaccagaggcggugaucgaacacccggaugcuguacgccaguuacauauggaguuucugcgagccgguucuaacgugaugcaaacuuucacguuuucagcaagugaggacaauauggaaagcaaguauuucgagcacgucgaagaggccgugugggcuguugaggugcuaaaagaauccgaucgucccgucgcagugaccaugugcauugggccugagggagacaugcaugauaucacaccaggcgaaugugccguaagacucguuaaggcuggcgccucuauugugggggucaacugcagguuuggacccgacacuucgcugaagaccauggagcuuaugaaagaaggucuggagugggcgggcuugaaggcacaccucauggugcagccucugggguuccaugccccagauuguggaaaagagggcuuuguggaccugcccgaauacccuuucggucucgagucacgggucgcuacacgcugggauauccagaaguaugccagagaagcauacaauuuagggguuagguauauaggaggcugcuguggcuuugagccauaccacauccgggcuauugccgaggaacuggcgccggagcgcggguuccuucccccugccagcgaaaaacacggaaguugggguuccggcuuggacaugcauaccaagccauggauccgagcaagagcuaggcgggaguauugggaaaaccugcuacccgccucugggcguccuuuuugcccaagccucuccaagcccgauuucuga

SEQ ID NO: 53380 - RNA, 1221 nt, Artificial Sequence
  derived and/or modified sequence opt3 from BHMT__Homo_sapiens__NP_001704
augcccccugugggcgggaagaaagccaagaaaggaauccuggagagacucaacgcuggugaaauugucauaggcgacgggggauucguuuuugcacuugagaagaggggcuacgugaaagccgguccauggaccccggaagcggcuguagagcaccccgaagccgugcggcagcugcaucgcgaguucuugcgagcagggagcaaugucaugcaaacauuuacuuucuaugccuccgaggauaaguuagaaaaccguggaaauuacgugcuggagaagaucucuggccaggaaguuaacgaggcugcaugcgacauugccagacagguggcugaugagggcgacgcccuagucgcagggggagugucacagacgccuaguuaucucagcuguaaauccgaaaccgagguaaagaaaguuuuucugcaacagcuugaaguguucaugaagaaaaaugucgauuuucugaucgcggaguacuucgaacacguggaggaggccgugugggcugucgaaacauugauugccucugguaagccaguugcagcuacuaugugcaucggccccgagggggaccuccauggagugccuccaggcgaaugugccguaaggcuggugaaggcgggugccucgauaaucggggucaacugccacuuugaucccaccauuucacugaaaacagugaagcucaugaaagagggauuagaagcagcucggcugaaggcccaucuuaugagccagccuuuggcuuaucacaccccagacuguaauaaacagggcuucaucgaucugccggaguuucccuucggccuagagccucgcguugccacuagaugggacauucaaaaguacgcaagggaagccuauaaccucggggugcgguacaucggagguugcuguggcuuugagccauaccacauacgcgcuauugcggaggaacuggcacccgaacgaggguuccuuccuccagccagugagaaacauggauccuggggcucuggucuggauaugcacacaaagcccugggucagagcuagggcccggaaggaguauugggaaaauuugcguaucgcaagcgggcgcccguacaacccuuccaugucaaaacccgacggcuggggagugaccaagggcacggccgagcucaugcagcagaaagaagcuacuaccgagcagcaacugaaggaguuauucgaaaaacagaaguuuaagagucaguga

SEQ ID NO: 53381 - RNA, 2925 nt, Artificial Sequence
  derived and/or modified sequence opt3 from BICC1__Homo_sapiens__NP_001073981
auggccgcucagggcgagcccggguaccuggcagcccaaagcgacccuggauccaacucugaaagaucaacagauaguccagugccggguagcgaggacgaucucgucgcgggcgcuacacuucacucccccgaauggucugaggaaagguuccggguugaccgcaagaaacuggaggccauguugcaggcagccgcugaggggaagggacgaucgggcgaagacuuuuuccagaaaaucauggaggaaacuaauacgcagauugcauggccuucaaaguuaaaaauaggugccaagagcaagaaagauccacauaucaaggugagugggaaaaaggaggauguaaaagaggcuaaggaaaugauuauguccgugcuggacaccaagucuaaccgugucacacuaaaaauggaugugagccacacugagcauucccacguuaucggaaagggcggcaauaacauuaaaaaggugauggaagagaccgggugccauauccacuuucccgacucaaauagaaacaaucaagccgaaaaauccaaccaggucagcauagcgggacagccugccgguguggagucugcaaggguacggauccgcgagcuccugccacuuguucugauguucgaauugcccauugcuggcauccuccagccugugccagauccgaauagucccucaauucaacacaucagccagacauauaacauaagugucucuuuuaagcagagauccaggauguacggggccaccgugauugugcggggaagccagaauaacacuucggcagucaaagagggcacagcuaugcugcuggaacaucucgccgguucuuuagcguccgccaucccuguuucaacccaacuggacauugcagcucagcaccaucuuuucaugauggggcgcaauggaaguaacaucaagcacaucaugcagcgaacgggcgcccaaauucacuuuccagaucccagcaauccucagaagaaauccacuguguauuugcagggcaccauagagucuguaugucuggcuagacaguaccuaauggggugccucccacuggugcuuauguucgacaugaaggaagagaucgaggucgacccccaauuuauugcccagcugauggaacaguuggauguguucaucagcauaaaaccgaagccuaaacagcccucaaagaguguuauugugaaguccgucgagaggaacgcacucaacauguaugaagcccggaaaugucuguuaggacuggagagcucuggugugacaaucgcuacuucaccaaguccugcgagcugccccgcaggccucgccuguccaucccuugacauccuggcuucugccggguugggacuaaccggccugggucuccuggggcccacaacccuuucgcugaauacgagcacuacaccuaacuccuugcucaaugcacugaacucaaguguaucuccauuacaaagcccguccucaggcacccccagcccuacucugugggccccaccccuagcuaauacaucuuccgccaccggauuuagugcaauuccucaucucaugaucccaagcacggcgcaggcuacccugacaaacauucuuuugucuggcguucccacuuacgggcacaccgccccguccccuccacccggacugacaccuguggauguccauauaaauucaaugcagacugaagguaagaaaaucagugcagcccucaacggccacgcucagagccccgacauuaaguauggggccaucucgaccuccucucugggagagaaagugcuuagcgcaaaucauggcgauccaucaauccaaacaagugguuccgagcagaccucuccuaagagcucccccacugaagggugcaacgacgcuuucgucgaggugggcaugccacguucaccgagccacaguggaaaugccggcgaucugaagcagaugauguguccuucuaaaguuuccugcgcgaagcgccagacgguggaauugcuccaagggacaaagaacagccaucugcacucgaccgacagauuacugucagaucccgagcuaucugccacugagaguccacucgcugacaagaaagcacccggauccgaaagggccgcugagcgggccgcagcggcccagcagaauagcgaacgagcucaccuggccccucgcucuagcuacguaaacaugcaagcauuugauuacgagcagaagaaacuuuuggcuaccaaagccaugcugaagaaaccagucgugacagaaguuagaacccccacuaauacaugguccggucucggcuucucaaagaguaugccugcagagacgauuaaagagcugaggcgggccaaccaugugagcuauaagccgaccaugacuacaaccuacgaagggucuuccaugucauuaagucgcagcaacuccagagagcaccugggaggcgguucugaaucggacaauuggagggaccguaacgggauaggcccaggaagccacucagaguucgcugcguccaucggcagucccaaacggaagcagaauaagucuacagaacauuaucuuagcuccucaaacuacauggauuguauuucuagcuugacugggaguaauggaugcaaccucaauuccagcuuuaaaggcucugaccugccugagcuauucucaaagcugggucucgggaaauauaccgaugucuuucagcaacaggagaucgaccugcagacguuccuuaccuugacagaucaggaccugaaggaauuaggaauuacuaccuuuggcgcccgaagaaaaaugcuccuggcaaucuccgagcuuaacaagaauaggcgcaagcuguucgaaaguccaaacgcucggaccagcuuuuuggaggguggcgccucggggagacuccccaggcaauaccacucugauauagccuccgugagcggacgcugguga

SEQ ID NO: 53382 - RNA, 2508 nt, Artificial Sequence
  derived and/or modified sequence opt3 from BICD1__Homo_sapiens__NP_001003398
auggccgcugaggaagugcugcagaccgucgaccacuacaagacagagaucgaaagacucacuaaagagcuuacggaaaccacacaugagaagauucaagcagccgaguauggccugguuguguuggaagagaaauuaacucugaagcagcaguacgaugaacuagaggcggaguaugacagccucaaacaggaacuggagcaacuuaaggaagccuucgggcaguccuuuucuauacacaggaagguagccgaggauggagaaacccgggaggagacacuguugcaggaaucagcaaguaaagaggccuacuaucucgguaagauccuggaaaugcagaacgagcugaaacaaagccgcgcuguggucaccaaugugcaggcagaaaacgagcgacucacugccguugugcaggacuuaaaggagaauaacgaaauggucgagcugcagcguauuagaaugaaagaugaaaucagggaguacaaguuccgggaagcucgccuuuugcaagacuauacagagcuggaggaagagaauauuacccuacagaagcucguguccacgcugaaacagaaccaaguagaauacgagggccuuaagcaugagaucaaaagauuugaagaggaaacuguucuguugaauagccagcucgaggaugccauaaggcugaaggaaaucgcggagcaccaguuagaggaagcacuggagacccucaaaaacgaacgggagcagaagaauaaccuucgcaaagaacugucgcaauacauuucauugaaugacaaccauaucagcauuaguguggaugggcuaaaguucgccgaggacggauccgagcccaauaacgaugacaagaugaauggccacauccacgguccucuggucaaacucaacggggauuaucgaacaccaacucugagaaagggagaaucucuuaacccggugagcgaccuguuuuccgaguugaauauaucagaaauucagaaacucaagcagcagcugaugcaaguggagagggaaaaagcuaucuuacuggccaaccuacaggagagucagacccagcucgagcauacaaagggcgcacugaccgaacaacacgagcggguccaucgucuuacggaacacguuaaugcuaugcgcggcuugcagagcucuaaggagcugaaagccgagcucgacggggaaaagggaagagauuccggugaggaagcgcacgacuacgagguggauauuaacggccuggaaauccuugagugcaaauauaggguagccgugacugaggucaucgaccugaaggcagaaauuaaggcuuugaaagagaaguacaauaaaucaguggaaaacuauacagaugagaaggccaaauacgaaagcaagauacagauguaugacgagcagguuaccagucucgagaaaacuacaaaggaaucuggggagaagauggcucauauggaaaaagagcugcaaaagaugaccuccaucgccaaugaaaaccacagcacguuaaauaccgcacaggaugagcuggugacauucucggaggaacuagcccagcucuaccaucacgucugucugugcaacaaugagacucccaaccgggugaugcuugacuacuaucgacaaucucgcguaaccagauccggaucauugaaaggcccugaugacccaaggggucugcucaguccccggcuggcucgcagagggguuagcuccccuguggaaacaaggacuucuagcgagccagucgcgaaggagucaaccgaagcaaguaaagagcccuccccuacaaagaccccaacuauuagcccggugaucacggcucccccuucuucaccagucuuagauacaagugacauacguaaagaacccaugaauauuuacaaccugaaugcuaucauccgggaccagauuaagcaucuucagaaggccguggaucgaucuuugcagcucuccagacaaagggcagccgcucgcgagcuggccccuaugaucgacaaagauaaggaagcacuaauggaggagauucugaaacucaagucucugcuuucgaccaaacgggaacagauagcgacuuugagagcuguucugaaggccaacaagcagaccgcagagguggccuuagcuaaccucaaaaauaaguaugaaaacgagaaagccaugguaacagaaaccaugacuaagcugaggaaugagcuuaaagcacugaaggaggacgcugccacauuuagcuccuugcgcgcgauguucgccacgcgaugugaugaauacgucacccagcucgacgagaugcaacggcagcuggcugcagccgaagaugagaagaaaacucuaaacacacugcuccguauggcuauccagcagaagcuggcccuuacccaaagauuggaagaccuggaguuugaucacgagcagucaaggcgcaguaaaggaaaguuaggcaaaucuaagauuggcagcccaaagaucguguccucacuccugcccccguaucggcacagcgcacauaauuga

SEQ ID NO: 53383 - RNA, 2568 nt, Artificial Sequence
  derived and/or modified sequence opt3 from BICD2__Homo_sapiens__NP_001003800
augagcgcccccuccgaggaagaggaauacgcuagacuggugauggaggcacagccugaauggcucagggccgaggucaagcggcuuucucacgagcuggcggaaaccacacgcgagaaaauccaagcugccgaauauggcuuggcaguuuuagaggagaagcaccagcugaaacuacaguucgaggaacucgaaguggacuacgaggccauucgaucagaaauggagcagcugaaggaggcuuuugggcaagcacacacuaaccauaaaaagguagccgcugauggagaaagucgugaggaaagccuuauacaggaguccgccucuaaggaacaguauuacgugagaaaaguccuggaguugcagacggagcucaagcaacugaggaaugugcugaccaacacacagucggaaaaugagcggcucgcgucaguugcacaggaauuaaaagagaucaaccagaauguggaaauucaacgcgguagacugagggacgauaucaaggaguauaaauuccgggaggcccgccuuuugcaggacuacagcgaacuggaggaagagaacauuagucuacagaagcaagucuccgugcuccgacagaaucagguagaguuugaaggccugaagcacgagaucaaaagacuugaagaggaaacugaguaucugaacucucaguuggaggaugcuauaaggcucaaggaaaucagcgagcggcaacuggaagaggccuuagaaacccugaaaacagagcgugagcagaaaaauucccuccgcaaggaacuuucacauuacaugaguauuaacgacagcuucuacaccucucaccuucacguuuccuuggaugggcuaaaguuuucagacgaugcagcugagccaaauaacgacgccgaagcgcuggugaauggauucgagcauggcggucucgccaaacugccgcuugauaacaagacuagcacacccaagaaagaagggcuggcaccuccaagucccucuuuggucuccgaccuccugagcgaguuaaauaucucggagauucagaagcugaaacagcaacuaaugcagauggaaagagagaaggcuggacuccuggccacccuucaggauacgcagaaacaauuggaacacacuaggggcucucuguccgagcagcaggagaaggugacccggcucacagaaaaccugucagcccuucgacgccugcaggcuaguaaggagagacaaacugcauuggacaacgaaaaagacagggauagccaugaggacggcgauuauuacgaaguggacaucaaugggccugagauacucgccugcaaguaucacgucgcuguugcggaggcaggagaacugcgggagcaguuaaaagcccugcgcuccacccacgaagcuagagaggcccagcaugcagaagagaaggguagguacgaggccgaaggccaagcucuaacagagaaagugucucuccuggaaaaggccagccgucaggaucgggagcuuuuggcacgacuggaaaaggagcucaaaaagguaucagacguggcgggggagacccagggaagucuguccgucgcucaggaugaauuagugacguuuagcgaggaacuggccaaccuuuaucaccauguuuguaugugcaauaacgagacuccaaauagagugauguuggacuacuauagggagggccaagguggggcaggacgcacaucucccggcggccggaccucaccugaagccagagggaggcgcaguccaauucuccugccgaaaggacuacuggcucccgaggccggucgagcagauggcgggacuggagacagcuccccuucuccaggcucgagccuccccuccccucugucagauccacggcgugaacccaugaacaucuacaaucuuauugcuaucaucagagaccagauuaagcacuugcaggccgcggucgacaggacaaccgagcugagucgccagcggauagccucucaagaauuagguccggcuguggauaaagacaaggaggcacucauggaggaaauccugaagcugaaaagccuguuguccacgaagagagagcagauuaccacacucaggacuguacugaaagccaacaagcagaccgcugaaguugcccuagcaaaucugaaaucaaaguacgagaacgaaaaagcgauggugacagagacuaugaugaagcuccgaaaugagcugaaggcccuuaaagaagaugcugccaccuucagcucuuugcgcgcaauguuugcuacacggugugacgaguauaucacccagcuggaugaaaugcaaagacaguuagccgcagccgaggacgaaaagaaaacucucaacucccugcuuaggauggcuauacagcaaaagcuggcgcuaacgcagcgucucgagcuguuggagcuggaucaugaacagacacgccgggggagagccaaagcagcuccuaagaccaagcccgccacuccaagugucagccauaccugcgccugugcuucugacagggcagagggcacaggauuagccaaucagguguucugcuccgaaaaacacucaauuuacugugauuga

SEQ ID NO: 53384 - RNA, 588 nt, Artificial Sequence
  derived and/or modified sequence opt3 from BID__Homo_sapiens__NP_001187
auggacugcgaagugaacaauggcagcucccugagagaugaauguaucaccaaccuccuugucuucggguuucugcagucuugcucagacaauaguuucaggcgggaguuggaugccuuaggacacgaacugcccguucuagcuccucaaugggaggguuacgacgaacuccagacagauggcaaccgcagcucccauucucgacuggggcguauugaggcagacucggagucacaggaagauauaaucagaaauauugccaggcaccuugcucaggugggagacagcauggaucggaguaucccaccgggccugguaaacgguuuggcgcuccaacugcgcaauacuuccagaucugaggaagacaggaaccgggaucuggccacggcacucgagcaguuacugcaggccuauccccgcgacauggagaaggagaaaaccaugcuuguguuggcucugcuacucgcaaagaaagucgccagccauacaccuucccugcuucgagauguguuucacacuaccguuaauuucauuaaccagaaucugagaacauacgugaggucauuggcucggaacgggauggacuga

SEQ ID NO: 53385 - RNA, 1365 nt, Artificial Sequence
  derived and/or modified sequence opt3 from BIN1__Homo_sapiens__NP_004296
auggccgagaugggcagcaagggggugaccgcuggaaaaaucgcauccaacguccagaagaaacugacaagagcccaagaaaagguucuccagaaacuugguaaggcggacgagacuaaggaugaacaguucgagcagugcgugcaaaauuuuaacaaacagcugacggaaggcaccagguugcagaaggacuuacggacauaccuggcuucuguaaaagccaugcacgaggcaucaaagaaacuaaaugagugucuccaggaaguguaugagcccgauuggccugggcgcgacgaagccaacaagauugcugagaauaacgaucugcuuuggauggacuaccaucaaaagcuggucgaucaggcauugcucacuauggacaccuaucugggacaguucccagauauaaaaagucgaaucgccaagcguggcagaaaacugguggacuacgauagcgcuaggcaccauuaugagucccuccagacagccaagaaaaaggacgaagcgaaaauugcaaaggccgaggaagaguuaaucaaggcucaaaaaguuuuugaagagaugaauguggaucugcaggaggaacuuccgucuuuguggaacucgcgggucgguuucuacgugaauaccuuucagucaauugccgggcuggaggaaaacuuccacaaggagaugagcaaacuaaaucaaaaccucaaugacguacugguuggacuugaaaagcagcauggcaguaacacuuuuacagugaaagcacagccccgcaagaaguccaaacuguucucuagauugaggcggaagaaaaauagcgacaacgcuccugccaagggcaacaaauccccaucacccccugaugggaguccagcggccacccccgagauccgcgucaaucacgagccugaaccagcaggaggugcuacgccgggcgccacucuccccaagagcccuucucagccagcugaggccuccgaaguggcagggggaacccaacccgccgcuggcgcgcaggagccuggugaaacagcagccucagaggcugccagcaguucucugccagcaguggucguugagacuuuucccgccaccgugaacgggacaguagaaggaggcuccggcgcugggcgauuagaccugccgccuggauucauguuuaaggugcaggcccagcacgauuauaccgcaacggacacugaugagcuccaacuuaaagcgggugacgucgugcugguuauacccuuccagaauccagaggaacaggaugagggcugguugaugggggugaaggaaagcgacuggaaccagcauaaagagcuagaaaagugcagaggagucuuuccugagaauuucacagaaagggugcccuga

SEQ ID NO: 53386 - RNA, 1620 nt, Artificial Sequence
  derived and/or modified sequence opt3 from BIN2__Homo_sapiens__NP_001276936
auggugcugcagaagcucggcaaagccgucgagaccaaggacgaaagauucgagcaaagcgcuuccaacuuuuaccagcagcaggcagaagggcacaaacuuuauaaggaucugaaaaauuucuugucugccguuaaggugaugcaugagucaaguaagaggguaagcgaaacauuacaagagaucuacuccucugagugggacggacacgaagaacugaaagcgauuguguggaacaaugaucuacucugggaagacuaugaggagaagcuggcugaucaggccguccggacuauggaaauauacguggcacaguuuucggagaucaaagaacgcauugccaagcgaggucguaaacuuguugacuaugauucagcuagacaucaccuggaggcagugcagaacgccaagaagaaagacgaagcuaagacggccaaagcggaggaggaguucaauaaggcacaaaccgucuuugaggauuugaaccaggaacuccuggaggaacugcccauccucuacaauagcaggauuggcugcuaugugacaaucuuccagaacauaaguaauuuacgggacguauuuuaccgcgagauguccaaacugaaccauaaucuuuacgagguuaugucuaaguuggaaaaacagcacagcaacaagguguucgucgugaaggggcuguccucaaguagcagaaggucucuagugaucuccccuccaguccggacugccaccguuucaagcccgcucacaagucccaccucuccuuccacucugagccuuaaaucggagucugaauccgugucagcuacagaggaucuggccccagacgcagcucaaggagaagauaauagugagauuaaggaguugcucgaagaggaagagaucgagaaagaaggcagcgaggccuccucuagcgaagaggacgaaccccugccugcguguaacgguccagcccaggcacagcccucaccuaccacggagcgcgcuaagagucaagaggaaguauuaccauccagcacuaccccgucucccgggggagcccugucaccuaguggccagccaagcuccucugcuacagaggugguccuccgaacuagaaccgccucggaaggcagcgagcagcccaaaaagagggcauccauucagcggacaucagccccuccaagucgucccccgccuccccgcgcuaccgcgucuccaagaccuagcuccgggaauauccccucaagcccaacggcaucuggagguggcucccccacaaguccuagggccagccuugggacuggaaccgcuucuccacggacuucccuggaagugucaccgaaccccgagccuccagagaagcccguucgaacaccugaagccaaagagaacgaaaauauacacaaccaaaauccagaggaauugugcaccagucccacgcuaaugaccagccagguggcaucggagccgggcgaggccaagaaaauggaagacaaggagaaagauaacaagcugauuuccgcuaauucuagcgaaggucaggaccagcuccaagucucaauggugccugagaacaauaaccugacagccccagagccccaggaagagguaaguacuuccgaaaauccucagcuuuga

SEQ ID NO: 53387 - RNA, 762 nt, Artificial Sequence
  derived and/or modified sequence opt3 from BIN3__Homo_sapiens__NP_061158
augagcuggauccccuucaagauuggccagccuaaaaagcaaauagugccaaaaaccgucgagagagacuuugaaagggaguacgggaagcugcagcagcucgaggaacagacacggcgccuucaaaaagauaugaagaaguccacugacgccgaucuggcuaugucuaaaucagcaguuaagaucaguuuggacuuacugagcaacccgcuaugcgaacaggaucaggaccuccugaauauggugacggcccuugauaccgcgaugaaacgaauggacgcuuucaaccaggagaagguaaaucaaauucagaaaacagugaucgagccccugaagaaguuuggauccgucuucccuucuuugaacauggccgugaaacguagagaacaggcacuccaggauuauaggcggcugcaagccaagguugagaaauacgaagagaaggagaaaacugguccagugcuggcuaagcuccaccaggcacgcgaagaguuaagacccgucagggaagacuuugaggccaaaaaucggcagcugcuugaagagaugccucgcuucuauggcucgcgauuggauuacuuucaaccaucauucgagagccugauuagagcucaggugguauauuacagugaaaugcauaagaucuuuggggaccuaucccaccagcucgaucagcccggacauucugacgagcaaagggaacgggagaacgaagccaagcugagcgagcuucgugcgcuguccauaguugcagacgauuga

SEQ ID NO: 53388 - RNA, 1857 nt, Artificial Sequence
  derived and/or modified sequence opt3 from BIRC2__Homo_sapiens__NP_001243092
augcacaagaccgccagccagagacuguuccccggcccuuccuaccaaaacaucaaaucuauuauggaggacucaacaauacucagugauuggacuaauagcaacaagcagaaaaugaaguaugacuuuuccugcgaacuuuacaggaugucuacguauucgaccuucccagcuggggugccggucucagagcggagccuggcacgcgccggauuuuacuauacagguguuaaugauaaagugaaguguuucugcuguggcuugauguuagacaacuggaagcugggggauagucccauccagaaacauaagcagcuauacccuuccugcucuuuuauucaaaaucucguaagcgcgucccugggaucaaccaguaaaaacacuagcccaaugcgaaauucuuucgcucacucccuuucacccacacuggaacauagcaguuuguuuucuggcuccuauagcucgcucucuccuaacccacuuaauucccgugccguggaggacaucucaaguagcagaaccaaccccuacuccuacgcaaugucuacugaagaggccagguuccugacauaucacauguggccucucaccuuuuuaagcccaucagagcuggcucgggcagguuucuacuauauugggccgggagaucgcgucgccuguuuugcuugcggcggcaagcugaguaauugggaacccaaagacgaugccauguccgagcauagaaggcacuucccuaacuguccauuuuuggaaaauagccuggagacgcuacgguucucuaucucaaaccucaguaugcagacucacgcggcacgcaugcgaaccuucauguacuggcccagcuccgugccuguucagccagagcagcuggccucugcuggguuuuauuacgugggaagaaaugacgaugucaagugcuucuguugcgacgguggccuuagguguugggaaucgggggaugaccccuggguggagcaugccaagugguuuccgcggugcgaguuccugauacguaugaaaggacaagaguuuguagacgaaauccagggccgcuauccucacuugcucgagcagcuguuaagcacauccgauacuaccggugaggaaaacgcagaucccccaauuauccauuucgggccuggagagucaaguucugaagacgcuguuaugaugaacacacccguggucaagagcgcccuggagaugggcuuuaauagagaccucgugaaacagaccgugcaauccaagauucuuacgacuggcgaaaacuacaaaacagucaaugauaucguuucagcgcuguugaacgccgaggacgagaagagggaagaggaaaaagagaagcaggcagaagagauggcuagcgaugaccuaucucugauacggaagaaucgaauggcccucuuccagcaacugaccugcgugcuuccaauucuggauaacuugcucaaagcuaauguaaucaacaagcaggagcacgacauuaucaaacagaagacucagaucccccugcaagcccgcgaauuaauugauacaauacuggugaaagggaaugcagccgcuaacaucuuuaagaauugucuaaaggagauugacuccacccucuacaaaaaccuguucgucgacaagaauaugaaauauaucccuacggaagaugugaguggacuuagcuuggaggagcagcugagaaggcuccaggaagaacggaccugcaagguuuguauggacaaagaagugucugucguguuuauaccaugcggucaccugguaguuugucaggagugcgcgccgucccuucgcaagugucccauuugcagaggcaucaucaaggggacagugaggacuuuccugucauga

SEQ ID NO: 53389 - RNA, 1815 nt, Artificial Sequence
  derived and/or modified sequence opt3 from BIRC3__Homo_sapiens__NP_892007
augaauaucguggagaauagcauuuuccuguccaaccucaugaagucugccaauaccuuugaacuuaaauacgaccugucaugcgaguuguauagaaugaguacauacagcacuuuccccgcuggcgucccuguuuccgaaaggucuuuagcacgggccggguuuuauuacacgggagugaacgauaagguaaaauguuucugcuguggucugaugcuagacaauuggaagcgcggcgauucgccaaccgagaaacacaagaagcucuauccgucaugccgauuugugcagagccugaacagugucaauaaccuugaagcgacaucccaacccacuuucccuucuagcgugaccaauuccacacauucacuguugccagggaccgagaacaguggauacuuucguggcagcuauucuaauucccccucaaacccuguuaauagcagagcuaaccaggacuucagugcccucaugaggucuuccuaccacugugcaaugaauaacgagaacgcccggcugcugacuuuucagacauggccacucaccuucuuaagccccacggaucuggcuaaagcagguuuuuacuauauagggccuggagaccgcguggccugcuucgcuuguggcggcaaacuuucgaauugggaaccaaaggauaacgccaugucugagcauuugagacacuuuccgaagugccccuucaucgaaaaucagcugcaagacacuuccagguacaccgucucaaaccuaaguaugcagacacaugcggcacgguucaaaaccuuuuucaauuggccuagcuccgugcucguaaacccagagcagcuggccucugcuggguuuuauuacguuggaaauagcgaugacgugaaguguuucugcugugaugguggccuucgcugcugggagucaggggacgaucccuggguccagcacgccaagugguuuccucgaugcgaauaucugauuagaaucaaaggacaagaguucauucgacaggugcaggcaaguuacccacacuugcucgaacagcuguuauccacuagcgacucucccggcgacgagaacgcugaaucaaguaucauacauuuugagccgggugaggaucacagcgaagacgccaucaugaugaauacaccugugauuaacgcggccgucgagaugggguucucccggucucugguuaagcaaaccgugcagcguaaaauccucgcaacgggagaaaauuaucgccuuguaaacgaucugguguuggaccuacugaaugcugaggaugaaauuagagaggaggaaagggagcgggccacugaagagaaggaaucgaacgaccuccugcuuaucaggaaaaaucgcauggcucuguuucagcauuugacaugugucauacccauucucgauagccuguuaaccgccggcaucauuaacgagcaagagcacgacgugaucaagcagaaaacucagacaucccugcaggcaagagaacuaaucgauaccauucucguuaagggcaacauagccgcuacgguguucaggaacucacugcaagaggcggaagcaguccuuuacgagcacuuguuugugcagcaggacaucaaguacauuccaaccgaggauguaagugaccugccuguugaggaacagcuccggcgccugcaagaagagagaacaugcaaaguguguauggacaaggaagucucuaucguguucauacccugcgggcaucuugucguguguaaagauugcgccccaagccugaggaagugucccauuugccguuccacuaucaaaggaaccguucggacauuuuugucauga

SEQ ID NO: 53390 - RNA, 414 nt, Artificial Sequence
  derived and/or modified sequence opt3 from BIRC5__Homo_sapiens__NP_001012270
augggcgcccccacccugccuccagcuuggcagccguuccucaaggaccacagaaucagcacauuuaaaaacuggcccuuccuugaggggugcgcauguacuccugaaaggauggccgaggcgggauuuauucauugcccaacggaaaaugagcccgaucuggcucaauguuucuuuugcuucaaggaauuggaggguugggagccugacgaugacccaaugcagcggaaacccaccauacgccgaaagaacuuacguaaacugagaaggaagugugccgugccuuccucuucauggcuaccauggaucgaagcaaguggccggagcugccucgucccggaguggcugcaccauuuucaggggcuuuuccccggagccacaucccugccuguuggcccauuggcuaugucuuga

SEQ ID NO: 53391 - RNA, 14574 nt, Artificial Sequence
  derived and/or modified sequence opt3 from BIRC6__Homo_sapiens__NP_057336
auggugaccggagggggagccgcucccccugguaccgucacugaaccacugccgagcguuaucgugcucuccgccggcagaaagauggccgcggcugccgcagccgcuucugggcccggaugcucaagugcagccggcgcuggugccgcggggguaagcgaauggcuugugcugagagacggauguaugcacugcgaugcagacggcuugcauuccuuaucuuaccacccugcccugaaugcuauucuggccgucacgucgcggggcaccauaaaagugaucgaugggacaucaggagcaacucuccaggcuagcgcccugagugcgaagccagguggccaaguuaaaugucaguauauuuccgccguggacaaggucaucuucguggaugacuacgcaguagggugccgcaaagaucuuaauggcauucuguugcucgacaccgcucugcagacacccguuucuaagcaggaugacgugguccaacuggaacucccugugaccgaagcccagcaguuacugagcgcuugucuugaaaagguggauaucuccucaacugaaggcuaugacuuguuuauaacacagcugaaagauggucugaagaacaccagucaugagacggccgcaaaucacaaagucgccaagugggcuacuguuaccuuccaucucccacaccacgugcugaaaagcaucgcgucugcaauuguaaacgagcuuaagaagaucaaucaaaacguggccgcucugcccgucgccuccucagugauggaccgauugagcuaccuccugccuagugcacguccagaauuagggguuggaccgggcagaucuguggacaggucccugauguauagcgaggccaaucggcgcgaaacauuuacuucguggccccaugucggcuacagaugggcucagccugauccaauggcccaggcaggguucuaucaccagcccgcgucuuccggagacgauagggcuaugugcuuuaccuguucagugugccucguauguugggagccuacagacgagccauggagugaacaugagcggcacagccccaacugcccguucguuaaaggugaacacacccaaaaugugccucuuuccgucacgcuggccacuucucccgcacaguuuccauguacagauggcaccgaccgcauuagcugcuucgggucaggaaguugcccucacuuuuuggccgcugccacuaagcgaggcaaaaucuguauaugggauguguccaagcuaaugaaaguccaccugaaguucgagauuaacgcauacgaccccgcuaucgugcagcaacucauucugagcggugauccaucuucagggguugacaguagaaggcccacacuugccuggcuggaagauagcuccucuugcucggacaucccuaaauuggagggcgacagcgaugaccuccuggaggauuccgacucagaagaacacagucggucugauagcgugaccggacacacgucccagaaggaagcgauggagguaucauuagacaucaccgcccugagcauuuugcagcagccagaaaagcuccaaugggagauagucgcuaaugugcuggaggauacaguuaaagaccuugaagaguugggcgcaaacccgugucugacuaauucuaaguccgagaagaccaaggagaaacaucaggaacagcacaacauccccuuuccuugccuccuggccgggggacuucugacauacaagaguccagcuacuagccccauuucuuccaauucacaccguaguuuggauggucucagccgcacccagggcgagucgaucuccgagcaagggucuacagacaacgaaagcuguaccaacucagagcugaauaguccuuuagugagaaggacucugccaguccugcuccuguauuccauaaaggaaucugaugagaaagccggaaagauuuucagccagaugaacaauaucauguccaaaucacuucaugacgauggcuuuacggugccccagaucauugagauggaauuggacagccaggagcaacugcuccugcaggacccgccuguaacauacauccagcaguucgcagaugcggccgcuaacuuaaccaguccagacucugaaaaguggaacuccguguuccccaaaccugguacucugguucaaugccuucgguugcccaaguuugccgaggaagagaaccucuguauugauagcauaaccccaugcgcagacgggauccaucuguuggucggccugcgaacauguccuguggagucgcucucagcuauuaaucagguggaagcccugaacaaucuuaacaagcuaaauucugcacugugcaaccgcagaaaaggagaguuagaaaguaaucucgccgucguuaacggcgcuaauaucuccgugauccagcaugagagccccgcggaugugcaaaccccacugauuauacagccggaacagaggaacguaucugggggauaucuuguccuguacaagaugaacuaugccacucggaucgugacauuggaggaggaaccuauuaaaauccagcacauuaaggacccccaagauacgaucaccagccucauacuguugccacccgacauccuggauaaucgcgaggacgauugugaagaaccuauugaagacaugcagcucacuuccaaaaacgguuucgagagagagaagacaucagauaucaguacccugggccaccuuguuauuacaacucaagggggauacgugaagaucuuggaccugagcaauuuugaaauauuagcaaaagucgagccacccaagaaagaaggcaccgaggagcaggacacguucgugucuguuauuuauugcuccgguaccgauaggcucugcgcuuguacaaaagggggagaacugcauuuucuucaaaucggaggcacuugcgacgauauugacgaggccgauauccugguggacgggucauugaguaaaggaauagaaccuagcuccgagggcucuaagccgcucucgaacccaagcucacccgguaucuccgggguagaucuguuggucgaccagccuuucacccuggaaauuuuaacaagucucguggagcugacucguuuugagacccuuacgccacgguucucugccacagugcccccuuguugggucgaaguucagcaggagcaacagcagcgaagacacccgcaacaucugcaccagcagcaucacggagaugcugcacagcacaccaggacuuggaaauugcaaacagacagcaauuccugggaugaacauguguuugagcucguacugcccaaggccugcauggugggccacgucgacuucaaguuugugcuaaacucaaauaucaccaacauuccacagauccagguuacucugcuuaaaaauaaggcgccuggucucggcaaagugaacgcucugaauauagaagucgagcagaacgggaagcccucuuugguggaccugaaugaggaaaugcaacauauggauguugaggaaagccaguguuuacgccucugcccauuccuggaggaccacaaagaagauauucuuuguggaccuguguggcuggccaguggcuuggaccucuccgggcaugcaggaaugcugacccuaacaagccccaagcuggucaagggcauggccggugggaaauaccggucuuuucuuauccacguaaaggcugugaacgagagaggaacggaggaaaucugcaauggcgguaugaggccaguugugcgccucccgucacugaaacaccaguccaacaagggcuacaguuuggcauccuuacuggccaaagucgcggcugggaaggagaagucgucuaacgugaaaaaugaaaacaccuccggaacucgaaagagcgagaaucuccggggcugugaucugcuucaggagguaucagugacaauucguagauucaaaaagaccaguaucucuaaagaaaggguccaacgcugcgccaugcugcaguucuccgaguuucaugaaaaguugcuaaacacacugugucggaagacugacgaugggcagauuaccgagcacgcacagagccucguucuggacacgcuuugcugguuagccggagugcauucaaauggcccugguaguagcaaagaagggaacgagaaucugcucuccaagacaagaaaauucuugucugauauagugagggucugcuuuuucgaggcuggacgaagcaucgcccacaagugugcacgcuuucuggcucucugcauuuccaacggcaaaugugaccccugccaaccagccuucggucccgugcugcuuaaggcgcuguuggauaauaugucauuucuaccugccgcaaccacuggcgggucuguuuauugguacuucguacugcucaacuaugugaaagacgaagauuuagcuggauguaguaccgccugcgcuucgcugcuuacagcagucagccggcagcugcaggacagacucacuccaauggaggccuugcugcaaaccagguacggccucuauuccucucccuuugacccugugcuguucgaucuugaaaugucagggagcuccuguaagaauguuuacaacaguucuaucggagugcagagcgacgagauugaucuaucagacguccuguccggcaaugguaaggugaguagcugcacagccgcugaagggucuuuuacguccuugaccggauuacuggagguagagccgcuccacuucacuugugucucaacaagcgauggcacccguaucgaacgcgacgaugcgaugucgucuuuuggcgugacuccagcaguugggggacugaguuccgguacagugggcgaggccagcaccgcucuuucauccgccgcacaggucgcccugcagucucucagccaugcuauggcgagugccgaacaacagcuacaggugcugcaggagaaacaacagcagcuacugaagcuccagcaacagaaagcaaaguuagaagcuaaacugcaccagacgacugccgcagccgcugccgcggcauccgccguugggcccgugcauaacagcgucccuucuaaucccguggcugccccaggauucuucauacacccuucagacguaauacccccaaccccuaagacaaccccguuauuuaugacucccccauugacaccucccaacgaggcugugaguguugucauuaacgcagagcuggcccaacucuucccaggcuccgugaucgauccucccgcugugaaucuggccgcacauaacaagaauagcaacaaaucucggaugaauccgcuugguucggggcuggcgcucgccauuucacacgcuagccacuuuuugcagccaccuccccaucaguccaucauaauugaaagaaugcacaguggagccaggcgauucgucacccuggacuuuggccggccaaucuuacuaacagauguacugauccccacuugcggcgaccucgcaucucuuagcauugauauauggacccugggggaggaaguggacggacgcagauugguuguggcuacggacaucuccacacauucacugauucuccacgaucugaucccuccgcccgucuguagguucaugaagauuaccgugaucggucgguauggcaguacuaacgcccgagcaaaaauaccacuuggguuuuacuacggacacaccuauauccucccuugggagucugagcugaaguugaugcaugacccccugaaaggcgaaggugagagcgccaaucagccugaaauugaucaacacuuagcuaugaugguugcgcuacaggaggacauccagugcagauacaaccuggccugccaucgccucgaaacacuucugcaguccauugauuugccaccccuaaauucagcaaacaaugcucaauauuuccucaggaagccugacaaggccguggaggaggauagccgugucuuuucugccuaccaggacuguauccagcugcagcuucaauuaaaccuggcacacaaugcugugcagcggcucaaaguagccuugggggcguccagaaagaugcugagugaaacuagcaacccagaggaucuaauacagaccucguccacggaacagcugaggacaauuauccgcuaucuccuugacacccuguugucucugcuccaugcuucaaauggacacagcgugcccgccguucugcaaaguacuuuccacgcacaggccugcgaggaauuauuuaaacaucuuuguaucuccggcacaccgaagauucgacugcacaccggccuccuacugguccaguugugcgggggagagagaugguggggucaauuccugucuaacgugcuccaggagcuuuacaauagcgaacagcuguugaucuucccucaggaucggguguuuaugcugcucucauguauaggccaaagguccuuaaguaacagcgggguccuggagucucuucugaaccuacucgacaaucuguugucaccacugcagccccagcucccuaugcaucgccguacugaaggaguucuugacauuccaaugaucuccugggugguaaugcuggugagcagauuacuggauuaugucgcuacaguggaggacgaagcagccgcggcuaaaaagcccuugaacggcaaucaguggucuuucauuaacaauaaccuccacacccaaagucugaaucggucguccaaggguagcucaucucuagauaggcuuuacagccgcaaaauccgaaagcagcugguucaccauaaacagcagcucaaccuguugaaggccaaacaaaaggcacugguggagcagauggagaaggagaaaauccaguccaauaaggggaguucauacaaacuccuugucgagcaagccaagcugaaacaggcuacgucuaagcacuuuaaagacuuaauuagacugcggaggacugccgaauggagccgcuccaacuuggauaccgagguaacaaccgcaaaggagaguccggaaaucgagccucuccccuucacacuggcucaugaaagaugcaucagcgugguucagaagcuagugcuuuuucugcucuccauggacuucacuugucacgccgaucuguuguuauuugucugcaaagugcuggcgaggauugccaaugcaacccggccaacgauccaucucugugagauugucaacgaaccucagcuugagcgucugcuacugcucuuggugggaacagacuucaaucgcggcgauauaucuuggggcggggcuugggcccaauauucacugacuugcaugcuucaggacauccuggcaggagagcucuuagcucccguugccgccgaagcgauggaggaagguaccgugggcgaugacguaggggcuacagcaggagauagcgacgacucgcugcagcaguccagugugcaauugcuggagaccauugaugaaccacucacucacgacaucaccggcgcacccccucuuucuagccuggagaaggauaaagagaucgaccuagaacugcuccaggauuugauggaggucgacauugauccacuggacauagaucuugaaaaggacccgcuggcugccaaaguuuuuaagcccaucucauccacaugguacgauuauuggggugcagacuacgggacguauaacuacaauccuuauauuggaggcuuaggcaucccaguggccaagcccccugcuaacacugagaaaaacgggucucagaccgucagugugagcguaucccaggcgcucgacgcccgacuggaagugggauuggagcaacaggcagagcugaugcucaagaugaugucaacacuugaagcugauagcauucugcaggcccuaaccaauacuucuccaacacugagucaaucccccaccgguacggacgauagccucuugggcgggcugcaggcagccaaccagacuucacaguuaaucauacaacuuucuuccguuccuaugcugaauguguguuucaacaaacucuuuucgaugcugcagguccaccaugugcaguuggagagccugcuccagcuuuggcugacacuaagucuaaauucuuccagcaccggaaacaaggaaaauggcgcugacaucuucuuauacaacgccaauaggauuccggucaucucacucaaccaagcgaguauuaccuccuuucugacuguguuggcaugguacccaaauacacuucugaggaccuggugccucguucugcacagcuugacacugaugacuaacaugcagcuaaauucugguucaagcuccgccaucgggacgcaggagucuaccgcucaucuccuuguaagugaucccaaccugauacacguguuagucaaauuccugucgggcacaagcccucauggaacuaaucagcacagcccccaggugggcccaaccgccacacaggcaaugcaggaguuccucacccggcugcagguucacuugucaucuacuugcccucaaauuuuuagcgaguuccuucugaagcucauccauauucugaguacggagcgcggggcuuuucagaccggacaggguccccuagacgcccaagugaaguugcuggaguucacacucgagcagaacuuugaagucguguccguaucaacuaucucugcugugauagagagcguuaccuuccuuguccaccauuauaucacauguuccgauaaagugaugaguagaagcggcucugacucauccgugggggccagggcaugcuuuggaggccuguucgcgaacuuaauucggccaggugaugccaaggcugucuguggggagaugacccgagaccagcugauguuugaucuccugaaauugguuaauauccuugugcagcugccgcucagcggcaacagagaauacagugcccgcguaucugugacuacaaauacgaccgacuccgucucggaugaggaaaaggugagcggaggcaaagacgggaacggaucauccacuucuguucaagguaguccugcauauguggcugaccugguccuagccaaucagcagauuaugagccagaucuuaucagcacugggcuugugcaacuccagcgccauggcgaugauaauuggggcuucuggacuccaccugacaaagcacgagaauuuccauggcggucuugaugccaucagugugggggacggccuguuuaccauccucaccacacuguccaagaaagcaagcacuguacacaugauguugcaacccauucuuacguacauggccuguggauauaugggcaggcaggggucacuggcuaccugccagcuaucugaaccacuccugugguucaucuuacggguucuggauacaucggacgccuugaaggcauuucaugauaugggaggcgugcagcucauauguaacaauauggucacuagcacccgugcuauugugaacacagccagauccauggugaguaccaucaugaaauuccuggacucuggucccaauaaggcggucgauucaacucuuaaaacgaggauucuggcuagcgagccugacaacgccgaggggauccacaauuucgcaccacucggaacaauaaccuccaguucucccacugcccaaccugcugaaguuuugcugcaggcaaccccgccacaucgccgggcccgaagcgcggccugguccuacaucuuucuucccgaggaggcuuggugcgaucugacaauucacuuaccugcagccgugcuacucaaggagauccacauucagccacaucuggcuucacuggccacuugucccagcucuguauccguggaagucagugcagacggcgugaacauguugccucucucaacccccguugugacaagcggucugacguauaucaaaauucaacuugucaaggcugagguggccucggcgguaugccugagauuacacaggccacgcgaugccuccacccucggccugucucagaucaaguugcuugggcugacugcauucggaacaaccaguagcgcuacuguuaauaacccguuucuaccuucagaggaccagguguccaaaacaucuauaggcuggcuccggcugcugcaucacuguuugacccacauuagcgaucucgaagggaugauggccagugcagccgcucccacggccaaccugcuucagaccugcgcggcucuguuaauguccccauacugcggaaugcauagcccuaauaucgaggucgugcucguuaagaucggccugcaaucuacaagaauuggucuaaaauugauagacauccugcuucguaacugugcagccucaggguccgaccccacugaucucaauagcccacugcuguucggaagguugaacggccuuaguucugacucaaccauugauauccucuaccagcuggguacaacucaggacccuggcaccaaggaucggauucaggcuuuacugaaauggguguccgacagcgcccgcgucgcagccaugaagcgaucggggagaaugaauuauaugugccccaacucuaguacaguggaauacggacuacucaugccguccccaagccaucugcauuguguagcugcgaucuuguggcacucauaugagcugcuuguggaguacgaucucccugcccuguuagaccaagaacuguuugagcuacucuucaauuggucuaugagccugcccugcaacaugguccuuaagaaagcaguugauucccugcuauguaguaugugccaugugcacccaaauuauuuuucacuccugaugggcuggauggggauaacacccccuccgguccagugucaccauagguugagcaugacugacgauuccaagaaacaggaccugucuaguagccuuacggacgauuccaagaacgcccaggcuccacucgcacugacagaaucacacuuagccacccuggcuucuucgagccaaucccccgaggccaucaaacaguugcucgacaguggacugccuucucuucuggugcggagccuagcgucauucugcuuuucccauauuagcucuagugaauccaucgcacagucaauugauaucagccaggacaagcuccgcagacaccauguaccccaacaguguaauaagaugccaauaacugccgaucugguggcuccuauuuugagguuccugaccgagguuggcaacucucacaucaugaaagacuggcuuggugggucggaggugaaucccuuauggacagcccugcucuuucugcuaugccacuccggaaguacgagcggcucacauaacuugggcgcacagcaaaccucugcucgauccgccagccugaguucagcggccacuacagggcucaccacucagcagcggacagcuaucgaaaaugcaaccgucgccuucuuucuucaguguauuuccugccacccaaacaaccaaaagcugauggcucaggugcucugugagcuguuccagacaagcccucagcguggaaauuuaccgacuucugguaacauaaguggcuucaucagacgcuuguuucugcaacuuaugcuggaagaugagaaaguuaccauguuccuccagagccccugcccacuguacaaggggaggauuaaugcaacgucccaugucauccagcacccuauguauggagccggccacaaauuucggacccuacaucuucccgugucuacaacucugucagacgugcucgauagaguaagcgacaccccauccauuacagcuaaguugaucucggaacagaaggaugacaaagagaagaaaaaccacgaggaaaaggagaaagucaaggccgaaaaugguuuccaagauaacuacucugugguuguggcaagugggcugaaaagccagucaaagcgcgccgucuccgcgacuccucccaggccgccaucucgacggggaagaaccauaccugacaagaucggcagcacguccggcgcugaggccgcaaauaaaauuaucacagugcccguuuuucauuuauuccacaagcugcucgccgggcagccacuucccgcugaaaugacccuggcccaauugcugacucuccuauacgacaggaaacugccucagggauaucgcaguauugaucuuacagugaagcuggguucacguguaaucaccgaccccagccucucuaaaacugauuccuacaagcgguugcauccagagaaggaccacggcgaucuguuagcaaguugcccugaggacgaagcucugaccccgggggaugaguguauggacggcauucucgaugaaagccuucuggagacaugccccauacagucaccauugcaggucuuugccggcaugggugggcuggcgcucaucgcagagagacuaccuaugcuguaucccgaagugauucaacaggugucugccccaguugucacguccaccacucaggagaaaccuaaggacucggaucaguucgaaugggugacaaucgagcaaagcggagaauuaguauacgaggcucccgagaccguggccgcugaaccgccuccaaucaaaagugcaguccagacuaugucccccauuccugcccacucucuggcggccuuuggccucuuccuuagguugccaggcuaugcugaggugcugcugaaggaacgcaaacaugcacagugucuccuucgacugguuuugggggugacagacgauggagaggguucacacauacugcagagccccuccgccaacguccucccuacccuaccauuucaugugcugcggucuuuauucagcacgacaccccuuaccacugacgacggcguucugcucagaaggauggcuuuggaaaucggggcccugcaccugauucucgugugccuuagugcacugucacaccauuccccgcgcguaccuaauagcucugucaaccaaaccgagccccaggugaguuccagccacaauccaacaucaacugaggaacagcaauuguacugggccaagggaaccggcuuugguacagggucgacggcuucuggaugggauguugagcaggcgcuaacuaagcagagacuggaagaggaacaugugaccugucucuuacagguccuggccagcuauaucaaccccguguccagugcaguaaauggcgaggcucaaucaucucacgagacacggggccagaacagcaaugcccuuccuuccgugcugcucgaauugcugagucagagcugccugauuccagcaaugucuuccuaccucaggaacgacucaguccuagauauggcccgucauguuccccuguaccgagcucuuuuggagcugcuccgcgcgaucgccagcugugcagcuauggugccuuuacugcuuccacugucgaccgaaaacggggaggaggaagaggaacaguccgagugccaaacuucugugggaacacucuuggccaaaaugaagaccugugucgacacguauacuaauagacugcggaguaaaagggaaaacgugaagaccgguguuaaaccggaugccucagaccaggagcccgagggccuaacacugcucguaccugauauacagaagaccgcugaaaucguguacgcagccacuacaagccuucgccaggcuaaucaagagaagaaacugggggaauauuccaagaaagcggccaugaagccaaaaccccuuucuguccuaaagagcuuggaggaaaaguacguggcaguuaugaaaaagcuccaguucgacaccuucgagauggugagugaggaugaagacggaaaacugggcuuuaaggucaacuaucacuacaugucacaggugaaaaaugccaacgaugcuaauuccgcagccagagcucggaggcuugcccaggaggcaguaacacugagcacuucucucccuuuguccaguagcucaucuguguucguccgaugcgacgaagaacgucuggacauuaugaagguuuuaaucaccgguccagcggauacgcccuaugccaacggguguuuugaguucgacguguacuuuccgcaagauuacccuuccagcccaccccuggucaaucucgagacaaccggaggccacucggugagauucaacccuaaucuauauaacgacggcaaaguuugccugaguauucuuaauacuuggcaugggcgccccgaggaaaaguggaacccacagaccucuucauuucuacaggugcugguauccgugcaaagccucauccuggucgcugagccguacuucaaugaaccuggauaugagcggucuagggguacacccagcggcacucaguccaguagagaguacgaugggaacauacgccaggccacggugaagugggcaaugcuugaacagauucggaacccaucacccugcuuuaaagagguuauccacaagcauuucuaucugaaaagggucgaaauuauggcucaaugugaggaauggaucgccgacauacagcaguacagcuccgauaagcgagugggaagaaccaugucucaccacgcggccgcucucaaacggcauacagcacaguugagggaggagcuguuaaagcuaccuugcccagaaggccuggaccccgauaccgacgaugccccugaggugugucgcgcuacuacaggugcagaagagacccucaugcacgaccaaguaaagccaaguucaagcaaagaacugccguccgauuuucagcuuuga

SEQ ID NO: 53392 - RNA, 843 nt, Artificial Sequence
  derived and/or modified sequence opt3 from BIRC7__Homo_sapiens__NP_071444
augggccccaaggacagcgccaaaugccugcacagagggccucagccaucccauugggcugcaggagaugguccgacccaagagagguguggcccccggucucucgggucaccugugcuuggacuggacacaugccgcgccugggaucacgucgacggccagaucuugggucaguuacgaccacugacugaagaggaagaggaagagggggcgggagcuacgcuaagucguggccccgccuucccuggcauggggagcgaggaacucagacuggcauccuuuuacgauuggccacuuaccgccgagguucccccugaacuguuggcugcagccggauucuuucauacaggucaccaggacaaggugagguguuucuuuugcuauggcgggcuccaaucuuggaaacggggagaugacccauggacugagcaugcuaagugguucccgucgugucaguuucugcugcgcucaaaaggcagagauuucguacacagcgugcaggagacccacagucagcucuuagguuccugggaccccugggaggaaccugaagaugccgcgccagucgcacccucugugccugccagcggguacccagagcugcccacaccgaggcgggaaguucaauccgagucagcucaggagccuggagcccgcgacguggaagcacagcuucgaagauugcaggaggaaaggaccugcaaggucugucuggaucgggcugugaguauuguauuuguucccugcggccaucuagugugugccgagugcgcgccaggccuccaacuguguccuauaugccgugcccccguccgcagcagagugaggacuuuccuuucuuga

SEQ ID NO: 53393 - RNA, 846 nt, Artificial Sequence
  derived and/or modified sequence opt3 from BIVM__Homo_sapiens__NP_001153068
augggcgccgggaaccugcccccuaucacccaggaggaagcucuccacauucuuggauuccaaccaccguuugaggacauaagauucggucccuuuacaggcaauacuacgcugaugaggugguuccggcagaucaacgaucauuuucacgugaaggggugcagcuacgucuuguauaaaccucauggaaagaauaaaaccgcaggcgaaacagccuccggugcguuaucuaagcugacucgcgggcuaaaagacgagucacucgcuuacauuuaucacugucagaaccauuacuucugcccaaucggauuugaagccacccccguuaaggcaaauaaggccuucagucgaggcccucugagcccacaggagguggaguauuggauucuuaucggcgaauccucucguaaacaccccgcuauacacuguaagaaaugggcagauaucguaacagaccugaacacccaaaauccugaguacuuggauauuagacaucucgaaagggggcugcaguaucggaagacuaaaaagccaacauuuuucucgucacaggugggagguaaccugcacugcaucauugccuuucagcgccucaauuggcaaagauucggcuuauggaacuuuccguucgggaccaucaggcaggagagccagcccccuacgcaugcucagggaauagccaagagugaguccgaagacaauauuucuaaaaagcaacacggccggcugggucgcagcuucuccgcgucauuucaccaggauagugcauggaaaaagaugagcucuauccaugagcgaagaaacuccggguaccagggauacucagacuaugauggcaaugacuga

SEQ ID NO: 53394 - RNA, 264 nt, Artificial Sequence
  derived and/or modified sequence opt3 from BLCAP__Homo_sapiens__NP_001161292
auguacugccugcaguggcuccuucccgugcuguugaucccuaagccauuaaacccggcccugugguucagccacuccauguuuaugggcuucuaucuacucucuuuucugcuugagagaaaacccuguaccauuugcgcucuggucuucuuggcagcccucuuucugauauguuacucaugcugggggaauuguuuccuguaucauugcagugacagcccucucccagaauccgcgcacgaucccggaguuguggguacauga

SEQ ID NO: 53395 - RNA, 327 nt, Artificial Sequence
  derived and/or modified sequence opt3 from BLID__Homo_sapiens__NP_001001786
auggugacccugcuccccaucgagggccaggaaauucacuucuuugagauacuugaaagcgagugcguccuguacacaggguggaucgaaagagccuccggaucuucaauuuauccugaggcuaaggcaagguugccauuagaggcccugcuagguaguaacaaagaaccgaugcuccccaaggagacuguucugagccuuaaacgguacaaucugggcuccucugcgaugaagcgcaacgugccugggcauguauugcaacgaccaucguaucucacgcguauccaggugacccugcuguguaauucaagcgcugaagcccucuga

SEQ ID NO: 53396 - RNA, 1518 nt, Artificial Sequence
  derived and/or modified sequence opt3 from BLK__Homo_sapiens__NP_001706
augggccuggugagcuccaagaaacccgacaaggagaaaccuaucaaggaaaaagauaaggggcaguggucuccacucaaggucucagcccaagacaaagaugcuccgccccuuccuccacugguuguguucaaccacuugacacccccuccacccgacgagcauuuagaugaagacaagcacuuuguaguggcacuguacgauuauaccgccaugaaugacagagaucuacagaugcucaaaggagagaagcugcagguccuuaaagguacuggcgacugguggcuggcgaggaguuuggugacggggcgggaaggauacguuccuagcaacuucguggcucgcgucgagucccucgagauggaacgaugguuuuuccguucucagggcagaaaggaggccgaaaggcaacugcuggcaccaauuaauaaggccgguucguuucucauacgggagucagagaccaacaaaggggcuuucagcuuaagugugaaggauguaacaacucagggagaacugaucaaacauuauaagauucgcugccuugacgagggcggcuacuauaucuccccgagaauuaccuuucccucuuugcaggcacugguucagcacuacagcaaaaagggggauggacuaugucaaaggcucacacugccuugcgugcggccagcuccccagaauccuugggcccaggacgaaugggagaucccacgccagucccuucgacuggucagaaaauuggguucaggccaauucggggaaguguggaugggauauuacaagaacaauaugaagguggccauaaaaacccucaaggagggcacuaugagucccgaggcguuucugggugaagcaaacgucaugaaagccuuacagcaugagaggcugguucggcucuacgcugugguaacaaaggaaccgaucuauauugugaccgaguacauggcccgugggugucuucuggacuucuugaaaacggaugaaggaagccgccuaucucugccuagacucaucgacauguccgcacagauugcugagggcauggccuauaucgagaggaugaacucaauacaccgggaucugcgagcggccaauauucuugucagcgaagcacugugcuguaagaucgcugacuuuggcuuggcccgcauuaucgauagugaguacacugcucaagaaggggccaaguuccccaucaaauggaccgcaccagaggccauucacuuuggaguguucacaauaaaggcugacguuuggucuuucggugugcuccugauggaagucgugacuuauggcagaguaccuuaccccgggauguccaauccagagguuaucaggaacuuagagcggggauaucgcaugcccagaccugauaccugcccaccggaacuguacaggggcgugauugcggaguguuggcguagccggcccgaggaacgaccuacauuugaguuccuacagucgguccucgaagacuuuuacaccgcaacggagagacaguaugaacugcagccauga

SEQ ID NO: 53397 - RNA, 1368 nt, Artificial Sequence
  derived and/or modified sequence opt3 from BLMH__Homo_sapiens__NP_000377
augagcuccucuggccugaacucagagaagguggccgcucucauccagaaacuuaauagugacccccaauucguccuggcacagaacguugggaccacacacgauuuguuagacauuugccugaagagagccacugugcagagggcgcagcauguauuucaacacgcugugccucaggaaggaaaaccaauaacgaaucagaaaagcuccggucgguguuggaucuucucuugccuaaacgucaugcgccucccguuuaugaaaaagcugaauauugaggaguucgaguuuucgcagucauaccuuuucuuuugggauaagguggaacgauguuauuucuuucugagcgccuucguugacaccgcacaacguaaagagcccgaggauggcagauuggugcaguuucuccugaugaacccugccaaugacgggggacagugggauaugcuggucaacaucguggaaaaguacggcguaauuccaaagaagugcuuccccgagaguuauacaacugaagcuaccaggcggaugaaugacauccucaaccauaaaaugcgcgaguuuuguauaagauuaaggaaucugguucacuccggugcaacaaagggggagaucucugccacccaggaugugaugauggaagagauuuuccgggucgugugcaucugucuuggaaacccuccagaaacuuucacaugggaguaccgcgacaaggauaaaaauuaucaaaagauuggccccaucaccccuuuggaauuuuaccgagagcaugugaaaccacuguucaacauggaggacaagauaugccuagucaaugauccgagaccccagcacaaauauaacaagcucuacacgguugaauaccugagcaacauggugggcgggaggaaaacucuuuauaauaaccagccuauugacuuucugaagaagaugguagcugccuccaucaaagacggagaggcggugugguucgguugugaugucggcaagcacuuuaauucaaaauuggggcucagugacaugaaccuguacgaucaugaauuaguguucggaguuagccugaagaauaugaacaaagcagagcggcucaccuuuggcgaaucucuuaugacacacgccaugacuuucaccgcuguguccgagaaggacgaucaagacggugccuuuacaaaguggcgugucgaaaauucauggggagaagaucaugggcacaaaggcuaucugugcaugaccgacgagugguucagcgaauacguguaugagguaguuguggaucgcaagcacgucccagaagagguguuggcaguccuagagcaggaacccauuauccugccugcuugggacccaaugggcgcccucgcggaguga

SEQ ID NO: 53398 - RNA, 4254 nt, Artificial Sequence
  derived and/or modified sequence opt3 from BLM__Homo_sapiens__NP_001274175
auggccgcugugccccagaacaaucugcaagagcagcucgaaagacacagcgcaaggacccuuaacaauaagcuguccuugucuaaaccuaaguucucaggcuuuacauucaaaaagaaaaccaguagcgacaacaaugucuccguuacgaacgugucuguagccaagaccccaguguuacggaauaaggaugucaacgugacagaggacuuuucguucucagaaccgcugcccaauacuaccaaccagcagcgcguuaaagacuuuuucaagaaugcgccugcugggcaagagacacagcgaggagguagcaaaagucuacucccagauuuucugcagacccccaaggaaguggucugcacuacacagaacaccccuacggugaaaaagucccgugauacugcccuuaagaaacuggaguucucuagcuccccagacucauugaguaccaucaaugauugggacgauauggacgauuuugacacaagcgagacuucuaaguccuucguaacucccccucaaucacauuuuguuagagugagcacagcacagaaaaguaagaaaggcaagaggaacuucuuuaaagcccagcucuacaccacgaauacugucaagacagaucugccaccgcccucuuccgaaagcgagcagauugaccugaccgaggagcaaaaggacgauucggaguggcucucuuccgacgugauauguaucgaugacgggccuauugcugaagugcacaucaacgaggaugcacaggaaucagacaguuuaaaaacucaucuggaggaugaacgggacaacagcgagaagaaaaagaaucuugaggaagccgaguugcacuccacagaaaaagucccaugcauugaguucgaugacgaugacuaugacaccgauuucguucccccuucuccagaagagaucauaagcgcuucaaguuccagcucuaagugucugucaacgcuaaaggaccucgauaccagugaccgcaaagaggaugugcugagcacauccaaggaccuucugucuaaacccgaaaagaugucgaugcaggaguugaacccggaaacuagcaccgauugcgacgccagacaaaucucccuccagcagcagcugauucauguaauggagcacaucuguaaauuaauugauacaaucccugacgauaagcugaagcuccuugacugcggaaaugaacuguugcaacagaggaacauacggcgcaaacuacugacugagguggauuuuaauaagucagacgcgagucuccugggcucucuuuggcgauacagacccgacagccuggaugguccaauggagggggacuccuguccuaccggaaacucaaugaaagaauugaauuucagccaccuccccucuaacuccgucaguccaggcgauugccuguuaacaaccacucugggcaagacgggguuuagcgcaacaaggaaaaaucuauucgagcggccccucuuuaacacccaucugcagaagucuuucguguccucaaauugggccgaaacuccucgucuuggaaagaaaaacgagaguagcuauuuuccagguaauguuuugaccucgacagcugugaaggaccagaacaaacacaccgccuccauuaaugaucuggagcgcgaaacucaaccgucuuacgacaucgauaacuucgacauugaugacuuugaugacgaugacgacugggaggauaucaugcauaaccucgcagcuagcaagucaaguacagccgcguaucagcccaucaaagaaggcagaccuauuaaguccgucucugagaggcugagcuccgccaaaacggacugucuuccagugucaagcaccgcacagaauauaaacuucagugaaucuauccagaauuacacugauaaguccgcucaaaaccuggccagccggaauuugaagcacgagcgauuucagucgcucucauucccccacacaaaagagaugaugaagauuuuucauaaaaaguucgggcugcacaacuuccgcaccaaucaguuagaagcuaucaacgccgcacugcuaggagaggacugcuuuauacucaugccuacaggcggugggaaaucucuguguuaucagcuuccagccugcguaagucccggaguuacuguggucauuuccccguugagaagccugaucguggaucaaguccagaagcucaccucucuggacaucccugcuacguacuuaaccggcgauaagacagacagcgaagcgacuaauauuuaccugcagcuuuccaaaaaggauccaaucauuaaauugcucuaugugacccccgagaagauaugcgcaucaaacaggcugaucaguacacuagaaaaucuguacgagcggaaacuccuggcccgcuucguuauugacgaggcucauugugugagccaauggggccacgauuuuagacaggacuauaagaggaugaacaugcuucgucagaaguucccuucuguacccgucauggccuugacugcaaccgccaauccacgggugcagaaagacauccugacgcaauuaaagauccuccgaccucagguauuuuccaugucauucaacagacauaaucugaaauacuaugugcuucccaagaaaccaaagaaggucgcuuuugauugccuggaauggauuaggaaacaccacccguacgacagugggauaaucuauuguuugagccgccgggagugcgauacaauggccgacacccuccagagagauggacuggcagcgcuagcuuaccaugccggucuguccgacucugcaagggaugaagugcagcaaaaguggauuaaccaggacggcugucagguaaucugcgccacuauugcuuucgggaugggaaucgauaaaccugacgugcgcuuuguuauacacgccucgcuccccaagagcgucgagggcuacuaucaggaaucaggucgagcagggcgggauggcgagaucucccauugucugcuuuucuacacauaucacgacgugacccguuugaaaagacugauuaugauggagaaggauggaaaccaccauacuagggaaacccacuuuaauaacuuauacaguauggugcauuauugcgagaauaucacagaaugucgccggauucaacuccuggcuuacuucggcgagaacggguuuaauccagacuucugcaaaaagcaccccgacgucucuugugauaacugcugcaagacgaaagacuauaagaccagagauguuacugacgaugugaaaagcaucgugagguucguacaggagcauuccucaucucagggaaugcgaaauauaaagcacgucgguccuagcggccgcuuuacaaugaacaugcuuguggacauuuuccuggggaguaaauccgccaagauccaaagcggaauuuuuggcaaggguucugcguacucacggcacaaugccgaaagacuauucaaaaagcucauccuggauaaaauauuggacgaggaucuguacaucaacgcuaaugaccaggcaauugccuauguuauguuagggaacaaggcucagaccgugcucaauggcaaccugaaagucgauuuuauggaaacagaaaauuccaguagcgugaagaagcagaaagcccuuguugcaaaggugucgcaaagggaagagaugguuaaaaagugucugggagaguugacugaagucugcaaaucucucggcaagguguucggggugcauuacuuuaacaucuucaacaccgucacgcugaagaaacuagcggagucccugagcucagacccagaaguucuucuccagauugauggagugacagaggacaagcuggaaaaauauggugccgagguaaucaguguguugcagaaguacucugaguggaccucccccgcugaagacagcucaccuggcauaagucugagcuccucucgugggccgggacgcagcgccgcagaggaauuagaugaggaaauuccagucuccucacacuauuuugcuucuaaaacucggaaugagagaaagaggaagaaaaugcccgccagucagcgaucgaagcggcgcaaaaccgcaagcuccggcucuaaggccaaaggugggucagcuacauguagaaagaucagcuccaaaacuaagaguucuagcaucauuggcucauccagugcgagccauaccucucaagccacauccggagcaaacucaaagcucggcaucauggcuccuccaaaacccauuaauaggccuuuccugaagccgagcuacgccuuuucguga

SEQ ID NO: 53399 - RNA, 1302 nt, Artificial Sequence
  derived and/or modified sequence opt3 from BLNK__Homo_sapiens__NP_001107566
auggacaagcugaacaaaaucaccgugcccgccagccagaagcucagacaacuucagaaaaugguccacgauauuaagaauaacgagggcgggauaaugaauaaaaucaagaagcugaaaguuaaggcuccuccauccgugccgaggcgggacuacgcaucugaaucacccgccgaugaggaggaacaguggagugacgauuucgacagcgauuaugaaaacccugacgagcauuccgauucugagauguacguaaugccagcggaagagaaugcugacgauucguaugaacccccuccaguggagcaggagacacgccccguccacccugccuugccauuugcacgaggagaauacauugacaaccguucaagccaaagacauaguccgcccuucuccaaaacuuuaccuucuaagccaagcuggcccuccgagaaagccaggcugacgucaacccuaccugcucucacagcacugcagaagccacaggugcccccgaagccuaaaggucuucuggaagaugaggccgacuauguugugcccgucgaagacaaugaugagaacuacauccacccaacugagaguagcucuccucccccagaaaagggccgcaauuccggggcuugggagaccaaaucacccccuccagccgcgccgagccccuugccucgggcaggaaagaaaccaacaacuccccucaagaccacaccuguggccagucagcaaaacgcuucuuccguaugcgaagagaaaccaauucccgccgaaagacauaggggcagcucgcaccggcaggaggcaguucagucuccgguguuuccuccagcucagaagcaaauccaccagaagcccauaccucugccccgcuucaccgagggugggaauccaacggucgacggaccucugcccuccuuuucaaguaacagcacuaucuccgaacaggaggccggcgugcucuguaaaccaugguaugcgggcgccugcgaucgaaagucugcagaagaggcuuuacauagaagcaauaaagacgggucauuccugauuaggaagaguuccggacacgauagcaaacaaccguacacccuuguggucuuuuucaacaagcggguuuacaauaucccugugcguuuuauugaagccacaaagcaguaugcuuugggucgcaaaaagaacggcgaggaguacuucgggucuguagccgaaaucauaagaaaccaucagcacucaccccuggugcuaauugacagucagaauaacacuaaagauagcaccaggcucaaguaugcagucaaaguguccuga

SEQ ID NO: 53400 - RNA, 288 nt, Artificial Sequence
  derived and/or modified sequence opt3 from BLOC1S2__Homo_sapiens__NP_001269365
augagacugcccaggaagucccucgagguggccaccagcgaagacuacaaacuucuggagaacaugaauaaguugacaucuuuaaaauaucuggaaaugaaggauaucgcuauuaacauaucacggaaucuaaaagaccucaaccagaaguacgcaggccugcaaccuuaucuugaucagaucaaugucauugaggaacagguugccgcgcuggagcaggcugccuacaaguuggacgcauauaguaaaaagcucgaggccaaauacaagaaacuggaaaagcgcuga

SEQ ID NO: 53401 - RNA, 609 nt, Artificial Sequence
  derived and/or modified sequence opt3 from BLOC1S3__Homo_sapiens__NP_997715
auggccagccagggcagaaggcggcgcccccugcgacguccugagaccguggucccaggggaagcuacagagacugacuccgaaagaucugcaucaaguagcgaggaagaggagcucuaccuuggaccguccggucccacgaggggccggccuaccgggcugcgcguugccggagaagcggcugagacagauucugaaccagagcccgagccugaaccaacugccgcacccagagacuugccuccauuagugguacaaagggagucggccgaagaggcuuggggcaccgaagaggcaccggcccccgcuccugcccggucacugcuacagcuccgccuggcggagagccaggcacgacuugaucacgacguggccgcugccgucagugguguguauagaagggcagggcgggauguugcugcccuggcgucccguuuggccgcagcucaggccgcuggacucgccgcagcccauucugugcgccuggcuagaggcgaccugugcgcgcucgcagaaagguuagauaucgucgccggcugucggcugcuuccagacauucgaggggugcccggaacagagccugaaaaggauccagguccccgcgcuuga

SEQ ID NO: 53402 - RNA, 654 nt, Artificial Sequence
  derived and/or modified sequence opt3 from BLOC1S4__Homo_sapiens__NP_060836
auggagggcagcuucuccgacgggggagcccugcccgaaggucucgcugaggaagcagagccucagggcgccgcguggucuggggauucaggaaccgugagucaaagccacuccucugcuucgggcccaugggaagacgagggugccgaggauggggcaccgggaagagaccuuccccuguugaggcgggccgcugcaggcuacgccgcuugcuuacugccuggcgccggggcgcgcccagaagucgaggcacuagaugccucacucgaagaccugcuuacacgaguugaugaguuugugggaaugcuggacauguugcguggugauagcagucauguaguguccgagggcguccccagaauccacgcuaaggccgcagaaaugaggcggauuuauucucgcauagacagacucgaggcuuucgugaggaugguugggggacggguggcccgcauggaggaacaggucacuaaagcggaagccgagcugggcacguuuccucgagcauucaagaaacugcuccauaccaugaacgugcccagcuuauuuuccaagucagcuccaaguagaccucagcaggccgguuacgaggcuccaguacuguucaggacagaagauuauuuuccguguugcagcgagcggccccaacuuuga

SEQ ID NO: 53403 - RNA, 372 nt, Artificial Sequence
  derived and/or modified sequence opt3 from BLOC1S5__Homo_sapiens__NP_001186251
auggagaagagaggccugagggaaaugcgggugcucgagaaccuuaaaaauaugauccacgaaaccaacgagcauacacugcccaagugccgcgacacuaugcgagauagcuugucccaggucuuacaacgucugcaggccgcuaaugacucuguuuguagacuacagcagagggaacaagagcggaaaaagauucacucagaucaucucguggcaagugagaaacagcacaugcugcagugggacaacuucaugaaggaacagccuaauaagcgcgccgagguagaugaggaacauagaaaagcgauggagaggcuuaaggaacaauacgcugagauggaaaaagaccuggccaaguuuagcacguucuga

SEQ ID NO: 53404 - RNA, 519 nt, Artificial Sequence
  derived and/or modified sequence opt3 from BLOC1S6__Homo_sapiens__NP_036520
augagcgugcccggcccuuccucuccagacggggcccugaccagaccgcccuacugccucgaggcuggagaaccuacaccaggucuuucagauacgagucccgacgagggccugaucgaagauuugacuauugaggacaaggcagucgaacaguuagccgaggggcugcuaagccacuaucucccugaucugcaaagguccaaacaggcgcuucaggagcugacccagaaccaaguuguguugcucgacacacuggaacaggagauaucuaaguucaaagaaugucauucgaugcuggauaucaaugcucucuuugccgaggcaaagcacuaccaugccaaauuaguaaacauucggaaggagaugcugaugcuucacgaaaagacuucaaaauugaagaaacgcgcucugaagcuacagcagaaacgacaaaaggaggaacucgagcgugaacagcagagagagaaggaguucgaaagggagaaacagcugaccgcacggccagccaagcgcauguga

SEQ ID NO: 53405 - RNA, 891 nt, Artificial Sequence
  derived and/or modified sequence opt3 from BLVRA__Homo_sapiens__XP_011513776
augaacgccgagcccgaaagaaaguucggcguggucguuguggggguaggaagggcugguagcgugcggaugcgcgaccugcgaaauccucacccauccucugcauuucucaaccuuaucggcuucgucucacguagagagcuggggaguauugauggagugcagcaaaucagcuuggaagacgccuuauccucucaggagguugaaguggcguacauaugcucggagucaagcagucaugaggauuauauuaggcaguuucugaaugcuggcaaacacguccuaguggaauacccgaugacccucucccuggccgcagcccaggagcuuugggaacuggcugagcaaaaggguaaaguauugcaugaggaacacguugagcuccugauggaagaguucgcauuucugaagaaagaaguggucgggaaggaccucuuaaagggaucucugcuuuucacagccggccccuuggaggaggaacgguuuggcuucccugcuuuuagcgggaucucccgccugacuuggcuagugucacucuucggagagcugagucuugugagcgccacgcuggaagagagaaaagaagaucaguauaugaagaugaccgucuguuuggagacagagaaaaagucuccacucuccuggauugaagagaaaggucccggccugaagaggaaccgguacuuaucauuucauuucaagagcgggagucuggaaaauguuccuaacgugggaguaaauaaaaacaucuuucucaaggaccagaauauauucgugcagaaacuucugggccaauucucugagaaggaauuggcggcagagaaaaagcgcauccuacacugccugggucucgccgaggaaauucagaaauauuguugcucccgaaaguga

SEQ ID NO: 53406 - RNA, 621 nt, Artificial Sequence
  derived and/or modified sequence opt3 from BLVRB__Homo_sapiens__NP_000704
auggccgugaagaaaaucgcuauuuucggcgcaaccgggcagacaggacugacuacgcucgcccaagcgguccaggcugguuacgagguuaccgugcuuguaagagacagcuccaggcugcccucugaaggcccucggccagcccacguggucgugggggauguuuugcaggcagccgacguggauaagacagucgcuggacaggacgcagugauaguauuacugggcacucgcaacgaucuaucaccgaccacaguuaugagugagggugcccgaaauaucguggcugccaugaaagcgcauggggucgacaaggugguggcaugcaccagcgccuuucuccugugggaucccacuaaagucccuccacgucuucaagcuguuacagacgaucacauuagaaugcauaaggugcugagggaauccggauugaaguauguagccgugaugcccccucacaucggcgaccagccacucaccggcgcauacacggucacucuggaugggcggggacccucucgcgugauuucgaaacaugaccugggucacuucaugcucagauguuuaaccacagaugaguaugacggccacucaacuuacccuagccaucaguaucaguga

SEQ ID NO: 53407 - RNA, 1203 nt, Artificial Sequence
  derived and/or modified sequence opt3 from BLZF1__Homo_sapiens__NP_003657
augaccacaaagaaccuggagacuaaagugacggucaccagcucccccaucagaggcgccggggacggaauggaaacagaggaaccuccaaagucuguugaggugacuucagguguacagaguaggaaacaccauagccuccaauccccguggaagaaagcugugcccucugaaucgccuggcguccuucagcuggggaagauguugaccgagaaggcaauggaggugaaagccguucggauuuuagugccaaaggcggcuauaacacacgauauccccaauaaaaacaccaaggucaaaucacugggacaucacaagggcgaauuucuaggucagagcgagggggugauugaaccuaauaaggagcucagugagguaaagaacguucuggaaaaacuuaaaaauuccgagcgccgacuguugcaggacaaggaaggacucucuaaccaacugcgugugcagacugaggucaauagagaacugaaaaagcucuuaguggccagcgugggcgaugaccugcaguaccauuuugagaggcuugcacgggagaaaaaccaguugauccuggaaaaugaggcccuaggccgcaacacagcucaacucuccgaacagcuggagagaaugucaauucagugcgaugucuggaggaguaaguuccuugcaagccggguuauggccgacgaacugaccaauucucgcgcugccuugcagcgacaaaacagagaugcgcacggggcaauccaggaccuccuguccgagagggagcaguuucggcaagaaaugauagccacgcagaaguuacuggaggaacuccuugugucacugcaguggggacgugagcagacuuauagcccaaguguacaaccccacucuaccgcugaauuggcccuaacaaaucauaaacuggcaaaggcugugaacucccaccuccuggguaaugucggcaucaacaaccagaaaaagauuccuagcacuguggaguucuguucgaccccagccgagaaaauggcggaaacaguucuucgcauccuggauccggugaccugcaaggagucuucccccgacaauccuuucuucgaaucaaguccaacgacuuugcucgccacaaagaaaaacauugggagauuucaucccuacaccagguaugagaauaucacuuucaacuguugcaaucacugucggggagagcugauagcauuauga

SEQ ID NO: 53408 - RNA, 492 nt, Artificial Sequence
  derived and/or modified sequence opt3 from BMF__Homo_sapiens__NP_001003942
auggagcccagccagugcguggaggaacuggaagacgaugucuuccaaccugaggacggcgaaccaguuacccagccggggucccuccuuucugccgaucuguuugcucagucauuguuagacuguccccugaguagacuacaacucuucccucugacacacugcuguggaccaggucuuaggcccacuagccaggaggauaaggcaacgcagacccuguccccugccucuccaucgcagggcgugauguugcccugcgggguaacagaggaaccucagcggcucuuuuacggaaacgcgggcuaucgccugccacugccggcuucauuccccgccgugcucccuaucggugagcaaccacccgaagggcaguggcagcaucaggcagagcaccaacagaaucagaaccgagucugguggcaaauuuuacuguuucuucauaauuuggcccugaacggagaggaaaaucguaacggcgcuggcccuagauga

SEQ ID NO: 53409 - RNA, 981 nt, Artificial Sequence
  derived and/or modified sequence opt3 from BMI1__Homo_sapiens__NP_005171
augcacagaaccacaaggaucaagauuacugagcugaacccccaucucaugugcgugcuuuguggcggguacuucauagacgccacgaccaucauugaaugccugcacagcuuuuguaaaacaugcaucguccgguauuuggagacuuccaaguacuguccuauuugcgauguucaggugcauaaaacccgcccauuacugaauauccgaucugacaagacacuacaagauauaguauauaaacucgugccgggacuguucaagaacgaaaugaagcguagaagggacuuuuacgcugcacaccccucagccgaugcggcuaaugguaguaacgaggaccggggcgaagucgccgaugaggacaaacgcaucauuaccgaugacgagaucauuagccuuuccaucgaguucuuugaucagaauagacuggacaggaaggugaacaaagauaaggagaaaucuaaggaagagguuaaugacaagcgguauuugcgcuguccugcagccaugacugugaugcaucuccgaaaauuccugagaucgaagauggacauaccaaacacauuucagauugaugucauguacgaggaagaaccccugaaagacuauuacacccucauggauaucgcuuacauuuauacguggaggcggaaugggccuuuaccacugaaguaccgugugcgccccacuugcaaaagaaugaagaucucacaccagagggacggacuuaccaacgcaggcgaauuggagagcgauagugguuccgacaaagccaauucuccugcugggggaaucccaagcacauccucaugucugccgagucccagcacuccuguacaaucuccacacccccaguucccucauauuuccucaaccaugaacggcacaagcaauaguccaucuggcaaccaccaguccagcuuugccaaucggccccgaaagucgucuguuaacggguccucagcgaccaguagcggauga

SEQ ID NO: 53410 - RNA, 1275 nt, Artificial Sequence
  derived and/or modified sequence opt3 from BMP10__Homo_sapiens__NP_055297
augggcagccuggugcucacccuuugcgcccuguucuguuuggcugcauacuuagucuccgggucucccaucaugaaccuggagcagucaccucuagaagaggacaugagucucuuuggagauguuuucagcgaacaagacgguguggauuuuaauacacugcuucaguccaugaaggacgaguuccugaaaacuuugaaccucucugauauuccaacgcaggacucggccaagguagauccgcccgaauauaugcuggagcuguacaauaaauuugcgaccgacagaacaucaaugccuagcgcuaacauaaucaggaguuucaagaaugaggaucucuuuucccagccagugucuuucaacggcuuacggaaauauccccugcuuuuuaaugucagcauuccucaccaugaagaggugaucauggccgaauugcgccuguacacucuaguucaacgagaccguaugauuuaugaugggguggacagaaagaucaccauauucgagguccucgaguccaagggagauaacgaaggcgagaggaauaugcuggugcuuguaucaggugaaaucuacgggacaaacagugagugggaaaccuuugacguuacugacgcaauucggcgcuggcagaaaagcggaucuuccacacaccagcuggaggugcauaucgagucaaagcacgaugaagccgaggacgcuagcaguggcagauuggaaauugauaccucugcacagaauaaacauaacccacuccugaucgucuucuccgacgaucaaagcucggacaaggagaggaaagaagaguuaaaugagaugauaucucacgaacagcugcccgagcucgauaaccuuggccuggacuccuuuucaagugggccuggagaagaggccuugcuacagaugcggagcaauauuaucuaugauuccacggcucgcauucgaagaaacgccaaggguaacuacugcaagaggacuccacuguacaucgacuucaaagaaaucggcugggauucuuggauuauagcgccgcccggguaugaggcauacgagugucggggagugugcaauuauccucucgccgaacaccugaccccaacaaagcaugcuaucauucaggcccuugugcaccugaaaaacagccaaaaggcaucaaaggcuuguugcguccccacuaaauuggagccuaucaguauacucuaccuggacaaaggcguugugaccuauaaguucaaguacgaagguauggccguauccgagugugggugccguuga

SEQ ID NO: 53411 - RNA, 1179 nt, Artificial Sequence
  derived and/or modified sequence opt3 from BMP15__Homo_sapiens__NP_005439
auggugcugcucagcauccuuaggauucuguucuugugcgaguuaguccuguuuauggaacacagagcccagauggcugagggcgggcaauccucuauagcacuacucgccgaagcgcccacccugccucuuaucgaggaacuguuggaggagucaccaggagaacagccgcggaagccccgccuccugggucauagucugcgauacaugcucgaguuauaucguagaagcgcugacucccacggccauccuagggaaaaccggacaauuggggccacuaugguucgccuggugaaaccacuuacgaauguagcaagaccccacaggggaaccuggcauauccagauuuugggcuucccucugcggccaaaccgcggucuauaccagcucgugcgagccacagucguguauagacaccaucugcaacuuacuagguuuaaucugucuugucacguugagcccugggugcagaagaacccuaccaaucacuucccaucgucagagggggauagcaguaaaccguccuugaugucuaacgcuuggaaggaaauggacaucacacagcucguccagcaacgguuuuggaauaacaaaggacaucguauacugcgcuuaagauucaugugccagcagcagaaggauagcggcggccuggagcucuggcacgggaccuccucacuugacaucgcauuucuguugcuauacuucaaugauacucacaagaguauuaggaaagccaaguuucugccccggggaauggaagaguucauggaacgagagagccuccugcgcagaacaaggcaagcugacgguaucucugccgaggugaccgcguccucaagcaaacauaguggcccugaaaacaaucaguguucucuucacccauuucagauuuccuuccggcaacuggggugggaucauuggaucauagcacccccuuuuuauacgccaaacuacugcaagggaacuuguuugcgcguacucagagacggccugaauagccccaaccacgccauuauccagaauuuaauuaaccagcugguugaucagucggugccgaggccuucuugcguccccuauaaauacgugccaaucuccgugcuaaugaucgaggcuaacgguucaauucucuacaaggaauaugaggggaugauagccgaaaguuguaccugccguuga

SEQ ID NO: 53412 - RNA, 2193 nt, Artificial Sequence
  derived and/or modified sequence opt3 from BMP1__Homo_sapiens__NP_001190
augcccggcguggccagacugccucuccuucugggguuguuacugcuaccaaggccgggacggccccucgaccuggcugauuacaccuaugaccuugcagaggaagaugacagcgagccucugaacuacaaggauccaugcaaagccgcggcuuucuugggugacaucgcccucgaugaagaggaccugcgcgcauuucagguccaacaggccguugaucugcgacgucacacagcuagaaaguccucuauuaaagcagccgugcccggcaauacuucaacgccuaguugucagagcaccaacgggcagccacaaaggggagcuugcggccgguggcgcgguagauccaggucucggcgcgccgcgacaucgcgacccgaaagaguauggccugacggggugauaccauucgucaucggaggcaauuuuacuggcucacagagggcaguguuccggcaggccaugcgucauugggagaagcacaccuguguuacauuucucgagcgcaccgaugaagacagcuauauuguguucacuuacagaccgugcggguguugcaguuaugucggaaggcgggguggcgggccccaggcuaucuccauuggaaagaacugugauaaguuuggcaucgugguacaugaguuaggucacguugugggguucuggcaugaacacacacgaccugaccgcgacagacacgucucuauagugagggagaauauccaaccaggacaggaguacaacuuucugaagauggaaccccaggagguggaaagccuuggcgagaccuaugauuucgacuccauuaugcauuacgcccggaauacguuuucacgcggcaucuucuuggauacuauugucccuaaauacgaaguuaacggggugaagccacccaucggacagagaaccaggcugaguaaaggugacauagcacaagcucguaagcuauauaaaugcccggccuguggcgagacacuccaggauagcacugggaauuuuucuuccccugaguaccccaacggauauucagcgcacaugcauugcguauggcggauuagcgugaccccaggcgaaaagaucauucugaauuucacaagucuugaccuguaccgaucuagauuguguugguaugauuacgucgaggugagggacgguuucuggcgcaaggccccucuccgggggagauuuugcggcuccaaacugcccgaaccaaucguuagcaccgauucgagguuauggguggaguuccgaucuuccucaaacugggucggaaagggcuuuuucgcaguguaugaagcuaucugcgggggagacguuaaaaaggauuacggucacauucagagucccaauuacccugacgacuaucgcccaagcaaaguauguauauggcggauccaaguguccgagggcuuucacgucgggcugacguuccagucuuuugagauugaacgucaugauagcugcgccuacgacuaucucgaggugagagauggacacucagaaaguuccacucuuaucggcagguacugugguuaugagaagccggacgauauaaaaagcacaucuucacgccugugguugaaguucgucagugacgggagcauuaacaaggcuggcuuugccgugaauuucuuuaaagaaguugaugagugcucccggcccaacagaggaggcugugagcagaggugccuaaacacccuggggucuuacaaguguucgugcgacccuggauaugaacucgcaccagauaaacgacgcugugaggccgcuugcgguggcuuccugacuaaacuuaaugggagcaucacaucccccggauggccuaaagaauacccacccaacaagaauuguaucuggcagcugguggcgccgacccaauaccggauuucauugcaguuugacuucuucgagacggagggcaacgauguaugcaaguaugacuuugucgaagugagaaguggucucaccgcagauucuaaacugcaugggaaguucugcggcagcgagaaaccugaaguuaucacaucccaguacaauaacaugaggguggaguuuaagucagacaauacugucagcaaaaagggauucaaggcccacuuuuucucugaaaaacguccagcuuuacagcccccucgcggccggccccaucaacugaaguuuagagugcagaaaaggaaccgaaccccacaguga

SEQ ID NO: 53413 - RNA, 1191 nt, Artificial Sequence
  derived and/or modified sequence opt3 from BMP2__Homo_sapiens__NP_001191
augguggccggcaccagaugccugcucgcuuugcuguugccccaggucuuacugggaggggcagccggucuaguuccugagcucggcaggcggaaguucgcggcugccagcuccgggcgcccaucuucacaaccgagugacgaagugcugagcgaguuugaacuucgacuguuguccauguucggacucaaacagcgucccacaccuucuagagaugcaguagugccacccuacaugcuggaccuguauaggcggcacucgggccagccugguucaccagcccccgaucaucgccucgagagagcugcaagcagggccaacacuguccggaguuuucaccaugaagaguccuuagaggaacugccugagacgucugggaagaccacacgccgauucuuuuucaaucuuagcuccaucccaacugaagaguuuauuaccucagcugagcuucagguguucagagaacaaaugcaggacgcccugggaaacaauaguagcuuucaccauaggauaaacaucuacgagauuaucaaaccggcgacagcaaauucuaaguuccccguuacccggcuacucgauacucgucuggugaaccagaaugccucccgcugggaaucauuugacgucaccccugcugugaugagauggacagcccagggccacgcaaaccacggcuucguaguugagguggcucaucuugaagagaaacaaggggucagcaagaggcacgugcggauuagucgaucucugcaucaggaugagcacuccuggagccagauccgcccauugcucgugacguuuggacacgacgguaagggccauccccugcacaaaagagaaaagaggcaggccaaacauaagcaacggaaacgcuuaaagucgucuuguaagagacacccucuguaugucgauuucuccgacguuggguggaaugauuggauaguggcgccacccggauaccaugccuucuauugccacggcgaguguccguuuccucucgcagaccaccuuaacucaacuaaucaugcuaucguacagacccuggugaacagugucaauagcaaaauucccaaggccugcugugugccaacagaauuguccgcuaucucuaugcuauaccuggaugagaacgaaaaaguugugcucaagaauuaucaggacauggucguggaggguugcggguguagguga

SEQ ID NO: 53414 - RNA, 1989 nt, Artificial Sequence
  derived and/or modified sequence opt3 from BMP2K__Homo_sapiens__NP_060063
augaagaaauucagcagaaugcccaaguccgagggcgggucuggagguggcgccgcugggggaggcgccgguggggccggagcgggcgcuggcugcgggucaggagguaguagcgugggcgucaggguuuuugccguggggcggcaccagguaacccuggaagagucccucgcagaaggaggcuucucuacaguguuucuuguccgcacucauggugggauccgaugugcccugaaacguauguacgugaacaauaugccugacuugaacguuugcaagagagagauuacgauaaugaaagaauuaucgggacacaagaauaucgugggcuaucuggauugugcugucaacucaauuagcgacaaugugugggagguacuaauccucauggaguacugcagggcaggccaaguugugaaccagaugaauaagaaacugcagaccggguucacagaaccagagguccuucagauuuucugugauacuugcgaagccguggcucggcugcaucaauguaagaccccgaucauacaccgcgacuugaaaguggagaacauccuccugaaugauggagguaacuauguccugugcgacuucggcagugccacaaauaaguuucucaacccccagaaagaugggguuaaugugguagaggaagagauuaagaaguacaccacuuuauccuauagagcgccugaaaugaucaaccuguacggaggcaaaccaauuacaaccaaggcagacaucugggcccuugguuguuugcuguauaaacuaugcuucuuuacgcuccccuucggggagucucagguggcuauaugugauggcaauuuuacuauuccugacaacagcagguacucccggaacauccauugccugauucgcuucaugcuugaaccagaucccgagcaccgaccugacaucuuucaggucucauacuucgccuucaaguuugcuaaaaaggauugcccagugaguaauaucaacaauagcucuauuccguccgcacugcccgagccuaugaccgccucagaagcggccgcaagaaaaagccaaauaaaggcuaggaucacagacacuauuggaccaaccgagacaaguaucgcaccccggcagcguccuaaggcuaacucugccaccacggcaacuccauccguuuugacaauacagagcucggccacccccgugaaaguccucgcuccgggcgaauuugggaaucaccgcccuaagggagcgcugagacccgguaacggcccagagauuuuacuggggcagggaccuccccaacagccaccccagcaacauagggugcuccagcagcuucagcaaggcgacuggcggcugcagcaguugcaccuacagcaucgacacccucaccaacagcagcagcaacagcagcagcaacagcagcaacagcagcagcaacagcagcagcaacagcagcagcaacagcagcaacaucaccaucaccaucaccaccaucugcuccaggaugcauauaugcagcaguaccaacacgccacucagcagcagcaaaugcugcagcagcaguuucuuaugcauucuguauaucaaccacagccguccgcuucacaguaccccacaaugaugccucaguaucaacaggccuucuuucagcaacagaugcuggcacagcaccagccaagucaacagcaggccagccccgaauacuugaccuccccucaggaguucucuccagcucucguuagcuauacgucaagucugcccgcccaaguggguaccaucauggacuccagcuacucugcaaaucgcucagucgcggauaaagaggcuaucgccaacuuuacaaaucagaagaacauuaguaauccgccugacaugagcggguggaacccauucggcgaagauaauuuuuccaaauuaacugaggaagaacugcuagacagagaguucgaucuccugaggucuucgaagggacaccuuaaggcauacuuugccagccaguga

SEQ ID NO: 53415 - RNA, 1320 nt, Artificial Sequence
  derived and/or modified sequence opt3 from BMP3__Homo_sapiens__XP_006714354
auggccggcgcuagcagacugcuguuccuuuggcuggggugcuuuuguguguccuuggcacagggagagaggcccaagccuccauucccggaauuacggaaagccguccccggugaccgcaccgcgggcgggggaccugauucugagcugcaaccacaggacaagguuucagaacacaugcuacgacucuacgaucguuauaguacagugcaggcugccagaacucccggcagccuggagggugggucccagccuuggaggccacggcuucugcgcgaaggaaacacgguaagaucuuuuagggcagccgcugcagagaccuuggagcggaaaggccucuacaucuucaaucugacaucgcugacuaagucagaaaacauucucagcgccaccuuauauuuuugcauaggcgagcuggggaauaucagucuuuccugucccgugucuggagguugcagccaucacgcucaacgcaaacauauucagaucgacuuguccgccuggacacugaaguucucacgaaaccagagucagcuacucggccaccugagcgucgauauggcgaagucucauagagacauuauguccuggcuuucaaaagauaucacccaacuguugaggaaggcaaaagaaaaugaggaguuucucauaggguucaacaucacuagcaagggacggcagcugccuaaacgucgcuuaccauuuccggaacccuacauucugguguaugccaaugacgcugccaucagugagccugaaucuguuguguccagccuccagggccacagaaacuucccaacagguaccguccccaagugggauucgcacauuagggcagcucuuucuaucgagcggcgaaagaaacgcuccacgggggugcuguugccucuacagaauaacgaacugccaggagccgaguaccaauauaagaaagacgagguaugggaagagagaaagcccuacaaaacucuccaggcgcaggccccggaaaagaguaaaaauaagaagaaacaaaggaagggcccucaucggaaaucacagacccugcaguuugaugagcagacacuuaagaaagcacgcagaaagcaauggauagaacccaggaacugugcucgucgguaccucaagagcuugaaaccauccaaucacgccacuauucagucuaucguucgagcugugggcgucgugccugggauucccgagccaugcugugugcccgagaagaugagcucacucaguauccuguucuuugacgaaaacaaaaaugucguuuuaaagguguauccuaacaugaccguagaguccugcgccuguagauga

SEQ ID NO: 53416 - RNA, 1227 nt, Artificial Sequence
  derived and/or modified sequence opt3 from BMP4__Homo_sapiens__NP_001193
augauccccggcaacagaaugcugauggugguccuccuuugccagguucuguuagggggagccagccacgcuuccuugauuccugagaccgguaagaaaaagguggcagaaauacaaggccaugccgggggaaggcggucuggccagucacacgagcugcuacgcgacuucgaagcgacacuccugcagauguuuggucuucgacguagaccacagccgaguaaaagcgcuguaauccccgauuacaugagggaccuguaucgguugcaauccggggaggaagaggaggaacagauucauucuacuggacucgaguacccugaacgcccagccucgagagcaaauacggugaggucauuccaccaugaggagcaccuggaaaacauccccggcaccagcgagaauagugccuuucgguuccuguuuaaccucuccucuauuccugaaaaugaggucaucagcuccgcugaauuacgccuguuccgagaacagguggaucagggcccagacugggagagaggguuucacaggauaaacaucuaugagguuaugaagcccccugcagagguggucccaggacaucuuauuacacgguugcuggauacucgucuagugcaccauaauguaacccgcugggaaacauucgacguuucaccggccgugcucagauggaccagggagaaacaacccaacuacggucuggcuaucgaagucacucaccuucaccagacacggacccaucagggccagcacgugcgaauuagucgcagccugccucaagggucuggaaauugggcccaguugagaccacuccuggugacguuuggccaugaugguagggggcacgcguuaacucggcgcagaagggcaaagcguucccccaagcaucacucacagcgggcccgaaagaaaaacaaaaauuguagaaggcacagccuguaugucgacuucagugauguuggauggaacgacuggaucguggcuccuccaggcuaccaagccuuuuauugccauggcgauugucccuucccgcucgcagaccaccuuaauucuaccaaccaugcuauaguacagacacuggucaauuccgugaacagcucgauuccuaaggccugcugugugcccacugaguugucugcgaucuccaugcuauaccuggaugaguacgacaaaguugugcucaagaacuaucaggaaauggucguggaggggugcggaugucgcuga

SEQ ID NO: 53417 - RNA, 1365 nt, Artificial Sequence
  derived and/or modified sequence opt3 from BMP5__Homo_sapiens__NP_066551
augcaccugaccguguuccuccuuaagggcaucgucggguuucuguggagcugcuggguuuuggugggauacgccaaagguggcuuaggggacaaccauguacacuccucuuucauuuauagaaggcugcggaaucaugagcgccgagaaauacagcgugagauccuaucaauucucggacugccccacagaccuaggccauuuaguccgggcaagcaagcuagcuccgcaccccuuuucaugcuggauuuguacaacgccaugacaaaugaagagaacccugaagagucugaguauucggugcgggcgucacucgcugaagagacucgcggugccagaaaaggguacccagcaagccccaauggauauccuaggcggauccagcugagucgcacgaccccacugacaacucagucucccccucucgccuccuuacaugacaccaacuuucugaaugaugcugacauggucaugagcuucgugaaccuuguugaacgagauaaggacuuuucccaccagagaaggcacuacaaagaguuccgguuugauuugacacaaauuccacauggcgaggcagugaccgccgcugaguuccguaucuauaaggaccgcucaaauaacagauuugaaaaugaaacuauaaagaucaguauuuaccagaucauuaaagaguacacaaacagggaugccgaccuguuccuacucgauacccggaaggcgcaggcacuggacgucggcuggcuuguguuugauaucacgguaacuagcaaucacuggguuauaaacccgcagaauaaccugggguugcaacucugugccgaaaccggagacggucgaucuauuaacgugaaauccgcuggccuggucgggcgccagggaccccagucaaagcagccuuucaugguggccuucuuuaaagcaagcgagguguuacugagaagugucagggcugccaauaagcggaagaaccaaaaucgcaacaaaucuuccagccaucaggacucgucuagaauguccucaguuggcgauuauaauacaagugagcagaagcaagcgugcaaaaagcacgaacucuacgugagcuucagggaccuugguuggcaggauuggaucauugccccagagggguaugcagcuuuuuacugugacggagaaugcuccuucccccugaacgcccacaugaaugcuacuaaccaugccaucguacagaccuuggugcaccuaauguuuccugaucaugucccaaaacccuguugcgcaccgacaaagcugaaugccaucucugugcucuauuucgacgauagcucaaacguuauucugaaaaaguaccguaauauggugguccggaguuguggcugccacuga

SEQ ID NO: 53418 - RNA, 1542 nt, Artificial Sequence
  derived and/or modified sequence opt3 from BMP6__Homo_sapiens__NP_001709
augcccggccuagggagaagggcccaguggcucugcuggugguggggacuucuguguagcugcugugguccuccaccguugcggcccccuuuaccagcugcagccgcggcugccgcaggcgggcaacugcuaggagacggcgguucccccgggcgcaccgagcagccuccacccucuccucagucaaguagcggauuccucuaccgacgucugaagacacaggagaaaagagaaaugcaaaaggaaauccuuuccgugcugggcuugccacacaggccgcggccccuccauggccugcagcagccucagccacccgcccugcgccaacaggaggaacagcagcaacagcagcaacucccuagaggggagccacccccgggaagguuaaaaucugcuccucuguuuaugcuugauuuguauaacgcacugucggccgacaaugaugaggacggugcuucagaaggcgagcggcagcagagcuggccccacgaagccgcgaguuccucucagcgccgacaaccaccucccggggcagcccauccacuaaacagaaagagccuccuggcucccggauccggcucagguggggccaguccucuuacuagcgcacaggauucugcuuuccugaaugacgccgauauggucauguccuuuguuaacuugguggaguacgacaaagaguucucaccaaggcagcggcaccauaaggaauuuaaguucaaucucagccagauuccggagggagaaguagugacggcggccgaguuucguauauauaaagauugcgucaugggcaguuucaagaaccaaaccuuucugaucucuauuuaccagguguuacaggaacaccagcaccgcgacuccgaucuguuccuccuugacacaagaguugugugggcaagcgaggagggcuggcuggaauuugauaucacugcuaccucgaauuugugggucgugacaccccaacauaacauggggcuacagcugucuguaguuaccagggacggagugcacguccauccucgggccgcuggucucgugggccgagacgggccauaugauaaacagcccuucaugguggccuuuuucaaggucuccgagguucacgugcgcacuacaagaucagcaaguagcaggcggcgccagcaauccagaaauaggucuacccagagccaggacguagcccgugugucaagugcuuccgauuacaacagcucugaacugaaaacggcgugucggaagcacgagcuuuaugucucauuccaagaccugggauggcaggauuggauuaucgcaccuaagggcuacgccgcuaauuacugcgacggugaauguaguuuuccauugaacgcccauaugaaugcaacuaaccacgccauagugcagacccucguucaucugaugaaucccgaguaugugccgaaaccuugcugugcuccaacaaaguuaaacgccaucagcguccuguacuucgaugacaacuccaaugugauucugaaaaaguaucgaaacaugguaguuagagcaugcgggugucacuga

SEQ ID NO: 53419 - RNA, 1296 nt, Artificial Sequence
  derived and/or modified sequence opt3 from BMP7__Homo_sapiens__NP_001710
augcacgugagaagccugagggccgcugcaccccauuccuucgucgcccucugggcgccucuuuuucuguugcggucugcuuuagccgacuucucacuggauaacgagguucacaguagcuuuauccaucgccgacuacguucccaggaaagaagggagaugcaacgggaaauucucucuauacugggccuuccacaccgcccgagaccccaucugcaggggaagcacaauucggcaccuauguucauguuggaccucuacaacgccauggcuguggaggaaggagguggcccagggggacagggcuuuucauaucccuacaaagcaguauucagcacccaggguccuccacuggccagucugcaagauucccacuuucucacagacgcugauauggugaugucuuucgucaauuuaguggagcaugacaaggaguuuuuccaccccagguaucaucaccgggaauuucgcuucgaucugagcaaaaucccugagggggaagccguuacugcggcagaguuucgaauuuacaaggacuauaucagagagagguucgauaacgaaacguuccggauuuccguguaccagguccuucaggagcacuugggacgugaaucagaccuguuucuacucgauagucgcacccugugggccagcgaggaaggcuggcuuguguucgacaucacagcuacuucuaaucauuggguaguuaacccaagacacaaucugggcuugcagcucuccguggagacccuggaugggcaaucaauaaacccgaaauuagccggacugaucgguaggcauggcccccagaauaagcagccuuuuauggucgcauucuuuaaggcuacagaggugcacuuccggagcauucgaaguaccgggucuaaacagcgcucccaaaacagaagcaagacucccaaaaaucaggaagcccucaggauggcgaacguggccgaaaauucgucuuccgaccagcggcaagcaugcaagaaacaugagcuuuaugucucauuucgcgaccugggauggcaggauuggaucauugcuccagagggcuacgccgcuuacuauugugaaggugagugcgccuucccuuugaacaguuacaugaaugcaacaaaccacgccaucguucagacccuagugcacuuuauaaacccagagacgguacccaagccguguugcgcuccuacucagcugaaugcgauuagcgugcucuauuucgacgauuccucuaacgucauccugaagaaauacagaaauauggugguuagggcaugugggugccauuga

SEQ ID NO: 53420 - RNA, 837 nt, Artificial Sequence
  derived and/or modified sequence opt3 from BMP8B__Homo_sapiens__XP_011540326
augaccgcccugcccggcccucucuggcuucugggguuggcuuuaugcgcacugggagguggcgggccaggacuaagaccgcccccuggcuguccacagaggcggcucggugcccgcgagcgacgugacgugcaaagagaaauccuggcgguccuugggcugcccggaaggccucggccacgcgcucccccugccgcaagcagauugccagccuccgcuccccucuucaugcuggaucuguaccacgcaauggccggcgacgaugacgaggauggcgcuccggccgaaaggcggcucgggcgcgcggacuuaguuaugucuuuugugaacaugguagagcgagauagagcacugggacaucaggaaccucacuggaaggaguucagguuugaccuuacacagauuccagccggugaggcugugacugccgcagaguuccggauauauaaaguccccucaauccauuugcugaaucguacgcuacacgugaguauguuucagguugugcaagaacagagcaaccgcgaauccgaucucuucuuucuggaccuucagacccugagagcuggcgaugaggggugguugguccucgacgugacagccgcgucugauugcuggcuguuaaagaggcauaaagaccugggacuccggcuuuacguagagacugaagacggcgagaccuggacagguuggggguggaccaaggauucgcgacugcagauguggaaauugcgccuaucaagaacuccuuggguucugagccuccacgccccaggacccgcacaagcuccggccgaaaggccucugcuuugucuguugcagggccacugccccuga

SEQ ID NO: 53421 - RNA, 2058 nt, Artificial Sequence
  derived and/or modified sequence opt3 from BMPER__Homo_sapiens__NP_597725
augcugugguucagcggcgugggggcccucgcugagagauacugcaggcggucccccggaaucaccuguugcguccuucuguuguuaaacuguucugguguuccuaugucacuggcaaguagcuuucuaacaggcuccguggccaagugcgaaaaugagggggaaguacuccagauuccauucauaacugacaacccguguaucaugugcgugugucugaauaaagaggucacgugcaagcgcgaaaaaugucccgugcuuucucgagauugcgcgcuggcuauuaagcaacguggagccuguugcgagcagugcaaaggcuguaccuaugaggguaacacauacaauucgucauuuaaguggcagagcccugcagaaccaugcguuuugagacagugucaagaggggguggucacugaaaguggagugaggugcguaguucacuguaagaacccccucgagcaucugggcaugugcuguccuaccugcccaggcuguguguucgaggggguccaguaucaggaaggagaggaauuucagcccgaggguuccaaaugcacaaaguguucuugcaccggcgggcggacucaaugcgugcgcgaaguguguccuauccugagcugcccacagcaccucucccauauuccgcccggacaguguugcccuaaauguuuaggccagagaaaggucuucgaccugccauuugguucaugccuuuucaggagugauguuuacgacaaugggagcuccuuuuuguaugauaacuguacagccugcaccugucgggacucuacggugguaugcaaacgcaaguguucacaccccggaggcugcgaucaaggccaggaggggugcugugaggaaugccugcuacgagugccuccagaggacaucaaggucuguaaauucggaaauaagauauuucaggauggugaaauguggagcaguaucaacugcacuauuugugcuugcgugaaaggcagaaccgaguguaggaauaagcaaugcauccccauuucuuccuguccgcaggggaaaauccucaaccggaagggaugcuguccuauaugcacagaaaaacccggcguuugcacuguguucggugacccacauuacaauaccuuugaugggcguacauucaacuuccagggcaccugucaguauguccugacgaaggacugcagcucgccugcaucucccuuucaagugcuuguaaagaaugaugcccgcagaacuagguccuucucauggacaaaaaguguugagcugguguugggagagagccgggucucccuccagcagcaccugaccgugcgauggaacggcucucgcauugcuuuaccauguagagcgccccacuuucauaucgaccuggacggguaccuccuuaaggucacuacaaaagccggacuggaaauuagcugggauggugacucauucguggagguuauggcagccccucacuugaagggcaaacuaugcgggcuguguggaaacuacaauggccauaagagggaugaccucaucgguggggauggcaacuuuaaguucgacguggaugacuuugcugaaaguuggcggguagaguccaaugaauuuugcaaccgcccacagagaaaaccgguccccgagcugugucaaggaaccgugaagguuaaacuuagggcccaccgugagugccagaagcugaaaagcugggaauuucagacgugucacucuaccguggauuaugcaacauucuaccggucaugcgucacugacaugugugagugcccugugcauaagaauugcuauugugaaaguuucuuggcuuacacccgagccugccagagagagggcaucaagguacacugggagccacaacagaacugugcggccacacagugcaaacauggggcaguguaugauacuuguggacccgguugcauuaagaccugugacaauuggaacgaaauaggcccuugcaauaaaccauguguugcugggugccacugucccgccaaccucguccugcauaagggaaggugcaucaaaccgguguuaugcccucagcgcuga

SEQ ID NO: 53422 - RNA, 1599 nt, Artificial Sequence
  derived and/or modified sequence opt3 from BMPR1A__Homo_sapiens__NP_004320
augccccagcuguacaucuauauuagacuccuuggcgccuaccuguucauaaucagcagggugcaagggcagaacuuggacuccauguuacacggaaccgguaugaagucugauucagaccagaaaaagagugagaauggcgucacacuggcuccugaagauacucuaccauuucucaaaugcuauuguagcgggcauugcccggacgaugcaauuaacaauacguguaucaccaacggacacugcuucgccauuaucgaggaagacgaucagggcgagacaacucuggcguccgguuguaugaaguacgaagggucugacuuucaaugcaaagauucgcccaaggcucagcuucggcgcaccauagaguguugccgaacaaaucuguguaaccaguauuugcagccuacccucccacccguugugaucggaccuuucuuugacggcucaauucguuggcugguacugcucaucagcauggccgugugcauuaucgcaaugauaauuuucaguuccuguuuuugcuacaagcauuauugcaaaucuaucagcuccagaaggcgguacaaucgcgauuuagagcaagacgaagccuucauuccagucggcgagucacugaaggaucuuaucgaccagagucagagcucuggguccggaucagguuugccccugcuagugcagagaacuaucgcuaaacaaauucagaugguuaggcagguuggcaaggggcgguacggagaagucuggaugggcaaauggcgcggugagaagguggcaguaaagguguuuuucacaaccgaggaagccagcugguuucgagagacggaaauauaucaaacugugcucaugagacacgagaacauccugggguucauugcugccgacaucaaaggaaccggcaguuggacacagcuuuaccugauaacugauuaucaugaaaauggcucuuuguacgacuuucucaagugugcgacccuggauacaagggcauuacugaaacucgccuauuccgcugccugcgggcuuugucaucugcacaccgagauuuacggaacgcaggguaagccugcaaucgcucaccgggacuugaaaagcaagaacauccuaauuaaaaagaauggcucgugcuguaucgccgaucuggggcucgcggucaaguucaacucugacacuaaugagguggaugugccacugaacacacgugucggaaccaaacgcuauauggccccggaaguucuugacgagucccugaauaagaaccacuuccagcccuacauuauggcagauauauacucauuuggcuugaucauuugggaaauggcuagaaggugcaucacuggugggaucguggaggaauaucaacucccuuacuauaacaugguaccaagugaccccagcuacgaggauaugcgggagguggucugugugaaacgacugcgcccuauuguuuccaauagauggaacucugacgaaugcuuaagggccgugcugaagcuaaugagcgaguguugggcucauaauccagccucacggcucacagcacugcgcaucaaaaagacccuugccaagauggucgaaagucaggacgugaaaauauga

SEQ ID NO: 53423 - RNA, 1509 nt, Artificial Sequence
  derived and/or modified sequence opt3 from BMPR1B__Homo_sapiens__NP_001243721
augcugcucagaagcgccggcaaacuuaacguggggaccaagaaggaggacggagaauccacagcucccacuccuaggccaaaaguccugcggugcaagugucaccaucacugcccggaggauucuguuaauaacaucuguucaacggacgguuacugcuucaccaugauugaagaggaugacaguggcuugcccgugguaacaagcggguguuuaggacuggaaggcuccgauuuucagugccgcgacacuccuauaccacaucaacgacguucuaucgaguguugcaccgagagaaaugaauguaacaaagaucuacaccccacacucccuccacugaagaauagggacuucguggauggucccauucaucaccgggcacuucugaucucggucaccgugugcucauugcuccugguucugauuauccucuuuuguuauuuccgcuacaagagacaggagacuaggccucgguauagcauaggguuagaacaggacgagacauacaucccaccgggagagagucugcgcgaucuuauugaacagucccaaucuagcggcuccggcucaggguugccccugcuagugcagcgaaccaucgccaaacagauucagauggucaagcaaaucggaaaagguagauauggcgagguguggauggggaaguggaggggagaaaaaguagcgguuaagguguuuuucacgacugaggaagcuaguugguuucgggagaccgagauauaccagacaguccucaugcgucacgaaaacauucugggcuucaucgccgcagacauuaaggguacugggagcuggacccagcuuuaucugaucacagauuaccaugagaauggaucuuuguacgacuaucucaaauccaccacgcuggacgccaagucaauguuaaaacuggcuuacagcagugugucuggccucugccaccuucauacugaaaucuuuuccacacagggcaagccugcaauugcccaccgcgaucugaaaagcaagaacauauuggugaaaaagaaugggaccugcuguaucgcugaccuaggacuggccgucaaguucauuucggauacuaacgagguugacaucccacccaauacaagaguggguaccaaaagguauaugccuccagaaguacucgaugagucucugaaccggaaucacuuucaauccuacauaauggcggacauguauucauucggccuuauucugugggagguggcacgacgcugcgucagugggggaaucguggaagaguaccaguugcccuaucaugaucucguuccgagcgacccuuccuacgaagauaugagagagaucguguguauuaagaaacugaggcccucuuuuccaaaccgguggagcucagacgaaugcuuacgccagaugggcaagcugaugacggaguguugggcccacaauccugcuaguagacuaaccgcccucagggucaaaaagacacuggcaaagauguccgagagccaagauaucaaacuuuga

SEQ ID NO: 53424 - RNA, 3117 nt, Artificial Sequence
  derived and/or modified sequence opt3 from BMPR2__Homo_sapiens__NP_001195
augaccagcucccugcagagacccuggagggugccuuggcucccauggacaauccuucuggucucuacugccgcugcaucacaaaaccaggagcgguugugcgccuucaaggacccguaccagcaggauuuaggcauuggggaaagucgcauaagccacgagaauggaacgauccuguguuccaaagguucuaccugcuauggccuaugggaaaagucgaaaggggacauuaaccucguuaagcaaggauguuggucacauaucggcgauccccaggagugccacuacgaagagugugugguaacaacuaccccuccaagcauucagaaugguacauaucgauuuugcuguugcaguaccgaccuguguaacgugaauuucacugagaacuuucccccuccagauacaacgccccuuuccccuccacauucuuucaaucgugacgaaaccaucauaaucgcgcuggcuagcgucuccguguuggccguucucauuguggcacugugcuuuggguacagaaugcugacuggagauaggaaacagggccuccacucaaugaacaugauggaggccgcugcaagugaaccgagcuuagaccuggauaaucuuaaguugcuggagcuaaucggccgggggcgcuauggagccgucuacaaggguucucucgacgagagacccguggcuguaaaaguuuucuccuuugccaacaggcaaaauuucauuaacgaaaagaauaucuaucgggugccucugauggagcaugauaacauagcgcgcuuuauugucggcgacgaacgagugaccgcagaugggagaauggaguaccuucuggugauggaauacuauccaaauggaucauuguguaaauaccucagccugcacacaagugacugggucucuuccugcagguuagcccacagcguuacucggggccuggcuuaucuccauaccgagcuuccccguggugaccacuacaagccugccaucucgcaucgcgaucugaacucuagaaacguguuggugaaaaaugacgggacaugcgugauuuccgauuucggacuaucaaugaggcugaccggcaaccggcucguccgaccaggcgaggaagacaaugcagcuaucagugagguggggacgauccgcuauauggcccccgaaguucuggagggagcggugaaccuuagagauugugaaagcgcccugaagcaggucgacauguacgcauugggucucauuuauugggagauauuuaugaggugcacugaucuguucccgggcgaguccgugccugaauaccagauggcuuuucagacagagguagggaaucaccccaccuucgaagacaugcaaguuuuagugucucgggagaagcagcgcccaaaauucccugaagccuggaaggagaacagccuggcugucagaucacuaaaagagacuaucgaagauuguugggaccaggaugccgaggcaaggcucacagcccaaugcgcugaagaacguauggcggagcugaugaugauuugggaacggaauaagagugugucccccaccgucaacccaaugagcacggcaaugcagaaugagcgaaaccuuucucacaauagaagggugcccaaaaucggaccuuacccagacuauucaaguagcuccuacauagaagacucuauucaucacaccgauucgaucguuaagaacaucagcuccgagcauucaaugaguucuacaccguugacuauuggcgagaaaaaucgcaacagcaucaauuaugagcggcagcaggcccaagcuaggauucccuccccugagaccucagugacaagccugucuacuaacaccacaaccacuaacacgacaggucucaccccauccacugggaugaccacaauaagugaaaugcccuacccugacgagaccaaucugcacacuacaaacguagcccagagcaucggcccaacgcccgucugucuucagcugaccgaagaggauuuggaaacuaauaagcucgacccgaaggagguggauaaaaaccugaaggagucuuccgacgaaaauuuaauggagcauucacugaaacaguuuaguggaccugauccacuaagcucgacauccucuagccuccuguauccccuuauuaaguuggcaguugaagccaccggccaacaggacuucacacagacugcuaacgggcaggccugccugaucccugaugugcuccccacccaaaucuacccacugccuaaacagcagaauuuacccaagagaccaacgucacugccgcuuaacaccaagaauaguacaaaagagccucgcuugaaguuuggauccaaacacaagucuaaccucaaacaggucgaaacugguguggcaaagaugaauaccauuaacgcggcugagccccacguagugacaguuacuaugaauggcgucgccgggcgaaaccauagcguaaauucccacgcagccaccacgcaauaugcuaacggaacagugcugucaggccagaccacuaacauagucacacaucgggcccaggagaugcuacaaaaucaguucaucggugaagacacccgucugaacauuaauagcaguccagaugagcacgaaccccuccugagaagggagcagcaggcagggcacgacgagggcguucuugaucgcuugguggaccggagagaaaggccucuggagggaggccgaacuaacucuaauaacaauaacuccaauccauguagcgaacaagacguguuagcucaggggguacccucgaccgccgcggauccuggaccgucaaagccacgccgggcccagagacccaacucucucgaccugagugcuacaaauguccuugaugguuccagcauccagauuggcgagucuacgcaagacgggaaaagcggauccggcgaaaagaucaaaaagagggugaaaaccccuuacucacugaagcguuggcgcccaaguacuuggguuauaagcacagagucuuuggauugcgaggugaacaauaacgguuccaaucgggcaguccauucaaagaguagcaccgccguguaccucgcugaagggggcacagccacuaccaugguuuccaaagacaucggaaugaacugucuguga

SEQ ID NO: 53425 - RNA, 3849 nt, Artificial Sequence
  derived and/or modified sequence opt3 from BMS1__Homo_sapiens__NP_055568
auggaggccaaggaccagaaaaagcacagaaagaagaacagcggccccaaagcugcaaagaagaaaaagaggcugcuccaagaucuucagcugggggacgaagaggaugcccggaaacgcaauccuaaggcguucgcugugcaguccgccguccgaauggcacguucuuuucauagaacccaggacuugaaaacaaagaagcaccauaucccaguuguggauaggacuccguuagaacccccuccaauuguaguggucgugaugggacccccuaaaguugguaagucaacgcugauacaaugccuaauccggaacuucacccgccagaaacucacagagauuagaggcccagugacuaucgucagugggaagaaaaggcggcugaccauuaucgaauguggaugcgacauaaauaugaugaucgaucuugccaagguggcugaccugguauugaugcucauugaugcuagcuuuggcuucgagauggagacauuugaguuccugaacaucugucagguucacgguuuucccaaaauuaugggggugcugacccaucucgacuccuucaagcacaauaagcagcugaaaaagacuaaaaagcgccugaaacaccgauuuuggacagaagucuacccuggagccaaacuuuucuauuugucuggcauggugcauggcgaauaccaaaaccaggagauccacaaucuggggagauuuauaaccgugaugaaguucaggccacuaacguggcagacuucgcauccguauauucucgcugaucggauggaggaccugaccaaccccgaagauauccguacaaauauuaaaugcgaccgcaaggucucacuuuacggauaucugagaggugcccacuugaaaaacaagagccagauccacaugccuggcguuggggacuuugcggugagugauaucuccuuccucccagaccccugugcacugccugagcaacagaaaaagaggugcuuaaaugaaaaggagaaacugguauacgccccacucucuggagugggcgguguccuuuaugauaaggacgcuguguacguugauuuagggggaagccauguguuccaggacgaagucggccccacucacgaguuggugcaaucccuaauuucaacccauaguacaauagaugccaaaauggcaagcucucggguaacccuguuuuccgacucaaagccgcucggcagcgaggauaucgacaaccaggggcugaugaugccuaaagaagagaagcagauggaucuuaauacgggacgaaugcgcagaaaggcuauuuucggugacgaagacgagaguggcgauucugacgaugaagaggacgaugagauguccgaagacgaugggcuggagaacggaagcucggacgaagaggccgaagaggaggaaaaugcggagaugacugaucaguacauggccguuaaaggcaucaagaggcggaaauuggaacucgaggaggacucugaaauggaucugcccgcauuugcugacuccgaugacgacuuagagcgcucaagugccgaagagggugaagcugaggaggccgaugaaagcuccgaggaagaggacuguacagcaggggaaaagggcauaucuggaagcaaagccgcuggcgaggggucaaaggcgggacugaguccagcaaacugccaauccgauagagugaaccuagagaaaagccuccugaugaagaaggccgcacuuccuaccuucgacucuggucacuguacugccgaagaggucuuugcaucagaagaugagagugaagagagcuccucuuugucggccgaggaagaggacagcgaaaaugaggaggcuauuaggaaaaagcuguccaaacccucacaggugaguucuggccagaagcucgggccacagaacuucaucgaugaaacaagcgacaucgagaaucugcuuaaagaagaggaagauuauaaggaggagaacaaugacuccaaggaaaccucaggagcccugaaauggaaggaggauuugagccguaaagcagcggaggcuuuucuccggcaacagcaggccgcacccaaccugcgaaaguuaauuuacggcacggucaccgaagacaaugaagaggaggaugacgacacacuggaggaacuagguggacucuucagagugaaccagccugauagggaaugcaaacauaaggccgacucucuggauuguucccgcuuucuuguugaggcuccacacgacugggauuuggaagaggugaugaauaguauccgggacugcuucguaacuggcaagugggaggaugacaaagaugccgcaaagguccuggcugaagacgaggaacucuauggagauuuugaggaccuggagaccggcgacgugcacaaaggaaagagcgggccgaacacacaaaaugaagauauugagaaagaaguuaaggaggaaauagaccccgaugaggaggaaucugccaagaaaaagcauuuagacaaaaagagaaaacugaaggagauguucgaugcggaauacgacgagggugaauccacuuauuuugaugaccuuaaaggcgagaugcagaagcaggcccaguugaacagggcugaguucgaagaucaagacgaugaggcacgcgugcaguacgaaggguuccgaccuggaauguauguccggaucgagauugaaaaugugccaugcgaguuuguacagaacuucgacccccacuacccuaucauccucggcggucugggcaauucagaggggaacgugggauacguucaaaugcgucuaaagaaacauagaugguauaagaaaauucugaagaguagggauccaauaaucuuuagcgucggcuggcgccgguuccagaccauuccccucuacuauaucgaagaccacaacgggagacagaggcugcuuaaauacacaccgcagcacaugcauuguggagccgcuuuuuggggcccuauuaccccacaagguacuggguucuuggccauccagucgguguccggaauaaugcccgacuuucgaaucgcagcgacgggcgugguccuggauuuagacaagucuauuaagaucguuaaaaagcucaaacugacagguuucccuuauaagauuuuuaaaaauaccagcuucaucaagggcauguuuaacucagcccuugagguggcuaaguucgaaggggccgugauacgcacuguaagugggauucggggccagaucaaaaaggcacugagagcucccgagggggccuuuagggcauccuucgaggauaaauugcucaugucugacauugucuucaugcguaccugguacccagugagcaucccugccuuuuauaaucccguuacaucccugcuaaagccagugggagaaaaagauaccuggucaggcaugcgcacuacaggucagcugcggcucgcucacggggucagacugaaggcgaacaaggacagccuuuacaaaccgauauugaggcaaaagaaacauuucaauagucugcacaucccuaaggccuuacagaaagcacuccccuuuaagaacaagccaaaaacgcaggcuaaggccggaaaagugcccaaggaucgacggcgcccugccguuauuagagagccacaugaaaggaaaauccuggcacuucuggacgcucuaucuaccgugcacucccagaagaugaaaaaggccaaggagcaacggcaccuccauaauaaagaacacuuccgagcgaagcagaaagaggaggaagagaagcugaaaagacagaaggauuugcgcaagaaacuguuuaggauucaaggccagaaggaacgucggaaccagaaaagcucguuaaagggugcugagggccagcuccaauga

SEQ ID NO: 53426 - RNA, 2028 nt, Artificial Sequence
  derived and/or modified sequence opt3 from BMX__Homo_sapiens__NP_001712
auggacaccaagagcauccuggaggaacuccuucugaaaagaucccagcaaaagaaaaagaugucucccaacaauuacaaagagagguuguucguguuaacaaagacuaaccugucauauuacgaauaugauaagaugaaacggggcagucgcaaggggagcauugagaucaaaaagauacgaugcgucgaaaaaguuaaucuagaggagcagacgccuguggaacgucaguacccauuucagauuguauauaaggacggacuccuguacguguaugccuccaacgaggaaucuagaucgcaauggcuuaaggcucugcagaaagagaucagggguaauccgcacuugcucgucaaguaccauucaggcuucuuuguggaugggaaauuccuguguugccagcagagcuguaaggcagcccccggaugcacccugugggaggcguacgcuaaccuccacacagccguuaaugaagagaaacaucgggugccuacuuuuccagaccgcgucuuaaagauucccagagcagugccuguacugaaaauggaugccccaaguuccucuaccacacuugcucaauaugacaacgaaagcaagaagaauuacggcucccagcccccuucaaguagcaccucuuuggcacaguaugauuccaacagcaaaaagaucuacgguucacagccaaauuucaacaugcaauauauaccgagggaggacuuucccgauugguggcagguucggaaacugaagaguucuuccagcucggaagacguggccucuuccaaucagaaagagcgcaacgucaaucacacuacaucaaagaucaguugggaguucccugaaagcuccucuagcgaggaagaggaaaaccuagaugacuacgauugguuugcugggaacauuucacgaagucaauccgagcagcuccugagacagaagggaaaagagggcgccuucauggugaggaauagcucucaggugggcauguauaccgucucacuuuuuaguaaggcgguuaacgacaaaaaggggacggugaaacauuaccacguacacacuaaugcagaaaacaagcuguacuuggccgagaauuauuguuucgacagcaucccaaagcucauucauuaccaccaacauaacuccgcuggaaugaucacccggcugcgucaccccgugucuacaaaagccaauaaggucccugauucggugagcuuagguaacggcauaugggaacugaaacgcgaggaaauuacucuccuuaaggagcugggguccggacaguuuggcguugugcaguuggguaaauggaaggggcaguaugacgucgcagugaagaugaucaaagagggaucaaugagugaagaugaguucuuccaagaagcucagaccaugaugaagcuaucucacccaaaacugguaaaguuuuacggcguuugcagcaaagaguaucccauuuacaucgugacagaguauaucuccaauggcugucuccugaacuaccuuagaucacaugggaagggacuggaaccgagccaguugcucgagaugugcuacgacgucugugaagguauggccuuccuggagucucaccaguuuauucauagggauuuagcggcccggaauugccugguggaccgagaucuaugugucaaaguguccgacuucggcaugacccgcuauguucucgaugaccaauacgugaguagcguagggacgaaguuuccugucaaguggucugcacccgaaguguuccacuauuuuaaauacuccucaaagagugauguuugggcuuucggaauacugaugugggagguguuuagccuuggcaaacagccauaugacuuguacgacaacucgcaggucgugcugaagguaucccagggucauagacucuauaggccucaccuggccucugauacuaucuaccaaauuauguacagcugcuggcacgagcuucccgaaaaacggccaacauuccagcagcuguugucaaguaucgagccccuccgcgaaaaggacaagcauuga

SEQ ID NO: 53427 - RNA, 2964 nt, Artificial Sequence
  derived and/or modified sequence opt3 from BNC1__Homo_sapiens__NP_001288135
augagaugcaggaacauguucuuuagcuucaaggccucccuguguggcugcggggcugcaaccgcccccucucucacagcgaucucauguacucuuaauugcaguugucagagcuuuaaaccuggaaagauuaaccaccggcaaugcgaccaguguaaacaugguuggguggcucacgcccuguccaaguugcgcauaccaccgauguaccccacgucucaggucgagaucguucagucgaaugugguauucgauauuucaagccucaugcuguauggcacccaagcaaucccugugcgacuaaaaauucuccuggaccgucuuuuuaguguccugaagcaggaugaaguguugcagauccuccaugcccuggacuggacacugcaggauuacauaagaggguauguucuccaagacgcuuccggaaagguguuagaucacuggucuaucaugacuagcgaggaagaggucgcaacccugcagcaguuccuuagguuuggcgaaacaaaauccauuguggaguugauggccauccaggagaaggaggaacaaucaauuaucauaccacccaguaccgcuaacguagacauucgggccuucaucgaaagcugcucucaucgcuccucaagccugccuacuccaguugauaaagguaaucccaguucuauucacccuuuugagaaccuaaucuccaauaugacauucaugcucccauuucaguucuuuaacccgcugcccccugcgcuuaucgggagccugccagagcaguacauguuggaacaaggacacgaccagucgcaggaucccaagcaggaggugcauggcccuuucccagacucuuccuuccucaccucaaguagcacgcccuuucaagucgaaaaagaucagugucugaauugcccggacgcaauuacuaagaaggaggacuccacccacuuaucugauagcucaaguuauaacauagugacaaaauucgaaagaacucagcuguccccugaggccaaggugaaacccgagaggaauagccucggcaccaagaaagggcgggucuuuuguacagcuugcgaaaagaccuucuacgacaaaggaacgcuuaagauccauuauaacgccguucaccugaagauuaaacacaagugcacuaucgaggguuguaauaugguguuuucuucauugcgcagucgaaacagacauagcgcaaauccaaacccuaggcuacacaugcccaugaaccggaauaaccgugauaaagaccugcgcaauucccucaaccuggcuucuucggaaaauuacaagugcccaggcuucacaguaaccagccccgauuguagaccuccaccguccuaccccgggucaggagaggacaguaaaggccagccugccuuuccaaacauaggucaaaauggggugcuuuuccccaaccugaagacuguccagccuguguugccauuuuauaggucucccgcgacaccggccgaaguugcaaauaccccuggaauuuuaccaagccugcccuuacuguccucaagcaucccugagcagcuaaucucuaacgagaugcccuucgaugcucucccaaagaaaaagucccggaaaaguagcaugccuauuaagaucgaaaaagaggccguggaaauugcuaaugagaagcgacauaaccugucuuccgacgaagauaugccccuucaggucgugucagaggacgagcaagaagccugcaguccacagagccaccgcguaucggaggaacagcauguucaguccggcggcuuggggaagccguuuccugagggagagagacccugucacagggaaucugugauagagagcucaggugcaaucagucaaacgccagaacaggccacccacaauuccgagcgggaaacagagcagacucccgcucugauuauggucccucgcgagguggaagauggcgggcaugagcacuacuucaccccaggaauggaaccccaagucccuuuuucugacuauauggagcuccagcagagacugcuugcgggcggucuguucagcgcauuguccaacagggggauggccuucccgugccucgaagacucaaaagagcuggagcaugugggccagcacgcuuuagcccgucaaaucgaagagaaucgguuucagugugauaucugcaagaaaacauucaagaacgcauguagcguuaaaauucaccauaagaacaugcacgugaaggaaaugcauacuugcaccguagagggauguaaugccacauuuccaagucgaagaucuagggaccgccacuccagcaaccugaaucuacaucagaaagcucucucgcaggaagcccuggagucaucugaggaucacuuccgggcagcguaccuuuugaaggacgucgcuaaagaagccuaucaagauguggcauuuacccagcaggccagucagacuuccguuauauucaagggcacgagcagaauggggucucugguguaccccaucacacaaguccacagcgcuucccucgagucauauaacaguggaccucugagcgaagguaccauuuuagaccugucuacuaccuccucaaugaaaagugagagcuccucucauucgagcugggauucagacggcguguccgaggaagggacaguacuuauggaggauagugacggaaauugcgaaggcucuagcuuggugccaggugaggaugaauaccccaucugcguucucauggagaaggccgaccagucccuggcaucacuaccuucugggcugccgauuaccugucaccucugccagaaaacuuacagcaacaagggcacauuuagggcucauuauaagacgguccaucugcgccaacuucacaaauguaaggugcccggaugcaauaccauguucaguuccgugcgaagccggaaccgucacucucagaauccaaacuugcacaaaucacuggccuccaguccuagccauuuacaguga

SEQ ID NO: 53428 - RNA, 3300 nt, Artificial Sequence
  derived and/or modified sequence opt3 from BNC2__Homo_sapiens__NP_060107
auggcccaccugggccccaccccuccaccgcauagccucaacuacaaguccgaggacagacuuucugaacaggauuggcccgcuuauuucaaagugccuugcuguggggucgacacaucacaaaucgagagugaagaggcagaaguugaugugagggagcgggagacucagcgcgaccgagaaccaaagcgugccagagaucugacguugagggacagcugcaccgauaauuccaugcaguuuggaacacggacuaccacagcggagcccgguuucaugggcaccuggcagaacgcugacacuaauuuacuguuucgcaugucucaacaggccauuagauguacacugguaaacugcaccugugaaugcuuccagccugggaaaauaaaucucaggacgugugaucagugcaagcacggauggguggcacaugcccuggacaaacuuucgacucaacaccuguaccauccaacccaggucgagaucgugcagucaaacguuguguuugauauuagcaguuugaugcucuauggcacacaggcuguccccgugcggcugaagauccugcucgaccgcuuauucuccguacugaagcaagaggaaguucuucacauuuugcacggucugggguggacucuacgagauuacgugagaggauauauccuccaggacgcagccggcaaaguccuggacaggugggcuauaaugucucgggaggaagagaucauuacccuucagcaauuucugcguuucggcgaaacaaagagcaucguggaguugauggccauucaggagaaagaagggcaggcgguggcagucccuuccucaaagaccgauagugacauccgcacguuuauagagagcaauaacagaacuaggucuccaucccuccuggcccauuuagaaaauucaaacccgagcaguauucaccauuucgagaauauccccaacucucuggcuuuucuccuuccuuuccaguacauuaauccaguuuccgcaccccuguugggacuaccuccaaacggucugcuccuggaacaacccggccuucggcugcgagagccgagcuugucgacacagaaugaguauaacgaaucuuccgagucagaagugaguccuacccccuacaaaaacgaucagacuccaaaucgcaacgcccucacaagcaucaccaauguagagccuaagacggaacccgcuuguguguccccaauccagaacucugcccccgucagcgaccugaccaagacagagcacccuaaaucaaguuuuaggauucacagaaugcggcgcaugggguccgcgagcagaaagggaaggguguucugcaaugccuguggcaaaacuuucuacgauaaggguaccuuaaaaauacauuauaacgcaguucaccugaagaucaaacaucguugcacaauugaggggugcaauaugguguuuucuucacuacggagucgaaacagacacagcgcuaauccaaacccgaggcuccauaugcccaugcugcgcaauaaccgggacaaggaucuuaucagagccacuuccggagcugccaccccugucauagcaucuacaaagucgaauuuggcccugaccagcccaggcaggcccccuaugggcuucacuacgccaccccucgacccggugcugcaaaacccucuuccaucccagcugguauuuucaggguugaaaacaguucagcccgugccucccuucuaccgcagucuccugaccccaggagaaauggucucuccucccacuagcuuaccaaccuccccgauuaucccuacaucagguaccaucgagcagcaucccccacccccuagcgaaccagugguccccgcugugaugauggcgacucacgagccuucugcagaucuggccccgaagaaaaagccacgaaaauccaguaugcccguuaagauugagaaggaaaucauugacacagcugaugaguuugacgacgaagaugacgauccuaaugacggcggggccgugguaaacgauaugagccacgacaaccacugucauucucaagaggaaauguccccaggaaugucagucaaagauuucaguaagcacaaucggacgcguugcauaagcagaaccgagaucaggcgcgcagacucgaugacuuccgaggaucaggaacccgagcgggacuaugaaaacgagucugaaagcucagagccuaaacuaggcgaggaaaguauggagggugaugaacacauucauuccgaggugucugaaaagguucucaugaauagcgagagaccggacgagaaccacuccgaacccucacaucaggaugugaucaaagucaaggaggaauuuacagacccaaccuacgacauguucuauaugagccaguacgggcuguauaauggcggaggcgccaguauggcugcccuucacgagucuuuuacauccagcuugaacuacgggucgccucaaaaguucucacccgagggagaucuguguucuaguccagacccuaaaaucugcuacguguguaagaaauccuuuaagagcucuuauagcguaaaacuccauuacaggaaugugcaccugaaggaaaugcacguuugcacugucgcagguuguaacgcggcuuuccccucccgacgcucacgggauagacauagugccaauauuaacuuacacaggaagcugcuuaccaaagaguuggacgauaugggccucgacagcucucagccaucccugucaaaggaucuacgugacgaauuucuggugaaaauauauggggcacagcauccgaugggacucgaugugcgcgaggacgccaguagcccugcuggcacggaagauucccaccugaaugguuacgggcggggcauggccgaggacuauaugguccuugauuugucuaccacaucgagccugcaaucauccaguucuauccauagcuccagagagucagacgcaggaucugacgaaggcauuuuacucgaugacaucgauggggcuagcgacaguggagaguccgcccacaaggcggaagcccccgcucugccagguagccuuggcgcagagguuucugggucacugauguucuccaguuugagcggaucgaacggcgguauuaugugcaauaucugucacaaaauguacucuaacaaggggacucucagggugcauuauaaaaccgugcaccuacgagaaaugcauaagugcaagguacccggcuguaauaugauguucuccagcguccggucacgcaacagacacagucagaacccuaaucuacacaaaaacauaccauuuacaucuguggauuga

SEQ ID NO: 53429 - RNA, 687 nt, Artificial Sequence
  derived and/or modified sequence opt3 from BNIP1__Homo_sapiens__NP_001196
auggccgcuccccaggacgugcacgucagaaucugcaaccaagagauuguuaaguucgaucuggaagugaaagcacucauacaggacaucagggauuguagcggcccucuuuccgcccugaccgaguugaauacaaagguaaaagaaaaguuucagcaguuacggcaucgcauucaagaccuggagcagcuagcgaaagaacaggauaaggagucugagaagcagcuccugcuucaagaaguggagaaccacaaaaagcagaugcugucaaaucaggcuaguuggcgaaaagccaacuugacuugcaagaucgcaauugacaaucucgaaaaagccgagcugcugcaagggggagaucucuuacgucagagaaagacgaccaaggagagccuggcucagacauccucuacuaucaccgaaucgcuuauggguauaucaaggaugauggcacagcaaguccagcagagcgaggaagccaugcagaguuuggugacauccucucggaccauccuggacgcuaacgaggaguucaaaagcauguccggcacuauucaacuagggcgcaagcucaucacaaaauacaauagaagggaacugaccgauaaguugcugauuuuucuugcccucgcgcuguucuuagcaacgguucuguauaucgugaaaaagcggcucuuuccauuccuuuga

SEQ ID NO: 53430 - RNA, 1308 nt, Artificial Sequence
  derived and/or modified sequence opt3 from BNIP2__Homo_sapiens__NP_004321
augcugugcggcuuccaggaggacgccaccccaccuccaccgcccagaccuaggcggcuccaccgccgacuuccacgucccgaagagguggggaugcugagcuugccuccaggauuacugacagucuccgguucugcugcagccgcggaugcuguuccccuaagaccuggcgacugggccggggugucaacugcagauaggggagaacgggccccacucggcccggcuuuuugugaccuggcaguaagucccacgagcccugccuggcgcggugaggaagaugagggggcuaaggccuccucuggagacaucggcucgcuugauuaccaagaguucguggucgacauugaaucaagacugaggauggagggcguggaauugaaagaggaguggcaggaugaagacuuuccaauaccccucccugaggaugacagcaucgaagcggauauucuggcaaucaccgggccagaggaccagcccggaagucuggaaguuaacgguaauaaggugcggaaaaagcucauggccccggacauuuccuuaacacuggauccuucugacggcagcguccuuuccgaugacuuggaugagucaggggagaucgaccuggauggacuagacacucccagugaaaacagcaaugaguucgaaugggaggaugaccucccaaaaccuaagaccacagaagugauacgcaagggcucuaucaccgaguauacugcugccgaggaaaaagaggauggucgaagauggaggauguuucggauuggggaacaggaccaucguguagacaugaaggcaaucgagcccuacaaaaagguuauuucccacggaggcuauuacggcgaugggcugaacgcuaucguggucuucgccgugugcuuuaugccagaaucaagccaacccaauuaucgcuaccuuauggacaaccuguucaaauaugugauaggaacauuggagcuccuggucgcggagaauuacaugauuguuuacuuaaacggugccaccacgagaaggaagaugccuagucugggcuggcuccggaaguguuaucagcagaucgaucgacgccuuaggaaaaaucugaagucuuugauuaucgugcauccauccugguuuaucagaacucuacuggcaguaacccggccguucauuagcucgaaauuuucucagaagauacgcuacguguucaaccucgcugaacuggccgagcuuguccccauggaauauguggggaucccugagugcauuaaacaaguugaccaggagcugaauggaaagcaggaugaacccaaaaacgagcaguga

SEQ ID NO: 53431 - RNA, 780 nt, Artificial Sequence
  derived and/or modified sequence opt3 from BNIP3__Homo_sapiens__NP_004043
augggcgacgccgcugcagaucccccugggccagcccugccgugcgaguuccucagacccggauguggugcgccucuuagcccaggcgcucagcuggggaggggagcccccaccuccgcauuuccuccacccgccgcugaagcacacccugccgcucggcgcggcuugcgaucuccacaauuaccgucaggugccaugagucagaacggggcgcccggaaugcaggaggaaagccugcagggcuccuggguggagcuacacuucucuaauaacggcaaugggggaucggucccugcaucaguuagcaucuacaacggugacauggaaaagauucuccuggaugcccaacacgagaguggccguuccucuagcaaauccucacauugcgacaguccacccagaagccagacaccucaggauacuaauagggcuucugagacggacacccacuccauaggggaaaagaacucaagccagagugaggaagaugacaucgagcggcgcaaagagguggaaucuauucuuaagaaaaauuccgauuggaucugggacuggagcucgagaccagagaacauucccccgaaggaauuucuguucaagcauccuaaaaggacagccacuuugucuaugcggaauaccuccguaaugaagaaaggaggcaucuuuucagcagaguuccucaagguguuucugcccagucugcucuuaagccaucugcuugcuauagguuuggggaucuauauuggacgccgacugacaaccuccacuucuacauucuga

SEQ ID NO: 53432 - RNA, 660 nt, Artificial Sequence
  derived and/or modified sequence opt3 from BNIP3L__Homo_sapiens__NP_004322
augagcucccaccugguggagcccccuccaccgcuccauaacaauaacaauaacugcgaagagaaugaacagucucuucccccuccagccggccugaacucaaguugggucgaguugcccaugaauagcuccaacgggaaugacaacggaaaugguaagaacggcggguuagaacacguuccuucuucgucaagcauccauaauggagauauggagaaaauucugcuagacgcucaacacgagaguggccaguccucuagcagagguuccucacauugugauaguccaagcccccaggaagacgggcagauaauguucgauguggagaugcacaccucuagggaccacuccucacaaagcgaagaggagguaguggaaggagagaaggaagucgaggcacucaaaaagagugccgauugggugucugacugguccagccggccugaaaacaucccaccgaaagaguuucauuuccgccaccccaagcgaucgguuucucuguccaugcguaagucaggcgcgaugaaaaagggcgggauuuuuagugcugaguuccuuaaaguguuuaucccuagccuguucuugucccauguccucgcccugggacuggguauuuacaucggcaagagacucucuacaccaagcgcaucaacuuauuga

SEQ ID NO: 53433 - RNA, 1032 nt, Artificial Sequence
  derived and/or modified sequence opt3 from BNIPL__Homo_sapiens__XP_011507538
augggcaccauccaggaggccgggaagaaaacagacgugggagucagagaaauugcugaggcacccgaacugggugccgcgcucaggcacggcgagcuugaacugaaggaggaguggcaagaugaagaguucccucgguuguuaccagaagaggcugggacuagcgaggacccggaagaucccaaaggagacucccaggccgcagccggcacgccuucuacccuggcucuaugcggucagcgcccaaugcgaaagcgucucucagcacccgagcugagacuuagucugacaaaagggccuggaaacgauggcgccagcccaacucaguccgcucccucuucgccugacggcucaagcgauuuggaaauagacgagcucgaaaccccaagugauuccgagcaacuggacucugggcaugaguuugaaugggaggaugaacugccgagggccgagggacucgguacaagcgaaaccgcggagcgguuaggccgcggguguaugugggacguuacuggagaggauggccaccauuggagaguguucaggauggguccccgggaacagcgcguagacaugacagugaucgagccuuacaagaagguccugucccacgggggauaucauggcgacggccuuaaugcagugauuuuguuugccucaugcuaccugccacgaaguagcauccccaacuauaccuacguuauggaacaccuauucagauauaugguggggacgcucgagcugcuugucgcugaaaauuaccuguuggugcaccucucuggagguacuuccagggcccagguaccuccacugucauggauucggcaguguuaucguaccuuagaucgcagacugaggaaaaaccuccgggcacuuguugugguccaugcuacaugcagcaaguuuacucgaaaaauccgcuuccuggacaguuugggcgagcuagcccaacugauaucucucgaucaggugcacauccccgaggcggugagacagcuggacagggaucuucauggguccggaggcaccuga

SEQ ID NO: 53434 - RNA, 3348 nt, Artificial Sequence
  derived and/or modified sequence opt3 from BOC__Homo_sapiens__NP_001288790
augcugagaggcaccaugacagccuggagggggaugcggcccgaggugacucucgcuugccuucuguuggcaacggccggauguuucgcggacuuaaacgaagucccucagguuaccgugcaaccagcuagcacaguacagaagccggguggcacugugauccuggggugcgucguggagcccccucgcaugaauguuaccuggcgacuaaacggaaaagaacucaauggcuccgaugacgcccugggugugcuuauuacacacgggacccuggucauaacugcauugaacaaucauacagugggacguuaccaguguguagccagaaugccagcuggcgcaguugccucugugcccgcuaccgucacgcucgccaaccugcaggauuuuaagcuggacgugcaacacgugaucgaggucgaugaaggcaauacugcgguuauugcaugccaucucccugagucacacccaaaagcccaggugagguauaguguaaagcaggagugguuagaagcuagccgggggaacuaccugaucaugcccuccggaaaucuucagauugugaacgccucucaagaggacgaagguauguauaaaugugcagcuuacaauccugucacccaggaggugaagacaucgggcucaagcgaucgcuugagaguuaggcggaguacugccgaggcggcccgcaucauauauccaccggaagcacagaccaucauugugacaaaggggcagucccugauccuagagugcgucgcuucuggcauucccccuccacgagugaccugggccaaagacggaagcuccguaacggguuacaacaagacuagauuccuccugucaaaucuucugaucgauacaaccagugaagaggacagcgggacuuauagguguauggcugauaacggaguuggccaacccggcgccgcagugauauuguacaauguccagguguuugaaccuccagaggucacaauggagcucucucagcuggugauucccugggggcaauccgccaaauuaaccugcgaaguucggggaaacccgccucccucagugcuguggcuccguaacgcuguaccacuuaucagcagucagcgccugagauugucuaggcgggcgcuacgaguccuguccauggguccugaggacgaaggcguguaccaguguauggcagagaaugaaguugggagcgcccaugcugugguccagcuccgcacgucgagacccucuauuaccccaaggcuguggcaagaugccgagcuugcaacaggaacucccccuguguccccaucaaagcugggcaacccggagcagauguugcggggucagcccgcccucccucgcccacccaccaguguagggccugcuagcccacagugccccggcgaaaaaggacaaggcgccccggcagaggcgccuaucauccuguccucuccaagaacaagcaagacugacucauaugaauuaguguggaggccccgucacgaggggaguggacgggcuccuauucuguacuauguugucaagcaccgaaaacaggugaccaauuccagcgacgauuggacaauaucugguauccccgccaaccagcauagacuaacccucacuaggcuggacccaggcucacuuuacgaaguggagauggcagccuauaauugugcuggggagggacagacggccauggucacauuccgcaccggccggagaccuaagcccgaaauuauggcaaguaaagagcaacagauccagagggaugacccaggugcuagcccgcaguccucuucgcaaccugaucacgggcgcuugagcccacccgaagcccccgaccgaccuacuauauccaccgcgucagagacaaguguuuacgugaccuggauuccacggggcaacggaggcuuucccauccagucuuuccguguggaguauaagaaacugaagaaaguaggggauuggauccucgccacuagcgcuauuccuccguccagacugucagucgaaaucacaggacuugagaaggguacgagcuacaaguuuagggugcgcgcacugaauauguugggcgaaucugagccauccgcccccagucggccuuacguugugagcggguauucuggaagagucuacgaaaggccaguggcuggccccuauauuaccuucacugacgccguuaacgagacaaccauaaugcucaaauggauguacaucccugcauccaauaacaauacaccgauucaugguuuuuauaucuacuaucgacccacugauucagacaacgauagugacuacaagaaagacaugguggagggggauaaguacuggcacagcaucucgcaucugcagccagaaaccuccuaugacauuaaaaugcaaugcuucaaugagggcggagaaucugaguuuagcaacguaaugauaugcgaaacgaaggcgcgcaagucaaguggccagccugggcgguuacccccaccuacccuggcucccccacagccgccucuacccgagacaaucgagagaccagucggaacuggcgccaugguggccagguccucugaucuccccuaccugauugugggugucguucuugggagcaucguguugauuaucguaaccuucauaccuuuuugucuguggcgugcaugguccaaacagaagcacacaacugaccucggauucccacgcucagcucugcccccuagcugcccguauaccauggugccauuaggcggucugcccggccaccaagccagugggcagccuuaccuuucuggaaucuccggccgggcaugugccaaugggauucauaugaacagaggaugccccagcgcugcggucggcuauccagguaugaaaccucagcagcacugucccggggaauugcaacagcagucggauacgucaucucuccugaggcagacacaucuaggaaacggcuacgacccacaaagucaccagaucacccgagguccuaaguccagcccggaugagggcucuuuccuguauacucuccccgacgauagcacacaccagcugcuucaaccacaucacgacugcugucagcggcaggaacagccugccgcaguggggcaauccggaguucgcagagcucccgauucaccaguguuggaggccgucugggacccucccuuucauaguggcccgccaugcugucugggguuagugccuguugaagagguggauagccccgacucuugccaggucuccggaggcgacugguguccacagcaccccguaggugccuacguggggcaggagccuggaaugcaacucucaccgggcccccugguuagggugaguuucgaaaccccaccucuuacuauuuga

SEQ ID NO: 53435 - RNA, 519 nt, Artificial Sequence
  derived and/or modified sequence opt3 from BOD1L2__Homo_sapiens__NP_001244893
auggccgacggcgggggagguggcagcgggggagcuggccccgcauccaccagagccucuggugggggaggcccuaucaacccagcgucacugccgcccggcgauccucagcucauugcuauaaucguggggcaacuuaagaguaggggacuguucgacagcuuucggcgcgauugcaaagccgacgucgauacaaagccagcauaccagaauuugucccagaaagccgacaacuucguuucuacucacuuagauaagcaggaguggaaucccccugcuaacgacaaucaacugcaugauggucuacgacagucggugguacagucaggccguagcgaagcagggguggacagaauuaguucccaggucguggauccaaaacucaaccacaucuuuaggccccaaauugagcagaucauacaugaguuccugguugcccagaaggaagcugccgugccugcgcuuccaccggaacccgagggacaggacccuccagcacccucucaagauacgagcuga

SEQ ID NO: 53436 - RNA, 639 nt, Artificial Sequence
  derived and/or modified sequence opt3 from BOK__Homo_sapiens__NP_115904
auggaggugcugagaaggagcuccgucuucgccgcugaaaucauggacgcauuugaucggucucccaccgacaaggagcucguugcccaggcgaaagcucuuggccgcgaauacgugcacgcccgacuguugcgugcaggguuaucauggagugccccugagagagcugcaccaguaccgggaaggcuggccgaagugugcgcuguccuacuccggcugggugaugagcuugagaugauucgccccagcguguauagaaacguugccaggcaacugcauauauccuugcagucugaaccuguggucacagacgcguuccucgcaguggccggccacaucuuuucggcugggauuacuuggggaaagguaguuucacuguacgccguggcagcuggccuggccgucgauugugugcggcaggcgcagccagccauggugcaugcacucgucgacugcuuaggugaguucguucgcaaaacgcuggcuaccuggcuucgaagaaggggaggguggacagauguguugaaguguguagugagcacugaccccggccugcggagucacuggcuagucgccgcucucugcuccuuuggccguuuccugaaagccgcauuuuucgugcuucugccugaacgcuga

SEQ ID NO: 53437 - RNA, 306 nt, Artificial Sequence
  derived and/or modified sequence opt3 from BOLA3__Homo_sapiens__NP_001030582
auggccgcuuggagccccgcagccgcggcuccucugcucagaggcaucagggggcuuccacugcaccaucggauguucgccacccagacagagggagaauugcgcgugacucaaauuuuaaaggagaaauuuccgcgagcaacggccauaaaggucaccgacaucuccgguacaaaacguagaaaccagagggaugcuuggauugcagacaucuaccugugcccccagacucuaaccacaccuuggcuccaccgguguugcugucugcgcccauggaugaauuucaccgauauuauccuucccuga

SEQ ID NO: 53438 - RNA, 525 nt, Artificial Sequence
  derived and/or modified sequence opt3 from BOLL__Homo_sapiens__NP_001271287
augaccgagcuggaauaccccaagggcagcuccaucaugccugccgcugggacaauguaucucacuacgucuaccggauacccauauacauaccacaacgguguggcauauuuccauacuccggaggucaccucaguucccccuccauggcccaguagaagcgugugcuccucuccuguaaugguggcccagccaauuuaccaacagcccgcguaucacuaccaggcuacaacccaguaccuuccuggccaauggcaguggucggucccacagccgucagccagcagugcacccuuucuguauuugcagccuuccgaagugauauaccaaccaguugagaucgcccaggacgggggaugugugcccccuccauuaucucugauggaaacuagcguccccgagccguauuccgaucauggcgugcaggcuacauaccaccagguauaugcaccuucagccauuaccaugcccgcuccaguuaugcaaccugagcccaucaaaacgguguggaguauucauuacuga

SEQ ID NO: 53439 - RNA, 2241 nt, Artificial Sequence
  derived and/or modified sequence opt3 from BOP1__Homo_sapiens__NP_056016
auggccggcagcagaggggcuggaaggaccgcagcccccuccgugcggccugagaagcgccgaucugaaccagagcuggaaccggagcccgaaccugagccaccccuccuuugcacaucaccucugagucacagcacugguuccgacucuggcgucucggauucagaggaaagcguuuucaguggguuggaggacuccggaucugauagcuccgaagacgaugacgagggcgaugaggaaggugaggacggggcguuagaugacgaaggacauucaggcaucaaaaagacgaccgaggaacaggugcaagcuaguacaccauguccccguacugagauggccagcgcaagaauuggcgaugaguacgccgaagacucuuccgaugaggaagacauaaggaacaccguagggaaugugccucuggagugguaugacgauuuuccacacgucggauacgaccuagauggucggcgcaucuauaaaccgcucagaacaagggacgaacuggaucaguuccuugacaagauggaugaccccgauuacuggcggaccgugcaggacccuaugacuggccgcgaucugcgauugacagacgagcagguugcucucgugagaaggcugcaaucagggcaguuuggagacgucggcuucaacccauaugagcccgcaguggacuuuuucagcggugauguaaugauucauccuguuaccaaucggccagccgauaaacguaguuuuauccccucucugguggaaaaggagaaggucucccgcauggugcacgcuauuaaaaugggguggauccagccgagaaggccucgggaccccacgccuagcuucuacgaucucugggcccaggaagacccaaacgcgguguuaggacgacauaagaugcacguccccgcaccaaaacuggcccuucccggccacgcugagucguauaauccuccaccggaauacuugcugucugaggaggaacgccuagccugggagcaacaggaacccggcgagagaaagcucuccuuucugccuaggaaauucccaucacuucgggcaguucccgcuuacgggcgcuuuauacaggagagauucgaaaggugccuggauuuguaucucuguccucgucagcggaagaugcgagugaacguagacccagaggaucugauccccaaguuaccgagaccuagggaccugcaaccauuucccacuugccaggcccucguguaccgcggacauagugaucuuguccggugucugagcguguccccugguggccagugguugguuucugggagcgacgauggaucacuaagacugugggaaguggcgaccgccaggugcguccgcacagugcccguaggcgguguugugaaaagugucgcauggaauccauccccugcugugugucucgucgccgcugccguggaggacagcguucugcuucugaaccccgcauugggggaccgacucguggccggcucuacugaucaacuguuaucagcuuucguaccaccggaggaaccuccccugcagccagcgcgguggcuagaggcaagugaagaggaacgucaggucggacucagacugaggauuugccacggcaagcccgugacccagguuacauggcaugggcgcggagacuaucuugccguggucuuggcuacccaaggucacacucaggugcugauccaccagcucagccggagaaggucccagucuccuuuccgacgcucgcauggccaaguacagcggguggccuuucacccagcaagacccuuccugcuuguugccagccagagguccguccgucuguaccauuugcuccgccaggagcugacgaaaaaguuaaugccuaauuguaaaugggugucaagucuggcugugcacccggccggggauaacgucauuugcggaucuuaugacagcaagcuaguuugguuugaucucgaccuguccacaaaaccauaccggaugcuuagacaucacaagaaggcauugagggcgguggcuuuccacccccgauauccucuguuugccucaggcagcgaugacgguucugugaucguaugucaugggauggucuacaaugaucuccugcaaaacccauuacuggugcccguuaaagugcuuaagggccacgucuugacccgggaccucggagugcuggauguuauauuccauccuacucagccguggguguuuuccaguggcgcagacgggacaguacgccuauucaccuga

SEQ ID NO: 53440 - RNA, 1905 nt, Artificial Sequence
  derived and/or modified sequence opt3 from BORA__Homo_sapiens__NP_001273675
auggagagauuccuguuucccgccccugaccucccagcuaggagcccgcuugugaacggcuccucucagggggucggaguugaggaacgggguacccgcaagucaggccacguggggcugggagcaacacccccuagucauagcauccaaggcucccgauugcacuuaaaucugccagaaguagauucuuuucccccucauccagccaaauucucgcuaugcgcgaugggugacgugaaggagucaaaaaugcagauuacucccgaaacgccugggcguauaccaguccucaacccguucgagagccccagugauuacuccaaucugcacgagcagacccuugcuucuccuagcguguuuaaguccacaaaacugccaacucccggaaaguucagauggucaaucgaccaguuggccguuauuaacccuguggaaaucgauccagaggacauucauaggcaagcacucuaucugagucacagccggaucgauaaggacgucgaagauaaacgccagaaggccauagaggaguuuuucaccaaagacgugaucguacccucuccguggacagaucacgaaggcaagcagcugucccagugucauucaagcaaaugcaccaauauuaacagugacucuccuguuggcaagaagcucacuauccacuccgagaaaagcgaugcugcaugucaaacauuacugucgcuucccguggacuuuaauuuggaaaacauucugggggacuacuucagagccgaugaguuugcugaccagucuccaggaaaucuauccucaaguagccucaggcggaagcuguuccuugaugguaacggcuccaucucugacagccugccuucagccagucccggguccccacauagcggaguccagaccucuuuggaaauguuuuauucaauagaucucagucccgugaaaugccgcagcccucugcagacgccauccucuggccaauucucgagcuccccgauucaggcgucagcaaagaaauacaguuuagguucuaucacuagccccuccccuauuucaagcccaaccuucucucccaucgaguuucagaucggggagacaccucuguccgaacaacgaaaguucacugugcacaguccagacgccagcucuggaaccaauuccaacggcauuacaaaucccuguauaagaucaccguauaucgauggcugcaguccuauuaaaaacuggagcccaaugaggcuccagauguacuccgggggaacccaguaucggacgucggucauccagauacccuuuacucuugagacacaaggugaagacgaggaagauaaggagaauauuccuucuaccgacguuagcucacccgcuauggaugccgcaggcauccaucugcgucaguucaguaacgaggcuuccacucacgggacacacuuggugguaaccgccaugucugugacgcagaaccagagcuccgcgucagaaaaggagcuagcccugcuccaagacgucgaacgcgagaaagacaauaacaccguggauaugguugacccaaucgaaauugcagaugagacaacuuggaucaaggagccuguggacaauggaagccugcccaugaccgauuuugucaguggcauugcuuucucuauagaaaacucccauauguguaugagcccacuugccgagucgucagugaucccgugcgaaucuaguaauauucagauggacuccgguuacaacacacagaauugugggagcaacaucauggauacuguaggcgcugagucuuacugcaaagagagcgacgcccagaccugugaaguugaguccaagucacaagcauuuaauaugaaacaggaucacacaacccagagaugcuggaugaagacugccaguccuuuccagugcagcucucccuga

SEQ ID NO: 53441 - RNA, 780 nt, Artificial Sequence
  derived and/or modified sequence opt3 from BPGM__Homo_sapiens__NP_001280014
augagcaaguacaaacugaucaugcucagacacggcgagggggccuggaacaaggaaaauagguucugcuccuggguggaccagaaacuuaacucugagggaauggaagaggcucggaauugugguaagcaacugaaagcauugaacuuugaauuugauuuagucuucaccucaguucugaaucgcaguauucauacagccuggcuaauacucgaggagcugggccaggaaugggugcccguagagagcuccuggcgacuuaacgaacgucacuauggggcgcugaucggauugaauagagagcagauggcucucaaccauggcgaggaacaggugaggcuguggcggcgcucuuacaaugucacuccuccaccgauugaggaaucgcaccccuauuaccaagagaucuauaacgacagaagguacaaggugugcgauguuccucuggaccagcucccacggucagagagcuuaaaggaugugcuggaacgccuuuugcccuauuggaaugagcgaauugccccugaaguccugagagguaaaacgauccuaauaagugcacaugggaacuccucuagggcccuccugaagcaccuugagggaaucagcgacgaagauauuaucaauauuacccugccaacaggcgugcccaucuugcucgagcuggacgaaaacuuacgggcuguaggcccucaccaguuccugggggaucaggaggcaauacaagccgcuauuaaaaagguugaggaccagggaaaagugaagcaggccaagaaauga

SEQ ID NO: 53442 - RNA, 771 nt, Artificial Sequence
  derived and/or modified sequence opt3 from BPIFA1__Homo_sapiens__NP_057667
auguuccagaccggcgggcugaucguguuuuacggacuccuugcccaaacaauggcucaguucgguggccugcccgucccuuuggaccagacuuuaccacugaacguuaauccggcacuaccccucagcccuacggggcuggccggaucccuuaccaacgcgcugucuaauggcuugcucucaggugggcugcugggcauucucgagaacuuaccacugcuugauauauugaagcccggaggcgggacaaguggaggucugcuaggcgggcuccugggaaaagugacuagcguaaucccuggccuuaauaacauuaucgacauuaaggugaccgauccacagcuguuggaacucggucugguccaaucccccgacgggcacagauuauaugugacaaucccucugggaauaaaacuccagguuaauaccccacuugugggcgcuucucuguugaggcuagccgucaagcuggauaucacugcagagauucucgccgugcgggacaaacaggaacgcauccaucugguacuuggcgauugcacacacucgccggggucacugcagauuagcuugcucgacggacugggucccuuaccuauccaaggccugcuagauagucucaccgggauacugaacaagguucuuccagaguuggugcagggaaaugucuguccccuggugaacgaagugcuccgaggccuggacauuacgcuuguccaugauaucguuaauaugcugauucacgguuugcaguuugugaucaagguauga

SEQ ID NO: 53443 - RNA, 750 nt, Artificial Sequence
  derived and/or modified sequence opt3 from BPIFA2__Homo_sapiens__NP_542141
augcugcagcucuggaagcuggugcuuuugugcggcgucuuaaccgggacaagcgagucccugcuagacaaccucggaaaugaucugucuaacguuguggacaaacuugaacccguacugcacgaggguuuggaaacuguggauaauacgcucaagggcauccuggagaaacugaaggucgaccucgggguguuacaaaaaucaagugccuggcagcuggcuaagcagaaggcacaggaagccgagaaacuuuugaacaauguuauuagcaagcugcuaccuaccaacacagauauauucggacucaaaaucuccaauucucugauucuugacgugaaggcggagccaaucgaugacggcaaaggucugaacuugucguuuccggucacugcuaaugugaccguagccgggcccauuaucggacaaauaaucaaccucaaggcaucacuggauuuacugacagccguuaccauugaaacugacccucagacacaucagccaguggcuguccucggcgagugugcaagcgaucccaccaguaucucccuuucucuguuggacaagcacagccagauuaucaauaaauucgugaacuccgugauaaauacgcuaaagucaacugucaguagccugcuccaaaaagaaauuugcccucugaucagaauuuuuauccauucucuugauguuaacgugauccagcagguaguggacaauccacagcacaagacccaacugcagacauugauuuga

SEQ ID NO: 53444 - RNA, 657 nt, Artificial Sequence
  derived and/or modified sequence opt3 from BPIFA3__Homo_sapiens__NP_001035904
augaugugcccccuguggagacuccuuaucuuccugggcuuguuagcccugccucuagcuccacacaagcagccguggcccgggcucgcacaagcccauagggacaacaaaagcacccuggcgcggauuauagcucagggacuuaucaagcacaaugccgagucccgcauucagaacauccauuuuggugaucgacugaaugcaucugcccagguggcuccuggcuuggucggguggcucauuucaggacguaaacaccaacagcagcaggaaaguaggagcuucgacaacaauaucguuaagaugugugcacauauguccauagugguagaguuuuggcuggaaaaagaugaguucggcagacgggaccuggugaucgguaagugcgaugccgaaccaucuucgguccacguggcuauucucacagaggccauucccccuaagaugaaccaauuuuuauacaaucugaaagagaaccuucagaagguuuugccacacaugguggaaucacaggucuguccccugaucggggagauccuaggacagcucgacgugaaacugcuuaagagccugauagaacaagaggcggcacaugagccuacucaccaugaaacgagucagccauccgccugccaggcuggcgagucuccgagcuga

SEQ ID NO: 53445 - RNA, 1455 nt, Artificial Sequence
  derived and/or modified sequence opt3 from BPIFB1__Homo_sapiens__NP_149974
auggccggccccuggaccuucacacugcucugcgggcuucuggcugcaacuuugauccaggccacguuaagcccuaccgcggugcugauucuaggaccaaaggucauaaaagagaagcucacacaagaacugaaagaccacaacgcuacuuccauccuucagcagcugccguugcucucugccaugagagagaagcccgccgguggcauuccuguucuggggucacuggugaauaccguacucaaacauaucauuugguuaaaggugaucacagcaaacauacugcagcuucaagucaagccaagugcuaaugaucaggaauugcuggugaaaaucccccuagacaugguugcaggauuuaacaccccucucgugaagacuauugucgaguuccacaugacaaccgaagcccaggcuacgaucaggauggauacuagcgccuccggcccaacccggcuggugcuuucugacugugcgacaucgcaugguucacugcgcauucaguugcuccacaaacugagcuuuuuaguaaaugcacuggccaagcaaguuaugaaccuccuugugcccagucugccuaauuuggucaaaaaccagcuaugcccagugaucgaggcuuccuucaaugggauguacgccgaucugcuccagcuggugaaggucccgauaucucuuagcauugaccgacuggaguuugauuugcucuaucccgcaaucaagggagacacuauucagcuguacuuaggcgcuaaacugcuagauucccaaggcaagguuaccaaaugguucaacaauucagccgcgagucucacaaugccuacccuggacaacaucccauuuagccuuaucgugucucaggauguagugaaggccgcagucgcugccguguugucccccgaagaguucaugguucugcucgacucagugcugccugaaagcgcucaucgucuuaaaaguucuauugggcugauaaaugagaaggccgcagauaaauugggauccacgcagaucgucaagauucucacucaagacacaccagaguuuuucaucgaccagggucacgccaagguggcucagcugauaguauuagaaguuuuucccagcucggaggcgcugagaccgcuauucacccucggcauugaagcaucuuccgaggcccaguuuuauacuaaaggggaucaacugauccuuaacuugaauaacaucucaagugacaggauucagcugaugaacagcggaaucggcugguuccagccugaugugcucaagaauauuauaacagaaaucauucacuccauccuguuacccaaccagaaugguaaacugcggucuggggucccagugagccuugucaaggcuuugggauucgaggccgcagagucaagucucaccaaagacgcccuggugcuaacgccugcuucccuguggaagcccagcucuccaguuucacaauga

SEQ ID NO: 53446 - RNA, 1377 nt, Artificial Sequence
  derived and/or modified sequence opt3 from BPIFB2__Homo_sapiens__NP_079503
auggccugggcuagcagacugggccuccuucuggcauuguuacugcccguggucggggccuccaccccuggaacaguugugaggcuaaacaaggcggcucucucuuacguaucagagaucgguaaagccccacugcagcgggcacuucaagugacugucccgcacuuccuggacuggaguggcgaagccuugcagcccacgcgcauucgaauacucaaugugcauguuccucgucugcaccugaaguuuaucgcuggguucggagugagacucuuagcagccgcuaacuuuaccuucaaagucuuuagggccccagagccccuggaacuuacauugccuguggagcugcuagcggauacucggguaacccagagcuccauucgcacaccaguugugucuaucucggcaugcucacucuucagcggccaugccaaugaauuugacgguaguaacuccaccucucacgcucugcuuguccuggugcagaagcauauuaaagccguguugagcaauaagcucugucuguccaucucaaacuuaguccaagggguuaaugugcaccugggaacucucauaggccuuaaccccguaggcccugagagucagaucagauauagcauggugucugucccaacagugaccuccgauuacauuucacuggagguuaaugcaguguuguuccuacuggggaagccgaucauucuccccacggacgcuacuccuuuuguccugccaaggcacgugggaaccgaagguagcauggccacaguaggccuuagucagcagcuguucgauucugcguugcuccuguuacaaaaagccggggcacugaaccuagacaucacuggacagcuccgguccgaugacaaucugcuuaacaccagcgcuuugggccgccugauacccgagguugcccgacaguuuccugaaccaaugcccgugguccucaaggugagacugggugcuacaccggucgccaugcuucauaccaauaacgcaacgcugagguugcagccuuucguggagguucucgccacugcuucuaauucggcguuucaaucccuguucucauuagaugugguagucaaccugcggcuacagcucagugugagcaaaguuaagcugcaggggacaaccuccgugcuuggagacguccaauugacuguggcaucuagcaacguaggcuucauugauacagaccaggugcguacccugaugggcacgguuuuugagaaaccccuccuggaucacuuaaaugcccugcuugcuauggggaucgccuugccaggagucgugaaccuccauuauguggcaccugaaauuuucgucuacgaggguuauguugugaucucaaguggccuguuuuaccaguccuga

SEQ ID NO: 53447 - RNA, 1524 nt, Artificial Sequence
  derived and/or modified sequence opt3 from BPIFC__Homo_sapiens__NP_777592
augugcaccaagacaauccccgugcuguggggcuguuuccuccuuuggaaccuguacgucagcuccucucagacuauuuauccugggauaaaagccagaaucacgcaaagggcuuuggacuacggaguucaggcagguaugaagaugauugagcagauguuaaaagaaaagaaacugccagaucuaucaggcagugagagccucgaauuucugaagguggacuauguaaauuacaacuucuccaauaucaagauuucugccuuuucguucccgaacaccucacuugcguuugugcccggggucggaaucaaagcucugacaaaucacggcacugccaacauaagcaccgauugggguuucgagaguccuuuguuucaggacacagggggagcagaucucuuccuguccggcguguauuuuaccggcaucauuauccugacucggaaugacuucgggcauccaacacucaaguuacaagauugcuacgcccagcugucucacgcucauguuagcuuuuccggagaacuuucaguguuguauaacaguuucgcagagcccauggagaaaccuauucugaagaaucuaaacgaaaugcucuguccaaucauagccagcgaggucaaagcucugaaugccaaccuuucuacccuggaaguguugacgaagauugacaauuacacucuccuggauuacuccuuaaucucaagccccgagauuaccgagaacuaucuggaccucaaucuuaaggguguauuuuacccucuggaaaacuugacagauccaccguucagucccguuccuuucgugcuaccagagcgcucuaacuccaugcuguauaucggcaucgcggaauacuuuuucaaaagcgcaucguuugcccacuucacugcuggggucuuuaaugugacccucucuacagaggaaauuuccaaccauuucgugcagaauagucagggacugggcaacguccuuagucgaauagccgagaucuauauucugagccaacccuuuaugguucguaucauggcaaccgagccuccaauaauuaauuugcagcccgguaacuucacgcucgacaucccggcuuccaucaugaugcugacucagccuaaaaauucuacaguggaaaccauuguaagcauggauuuuguggccucaacuucagucggguuagugauccugggacagaggcuaguuugcucccucagccugaacagauuccggcuugcguugcccgagucuaaucgcucaaacauugaagugcugagauuugagaauauacucaguagcauccugcacuucggcguccuuccacuggccaacgcaaaguugcaacagggcuuuccucucuccaauccccacaaguuccuguucgugaacucugacauugaaguauuagagggguuucugcuaaucucgacagaccucaaauacgagaccagcuccaagcagcaaccaucauuccauguuugggaaggacugaaucuuaucaguaggcaguggcgggguaaaucugcucccuga

SEQ ID NO: 53448 - RNA, 1464 nt, Artificial Sequence
  derived and/or modified sequence opt3 from BPI__Homo_sapiens__NP_001716
augagagagaacauggccaggggccccugcaaugcuccucggugggcaagccugauggugcucgucgccaucgggaccgcgguuacagcugccgugaacccaggaguagugguccgcauuucccagaagggucuugacuacgcaucucaacagggcacugccgcucugcagaaagaauugaagcgaauaaaaaucccggauuauucagacaguuucaagauuaaacacuuagggaagggacauuacagcuuuuauuccauggauauccgugaguuccagcugcccucuucgcaaauuucaauggugccuaauguuggccuaaaguuuagcaucaguaacgcaaauauaaaaaucuccgguaaguggaaagcccagaagagauuccucaaaaugucugggaacuuugaccugagcauugaaggaauguccaucucagcugaucuuaagcugggcaguaauccaacgagcggcaagcccaccauuacauguucuuccugcucaagccacaucaacagugugcauguccacauaucuaaauccaagguggggugguugauucaacucuuccauaaaaagaucgagagcgcccugaggaauaaaaugaacucgcagguaugugaaaagguuacuaauucuguguccucagagcugcagccuuacuuucagacccucccagucaugacaaaaauugacaguguggcgggaaucaacuaugguuuaguggcacccccugccaccacugcugagacacuggauguccagaugaagggcgaguucuacagcgaaaaucaccacaacccaccgcccuuugccccuccaguuauggaguuccccgcagcucaugaccggaugguguaucuuggguuguccgauuacuuuuucaauaccgccggacugguauaccaggaagcgggcgugcuaaagaugacgcuccgcgacgauaugaucccuaaagagucuaaguuuagacugacuaccaaauucuucgguacauuucuuccagaagucgccaagaaauuccccaacaugaagauucaaauacacgugagcgcaucaacuccgccucaucugaguguucagcccaccggguugacauuuuauccagcuguggacguccaggccuucgcugugcucccuaacuccagccuggccucuuuauuucugaucggaaugcacaccacgggcucaauggagguaagugcagaaagcaauaggcucguuggcgagcuuaagcuggaucgguugcuacuggaacucaaacacuccaacauugggcccuucccaguggagcugcuucaagacaucaugaauuacauaguccccauucugguguugccucgcgucaacgagaagcuccagaaaggauuuccacugccgacucccgcccgagugcaguuauauaauguugugcugcagccucaucaaaacuuccuacucuuuggugcugacguagucuacaaguga

SEQ ID NO: 53449 - RNA, 762 nt, Artificial Sequence
  derived and/or modified sequence opt3 from BPNT1__Homo_sapiens__NP_001273078
augagcaucugcuccucucuggccagaaaguuccccaaacucaccauuauaggcgaggaagaccuuccuucagaggaaguggaucaggagcugaucgaagacagucaaugggaggagauuuugaagcagccauguccgagccaguacuccgcuaucaaagaagaggauuuagucguuuggguggacccccuggaugggacaaaggaauauacugagggacuacucgacaacguaacggugcugauugguaucgcauacgagggcaaagccauagcgggggucaucaaucagccuuauuacaacuaugaagcuggaccagaugccgugcuuggcaggaccauuugggguguucugggguugggagcauuuggcuuccaacucaaggaggugcccgccggcaagcacaucauuacaacuacccggucucauucgaauaaacuggucacagacugcguggcugcaaugaacccugaugccguacugcgcguugggggagcugguaauaagaucauacagcucauugaaggcaaagccucagcguacguguuugcaagcccaggguguaagaaaugggauaccugcgcccccgaggucaucuuacacgcugugggaggcaagcugacugacauucaugguaacgugcuucaguaucacaaggacgucaaacauaugaauagugccgggguuuuggcaacacugcgaaacuacgauuacuaugcuucccgugugccugaaucuaucaagaaugcccuaguaccauga

SEQ ID NO: 53450 - RNA, 8712 nt, Artificial Sequence
  derived and/or modified sequence opt3 from BPTF__Homo_sapiens__NP_004450
augcgcggcaggcgggggagacccccuaagcagccagccgcuccggcagccgagcgaugcgcgcccgcuccuccacccccuccacccccuccaaccagcggaccgaucgguggccugcguuccagacacagggggucuucacggggacgcugggcagcagcccaagcugaaguggcacccaagacaagacucaguagcccuaggggcgguuccucuucgcggcgcaagccacccccuccacccccggccccucccucaacuagcgcuccagggcgaggaggcagaggcgggggagguggcaggacagggggaggcggugggggaggccaucuugcccggaccacagcggcacgucgcgccgucaacaagguuguguacgacgaucacgagagugaagaggaagaggaggaagaggacaugguguccgaagaggaggaagaggaagauggcgacgcugaggaaacucaggauucugaggacgaugaggaagacgagauggaagaggaugacgaugacagcgauuauccugaagagauggaggacgacgaugacgaugccuccuacuguaccgaaucaaguuucagaagccauucuacauauuccucaacccccgggaggcggaagccacgagugcaccgccccagaagcccuauucuggaggaaaaagacauaccaccguuggaguuucccaagaguucugaagauuuaauggucccuaaugagcauaucaugaacgugauugcaaucuacgagguucugaggaauuucggaacugugcuacggcucuccccauuucgcuucgaagacuuuugcgcugcccuggucagccaggagcaguguacacuuauggcggaaaugcacgugguacuguugaaggccguucucagagaggaggauaccucgaacacgacuuucggucccgcagaccugaaagauucuguaaauuccacccuguauuuuauugacggcaugacauggccugaaguccucaggguguacugcgagucagauaaggaauaucaccauguguuaccauaccaagaggcugaagacuaccccuaugggccggucgagaacaaaaucaagguucugcaguuccuuguggaccaguuuuugacuaccaauauagcccgugaggaacugaugagugagggaguaauccaguacgaugaccacugucgggugugccauaaacuaggcgaucuccuguguugcgaaacauguagcgcugucuaucaccuugagugcgugaagccuccacuggaagagguucccgaggacgaauggcaaugugaggugugcgucgcccacaaggugccugguguaaccgauugcguugcagaaauucagaaaaacaagcccuacauccgacaugagccaauuggguaugacagauccaggcgcaaauacugguucuugaaucggagacucaucauagaagaggauacggagaacgaaaaugagaagaaaauuugguauuacucuacuaaggugcagcuggccgaauuaaucgacugucuggauaaagacuacugggaggcugagcucugcaagauucuugaagagaugagggaagagauccaccgccauauggauaucacagaagaccugaccaacaaggcgcgaggcagcaauaaaucauuuuuggcagccgcuaacgaggagauucuagaaaguauacgggccaagaaaggagauaucgacaaugucaaguccccugaggaaacugagaaagacaagaacgaaacagagaacgauagcaaggacgcagagaaaaaucgugaagaguucgaagaucagucucuggagaaggacucagaugacaaaacccccgaugacgauccagaacaaggcaagagugaggagccgacggaagugggggacaaaggaaacagcgucuccgccaaucucggugauaacaccacaaaugcuacuucugaggaaaccucgccuagcgagggcagaucccccguggggugucugucagagacaccagacaguucuaacauggccgaaaagaagguugcaagcgagcuuccccaggaugugccugaggaaccuaauaaaacuugcgaauccucaaacaccagcgcgacaaccacuucuauucagcccaaucuggagaacuccaauaguagcucugaguugaacuccucacaaagugaaagcgcuaaggccgcagacgacccugagaauggagaaagggagucgcacacgccgguauccauccaggaagagauagucggcgauuuuaaaucugaaaaguccaacggugaacucucagagaguccaggggccggcaaaggagcuuccggcucuacacgcauuaucacccggcugagaaaucccgacagcaaguuaucccagcugaagucacagcaaguggccgcagcugcccaugaagcgaacaaacuauucaaggaggggaaagaaguucucguggucaacagccagggagagaucaguaggcugucuacuaagaaagaggugauuaugaaggguaauaucaacaauuauuucaaacuuggccaggaagggaaguaccgaguauaucacaaccaguacuccaccaauagcuuugccuugaacaagcaccaacaucgcgaggaucacgacaaacggagacaucuggcucacaaguucugucucacuccugcaggagaauuuaaauggaauggcucggugcacgguucaaagguucugaccauuucuacucuuaggcugacaauaacgcaguuggagaacaauaucccaaguuccuuccuccaucccaacugggccagccaccgugcuaauuggauuaaagccguccagaugugcucuaagccucgcgaguuugcacuggcguuagccauccuggaaugugcugugaagccgguggucaugcuacccaucuggcgggagagccucgggcauaccagacugcacaggaugacuuccauugaacgagaggaaaaagagaagguuaaaaagaaagagaagaagcaggaagaggaagagacaaugcaacaggccaccugggugaaauauacauucccagugaagcaucagguauggaaacagaagggcgaagaguaccgggucacuggauauggcggguggucauggauaaguaaaacccacguguaccgcuuuguuccuaaacuucccggaaacacgaaugugaacuacagaaagagcuuggagggcaccaaaaauaacauggaugaaaacauggacgagucugauaagaggaaaugcucccggucaccaaagaaaaucaagauugaaccugacagugagaaagaugaagucaaggguagcgacgcagcuaagggggccgaucaaaaugagauggacaucuccaaaauuacagagaagaaagaccaggaugugaaggaacugcucgacucugauucggacaaacccuguaaggaggaaccaauggagguugaugacgauaugaagacugagagccacgugaacugccaggaaucaucccaaguagacgucgugaaugugagugagggauuccaucugcgaaccucuuauaaaaagaaaacaaagagcuccaaauuagauggccugcuugaaagacgcaucaagcaguuuacuuuggaggaaaagcagaggcucgagaaaauaaagcuggaggguggcaucaaagggauuggaaagaccucaacgaacucuagcaaaaaucuaagugaauccccggucaucacaaaggcaaaggagggcugucagagcgacucuaugcgucaagaacagucaccuaacgccaauaacgaucagcccgaggaccugauucaggggugcuccgaaagugauagcucgguucuccggaugucugacccaucccacaccacuaauaaacuguaccccaaggacagagugcuugaugacguaagcaucaggucaccugagacaaaaugcccaaagcaaaacaguauagagaaugauauugaagagaaagugucugacuuggcuucccgcggacaggaacccagcaagucaaagaccaaaggcaacgauuucuuuaucgacgauaguaagcuggcgagcgccgacgauauugguacuuuaaucuguaaaaauaagaaaccucucauacaggaggaauccgacaccaucgucucuagcuccaagucagcacugcauucuagugugccgaaaucgacaaacgaucgagacgcuacgccacuuagcagagccauggauuucgaggggaagcugggaugcgacuccgagucuaauucaaccuuggaaaacagcuccgacacuguuaguauucaggauucuagcgaggaagacaugaucgugcaaaacucaaaugaguccauuagugagcaguuucggacaagggaacaggaugucgaggugcucgaaccccugaagugugagcuaguuagcggcgaaucuaccgguaacugcgaggaccgccugccugugaaaggcacagaggccaaugggaagaaacccucccaacagaagaaacucgaggaacguccagucaacaaguguucagaucagaucaagcugaaaaauacuaccgacaagaaaaacaaugaaaacagagagagcgaaaagaaaggacagcggacgucgacauuccaaauaaauggcaaggauaacaagccuaaaauuuaucuuaagggggagugcuugaaagagaucucugaaaguaggguaguguccggaaauguugagcccaaggugaacaauaucaacaaaauuaucccagaaaaugacauuaagagccugaccgucaaggagucagcuauacgcccuuucaucaacggcgaugugauuauggaagacuuuaaugagcgaaacuccucugagacuaaaagccacuuacucaguuccagcgaugcagaagguaacuacagagacucucuggagacccuuccgucaacaaaggaaagugacuccacucagaccacaacgcccagcgccucuuguccagagagcaauucaguaaaccagguggaggauauggaaaucgagaccagcgaagucaaaaagguuacuuccaguccuauuacaucugaggaagagagcaaucuguccaacgacuucaucgaugagaaugggcuacccauaaacaaaaaugaaaacgugaauggagagucaaagcggaaaaccgugaucacugaagucacaaccaugacgaguacuguggcgaccgagucuaagacaguuauuaagguagaaaaaggcgacaagcagaccguggucagcuccacugagaacugcgcuaaaucaacagugaccacaacuaccacgacaguuaccaagcucagcacuccaucuaccgguggcuccguggauaucauuagugucaaagagcaaagcaagacagugguaacuaccacggucacagacucgcugaccacuacagggggaaccuuggugacuuccaugacaguuucuaaggaauauucaaccagggauaaagugaagcugaugaaauuuagccgcccuaagaaaacgagaaguggcacugccuuacccuccuacaggaaguucgucaccaagucuagcaaaaagucaaucuuugugcucccgaaugacgaucugaagaaacuugcacggaaagggggaauacgugagguuccauauuucaacuacaaugccaaaccugcucuggacauuuggcccuacccaagcccccgcccuacauuuggcaucaccuggcgauauagauugcagacagugaagagucucgccggugucagccugaugcuaaggcugcuuugggccucucuccggugggaugacauggcggcuaaagccccgcccgggggaggcacuacccgcacggaaacaucagagacugaaaucaccacaaccgagauuauaaagagaagggaugugggcccauacgggauccgguccgaguauuguauucgaaaaaucauuugcccuaucggaguacccgaaacuccuaaggagaccccaacaccccagagaaaaggucugcgcagcucugcauugaggccuaagcggccagaaacgcccaaacagacuggcccggugauaaucgagaccuggguugccgaggaggaacuggaauuaugggagauucgugcuuucgccgaaagagucgagaaggagaaggcacaagcuguggaacagcaggccaaaaagaggcucgagcagcaaaaaccuacagugaucgcgaccaguacuacaucgccaaccuccagcacgacuucaacaauuucucccgcccagaaggucaugguagcaccuaucagcggguccgugaccaccggaacuaaaaugguucugacaaccaaggugggcaguccagcuacagucacuuuucagcaaaacaagaauuuccaucagacguuugccaccugggugaaacagggucagucaaacucugggguugugcaaguccagcagaaggugcuuggaauaauucccagcuccacaggcacaagucagcaaaccuucacgucguuucagccgcgcaccgcuacuguaacgauccggccuaacaccuccggcucugggggaacaacuucaaauagccaggugaucaccgguccccagauucgaccaggcaugacaguuaucagaaccccucugcaacagucgacuuuggggaaagcaauaauuaggacacccgucauggugcagccaggagcaccccaacaggugaugacgcagaucauucgcggccagccugucuccaccgccguuagugcuccaaacacugugucuagcacaccgggucaaaagucacucaccuccgcgaccucuacaaguaauauccagagcuccgcaucacagcccccucggccacagcaagggcagguaaaacugacuauggcccagcuaacgcagcugacccaaggacacggcggcaaccaggggcuuacaguggucauacagggacagggucaaacuaccggccagcuccagcugauuccccaaggggugacaguuuugccuggaccaggccagcaguuaaugcaggcugccaugcccaaugguaccgugcaaagauuccuguucacuccucucgcaacgacagccaccacugcuagcaccacaacuaccacagucucuacgaccgcggccgggacuggagaacagcgucagaguaagcuguccccgcagaugcaaguacaccaggacaagacacuuccacccgcacagagcucaucugugggcccugcugaggcccagccccaaaccgcacagccauccgcccagccucaaccccagacucagccacagucgccggcucaaccugaaguucagacacagcccgaggugcagacccaaacgaccgucagcagucaugugccaucugaggcccagcccacacacgcgcaguccagcaaaccucaggucgcagcccaaucacagccacagaguaacgugcaaggccagucccccguuagggugcagagcccuucucagacucggauccgcccgucaaccccaagccaacugucccccgggcagcagucucagguacaaacaacuaccagucagccuaucccaauucagccccauacaucguugcagaucccuagccaaggacagccccagucccagccacaaguggucaugaagcacaaugcuguuauugaacaccuaaaacagaagaaaucaaugaccccggccgagcgagaagagaaccagagaaugauaguguguaaucaagucaugaaguacauccuggacaagauugauaaagaagagaagcaggcugccaagaagaggaaacgggaggaaucuguggagcagaagcgcagcaagcagaacgccacuaaacucagugcucugcuuuuuaagcauaaagaacaauuaagagccgagauccugaagaaaagggcacucuuggacaaggaucugcagaucgagguacaggaggagcucaaacgagaccugaagauuaagaaagaaaaggaucuuaugcagcuggcgcaagccacggcuguggccgcaccuugucccccaguuacaccagcucccccagccccucccgcaccgccaccuucacccccacccccuccggccgugcagcacaccgguuugcuaagcacuccaacccugcccgcugcgucucagaaacggaagcgugaggaagagaaagacagcuccaguaagagcaagaaaaagaaaaugauaucuacaacgucaaaggagaccaaaaaggauacuaagcucuauugcaucugcaaaacaccuuacgacgaauccaaguucuauauuggcugcgauagaugucagaauugguaccaugggcgcugcgucggaaucuuacaaagcgaggccgaacugauugacgaguacguguguccccagugccagaguaccgaagaugcaaugacuguccuuacaccacugaccgagaaagacuaugagggccucaagaggguguugcggucucugcaagcucacaaaauggccuggccuuuucucgaacccguugacccaaacgaugccccugacuacuaugguguaaucaaggagccgauggaucuggcaacaauggaagagagagugcagcgcagguacuaugaaaaacuuacugaguucgucgcugacaugaccaaaauauuugauaauugucgauacuauaaccccuccgacucgccauucuaccagugcgccgaggugcuagaauccuuuuucguucagaagcugaaaggguuuaaggcgucacggucccauaauaacaaauugcaaucuacggcuaguuga

SEQ ID NO: 53451 - RNA, 321 nt, Artificial Sequence
  derived and/or modified sequence opt3 from BPY2__Homo_sapiens__NP_004669
augaugacccuggugcccagagccaggacacgggcuggccaggaccacuacagccauccuugcccacgcuucucccaaguccuccuuacugaggggaucaugacguauugucugaccaagaacuugucugauguuaauauuuuacaccgacugcucaaaaacggaaaugugcguaacacacuacugcagucaaagguaggucuucugacuuacuaugugaaauuguacccgggcgaagucacccuccugacaagacccaguauacagaugaggcugugcuguaucaccgggagcgugucccggccucgcucucagaaguga

SEQ ID NO: 53452 - RNA, 2301 nt, Artificial Sequence
  derived and/or modified sequence opt3 from BRAF__Homo_sapiens__NP_004324
auggccgcucugagcggcgggggagguggcggggcagagcccggacaggcccucuucaacggcgacauggaaccugaggcgggugcuggggccggagcagccgcuuccucugcagccgauccagcuaucccggaagagguguggaauauuaagcaaaugauaaaacuuacccaggaacacaucgaggcccuguuggacaaguuuggcggcgagcauaaucccccuucaauuuacuuagaagcguaugaggaauacacaaguaaacuggaugcacuacagcagagagagcaacagcuccuggagagccuugggaacggaacugacuucuccgucucuucgucagccagcauggauacgguuaccaguuccucuagcuccucacugaguguguugccaagcucucucuccguauuucagaaccccacagacguggcuaggucaaauccuaagagcccacagaaacccaucguccggguguuccugccuaacaagcaacgcacuguugugccagcccgaugcggugucaccgugcgugauagucugaagaaagcacucaugaugagaggcuuaauuccggaauguugcgcuguauauaggauccaggacggggagaagaaacccauaggaugggauacagacaucucuuggcugaccggcgaggaacuucacguugaaguguuggagaaugucccucugacuacacauaacuuugugcggaagaccuucuuuacgcuagccuucugugauuuuugccgcaaacuccuguuccaggguuuuagaugucagacuugcggguacaaguuccaccaaagguguuccaccgaggugccacuuaugugcgucaauuaugaccagcuggauuugcucuuuguuagcaaguucuucgaacaucaccccauuccucaggaggaagcgucgcuggccgagacagcauuaacuucuggauccucaccaagugcucccgccagcgacuccaucggcccgcaaauucugaccucuccuagccccucaaaaaguaucccaauaccucagcccuuucggccagcugacgaagaucaccgcaaccaguucggccagcgagacagauccagcucugcccccaaugugcauauuaacacaaucgagccuguaaauauugaugaccucaucagggaucaaggguuucggggagacgguggcucaaccacggggcuuagugcaacuccaccggccagccugcccggauccuugacaaacgugaaggcucuacagaaaucuccuggcccacagcgugagcgcaagucgagcuccucaagugaagauagaaauaggaugaaaacccugggucggcgagacucuagcgaugacugggagauccccgaugggcagauuacugucggccaacgcauaggauccggcucauucgggacaguguacaagggaaaauggcacggugacguugcggugaagaugcucaacgucaccgcaccuacgccacagcagcugcaggccuuuaagaacgaagugggcguacuuagaaaaaccaggcauguuaauauccuguuguucaugggguauagcacaaagccccaacucgcuauugugacucaguggugugagggaucuucccuguaccaccacuuacauaucauagaaaccaaauuugagaugauuaagcugaucgacaucgcccggcagacagcacagggcauggauuaccuacacgccaaaaguauuauccaucgcgaccucaagagcaacaauauuuuccugcacgaggaucuuacugucaagauaggugacuuuggguuggcuaccgugaaaucuagaugguccggcucacaucaauucgaacagcugaguggaagcauccucuggauggccccggaggucauuaggaugcaggauaagaacccuuauucguuucaauccgacguguacgcauucggcaucguucuguaugaacuuaugacagggcagcugccauacucuaauaucaacaaucgugaucagauuauauuuauggugggacgggguuauuugagccccgaccucucaaaaguacgaaguaacugcccuaaggcgaugaaaagacugauggcugaguguuuaaagaagaaaagggaugagcgcccccuguucccacagauccuagccuccauugaacuccuggcacggucucuuccuaagauccacagaagcgccuccgagcccucauugaauagggcuggcuuccaaaccgaagacuuuagccuguacgccugcgcaaguccaaaaacuccgauucaggcugggggauauggcgccuucccuguccacuga

SEQ ID NO: 53453 - RNA, 1779 nt, Artificial Sequence
  derived and/or modified sequence opt3 from BRAP__Homo_sapiens__NP_006759
augagcgugucccuggucguuaucagacucgagcuugccgaacacucucccgugccugcuggcuucggguuuucagcagccgcgggagagaugagugacgaagagauuaagaaaaccacacuggcuagcgccguagcaugcuuggaagguaaguccccaggcgagaaaguggccauaauccaucagcacuuagggaggcgggagaugacugaugucauuaucgaaacgaugaagucuaacccggacgagcugaaaaccacaguggaagaacgcaagucgucagaggcuagccccacugcacaacgaaguaaggaucauuccaaagaauguauuaaugccgcuccugacucuccaagcaagcagcuacccgaucagaucuccuucuuuucaggaaacccuaguguugagauagugcacggcaucaugcaucucuacaaaaccaauaagaugacaagccugaaagaagacguccguagaucugccaugcuuugcauucugaccgugccagcggcaaugacuucccacgauuugaugaaguucguagcccccuuuaacgagguuaucgaacagaugaagauuaucagggacucaacaccuaaucaauauauggugcucauaaaauuccgggcucaggccgaugcagacagcuuuuacaugaccuguaacggucgccaguucaauaguauugaggaugacgucugccagcugguguauguggagagagcugaaguccugaagucugaggauggggccucccucccaguuauggacuuaacggaacugccgaaauguacugugugccuugagaggauggacgaaagcguaaacggaaucuugaccacacuguguaaucacucguuucauucucaaugccuacagcggugggaugacacuaccugucccgugugccgcuacugucagacaccugagccagucgaggaaaacaagugcuucgagugcggcgugcaggaaaaucucuggauuugucugaucugcggccacaucggguguggacgauauguuuccagacaugcguacaaacacuuugaggaaacccaacacacguaugccaugcagcuuacuaaccauagggugugggauuacgcuggugacaauuacguccaccggcugguggcaucaaagacagauggcaaaauuguacaguaugagugcgagggggacaccugucaagaagagaagauagaugccuugcagcucgaauacaguuaucuguuaacuagccagcuggagucccagcguaucuacugggagaacaagauuguucgcaucgaaaaagacacagcugaggaaauaaauaacaugaagaccaaauucaaggagacgauugaaaaaugcgauaaccucgagcauaaacuuaaugaccuguugaaggagaagcaaucuguggaaagaaaguguacccagcuaaacacaaaagucgccaagcugacuaaugagcucaaagaggagcaggaaaugaacaagugccugagggcaaaucaggugcuucugcaaaacaaguugaaagaggaggaacggguccucaaggagaccugugaucagaaagaccugcagaucacagaaauccaggagcaauuacgagacgugauguuuuaucuggaaacucagcagaagauuaaucaccuacccgccgagacccgccaggagauccaagaaggacagauuaacauagcuauggcgagcgcaucaaguccugccuccagcggcgguucugggaaacucccaucaagaaagggaaggaguaagcggggcaaauga

SEQ ID NO: 53454 - RNA, 2466 nt, Artificial Sequence
  derived and/or modified sequence opt3 from BRAT1__Homo_sapiens__NP_689956
auggaccccgagugcgcccagcugcucccugcucuuugugcagugcuggucgauccaagacaaccgguugccgacgauaccugcuuggaaaaguuacuggacugguucaaaacagugacugagggcgaaagcuccguagugcuacuccaggagcaccccugucuggucgaacuucugucucauguguugaagguucaggaucucucaaguggggugcugagcuuuucccugaggcucgcgggaacguucgcugcccaggagaacugcuuucaauacuuacagcagggugagcugcuuccuggcuuguucggggaaccaggaccccugggccgggcaaccugggccgucccuacagugcgcucugguuggauccaggggcuacgaucgcucgcucaacacccaucagcacugcguuuucuugccgaccauggagcuguagauacuauuuucagccugcagggcgacaguuccuuguuuguugccucugcggcaagccagcuccuggugcacgucuuagcccuguccaugagaggcggggcugagggacagcccugucucccugguggcgauuggccagccugcgcacagaaaauaauggaccauguggaagagucacuuuguagugcugccaccccgaaggugacacaagcgcugaaugucuugaccacuacauucgggaggugccagagccccuggaccgaggcccuauggguucggcugucuccucgcguggcaugucuccuggaaagagauccaauccccgcugcccacuccuuuguagaccuucuguugugcguggcuaggucaccugucuucagcaguucugauggaucccucugggagacgguggcccgggcacugagcuguuuaggcccaacucacauggguccccuggcccuagggauucucaaacuggaacauugcccgcaagcgcuucgcacccaggcuuuucagguuuugcugcagccucucgcaugcgugcugaaggccacaguccaagcucccggaccaccuggccuucuggacggcacugccgacgaugcaaccacaguggacaccuugcucgccucgaagucuuccugugcugggcuguuaugccgaacgcuggcccaccuagaggaacuccagccccugccacagagacccucaccuuggccacaggcaagucuuuugggagcgacuguaacaguucugaggcucugugaugguagcgcugccccggcauccucugugggcgggcaucugugcggaaccuuagccggcuguguccgggugcaacgugcugcccuggacuuccuugguacuuugagccaggggacaggcccccaggagcucgucacccaggcacuggcugugcuacuggagugccucgaaucaccuggaaguuccccaacgguucugaaaaaggccuuucaagcgacccuucgcugguugcugagcucucccaaaacaccuggcuguucagauuuagggccacucaucccccaguuccugagagagcuuuucccggugcugcagaagagguugugccacccuuguugggaaguacgggacagugcccucgaguuucugacucagcuaagccgacacuggggaggucaagcugauuuccgcugcgcacugcucgccuccgaagucccacagcuggcccuucaguugcugcaagaccccgagucuuaugugagagcuucggcaguuaccgcgaugggccaguuaagcucccaggggcuccaugccccuacaucacccgagcacgcugaagccaggcagagucuguuucuugagcugcuacauauucucucuguggauagcgaaggauucccacggcgcgcagucaugcaaguguuuacugaguggcugagagacggccacgcugaugccgcacaggacaccgaacaguucguagccacaguguugcaggcugcguccagggaccuggauugggagguucgugcccaagguuuagagcucgcacuggucuuucuugggcagacccugggcccuccccggacucauuguccauacgcuguggccuugccggaaguggccccugcucagccccucacggaggcacugcgagcccuaugccacgucggacuguucgacuuugcguucugcgcucuuuuugauugugacagaccaguugcccagaaaucaugcgaucuccuguuguuccugagggacaagaucgcaagcuauucuuccuuacgcgaagcccggggcagucccaacacagcuagcgcagaggccacccucccuagauggagggcgggggagcaagcucagccacccggagaucaggaaccugaggccgugcuggcaaugcuucgcucucuggacuuggaaggucuccgauccacucuggccgagucaagugaucacguggaaaagagcccgcaaucgcuacugcaggacaugcuugcuaccggcggguuucuccagggagaugaggccgacuguuacuga

SEQ ID NO: 53455 - RNA, 5592 nt, Artificial Sequence
  derived and/or modified sequence opt3 from BRCA1__Homo_sapiens__NP_009225
auggaccugagcgcccucagaguggaggaaguccagaacguuaucaaugcuaugcaaaagauucuugagugccccauaugucuggaauugaucaaagagccuguguccaccaagugcgaucacauuuucuguaaauuuugcauguuaaagcugcuaaaccagaaaaagggcccaucucaguguccgcucugcaagaaugacaucacaaaaaggucacugcaggaaaguacucgguucagccaacuuguagaggagcuguugaagauuaucugugcauuucagcucgauacggggcuggaauacgccaacuccuauaauuucgcgaaaaaggagaacaauucucccgaacaucugaaagacgaggugucgauaauccagucaaugggauaccgcaaccgagcuaagcgucucuuacagagcgagccugaaaauccaagucugcaagagaccucccuuucuguccaguugagcaaccuggguacagugagaacucuaaggaccaagcagcggauucagccccaaaaaacauccguuuauaucgaacucggcucagauaguagcgaggacaccgugaauaaggccacuuacugcucugucggggaucaggaacugcuucagauuacaccucaaggaacccgcgacgagaucucccuggauucagcaaaaaaggccgcuugugaguuuagcgaaacggacgugacuaacaccgagcaccaucagccaaguaauaacgauuugaauacaacugaaaaaagagcagccgagaggcaccccgaaaaguaucagggcucuuccguaagcaaccuccauguugagccuugcgguaccaacacacacgcuucgucucugcagcacgagaauuccucauuacugcucaccaaagaccggaugaacguggaaaaggccgaguucuguaauaagaguaaacaaccagggcuugcgcgcagccagcauaaccgaugggcaggauccaaggaaacgugcaaugauagaaggacuccgucuacagagaaaaaggucgaccugaacgccgaccccuugugcgaacggaaagaguggaauaagcagaagcuaccuuguagcgagaacccacgugauaccgaagacgugcccuggauaacucugaauucaaguauucagaaagugaacgagugguuuucccgcagcgaugaacuccugggcucugacgauucacacgacggcgagagugagagcaaugcuaaggucgccgauguucuugacgugcugaacgaaguagaugaguacuccgggucuucggaaaaaaucgacuugcucgcaagcgauccucaugaggcucugauuugcaaguccgaaagagugcacucaaaaagugucgagucuaauaucgaggacaagaucuucggaaagacauauaggaaaaaggccagcuuaccaaaccugucccacgugaccgaaaaucuaauuauaggugcguuuguuacggagccccaaaucauucaggaacggccgcucaccaacaaacugaagcgaaaacgcagaccuacaucaggccuucaucccgaggacuucaucaagaaggccgauuuggcagugcagaaaacuccagaaaugauaaaccaggggaccaaucaaacagagcagaacggacaggucaugaauauuacuaacagcggccacgagaauaagaccaaaggugacucuauccagaacgaaaagaauccuaaccccaucgagucccuggaaaaagagagugcuuuuaagacaaaagccgaaccaauuagcucuuccaucucaaauauggagcucgagcugaacauucauaauaguaaggcucccaagaaaaacaggcuucggcgcaagagcucgaccagacacauacaugcccuggaauuggugguauccaggaaucucucuccuccaaacuguacugagcugcaaaucgauagcugcucaaguuccgaagagauuaaaaagaaaaaguacaaucagaugccgguucgucacucucggaacuuacagcugauggaggggaaggaacccgcaacgggagccaaaaagagcaacaaaccuaaugagcaaacauccaagcgacacgacucagauaccuucccagaacuaaaacucacuaacgcucccggcagcuuuaccaaguguaguaauacaucugagcugaaggaauucgugaacccuucccuuccaagagaggagaaagaagagaaguuggaaaccgucaaagugagcaauaacgcggaggaccccaaggaucugaugcucucgggcgaaaggguccugcagacugagcgcucaguggagucuaguuccaucagcuuaguuccggggacagacuacggaacgcaggaaucuaucagccugcuugagguguccaccuuggguaaagcaaagacugaaccuaauaagugcguaucacagugugccgcuuucgagaacccaaaaggccucauucaugggugcaguaaggauaaucggaacgacacagaaggauuuaaauauccccugggccacgaggucaaucauagcagagagaccucuauagaaauggaggaauccgagcuagaugcccaauaccugcagaacacauucaaggugucaaaaaggcagaguuuugcaccuuucagcaaucccgguaacgccgaggaagagugugcuacuuuuuccgcccacucugggucgcucaagaaacagagcccaaagguuaccuucgaaugcgagcaaaaggaagagaaucagggcaaaaacgagucaaacaucaagccugugcagacggucaauauuaccgcaggauuucccgugguaggccagaaagacaagccaguggauaacgcgaaauguuccaucaaggggggaagucgcuucugccugucuagccaauuucgagguaaugaaacaggccuuauuacuccgaacaagcacggguugcugcagaauccuuaucggauccccccauuauuccccauaaaauccuuuguuaagaccaaaugcaagaaaaaccuccuggaggaaaauuucgaggaacauucaaugucuccugagcgugagaugggaaacgaaaauaucccaagcacagucaguacuauuuccagaaacaauaucagggagaacguguuuaaggaagcuagcucuucaaauauuaacgaggugggcuccaguaccaaugaagucgguagcucgaucaacgagauagggucuuccgacgagaauauucaggccgaacuuggccgcaaccggggacccaagcugaacgcaauguugagacucggcguucugcaaccugagguguacaaacagagccuaccggggucaaauuguaagcacccagaaaucaaaaagcaggaguaugaggaagugguacagacggucaacacagacuucagucccuaccugauuucugauaaucucgagcaaccuaugggauccagccaugccucacaggugugcagugaaaccccagacgaucugcuugacgauggugagaucaaagaagacacuagcuucgcugagaacgauauaaaggaguccucugccguuuuuagcaaguccgugcagaaaggcgaauugucaaggucucccaguccuuucacacacacccaucuggcacagggguaucgacgcggagcuaagaaauuagagucgagcgaagagaaucucuccucugaagacgaggagcugccguguuuucaacaccuucuguucggcaaggucaacaauauccccucacagagcacucggcacuccaccguggccacagaaugccuaaguaaaaacacggaggaaaaucuccugucuuugaagaacagccugaaugauuguucaaaccagguuauuuuagcgaaggccucccaggagcaucaccucagugaagagaccaaaugcagcgcuucucuguuuuccucacaauguagcgagcuugaagaccugacugcaaauacaaacacccaggauccauucuugaucgguucgucuaagcagaugagacaucagagugagucccaaggggugggccucagcgacaaagaacugguaucagaugacgaggagaggggaacaggccuagaagagaauaaccaggaagagcaguccauggacucuaaccugggggaagccgcuagcggaugcgagagugagacuuccgucagcgaagauuguucuggccuuucaagucaauccgacauucucaccacgcagcagcgugauacaaugcagcacaaucugaucaaguugcaacaggagauggccgaacuggaggcaguguuagaacagcaugguagccagccuucuaacucguaccccucaauaauuagcgacuccagugcgcucgaggaucugcgcaauccagagcaaucuaccagcgaaaaagccgugcuuacuucccagaagucaagugaguacccuaucucucagaaccccgaagggcugagcgcugacaaauuugaggucuccgccgauucaagcaccucuaagaauaaggaaccaggaguugagcgguccaguccgagcaaaugcccuucguuggacgauagaugguauaugcacuccuguucuggcucacuccagaacaggaauuaccccagccaagaggaacugaucaaggugguagacguggaggaacagcagcuagaggagagugguccacacgaucugacagaaacuuccuaucuuccccgacaagaccucgagggcaccccuuaccuggaaucugggauuagcuuguucucagacgauccagaguccgaccccagugaagaucgggcaccugagagcgcucgcgucggaaacaucccgucuucaacauccgccuuaaaagugccacagcugaagguugcagagagcgcccagucucccgcugcggcccauacgaccgacacugcaggcuauaaugcuauggaagagagugugucgagagaaaaaccugagcucacagccuccaccgaaagggucaacaagcggaugagcauggugguuucagggcugacucccgaggaguuuaugcuuguguacaaguucgcccgaaaacaccauauuacacugaccaauuugauaacggaagagacuacccacgucguaaugaagacagaugcugaauuugugugcgagagaacccuaaaauauuuccugggaaucgcaggcgguaaguggguugugucuuacuuuugggucacucagagcauuaaagaacgcaagaugcucaacgagcacgacuucgaggugaggggggauguagugaauggacguaaccaucaaggcccaaagcgggccagagaaucccaggacaggaaaaucuuccgcggucuggagauuugcuguuacggcccuuuuacaaauaugcccaccgaucagcuugaauggaugguccaguuaugcggggcgaguguugugaaggagcugucaucuuucacacucggaacuggcgugcacccaaucgucgugguucaaccugacgcuuggaccgaggauaacggguuucaugccauaggacagaugugugaagcaccgguagugacgcgagagugggucuuggacagcguggcccuguaucagugccaggaacucgauacauaccugaucccccaaauuccacacucccauuauuga

SEQ ID NO: 53456 - RNA, 10257 nt, Artificial Sequence
  derived and/or modified sequence opt3 from BRCA2__Homo_sapiens__NP_000050
augcccaucggaagcaaggaacgaccuaccuucuuugaaauuuucaaaaccaggugcaacaaggcagaccuggggccaauaucccucaauugguuugaagaacuuucuucagaggcuccgcccuacaacagugaaccugcagaggagagcgaacacaaaaauaacaauuaugagccaaaccuguucaagacuccccagcggaaaccuuccuacaaucaauuggccucuacgccaaucauuuuuaaggaacagggauuaacccugcccuuauaucagucgccugugaaggagcucgauaaauucaagcuggaccuuggucgcaacgucccaaauucacgacauaaaagccugcguacaguuaagacuaaaauggaucaggcggacgaugugaguuguccguugcucaacuccugccugucugagagccccguggugcugcaauguacccacgucacaccucagcgggacaaguccgugguuugcggaucacucuuucauaccccaaaguucgugaaagggaggcagacucccaagcacaucagugagucauuaggagcugaggucgauccugacaugucuugguccucaagccuggccacaccacccacccuuaguucuacgguguugauugugcggaaugaagaggcauccgaaacuguuuuuccgcaugauaccacagccaacgugaaaagcuacuucucgaaucacgacgagucucugaagaaaaacgaucgcuuuaucgcuuccgucacugacucagagaauaccaaccagagagaagcagccagucacggcuucgguaagacaagcgggaacuccuuuaaaguaaauucuuguaaggaucauauaggaaagagcaugccuaacguguuagaggacgaagucuaugagaccguuguggacacgucagaagaggauaguuucucccucugcuucagcaaauguaggacuaagaaucugcaaaaagugcggacaucuaagacccgcaaaaagaucuuucacgaggcuaacgccgacgaaugcgagaaaagcaaaaaucaggugaaggaaaaauacaguuucgucagcgagguggaacccaacgauacugacccacuugauuccaauguugcgaaccagaagccuuuugagucuggcucggacaaaauuagcaaggaggugguccccucccuggcaugugaauggucacaguugacacucaguggccugaauggggcccaaauggagaagaucccauuacugcauauuucuagcugcgaucagaacaucuccgaaaaagaccuccuugauaccgagaauaagagaaagaaggacuuccugacgucagagaacagcuugcccagaauaucuucccuaccuaaaagugaaaagccacugaaugaggaaaccgugguaaacaagagggaugaggaacagcaccucgagagccacacagacuguauucuggcuguuaaacaagccaucucuggaacuuccccgguggcaucaaguuuucaggguauuaagaaaagcaucuuccggauccgugagucgcccaaggaaaccuuuaaugcuuccuucucuggccauaugacagacccuaacuuuaaaaaggagacugaagccagcgagucagggcuugaaauucacaccgucugcagucagaaagaggauucccugugcccaaacuugauagacaauggaucuuggcccgcgacaaccacucagaacagcguggcccucaagaaugcaggccugaucuccacguuaaagaaaaagacaaacaaauucauuuaugcuauccaugaugagaccucauacaaggguaaaaagauaccuaaggaccagaaaagcgaacugauuaauuguagugcccaguuugaggcuaacgccuucgaagcaccacuaacuuuugccaaugcugauucugggcuccugcacuccagcgucaagcgcucgugcucacagaacgacucugaggaacccacccuuaguuugacauccagcuucggaaccauccugagaaaauguucuaggaaugagacuugcagcaacaauacagugaucucccaggaucucgacuacaaggaggcgaaauguaacaaggaaaagcugcaacuuuucauuacgccggaggcagauucacugaguugcuugcaggaaggccagugugagaaugacccuaaaagcaagaaaguuucugauaucaaggaggaagugcucgccgcugccugccauccaguacagcacuccaaagucgaguauucagacaccgauuuucaaagucaaaagagccuguuauacgaccacgaaaacgcauccacucugauucuaacacccaccucuaaggacgugcucucgaaucugguuaugauaagccggggcaaagagucauauaagauguccgauaaacuuaaggggaacaacuacgaaagugacguggaguugacuaaaaauaucccuauggagaagaaccaggaugucugugcccugaaugaaaacuauaaaaauguggagcuccugcccccagaaaaguacaugcgaguagcuucuccuagccgcaaggugcaguucaaccaaaauacuaacuuaagaguuauucagaaaaaucaggaggaaaccacguccaucucaaagaucaccgucaaccccgacucugaggagcuguuuagcgauaaugaaaacaauuucguguuucaaguggccaacgagaggaauaaccuugcauugggaaacacaaaagaacuccaugagacugaccugaccugcgucaaugaaccaauuuucaagaacaguacaaugguucuauauggugauacuggcgacaaacaggcgacccagguguccauaaagaaggaucugguguacguacucgcugaggagaauaaaaacagcgucaagcagcacaucaaaaugacgcuggggcaagaccuuaagucugauauuucauugaauaucgacaaaauuccggaaaagaacaaugauuacaugaacaagugggccggacuguuaggcccuaucuccaaucauaguuuuggugggagcuuccggacagcaucgaacaaagagauaaagcucucugaacacaauaucaaaaaguccaaaauguuuuucaaggacauugaggagcaguaucccaccagccuggccuguguggaaaucguuaacacucuugcucuggacaaucagaagaaauugucaaagccacagaguauuaacacagugucugcccaccuccaauccagcgucgugguuucagauugcaaaaauagucauaucacaccccagaugcuguuuagcaagcaggacuucaacuccaaucacaaccuaacuccuucucagaaagcagagauaaccgaacugagcacaauucucgaggaauccggcucacaauuugaguucacgcaguuccgcaagccaucuuacauccugcagaagaguaccuuugaggugcccgaaaaccaaaugacuauucuuaaaacaaccucggaggaaugcagagaugcugacuugcauguaaucaugaaugccccuagcauaggacaggucgauuccucuaagcaguucgagggcacaguggaaaucaaaaggaaguuugcggggcugcucaaaaaugacuguaauaagucagccagcggauaucuaacugaugagaacgagguggguuuccguggcuuuuacuccgcucacgggaccaaacugaaugucaguacggaagcacuucagaaggccguuaagcuguucucugacauugagaacaucagcgaagagacaucagcugaagugcauccgauuucccuaaguagcucuaaaugccacgauuccguagugucaauguuuaagaucgagaaucacaacgacaaaaccgucagcgagaagaauaacaaaugucaacucauacugcagaauaacauugaaaugacuaccggaacauucguggaggaaaucacugagaauuauaagcggaacaccgagaaugaagauaacaaguacacagccgcaucgcgaaacucucauaauuuggaguuugacggcagugacuccagcaaaaacgauacgguuugcauccacaaggacgaaaccgaucuguuauucacugaccagcauaauauuugucucaaacugucaggucaguuuaugaaggaggggaacacacaaaucaaagaagaucuuuccgaccugaccuucuuggagguggcgaaggcccaggaggcuugccacggcaauacuucuaacaaggaacagcucacagccaccaaaacggagcagaauauuaaggauuucgaaacuagcgacaccuuuuuccaaacagcaaguggcaaaaacauauccgucgcuaaggagagcuuuaauaaaaucgugaacuucuuugaucagaagccagaagaacugcauaauuucucucuaaacucagagcugcacagugacauuagaaagaauaaaauggauauccuuuccuaugaagagaccgacauuguuaagcacaaaauccucaaggaaagcgugcccgucggcacugggaaccagcugguaacauuucagggacaaccugagagggaugagaaaauaaaggagccaaccuugcuggguuuccauacagccucuggcaaaaaggugaagaucgcaaaagagucguuagacaagguuaaaaaucucuuugacgaaaaggagcaggggacuucagaaauuaccagcuucucccaccagugggccaaaacgcugaaguaccgcgaggcuuguaaggaucuugagcuggcgugcgaaacaaucgagauuaccgccgcacccaaauguaaggaaaugcaaaacaguuugaacaaugacaaaaaccucgugucuaucgagacugucgugccuccgaagcugcuaagcgauaaucugugccggcagaccgaaaaccuuaaaacauccaagucaauauuucucaagguaaaagugcaugagaaugucgagaaggaaacugcuaaaagucccgccaccuguuacacgaaccagucuccauauagcguuauugaaaauuccgcccuggcuuucuacacaucaugcagcagaaagaccucugugucccagacaaguuuguuagaagccaaaaaguggcugagggagggaaucuuugacggccaaccugaacgcaucaacacagccgauuauguggguaauuaccucuaugagaacaauagcaacucgaccauugcggagaaugacaagaaccaccuguccgaaaaacaggauacuuaccuuucuaauucaagcaugaguaacuccuauucuuaccacagcgacgaggucuacaacgauucaggguaucuguccaagaauaaauuggacaguggcauagaacccgugcuaaagaacguugaggaucagaaaaauacuagcuucucuaagguaaucucaaacgugaaagacgcuaaugccuacccacagaccgucaacgaagauauuugcguggaggagcugguuacguccagcucuccuuguaagaauaagaacgcagccaucaaacucaguauuucgaacuccaacaauuucgaagugggacccccagcuuuucgaaucgcaagcggcaagauagucugcgugucacaugagacuaucaaaaagguaaaagacauuuucaccgacucuuuuagcaaggucaucaaggaaaacaaugagaacaaauccaagauuugucaaacaaaaaucauggccgggugcuaugaggcgcuggaugacagugaagauauacuucacaauucauuagacaacgaugaguguucuacccauagccacaagguguucgcugacauucaguccgaagagauccugcagcauaaccagaauaugaguggacucgaaaaaguuagcaagaucuccccgugcgaugugucuuuggagacaucagacauuuguaagugcagcaucggcaaacugcacaagucggucuccagugccaacacuugugguauauuuucuaccgcaagcgggaaaucagugcaaguuuccgaugccucucuccagaaugcuagacagguguucagugagauugaagacagcacgaagcaagucuuuuccaaagugcuguucaagucaaacgagcacagcgaucagcuuacacgugaagagaauacugccaucagaaccccugaacaucugauuucucagaagggauuuaguuacaacguaguaaauuccagcgcauucucaggcuuuucuacagcuuccgguaaacagguuucgaucuuggagagcagucuacacaaggucaaaggcgugcuggaggaguucgaccucauaaggaccgagcauucuuuacacuauucccccacuagccgccaaaacgugucaaagauucugccacgggucgacaaaagaaaucccgaacacugcguaaacagugagauggaaaagaccuguuccaaggaguuuaaacuuagcaauaaccugaauguggaagggggaucuucagaaaacaaucauagcaucaagguuuccccuuaccucucucaguuccagcaggauaaacaacaguuggugcugggcacaaaggucagucucguggagaacauccacguucuggggaaagaacaggccucgccaaagaacgugaaaauggagauuggaaagacggagacuuucagcgacguccccgugaagaccaauaucgaaguaugcuccacauauucaaaagauucugagaacuacuuugaaaccgaggcgguggaaauugccaaggcauucauggaggacgaugagcuuacugacagcaaacuaccuagucaugcuacacacucccuguuuaccugcccggaaaaugaggaaaugguuuugucaaacucuaggauaggcaagcgacgcggugagccauuaauccuggucggggaacccagcauuaaacggaaucuccugaacgaguucgauagaaucaucgagaaucaggaaaagucccuuaaggccaguaaaagcacgccugacggaacuauuaaggauaggcgucuguuuaugcaucacgugucucucgagcccauaacaugugugccauuccgcaccaccaaagaacggcaagagauccagaacccuaauuuuacugcucccggccaggaguucuugucaaagucccaccuguacgagcaucuaacacuggagaaaagcaguucuaaccucgcagucuccggucacccauuuuaucagguuucggccaccagaaaugaaaagaugaggcaucuuauuacaacuggccgaccuacgaagguguucguaccgcccuuuaaaaccaagagccacuuccaccggguggagcaaugcguccgcaacaucaaucuggaagagaacagacagaaacagaauauugacgggcauggaucagaugacuccaagaacaaaaucaacgauaaugagauacaccaauuuaacaagaauaacucuaaucaggccgcugcggugacauucacuaagugugaagaggaaccauuagacuugaucaccagucugcagaacgcaagggacauucaggauaugcggaucaaaaagaaacaacgacagagaguuuucccucagcccggcagccucuaccuggccaagacaucaacccuuccacgcauuucccugaaagcugccguagggggacaggucccuagcgcaugcucucauaagcaacucuauacuuacggcguaaguaaacacuguaucaagauaaauuccaagaacgccgagagcuuucaguuccauacggaagacuauuuugguaaagagucauuguggaccgggaagggcauucagcuggcugauggcgguugguuaauccccucuaaugacggcaaagcggggaaggaggaguucuacagggcccuaugcgauacaccgggaguggacccaaaacugauuucgcguaucuggguuuauaaccacuaccgguggauaaucuggaagcucgcagcuauggagugugccuuuccuaaggaguucgcaaauagaugccuuagccccgagagggugcuguugcagcugaaauaccgcuaugauacugaaauugaccgauccagacggagugccaucaagaaaauuauggagagggaugacaccgcugccaagacacucguccugugugugucugauaucauaucacuuagcgcgaacauuuccgagaccaguucuaauaaaacuagcuccgcagacacacaaaaggucgccaucaucgaacucacggacggcugguacgcugugaaggcccagcuggauccacccuugcuggcuguucugaaaaacgggcgccuaaccgugggacagaagauuauccuacacggcgcagagcucguagguucaccugacgccugcacuccgcuugaagcucccgagagccugauguugaaaauaucugccaauuccacacguccagcaagaugguauaccaagcugggguuuuucccugauccccggccuuuuccacucccccugaguucacuuuucagcgacggaggcaacgugggcugugucgauguuauuauccaaagggcguacccuauucaguggauggagaaaaccucguccggguuauauaucuuucgcaacgagcgagaggaagagaaggaagccgcuaaguacguggaggcccagcagaaaagacuggaggcacucuucacaaagauacaagaagaguuugaagaacaugaagagaauacuacgaaaccauauuugcccucucgggcucugaccaggcagcagguccgcgcccuacaggacggagcagagcuguacgaagccgugaagaacgcugcggauccggccuaccucgaggguuauuucagugaagaacaacuuagagcacugaauaaccacaggcagauguugaaugacaaaaagcaggcucagauccaacuggaaauucggaaagccauggagagcgccgagcagaaggaacagggccucucacgugauguaacaacuguguggaagcugcgcaucguuuccuacucuaaaaaggagaaagacagcgugauuuuaaguaucuggcgaccuuccagcgaucuuuauucucugcucaccgaagggaagagauacaggauuuaucaucuagcaacaucaaaauccaagagcaagagugagcgggcuaacauccaacuggccgcgaccaaaaagacucaguaccagcaguugccagucucugacgaaauacuguuccaaauuuaucagccccgcgagccucuccacuuuucaaaauuccuugauccagacuuucagcccuccugcagcgagguggaccugaucggauucgucgugucgguuguaaagaaaacgggcuuggcuccguuuguguaccugucugaugaaugcuacaaucucuuagccaucaaguucuggauugaccugaacgaggauauaaucaagccucauaugcuuauugcagccaguaaucugcaguggagacccgaauccaaaagcggucuacucacacuguuugcuggggacuucucagucuuuucugcaagcccaaaggagggacacuuccaagagaccuuuaacaaaaugaagaauacuguggaaaacaucgauauuuuguguaaugaggccgaaaacaaacugaugcacauccuccaugcgaaugacccuaagugguccacccccacaaaggauugcacaaguggcccauauaccgcucagauaauccccggcacagggaacaaacuucugaugucaagcccuaauugugagauuuacuaucaguccccauuaucucugugcauggccaagaggaaaaguguuagcacgccgguguccgcacagaugaccucaaagucuuguaaaggagaaaaggagaucgacgaucaaaagaacugcaaaaagcggcgagccuuggacuuccucucgagacugccccuaccuccacccgucagcccuauuuguacuuuuguguccccagcugcccagaaagcauuccagcccccucgcaguugcgguacaaaguacgagaccccgaucaaaaagaaagaacuuaacucuccacagaugacucccuucaagaaguuuaaugagauaagccugcucgaaucaaacuccauugcugaugaggaacuggccuugaucaauacacaagcgcugcucagcggcucuaccggggagaaacaguucaucaguguauccgagucaacgaggaccgccccuacaagcucugaagacuaucuucggcugaagcguagauguacuaccucguuaauuaaagagcaggaauccagucaagcaagcacagaggaaugcgagaagaacaaacaggauacuauaaccacaaagaaguacaucuga

SEQ ID NO: 53457 - RNA, 876 nt, Artificial Sequence
  derived and/or modified sequence opt3 from BRCC3__Homo_sapiens__NP_001018065
auggccgugcaggucguucaagcugugcaggcaguacaccuggagagcgacgccuuccucgugugccuuaaccaugcgcuguccaccgaaaaggaggaagucaugggcuuguguaucggggaguuaaaugaugacacaagaucugauucaaaauuugcuuacacuggaacggaaaugaggaccguggccgagaagguugacgcagugcggauuguccacauacauagugugaucauucugcgccgaagcgauaaacguaaggacagaguagagaucucccccgaacagcuaucugccgcuucgacagaggcagaaaggcucgccgagcugacuggucggccuaugcgcguugugggcugguaucacucacauccacacauuaccgucuggccgagccacguggaugugagaacacaggcuauguaccaaaugauggaccagggguucgucggacuuaucuuuaguugcuucauagaggauaaaaacaccaagacuggcaggguucuguauacauguuuucaguccauccaggcccaaaagucuagcgaauacgagcggauugaaauccccauucauaucgugccucacguaaccauagguaaagugugcuuggaguccgcggucgaacucccaaagauucugugucaggaggagcaggacgcauaucgccgaauccauucacugacgcaccucgauagugugacuaaaauucacaaugggagcguuuucaccaagaacuuaugcucucagauguccgccgugucaggaccccugcuucaaugguuggaagacagacuggagcagaaucagcaacaucuacaggaacuccagcaggagaaagaggaacugaugcaagagcuuagcagucuggaauga

SEQ ID NO: 53458 - RNA, 3570 nt, Artificial Sequence
  derived and/or modified sequence opt3 from BRD1__Homo_sapiens__NP_001291737
augagaaggaagggccggugccaccgcgggagcgccgcucgacaucccuccucuccuuguucagugaaacacaguccaacccgugagacacugacuuacgcacaggcccaaagaauggucgaaaucgagauugaaggaaggcuccaucggauaagcaucuucgacccgcuugagauuauccuggaagaugacuugacggcgcaggagauguccgagugcaacucuaauaaggaaaacucggagagacccccuguuuguuuacgcaccaaaaggcacaagaauaaccgggugaaaaagaagaaugaagcucugccaucagcccaugguacacccgcaagcgccagugcucuaccugagccaaaaguacgcauuguggaguauagucccccuucugcaccacgaagaccgcccgucuacuauaaguuuaucgagaaaagcgccgaggaacucgauaacgagguggaauacgacauggaugaggaggacuaugcuuggcuggaaauaguuaaugagaagaggaaaggcgauugcgugccugccgucucccagucaauguucgaauuucuuauggaccgguucgagaaggaaagucacugugagaaccagaagcaaggggagcagcagagccugaucgaugaagacgcggugugcuguauuugcauggauggagagugucaaaauucuaacguaaucuuguuuugcgacauguguaaucucgcaguucaccaggaaugcuacggcgugccauauauucccgagggucaguggcugugccgucauugucugcagucccgcgccagaccugcugauugcguccucuguccaaacaaagggggagccuucaagaaaacugacgacgauagguggggccacguggugugcgcauuauggauccccgaagucggcuuugcuaauaccguuuucauagagccgauugacggggugcggaacaucccucccgcccgauggaagcugacauguuaccuuugcaaacagaagggaguaggugcguguauucaaugccauaaagccaauuguuacaccgcauuucacgugacuugcgcucagaaggccggcuuguauaugaagauggagccagucaaagaacugacagggggaggcaccacguucucagugcgcaagacugcuuacugugauguucacaccccucccgguugcacaagaaggccacuaaacaucuauggggacguggagaugaaaaacggagucugccggaaggaaagcagugugaaaacuguacgcucuaccuccaagguuagaaagaaagccaagaaagcaaagaaagcccucgcugagcccugugcggugcugccuacagucugcgcaccauacaucccgccccagaggcuuaaucguauugccaaccaaguggcuauacagcggaagaagcaguuugucgagcgagcccauagcuauuggcuguugaaaagacucucgaggaauggcgcaccucuguuacgccggcugcagucuucccuccaaucacagagaaguagccagcagagggaaaacgaugaggaaaugaaggccgcuaaagagaaacuuaaguacuggcaacgccugcgacacgacuuggaacgggcccgucuacugaucgagcuccugagaaagagggagaaacuuaagcgcgaacaggugaagguugaacagguggcaauggaacugcgguugaccccacucacgguacuguuaagauccguccuggaucagcuacaagacaaagaucccgcgaggauuuucgcucagccugugucucucaaggagguuccagacuaucuggaucauaucaaacaccccauggacuuugccacuaugcgaaagcgccuugaagcacagggcuacaaaaauuugcaugaguucgaggaagacuucgaucugauaauugacaacuguaugaaguacaaugcccgggauacaguguuuuauagagcugccgucaggcuccgugaccaagggggagugguacugcgccaggcacggagagagguggauagcaucggucuugaagaggcuucaggcaugcaucugccggaaaggccugccgcggccccacgacggcccuucaguugggaggacguugaucgcuugcucgacccugcuaacagagcacaccugggguuagaggaacagcugagggagcuacucgauaugcuggaccuuaccugcgccaugaaguccagcggaucucggucaaaacgagcuaaguugcugaaaaaggaaaucgcccuccugagaaauaaauuaagucagcaacacagccagccccugccaacuggcccuggucuugagggguuugaggaagauggcgcagcguugggacccgaggccggcgaagagggggacaaguccccaccgaagcucgaaccuucugaugcucugccccuaccaucgaacagcgagacaaauuccgagcccccuacccugaaaccagucgaacucaaccccgagcagucaaagcuguucaaacgcgugacguuugacaaugaaagucacucugccuguacccagagcgcacuuguguccggaaggccuccggagccaacacgugcuucaagcggugacguccccgccgcagccgcuucugcgguugccgaaccugcauccgaugugaaccggagaacuuccguguuguucugcaagagcaaaucuguauccccacccaagucagcuaagaauaccgagacacaaccuaccaguccgcagcugggcacuaaaacauuuuuaagcgucgugcuccccaggcuggagacccuucugcagccacgcaagcgaucgagauccacuuguggggacucugaaguugaggaagagagcccuggaaaacgguuggaugccggccucacgaacgguuucgggggcgccaggucagaacaggagcccggaggcgggcugggacgcaaggcuacaccacguagacggugcgcaagugaguccucuauuagcuccucaaacagcccucuaugugacaguucuuuuaaugcccccaaaugcgguaggggcaagccagcgcuggugcgccgacauacccucgaagauagauccgagcugaucagcuguauugaaaacgggaauuacgcuaaggccgcacggauagccgcugaggucggacaaucgucaauguggaucucuacugacgcagccgcgagugugcuugagccguugaaaguugugugggcuaagugcuccggcuauccuagcuaccccgcccugauuaucgauccaaaaaugcccaggguaccuggucaccacaacggggucaccaucccagcacccccuuuagacgugcucaagauuggcgaacauaugcagacaaaaucugaugagaagcuguuccuugugcuguuuuucgacaauaaacgcagcuggcaguggcuaccgaaguccaagauggucccacucggaauagaugaaaccaucgacaaacugaagaugauggagggcagaaacucaaguauuaggaaagccguucggaucgcuuuugaucgugccaugaaucacuugagccgcgugcauggggaacccacuucugaccuguccgacauugauuga

SEQ ID NO: 53459 - RNA, 2406 nt, Artificial Sequence
  derived and/or modified sequence opt3 from BRD2__Homo_sapiens__NP_001106653
augcugcagaacgugacaccccacaauaagcucccuggcgaggggaacgccggacuucuggguuugggcccagaagcugcagccccggggaaaagaaucaggaagcccagcuuacuguacgagggauucgaauccccuaccauggcgucugucccagcucuacaacucacucccgccaauccuccacccccugagguuucaaacccaaagaagccgggccgggugacgaaucagcugcaguaucuucauaaaguagugaugaaggcacuguggaagcaccaguuugccuggcccuuccgccaaccugucgacgcugugaaauugggucucccagauuaccauaagauuauaaaacagcccauggacauggggaccaucaagcgacgucuggaaaacaauuauuacugggcagccagugagugcaugcaggauuuuaacacaauguucacuaauuguuauauuuacaacaaaccuaccgacgauaucguucugauggcucagacacucgagaagaucuuuuuacaaaagguggccagcaugccacaggaggaacaggaacuggucgugaccauucccaaaaauucccacaagaaaggagcgaaacuugcagccuugcagggcucuguaacuucggcucaucaaguuccggccgugucaagcgucagucacacagcacuguauaccccucccccagagauaccuacgacugugcuaaacaucccccacccauccgugauuucuagcccccuccugaaaucccuucauucagcuggcccuccacuguuggccgucaccgcggccccgcccgcacagccucucgcuaagaaaaaggggguuaagagaaaagccgacacaacuaccccaacacccaccgcuauccuggccccuggaaguccagcaucucccccggguagcuuagagccuaaggccgcuaggcugccacccaugcggcgcgaauccggcagaccuauuaaacccccaaggaaggaucucccugacucacagcaacagcaccagagcaguaaaaaggggaaacuuucugagcagcugaaacauugcaauggaaucuugaaggaacuacuguccaaaaagcacgcggcauacgccuggcccuucuacaaaccaguggaugcuagcgcccucggccugcacgacuaucaugauauaauuaagcacccgauggaccuuucgacgguaaagcggaaaauggagaaccgcgauuaccgagacgcacaagaauuugccgcugacgugagacugauguucucuaauuguuauaaguacaacccucccgaucaugacgucguggccauggcaaggaaauugcaggauguuuuugaguuccgguaugcgaagaugccagacgagccccucgaaccugguccacugcccguguccacugcuaugccuccgggguuagccaaaucaaguagcgaguccucuagcgaagagucaaguuccgaaucuagcucagaggaggaagaggaagaggaugaagaggacgaggaagaggaagagagugagagcuccgauucugaagaggaacgugcacaccgccuggccgagcuacaggaacagcucagagcuguccaugagcaacuggccgcacuuucgcagggaccaaucagcaagcccaagaggaaacgggagaagaaagaaaagaaaaagaaacgaaaggcugagaagcaccgcggcagagccggcgcggacgaagaugacaaagggccuagggccccacggcccccucagccgaagaaauccaagaaggcuucaggaagugguggcgggucugcagccuugggacccagcggcuuugguccauccgggggcucaggaacaaagcugccuaagaaagcuaccaagacugcacccccagcccucccuacaggcuacgauagcgaggaagaggaggaaucucgccccauguccuaugacgagaaaagacagcugagucuugacauuaacaagcugccaggggaaaaauugggaagggugguacacaucauccaagcgcgugagccgagccuccgggauucuaauccugaagagauugagauagacuucgaaacccugaagcccuccacguuacgagagcuggaaagauacguucuaucaugccucaggaagaaaccacgcaagcccuacaccaucaaaaagccuguggguaaaacaaaggaggagcuggcccuugaaaagaaacgggaguuggaaaagagacugcaggaugucaguggccagcucaacagcacuaaaaagccacccaaaaaggcuaaugagaaaaccgaaucguccucugcccagcaaguggcagucagcaggcugucagcuaguuccucuagcuccgacucaagcaguucuuccagcucgucaucuaguuccgauacaagcgacucugauagcggguga

SEQ ID NO: 53460 - RNA, 2181 nt, Artificial Sequence
  derived and/or modified sequence opt3 from BRD3__Homo_sapiens__NP_031397
augagcaccgccacaacuguggcucccgcaggcaucccugccacgccagggccggucaacccaccuccacccgagguuuccaauccuucuaagccaggaagaaaaaccaaccagcugcaauacaugcagaaugugguagugaagacacucuggaaacaccaguucgcguggcccuuuuaucagccugucgacgcuauuaaacuuaaccugccagauuaccauaaaauaaucaagaauccgauggacauggguacuauuaagaaaagguuggaaaacaauuauuacuggucagccagugagugcaugcaagauuucaacaccauguuuacaaauuguuauaucuacaacaagcccaccgacgauauuguguuaauggcacaggcccuggaaaagaucuuccuacagaagguugcucagaugccucaagaggaaguggagcuccugccacccgcaccuaaaggcaaggggcggaagccagccgcuggagcccagagcgcgggcacucagcaggucgcagccguguccucuguaucgcccgcuacaccguuucaaucaguuccucccaccgugagccagacgccagucauagccgcaacuccugugcccaccaucacagcuaaugugacuagcgucccaguucccccugccgcggccccaccgcccccugcaaccccaauugugcccguagugccuccaacacccccggucgugaaaaagaaagguguuaagcgcaaagcugacaccacgacuccuacaaccuccgccaucacugcuucucgaagcgaguccccacccccucuuucagaucccaagcaggccaaaguggucgcacguagagaaagugggggaaggccaauuaagccucccaagaaagaccuggaggauggcgaagugccacaacacgccggcaagaaagggaaguugagcgagcaucuccgguauugcgacucuauccugcgcgagaugcuguccaaaaagcacgcugcguacgcauggccguucuacaagccuguagaugccgaagcucucgaguuacaugacuaucacgauauaauuaaacaccccauggaccugucaacaguuaagagaaaaauggacggaagggaauacccagaugcccaggguuuugcagccgacgugcggcuuauguucagcaacuguuauaaguacaaucccccugaucaugaggucguggcuauggcccgcaaauugcaggacgucuuugaaaugcgauucgcaaagaugccagaugagcccguggaggcgccugcucugccggccccagcagcccccaugguuaguaagggcgcugaaucuuccagaagcucggaggaaucuuccucagacagugggagcuccgauucugaggaagagagggccacccggcuagcagagcuccaggaacaacugaaagcugugcacgagcagcuugccgcgcugagccaggccccuguaaacaagcccaaaaagaaaaaggaaaagaaagagaaggagaaaaagaaaaaggacaaagaaaaggagaaggaaaaacauaaggucaaagcugaggaagagaagaaagcaaagguggcucccccugccaagcaggcccaacagaaaaaggcaccggcgaaaaaggccaauucaacgaccacagcuggacgucaguugaaaaagggcgguaagcaggccagugcauccuaugauagcgaggaagaggaagaggggcuccccaugucuuacgacgaaaaacgccaacugucauuagauaucaacagacugccaggagagaagcucggcaggguugugcacauuauccagagucgggagccuagccuucgagacuccaaccccgacgaaaucgagauugauuuugaaacucugaaaccaaccacauugcgcgagcuagaaagauaugucaagucuugccugcagaaaaagcagaggaagccuuucucggcuagcggcaaaaagcaagccgcaaaauccaaggaggagcucgcccaggagaaaaagaaagaacuggaaaagcggcuucaggacgugucagggcaacugaguucuagcaagaaacccgcucgcaaggagaaaccaggauccgcgccgucagguggcccuagcagauugucuuccaguaguucuuccgaaucagggaguagcucguccucuggaagcucaagugauuccucugacagcgaguga

SEQ ID NO: 53461 - RNA, 4089 nt, Artificial Sequence
  derived and/or modified sequence opt3 from BRD4__Homo_sapiens__XP_011526156
augagcgccgaguccggccccgggaccagacugaggaaccucccugugaugggagacggucuugaaacaucucagaugucaacuacgcaagcucaggcacagccacagccggccaaugcggcuaguaccaaucccccuccacccgagacaagcaacccuaacaagccaaaacggcaaacuaaucagcugcaguacuuguuacgcgucguucugaagacccuauggaaacaccaguucgccuggcccuuucaacagccuguggaugcaguaaagcucaaccugccagacuauuacaaaaucauuaagacaccgauggauaugggcaccauaaagaaacgacuugaaaauaacuauuacuggaaugcccaggagugcauccaggacuucaacacuauguuuacaaauuguuauauuuacaacaagcccggggaugacaucgugcugauggcugaagcauuggagaaacucuuccugcaaaagauuaaugagcugccuaccgaagagacggaaaucaugauaguccaggccaaaggacguggcagagguaggaaggagacugggaccgcuaagccaggaguguccacaguucccaacacuacccaggccucuacaccuccacaaacccagacgccccagccgaauccucccccagugcaggcgacuccucaucccuuuccagcagucacacccgaucucaucgugcaaaccccuguaaugacuguugugccaccgcagcccuuacagacaccuccacccgucccuccacagccccaaccgccuccagcccccgcuccucagcccgugcagucgcacccaccuauuaucgccgcaacgccccagccagugaaaaccaagaaaggcgucaagcggaaagcugacaccacaacuccgaccacaauugauccuauccaugagcccccaucacugcccccugaaccaaagacuaccaaacuuggccaacgcagagagagcaguaggcccguuaagccuccgaagaaagacgugccagauucccagcagcaccccgccccugaaaagucuagcaaaguauccgagcaguugaagugcuguucagggauacugaaagaaauguucgcgaagaagcaugccgcauaugcuuggccauuuuacaaacccguggacgucgaggcccuaggacuccacgauuacugcgacauuaucaagcacccuauggacaugaguacaauuaaaagcaagcuggaggcucgggaauaucgcgaugcccaagaguucggugcagacgugcgacuuauguuuucuaacuguuacaaauauaacccgcccgaucaugaaguuguggccauggcuagaaagcugcaggacgucuucgagaugagguuugcgaagaugccagaugaaccugaggagcccgugguagcaguuuccucaccagccgugccucccccaaccaaagucguggcuccgccuagcaguucugacuccagcucggauucuuccucagacagugauagcuccacugacgauucugaagaggaacgggcccagcguuuggcagagcuccaagaacagcugaaggccguccacgagcaguuagcugcccugagccagccccaacagaauaaaccaaagaaaaaggagaaggacaaaaaggagaaaaagaaagaaaagcauaaacgcaaggaagagguggaggaaaacaagaaaucaaaggcaaaagagcccccuccaaagaaaacgaagaagaauaacaguuccaauagcaacguuucuaaaaaggaacccgcgccuaugaaaucaaagccgccacccacauacgagagugaagaggaggacaaaugcaagccuaugagcuaugaagagaagagacagcucucccuugauaucaauaaacugcccggcgaaaaguuggggagggugguacacaucauucagucucgggagccaucgcugaaaaacagcaauccugacgaaauagagaucgauuucgagacccuaaagcccuccacucuccgagaacuggagcgcuacgucaccucaugucuuaggaaaaagagaaagccacaagcugaaaaaguggacguuauugccggaaguucuaagaugaaaggcuuuagcuccucagagagcgaaucuuccagugagucuagcuccucagauagugaggacagcgaaacagagauggcaccuaagucgaaaaagaaaggucacccggggcgggaacagaagaagcaucaccaucaccaucaccagcagaugcaacaggcccccgcuccagugccucagcaacccccaccucccccgcagcagccaccucccccacccccuccgcagcaacagcagcagcccccaccucccccuccacccccuuccaugccacaacaggccgcacccgcuaugaaaucuagcccgccuccauucaucgccacccagguccccgugcuggagccucaguugccaggaucaguauucgaucccauaggccacuuuacucaaccgauucuccaucugccucagcccgaguuaccaccucaucugccccagccacccgaacacaguacaccuccacaccuaaaccagcacgcggugguuuccccgcccgcccuccauaaugcucugccucaacagccaucucgccccagcaacagagcagccgcccuuccuccaaagcccgcuaggccuccggcagucuccccagcguugacgcagacuccccugcucccucaacccccaauggcccagccuccccaggugcugcuugaggacgaggaaccaccggcuccuccccugaccucaaugcagaugcaauuguaucuccagcagcugcagaaagugcaaccacccacaccuuuacugccaagcgucaagguucagagucagcccccuccgccacuacccccuccaccccacccuucugugcagcaacagcuccagcaacagcccccaccgccucccccaccucagccccagccaccuccccaacagcagcaucagccgccaccucgucccgugcaucugcaaccaaugcaguucuccacccacauccagcagcccccuccgccacaaggccagcagcccccucaucccccaccugggcagcaacccccaccuccgcagcccgccaaaccacagcaaguaauccagcaccaccacagcccucggcaucacaagucggaucccuacucaacaggacaucuucgagaagcaccaucuccuuugaugauucacaguccccagaugucccaguuucaaagccugacucaccagucuccgccacagcagaauguccaaccuaagaaacaggagcucagagcugccagcgugguucagccccagccacugguggucgugaaggaggagaaaauccauucccccauuauaaggucagaaccuuucagucccagcuuacgcccagaaccuccgaagcaccccgagucuaucaaagcaccaguucaucugccucaacggcccgaaaugaagccaguggacguagguagaccugucauuaggcccccggagcagaacgccccuccacccggcgcuccugauaaggacaaacagaagcaagagccaaaaacccccguggcgccuaagaaagaucuuaagaucaagaauaugggguccugggccucauuggugcagaaacacccaacgacccccaguagcacagcaaaguccucuucggacagcuuugaacaguuccgccgagcugcccgggagaaagaggaacgugaaaaggcccucaaagcucaggcagagcacgccgagaaggaaaaggagagacugaggcaagaacgcaugcggucaagagaggacgaggaugcgcuagaacaggcuaggcgagcccaugaggaagcacgccggagacaggagcagcaacagcagcagaggcaagaacagcagcaacagcagcagcaacaggccgcugcagucgccgcggcugccacuccgcaggcacaguccagucaaccucagucuaugcuggaccagcagcgugagcucgcccgcaaacgggagcaagaaagaaggcgacgggaggcuauggccgcaaccaucgauaugaacuuucagagcgaccugcuuuccauuuucgaagagaacuuguuuuga

SEQ ID NO: 53462 - RNA, 1959 nt, Artificial Sequence
  derived and/or modified sequence opt3 from BRD7__Homo_sapiens__NP_001167455
augggcaagaaacacaagaaacauaagagcgacaaacaccuguacgaggaauauguggagaagccccucaaacuuguccugaaaguugggggaaacgaagugaccgaguuguccacagguucuucaggccaugauaguagcuuauucgaagacaagaaugaucacgacaaacauaaggauagaaaaaggaagaagcggaaaaagggggagaaacagaucccuggagaggaaaagggccgcaaacgacguagaguaaaggaggacaaaaagaagagggaucgggaccgcguggaaaacgaggccgagaaagaucugcaaugccacgcuccagucagacuagaccucccgcccgaaaagccucugacuuccucucuugcaaaacaggaggaaguggagcagacgccacugcaggaagccuugaaucaacucaugaggcagcugcagcggaaggaucccucggcguuuuucucauuuccuguuaccgacuucauugcuccagguuacagcaugauaaucaaacaccccauggauuuuaguacaaugaaggagaagauuaaaaacaaugacuaucaguccaucgaggaacugaaggacaacuucaaacucauguguacuaaugccaugauuuacaacaagccugagaccaucuauuacaaagcagccaagaaguuacugcauucugggaugaaaauacuuagccaagaacgcauccaguccuugaagcagucaauugauuuuauggcugaccugcagaaaacacgaaagcaaaaagauggaaccgacacaagucagagcggcgaggauggcgggugcuggcagagagaaagggaggacucuggagaugcagaggcccacgcuuucaaguccccaucaaaggaaaauaaaaagaaagacaaggauaugcuagaggacaaauuuaagagcaacaaucucgaacgggagcaagaacagcuggaucguaucgugaaagagagugguggcaaacuuacucgcagacuggucaacucucagugugaguucgaaaggcggaagccggacgggaccacgacuuugggacuccugcaucccguggacccuauuguaggcgagccagguuauugccccguucgauuagggaugaccacaggacgccugcaguccggcgugaauacucuccaaggcuuuaaggaagauaagagaaacaaagucaccccugugcuuuaccugaauuacgggccauauagcucguacgcgccccacuaugacucuacauucgccaacaucuccaaggaugacucagauuugauauacaguaccuauggagaggacagcgaucuaccguccgacuuuucuauucacgaguuccuggcaacgugucaggauuacccuuaugugauggccgacagccuccuggauguccuuacuaaagguggccauucaaggacacugcaggaaauggagaugaguuugcccgaagacgaggggcacacccggacucucgauacagcuaaggaaauggagcagaucaccgagguugaaccaccuggacgccuggacuccagcacgcaagacagauuaauugcccugaaggcagugaccaacuucggcguacccguggaggucuuugauucugaagaggcugaaaucuuccagaaaaagcuagacgagacaacuaggcuccugcgugagcuucaggaagcccagaaugagcgguugucaacccgaccacccccuaacaugaucugccugcucgguccaaguuacagagaaaugcaucuggcggagcaagugacaaauaaccuuaaagaacuggcccagcagguuacuccgggggauauugugagcaccuacggcgucaggaaggcaaugggaauauccauccccucuccugugauggagaauaacuuuguagacuugacagaggauaccgaggaaccaaagaagacugacguugcugaauguggccccgggggaucguga

SEQ ID NO: 53463 - RNA, 2601 nt, Artificial Sequence
  derived and/or modified sequence opt3 from BRD8__Homo_sapiens__NP_001157798
auggccaccggcacagggaagcacaaacugcucagcacuggacccacggagccuugguccaucagagaaaaacuuugccuggcuucuucagugaugaggaguggugaccagaacugggucagcguuucccgggcaauuaaaccauucgccgagccgggccgacccccugauugguuuucucaaaagcauugugcgucgcaguacucagaauuguuagagaccacagaaacuccaaaacgcaagcguggggagaagggagaggugguagaaaccguggaggacgucauagugagaaaacugacagcugaaaggguugaggagcuaaagaaagugaucaaggaaacccaggagcgguaucgcagacucaaaagggaugccgaacugauucaggcaggccacauggacagccggcuugaugagcugugcaaugacaucgccacuaagaagaaauuggaagaggaggaagcugaggucaagcgcaaagcaacagaugccgcuuaccaagcccgacaggcggugaagacgcccccuagaaggcucccaaccguaaugguucggagucccauugacuccgcaucuccugguggggauuauccacugggagaccugacuccgaccacaauggaagaggccacuagcggcgugacccccggcacacucccuuccaccccagucacgucauuccccgggaucccugauacuuuaccacccggaagugcuccgcuggaagccccuaugacacccgugaccgacgauagcccacagaaaaagaugcuuggucagaaagcaacuccucccccaucucccuugcuguccgagcuacucaagaagggcucacugcuuccuacaagcccacgucuggugaacgagagugaaauggcugucgccucugggcaucucaauuccaccggaguuuugcuggaggugggcgguguauuaccgaugauacacgggggagaaauccaacagacgcccaacaccguggcggccagcccugcagcuucggucucucagccagacaauugugugcccauggaggccguuggcgacccucauacagugacugucuccauggauucaagugaaauuagcaugaucauuaacuccaucaaagaggagugcuuucgcucuggcguggcugaagccccaguagggagcaaggcacccucaauagacggaaaagaggaacuggaucucgccgagaagauggacauugcuguuaguuacaccggugaggaacuugauuucgagacagugggcgacaucauugcgaucaucgaagauaaagucgacgaucacccggaggugcuggacgucgcagccguggaagcugccuuguccuuuugugaggagaaugaugacccucagagccuaccagggcccugggaacacccuauucaacaggagagagacaagcccguuccacugccugcacccgaaaugacugugaagcaggagaggcucgauuucgaagagaccgagaacaaaggaauacaugaacugguagacauccgggagccaucugccgaaauuaaggucgagccggcugaaccugagcccgugaucucaggcgccgagauaguugcugguguggucccagcgacaaguauggaacccccugagcuucgaagccaagaucuggacgaagaguugggguccaccgcugccggcgagauuguggaagcagauguagccaucggaaaaggcgacgagacuccacucacgaaugugaagacagaagcaucucccgagucgaugcugagcccuucccacgggucaaacccgaucgaagauccauuagaggccgagacccagcauaaauuugaaaugagugacucucugaaggaggaaagcggaacuauuuucgguucccagaucaaggaugcacccggcgaggacgaagaggaggaugggguuucagaagcugccagccuagaggaaccuaaagaggaagaccagggagagggcuaucucucugagauggauaaugaaccacccgucuccgagagugacgacgguuuuagcauucacaacgcgacccugcaaucucacacacuugccgauuccauaccuucaaguccggcuagcucgcaguucuccgugugcucugaagaccaggaggcaauccaggcccaaaagauuuggaaaaaggcuaucauguugguguggcgcgccgcagcgaaucauagauacgccaacgucuuucugcagcccguuaccgaugacaucgcuccaggguaucacagcauugugcagaggccuauggaucucucaacuauaaagaagaauaucgagaacggccugauucggaguacagccgaguuccagcgcgacaucaugcuuauguuucaaaacgcagugauguacaauuccucugaucaugacguauaccacauggcugucgaaaugcagagagaugugcuggaacagauucagcaauucuuggccacgcagcucaucaugcagaccagcgaguccggaauaucagcaaagagccugaggggccgugacaguacucggaaacaagaugccucugaaaaggacgggggaacacgagguagaaggugugcuaucgaggcggauaugaaaaugaagaaauga

SEQ ID NO: 53464 - RNA, 1248 nt, Artificial Sequence
  derived and/or modified sequence opt3 from BRE__Homo_sapiens__NP_004890
augagccccgagguggcccugaacagaaucuccccuaugcucucuccauucauuucaagugucguuaggaauggcaagguggggcuugacgcuaccaacugccugcggauaacagauuugaaaagcggauguacuuccuuaacgccgggucccaauugcgaccgcuuuaagcugcacaucccuuacgcaggcgaaacccuaaaaugggauauuaucuucaacgcccaguauccagagcuucccccugacuuuauuuucggggaagaugcggaguuucugccagaccccucugcucuccaaaaucuggccucguggaacccuucaaauccagaauguuugcuccugguagugaaggagcugguccagcaguaccaucaguuccaaugcagccgacuccgugagaguuccagauuaauguuugaauaucagacacugcuugaggaaccgcaguacggagagaacauggagaucuaugcaggcaaaaagaauaacuggacuggugaguucucugccagguuuuugcugaagcuacccguggauuucagcaauauaccuaccuaccuccugaaagacguuaacgaggauccaggggaagacguggcacuucuguccgucucauuugaggauacagaagcuacccagguguaucccaaguuguaccucaguccucggaucgagcacgcccugggaggcagcucugcuuuacauauuccagccuuccccggcgggggaugucugaucgacuacguaccgcaaguuugccaccuccuuacuaauaaagugcaguaugucauucaggguuaccauaagcgcagagaguauaucgcggcauuucugucccacuucggcacaggggugguggaauacgaugccgagggauucaccaaauugacgcuacugcucauguggaaggacuuuuguuuccugguccacauagaccuuccucuguuuuuccccagggaucagccaacuuugaccuuucaaucaguuuaucauuucacaaacagcggccagcucuacagucaggcucaaaagaauuauccuuacucuccccggugggacgguaacgaaauggccaaacgcgcaaaggggugccagggaucccgagaugcuuguagcccaugggaacaggugcuggccuuugcgguagccaaaacuggcugcaaguuacugcagccccaaagaaacuggccuucgucuaggggcccaccguggcgggcauccgaaggggagcguaccgcucaguga

SEQ ID NO: 53465 - RNA, 1755 nt, Artificial Sequence
  derived and/or modified sequence opt3 from BRF1__Homo_sapiens__NP_001229715
auggccgugagcagacaccugaccaggggccggaagauggcucaugucaucgcagccugccucuaccuuguuugucgcacagaggggacuccccacaugcuguuggacuuauccgaucugcuacaggugaacguauaugugcucggaaaaacguuccugcuucuggcgcgagaauugugcauuaaugcuccugccauagacccaugucucuacaucccgcguuuugcacaucugcuggaguucggugaaaagaaccacgaggucucuaugaccgcccucagauuacugcaaaggaugaaacgggauuggaugcauacaggccgcagacccucagggcuuugcggagcugcauugcugguggccgcuaggaugcacgacuuucggcgcacuguuaaggaagugauuagugucgugaaaguaugugagagcacccuacgaaagagacucacagaguucgaagauaccccuacuucccagcugacaaucgacgaguuuaugaagauugaucuugaagaggagugcgacccacccucuuauaccgccggccagaggaaacugcggaugaagcaguuggaacaaguucucucgaaaaagcuggaggaaguggagggugaaaucucaagcuaccaggaugcgauagagaucgaguuagaaaauagucguccuaaagcaaaagggggacuggccucccucgcuaaggacggcucuacggaggauacugccagcucccuuuguggcgaagaggacaccgaagaugaggagcuggaagcagcugccucacacuugaacaaggaccuauaucgcgagcugcucgggggagcgccagguaguagcgaagccgcaggcucucccgaguggggagggagaccuccagcucugggcucccuucuggacccguugcccacagccgcuucacucgguauuagcgauaguaucagggaaugcauuucuucccagagcucggacccuaaggaugccucuggggacggagagcuggauuuauccggcaucgacgaucuggagauagaccggcgagaucuaucaaugccacgcugugcaaaagccaagagucagccccauuucccuguccucgcucaauacauucugaaugaaagcgaggcgagagugaaagcagaacuuuggaugagggagaacgccgaguauuugcgggaacagcgcgagaaggaagcuagaaucgccaaagagaaggaacugggcauuuacaaggagcacaaaccaaagaaauccugcaagaggcgugagcccauccaggcaucuacugcccgggaagcuaucgagaaaaugcucgaacagaagaagauuagcucaaaaauaaauuacagugugcugcgagggcuuuccagcgccggagguggcucuccgcauagagaggacgcacaaccugaacacucagcgagugcuaggaagcugagccgccggagaacccccgccuccaggucuggggcagauccagucacaucgguuggaaaacgcuugcgaccucucgugagcacccagcccgccaagaaaguagcuacgggcgaggcccuguuaccauccucacccacucugggugcagagccugcucggccacaggccgugcuagucgaaagugggccggugucuuaucacgcggacgaggaagccgacgaggaggaacccgaugaggaagacggcgagccuuguguuagcgcucuccaaaugaugggauccaacgauuacggcugcgacggggaugaagacgauggauauuga

SEQ ID NO: 53466 - RNA, 1260 nt, Artificial Sequence
  derived and/or modified sequence opt3 from BRF2__Homo_sapiens__NP_060780
augcccggcagagggaggugcccugacuguggaagcaccgagcugguggaagauucccacuacucucagucacaacucgucugcagugacugugguugcguugugacagagggcguacuuacuacgaccuucagcgaugaagggaaccugcgggaggugacauauucccgcucuacuggagaaaacgagcaggucucgcgaucacagcagcguggcuugagaagggugcgggacuuaugucgcguucugcaacuaccaccgaccuuugaggauacagccguggcuuacuaucagcaggcauacagacauagcgguaucagggccgcgcggcuccagaagaaagaaguccugguggggugcuguguacuuauuaccugccgccaacacaacuggccccugacuaugggagcuauauguacauugcucuaugccgaccuggauguuuucaguuccaccuacaugcagaucgugaagcugcucggcuuagacgucccuucucugugccuugcagaguuggugaaaacguauuguagcuccuuuaagcuguuccaggccucaccaagugugcccgcuaaauacgucgaagauaaggagaagaugcuaagccgaacuaugcagcucguugagcuggcaaaugaaaccuggcuugugacaggcagacauccucugccaguaauuacugccgcuaccuuuuuggccuggcaaucucuccagcccgcggacaggcuguccugcucauuagcacgguucugcaaacuggccaacguggaucucccuuacccagcuagcagucgucuucaggagcuguuggccguccuacugcgcauggcagaacaacucgcuuggcugagagugcuuaggcuggacaagcggucuguugugaaacacaucggggauuugcuccagcaucgacagucccugguccgcagcgccuuuagagacggaacagcggagguggaaaccagggagaaggagccgcccgguuggggccaggggcaaggagaaggcgagguagguaauaacucguuagggcugccucagggaaaacggccagccucucccgcacuacuccugccuccauguaugcuuaagucccccaagcgcauuugcccgguuccucccgugucaacggucacuggcgacgaaaauaucagugauagcgagauagaacaguauuugagaacaccacaggaggugagggacuuccaacgugcucaggccgcucggcaggccgcaaccuccgucccuaaucccccauga

SEQ ID NO: 53467 - RNA, 756 nt, Artificial Sequence
  derived and/or modified sequence opt3 from BRI3BP__Homo_sapiens__NP_542193
augggcgccagagcuagcgggggaccccuggcaagggccggucuccuucuguuguuacugcuacuccugcuucugggcuugcucgcgccuggggcucagggagcccggggccgcgguggggcagagaagaacuccuaccgacguaccgugaauacauucucucaaucagucaguagccuguuuggagaagacaacguuagagccgcucagaaauuccuggcaaggcucacugagcgguuuguguuaggcguagauauguucguggaaacgcuguggaaggucuggaccgagcuuuuggacgugcugggccuagauguuuccaaucucucucaguauuuuucgccagccucagugagcaguuccccggcucgcgcccugcuucuggucggggugguauugcucgcguacugguuccugucuuuaacacugggauuuacuuucagcguucuccacguggucuuugguagauucuuuuggaucgugagggugguccuuuucuccaugucaugcguuuauauucugcauaaauacgaaggcgagcccgagaacgcaguguugccucuauguuuuguaguggccgucuauuucaugaccgggccaaugggauucuacuggcggaguagccccucuggcccuuccaauccaucaaaccccagcguggaagagaagcuggaacaccucgagaaacagguucgccugcuuaauauacgacugaacagaguguuggagagucucgacaggucuaaggauaaguga

SEQ ID NO: 53468 - RNA, 297 nt, Artificial Sequence
  derived and/or modified sequence opt3 from BRI3__Homo_sapiens__NP_001152963
auggaccacaagccccugcuccaggagagaccuccagccuacaaccuugaagcuggccaaggggauuaugcaugcggaccgcaugguuacggcgccauccccgcggcuccuccacccccuccauaucccuaccuggugaccgggauuccuacacaccauccaagggucuauaauauacacagccggacuguuacgcgcuacccggccaacuccaucgugguagugggaggcugucccgucugccgacaucagcguucuucaugguuguauaccuacccuuuaagaguguguacauga

SEQ ID NO: 53469 - RNA, 2286 nt, Artificial Sequence
  derived and/or modified sequence opt3 from BRINP1__Homo_sapiens__NP_055433
augaacuggagauucguggagcugcucuacuuucuuuucaucuggggcaggauuagcguccagcccucccaccaagaaccugccgggaccgaccagcauguuucuaaggaguuugauuggcugauaucagaccggggaccauuccaccauagucgcagcuauuuguccuuuguggaacgacaccgucaggguuucacaacuagauacaaaaucuauagggaguuugcucgguggaagguacgcaauacggcaauugaaagaagggauuuagugcggcauccggucccccugaugccugaguuccagcgcucuauccgacuacucggcagaaggccaaccacacaacaguuuauugacacuaucaucaaaaaguacgggacccaucugcuuauaucggccacacugggaggcgaggaagcguugaccauguauauggauaaaucacggcucgaccguaagagcgguaacgcuacucagaguguggaggcccugcaccagcuggcauccucuuacuucguugaucgcgacgggacaaugagaaggcuccaugaaauucaaaucagcaccggagccauuaaggugacggagacucggaccggccccuuaggcugcaauuccuaugauaaccuggacucagucaguagcgugcuuuugcagucuacagaguccaaacugcaccuacaggggcuccagaucauauuuccucaauaccugcaggaaaaguucguacagucagcucuuagcuacauuauguguaauggagagggugaauaucugugccaaaacagucagugucgaugccagugugcagaggaauuuccacagugcaauugucccaucacugauauucaaaucauggaguacaccuuggccaacauggcuaaaucuugggccgaggcguauaaggaccucgaaaauuccgaugaguucaagagcuucaugaagcgccugccuucgaaccacuuuuuaacaaucggcucuauucaccagcacugggggaaugacugggaccugcagaacagauacaagcuccuucaguccgcaaccgaagcccaaaggcagaaaauacagcggacggcucgcaagcuguucggauugucaguuagaugcaggcauaauccaaaccaccagcuaccgcgugagcggacuauccaacaguggcuggcccgagugcagagucuccuguauuguaaugaaaacggcuuuugggguacauuccuugagagccagagauccugcgucugucaugggucuaccacucugugccaaaggcccauuccuugcgugaucggaggcaacaauagcugugcaaugugcucauuggcuaacauaagucucuguggcuccugcaauaaaggguacaagcuguaucgcggacggugugagccacagaacguggauagcgaaagaucugagcaguuuauuucauucgaaacagacuuagauuuucaagaccuggagcuaaaauaccuccugcagaagauggauaguaggcuuuacguccacaccacguucaucagcaaugaaauccgcuuggacaccuuuuucgauccccgauggcggaaacguaugucccugacacucaagucuaacaagaauagaauggacuuuauucauaugguuaucgguaugucgaugaggauuugccagaugcgcaacagcucccuggauccuauguucuuuguguauguaaauccauucucaggcagucacucugagggguggaacaugcccuucggagaguuuggcuacccgcggugggagaaaauaagacuucagaauagccaauguuauaacuggacucuguugcucgguaauagguggaagaccuucuuugaaacagugcacaucuaccugcgaucccgcacucgguuaccuacccugcuaagaaacgaaacagggcagggccccgucgaccucucagauccaagcaaaaggcaguucuauauuaagaucucugacgugcagguuuuuggauacucccugcguuucaaugccgaccuuuugcgcagugcggugcaacaggucaaccagagcuauacccagggcgggcaauuuuacucuuccucaagugugaugcugcuccuguuagauauccgggacagaauuaacaggcuggccccucccguagcaccaggaaaaccccagcuugauuuguucagcugcaugcucaagcaucgacugaagcuaacuaauucggagauaauccggguuaaccacgcucuggaccucuacaauacggagauucugaaacaguccgaucaaaugacagccaaacuuuguuga

SEQ ID NO: 53470 - RNA, 2352 nt, Artificial Sequence
  derived and/or modified sequence opt3 from BRINP2__Homo_sapiens__NP_066988
augagauggcagugcggcaccagguuccgggggcugcgccccgccguggcuccuuggacagcacuccuugcccugggauugccagguugggucuuagcgguuagcgcuacugccgcagccgugguaccggagcaacacgcuuccguggcaggccagcauccccuggacuggcuacucacggaucgagggccuuuucaccgugcccaggaauacgcugacuucauggagagauauaggcagggauuuaccacacgguaccgcaucuauagagaauuugccagguggaaggucaacaaucuggcgcuugagcggaaagauuucuucucucugccauugccccucgcaccugaauuuauucgcaacauacgacugcugggcagaaggccaaaucuccaacaggugacugagaacuuaaucaagaaauacgguacccauuuccugcuuucagccacauugggaggggaggaaagucugaccauuuuuguugacaagcagaaacuaggccggaagacugagacaaccggcggggcuagcaucauuggagguuccggcaauucuacggccgugucgcucgaaacucugcaccagcuugcagcuucauauuucaucgaucgugagagcacccugcgcagauugcaucacauacaaaucgccacaggggcgauuaaggucacugagaccaggacaggaccccucggcuguaguaacuacgacaaucuggauuccgugucuagcguauuaguucaguccccugaaaacaaagugcagcugcucggucuucagguccuguugccagaguaucuacgggaacgauuuguggccgcagcucugucauacauuaccugcaguagcgagggggaacucguguguaaggagaaugacugcugguguaaaugcucuccgacguuccccgaguguaacugcccugaugccgacauccaagcuauggaagauucccugcuucagauccaggacucaugggccacucacaaucgccaauuugaggaaagcgaggaguuccaggcacuguugaagagacucccagaugacagguuccugaacaguacagccauaucucaguuuugggcuauggacaccuccuuacagcaucgguaccaacagcugggagcgggccuaaaaguccucuucaagaagacucaccgcauucugagaaggcuuuuuaauuuguguaaacguugccaucggcagccccgauucagacugccuaaggaaaggagccucucguauugguggaaccgcauccagucucugcuuuacuguggcgaguccacauuuccagggaccuuccuggaacaaucacacaguugcacgugccccuaugaucagagcuccugucagggaccgauuccuugcgcauugggugagggccccgccugugcucacugcgccccagacaauucuacccggugugggagcugcaacccuggauacguucucgcacagggccuguguagacccgaaguggccgagucauuagaaaacuuucugggucuagagacagaucuccaagaccuggagcuuaaauauuugcugcagaagcaggauaguaggaucgaaguacauuccaucuucauuagcaaugacaugcgccucgggucuugguuugauccaucauggcgaaaacggaugcuguuaacucugaagaguaacaaauacaagcccggccuugugcacgucauguuggcucucagccugcagauaugccuaaccaaaaauuccacacuggagccugugauggccaucuauguuaacccauucggaggcucucauucggaaagcugguuuaugccggugaaugagggguccuuccccgacugggagcguacuaacgucgaugcagcggcucaaugucagaauuggaccauuacacucggaaacagauggaagaccuuuuucgaaacugugcacguauaccugaggucacgcaucaagagucuugacgauucuagcaaugagacgauauacuaugaaccuuuggagaugacagacccauccaaaaaccuggguuacaugaagauuaauaccuuacagguuuucggcuauucacuccccuuugacccugaugccauccgggaccugauccuucaacuggauuacccauauacucaggggagccaggacucugcauugcuccagcugauugaacuaagagauagggugaaccaacugagucccccgggaaaaguccgacucgaccuguucuccugccuuuugcgccaucggcugaaguuagccaauaacgaggugggcagaauccagagcucucucagggcuuuuaauuccaagcugccuaacccagucgaguacgaaaccgguaaacuuuguucauga

SEQ ID NO: 53471 - RNA, 2301 nt, Artificial Sequence
  derived and/or modified sequence opt3 from BRINP3__Homo_sapiens__NP_950252
augaucuggagaagcagggccggcgcugagcuguucucccucauggcacuuugggaauggauugcccugucuuugcacugcuggguguuagcggucgcugccguuucagaccagcaugcaaccagucccuuugauuggcugcuaagcgacaaggggccuuuccaccggucccaagaguacacagauuuuguggaccgcucucgacagggauucucgacucguuauaagauauacagagaauuugguagguggaagguaaacaaucucgccguggagcggcgcaacuuccugggcucaccacuuccgcuggcucccgaauuuuucagaaauaucagguugcucgggcggcgcccuacgcugcagcagauuaccgagaaccugaucaaaaaguauggaacacauuuucucuuaagcgcaacucugggcggugaggaaagucuuaccauuuucgucgauaaacgaaaguuguccaagagagccgaggggucugacagcacaaccaauuccucaagugugacucuggaaacacuacaccaacucgcugccagcuacuuuaucgauagggacucuacccugcggcgucuucaucacauacagaucgcguccacggcaauuaaaguuacugagacccgcacaggaccacugggcuguucaaacuaugauaauuuggacagcgugaguucuguccucgugcagucccccgagaacaagauccagcugcaaggcuuacagguacugcucccugauuaccuucaggaaagauucguucaggccgcucugagcuauauugccugcaauucggagggggaauuuaucuguaaagagaacgacugcuggugucacugcggaccaaaguuccccgaauguaauugcccuucuauggauauacaagcaauggaggagaacuugcuaaggauuacugaaaccuggaaggcuuacaauuccgacuucgaggaaucagacgaguuuaagcuguucaugaagcggcucccaaugaacuacuuucugaauacaaguaccaucaugcaucuuuggacgauggauagcaacuuccagcgacgcuaugaacagcuggagaacuccaugaaacaauuguuucucaaggcccagaaaauugugcacaagcuguucucuuuaagcaaaagaugucauaagcagccgcugaucucacuacccaggcagcggacaaguacuuacuggcucacccgcauccaauccuuucuguauugcaaugagaacggucuuuugggcagcuucucugaagagacucacucauguacaugcccuaaugaccaggucgugugcaccgcguuucugccauguacggugggggaugccagugcaugccucaccugugcucccgacaacagaacaaggugcggaacuuguaauaccggcuacaugcugagccagggucuuugcaaaccugaagucgccgaguccacagaucacuauauuggguucgaaacugaccugcaggauuuggagaugaaguaccuccugcaaaagaccgaccgucggauagagguucaugcuaucuuuauuucuaacgauaugcgauuaaauucgugguucgacccaagcuggagaaaaaggaugcugcuaacacucaaguccaacaaauauaagucaagucuggugcacaugauccuuggauugucucugcagauaugucucaccaaaaauagcacucuggaacccguauuagccguguacgucaacccguuuggcggcucccauucagagagcugguucaugccugugaaugaaaacucuuuccccgauugggagcgcacgaagcuggaccuuccauugcagugcuacaauuggacacucacccuggggaacaaguggaaaaccuuuuucgagacuguucacauuuaucuacgguccagaaucaagaguaauggaccuaacgguaacgaaagcaucuacuaugagccccuggaauuuauugacccaucuaggaaucucggcuacaugaaaaucaacaauauucagguguucggguauuccaugcauuuugaucccgaggcaauacgcgaccugauccuucaauuggauuacccuuauacacagggaucacaggacagugcccuguuacagcuccuggaaauucgagaucgggucaacaaacuuagcccaccgggccaacguagacuggacuuguucucgugucuccugaggcaccgccuaaaacuguccaccucugaggugguacggauccagagcgcucuccaggcguuuaaugcaaagcugcccaacacuauggauuacgacacaacgaaacuuugcucauga

SEQ ID NO: 53472 - RNA, 3750 nt, Artificial Sequence
  derived and/or modified sequence opt3 from BRIP1__Homo_sapiens__NP_114432
augagcuccauguggucugaguacaccaucggcggggugaagauuuauuuccccuacaaagccuauccuucacagcuggcuaugaugaacaguauacucagaggacuuaauagcaagcaacacugccuguuggaauccccaacagguucuggcaaaucguuagcacugcuauguucagcccucgcguggcagcagagccugagugggaagccggcugacgagggagucuccgaaaaagccgagguucagcuuucuugcuguugcgcaugucauagcaaggauuuuacuaacaaugacaugaaccaaggcacguccaggcacuucaauuaccccucaaccccuccaagugaacggaacgguacaagcucuacuugccaggauucccccgagaagaccacacuggccgcuaaauugucagcaaagaaacaggccagcaucuaucgcgacgagaaugaugacuuucagguggaaaagaaacguauucgaccucucgagaccacucaacagaucagaaagaggcauuguuucgggacagaaguacacaaccuggaugcuaagguggacaguggaaaaaccgucaagcucaauucuccacuggagaaaauuaacuccuuuagcccccagaagccuccaggccauugcucgcgguguugcuguucuacgaaacagggcaauucccaagagucaaguaacacuaucaagaaagaucacaccggaaagagcaagauaccgaaaaucuacuucgggacacgcacucacaagcagauugcccagaucaccagagaauuaaggcggacagcguauuccggugugcccaugaccauucugucuagccgcgaccauacgugcguucacccugagguggucggcaauuuuaaccgaaaugaaaaaugcauggagcuuuuggaugggaagaacggaaaaucauguuacuucuaccauggcgugcacaagaucagugaccaacacacucugcagacauuucaggguaugugcaaggcaugggauauagaggagcuaguaucccucgggaaaaagcugaaagccuguccauauuacaccgcuagagaacuuauucaggacgccgacaucauuuucugccccuauaacuaccuguuggaugcacaaaucagggaaagcauggaccucaaucugaaggagcagguugugaucuuagaugaagcucauaacauugaggacugugcccgggaaucugcgucauauagugucacugaggugcagcugcguuuugcccgcgaugagcucgacagcauggugaauaacaauauaagaaagaaagaucacgaaccucuuagggcagucugcuguucccugaucaacugguuggaggcuaaugccgaauaccuaguugagcgggacuaugaaucugcuugcaagauuuggucgggaaacgagaugcugcucacacugcauaaaaugggcaucaccacggccaccuucccaauacuucagggccacuuuagcgcagugcugcaaaaggaggagaaaauuucccccaucuacgggaaggaagaagcccgagagguaccggugaucucagcuaguacacagauuauguugaaaggacucuucaugguccuggauuacuuauuccgccaaaauucuagauuugcggacgauuauaagaucgcaauucagcagacuuacagcuggaccaaccagauagacaucuccgacaagaauggucugcuagugcucccuaaaaacaagaaaaggucacggcagaagacagccguucaugugcugaauuucuggugucuuaaccccgcugucgccuuuagcgauauuaauggcaaagugcagacuaucguauugaccucugggacacuguccccaaugaagaguuucagcucugagcucggaguuaccuuuacuauccaacuggaagcaaaccacauuaucaaaaacucccaggugugggucggcacgauagguucagggccuaagggccgcaaucuuugcgccacauuccagaacaccgagacuuuugaguuccaagacgaagugggagcucuguugcucagugucugucagaccgugagccagggcauucugugcuuuuuacccucguauaagcugcuagaaaaacucaaggagagauggcuguccacagggcuuuggcacaauuuggagcugguuaaaaccgugaucguagaaccacagggaggugagaagacuaacuucgaugaacuccugcaagucuacuaugacgccauuaaauacaagggcgagaaggauggggcauuacugguggcgguuugcaggggaaaagugucugaaggccuugacuuuagcgaugacaaugcucgugccgucaucacaauagguauccccuucccuaacgugaaggauuugcagguagagcucaaacggcaguauaaugaccaucacucaaagcugcgagggcuacugccaggcagacagugguacgagauucaagcauacagggcccucaaccaggcucugggacgcuguauccggcauagaaaugauuggggcgcccuuauuuugguggacgauagguuucgcaacaauccgagucgauauaucuccgggcugucuaaauggguucggcagcagauacaacaccacagcacguucgaauccgcauuagagucacucgcugaguucagcaagaagcaucagaaaguccugaacgugaguauuaaggaccguaccaauauccaggacaacgaaucuacucuugaagugacaucccugaaauacagcaccucgcccuauuugcucgaggccgcgucacaccugucuccugagaauuuugucgaagaugaggccaagauuugcguucaagaacuacaguguccaaaaaucauaacaaagaacaguccccugccuuccagcaucauuucuagaaaggagaaaaacgacccaguguuccucgaggaagcuggaaaggcagagaaaaucgugauuagcagguccacuucacccaccuuuaauaagcagacgaaacgcguaaguuggagcucuuucaacucccugggucaguacuuuaccggcaagaucccgaaagccacaccugaacuugggucaagugagaauagcgcuuccucuccaccccgguucaagacugaaaagauggagucgaaaaccgucuugccuuuuacagauaagugcgagagcucaaaccugacugugaauaccuccuucggaaguuguccccaaucugaaacgauaauuagcuccuuaaaaaucgacgccacacucaccagaaagaaccauucagagcacccacugugcucugaagaggcacuugauccugacaucgaacugagccuaguuagugaggaggauaaacaguccacuagcaauagggacuuugaaacagaggcggaagaugagucuauuuauuucacccccgaacucuacgacccagaggauacugacgaggaaaagaacgaucuggccgagaccgaccgaggcaaucgcuuggcuaacaauucagacuguauccuggccaaggauuuauuugaaauucggacaauaaaagagguggacuccgcaagagaggucaaggcugaagauugcaucgacacgaaacucaacgguauucugcauaucgaggaaaguaagauugaugacaucgaugggaaugugaaaaccacuuggauaaacgagcuugaacugggcaagacacacgagaucgagauuaagaauuucaaaccgagcccuucgaagaacaaaggaauguuucccggcuucaaguga

SEQ ID NO: 53473 - RNA, 228 nt, Artificial Sequence
  derived and/or modified sequence opt3 from BRK1__Homo_sapiens__NP_060932
auggccggccaggaggaccccgugcaaagagaaauccaccaggauugggcuaacagggaguacauugaaauaaucaccagcuccauuaagaaaaucgcagacuuccucaauucuuuugauaugucaugccggagucgccuggccacacuuaacgagaagcugacugcguuggaacgacguauugaguauaucgaggcuagagucacgaaaggggaaaccuuaacauga

SEQ ID NO: 53474 - RNA, 873 nt, Artificial Sequence
  derived and/or modified sequence opt3 from BRMS1__Homo_sapiens__NP_001020128
augcccgugcagccuccaagcaaggacaccgaggaaauggaggccgaaggcgauuccgcugcagagaugaacggggaagaggaggaaucugaggaagagagaucaggaagucaaacagagagcgaagaggaauccucugagauggacgaugaagacuacgagaggcggcgcucggagugcgucucagaaaugcuggaucucgagaaacaguucagcgaacuuaaggagaaacuguuucgagaacguuugagucaguuaagacugaggcuagaggagguuggugccgaacgggcgccggaguauacugaaccccucggcgggcugcagcgcucccuuaagaucaggauucaaguggcuggaauauacaaaggcuucugucuggacguaaucagaaauaaguaugagugcgaauugcagggugccaagcagcaccucgagucugagaaacugcugcucuacgauacguuacagggggaacugcaagagcggauucagcgccuugaagaggaccgacagagcuuggaucuguccucagaguggugggacgauaagcuacaugcaagaggaaguagcaggucuugggacucccucccuccaucaaaacggaagaaagcuccccuggugagcggcccuuauaucgucuacaugcuucaggaaauugauauccuggaggacuggaccgccauaaagaaggcacgugccgcugugaguccacaaaaacgcaagucugacgauagaaggacacaccggcccuugcgaguuuguccugcccgccuccuguggugcuguugggcguuaccacugcaucucgcacuugccuggacuccgccccugccuuccagcagaccagcucaguuguggcccuggucguga

SEQ ID NO: 53475 - RNA, 972 nt, Artificial Sequence
  derived and/or modified sequence opt3 from BRMS1L__Homo_sapiens__NP_115728
augcccgugcacagcagaggcgacaagaaagagaccaaccaucacgaugaaauggaggucgacuacgccgaaaaugagggguccucuucagaagaugaggacacagagaguagcuccguuucugaagauggagacucgucagagauggaugacgaagauugcgagaggcggcgcauggagugucuggacgaaaugagcaaccucgagaagcaguucacugaucuuaaagaccaacuguauaaggaacgauugagucagguggaugcuaaauuacaggagguaaucgcagguaaggccccugaauaccuggagccacuagcgacgcuccaggagaauaugcaaauucguaccaagguggcuggcauauauagagaacugugccuugaguccgucaaaaacaaguacgaaugugagauccaggccucuaggcagcauugcgaaagcgagaaacuguugcucuaugacacagugcaguccgagcuggaagagaagauucggcgccuggaagaggacagacacucaaucgauauuaccagugaacucuggaaugacgaguuacaaagcaggaaaaagcggaaggauccguuuucucccgacaaaaagaaaccuguuguggucuccgggccauacaucguguauaugcugcaggaucuugacauauuggaggauuggacuacaauccgcaaggcaauggccacccugggaccccaucgaguaaaaacugaaccuccaguuaagcuagagaaacaccuccacucagcuagaagcgaagagggcaggcuguacuacgacggugagugguauauucgggggcagacaaucuguauugauaagaaggacgaaugccccaccagugcagugaucacgacuauaaaccaugaugaggucugguucaaacguccugacggaucuaaguccaaacuuuacauuagccagcugcaaaagggcaaauauucgaucaagcacucuuga

SEQ ID NO: 53476 - RNA, 1200 nt, Artificial Sequence
  derived and/or modified sequence opt3 from BRS3__Homo_sapiens__NP_001718
auggcccagagacaaccccacagcccuaaccagacccugaucuccauuacaaaugacacugagucuucaaguagcguggucuccaacgauaauacgaacaagggcuggucuggggacaauucgccaggaauagaagcucucugcgcaaucuacauuaccuaugccguuaucauuucaguggguauccuuggcaacgcgauacugaucaaaguauucuuuaagacaaaaagcaugcagacugugccgaauauuuucaucaccaguuuggcuuuuggggauuuacugcuacuccugacauguguccccguggacgccacccauuaccuugcagagggauggcuguucggcaggauugguugcaagguuuuguccuuuauccggcucacuucugugggggucagcguguucacacugaccauacuguccgccgaucgcuauaaagcuguaguuaagccucucgaacgacagccaucaaacgcaauuuuaaagacgugugugaaagccggaugcgucuggaucgugaguaugauuuuugcucugcccgaggccaucuucagcaauguguacacuuuucgugacccuaacaagaauaugaccuucgaaucuuguacauccuauccagucucaaagaaacuuuugcaagagauccacagccugcuaugcuuucucguuuucuacauuauaccccugaguaucauuucuguguauuacucccuuaucgcgagaacucuguacaaaagcaccuugaacauaccuacagaggaacagucgcaugcaaggaagcagauugagucucggaagcgcaucgccagaaccguacucgugcuggucgcuuuauuugcccuguguuggcucccaaaucaccuucuguauuuguaccauuccuucacgucacagacuuauguggauccgagugcaaugcacuucaucuuuacaauuuucagcaggguucuagcuuuuuccaacucuugcgugaaucccuucgcccuguacuggcucagcaaaucauuucaaaagcacuucaaagcgcagcuguuuuguugcaaggccgaacggccugagccacccgucgcagacaccagucuuacuacacuggcugugaugggcaccguaccuggcacgggguccauccagaugagcgagauuucuguuaccucauucacaggauguagugugaaacaggccgaagaucgcuuuuga

SEQ ID NO: 53477 - RNA, 2337 nt, Artificial Sequence
  derived and/or modified sequence opt3 from BRSK1__Homo_sapiens__NP_115806
augagcuccggcgccaaggaagggggagguggcucucccgcuuaccaucugccucacccacacccgcaucccccucagcacgcacaauauguggggccauacagacucgaaaagacccuuggaaagggccagacaggucuggucaaauuggggguucauugcaucacuggacagaagguggccauuaaaauaguaaacagggagaaguuaucagaaagugugcugaugaaggucgagcgggaaaucgcgauucuaaaacucaucgagcacccccacgugcugaaacuucaugacguuuaugagaauaaaaaguaccuguauuuggugcucgaacacgucagcggcggcgagcuguucgauuaccuggugaaaaaggggcgccucacgccuaaggaagcucgaaaauuuuuccgucagauuguauccgccuuagacuuuugucauucuuauucgaucugccacagagaucugaagccagagaaccuuuugcuggacgagaaaaauaacauaaggaucgcagauuucggaauggccucacuacaaguuggugacagccuccuggaaaccaguuguggcucuccccacuacgcuugcccugaggugauuaagggggaaaaauacgauggacggcgcgcagacaugugguccuguggcgucauccuuuuugcccuguuggugggugcucucccauucgaugacgauaaucugagacaguuacuggagaaggugaaacgcggggucuuucauaugccgcacuucauucccccugacugccagagccuccuucggggaaugaucgaaguugagccagagaagcgccuguccuuggaacagauacaaaagcaucccugguaucuaggcggcaaacacgagccugauccaugucuggaacccgccccggggcgaagaguggcgaugaggucacucccuaguaacggagagcuggaccccgacguacuugaaagcauggcaucucuggguugcuuucgggaucgugagcgcuugcauagagagcucagguccgaagaggaaaaucaggagaagaugauuuacuaucuguuacuggaccggaaagaacgauacccaucaugugaggaucaggaccuaccuccccgcaacgauguggacccacccagaaagagggucgauagcccuaugcucagucggcacggcaaacgcagaccagagaggaagucuauggaagugcuguccaucacagacgccgggggaggcgguagcccgguucccacucgucgggcucuugagauggcccagcacucgcaacgaucuagauccgugucaggggcaaguaccggcuugagcuccucuccucugagcucaccaaggagucccgucuucuccuuuagcccugaaccaggagcuggcgaugaggcccgcgggggagguucucccacaucaaagacccagacucucccgagucggggcccuagagggggaggcgcgggugagcagccacccccucccagcgccagguccacaccacugccugggcccccaggcucuccgcgcucgagcggaggcaccccucuucauucaccccugcacacgccacgagcaucccccacugggaccccuggaacaacuccacccccuaguccggguggcggggugggaggcgcugccuggcggucucguuugaauagcauuagaaacuccuuccucgguucaccaagguuucaucgccggaaaaugcaaguacccaccgcugaagagaugagcucucugacaccugaauccaguccagaguuagccaagagaagcugguucgggaauuucaucucucuggacaaagaggagcagaucuuucuaguucucaaggauaaaccccuguccucaauuaaggcagacauagugcacgccuuccuuaguaucccuagcuugucgcacuccguccugucucagaccagcuuuagggcugaguauaaggcgucaggcggaccgaguguguuccagaaacccguccgauuucaaguggacauuuccucuagcgaaggcccagagccuucccccaggcgggaugggucaggaggcggugggaucuacagcguuacguucacucucauaaguggaccaucuagaagguuuaagcgugugguagaaacaauucaggcacagcuguuauccacccaugaccagccuagcguccaagcccuggcugaugagaaaaacggcgcccagacucgccccgccggugcaccaccgcggucgcuucagccucccccaggcagacccgacccugaauugucaucuaguccaaggcgagggcccccuaaggauaaaaagcuccuggcuacaaauggaaccccgcuaccauga

SEQ ID NO: 53478 - RNA, 2211 nt, Artificial Sequence
  derived and/or modified sequence opt3 from BRSK2__Homo_sapiens__NP_001243556
augaccagcacaggcaaggacgggggagcccagcacgcucaauacgugggucccuauagacuggagaaaacucucggcaaggggcagacgggacuugucaaacugggcguucauugcgugaccugucagaagguagcaaucaaaauugugaacagggaaaaguuguccgagucugucuuaaugaagguggaacgggagauagccauccugaaacuaauugaacacccucauguucucaagcugcacgauguguacgagaauaaaaaguaucuuuaccuggucuuggagcaugugucagguggggaacucuucgacuaucugguuaaaaagggacgccugacaccaaaggaggcgcgaaaauuuuuccgucagaucauuagugcucucgauuuuugccacagccacuccaucugucauagagacuuaaagccggaaaaccugcuuuuggaugagaaaaauaacauaaggaucgccgacuucggcauggcaucucugcaaguaggcgauucgcuacucgagacuucaugcgggagcccccacuacgccuguccugaagugauucggggagagaaguaugacggucgcaaagcugaugucuggaguugcggcgugauccuguuugcacuucuggugggggccuugccauucgacgaugacaaucucagacagcuguuagaaaaggucaaaaggggaguuuuucauaugccccacuucauuccuccagauugucagucccugcuccggggcaugaucgagguggacgcugcccgccgacuuacccuggaacacauacagaagcauauuugguacaucggugggaagaacgagcccgagccugaacaaccaauuccgagaaaaguacagaucaggucuuugcccagccuagaggacaucgauccugacgugcuggauuccaugcacucacucggaugcuuucgggaccguaauaagcugcuucaggaucuguugagugaagaggaaaaccaggagaaaaugauuuacuuccuccuguuagaccgcaaggagagauauccaagccaagaagaugaggaccugcccccuaggaaugaaauagauccaccccggaaacgagucgacucuccgaugcuaaaccgccauggcaagagaaggccugagcggaaguccauggaagugcucucaguuacagauggcgggagccccgugccagcgcgcagagcaaucgagauggcccagcacggacagaggagucguucuauuuccggugcuagcucgggccugucuaccuccccucuuucaaguccccgggucacuccacaucccagcccucgaggguccccauugccgacacccaaaggaaccccugugcacacgccaaaggagucucccgccggcacuccuaauccaacacccccgagcucaccuaguguaggugggguuccauggagagcaaggcugaacuccaucaaaaauagcuuucucggcucuccccgcuuccaccggagaaagcugcaagugccuacccccgaagagaugucaaaccuuacuccagaaaguagcccugagcuggcuaaaaaguccugguuuggaaauuucauaucuuuggagaaggaggaacagauuuucgucgugaucaaagacaagccccucucgagcaucaaagccgacauuguccaugcguuucuguccaucccaucauuaagucacucugugauuagccagaccuccuucagggccgaauacaaggcaacaggcgggccggcuguuuuucagaaaccugugaaguuccaaguagauauaaccuauacggagggaggugaagcccagaaggagaacggcaucuacucagucacuuuuacacugcuaagcgggcccucucgccgauucaaacgggugguugagaccauucaggcucagcuccuguccacucaugacccacccgccgcacaacaccuuagugauacaaccaacuguauggaaaugaugacgggacguuugagcaagugcggcucuccucuguccaacuuuuucgacgugaucaaacagcucuuuucagaugagaagaauggucaggccgcucaggcgccaaguacccccgcaaaaagaagcgcccacgggccucugggcgacucggcugccgcaggaccgggcccagggggagaugccgaauaucccacagguaaggacacugcuaaaaugggcccuccaaccgccaggcgcgagcaacccuga

SEQ ID NO: 53479 - RNA, 363 nt, Artificial Sequence
  derived and/or modified sequence opt3 from BRWD1__Homo_sapiens__NP_001007247
auggccgagcccagcuccgcuagaaggccugugccacugaucgaaucugagcucuacuuccuuauugcacgguaucugucagccggcccgugccgccgagcggcucaggucuugguucaagaauuagagcaguaccagcugcuacccaagcgucucgacugggaagggaacgagcacaauagaaguuaugaggaacuggugcuuagcaacaaacauguagccccugaucaccuguugcagauaugucaaaggaucggaccaaugcucgacaaggagauucccccuuccaucucucgggugaccucgcugcugggugcaggccgccagucacucuuaagaacagccaaagggacucugauuuga

SEQ ID NO: 53480 - RNA, 5409 nt, Artificial Sequence
  derived and/or modified sequence opt3 from BRWD3__Homo_sapiens__NP_694984
auggccgcugcacccacccagaucgaagccgaacuguacuaucucauugcgcgguuccuucaaagcggcccuugcaacaaguccgcucaggugcugguccaggaauuggaagaacaccaguuaauaccaaggcggcuggacugggaagggaaagagcaucgccgaucuuuugaggauuugguugccgcaaaugcccacaucccgcccgacuaccuccugaagauuugugaacguaucggaccucuucuggauaaagagauuccacaaucagugcccgguguacagacauugcucggcguggggagacagagucugcugagggacgcuaaggauugcaaaagcacucucuggaacggauccgcauucgccgcuuuacaucggggccgcccuccagaacugcccgucaauuaugugaagccuccaaacguugugaauaucacgucugcccgccagcuuaccgguuguucgagguuugggcacauauucccgucaagcgcguaccaacauaucaagaugcacaaacggauuuugggacaccugaguuccgucuauugcguggcauuugaccgcucuggccgaagaaucuucacaggcagcgaugacugucuaguaaagauuugggccacugaugacgggaggcuccuggcuacccuucggggacauuccgccgagaucucagauauggcaguuaacuacgagaauacacugauagcugccgguaguugcgacaaagugguccgugugugguguuugagaaccugcgcgcccguggccguccuccagggccacagcgcaucuauuacuuccauccaguuuuguccuucaacaaaggggaccaacagauaucugacgagcacuggagcugauggcaccauuugcuucuggcaguggcauguuaaaacaaugaaguuuagggaccggccagugaaguucacugaacgaagucgccccgguguacaaaucucuuguuccagcuuuucgucugggggaauguucaucaccacaggcuccaccgaccacgugauuagaauauacuacuuaggcucagaggucccugagaaaaucgccgagcuggaaagucacacggauaaggugguugcugugcaguuuugcaauaacggggacagccucagguucgucuccggaucucgggaugguacugcccgcauuuggcaguaucaacagcaggaguggaaaagcaucgugcuugacauggcaacaaagaugaccggcaauaaccugccaucaggggaggauaaaauaacuaaguugaaaguaacaaugguugccugggacagauacgauaccacggugauuaccgcugucaauaacuuccuacugaagguguggaauaguaucacaggacagcuccugcauacucuuuccggccacgacgaugaagucuuugugcuggaggcgcaucccuucgaccaaaggaucauuuugagcgcaggucacgaugggaacaucuuuauuugggaccucgaccguggcaccaagauacggaacuauuucaauaugaucgaaggacagggccauggggccguuuuugauugcaaauucucuccggacggaaaccacuuugcuuguacagauucacacggucaucuguuacuguucggcuuugggugcaguaaguacuaugagaaaauuccugaccagauguucuuucacacugauuaccgaccccuaaucagagacgccaauaacuaugugcucgaugaacagacccaacaggcaccacaucugaugccucccccauuccuuguagacgucgauggaaauccccacccuacaaaguuucagagguuggugccaggccgcgagaacuguaaagacgagcagcugaucccgcaacucgguuacguugccaauggggauggcgaaguggucgaacaggugauuggacagcagaccaacgaccaagaugaaagcauacuggacggcaucauucgggagcuucagagagaacaggaccugagguugaucaaugagggggauguaccccaccucccugugaaccgcgcuuacuccguuaauggagcccugcgaucuccaaacauggacauuucgagcucccccaauauccgguuacguagacauucaagucaaauagagggugucaggcagaugcacaacaaugcaccucgcucucagauggcgacugaacgggaucugauggcuuggagcagaagggugguggucaacgagcuaaacaauggcguuucccgagugcaggaagagugccgcacggccaagggggacaucgagauuucacucuauacaguggaaaagaaaaagaaaccaagcuacaccacucaacggaacgauuaugagcccucuuguggaagaucccugaggcguacccagcgcaagcggcagcauacauaccagaccagaaguaauaucgaacacaacagccaagcaucuugccaaaauuccggcguacaggaggacucagauaguagcucggaagaggacgagacugucgguacauccgaugccucuguggaagacccgguuguggaguggcagagcgaaucaaguuccucugauagcuccucagaguauagcgacuggacggcugaugccgggauuaaccuucaaccuccaaaaaggcagacccgacagacuacacggaagaucuguaguucuuccgacgaagagaaucuaaagagccuggaggaacgccagaaaaagcccaaacagaccagaaagaaaaagggcggacucgucucgauagcaggcgagccuaacgaagagugguucgcuccccaguggauucuggacacaaucccaaggcggucaccuuucgugccccagaugggggaugaauuaauuuacuuucgacaaggacaugaggccuauguuagagcggugcgcaagucuaaaaucuacaguguaaaucugcagaagcagccauggaacaaaauggaccuuagggagcaggaguucgucaagauagugggcaucaaauacgagguggguccgccuacuuugugcugucucaagcuggccuuucuagaucccauuuccgggaaaaugaccggagagagcuucucuaucaaguaucacgacaugccagaugucauugacuuucugguucuccaccaauucuacaaugaggcuaaggagcguaacuggcagaucggcgaucgguuuagaagcauaauugacgaugcauggugguucgguacgguggaaucccagcagcccuuucaaccugaguauccagacucaaguuuccagugcuacagcguacauugggauaauaacgaaagggagaaaaugucucccugggacauggaaccuaucccggagggcaccgccuuuccagacgaggugggggcuggaguccccgugucccaggaagaacugacagcccuuuuguauaagccucaggaaggcgaguggggagcacacucacgcgaugaagagugugagcgaguuauccaaggaauuaaucaucuguuaagucucgacuucgcgagcccauuugccgugcccgucgaucuguccgcuuacccucuuuauugcacugugguugccuacccgaccgaccugaacacaaucagacggagguuggaaaaccgcuucuaccguagaauuucugcacucaugugggaggugcgguauauagaacacaaugcuaggacuuucaacgagcccgauucgccaaucgucaaagccgcaaagauuguaaccgacgugcugcuacgcuuuaucggcgaucagagcugcacggacauucuggauacauacaauaaaaucaaggccgaagaacgaaacucaaccgacgcugaggaagauacugagauaguugaccucgauuccgacgguccugggacaaguucuggaagacgggugaaguguaggggccgcagacagagccugaaaugcaaucccgacgcguggaagaaacaauguaaggaacuuuugucccugaucuaugagagggaggauucagaaccauuccggcagccugccgacuuacucucuuaccccggucaucaggagcaggaaggcgagagcagugaauccgucgugccagagcgucaacaggauagcucucugucagaggacuaucaggauguaauugacaccccgguggauuuuuccacugucaaagaaacccuugaggcagggaacuacggaaguccucuggaguucuauaaggacguucgccagaucuuuaauaacagcaaggcuuacacaucgaauaaaaagucucgaauuuacuccaugaugcuaagacucagcgcccuguucgagucacacaucaaaaacauaauuagugaauauaagucugccauccaaucccagaaaaggcggcgccccagauacaggaagcgguugcgaagcucaaguagcucccugucuagcuccggcgcuccaucacccaaggggaaacagaagcagaugaaauuacaaccuaagaaugaucagaacacgucugugagucacgcaagaaccucgagcccauuuuccucucccgugucagacgccgcggagggacucagccuguaucuucuggaugacgagccugauggcccguucuccaguucuagcuuugguggguacucacgcuccggaaauagucaugacccaggcaaagcuaagagcuucaggaaccgggucuugcccgugaaacaggaccacucucucgaugguccucugacuaauggcgacgggcgugaacccagaacaggaaucaagaggaagcuacuguccgccucagaggaagaugagaacaugggcggggaagacaaagagaagaaagagaccaaggagaaaagccaucuuucgacaucugagaguggagaacucggcuccagccugucauccgagucuacuugcgguagcgauagugacuccgagagcaccucucgcacggaucaagacuauguugauggggaccacgauuacucaaaguuuauucagacacggccaaagcgaaaauugagaaagcagcacggaaacggcaaaaggaauuggaagacccgcggcacugggggacgggguagauggggccguugggggagguggagucggggaggccgcggucgagggggaagaggcaggggcucccgggggcgcggagguggcgggaccagaggaaggggccgagguagaggcgggcguggggcaagcagaggcgccacacgcgcuaaaagggcacggauagccgacgacgaguucgauacuauguucucugggagauuuucgcgccugccuaggaucaagacccgaaaccagggacggagaacaguauuauauaaugacgauucagacaacgauaauuucgugagcacggaggacccccucaaccuggguaccuccaggaguggccgcguccguaagaugacugaaaaagcgcgggugucucaucuuaugggguggaauuacuga

SEQ ID NO: 53481 - RNA, 1389 nt, Artificial Sequence
  derived and/or modified sequence opt3 from BSCL2__Homo_sapiens__NP_001116427
augagcaccgagaagguggaccagaaagaagaggccggcgaaaaggaggucugcggggaucaaaucaaaggacccgacaaggaagaggagccuccagcugcagccucccacggucagggcuggagacccgggggaagggcggcucggaacgcccgcccggaaccuggcgcacgacauccagcccugcccgcuaugguuaaugauccuccagugcccgcacuccuuugggcccaggagguaggucaggugcuggcugggcgugccagaagguuguuacugcaauucggaguccuauuuuguacaauucuccugcuucugugggugucuguuuucuuguacggcucauuuuauuacaguuauaugccuacugugagccaccucuccccaguccauuucuacuaucggacggacugcgauucuucgaccacaucacuguguagcuuuccgguggcgaacguaagucugacuaaaggcgggcgcgacagaguucucauguacggacagcccuauagggugaccuuagaacuggagcuuccugaguccccagucaaucaggauuuggguauguuccuggugacaauaucuugcuacacccggggcgggcgcaucauuagcacuuccucacgaagugugaugcuacacuacagaagcgaccuccugcagaugcuugauacacuggucuuuucuuccuugcuccuguucggauuugcagaacaaaagcaguuacuggagguugaacucuaugccgacuacagggagaacucauaugugcccaccacgggcgcuaucauugaaauccauagcaagcggauacagcuuuacggugccuaucugcguauccacgcacacuucacuggguugcgcuaccuacuguauaauuuuccuaugaccugugcuuucauuggaguagccaguaacuuuacauuccucucugugaucguccuguucuccuacaugcaguggguguggggcggcauuuggccaagacauagguuuagccuucaaguuaauauccggaaacgagauaacucgcgcaaggaggugcagagaaggauaucugcgcaccagcccgggccggagggacaagaagaguccacuccucagucagacgucaccgaagauggugagagucccgaagacccaagcggcacagaggggcagcuguccgaggaagagaaaccugaccagcaacccuugucuggagaagaggaacucgagccagaggccagcgauggcucagguaguugggaagacgcagcucuguuaaccgaggccaaucugcccgcuccugccccagcauccgccagcgcuccggugcuagaaacgcucgggucuucagagcccgcgggcggagcacugcggcagcgcccuacuugcaguagcuccuga

SEQ ID NO: 53482 - RNA, 1158 nt, Artificial Sequence
  derived and/or modified sequence opt3 from BSG__Homo_sapiens__NP_001719
auggccgccgcacuguucgugcuccuuggcuuugcccuguuggggacccacggagcgagcggugcugccggcuucguccaggcacccuuaucccaacagagauggguugggggaucuguggagcugcauugcgaagccguaggcucaccugugccagagauccaguggugguuugaaggucaggggccgaacgacacauguagucaacuaugggauggagcuaggcucgaccggguccacauucaugcaacuuaccaccagcaugccgcuagcacgauauccaucgauacccugguggaggaagacacaggcacuuaugagugccgcgccucuaaugaucccgaccgaaaccaccuuacccgugcgccuagaguuaagugggugagggcacaggccgucgugcugguauuggagccaggcacaguuuucaccacuguggaagaucucgggucgaaaauucugcugacauguucacucaaugacagcgcuaccgaggucacgggacaccggugguuaaaggguggcguggugcugaaagaagaugcccuucccgggcagaagacugaguuuaaagucgacagugaugaccaauggggagaguacuccugcguuuucuugccugaaccaaugggcaccgcaaacauccagcugcauggucccccucgcgugaaggcuguaaagucuagcgagcacauuaaugaaggggagacagccaugcuaguguguaaauccgaaucagucccaccggugacugauugggcgugguauaagaucaccgacagugaggacaaagcccucaugaacggaagcgagucuagauuuuucguuuccucaagccagggcaggagugaacugcauauagagaaucuuaacauggaagcagaucccggccaguaccggugcaaugggacaucuuccaagggaagcgaccaagcuaucauuacccugcgcgugcgaucgcacuuggccgcucucuggccuuuucuggguaucgucgccgagguguuaguacugguuacgauuaucuucauauaugagaaaagaaggaagccagaagaugugcucgacgaugacgaugcaggcucugcuccccuuaaguccucagggcagcaccagaacgacaaaggaaagaauguccggcaacguaacaguagcuga

SEQ ID NO: 53483 - RNA, 11781 nt, Artificial Sequence
  derived and/or modified sequence opt3 from BSN__Homo_sapiens__NP_003449
augggcaacgaggugucacuggaagggggagccggugacggcccccucccuccagggggagcuggcccgggucccgggccuggaccaggccccggcgccgggaagccuccauccgcccccgcgggagguggccagcuuccugcugccggggccgccagaucuacagcugucccaccgguucccggaccuggcccaggucccgggccuggaccaggccccggcucaacaaguaggcggcuggauccgaaagagccuuuggggaaucaacgcgcagccagccccacuccaaagcaggcuuccgccacgaccccuggacacgaaucuccccgagagacacgugcgcaggguccagcaggccaggaagccgacgggcccagaaggacuuuacaaguggauucgcggacccagcgcucaggaagaagcccuaguguauccccagacaggggcucuacaccgaccagccccuacuccgugccucagaucgcuccacugcccucaaguacucucugcccuauuuguaaaacaagcgaucucaccucuacgccaucccagcccaacuucaauacuugcacccaaugucauaacaaggucugcaaucagugugguuuuaacccgaauccucaccugacacaggugaaagaguggcuuugccugaacugucagaugcaacgggccuuggggauggacaugacuaccgcaccacgcucaaagagccagcagcaacuccauagucccgcucugucuccugcccacucccccgcgaagcagccacugggcaaaccugaucaggagcgaagcagaggacccggcgggccacagccgggaucgaggcaagccgaaacagcacgggcuaccucuguuccuggucccgcccaggcugccgcaccacccgaggugggccgugucuccccucagccaccccagccuacgaagccgucaacugccgaaccacgcccuccagcuggggaggcgccagcaaaaagugccacagcugugcccgccggacucggcgcaaccgagcaaacucaggaagguuuaacagggaagcuguucggccuuggagccagcuugcugacccaggcuuccacguugaugucuguacagccugaggccgacacccaaggccagccggcacccagcaaagggacaccaaagauaguuuuuaaugaugcgucaaaggaagcuggaccuaaaccccucgguaguggcccagggccuggacccgccccaggcgcaaagacugagccgggugccagaauggggccuggcuccggacccggcgcucugccaaaaaccgggggaacaacuagccccaagcauggcagggccgaacaccaggcagcuucuaaagccgcggccaagccuaaaaccaugccaaaggagcgggcuaucugcccccuuugucaggcagagcugaacguggguucaaagaguccugccaauuauaacacaugcaccacuugucgauugcaagucugcaaucucugcggguucaacccgacgccacaccugguggagaaaaccgagugguuaugucugaauugccagaccaagcgccuccuugaaggaagccugggcgagcccacuccuuugcccccaccuaccucccagcaacccccagugggugcuccucauagagccucuggcacaucgccgcuaaaacagaaggggccccagggacugggccagccaagcgggccucuccccgcaaaagcguccccacugucaaccaaggccaguccucuucccucuaaggcuagcccgcaagccaaaccacugagggcauccgaaccuucaaagacucccagcucuguccaggagaaaaagacacggguuccaacgaaagcugagcccaugccuaagccgcccccagaaaccacuccuacacccgccaccccuaaggugaaauccggaguacgcagagcagagccagccacacccguggucaaggcugugccugaagcgccaaaaggcggugaggccgaagacuugguugggaagcccuacagucaggaugcaagcaggucuccgcagucccucucagacacuggauauaguagcgauggcauuucguccucucaaagcgagaucaccggugugguccagcaggagguggaacagcuggacucagcuggcguaacggggccucacccacccaguccuuccgagauucauaaaguuggaucuagcaugcguccauuacugcaagcccagggccuagcccccuccgaacggucaaagccgcucagcagugggaccggagaggagcagaagcaacgaccucacucucuguccaucacacccgaggcuuuugacagcgaugaggaacuugaggacauauuggaagaggaugaggacucggcagaauggagaaggcgccgggagcagcaggauacugccgaaucaucugacgauuucggcagucagcugagacacgacuacguggaggauuccagcgaaggugggcucucuccacugccuccccaaccacccgcgagggcugccgagcuuaccgacgaggauuuuaugcgccgacagauccuggaaaugagcgcagaggaagacaacuuggaggaagacgauacagccacuuccggacggggccucgcuaaacaugguacccagaagggcgggccucguccaagaccggagcccucacaggagccugcagcccugccaaaaaggcgcuuaccccacaacgcgacgacaggauaugaagaacugcuaccugaaggcgggagugcugaggccaccgacggaagcggcacucuccaaggugggcugcggagauucaagacaauugagcuuaauucuaccggauccuacggccaugaauuggaucugggccaggggccagaccccucacucgauagggagccugaacuggagauggaaaguuuaacuggaagcccggaggaccgaucccgcggugagcacucuucgacccugccagcaagcacacccucauauacguccggcaccaguccuacuucucuuagcuccuuggaagaggauucagacucuagccccagucggagacagaggcucgaagaggccaaacagcaacguaaggcucgccaucggucccacgggccacugcuaccuacaaucgaagauagcucugaggaggaagaacugagagaagaggaagaacuccugagggagcaggagaaaaugcgagaggucgaacagcagcggauucgcucaaccgccagaaagacaaggcgggacaaggaggagcuucgagcacaaagacgcagggaacguuccaaaacucccccaaguaacuugagcccgaucgaggaugcuucgccuaccgaggaacugcggcaggccgcggaaauggaggaguuacacagaucuuccuguagcgaauacucacccaguccaucucucgacuccgaggccgaagcacuggauggaggccccagcaggcuuuacaagucagguagugaguauaaucugccuacguuuaugagcuuguacuccccaacagaaacccccucugggagcuccacuaccccuucaucuggacgcccgcucaaaagugcugaggaggccuaugaagagaugaugcgaaaggcugaacugcuacagagacaacagggccaggcagccggcgcccgggggccacauggaggucccucgcagccuacaggcccaagggggcugggauccuucgaguaccaagacacuaccgaccgcgaauauggccaggcugcgcagcccgcagccgaggguaccccugcuucccucggggccgcaguguacgaggaaauacugcagacgucucaaucaauuguccguaugagacaggccagcucccgggaucuugcuuuugcggaggacaaaaagaaggaaaaacaguucuugaacgccgagagugcauauauggaucccaugaagcagaauggaggcccacugaccccgggcacuucuccuacacaauuagcugcccccgugagcuuuucaaccccaacuuccagugacagcucugggggaaggguuaucccugaugugcgcguaacacagcacuucgcaaaagagacccaggacccccucaagcugcauuccucaccagccagcccuucgucugcuaguaaagaaauugguaugcccuucucccaaggcccggggacgccagccacuaccgcggucgcaccuugccccgccggacuuccacgaggcuacaugacacccgcuagcccugccgguucagagagauccccgucuccaagcaguaccgcucacuccuacgggcacagccccacuacagcaaacuauggaucucagaccgaagaucugccucaggcccccucaggccuagcugccgcaggccgggcggccagggagaagccacucagugcuuccgacggggaaggagguacaccucagcccagccgcgccuacucuuauuuugcaucgucaagcccaccucuguccccgaguucucccagcgaguccccaacuuucucaccuggcaagauggggcccagagcuaccgccgaguuuaguacgcaaacaccaucuccugcacccgccagcgauaugccgagguccccaggagcuccuacccccucaccaaugguggcgcagggcacucagacaccccaucggccuagcacaccccguuugguuuggcaggaaucuucccaagaggccccauucauggugaucacucuggcaagugacgcuagcucgcagacccgcaugguccacgccuccgccucuacgucaccuuuauguagcccgacagaaacccagcccacuacacaugguuacagucagaccacuccaccuuccgugucucaacuacccccagagccucccgggccgccuggauuuccacgaguacccagcgcaggcgcugauggcccucuggcccuuuauggguggggagcgcugccagcugaaaauaucucauugugcagaauuuccagugugcccgguacaagcaggguugagccuggcccacggacccccgggacggccgucguggaccuccgcacugcagugaaaccgaccccuauaauccugacagaucagggaauggaccuaaccucucuggccgucgaggcuagaaaguacggccuugcacucgaccccauuccagguaggcagucaacagccguucagccccuggugaucaacuugaaugcgcaagaacacacuuuccuggcuaccgccacgacaguguccauaacuauggcaagcucuguauuuauggcccagcagaaacaaccugucguguauggggauccauaccagagucgguuagacuucggccagggaggcgggucgcccguuugucucgcucaggugaagcaagucgagcaggccgugcagaccgcaccuuaccgauccggaccaagaggucgcccgagggaagcuaaauuugcccgguauaaccugcccaaucagguugcgccucuugcccguagagaugugcugauuacacaaaugggcaccgcacagagcaucggguugaagccaggacccguaccugagccaggcgcugaaccccauagggccacuccggcagagcuccgcucacacgcucugccuggugcccggaagccacacaccgucguggugcagaugggggagggcacagccggaacggucacuacccuacugcccgaggaaccugcgggcgcucuugaccucacagggaugcgacccgaaucucagcuggcaugcugugauaugguuuacaaauugccauucggaagcuccugcaccgguacuuuucauccggccccuagugugcccgagaagucaauggcugacgccgcaccacccggccaaucuagcuccccuuucuaugggccaagagaucccgagccuccagaaccgcccacauacagggcccagggaguagugggcccugguccacacgaggaacagcgccccuauccucaaggguuaccaggccggcuguacaguagcauguccgacaccaaccucgcugaggcgggacugaauuaucaugcccagagaaucggccagcuuuuucaggggcccggacgugauucugcaauggaccugucauccuugaaacacucguacucccuaggcuucgcugaugguagguaccuggggcaaggacuccaguauggcagugucacggaccugcggcauccuacugaccuuuuagcccacccgcugcccaugcgccgauacucuagcgugucaaacauuuauuccgaucacagauacgguccaaggggcgacgcaguuggguuccaggaagccucucucgcucaguauagugccacaaccgcgcgggagaucagccgcaugugugcagcccuaaauuccauggaucaauacggaggcagacaugggucaggaggcggugggccugaccuggugcaguaucagccccagcacggaccaggccucagcgcuccucaaucucuggucccccuuaggccaggucuguugggcaacccgaccuuuccugaggggcaucccaguccaggaaaccuagcccaguacggccccgcagcugggcagggaacugccgugcgacaacugcucccuuccacagcuaccguucgggccgcagauggcaugauuuacagcacaauaaauacuccaaucgcggccacguuacccauuaccacacagccugcuucagugcugcguccgauggucagaggugggauguaucgccccuacgccucuggaggcaucacugcaguaccacuuaccucccugacaagggugccuaugaucgcuccccggguuccacucggcccuaccggguuguauagauaccccgccccaucgcgcuucccgauugcaagcagugugccucccgccgaaggaccagucuaucuggguaagccugcggcugccaaagcacccggcgccgggggaccaucuaggccugagaugcccgugggcgcugcccgagaggaaccgcucccaacuacgacccccgcagcuauaaaggaagccgcgggugcuccugccccagcaccccuggccgggcagaaaccuccggcugacgcagcccccggaggcggcuccggggcgcuuagccggccaggauuugagaaggaggaagccucacaggaggaaagacaaaggaagcagcaggagcagcuacugcaauuggaacgcgagcguguagaguuagaaaaacugcggcagcucagacugcaggaggaacuugagagggagcgcguggaacugcagcgacaccgggaggaagaacagcucuugguccagagagaacugcaggagcuacagacaaucaagcaccauguucugcaacagcagcaagaggaaaggcaggcucaguucgcacuccagcgcgagcaacuugcccagcagagacugcaguuagaacaaauucagcaguugcagcaacagcugcagcaacagcucgaggaacagaaacagcggcaaaaggcuccuuuucccgccgcaugcgaggcuccagguaggggcccuccccuggccgcggccgagcuugcacagaacgggcaguacuggccaccucugacucacgcugccuucaucgcaauggccggacccgaaggccucggucagccgcgugagccuguguugcaucgagggcugccaaguuccgcuagcgauaugucuuuacaaaccgaggagcagugggaagccucacgcagcggaauuaaaaagagacacuccaugccccggcuaagggacgcgugcgagcuggagucuggcacagaaccuugugugguccgcagaaucgcugauaguucggugcagaccgacgaugaggacggcgaaagccgguaucuccuuuccaggcgacguagagcacgccggucagccgauugcucuguucagacugacgacgaggauagcgcugagugggaacaaccaguaaggagacgccggaguaggcugccccgacauuccgacucagggucugauagcaagcacgacgccacagcauccaguagcucugccgcugcgacggugagagccaugucauccgucggaauacagaccaucagcgauuguagugugcagacugagccggaccaguugccucggguuucucccgcaauucacaucacagccgcuaccgauccaaaaguggaaauugucagguacaucuccgcacccgagaagaccggucgcggcgaaucgcuggccugccaaacagagccugacgggcaggcucagggaguggccggcccacaacucguaggucccacugcgauaagcccuuaccugccagggauucagaucgucacgccgggaccccuuggccguuuugagaaaaagaaaccugauccacucgaaauuggcuaucaggcacaucugcccccugagucauugucccagcuggugucuagacaaccacccaagaguccgcagguuuuauacagcccugugucaccacuaagcccccaccgacugcucgacaccagcuucgccucuagugaaaggcuuaauaaggcucaugucuccccucagaaacacuuuacagccgauagcgcacugcggcagcaaacuuugccccgcccaaugaagacccugcagagaucacucucugacccuaaaccccugucgccaacagcugaggaaagcgccaaggagagguucucccuuuaucagcaccaagggggauuagguagucaagugucugcgcugccgcccaacucacucguucggaaagugaagcgcaccuugccuagcccacccccugaggaagcccaucugccacuagcuggccaggcaagcccccagcuguacgccgcuagucuccuucaaagagggcugacuggaccuacgacagucccggcaaccaaggccucuuugcugcgagagcucgauagggaccugcgguuaguggaacacgagagcacuaaacuucguaagaaacaggcugaacuggacgaggaggaaaaggagaucgaugccaaacucaaguaucuagaacugggcauaacccagcgcaaggaguccuuggcaaaagacagaggugggagggauuacccaccccugcggggacucggcgagcauagagacuaucuuucagauagcgaacugaaucaguugcgccugcaaggcuguacaacuccugccgggcaguuuguagacuucccagcgaccgcugccgcacccgccacaccuucuggacccacggcuuuucagcagccacgauuccaaccgccugcaccccaguacuccgcagguaguggcgggccaacccagaacggauucccugcucaccaggcccccacuuacccaggcccgucaacauauccugcgcccgcauuuccacccggugccagcuacccugcugagccagggcuccccaaucaacaggccuucaggccuaccggacauuaugcuggccagacuccgaugccaacaacccaaucgacguuauuucccgugccugcagauucccgggcaccccugcagaagccaagacagaccucucuugcggaccuggaacagaaaguuccuacaaacuacgaggucaucgccagucccguggugccaaugagcucagcuccuuccgaaacuucuuauagcggcccggcagucaguuccggguacgagcaaggaaagguacccgaggugccacgugccggugaucgcggcagcguuucucagagcccugcucccaccuauccauccgacagccacuacacaagucuagaacagaaugugccuaggaacuacgucaugauugaugacaucucugagcucacuaaagacucaaccuccacagcccccgauagccagcggcuggaaccguuggggccaggaucgucuggcagacccgguaaggagccuggggaaccaggcgugcuggacggacccacccucccuugcuguuaugcacgaggcgaggaggaaagugaggaagauuccuacgaccccagggggaaaggaggucaccuucgcagcauggagucaaauggccggccagccucuacucauuauuacggggauagcgacuauagacacggagcuaggguugaaaaguacggcccugguccgauggggcccaagcauccauccaaaagucuggcgccugccgcaauuucaagcaagcgcuccaaacaccguaagcaaggcauggagcagaaaaucucuaaguucagucccauagaggaagcuaaggauguggagagcgacuuagccuccuauccaccucccgcagucucaucuucgcuggugagccggggaagaaaauuucaggaugaaauuacguacggcuugaagaaaaacguauacgagcagcaaaaguauuacgggauguccagucgagacgccguggaggaugacaggaucuauggagguucuagccgcucacgggcuccguccgcguacagcggcgaaaaacucucuagucacgauuucuccggguggggaaagggcuaugagagagaaagggaggccguugaacgccugcagaaggcagguccaaaaccuucaagccuaucuauggcucauucgagaguccggcccccaaugcgaucccaggccagugaggaggaaagcccugugucaccccuuggcaggccgcguccugccgggggaccccugccacccggcggggacacaugcccucaguuuuguucuucccacagcaugccagacgugcaagagcaugucaaggauggacccagagcucacgcauacaaacgggaagagggcuauauccucgacgauagucauugcguugugucagacuccgaagccuaccaccugggucaggaggagaccgauugguucgacaagccucgcgaugcuaggagcgaccgauuuagacaccaugggggacacgcgguaucuaguagcucccagaaacggggcccagcccgccauucuuaccacgauuaugacgaacccccggaggaagguuuguggccucaugaugagggcgggccaggaaggcacgcaucagccaaggaacacagacauggcgaccacgggcggcauagcggacgucacacuggcgaggagcccggucgcagggcugcaaagccucacgcccgagaccuggggagacaugaagcucggccacacucccaacccucgucugccccugcaaugcccaaaaagggacagcccggcuacccgaguagcgcggaguauucacagccuuccagggccucuagcgcuuaccaucacgccuccgauaguaaaaaggguucacgccaggcacauagcggcccagcugcccuccaaucuaaagcggaaccccaggcccagccucagcuucaagggagacaggcugcacccggaccacagcagucccaaaguccgagcucacggcagauucccucuggcgccgcuuccaggcagccucaaacccagcagcagcaacaggggcugggauuacagccaccccagcaagcacugacacaggcccgcuugcagcagcaaucgcagccuacgacccgaggcagcgccccagcugcaagucagcccgccgguaagccucagccagggccguccacugcgacaggaccccaaccugcuggcccacccagagccgagcagaccaauggcucuaaagggacugcaaaggccccucagcaaggacgugcuccacaggcccagcccgcaccggguccuggccccgcuggggugaaggccggagcgcggccaggcgguacaccuggggcacccgccggacagccaggcgcugacggcgagucagucuucagcaaaauccucccugggggagccgcugaacaagcagguaagcugaccgaggccguguccgcguuuggcaaaaaguucucuagcuucugguga

SEQ ID NO: 53484 - RNA, 399 nt, Artificial Sequence
  derived and/or modified sequence opt3 from BSPH1__Homo_sapiens__NP_001121798
augggcagccugaugcuccuuuucguggagaccacaagaaacuccucugccugcaucuuucccgucauucugaaugaauugucaaguacuguugagacgauaacccacuucccugaagugacagacggggaguguguauuuccauuccauuacaagaacggaacuuauuacgauugcaucaaaagcaaggcuaggcacaaaugguguuccuuaaauaagaccuaugaagguuacuggaaauuuugcucugcagaggacuucgccaacuguguguuuccguucugguaucggcgccugauuuacugggagugcacagaugacggcgaagcguuugggaagaagugguguucgcuaaccaaaaauuucaacaaggaucgaaucuggaaauauugcgaguga

SEQ ID NO: 53485 - RNA, 1209 nt, Artificial Sequence
  derived and/or modified sequence opt3 from BSPRY__Homo_sapiens__NP_060158
augagcgccgagggcgcugaacccgggccuggauccgguucuggcccagggccgggaccccugugcccugagcacggccaggcacucucaugguucugugguagugaaagaaggccagugugcgccgcgugugcugggcuuggaggccggugccgcggccaucgaauccguagagccgaggaaagggcagaggagcugcggaacaagauugucgaccaaugugaacgcuugcaguuacagagcgccgcuauaaccaaauacguugcagaugugcugcccgggaagaaucagagagccguauccauggcuucugccgcgagggagcuagugauccaacggcucucgcugguccgcucacuuugcgaaagcgaggagcagcgacuguuggaacaggugcacggagaggaagagagagcacaucagaguauucucacacaaaggguucacugggccgaagcucugcagaaacuggacacuauccggacgggucucgugggcauguuaacccaucuggaugaccuucaguugauucagaaggagcaagagaucuuugaacguacagaggaagccgaggggauacuggauccucaggaauccgagaugcuaaacuucaaugagaaauguacucgcucuccacuccugacccagcuuugggcaacagcuguccugggaucauuguccggcaccgaagacaucagaauugaugagaggacugugucacccuuucuccaacugagugacgaucggaagacauuaaccuucagcacgaagaaaucuaaggccugcgcggacgguccugaacgauuugaucacuggccaaacgcccuggcagcuacuuccuuccagaaugggcuccacgccuggaugguaaacguucagaauagcugugcuuauaaagugggagucgccagcggccaucuuccgcgcaagggcagugggucugacugcagacugggacacaacgcauuuuccuggguguucagcagguacgaucaggaguuucgguucucgcauaauggucaacacgaacccuugggccuacugcgcgggccugcccagcucggagugguccuggaccuucagguucaggagcuguuguuuuaugagccagcuucuggcaccgugcucugugcgcaccauguauccuuccccgguccucuguuuccaguguucgcagucgccgaccaaacaaucucaauugugagauga

SEQ ID NO: 53486 - RNA, 957 nt, Artificial Sequence
  derived and/or modified sequence opt3 from BST1__Homo_sapiens__NP_004325
auggccgcucagggcugcgcagccagcagacugcuccaacuucuguugcaguuacugcuacuccugcuucuguuggcggcugggggagccagggcacgguggcgcggugagggcaccuccgcccaccuccgagacaucuuccuggggcguugugcugaauacagagcacugcucucucccgagcagaggaacaagaauugcacagccauuugggaggcuuuuaaaguggccuuagauaaggacccuuguucaguccugccaagugauuaugaccuuuucauaaacuugagccggcauuccaucccgcgcgauaaaucucuguuuugggaaaauucgcaccuacucguuaacucauucgcggacaauacuagaagguuuaugccccugagcgaugugcuuuacggacggguagcagacuuccugaguuggugccgccagaagaacgauuccggcuuggacuaucaaucuuguccuacgagcgaagauugcgagaauaacccaguggacuccuuuuggaaacgagccucaauucaguacaguaaggauagcucuggugucauccaugugaugcucaauggguccgagcccaccggagcuuauccuauuaagggcuucuuugccgacuacgaaaucccaaaccugcagaaagagaagauaacaagaaucgaaauuuggguuaugcacgagaucggcgggcccaauguggagucauguggagaagguagcaugaaagucuuagagaagaggcugaaagacaugggcuuccaguauaguugcauuaacgauuaccggccugugaagcuccuucaauguguagaccauucuacucacccagauugcgcacugaaguccgcugccgcggccacccagcguaaagcaccgagcuuguacacagaacagcgcgcugggcuaaucauaccccuguuucucguucuggccucgagaacccagcuuuga

SEQ ID NO: 53487 - RNA, 543 nt, Artificial Sequence
  derived and/or modified sequence opt3 from BST2__Homo_sapiens__NP_004326
auggccagcaccuccuacgacuauugcagagugcccauggaggauggcgacaagagguguaaacugcuccuugggaucgguauucuggucuuguuaauaaucguuauucugggagugccucuaaucauuuucacaaucaaggcuaacucugaagcaugccgggauggccuccgcgccguaauggagugucgaaaugugacucaucugcuucagcaagaacugacggaggcgcagaaaggguuucaggacgucgaagcucaggccgcaaccugcaaccacacagugauggccuugauggcuucacucgaugcagagaaggcccaaggacagaaaaagguugaggaacuggagggcgaaauaacuacccugaaucacaagcuccaggacgcuagugccgagguggagcguuuaagaagggaaaaccagguccugagcgugcggaucgcggauaaaaaguacuauccauccucucaagacucgucaagcgcagccgcuccgcagcuuuugauuguacugcuaggucucagugcccugcuucaguga

SEQ ID NO: 53488 - RNA, 702 nt, Artificial Sequence
  derived and/or modified sequence opt3 from BSX__Homo_sapiens__NP_001091639
augaaccugaauuucaccagcccccuccacccugccuccucucagagaccaacaucauuuuucaucgaggacauucuucugcauaagccgaaacccuugagggaaguggcuccugaucacuuugcaaguagcuuagccucccgggucccacugcuagacuacggcuauccccucaugccuacuccaacgcugcuugcgccccaugcucaccauccucugcacaagggggaucaccaucacccauacuucuugaccacaucuggaaugccgguucccgcccucuuuccucauccacaacacgcagagcugcccgguaaacacugccgccgacguaaggccagaacuguguucucggacucacagcugagcggccucgagaaaagguuugaaauacagcgguauuuaaguaccccugaacgcguagagcuggcuacagcacuuuccuugucugagacccaggugaagacuugguuccaaaacagaaggaugaagcauaaaaagcagcugcggaaaagccaggaugaaccaaaggcccccgacgggccggaguccccugaaggaucaccccgcggcagugaggcugccacagcggcagaggcccgacuaagccucccagcugguccuuuuguccugaccgaacccgaggaugaaguggacaucggggaugagggagaacuuggcucuggcccacacguucuguga

SEQ ID NO: 53489 - RNA, 1428 nt, Artificial Sequence
  derived and/or modified sequence opt3 from BTBD10__Homo_sapiens__XP_011518706
auggccggcagaccccacccuuacgacgggaacagcuccgauccagagaauugggacaggaagcugcauucucggccgcgcaaacucuauaagcacucaaguaccagcucccgaaucgcuaaaggagguguggaucauacaaagaugucucuucacggcgcaucagggggacaugaacguucgagagacaggcggcgcagcagugauagauccagggacucuagccacgagcggacugaaucccagcugacgcccugcauucgcaacgucaccucaccuacacgacaacaccauguugagagagaaaaagaucacaguagcucuaggccauccucaccccggccucagaaggccagcccaaauggcaguauaucuuccgcggguaacagcucgcguaauucuucccagucaaguagcgacggguccuguaagacugcuggagagaugguguucguauacgagaacgccaaagaaggcgcacgcaauaucagaaccucugagagggugacauugauugucgauaacacccgguuugugguugaccccagcaucuucacugcccagccuaauacaauguuaggccgaauguuugggucaggacgcgaacauaacuucaccagaccaaaugagaagggugaguaugaaguggcugagggcauugggaguacggucuuuagggcaauccuggauuacuauaaaacuggaauaauccggugcccggacggcauuuccauccccgaacuacgcgaggccugugauuaccucugcauuagcuucgaauauucuaccaucaaguguagagaccugucagcucuuaugcacgagcugaguaacgacggugccaggcgucaauuugaguucuacuuggaagagaugauacucccucugaugguggcgagcgcacaguccggggaacgggagugccacauuguaguucugacagaugacgauguggucgacugggaugaagaguacccaccccagaugggagaggaauauucucagaucauuuacucgacuaaacucuaucgauuuuucaaguacaucgagaauagagacguggccaagagcguguuaaaagaaaggggccugaagaaaauccgccuuggcauugagggguauccuaccuacaaggaaaaagucaagaaacggccaggagguagacccgagguuauauauaacuacgugcaaaggccguuuauccgcauguccugggagaaggaagagggcaagucacgacauguagauuuccagugugugaaaaguaagucuauuacaaauuuggcugccgcagcugccgacaucccucaggaucagcuggucgugaugcaccccaccccacaaguugacgaacuagauauacucccuauucaucccccaagcgggaacuccgaccuggaccccgaugcgcagaacccuaugcuuuga

SEQ ID NO: 53490 - RNA, 1926 nt, Artificial Sequence
  derived and/or modified sequence opt3 from BTBD11__Homo_sapiens__NP_001017523
augagaaagcugaggcccaaagacagccgggagccugccccaggcuccccggugcgcucugggugccuccagcgacuuucacacuacaguggaauccaacgucccuuccuggucuugccuccauuaauggaauggauuagaguugcuguggcacaugccggucacaggcggagcuuuuccauggauucugacgauguacgccaggcggcuagacugcuacuccccggcguggacugugagccuaggcagcugcgggccgaugacugcuucugugcaucgcgcaagcuagaugccgucgcuauagaagcaaaauuuaagcaggaccugggguuccgaauguugaacugcggaagaaccgaucucgugaaacaagccguuucacugcugggcccagacgguaucaauacaaugagcgagcaggggaugacuccccucauguaugcuugugugaggggagaugaagccaugguccagauguuacuggacgcgggcgcagaucuuaacguggagguaguuaguacgccucauaaguacccauccgugcacccggagacccggcauuggacagccuugacuuuugcuguccugcacggccacauucccguggugcagcuacuccuggacgccggggcaaaggucgaaggaucuguugagcauggugaagagaauuauagcgagaccccucuucaacuggcugccgcggugggcaacuucgaauugguaucccuccuguuagagcguggggccgacccacugaucggaacaauguaccgcaauggcauuucaaccacuccccagggugauaugaacaguuuuagccaggcagcugcccacgggcauagaaauguguucaggaaacuccuugcucagccugaaaaggagaaaucugacauccuguccuuggaagagauacuagccgagggaacagaucuggcagaaaccgccccacccccgcucugcgcuucacggaacagcaaggcgaaacugcgagcacuucgcgaggccauguaucacagugcugaacacggcuacgucgacgugacgaucgauauuagaucuaucggcguuccuuggacucugcauaccugguuggagucccucaggauugccuuucaacagcaccggcgcccccugauccaguguuuacugaaggaguucaagacaauacaagaagaggaauauacugaggaacuugugacccaggggcucccacugauguuugagauucuuaaagcaagcaagaaugaagucaucucgcagcaguugugcgugauuuucacacauuguuacggaccuuaccccaucccaaaacugaccgagaucaagagaaaacaaacgucuaggcucgacccccacuuucugaacaauaaggagauguccgauguaacuuuccuuguugaaggucguccuuucuaugcccauaaagugcuguuguuuacagcuucaccacgguucaaggcccuccugaguagcaagccgaccaacgacggcacuugcauugagauaggguacgucaaauauuccaucuuucaguuagugaugcaguaccuguauuacggaggccccgaaucucuacucauuaagaauaacgagaucauggagcugcuuagcgcagcgaaauucuuucaguuggaagcucugcaacgacacugugagauaauuugcgccaagucaaucaauacagauaacugcgucgacaucuauaaccacgcaaaauuccucggugugaccgaacugagugccuacugugagggguacuuuuuaaagaauaugaugguucugauugaaaacgaggcuuucaagcagcuuuuguaugauaaaaauggcgagggaacgggccaggacgugcuccaggaccugcaaagaacccuagccaucaggauucaguccauacaucugucuagcucaaaggggaguguagucuga

SEQ ID NO: 53491 - RNA, 1521 nt, Artificial Sequence
  derived and/or modified sequence opt3 from BTBD16__Homo_sapiens__NP_653188
augaucaugagcaacacccacaaggccagacuggaaaggcgggugacaggcuccacuaaucgcuggcgacuccccaaacagccuuucucuggggaccuucugucauugagucaaaugugcaaggcuuuaagcauugauuuugaagaggcacugcguaacccagacagacuauguauaucccagauccagaaauucuuuuucgaaaauuuuaagaacaaagauauucagucuggagaggccgacgucauccucgaaugccuggguuucaagugggagcuucaucaaccgcagcuguuucagucggagacguuggcgaagcucuaccugaaagcucuggcccagggcaccacacacccccucagggaauuagaggaacugcuucgggcacaaucaccuaagaaaacuaaggagaaaagcccagccaagcgcauuaucauaaguuugaagaucaaugauccccugguuaccaaaguggcuuucgcaacagcccuaaagaaccucuauauguccgagguagaaauuaaucuggaggaccuucuggggguguuggcuucugcccauauccuccaguuuagcggacuguuccagagaugugucgaugugaugauugcgagguuaaaaccuuccaccaucaagaaauuuuacgaagcaggcugcaaguauaaagaggaacagcugacuacagguugugagaaguggcucgagaugaaccuuguuccacugggagggacccaaauacacuugcauaagauuccccaggaccuacugcacaaagugcucaagucaccucggcuguucacguuuagugaauuucaccuucugaaaacuauguugcucugggucuuccugcaguuaaauuacaagauccaagccauuccaaccuaugagacagugaugacuuucuucaagagcuuuccggaaaacugcuguuuccuggaucgcgacaucggccgaucucuaagaccccucuuucugugccuuagguugcauggcaucaccaaagggaaggaucuggagguacuccggcaccugaauuucuuuccugaauccuggcuugaccagguuacagugaaccauuaccacgcucuggagaauggaggugauaugguccacuugaaagaccucaacacccaggccgugcguuucggccuguuauuuaaucaggagaacacgacuuauucaaagacaauugcacuguacggguucuuuuucaaaauaaagggacuaaaacaugacaccacuagcuacaguuuuuauaugcaacgcaucaagcacacagaucucgaaucuccauccgcuguguacgagcauaaccacgucagccugagagccgcgaggcuuguuaaguaugaaauucgggccgaggcauugguggacggcaaauggcaggaguuccgaaccaaucagaucaagcagaaauucggucugacgaccucgucuuguaagucccauacacucaaaauacaaacuguagggauucccaucuacgugucauuugcuuucaucuuuccugccaguuga

SEQ ID NO: 53492 - RNA, 1158 nt, Artificial Sequence
  derived and/or modified sequence opt3 from BTBD1__Homo_sapiens__NP_001011885
auggccagccugggccccgcugcagccggggagcaggcguccggagcugaagccgagccugguccagcaggcccgcccccuccacccucuccuucaagucucgggccacuucugcccuugcaaagagaaccuuuauacaacuggcaggccaccaaggcuagccugaaagagagguucgcauuucuauucaauuccgaacuccugucugacgugcgguuuguccuuggaaagggccgcggugccgcugccgcagggggaccacagcgaaucccggcgcaccguuucguucuggccgcuggcucggccguguuugaugcaauguucaacggcgggauggcuacaacuucagccgagauugaguugcccgacguagaaccugcggccuuucucgcacugcugagauuccucuauagcgaugaggugcagauaggaccagaaacggucaugaccacauuauacacugcuaaaaaguaugccgugcccgcucuggaggcccauugcguugaguuucuuaccaaacacuugagggcagacaaugccuucaugcugcuaacacaagcucggcucuuugaugaaccucagcuggcgagucuuugucuggacaccaucgauaaguccacuauggacgcaauuucugccgaggguuucacagauaucgacauugauaccuugugcgcugugcucgaacgcgacacgcugagcaucagagaguccagguuauuuggcgccgucgugcggugggcagaagccgagugucagcgccagcaacugccaguaacuuucgggaacaagcagaaaguucucggaaaggcucuuucacugauacgauuccccuugaugaccaucgaggaauuugccgcaggcccggcgcagagugguauucuaagcgauagagagguggucaaucuguuccuccauuuuacagugaacccuaaacccaggguggaauacaucgaccggccacguugcugucugcgcgggaaggagugcuguauuaauagauuccagcaagucgaaucuagguggggauauuccggcacuucagaccggauccgaagccuuaacaugcgcaaaaguaagccuugggauagaaugauacccgcucugguugugaugggccaguugacccacucuggguccugcagcaggaauccauga

SEQ ID NO: 53493 - RNA, 1578 nt, Artificial Sequence
  derived and/or modified sequence opt3 from BTBD2__Homo_sapiens__NP_060267
auggccgcuggcgggagcggagguagagcauccugcccuccuggcgugggggucggaccaggcaccggugggucuccgggacccucagccaacgcggcugccacacccgcaccaggcaaugccgcugcagccgcugccgcggcagccgcugccgcagcugcccccggcccuacuccacccgcgccuccagggccgggaacggacgcccaggcagcuggugccgagagggcugaagaggccgcaggccccggggccgcugcgcugcaacgggaagcagccuacaacuggcaggcuaguaagccuaccguucaggagcgcuucgccuuucucuucaauaacgaagugcuuugugauguacacuuucuggugggaaaaggcuugagcucccagcgaaucccagcacaucguuucgucuuagccguggguucugcuguuuuugacgccauguucaaugggggaauggcaacaacuucgaccgagauugagcugcccgauguggaaccugcggcuuuucuagcccuccugaaguuccuuuauucagacgagguccaaauaggcccagaaacagugaugaccacucuguacacagccaaaaaguaugcaguacccgcuuuggaggcccacugcguugaguuucucaaaaagaaccugagagcagauaaugcuuucaugcugcucacccaggccagguuauuugacgaaccgcagcuggcgagccuuuguuuggagaacaucgauaagaauacggccgacgcuauuacugcagaaggcuucaccgauaucgaccuggauacucuaguggccguccucgagcgggacacacuggggauucgcgaagugagacuuuuuaacgcuguggucagguggagugaggccgagugccagcggcaacagcugcagguuaccccugaaaaucgccgaaaaguguugggaaaggcacucggucugaucagauuccccuuaaugacaauagaggaguucgcggccggcccagcucaguccgggauccugguagauagggaaguggucucucucuuucuucauuucaccgugaacccuaaaccccggguugaauuuauugaccguccacgcuguugccugagaggaaaggaguguagcaucaauagguuccaacagguggagucccgguggggcuacucagguacgagugaccgcauucgauuuagcgucaacaaaagaaucuucgugguaggguuuggcuuguauggaucuauacacggccccacugauuaccagguuaauauucaaaucauucauacagacuccaacaccgugcuagggcagaacgauacuggauucucaugcgacgguagcgccaguacauuuagggucauguucaaggaaccuguggagguccugccaaaugugaacuauaccgcaugugcuacgcucaagggcccggauucucacuacgggaccaaaggacugcggaagguuacacacgaaucccccacuaccggcgccaaaacaugcuuuacuuucuguuacgcagccgguaauaacaaugggaccagcguggaggacggccagaucccugaaguaaucuuuuauacauga

SEQ ID NO: 53494 - RNA, 1386 nt, Artificial Sequence
  derived and/or modified sequence opt3 from BTBD3__Homo_sapiens__NP_001269480
auggccgcugacaucuuccccagaaagaaaccugcaaacagcuccucuaccucagugcagcaauaccaccagcagaaucugaguaacaauaaccucauuccagccccgaauuggcagggccuuuaucccacaauaagggagcggaacgcgaugauguuuaauaacgaucugauggcugacguccauuucguuguggggccuccaggagguacucaacgcuugcccggccacaaguacguauuagccguggggagcuccgucuuucaugcaauguucuauggagaacuggccgaggauaaagacgaaauccguauuccugauguggagccagcugcauuucuagccaugcucaaguacaucuauugcgacgaaauugaucuggcugccgacacgguucuugcgacccuguacgcagccaaaaaguauaucgugccccacuuggcucgagccugugucaauuuccucgagacaucucugucggcaaagaacgcuugcgugcugcucucacagagcuguuuauuugaggaaccugaucugacucagagaugcugggagguaauagacgcccaggcggaacuugccuugaaaagugagggcuucugugauaucgacuuucaaacccuggaguccauucuaaggcgggaaacacucaaugcaaaggagaucguuguguucgaagcugcccugaacugggcugaggucgaaugccagcgccaggaucuugcccugucuauugagaauaaaagaaagguguuggguaaagcacucuaccugaucaggauaccaaccauggccuuagacgacuuugcuaacggggcggcacagagcggagugcugacucucaaugagacaaacgauauuuuccuuugguacaccgccgcuaagaagccggaacugcaauuugucuccaaagcccggaagggcuugguuccccagcgcugucaucgauuccagucaugcgcauauagaaguaaccaauggagguaccggggccguugugacagcauccaguucgccguggauaaacgcguauuuauugcuggguucggacuauaugguucuuccugcggcucagccgaguacagcgcaaagaucgaacugaaaagacagggggugguccucggacagaaucugaguaaguauuuuucugacggcuccagcaacacguucccugugugguuugaguacccaguucaaaucgaacccgauacuuucuauaccgcgucggugauucuugacgguaaugagcugucuuacuuugggcaggagggaaugacagaaguccaguguggcaaagugacuguacaguuccaaugcuccucagauaguaccaacggcacagggguucagggaggucagauaccugaguugaucuuuuacgcuuga

SEQ ID NO: 53495 - RNA, 1749 nt, Artificial Sequence
  derived and/or modified sequence opt3 from BTBD9__Homo_sapiens__NP_001165889
augugcagagcccugcucuacggcgggaugagggagagccagcccgaagcugagaucccucuucaagacaccacagcagaagccuucacuaugcuguugaaguauauuuacacgggacgggcgaccuuaacagaugagaaagaagaggugcugcuagacuuucucucccuggcucacaaguaugguuucccagagcuugaagauucuacuucagaguaccuguguaccauauugaacauccagaaugucugcaugacauuugacguugccagucucuauagccugccgaaacugaccuguaugugcuguauguucauggaucgcaacgcacaggaagugcucuccucugagggcuuuuuaucgcugucaaagacugcccuuuugaauauuguacugcgagacagcuucgcugcacccgagaaagauaucuuucuagcccuccugaacuggugcaagcauaauaguaaggaaaaccacgcugagauuaugcaggccgugcgucuuccucugauguccuugacagaacuccugaaugucgugagaccaucuggguuacugagccccgacgcgauccucgaugcaauaaaaguuagguccgagucacgggacauggaucuuaacuaccgcggaaugcugaucccugaagagaauauugccaccaugaaguauggcgcucaaguggucaaaggugaguugaagagugcccuacuggacggggauacgcagaacuacgaccucgaccauggauucagcagacacccaaucgaugacgauuguaggucuggcauugaaaucaaacugggccagcccuccauaauuaaucauauccggauucuucugugggaccgcgauucacgaagcuacaguuauuuuaucgaggugucuauggacgaauuggauuggguaagaguuaucgaccacucccaguaccucugcaggagcuggcaaaagcuguauuucccugcacggguguguucgggggauggagucucuuuauggugcccacuguggucccguacuccggagcuaaagcagucaagucuccugggucuucccaaaugucgcuacauuagaauagugggcacccacaacacagugaauaagaucuuucauauugucgcuuucgaaugcauguuuacuaacaaaaccuucacauuggagaaggggcugaucguuccuauggagaauguggccaccauagcggacugcgccagcguaauugaaggaguguccaggucucggaacgcacuccugaacggcgauacgaaaaauuaugacugggacagcgguuacacuugucaccagcuugggucaggagcuaucgucgugcagcuggcccaaccauauaugaucggcaguauucgauugcuccugugggauugcgacgaucgcuccuacagcuacuauguugaggugucuacaaaccagcagcaauggaccauggucgcugacagaacuaaggugucauguaaaaguuggcagagcguaacauucgaaaggcagcccgccuccuuuauccggauuguuggcacccauaauacggcaaacgagguguuccacugcguccacuuugaauguccugagcagcaaucuucgcagaaggaggaaaauagcgaggaauccgggaccggagauacaucauuagccggucagcagcuggacagucaugcucuacgcgcgccaucuggcagcucccuccccucaagcccggggucuaacuccagaaguccuaauaggcaacaccaguga

SEQ ID NO: 53496 - RNA, 537 nt, Artificial Sequence
  derived and/or modified sequence opt3 from BTC__Homo_sapiens__NP_001720
auggacagagccgcuaggugcagcggcgcauccucucugccccuccuucuggccuuggcguuagggcuggugauccuacacugugucguugcugauggaaacucaacccggaguccugagacaaauggucuccugugcggcgacccagaagagaacugugccgcaacuacgacccagagcaagcgcaaagggcauuucucccgaugcccgaagcaauacaaacacuauuguauuaagggacguugcagauuugugguagccgaacagacacccucuugugugugcgaugagggcuacauaggugcuaggugugaacgggucgaccuuuucuaucugcgcggggauagaggacagaucuuggugauuugccucaucgcaguuaugguggucuuuauuauccuggugauaggcguauguacuugcugccauccucugaggaaacggcgcaagcgaaagaaaaaggaggaggaaauggagacccucggcaaagacaucacaccaauuaaugaagauaucgaggagaccaacauugccuga

SEQ ID NO: 53497 - RNA, 1632 nt, Artificial Sequence
  derived and/or modified sequence opt3 from BTD__Homo_sapiens__NP_000051
auggcccacgcucauauccagggcgggagaagggcaaagagccgguucguggucugcauuauguccggagcccgcucuaaacuggcgcucuuucuuugugguugcuacguuguggcucugggcgcccacaccggggaggaaucaguagcagaccaucacgaggccgaauauuacguggcugcagucuaugagcaucccaguauauugagcuuaaacccucuggcccuaaucucccgacaagaagcucucgagcugaugaaucagaaccuugauauuuacgagcaacaggugaugacagccgcgcagaaggacguucagaucauuguguucccagaagauggaauccacggcuuuaauuucacucguacgucuauauauccguuucuggacuucaugcccucgccucaggucgugagauggaacccauguuuggagccccacagguuuaaugauaccgaaguacuccagcggcugucaugcauggcaauccgcggugacauguuccugguugccaaccucgggacaaaagagccuugucauagcagugauccaagaugccccaaggacggaagguaccaauuuaauacuaacguggucuucuccaauaacggcaccuuaguggaucgguaucgcaaacacaaucuguacuuugaggcugccuucgacgugccucuuaaggucgauuugauuacauuugacaccccauucgcaggccgauucgggaucuuuacuuguuucgauauucuguuuuucgacccggcuaucagaguucuaagggacuacaaggugaaacauguaguguaucccacagccuggaugaaccagcucccucugcuugcggccauagaaauucagaaggcauuugcugucgccuucggaaucaaugugcuggcugccaacguucaccacccaguguuggguaugaccggcucugggauucauacgccccucgagagcuuuugguaccacgauauggaaaauccuaaaucccaucugaucaucgcacaggucgccaagaacccagugggauuaauuggcgcugagaacgcgacuggugaaaccgaccccucacacaguaaauuccugaagauacucagcggggauccguauugcgagaaggacgcacaagagguacauugugaugaagccacaaaauggaauguuaacgcuccucccacuuuucacucugagaugauguacgacaauuucacccuugugccagucuggggaaaggaaggcuaucugcacgugugcuccaacggcuuguguugcuaccuacuguaugagcggccuacacucucaaaagaacuguacgcccuuggggucuuugauggacugcauaccgugcacgguacguacuauauccagguuugcgcauuggugcguuguggcgggcucggauucgacacuugcggccaggagauuacagaggccaccgguaucuuugaguuccaucugugggggaauuucagcacaaguuacauauuucccuuauuccugacuucuggcaugacccuagaaguaccagaucaacucggaugggaaaacgaccacuauuuucugcgcaaguccagacuuagcucgggcuuggucacggcugcccuguacgggaggcucuaugagcgggauuga

SEQ ID NO: 53498 - RNA, 621 nt, Artificial Sequence
  derived and/or modified sequence opt3 from BTF3__Homo_sapiens__NP_001032726
augagaaggaccggcgcccccgcucaggcagacagccgggggcgcggacgagcccgugguggcugcccugggggagaggcgacacugucccaaccaccgcccagaggcgguacuagggggcaggaaccucagaugaaggagacgaucaugaaccaggaaaaacucgcuaaacuucaagcccaggugcggauuggaggcaaaggcaccgcacgcagaaagaaaaaggucguucacaggacagccacugcugaugacaagaaacugcaguucucuuugaagaaauuaggggugaauaacauaucaggaaucgaggaaguaaauauguuuaccaaccaggguacagugauucauuucaauaacccaaagguccaagcaagucuggccgcuaauaccuuuacuaucacaggccacgccgagaccaaacagcuaacggagaugcuccccagcauucugaaccagcuuggggcggauucccugacuucuuugcggcgccucgcagaagcccugccuaagcagucgguggacggaaaggcuccacuggccaccggcgaggaugacgaugacgaaguucccgaucucguggagaauuucgacgaggcaucaaagaacgaagcuaauuga

SEQ ID NO: 53499 - RNA, 516 nt, Artificial Sequence
  derived and/or modified sequence opt3 from BTG1__Homo_sapiens__NP_001722
augcaccccuucuacaccagagccgcuacaaugaucggcgagauugcagccgcggugagcuuuauauccaaguuccugaggacuaaagggcucacgucugaacggcagcuucagaccuuuucacagagucugcaggaguuguuagcugaacauuauaagcaccauugguucccugagaaaccaugcaagggaagcgguuaccgcuguauccgaauuaaccacaaaauggacccgcugaucggccaggccgcacaacguauugggcuauccucucaggaacucuuuagacugcuucccucggagcugacauugugggucgauccuuaugagguuucauacaggaucggagaagacggcagcauaugcgugcucuaugaggccaguccagcugguggguccacucaaaauucuaccaacguacagaugguggauagccggaucuccuguaaggaggaacugcugcucggacgcacaucacccaguaagaauuacaacaugaugaccgucagcggcuga

SEQ ID NO: 53500 - RNA, 477 nt, Artificial Sequence
  derived and/or modified sequence opt3 from BTG2__Homo_sapiens__NP_006754
augagccacggcaaggggaccgacaugcugcccgagaucgccgcugcagugggauuccucuccucucuucugagaacaagggguugcgucucagaacagcgguugaaaguuuuuaguggcgccuuacaagaggcgcugacugaacauuacaagcaccauugguucccugagaaaccaagcaagggguccggauaucgcuguauucgaauaaaccacaaaauggauccgaucauuucucguguggcuucgcagaucggccuaucacagccccagcuccaucaacugcuuccuagcgaacugacguuguggguagacccauacgaggugaguuauagaauuggugaggauggguccaucugcguccucuacgaagaggcaccccuggccgccucuuguggacuguuaaccugcaagaaucaggugcuccugggcaggagcuccccuucaaagaacuauguuauggcugugaguagcuga

SEQ ID NO: 53501 - RNA, 891 nt, Artificial Sequence
  derived and/or modified sequence opt3 from BTG3__Homo_sapiens__NP_001124386
augaagaacgagaucgccgcuguggucuucuuuuucaccagacugguuaggaaacacgacaagcucaaaaaggaagcaguggagcgguuugccgaaaaacuuacacugauuuugcaggagaaguacaagaaucauugguaucccgaaaaaccuagcaagggccaagcguaccgcugcauacgaguaaacaaauuccagcguguggauccagacgucuuaaaggcuugugaaaauuccugcauccuguauucugaucuagggcucccgaaagagcugacucuuuggguggaccccugugagguuugcuguagaagggauggagugucaccuugcuggccagacuguagucagacgcccgaucuggucauucggccuccauggcccccuaaggccuuggacuaccgcagagagccacucaggccggcaagcuccuuucugaucauguauggugaaaagaacaaugccuucauuguggcuucuuuugagaacaaagaugagaauaaggacgaaaucucgcggaaaguaacccgcgcacuggauaagguuacaucagacuaccacagcggcaguuccucuagcgaugaggaaacuuccaaagagauggaagugaagcccucaagugucaccgccgcugccagcccuguguaucagauaucugagcucaucuucccacccuuaccuauguggcauccacugccccgaaagaaaccggggauguacagaggaaacggccaccaaaaucauuacccucccccagugccuuuugguuaucccaaccaggggaggaagaauaaaccauaccggcccauuccugucacauggguuccaccgcccggaaugcacugcgaccguaaccacuggaucaauccucauaugcuugcgccacacuga

SEQ ID NO: 53502 - RNA, 672 nt, Artificial Sequence
  derived and/or modified sequence opt3 from BTG4__Homo_sapiens__NP_060059
augagagacgagaucgccaccacaguguucuuugucacuaggcugguuaagaaacacgauaagcucagcaaacagcaaauugaagacuucgcugagaaacuuaugacgauacuguuugaaaccuaccggucccauuggcacucugauugccccucaaaaggccaggcauuccgcuguauccgaauuaacaauaaccagaauaaggacccuaucuuggagcgugccugcguggaaaguaacguagauuuuagccauuuagggcugccaaaggagaugacaauuuggguggacccguucgaggucuguugcagauauggagaaaagaaucaccccuuuacuguggcguccuucaaggguaggugggaggaaugggagcuauaccagcaaaucucuuaugcuguuucgcgggccucaagcgaugugaguuccggcaccucuugugacgaggaaagcugcuccaaagagccucgcgucauaccaaaggugucaaaccccaaaaguaucuaccagguagaaaaucucaagcagccuuuucagagcuggcugcaaauuccaagaaagaaaaacguuguggaugggagggucggacuucugggcaauacauaucaugguucucagaagcaccccaaauguuaccggccugcaaugcaccgcuuggaccgaauccucuga

SEQ ID NO: 53503 - RNA, 1980 nt, Artificial Sequence
  derived and/or modified sequence opt3 from BTK__Homo_sapiens__NP_000052
auggccgcugugauccuggagagcauuuuccucaagagaucccagcagaaaaagaaaaccucuccccuuaacuuuaagaaaaggcuguucuuguuaacaguccacaagcugucauacuaugaauacgacuuugagcggggccgccgagggaguaagaaaggaagcauagauguugaaaagaucacuugcguggagacgguagugccugagaaaaauccaccgcccgagcgucaaauuccuagaaggggugaggaauccucugagauggaacagaucucgauuaucgagcgguucccauaucccuuucaggucguguacgacgagggcccucuauauguuuucucaccaaccgaggaacuccgcaagagauggauacaucaacugaaaaacgugaucagguacaauagcgaucuuguccagaaguaucaccccuguuuuuggauugacgggcaguaccugugcuguagucagacagcaaagaacgccaugggaugccaaaucuuggaaaaucggaacggcucccucaaaccugguucuagccaucgcaagacuaaaaagccacugccgcccaccccugaggaagaucagauucugaaaaagccauuacccccugagccagcggcugcccccguguccacaucagagcucaaaaagguaguugcacuguacgacuauaugccgaugaaugccaacgaucuucaguugcgaaagggggacgaauacuucauccuggaggaaaguaaucuaccuugguggagagcuagggauaaaaacggacaggagggcuauauacccagcaauuacgugaccgaagcagaggacucuauugagauguaugaaugguacuccaagcacaugacucggucacaagccgagcagcuccugaaacaggaaggcaaggaagggggauuuaucguccgugauagcaguaaagcugguaaguauacagugucuguguucgccaaguccaccggcgacccacaaggggucauucgccauuacguuguguguagcacgccucagucgcaguacuaucuugcggaaaaacaccuguuuucuacuauccccgaguugaucaacuaccaccagcauaauuccgcaggacucauuucaagacugaaguauccaguaagucaacagaacaaaaaugcccccagcaccgcuggcuuagguuacggguccugggagauagauccuaaggaccugacauuccucaaagaacuuggaacuggccaguuuggcguggucaaguaugggaaguggaggggacaguacgacguggccaucaaaaugauuaaggaggguucuaugagcgaagaugaguucaucgaggaagcaaaaguuaugaugaaccugucacacgagaaguuggugcaacuauauggcgucugcaccaaacagcggccaauauucauuaucacagaauacauggcuaacgggugucugcucaauuaccugcgagagaugcgccauagauuucagacccagcaacuucuggaaaugugcaaggacgugugugaggccauggaguauuuggaaaguaagcaguuccuccacagggaucuggcggcccggaacugcuuaguaaaugaccagggaguugugaaagucuccgauuuuggccugagccgcuacgugcuagacgaugaguauacgucuucagucgguaguaaguucccggugagauggucgcccccugaaguucucauguacuccaaauuuucuagcaagagcgacaucugggcauucggggugcugaugugggagauuuauucccuuggcaaaaugccauacgaaagguuuacuaacucagagacagcugagcacaucgcccagggauugcgucuguaucggccccaucucgcuagugaaaagguauacaccauuauguacucuuguuggcacgagaaagccgaugaacgaccuacuuucaagauacugcuuagcaauauccuggacgucauggaugaggaauccuga

SEQ ID NO: 53504 - RNA, 726 nt, Artificial Sequence
  derived and/or modified sequence opt3 from BTLA__Homo_sapiens__NP_001078826
augaagacccugcccgccaugcucggcacagggaaacuuuucuggguguuuuuccugaucccuuacuuggacauuuggaacauacacggaaaggagagcugcgauguccaguuauauaucaaaagacaauccgaacauucuauucuggcuggugacccauuugagcuagaauguccgguuaaguacugcgcaaauaggccccacgugacuugguguaaacucaacggcacgaccugcguaaagcuggaggaucggcagacaucauggaaggaagagaaaaauaucaguuucuuuauucuucauuucgagccugugcugccaaacgacaaugggagcuaucgcuguuccgccaacuuucagucuaauuugaucgaaucgcacucaacuacccucuacgucacaggaaagcagaacgagcugagcgauaccgcgggccgagaaauaaaucugguggacgcucaucucaaaagugagcaaacugaggccuccacacgucagaacucucagguuuuacugagcgaaaccgguaucuaugauaaugaccccgaucuuugcuucagaaugcaggagggguccgaaguguacucaaacccuuguuuggaggaaaauaagccaggaauugucuaugcaagucugaaccacagcgugaucggccccaauucuaggcuagcccggaacguaaaagaggcuccuacggaguacgcauccauuugcguucgcucauga

SEQ ID NO: 53505 - RNA, 1581 nt, Artificial Sequence
  derived and/or modified sequence opt3 from BTN1A1__Homo_sapiens__NP_001723
auggccguguuccccagcuccggccugccuagaugccuccuuacccugaucuuguuacagcugccaaagcuagacucugcuccguuugaugucauugggcccccugagccaauacucgcaguugugggagaagacgccgagcugcccuguaggcuuucaccuaacgcgagugcugaacaccuggaguugcggugguuccgcaaaaagguaagcccagccgugcucguccaucgagauggucgugaacaagaggcagagcagaugcccgaauacagaggcagggccacacuggugcaggacgggaucgcuaaaggacggguugcacugcgcauuagaggcgugagggucuccgaugacggugaguauacuugcuuuuuccgggaagaugggucuuacgaggaggcccucgugcacuuaaagguagcugcccugggaucggacccucauaucucaaugcagguucaagaaaauggcgagauuugucuugaaugcacgagcgugggcugguauccagagccgcagguccaguggcgcaccaguaaaggggaaaaguuucccuccacaucugagagccgaaacccugaugaggaaggauuguucacuguggcggcauccgugaucauaagagacaccucagccaagaaugucaguuguuacauccagaaccugcuacucggucaagagaaaaagguugaaauuagcaucccagcuucuucccugcccaggcuuacaccuuggauuguggccguagcagugauccugauggucuugggccuccugaccauagggucaaucuuuuucacuuggcgguuauauaaugagcguccacgcgaaagaaggaacgaguuuagcaguaaagagcggcugcucgaggaacuuaaguggaaaaaggcuacacugcacgccguggauguuaccuuggaccccgauacggcgcauccgcaccuauuccuguacgaagacucuaaguccgugcgacucgaggacagccgccagaaacugccugaaaagacugagagauuugauucguggcccugcguccuuggaagggagaccuucacaucuggccggcacuauugggaaguggagguaggugaccgcacugauugggccauugggguuuguagagaaaaugugaugaaaaagggauuugacccaaugaccccugagaacggcuucugggcagucgagcuguacggcaauggguacugggcuuugacaccccucaggaccccacugcccuuagccggaccuccacgucggguggguauuuuccuggauuaugaauccggcgacaucucauuuuacaacaugaaugaugggagugacaucuauacguucagcaacgucacuuuuuccggaccgcuacgacccuucuuuugccucuggucuagcggcaaaaagccucugacaauuuguccaauagcugauggucccgagagagugaccguuaucgccaaugcacaggaccuuucaaaagaaauuccuuugaguccaaugggggaggauuccgcccccagggacgcugacacucugcauagcaagcucaucccgacacagccuucucaaggcgcgccauga

SEQ ID NO: 53506 - RNA, 1401 nt, Artificial Sequence
  derived and/or modified sequence opt3 from BTN2A1__Homo_sapiens__NP_001184162
auggaggugagaugguucaggagccaguuuucccccgccgucuucguuuacaagggcgggcgggaacgcaccgaggaacaaauggaggaauaucgaggacguacaacuuuugugucuaaagacaucucaagagguaguguagcucuggugauucacaacauaacggcacaggagaauggcaccuacaggugcuauuuccaggaggggcggagcuacgaugaagccauccuccaucuugucguggcgggacugggcuccaagccuuugauuucuaugcgcggucacgaggacgggggaaucagauuagaauguauuucgaggggcugguauccaaaaccgcugacaguuuggcgggaucccuacggcgggguggcuccugcccuaaaggaggucucaaugccagacgcagauggacucuuuauggugacuaccgccguaaucauacgcgacaaaagcguucgaaacaugaguugcuccaucaauaacacacugcuuggucagaagaaggagucugugauuuucauccccgagagcuuuaugccuuccgucucaccaugugcuguggcacugcccauuaucguggucauauugaugauuccuaucgccguuugcauuuauuggaucaauaaacuccaaaaggagaaaaagauccugaguggcgaaaaagaguucgaaagagagaccagggagauugcucugaaggaacucgagaaggaacgggugcagaaagaggaagaguuacagguaaaggagaaacugcaggaagaacuucguuggcgcagaacauuuuugcaugccguggaugucgugcuggacccagauacugcgcacccggaccuauuccucagcgaagauaggcggucuguucgacgcugucccuuuagacaucugggggaguccgugccugacaacccagaaagguucgauucacaacccugcguccuuggacgggagagcuuugcaaguggcaagcacuacugggagguggaaguagagaauguuauagaauggaccgugggugucugucgcgacucuguggagagaaaaggggagguccuguugaucccucagaacggauucuggacgcucgaaaugcacaagggccaguacagggccguguccagcccagaccguauucugcccuuaaaagagucgcugugccggguuggcguguuccucgauuaugaagcuggggacguaucuuuuuacaauaugcgagauagaucccauaucuauacuuguccgaggucagccuucagugucccugugcgccccuuuuuccggcuuggaugcgaggacagcccaauauuuauuuguccugcacugaccggugcuaacggcguuacagugcccgaagagggguugacucuacacagagucggaacccaucagucccuguga

SEQ ID NO: 53507 - RNA, 1572 nt, Artificial Sequence
  derived and/or modified sequence opt3 from BTN2A2__Homo_sapiens__NP_001184166
auggagcccgccgcugcacugcacuucagccucccugccucccuucuguuguuacugcuacuccugcuucugucuuugugcgcgcucgugucagcucaguuuaccgucguuggcccagccaacccgauccuggcaauggugggggaaaauacaacucugagaugucaucucagucccgagaagaacgccgaagacauggagguaaggugguuccggagccaauuuuccccugcuguguucgucuacaaaggaggucgcgaacgaacggaggagcagauggaagaguaucguggcagaauuaccuuugugucuaaggauauaaauagggggucgguugcauuagugauccacaacgucacagcccaggaaaauggaauuuaccggugcuauuuccaggagggccgcucauacgacgaggcuauccugagacuugugguagccgguuuggggagcaaaccacugauugaaaucaaggcgcaagaggauggaaguauauggcuagaauguaucuccggcggcugguaucccgagccucucacuguuuggagggacccauacggggaagugguccccgcacugaaagaggugucuauugccgaugcugacggacuuuuuauggugaccacagccgucaucauucgggauaaguauguucgcaacgugagcugcuccguaaauaacacccuguugggucaggagaaggaaacugugaucuucauaccugagucauuuaugccaagugcaagcccguggauggucgcucucgccgugauucugacagcgucucccuggaugguuuccaugaccgugaucuuagccgucuucauuaucuuuauggcagugucaaucuguugcauuaaaaagcugcagcgagaaaagaaaauacucagcggcgagaaaaagguagaacaggaggagaaggaaaucgcucaacagcuucaggaggaacugagauggaggcggacguucuugcaugccgcugacguugugcuagauccugacacugcccacccagagcuguuucucagugaagaucgucgcucugucagaagggggcccuaccggcagcgagugccugacaauccagagcgcuucgauucccaacccuguguccugggaugggagagcuucgcaucgggcaaacauuacugggaaguggagguugaaaacgugaugguauggaccgucggugugugcagacacucuguugagaggaagggggaggugcuucugauuccgcagaauggauuuuggacauuggaaauguucggcaaccaguaucgggcccucuccucaccugagcgcauccugcccuuaaaagaaagucuguguagagucggcguguuucuagacuacgaggcuggggacgugagcuucuauaauaugagggaucguucccacauauacacuugcccacggucugcguuuaccguaccuguucgacccuucuuuagacucggaagcgacgauucaccaauuuucaucugucccgcacugacaggugccaguggcgucauggugccugaagaggggcuuaaguugcauagggugggaacccaccaaucccuguga

SEQ ID NO: 53508 - RNA, 1386 nt, Artificial Sequence
  derived and/or modified sequence opt3 from BTN3A1__Homo_sapiens__NP_001138480
augaagauggccagcuuccuggcuuuucuccuucugaacuucagagugugcuuguuacugcuacagcuccugaugccccacuccgcacaauuuucuguccuuggcccuucagggccaauccuggccaugguuggagaggacgcggauuugccgugucaucucuuccccaccaugagugcugaaacaauggagcugaaaugggugagcuccucucugaggcagguagugaaugucuacgccgacgguaaggaaguggaggaucggcagucggcaccuuaucgcggccgaacuucaauucuccgugacgggauaacggccggaaaagcugcauuaagaauccacaacguuaccgccagcgauaguggcaaguaccugugcuauuuucaggacggugauuucuacgaaaaagcucuuguggaguugaaggucgccgacggggugggacuguaugcgguagcagccuccguuauuaugaggggcucuagcggcgaggggguguccuguacaauccggucaagucuacucggacuggaaaagacugcuagcauuucuaucgccgauccauuuuuccgcuccgcacaaagauggauagcugcccuugcggguacccugcccgucuugcuccuguuacugggcggggccggauacuuucucuggcagcagcaggaggagaaaaagacacaauucaggaaaaagaaacgggagcaggagcuucgcgaaauggcauggucaaccaugaagcaggagcagagcacucgagugaagcuguuggaagaacuaagauggaggaguauccaauaugcuucucggggcgaacgucauuccgccuacaaugaguggaaaaaggcucuguuuaaaccugccgacgugauucucgauccaaagacagcaaaccccauccugcuugucagcgaggaccagcgcucgguucagagagccaaagaaccucaagaucugccagacaauccggagagguucaacuggcacuacugcguguuggguugugaaucuuuuauuuccgggcggcauuauugggagguagaagugggagaccgaaaggaguggcacaucggcgucugcaguaaaaaugugcagcgcaagggcuggguuaagaugacccccgagaacggguucuggacgaugggacucacugaugguaauaaauacagaacccugacagaaccuaggacuaacuuaaagcugccaaaacccccuaagaaagugggcgucuuccuagacuaugagaccggggauauaucauuuuacaaugcuguggacggaagccacauucauacauuccucgauguauccuuuucugaagcgcuguauccaguuuuccggauccuuaccuuggagcccacggcacugacuauuuguccggccuga

SEQ ID NO: 53509 - RNA, 1005 nt, Artificial Sequence
  derived and/or modified sequence opt3 from BTN3A2__Homo_sapiens__NP_001184175
augaagauggccagcucccuggcuuuccuccuucugaacuuucacgugucuuuguuacugguccagcuacucacccccugcucagcacaauucaguguucugggcccuagcgggccaauccuugccauggugggagaggacgcggaucugccgugucauuuguuucccacaauguccgcugaaacuauggagcucaaauggguaucuucgucacugagacagguggucaauguguacgccgacgguaaggaaguugaggauaggcagagcgcaccuuaucggggccgcacgaguauucugcgagacgggauaaccgccggaaaagcugcacuccguauccacaacgugacagccuccgauucuggcaaguacuuaugcuauuuccaggacggugauuuuuacgaaaaagcucuggucgagcuuaagguggccgcguuggggagcaaucugcauguagagguuaagggauaugaagacggcggcauucaccuagaguguagauccacugggugguacccacaaccccagauccaguggucaaacgcaaaaggagaaaauauuccugccguggaggcuccagucguggccgauggugugggccucuaugaggucgcagcuaguguuaucaugaggggagggagcggcgaaggugugucuugcauaauccggaacucccugcuugggcuggagaagaccgccucaauuagcaucgcggaccccuucuuucgcagugcccagccuuggauugcagcuuuggccggaacacucccaauccuguuacugcuccuugcuggcgccucuuacuuccuguggagacaacagaaagaaauaaccgcauuguccagcgagauugaaucggagcaggagaugaaggaaaugggcuacgccgcuacugagagggaaaucucucuacgggagucccugcaggaggaacucaaacgcaagaagauucaauaucugacacgaggggaggaaucaaguagcgauaccaauaaauccgcguga

SEQ ID NO: 53510 - RNA, 1755 nt, Artificial Sequence
  derived and/or modified sequence opt3 from BTN3A3__Homo_sapiens__NP_008925
augaagauggccagcucccuggcuuuccuccuucugaacuuucacgugucuuuguucuuaguccagcugcuaacccccugcucagcacaauuuaguguucucggcccuagcgggccaauccuggccauggugggagaggacgcggaucuuccgugucaucuguuccccacaauguccgcugaaacuauggaguugagauggguaucuucgucacucagacagguggucaauguguacgccgacgguaaagaaguugaggaucggcagagcgcaccuuaucgcggccgaacgaguauucugcgugacgggauaaccgccggaaaggcugcacugagaauccacaacgugacagccuccgauucuggcaaauaccucugcuauuuucaggacggugauuucuacgaaaaggcuuuagucgagcugaaaguggccgcgcuugggagcgacuugcauauugagguaaagggauaugaagauggcggcauccaccuggaguguagguccacugggugguacccacaaccccagauuaaguggucagacaccaaaggagaaaauaucccugcaguugaggccccaguggucgcugauggugugggccuauaugccguggcagcuagugucauaaugcgggggagcucuggaggcgguguuuccugcaucauucgcaacucacuccuggggcuugagaagacagccagcaucaguauugcggaccccuuuuucagaucugcccagccuuggaucgcagcucuggccggaaccuugccaauaucccuccuguuacuggcuggcgccagcuacuuucucuggaggcagcaaaaagaaaagauugcacuuucgcgggagacugaacgcgagcgagaaaugaaagagaugggcuacgccgcuacagagcaggaaaucucucugagagagaaguugcaggaagaacuaaaguggaggaaaauucaguauauggcgcguggggaaaagucccuggcauaccaugaguggaaaauggcccucuucaagccggcugaugugauccuggaccccgacaccgccaaugcaauccuucugguaucagaggaucaacggagugugcagcgcgccgaggagccuagagacuugccagauaaccccgaaagguuugaguggcgguauuguguccucggaugcgaaaauuucacgagcggucgacacuacugggagguggagguuggcgaccgcaaagaauggcacauugggguguguuccaagaacgucgagaggaaaaagggaugggugaagaugacuccugaaaauggcuauuggaccaugggucugacagaugggaacaaauacagggcuuuaacugagccacggaccaaucugaagcuacccgagccgccucgcaaaguaggcauauuucucgacuaugaaacaggagagaucucuuucuacaacgccaccgauggcagccauauuuacacguucccccacgcaucauuuagugaaccacuguauccuguuuucagaauccuuacuuuggagcccacagcgcugaccauaugcccaauucccaaggaaguggaguccagcccugacccagaucucgucccggaccauucucuggagacuccccuuacaccugggcuggcuaaugaaucaggagagccacaggccgaagugaccaguuugcuccugcccgcacacccuggugccgaggucagcccauccgcuacgaccaaccaaaaucacaaauuacaggccaggacagaagcacuguacuga

SEQ ID NO: 53511 - RNA, 1449 nt, Artificial Sequence
  derived and/or modified sequence opt3 from BTNL2__Homo_sapiens__NP_001291490
augguggacuuccccggcuacaaccugagcggggccgucgcuuccuuucucuucauccuucugaccaugaagcagucugaggauuuuagaguuauuggaccugcacacccaauauuggccggugugggcgaagacgcguuacugacaugccaacuacucccgaaaaggacuacgaugcauguagaggugcggugguaucgcucagaacccaguaccccugucuucgugcaccgagaugggguugaggugacagaaaugcagauggaggaguaccguggaugggucgaauggaucgagaauggcauugcuaaggguaacguggcccugaaaauccauaauauucagccaagcgacaacgggcaguauuggugucacuuucaagauggaaauuacugcggcgaaacuucccuucuguugaagguagcaggccucgggucugcccccucgauccauauggagggaccuggugagucaggcguucagcugguguguaccgcuagagggugguucccagaaccccaggucuauugggaggacauaaggggagaaaaacugcucgcagugagcgagcaccggauccaggauaaggacggcuuauuuuacgccgaagcuacacuggugguccgcaacgccagugcggaguccguuucuugccuugugcacaauccuguauugaccgaggaaaaggguagcgugauuucccugccagagaaacuacaaacugaacucgcaucacugaaggucaacgggccgagucagcccauccuugugagaguuggagaggauauucagcugacauguuauuugagcccuaaagccaaugcucagucuauggaagugaggugggaccggucccaucgcuacccagccguccacguguacauggauggcgaccauguagcaggcgagcaaauggcugaguaucgagggagaaccguucucgugucagaugccaucgacgaaggaaggcugacguuacagauacugagcgcgcggcccagugacgauggucaguaccguugccucuucgagaaggacgaugucuaucaagaagccucucuugaccugaaaguggucuccuugggcagcucgccucuaauuacuguggaggggcaggaagauggagagaugcagccaauguguucuuccgacggcugguuuccccagccgcacguuccuuggcgcgauauggaggguaagaccauccccucaaguagccaagcacugacacaggggucccacggccucuuccaugugcagacucugcuuagaguaaccaacauuucugcugucgacgugacaugcagcaucucaaucccauuucugggagaagagaagauugccaccuucaguuuguccgaaagcaggaugacguuucucuggaaaacucuguuaguuuggggccugcuacucgcuguggccgucgggcugccucggaagcgaucuuga

SEQ ID NO: 53512 - RNA, 1740 nt, Artificial Sequence
  derived and/or modified sequence opt3 from BTRC__Homo_sapiens__NP_001243785
auggaccccgccgaggcugugcugcaggaaaaggcacucaaauucaugugcagcaugccuagaucccuuuggcugggcuguucuucauuggccgauaguaugccgagcuuaaggugccuguacaacccagggaccggagcgcuaacagcuuuucaaacuuauaauuccugugcccggcucugccugaaccaggagacggucugucuugcaucuaccgccaugaagacagaaaauugcguugcuaaaacuaagcuggcaaacgguaccucgucaaugaucgugcccaaacagcgcaaguugagcgccaguuacgagaaggaaaaagagcucuguguaaaguauuucgagcagugguccgaaucugaccaaguggaguuugucgaacaccugauuagccagaugugccauuaccagcacggccauauaaauuccuaucugaaaccuaugcuccagcgagauuucaucacagcuuuaccagcccgugggcuggaccacauugcggagaacauccuuucauacuuggaugcaaagagucugugugccgcugagcuagugugcaaagaaugguauagaguuaccagcgacggaaugcucuggaagaagcugauugagaggauggugcggacugauucucuuuggcgcggccuggccgaaagaagggguugggggcaauacuuguuuaaaaauaagcccccugacggaaacgcaccacccaauuccuucuaccgggcucucuauccuaaaaucauacaggauaucgagacaauugaaucaaacuggcgcuguggccgacauagccugcagagaauccacugcaggagugagaccucuaagggcgucuacugcuuacaguaugacgaucagaaaauuguguccgggcugcgggacaauacgaucaagauaugggauaaaaacacucucgaguguaagcguauucuuaccggacacacagguagcguacugugcuugcaauacgacgaacgcguuaucauuacuggcucgucugacuccaccgugagagucugggaugugaauacaggggagaugcuaaacacccugauccaucacugugaagccgugcuccaucugagguuuaauaacggaaugauggucacgugcucaaaggaccggaguaucgcgguuugggauauggccagcccaacugacauuacacuucgacgcgugcugguaggccacagagcagcugugaacgucguggauuucgacgauaaauauauaguuuccgccucuggugacaggaccaucaagguguggaauacuagcacaugugaguuuguccggaccuugaacgggcacaaacgcggaauugcuugccuccaguacagagauaggcuggugguaucaggcaguuccgacaauacgauccguuuaugggauauagaauguggcgccugccugcggguucuagaggggcaugaggaacucgugcgauguauuagauucgacaacaagaggaucgucagcggagcauaugacgguaaaaucaaggugugggaucuggucgccgcucuugacccgcgcgcgcccgcaggcaccuugugccugcggacacucguggagcacucugggagaguuuuuaggcugcaauucgaugaauuucagauugugucaaguagccaugacgauacuauccuuauuugggacuuccugaaugauccugccgcucaggccgagccaccccgcuccccuucucgaaccuacacauacauaucgcgguga

SEQ ID NO: 53513 - RNA, 3153 nt, Artificial Sequence
  derived and/or modified sequence opt3 from BUB1B__Homo_sapiens__NP_001202
auggccgcugugaagaaagagggcggggcacugagcgaagccaugucccucgagggagacgaaugggagcuuucuaaggaaaacguccagccccugagacaagguaggaucaugucaaccuugcagggcgcguuagcucaggagagugccugcaauaacacacugcagcaacagaaacgggcauucgaguacgaaauucgcuuuuauacugggaaugauccucuagacguuugggaucgauacauaagcuggacggagcagaacuauccacagggaggcaaggaauccaauaugucuacccuccuggagcgugccguggaggcucugcaaggugagaaaagauacuauucggacccgagguuccugaacuuguggcucaagcuggggcggcuguguaaugaaccccucgauauguacucauauuuacacaaccagggaaucggcguaagccuggcacaguuuuacauuaguugggccgaagaguacgaagcucgcgagaauuucagaaaggccgacgcgaucuuucaggagggcauucaacagaaagcagaaccucuugagagguugcagucccaacaucggcaguuccaggcccgcgugucucgacagacacugcuagcucucgaaaaggaggaagaggaggaagucuuugagagcuccgugccacaaagaucaacucuggccgaacuuaaaaguaaggggaaaaagaccgcaagggcucccaucauacggguuggaggugcccugaaggcgccuagccagaaccguggcuugcagaauccauucccccagcaaaugcagaacaauucucgcaucacaguguuugaugagaacgccgacgaagcauccaccgcugagcucucaaaaccuacuguccagccauggauugccccgcccaugccuagagcuaaggagaaugaacugcaggccgggccauggaacacaggaaggagcuuagagcaccggccccgaggcaacaccgcaagucugaucgccgugccugcuguacucccaucuuucacgcccuauguugaagagacugcgcaacagccggugaugaccccuugcaaaauugagcccuccaucaaucauauacuuagcacacgcaagccagguaaagaagagggggauccucugcagagaguccagucgcaccaacaggcaucugaagagaagaaagaaaagaugauguacuguaaggagaaaauuuaugccggagugggcgaguuuuccuucgaagagaucagggcugaaguguuucggaagaaauugaaggagcagcgcgaagccgagcuacugacuucagcagagaaaagagccgaaaugcaaaagcagauugaggaaauggagaagaaacucaaggaaauccagaccacacagcaagagaggaccggcgaccagcaggaggaaacgaugcccacuaaagagacaaccaagcugcagaucgcuagugaaagccagaaaauuccagggaugacucuuuccucuagcgucugccaaguuaacuguugcgcccgugagacaucacuggcagagaauauauggcaggaacagccccauaguaagggaccuuccgugccauucagcaucuucgaugaguuuuugcucucugaaaagaaaaacaagucaccgcccgcggacccuccacggguacuggcucaacgaagacccuuagccgugcugaaaaccagugagagcauuacguccaaugaagaugucucuccugacgugugugacgaguucaccgguaucgagccacuaucggaagaugcaauaauuacaggcuuuaggaacguuacuaucugccccaauccggaggacaccugugauuucgcccgcgcugcccgguuugugagcacaccuuuccacgaaaucaugucccucaaggaccugccaucagaucccgagagacuuuugccugaagaggaccuggaugucaaaaccagugaggaccagcagacugcaugcgggacaauuuacucucaaacccucagcaucaagaagcugucccccauuauagaagauucaagggaggcuacucacagcucuggauuuuccggcaguagcgccucuguggcguccacgucaaguaucaaaugucuucagauuccagaaaagcuggaguugacaaacgaaaccagcgagaauccuacucagucgcccuggugcucccaguaucgccgacaacuccugaaaucuuuaccagagcugagcgccucagcugaacuaugcaucgaggaccggccgaugccuaagcucgaaaucgagaaagagauugaacuggguaacgaggauuacuguauaaagcgugaauaucuuaucugcgaggacuacaaauuguucuggguagcacccagaaauagugccgaacugaccguuauuaagguguccucucagccaguccccugggacuuuuacaucaaccucaagcugaaagagagguuaaaugaggauuucgaccauuuuuguagcugcuaucaguaccaggauggguguauuguguggcaccaauauaucaacugcuucacacugcaggaccuuuugcagcauuccgaauacauaacccacgagaucacuguccucauuaucuauaaucugcuaacaauuguggaaaugcugcacaaggcugagaucguucauggcgaucucucaccucgcugucugauacuucggaacaggauucacgacccauacgauugcaacaaaaauaaccaggccuugaagaucguggacuuuagcuauaguguagaucugagaguccaauuagacguguucacgcucucuggauuccgaaccguucagauucuggaaggccagaaaauccuugcaaauuguuccagccccuaccagguggaucuguuugggauagcggacuuggcccaucuccugcuauucaaggagcaccuucaagucuuuugggauggaucguucuggaagcucucacagaacaucucugagcugaaagacggugaacuuuggaauaaguuuuucgugcgcauuuugaacgcuaaugacgaggccacuguaagugugcugggcgaauuagcagcugagaugaacgggguuuuugauacaaccuuccagucccaucucaauaaagcccuguggaaggucggaaaacuuacaagcccuggcgcacugcuauuucaauga

SEQ ID NO: 53514 - RNA, 3198 nt, Artificial Sequence
  derived and/or modified sequence opt3 from BUB1__Homo_sapiens__NP_001265545
auggacacccccgagaacgugcugcaguacauccaaugggucgaagagaauuucccugaaaacaaggaguaucucauuacacuucuggaacacuugaugaaagaguuuuuagauaagaaaaaguaccauaaugacccaagauucauaagcuauugccugaaauuugcugaguacaacuccgaucuacaccaguucuuugaguuccucuauaaucauggcaucgggacucugucuucaccgcuuuacauugcuugggcaggacaccuggaagcccagggugaauugcagcaugcgagugcuguucuccaaaggggcauccagaaccaggccgagccccgggaguuucugcagcaacaguaucgccuguuccagacgcgacucaccgaaacacacuuaccugcacaggcccguacuagcgagccacugcacaaugugcaaguacuuaaccagaugauuaccuccaagucuaaucccgggaacaauauggcuuguaucucgaagaaccagggaucagaauugagcggcgugauaaguuccgcaugcgacaaagagucuaauauggaaagaagggucaucacaauuagcaaguccgaguacucagugcauaguagccuggccucuaaaguugauguggagcaagucgugauguacuguaaggaaaaacuaauccggggugaguccgaauuuucauucgaggaacuccgcgcucagaaguauaaccagagaaggaagcacgagcaguggguaaaugaggaccggcauuacaugaaacgcaaggaagccaacgcguuugaggaacaacugcuuaaacagaagauggaugagcugcacaaaaaguugcaccagguuguggaaaccagccaugaggaccucccugcaagucaggagcgaucugaagucaacccagccagaauggggcccuccgugggaagccaacaggagcugagggcuccuugcuuaccagugacuuaucagcagacaccggucaauauggagaaaaacccccgggaagccccuccaguugugcccccucuggcaaaugcuauuucggccgcgcucguaucuccagccaccucccaaucaaucgcacccccggugccucuuaaggcucagacggucacugauaguauguucgccguggcuagcaaggacgccggcuguguuaacaaauccacccacgaguuuaagccccagucuggcgcagaaauaaaagaggggugcgaaacacauaagguggccaauacuagcucauuccacaccacaccaaacaccagucugggaaugguccaggcuacgccuuccaaagugcaacccagcccaacuguacauacaaaggaggcguuggguuucauuaugaauauguuucaggcacccacccuaccugauaucucugacgauaaggacgaauggcagucacuggaccaaaacgaggaugccuucgaggcucaguuucagaaaaauguucguaguagcggcgccuggggagugaacaagauuaucuccucucucucgagcgcauuccacgucuuugaagacgggaauaaagagaacuacggccugccacagccgaagaauaaacccacuggugcccgcacauucggggaaagauccgugucaaggcuuccuaguaagccaaaggaggaagucccccacgcugaggaguuucuggaugacucuaccguguggggaauccgguguaacaaaacguuggccccuagcccaaagucccccggcgauuucaccucagcagcgcaacucgcuagcacaccguuucauaaacugccuguugaaucugugcacauuuuagaggacaaggaaaauguagucgccaaacagugcacucaggcaacccuggauuccugugaggaaaacauggugguuccaagucgagacggcaaguucagccccauacaggagaagucuccuaaacaagcccuauccucacauauguauagugcuagccuccugcgccuuucgcagcccgccgcagggggaguguugacaugcgaggcugaacugggugucgaggccuguagacucacugauaccgacgcggccaucgcugaagauccaccugacgcaauugccggccugcaggcugaguggaugcagauguccucucuugggacaguggacgcccccaacuuuaucguaggaaauccaugggaugacaagcugauauucaaauugcucagcggccugucaaagccggugaguuccuacccuaacaccuuugaguggcaaugcaaauuacccgcaauuaagccaaaaacugaguuccagcuggguucuaagcuaguuuauguccaccaccuccugggggaaggcgcguucgcccagguguacgaagcuacgcaaggagaucuuaaugacgccaagaacaaacagaaguuuguguugaaaguccagaagcccgcaaauccuugggaguucuacaucggcacacagcugauggaaaggcucaaaccaagcaugcaacauauguuuaugaaguucuauuccgcucaccuguuucagaacgggucaguuuuagugggagagcuguacagcuaugguacccuuuugaaugccaucaaccucuacaagaauacucccgagaaagugaugccucagggccugguaauuaguuucgcaaugcggaugcuauauaugaucgaacagguccaugauugcgagauuauacacggggacaucaagccggauaacuuuauucugggaaauggcuuccucgaacaagacgaugaggacgaucugucugccggucuugcuuugaucgaccuggggcaguccaucgauaugaaauuauuuccaaagggcaccauuuucacagcgaaaugugaaaccagcggauuucagugcguggagaugcucucgaacaagcccuggaauuaccagauagacuauuucggcguugccgcaacuguguacuguaugcuguuugggacauacaugaaggucaaaaacgagggaggugaaugcaagccugagggccuuuuccgcagacugccacauuuggacauguggaaugaguucuuucacgugaugcucaacauccccgauugucaccaucugccuucacuagaccugcucaggcaaaaacugaagaaaguuuuccagcagcacuauacgaacaagauucgugcccuucggaaucgauugaucgugcuguuacucgaaugcaagagaucuaggaaauga

SEQ ID NO: 53515 - RNA, 981 nt, Artificial Sequence
  derived and/or modified sequence opt3 from BUB3__Homo_sapiens__NP_001007794
augaccggcagcaacgaguucaagcugaaucagcccccugaagacgggaucuccucugugaaauuuucaccaaacacaagucaauuccuccuugucagcuccugggauacuucuguuagacuguacgacgugccggccaauucgaugagguugaaguaucagcacacgggagcuguauuagauugcgcauuuuacgaccccacccaugccuggucagguggccuggaucaccagcuaaaaaugcaugaccucaacacagaucaggagaaucugguggggacucacgacgcgccuauucggugugucgaauauugcccagaggugaacguuauggugaccggaagcugggaucaaacagucaaacuuugggacccccgcaccccuuguaaugcuggcacuuucagucagccagaaaagguguacacacuguccguaucuggugaucgauugauaguugggaccgccggacguagagugcucgucugggaccugaggaacaugggcuaugugcagcagcggcgcgagagcucccugaaguaccaaacgagaugcaucagggcauuucccaauaagcagggcuaugugcucucaaguauugaggggcgggucgccguugaauacuuagauccuagcccagaggugcagaaaaagaaauacgcuuucaagugucaucgccugaaagaaaacaauaucgagcagauuuauccgguaaacgcaaucucuuuucacaauauacacaacacuuucgccaccggagguuccgacggcuuugugaauaucugggaccccuucaacaagaagcgacuuugccaauuucauagauacccuacaucaauugcuagcuuggccuucaguaacgaugggacuacccuggcgaucgcaucuuccuauauguacgagauggacgauacagaacacccagaggacggaauuuuuaucaggcaggucaccgaugccgaaacgaaacccaagagcacuuga

SEQ ID NO: 53516 - RNA, 1458 nt, Artificial Sequence
  derived and/or modified sequence opt3 from BUD13__Homo_sapiens__NP_001153208
auggccgcugcacccccucugagcaaggccgaguaccucaaaagauaucuuuccggcgcggacgcugggguggauaggggaucugaaucaggucggaagcgccguaaaaagcgaccaaaaccgggcggggccggaggcaaggguaugagaaucgucgacgaugacguuaguuggaccgcaauuagcacaacuaagcuggagaaagaagaggaagaggaugacggggauuugcccgugguagccgaguucguggacgaaaggccugaggaagucaagcagauggaggcuuuucgguccucugcaaaauggaaguuacugggaggccacaacgaggaucuaccaucgaaucgccauuucagacacgacacgcccgauucaagcccuaggcgggugcgccauggcaccccagaccccaguccucgaaaagauagacacgacacaccagacccgucccccaggcgggcccgucaugauacuccugacccaucuccccuccgcggggcuagacacgauagcgacaccuccccuccaaggcggauacgacacgauucaagugacacaagcccgccccgcagagccaggcaugauucuccugaccccuccccaccucggcgcccccaacacaacucaagcggagauugccagaaggcgaccgacagugaucugucuuccccaagacauaagcagagccccggucaccaggacucggacucugaucuuuccccuccaaggaaucguccgcggcaccgaucaagugacagcgaucugucucccccuagaaggcgccaacggacuaaauccagcgacucagauuugaguccacccagaaggucccagccuccaggcaagaaagcagcccauauguacagcggggcuaagacaggacucguucugaccgacauccagcgcgaacagcaagagcugaaagaacaggaucaggagacgauggccuuugaagcagaguuccaguaugcugagacuguguuucgagacaagucuggccggaaacguaaccucaaguuagaaagacuggagcaaaggcgcaaggccgaaaaagauucagagcgggacgaacuuuacgcgcagugggguaagggguuggcccagaguagacaacagcagcagaaugucgaggaugcaaugaaagagaugcaaaagccccuggcuagguauauugacgaugaagaccuagaccgaaugcuccgcgagcaggaacgggagggagauccgauggccaacuucaucaaaaagaauaaggcuaaagaaaacaagaauaaaaaggugagaccuagguacagcggcccagcacccccucccaaccguuuuaauauuuggccaggcuaucgcugggacgggguagaucgguccaacggauucgagcagaaaagauuugccaggcuggccucuaagaaggcuguugaggaacuugcguacaaauggucgguggaggacauguga

SEQ ID NO: 53517 - RNA, 435 nt, Artificial Sequence
  derived and/or modified sequence opt3 from BUD31__Homo_sapiens__NP_003901
augcccaaggugaaaagaagcaggaaggccccuccagacggcugggagcugaucgaaccgacccucgaugagcuugaccagaaaaugcgggaagcugagacagaaccccacgaggggaagcgcaaagucgagucccuguggccuauuuuccgaauacaucaccaaaagacucguuacaucuuugauuuguucuauaagagaaaagcaauuucuagggaauuauacgaguauugcaucaaggaaggauacgccgacaaaaaccugauugcgaaguggaaaaagcaggguuaugagaaucuauguugccuccgguguauccagacgcgcgauaccaacuuuggcacaaauugcauauguagaguuccaaagucaaaacuggagguggggaggaucauugaaugcacucauuguggaugccggggcuguagugguuga

SEQ ID NO: 53518 - RNA, 1083 nt, Artificial Sequence
  derived and/or modified sequence opt3 from BVES__Homo_sapiens__XP_011533700
augaacuacaccgagagcucuccccugagagaauccacagccaucggcuucacuccugagcucgaaucaauuauaccagugccgaguaauaagacgaccugcgagaacuggagggaaauccaccaucuugucuuucacguugcuaauauuuguuucgcaguggggcugguaauccccacaacuuugcauuuacacaugauuuuucugcggggaaugcuaacccucgguugcacacuguauaucgugugggccacccuuuaccgcugugcgcuggacauaaugaucuggaacagcgucuucuugggcgugaauauucuccaucuguccuaucugcucuacaaaaagcgaccuguuaaaaucgagaaggaguuaucugggauguaucguagacuguuugaaccacuuagggugcccccugauuuguuccggcgccugacuggacaguuuugcaugauucaaacacucaaaaagggccagaccuacgcugccgaggacaagacgucggucgaugacagacuaucaauccugcuuaaagguaagaugaaagugagcuauagggggcacuuccugcacaacauauacccaugugcauuuauugauagucccgaguuccgguccacucagaugcauaagggagaaaaauuucagguaaccaucauugccgacgauaauugccgcuucuuguguuggucucgagagagacucacauacuuucuggaaagcgagccuuucuuauaugaaaucuucagguaccugaucggcaaggacauuacuaacaagcucuauucccuuaaugauccaacccugaacgacaaaaaggcuaaaaaguuggagcaccaacuaucacugugcacacagauaaguaugcucgaaaugcggaauagcaucgcaucuuccucagauagcgacgauggccugcaucaguuucuucgugggaccaguucuauguccagccugcacguuucgucuccgcaccagcgcgccuccgcuaaaaugaagcccauugaggagggagccgaagacgacgaugacguguucgagccugcgucaccaaacacguugaaaguccaucaacuccccuga

SEQ ID NO: 53519 - RNA, 1314 nt, Artificial Sequence
  derived and/or modified sequence opt3 from BYSL__Homo_sapiens__NP_004044
augcccaaguucaaagccgcuagaggcgucgggggacaggagaagcacgcaccucuggccgaccaaauccucgcggguaacgcugugagggccggcguucgggaaaaacgccgagggcguggaaccggcgaggcagaagaggaauacguggguccaagacuuagcaggcggauucugcagcaggcccgccagcaacaggaggaguuggaagcugagcaugggacaggagauaagccggcagcccccagagaaaggacuacgcgguuaggcccucgcaugccacaggacggcuccgaugacgaggaugaggaauggcccacccuggagaaagcugccacaaugacugcggcagggcaccaugccgaaguaguggucgacccugaggaugaacgagcuauagagauguuuaugaauaagaacccacccgccagaaggacccuagcagacaucauuauggagaagcucacagaaaaacagaccgagguggaaacuguuaugucugaggugucaggauucccuaugccacaacuggauccgcggguccuugaaguguaucgugguguacgcgagguucugaguaaguacagaagcggcaaauugcccaaggcuuuuaaaaucauuccugcccucuccaauugggagcagauccuguaugugacagaaccagaggcguggaccgccgcagcuauguaccaggccacgaggauauucgcuucuaaccugaaggaacggauggcccagcgauuuuauaaucucgucuuacugccccgcgugagagacgauguggcagaguacaagaggcuuaacuuccacuuguauauggcccugaaaaaggcucuauuuaaaccuggggcgugguucaagggaauccucauuccacugugcgaaucgggcacuuguacccuucgggaggcaaucauugucgguucaaucauaacaaaaugcagcauucccguucugcauaguuccgccgcuauguugaagaucgccgagauggaauacucuggggcaaauagcauuuuucuccgccuguuacuggacaaaaaguacgcccucccguauagagugcuugaugcucugguauuccacuuuuugggauucaggacugagaagcgugaacuaccugugcuguggcaccaaugucuccugacccuuguccagcgguacaaagccgaccuggcaacagaccagaaggaggcguugcucgagcuguuacgacugcaaccccauccacagcuauccccugaaaucagaagggagcuccagucagcugugccccgcgauguugaagacgugccaaucaccgucgaguga

SEQ ID NO: 53520 - RNA, 5547 nt, Artificial Sequence
  derived and/or modified sequence opt3 from BZRAP1__Homo_sapiens__NP_001248764
auggagcagcugaccacucuccccagaccuggcgacccaggggccauggaaccgugggcacuuccaacuuggcacagcuggacgccuggcagggguggcgagccauccucugcugcccccucaaucgcggauaccccuccagcugcccugcaauugcaggaauuacggagugaggaaagcuccaagcccaaaggggacggaucuucgcgcccugugggcgguacagauccagagggggcagaggccugccugccgucacuaggacagcaggcuagcaguuccggccccgcaugccaacgaccugaagacgaggaagucgaggccuuccucaaggcuaagcugaacaugucuuuuggcgaucguccaaaucuugagcuguugagagcccucggggaacugaggcagcggugcgcgauucugaaggaggaaaaccagaugcuccgcaaaagcuccuuccccgagacugaagagaagguuagaagguuaaagcggaaaaaugcagagcuggccgugauagcuaagcgccuugaggaacgagccagaaaauugcaggaaaccaaccugaggguagugucagcaccucuaccacggcccggaacaagucucgagcugugucguaaggcucuugcccgccaaagagcgagggaccugagcgaaaccgccucugcauugcucgcuaaagauaagcagaucgccgcucugcagcgggagugccgagaguuacaggcccgccugacucucgucgguaaggaaggcccgcaauggcuucacgugagagacuuugauaggcuguugcgggagucccagcgcgaaguucuaagacugcagaggcaaauugcacuccguaaucagcgggagacacugccucuucccccaucauggccucccgggccagcccugcaggcucgagcgggagcacccgccccuggcgcuccaggugaagccaccccgcaggaggacgcagauaacuugcccgugauccucggggagccugaaaaagagcaaagaguccagcagcuggaaagcgaguuaaguaagaaaaggaagaaaugugagucucuggaacaggaggcccgcaagaaacaacggagaugcgaggaacuugaacuccagcugaggcaggcucagaaugagaacgcccgccuuguggaggaaaauucccgauugagcggacgggcaacggagaaggaacaaguagagugggaaaacgcggagcugcguggccagcuccugggcguuacucaggagagagacucggcucuuaggaagucucaggggcugcaauccaaauuggaaucacucgaacaggugcugaagcacaugcgcgaagucgcccagcggagacaacaguuagagguggaacaugagcaggcaaggcugagucuacgagagaaacaggaagaggugcgccggcuccaacaggcccaggcugaagcccagagagagcacgagggagcaguccaacugcuugaaagcaccuuggauuccaugcaggcuaggguucgugagcuggaggagcagugucgcucucagacagaacaauucagccuccuggcccaggaguuacaggcguuucggcugcauccagguccccuugacuugcucacuucagcccuggacugcggcagucuaggggauuguccuccacccccgugcuguugcuccauuccucaaccaugcagaggaagcggccccaaggaccuggaucucccucccgguucuccagggagguguaccccuaaaucaagugagcccgcuccagcaacacugaccggcgugccgcgacggacggccaagaaggcugaaagccuuuccaauucuucgcacagcgaguccauccacaacucaccuaaaaguugccccacuccagaaguagacacagccucugagguggaagaguuggaggcagauagcgucucccuguuacccgcggccccugaaggaucacgcggcggggcuagaauacagguguuccucgccagguacagcuauaauccauuugagggacccaacgaaaauccugaggcagaacugccgcuuaccgcuggugaguacaucuauauuuacggcaacauggacgaggauggguucuuugaaggagagcugauggacggccggcgagguuugguuccaucuaacuucguggaaagagucuccgaugacgaucuccugacaagucuacccccugagcuggccgaccucagccauucuuccgggccagagcugucauuucuuagugugggcggaggcgggagcucguccggaggucagucuagcguaggccgcucacagcccaggccugaagaggaagacgcaggggaugaguugagucuguccccgucucccgaaggauuaggcgagcccccugccguucccuauccacgucggcucgugguccugaagcaacuugcucacagcgugguccuggcgugggagccucccccagaacagguggagcuacaugguuuccacaucuguguuaauggggaacucagacaggcccugggcccgggagcaccucccaaagcuguguuggagaaccuggacuuaugggccggcccacuccacauuuccguacaggcccugacaucaagggggagcagugauccccuucgcugcugucuggcugucggagcacgagccggcgugguuccuucucaauugagagugcaucggcucaccgcgacguccgcugaaaucaccugggucccagguaauagcaaccuggcccacgcaauauaccuaaauggggaggagugucccccugccucgccgucaacauauugggcuacuuuuugucaucugaggccaggaacccccuaccaggcacagguggaagcccagcuuccuccccaaggcccaugggagccugguugggaacgccucgagcagcgugcggcuacacugcaguucacuaccuugcccgccggcccaccugacgcaccgcuggauguacagauugaacccgggccaucuccuggaaucuuaauuaucaguuggcuccccgugacaaucgacgccgcuggcaccuccaacgggguuagagucacuggauacgccauuuaugcagauggccaaaagauaauggagguggcuagcccaacggccgguucugugcuggucgagcuuagccagcugcaguugcuccaaguuugccgggaaguggugguaaggacaauguccccucacggggagucagcggacaguauccccgccccgauuaccccagcacuggcuccugccagccuacccgcucgcgucucuuguccaucaccccauccuuccccggaagcacgagcuccccuggccagugccagcccaggaccuggcgaucccuccucuccucuucagcacccagcgccccucgguacucaggagccuccaggcgcacccccggccucgccuagcagagagauggcuaaagggucacacgaagacccacccgccccuugcucccaggaggaagcaggagccgcugugcugggcaccagugaggaacggacagcgucuaccagcacuuugggggagaaggauccaggacccgccgcaccguccuuagcuaagcaagaggccgaauggacagcaggcgaggccuguccugcuucaucuagcacgcagggugccagggcgcagcaggcacccaauaccgaaaugugccaagggggagacccaggcaguggucugcgcccuagagccgagaaagaagauacugcugagcucggcguucaucuggugaacucccuugucgaccacgggaggaauagcgaccugucugauauccaggaggaagaggaagaggaagaggaggaagaggaagaggaguugggaucacggacaugcuccuuccagaaacagguggccggcaacaguauacgugaaaauggggcuaaaagccaacccgacccauuuugugagaccgauucggacgaagagauucuagaacagauccuggagcucccccugcagcaauucugcucuaagaaacuauuuuccaucccugaggaagaggaagaggaagaggaggaugaagaggaagaaaagagcggagcaggcuguucaagucgcgacccagguccgcccgaaccugccuuacuggggcucggaugcgauucuggccagccacgaagacccggccaguguccuuuguccccagagagcucaagggcuggggacugccuggaggauaugcccggacucguugguggcaguagccggcgcagagggggaggcuccccugaaaagccgccaucuaggcggcgacccccugaccccagagagcauuguagccgccugcuuuccaacaaugguccacaggccucagggaggcugggaccuacacgggaacguggcggcuugcccgugauugaggggccaagaacuggacuagaggcaucugguaggggccgccuggggccgagucggcgaugcucgagaggaagggcgcucgaaccuggcuuagccagcugucugucccccaaaugccuugagaucucuauugaauacgauucagaggacgaacaagaggcugguagcgggggaauauccaucaccaguucuuguuauccaggcgauggcgaggccugggggacggcaaccguaggacgcccccgggguccuccaaaggcuaacagcggccccaaaccuuacccgagacugccagccugggaaaagggggagcccgaacguaggggacggucagcaacaggccgcgccaaagagccucucucccgagcuacugaaaccggugaggcgagagggcaggacggaaguggcaggcggggcccacagaagcgcggggucagaguguugaggcccagcacagccgagcuggugccugcacgaucucccuccgaaacucucgcuuaucagcaucugccaguccggauuuucguugcccuuuuugacuacgauccggugucaaugagcccuaaucccgacgccggagaggaggagcuaccauuccgugaaggucaaauccugaaaguauuuggcgauaaggacgcagauggguucuaucagggagagggcggugggagaaccggauacaucccuugcaacaugguggcugaggucgccguggacucgcccgcgggccgccagcaguuguuacaaaggggcuaccugucuccagauauucuccuggaagggagugcucacacgacaggaccucccccgaagccacggagauccaaaaaggccgagagcgaagguccugcacagcccugcccaggacccccuaaacuuguuccgucagccgaccugaaggcuccacauuccaugguggcagccuuugauuauaacccccaggagucuagcccuaauauggacgucgaggcggaacuccccuuccgcgcuggggaugugauaaccguuuuuggaggcauggacgacgaugguuucuacuauggggaguugaacggccagaggggacuggugccaaguaauuuucuagaaggcccugggcccgaggccggaggucuggaccgagaaccacggacuccucaagcagagucccagagaacaaggcgccgucggguccaguguuga

SEQ ID NO: 53521 - RNA, 1260 nt, Artificial Sequence
  derived and/or modified sequence opt3 from BZW1__Homo_sapiens__NP_001193996
augaacaaucagaagcaacagaaacccacccugagcggccagagauucaagacaaggaaacgggacgagaaggaacgcuuugauccuacucaguuccaagacugcaucauucaggggcucacggagaccggaacagaucuugaagccguggcuaaauuucuggacgcauccggugccaaguuggauuaccgacguuaugcggagacuuuauucgacauacuggucgcuggcgggaugcuagccccaggaggcacccucgcagaugacaugaugagaacagauguuuguguguuugccgcucaggaagaccuggagaccaugcaggcauucgcccaaguauuuaacaaacuuaucaggcgguacaaauaucuggagaaggguuucgaagaugaggugaaaaaguugcuccuguuucugaaaggguucucugaaucagagcgcaauaagcucgcuauguuaacuggaguccugcuugccaacggcacauugaaugcgaguauucugaacagccuauacaaugagaaccucgugaaggaaggcguuuccgcagccuuugcugugaaacuguucaagucuuggaucaaugagaaagacauuaacgccgucgcagcuucgcuuagaaaggugucaauggauaauaggcugauggaauuguuuccggccaacaaacagagcguagagcacuucaccaaguauuucacggaagcggggcucaaagagcugagugaguacguucggaaucagcagacuaucggagcccgcaaggaauuacaaaaggagcugcaggaacagaugucccgaggugaccccuuuaaagacauaauccucuaugugaaggaggaaaugaaaaagaacaauauuccugagccagucgugaucggcauuguguggucuagcgucauguccaccguugaguggaacaaaaaggaggaacuuguggcagaacaagcuaucaagcaucugaaacaguacucacccuugcuagccgcuuucacaacucaggggcagagugagcugacccuccugcuuaagauacaagaauacugcuaugauaacauucacuuuaugaaagccuuccagaagaucguagugcuguuuuacaaagcagaggucuugagcgaggaaccuauucucaagugguauaaggacgcccauguggcuaaaggaaagucuguuuuccuggagcagaugaaaaaguuuguggaaugguuaaagaaugcggaggaggaauccgagucagaagcagaggaaggcgauuga

SEQ ID NO: 53522 - RNA, 627 nt, Artificial Sequence
  derived and/or modified sequence opt3 from C10orf107__Homo_sapiens__XP_005269657
auggacuucagcaucauucaguacuccaaguuuaugacccugcucgccaugucucuucaaaaccugaaaacauugcacaugucauuagaggaaaguauaaaguggcugggcgaggugauggcugaaaucgggcccacucauagccagaaauccgaggauuggaauauuuucgacgucaagcaggcaaacgccaucauugauuaucuaaaaaucucucucuuucagcacuacaagcuguaugaguucauguuuuacucggcgagagaagagauaguuaucggaacggaacaagugauugagguagugaagucagcuugcgguccuuucccaaauccgcuugaagagggcaucagcuuugacauuuauaguaccuucaucgagcccccuacaauacuggauacugaaaugaaaagguuggaccaggagcaggggccagaagagucccagcccgaaaccgauacaucugacauggauccucucgucggauuuaccauugaggacgugaaaagcguucuggaucaagugacugacgauauccugauuggcauccagacagagaucaacgaaaaacuccagauucaggaggaagccuucaaugcacggauagagaaguuaaagaaggccuga

SEQ ID NO: 53523 - RNA, 639 nt, Artificial Sequence
  derived and/or modified sequence opt3 from C10orf10__Homo_sapiens__NP_008952
augagaagcaggcugcuccuuuccguggcccaucugcccaccauccgggagacaacugaagagauguuguuaggcgggccuggacaggaaccaccgcccucuccuucacuggacgauuacguccgcaguauuagccgacuagcucaaccaacguccguucucgacaaggcaaccgcccagggucagccccguccuccacacagacccgcgcaggcuugcaggaaaggccggccugccgugucucugcgcgauauaacagcaagauucucggggcaacagccaacucuuccgauggccgacaccguagauccccuggacugguuguuuggagagucacaggaaaagcagccuagccaaagggaucucccacggcgcacaggccccagugcuggucugugggggccucaccgacagauggacuccucuaaaccaaugggagcacccagaggcaggcugugugaggcccggaugccgggccauagccucgcucguccuccccaggaugggcagcaauccucagacuuacgcaguuggaccuucggacagagcgcccaggcgauggcaucuagacacaggccacggccuuccucagugcugcgaacucuuuauagccauuugcccgucauccacgagcuguga

SEQ ID NO: 53524 - RNA, 468 nt, Artificial Sequence
  derived and/or modified sequence opt3 from C10orf113__Homo_sapiens__NP_001010896
auggccaagagcgagagaaggaucuacuccauggaaucuauggcucccgagauuucagaagacauaggcugcccucuggcauauaugcgggagagugugugugcccuccuuaucaaccagagcuucuuuuccugcgucgcggaaauguacauuccagauaugaaucgcccggggaaagcugagcgacgugccgagaagggacugagacccccuaggaaauugguuggugaaacccggcgcuuacaaucuuggccaacacuggcaagauggcuaaggcgggugucguucucacucuauaagcccccuauccaggccgcuccagagcccgacccuggcaacugggcaaaaagcccacgccugagucuugggccggaaggaauuacuaagggcaagcacgguuuuaaauuccaggggaucaaggagaaauuuaauguauccaagaaagugcugaagaugacguucuuguga

SEQ ID NO: 53525 - RNA, 597 nt, Artificial Sequence
  derived and/or modified sequence opt3 from C10orf11__Homo_sapiens__NP_114413
auggagaaguaccugagccucuccggcaaccacucuucaaauaaaagaagucuugaagggcugagcgccuucagguccuuggaggaauuaauccuggacaacaaucagcuaggagaugaccucgugcugcccggucuuccucggcugcauaccuugacacucaacaagaaucgcauuacugaucuggagaaccugcucgaccacuuagcugaagucacgccagcacuggaguaucuuucuuugcugggcaauguugccugcccgaacgagcuagugucgcucgaaaaagaugaggaagacuacaagcgauaucguuguuuuguacuguacaaacuucccaaucugaaguucuuggaugcgcaaaaggugaccagacaggagagggaggaagcucucguccgcgggguguuuaugaaaguugugaagccuaaagccucaagcgaggacgucgcaaguuccccagaacggcauuauacaccccugccuucugccagcagagaguuaacuucccaccagggagugcugggcaagugcagguacguauauuacgguaaaaacucagaagggaaucgguucauacgcgaugaccagcucuga

SEQ ID NO: 53526 - RNA, 1749 nt, Artificial Sequence
  derived and/or modified sequence opt3 from C10orf2__Homo_sapiens__NP_001157284
augugggugcugcucagaagcggcuacccccuuaggauccuguugccuuuacggggcgaguggaugggacgccgaggucugccacguaaccuagccccggggcccccuagaaggcgguaucgcaaggaaacccuccaggcucuggacaugccaguccuucccguuacagcaacugagauuagacaauaccugagggggcacggaauaccuuuccaggauggccauuccugcuugcgggcccucucuccauuugcggaaucaagucagcugaaaggucagacgggggugaccacuagcuucucccuguuuaucgacaagacaaccggacacuuccucuguaugacaucuuuagcugagggcucgugggaagauuuucaagccucaguagagggccgcggggacggagcacgagaggguuuccugcuuagcaaagcccccgaauuugaggauagugaagaggugagaaggauuuggaaucgggcuaucccuuugugggagcugccagaccaggaagagguccagcuagcagauaccauguucggccucacuaaggugacagacgauacccugaaacguuuuuccguucgcuaucuuagaccggccaggucucugguguuccccugguuuagcccugggggauccggcuugcggggucucaagcuguuagaagcuaagugccagggggacggagucucauacgaggaaacgacuauuccacgacccagugccuaucauaaccuguucggccucccucuuaucagccgcagagaugcggaggugguacugaccucuagggaguuggacucccuagcacugaaucaaucaacaggccucccaacucugacccuuccccgggggacaaccugucugccgccugccuugcuccccuaccuggaacaguuucgcagaauaguuuucugguuaggagaugaccugaggagcugggaggcugccaaacuauucgcacguaagcucaacccaaaacggugcuuucuggugcgaccuggugaccagcagcccagaccacuugaggcuuugaauggcggguucaaccugaguaggauccuccgcacggcccugcccgcguggcacaagucuauugucuccuuucggcaacuuagagaagaagugcugggagaguugagcaauguggagcaggccgcaggccucagguggucgcgcuucccugaucugaaccgaaucuuaaaaggucaucggaagggggaacugacugucuuuacaggcccaaccggaucuggcaagacuacauucauuuccgaguaugcucuagaccucuguucacaggggguuaauacccuguggggaaguuuugaaaucagcaacgugcgucuugccagaguaauguugacgcaauucgcugaggguaggcuggaagaucagcucgacaaauacgaucacugggccgaccgcuuugaggaucugccguuauacuucaugaccuuucacggccagcaguccauacggacagugauugacacuaugcaacaugcagucuauguguacgauaucugccacguuauuaucgacaaucugcaguucaugauggggcaugagcagcuuucuaccgauagaaucgccgcucaggacuauauuauaggaguguuuaggaaguucgcgacagacaacaauugucacgucacuuuggugauccacccccgaaaagaagaugacgauaaggagcuccaaaccgcaagcauuuucggcucagccaaaguaaguggucuguga

SEQ ID NO: 53527 - RNA, 321 nt, Artificial Sequence
  derived and/or modified sequence opt3 from C10orf32__Homo_sapiens__NP_001129672
augauggccaccggcacacccgagagccaggcuagauucgggcaauccgugaagggacugcucacugaaaaagucacgaccugcgguacagacguuaucgcacuuacuaaacaggugcugaagggcucuaggucaagugaguuguuagggcaggccgcgcggaacaugguacugcaggaagaugcuauucuacacagcgaggacucccuccgcaagauggccauaaucaccacacaucugcaauaccagcaggaagcaauucagaaaaauguggagcaaucuucggaucuucaggaccagcugaaccacuugcucaaguga

SEQ ID NO: 53528 - RNA, 366 nt, Artificial Sequence
  derived and/or modified sequence opt3 from C10orf35__Homo_sapiens__NP_660349
auggugagaauccuggccaacggcgagauuguccaggacgaugaccccaggguucggaccacaacucaaccuccacgcgggagcauaccgcgacaguccuucuuuaaucguggacacggugcucccccuggcgggccaggacccagacagcagcaagcaggcgccaggcucggugcggcucagucuccuuucaacgaucuuaaucggcagcuggugaacaugggguuuccacaguggcauuugggaaaucacgccguagaacccgugacgucaaucuuacugcuauuccuccugaugaugcuuggcguccgcggccuguugcucguggggcugguuuaccuggugagucaucucagccaaagauga

SEQ ID NO: 53529 - RNA, 936 nt, Artificial Sequence
  derived and/or modified sequence opt3 from C10orf54__Homo_sapiens__NP_071436
augggcgugcccaccgcccuggaggcugggagcuggagauggggaucccuccuuuucgcacuguuuuuggccgcgucuuuagguccugucgcugccuucaagguugcaacaccauacucacuguaugugugcccggaaggccagaacguaacucuaacguguaggcuccuggggcccguggacaaaggacacgaugucaccuuuuacaagacaugguaucggaguagccgcggcgaggugcaaacuugcuccgaacgacguccuaucagaaaucuuaccuuccaggaccugcauuugcaccauggugggcaccaggccgcuaacacaucucaugaucucgcacagaggcacggacuggagucggccucagaccaccauggcaauuuuagcauuaccaugcggaaccugacucucuuagauaguggccuguacuguugccuuguuguggaaauacgccaccaucacuccgagcacagaguccauggggcuauggaguugcaagugcagacaggaaaagacgccccaucuaauuguguaguuuaucccagcuccucacaggauagugaaaacaucaccgcggcagcccuggcuacgggugccugcauugugggcauccuaugucucccucugauucuucuguuggucuacaagcagaggcaagcagcuagcaaucggcgcgcccaggagcucgugcgaauggacucuaacauccaggggauagaaaauccaggauucgaggcguccccucccgcccagggcaucccagaggcaaaagugagacacccgcugucauaugucgcucaaaggcagcccagcgaaaguggucggcauuuacugucugagccuuccacuccacucucgcccccugggccaggagauguguuuuuccccagccuugacccgguuccugauucucccaacuuugaaguaauuuga

SEQ ID NO: 53530 - RNA, 558 nt, Artificial Sequence
  derived and/or modified sequence opt3 from C10orf67__Homo_sapiens__NP_714925
augauggcccuggugagagacaggcgggcucacuacgucaugagcaucguuauucgcugggugcauugcuucuccucuucacuccgaggcaccuuugggacacguugggaggcaaugaaggccaaagcgacugaacuuagaguauguugcgcuaggcggaagcgcgaggccagagaauuuaaacccccucagaugaggggaaguacgcggcugaacauaagcgaugacuugaagaucgguuucuucuccaccgaucacgcaacacaaacugacucuucggagauuuuaucagugaaagaacugagcaguuccacccagaagcuagcccagaugaugaagucucuccaggucgauuuuggcuuccugaaacaacuucugcaguugaaguuugaggaccgccucaaagaggaaagccugucccuguucacaauccuccaugaucgaauuuuagagaucgaaaagcacuaucagcagaaugaggacaaaaugagaaagucauuuaaccaacagcuggcugaugcaauagccgugaucaaggggauguaccagccacuuuga

SEQ ID NO: 53531 - RNA, 465 nt, Artificial Sequence
  derived and/or modified sequence opt3 from C10orf82__Homo_sapiens__NP_653262
auggagcccagcaagaccuucaugagaaaccugccuaucacaccaggcuacuccggguuugugccguuccucucuugccagggaaugucaaaagaagacgauaugaaucacugugucaagacuuuucaagagaaaacgcagagguauaaggaacagcuucgggagcugugcugugccguugcuaccgcacccaaauugaagccugugaacagugaagagacaguauuacaggcccugcaucaauacaaucuacaguaucacccacucauucuggagugcaaguacgugaaaaagccccuucaggaaccuccaauacccgguugggcgggcuaucugccucgcgcuaaagucacugaguucggguguggaacccgauacacagugauggccaagaacugcuauaaagacuuuuuggaaaucaccgagcgugcaaagaaggcccaucucaaaccauacgaggaauga

SEQ ID NO: 53532 - RNA, 1338 nt, Artificial Sequence
  derived and/or modified sequence opt3 from C10orf88__Homo_sapiens__NP_079218
auggagaccagaacagaagacggcgggcugacuaggcggcccacgcucgccagcuccugggauguggcuggaggugcacuuacccacucucuguuguuaacacgcgccggccuggggccuggagacuucgauugggaggaacuacucgcgccaccggcucccggccaggaccuggucauccuuaagcgaaaccauaauaacaaagaugagaauccuugcuuucuguacuugcguugugguccagacgggggagaagagauugccucaauaggcauccucaguagcgcaagaaacauggagguuuaucugggcgaagaguacugcgggacuuccaggggaaagaauguguguaccguacuggaugacucugaacacgagaaaauuauccucuauaagaaaaacuuaaagcuggagucgucaacacaugccugcaagauuaaacuuuugagcuucggugaacggcaauguguguuuaucaguaaggucgugguucacaugcgcuccguguucgcuaauucuagcaccuccucacccgcacugggcaguagaauagaucuagacaaaguccagacuaucauggagagcauggggucuaagcucuccccuggagcccagcagcugauggauauggugaggugccaacagcggaacuguauuccaaucggcgaacagcuucagucaguacuggguaauagcggguacaaacauaugauuggauugcaaaguucuuccacacucggcacccugaacaagagcucgucuacgcccuuuccuuuccgcacuggcuuaaccuccgggaauguuacagagaaccugcagacuuauaucgacaagucaacccagcucccaggaggugaaaauaguacaaaacuugaugagugcaaggugaugccgcagaaccacagcuuucuggagaaugacuugaaaaacgcuauggccuccuuccuacccaagaaagucucugacaacagcaauauaccuaacucagaacugcucccauuucugcaaaaucuuuguagucaggugaaccaucugcacgugggcaauaagaccgagugccaggaaaacauuacgaaacacggggagcgaaucuugggagucggcauggaggaacaauccauuuguagcuaccucgagaagauccugucuaagaauauggaauuaauggagaaaaagcugauggauuauaucgaccagaggauucaugaacuacaggagcacauagaugacaaaaucgcgcuccugcuugauuugcugcagaaccccaauucaccuccaacugguauuccccucagacacuacgacaguggggaacggcugagcaacggcgagcguuga

SEQ ID NO: 53533 - RNA, 2100 nt, Artificial Sequence
  derived and/or modified sequence opt3 from C10orf90__Homo_sapiens__NP_001004298
augcugaagcucagcggcgaggggcuuagagacuccuaccacucuaggcgggaucagaucgcccugaaaaacuugcaaucagacgugaccgaagcuaagagugauuucacaaaagagacuuuagcaagccagaauacgaagaugauuuccucuauagucaucucgcagaugauugacgaaaacaaaucacgcgagaaucgagccagccugccccuaccuugcgcgaucgcucagagucgugcccaucacgcaaagcaaucccucgccaacagaucuggaguuaauauucauagggcuuuugcacugcuuccaggucggcugggcaucccggcccccagcgaugaacgcgggccugaggcugaguugccacccaaggaagagagaccuuguggaggcccaaggcgggguuucgccuccauaaccaucacagcgcgccgaguggggcccccugcaagagcccucguauggggaacugcuggcgacucacugugcccaaaauguagggccgaagauacccuguuucaggcaccgcccgcucucgccaacggcgcgcacccugggcggcaucagcguaguuucgccugcacagaguuuagccgcaauucuuccguggucagauuaaaggugccagaggcacacaccggacugugugaaaggcggaaauauuggguuacucacgcugacgauaaggagacaucauucagccccgacaccccucuuagugguaaaucuccauugguguuuuccagcugcguccaucugcgagugucgcagcaaugucccgauucuauuuacuauguagacaagucccuaucaguuccgaucgaaccuccccagauugccaguccaaagaugcaccgcagcgugcucucccugaaccuuaauugcucuagccauagacugacggcugauggcgucgacggguuggugaacagggagccuaucucagaagcccucaaacaggagcuguuagagggagaccaggaucuggugggccaacgguggaaucccggucuccaggaaagucaccuuaaggagacuccaucccugcgcagaguccacuuggggaccggagcaugucccuggagcggcucuuucccucuagaaaacacagagcuggccaauguuggcgcuaaccaggugacuguaaggaaaggggaaaaggaccauaccacacacugccaugcgucagaucacgcaaaucaacucaguauacauauuccaggauggagcuaccgugccgugcacaccaaagucuuuuccgguucuucgaagcggcagcagggcgagguguguaugacgguuagcgcuccgcccguggagcagaaaccuacucgacacuuccugccaaucggggacuccucacccagugaugacugccuuucuagagaucugagcgaaccuacagagaggcgccaucaauccuuuuugaagccacggauucucuuccccggauuucugugcccguuacaggacgucugugccucacugcaggaagauaacggcgugcagaucgagagcaaguucccuaaaggugacuauaccugcugugaucuaguaguuaagaucaaagaaugcaagaaaucugaggacccaacuacacccgagccuucccccgcagccccaaguccugcucccagagacggggccggcagcccaggacucucugaagauuguuccgagucacaacagaccccggcaaggagucugacgcuucaggaagcguuggaggugcgcaagccucaguucauuagccgaucgcaagagcggcugaagaaacucgaacacaugguccagcagcguaaggcucagagaaaagaggaccugaggcaaaagcagucccuucugcccauacgcaccucuaaaaagcaguuuacaaucccacaucccuugagcgauaaccucuucaagccuaaagaacggugcauuucagagaaggaaaugcacaugagaaguaaaaggaucuacgacaaucugccagaggugaagaaaaagaaggaggaacaacgaaaacgcgucauauuacaguccaaccggcugagagccgagguguuuaagaaacagcuacucgaucagcugcuucaaaggaaugcaguuuga

SEQ ID NO: 53534 - RNA, 537 nt, Artificial Sequence
  derived and/or modified sequence opt3 from C11orf21__Homo_sapiens__NP_001136418
auggccagcuuccugguguggccccucagaaccgcucuuaggggcgggaaguccugggcaggaccuggugucggcugcgggggagacggcgcccggggugggggagagcugucuuugucaaacuuagaucugccaggcgcgggcgaagcugggcuagagcaccauccgcuccugggacaccuuuuuaucagugccguuccccgcuggccucaucugagcucccagucugguguggaaccacccgaccgauggacaggcacuccuggguggccaucgcgugaucaagaggcacccggaucaaugaugccuccagccgcugcacagccgagcgcccacggcgcuuugguacccccugccacggcgcaugaaccaguggaccaccccgcacuccacuggcuggccuguugcuguugccugagucucccuggucaguuaccacuggcuauuagacuugggugggauuuggaccuggaggccggacccuccucuggcaaacuauguccgagggcacggcgcuggcagccucuccccagcuga

SEQ ID NO: 53535 - RNA, 3969 nt, Artificial Sequence
  derived and/or modified sequence opt3 from C11orf30__Homo_sapiens__NP_064578
augcccguggucuggccuacccugcucgaccuuagcagagaugagugcaagaggauccugcggaaauuggaauuagaggccuacgcuggcguuauuuccgcacugcgcgcccagggggaccuaacaaaggaaaagaaggaucuccugggagagcuuucuaaagugcugucaauaaguacugaacgacaccgugcggagguaagaagggcugugaacgacgagcgguugacgaccaucgcccauaauaugagcgguccaaacuccucuucggaauggucaauugagggccgcagacucgucccgcugaugcccaggcuggugccucaaacagcauucacuguuaccgccaaugcuguggcaaacgccgcuauccagcacaaugccagccucccaguccccgcggaaacagggaguaaggaggugguauguuauuccuacaccucuacuacaagcaccccuacguccacuccaguucccucaggaaguauugcaaccgucaagagcccucggccagccucuccggcuuccaacguggugguguuacccucaggcagcacagucuauguuaaaagugugucuugcuccgaugaggacgaaaagccucgcaaacgaagaaggacuaauagcucgucuuccucaccaguagugcugaaggagguccccaaagccgugguuccugugaguaagaccaucacagucccagugagcgguucccccaagaugucuaacauaaugcagagcaucgcaaauucacuuccgccucauaugagucccguaaaaauuaccuuuacgaagccauccacucagacaaccaacacuacaacccaaaaaguuaucauugugacgaccagcccuucuucaacauucguccccaauaucuugaguaagagccacaacuacgcugccgugacuaaacuggucccaaccuccgugauagcgucuacaacucagaagcccccuguugugauuaccgccucgcagagcucccuaguaucaaauaguucuagcggguccucaagcucuacaccauccccgauccccaacaccgucgcagugacugcuguugugaguagcacgccuucugucgugauguccacaguagcccagggagugucaaccagugcuauuaaaauggccagcacucggcucccaucgcccaagucccugguuucugcaccuacccaaauccuugcccaguuuccaaagcagcaucagcaaagccccaaacagcagcuguaucaaguccagcagcagacacaacaacagguggcucagccgucaccugugagucaccaacagcagccacagcaaucccccuugccucccggcaucaagccaaccauucagauaaaacaggaaucuggcgucaagaucauuacucagcaaguucagccuagcaaaauccuccccaagccagugacagcgacgcugccgaccuccucaaauagcccuauaauggugguaaguucuaacggggcaauuaugacuacaaaguuagucaccacacccacuggaacccaggccacguacacccguccaacagugucccccagcaucggucgcauggcugccacuccuggcgcagccaccuauguuaaaacaacuucggggucaaucauuaccguggucccaaagucucuggcuacgcucggaggcaaaaucauuaguuccaacauagugagcgguacaaccacuaagaucacaaccauucccaugacuucuaaaccuaauguuaucgugguacaaaagaccacagggaagggaacgaccauccagggccuuccgggcaaaaacgucgugacuacacuguugaaugccgggggagagaagaccauucagacagugccaacuggugcaaaacccgcgauacuaaccgcuacgagaccuaucacaaagaugauugucacccagccaaaaggcaucgggagcacuguucaacccgccgcaaagauuaucccuaccaagauaguguacggacagcagggcaaaacacagguacugaucaagccgaaacccgugacuuuccaagccaccgucguguccgaacagacaaggcagcucguuacggagacccugcagcaggcuucacggguggccgaggcagguaacaguagcauucaggaagggaaggaggaaccacagaauuacacugauucuuccucaaguagcacagaguccucucaaucgagccaggacucacagccugucgugcacguuaucgcuucccgacgccaggauuggagugaacaugagauugccauggagaccucucccacuaucauauaucaagacgugagcuccgaaucacagucugcgacaagcaccauuaaagcccuucuggaguugcagcagacgacugucaaggaaaaacucgagaguaagccaagacaaccuaccaucgaucugucccagauggcuguacccauucagaugacacaggaaaagaggcacagcccagagucuccgucaaucgcagugguugaguccgaauuaguggccgaguacauaaccacugaacggacagacgagggcaccgaggucgcuuuuccucugcuagugagucaucgcagccaaccccagcagccaucgcagccccaaagaacacuccugcagcacguagcccagucucaaacugcaacccagacguccguggucguuaaaagcaucccugcgucaaguccaggagccauuacacacaucaugcagcaggcucuuucuucccauaccgccuucacuaagcacagcgaagaguugggcaccgaagagggggaaguggaggagauggauacacuggacccccaaacuggacucuuuuauaggucagcacugacccagagucagagcgcuaaacagcaaaaacuuucccagccuccgcuggaacagacgcaguugcaagugaaaacacuccaguguuuccagaccaagcaaaagcagacuauucaucugcaggccgaccaguuacaacacaaacugccacagaugccccagcuaucuauccgucaucagaagcucacaccucugcaacaggagcaggcacagcccaaaccagauguccaacacacccagcacccuaugguggccaaggaccggcagcuucccacuuugauggcucagccaccucaaacaguuguacaggugcuggcggucaaaaccacgcagcaacucccgaagcugcagcaggcccccaaccagccaaagauauacgugcaaccucagacuccccagagccagauguccuuaccagcaucaucugaaaaacaaaccgcuagucagguugagcagccuauuaucacacaggguucgagcgugaccaagaucacauuugaaggccgacaacccccgacugucaccaaaauuacagggggauccucugugccaaagcugacgucaccuguaacuagcaucucccccauucaggccagugagaaaaccgccgucucugauauacuuaagaugagcuugauggaggcucagaucgacacaaauguggaacauaugauuguugauccacccaagaaagcacucgccaccucaaugcugacuggcgaggcggguucccuaccuaguacccacaugguggucgcugggauggccaacagcacaccgcaacagcagaagugcagagaaucuuguuccucacccagcacggugggcucgucucugacuaccaggaaaaucgacccuccagcaguucccgccacaggacaguucaugcgcauucaaaaugugggccagaagaaagcugaggaaaguccugcagagaucauaauccaggccauuccacaguaugcgauccccugccauuccagcucaaacgucgugguagagccuuccgggcuccuggaacuuaauaacuuuaccucucaacaguuggaugacgaggaaacugcuauggagcaggauauugacagcaguacagaggauggaaccgaaccaucccccagccagucuucagccgagcggaguuga

SEQ ID NO: 53536 - RNA, 711 nt, Artificial Sequence
  derived and/or modified sequence opt3 from C11orf53__Homo_sapiens__NP_940900
augcccggcagcccugugaccuccggguacuauggagucagaaggucuuuccugucagacagugauuuucacaacagcaagcaguucuccaaugacguuuacacaucuucgguggguaaaccauuuccgugcgagucaagcgccggccaaagucaugcugcacuccuugaacccuauuucccucaggagccauacggggauuaucggcccccugcccugacuccaaacgcgggauccuuguuuucugcuagccccuuaccuccacugcuaccgcccccuuucccaggcgaccccgcccacuuucucuuccgcgauuccugggaacagacgcugccugacggucuuucacagccagaucccguaagugcagacgcccuguugacccucccgccuagcacaucuugucugucccaacuggagucagggagcaucgcucagcaucgaggaaguucuuggggcuccagccucgcaggcgcccagucguacucuuuacacgcucuggaagaucuucaucacacucccggguauccaaccccucccccauaccccuuuacaccuuucaugaccguguccaaugacuugccaccgaaggucggaccccugucaccugaugaggaggccgacacugguagucuacacgauccaagccccugggugaaagaagacggcuccauugcgugggggucuuacgagugccguagagcauauuga

SEQ ID NO: 53537 - RNA, 942 nt, Artificial Sequence
  derived and/or modified sequence opt3 from C11orf65__Homo_sapiens__NP_689800
augcccuggaaggaggaaagcgaguucaccaaacaggacaaggccgcuagagugauccaacaggcauggaaauccuuucugaacgucgccauuuuccagcacuuuaagucucucauagaucuuaggcggcagggcgaaccucgccaaaucguuaaauacauuaauccaaaggaggcggaacuguuggacgcugccgcagggauccaugugcgauuccguuuaggagguguaaaguuuccgcccgauauuuauuacaaaaucuucacacacagaccuauagaggaccugugcgccaacucaccaaggaauuaugcuaagcuacccgcaaaacauacgagucacaacaagaaugaucaucuccaggaggaagaccacagcggcugguaccaccggaucgagaacaauggguggcgcccuguguccgauacuuuuuggcugucuaccgacggaauggucguggaagauaaaaaggagucggaguuccauuuuucaaaacuuaagagaaggcaggaccuggaaaagaaacggaaguugcgcaaaauugaguggaugcgacagauguauuacagcggcagucucgaagccaaguccacacaccaugagacucugggucugauccacaccgcuacaaaagggcucauuagagccuucgaagauggaggcaucgacucuguuauggagugggagguggaugaagucuuaaacuggaccaauacucugaacuuugacgaguauauagcgagcuggaaggaaauugcaacauccaauucaagugccaacuucaagggcuuuagguucaaucaagcucagaaaaacaucuacaauuacgggggagacauuagcaagaugcagauggguaucccagaugacaccuauuacgagaacguguaucaggaacccaacguaacgcggcuuacuccugauucuaccuacggcuuguga

SEQ ID NO: 53538 - RNA, 882 nt, Artificial Sequence
  derived and/or modified sequence opt3 from C11orf68__Homo_sapiens__NP_001129107
auggccgcugcagccgcggcugccguggcaggcgucgggagaggagguggcggggccgagcccaggcaggaacggagccgcgcucgaggaugggcaggcguugagcguuccgaagguagaucuaggauggagccuggggaggaacuggaggaagagggaucaccaggcggccgggaagacggguucaccgccgagcaccucgcugccgaggcgauggcagccgauauggacccguggcuuguguuugaugcucgcacaacucccgccacggaacuggacgcaugguuggcuaaguacccuccaagucaaguaaccagauauggagaucccgguagcccuaacuccgagccagugggcuggaucgccgucuacgggcagggauauucucccaauucgggcgacgugcaggguuuacaggcggccugggaagcacugcaaacaucagggaggccuauuacuccaggaacccuacggcagcucgcuauaacacaucacguucugagcggcaaauggcuuaugcaucuggccccgggcuucaaguuggaucacgcuugggccgggaucgcacgcgccguggucgagggacagcuccagguggcuaaaguaaguccccgagcgaaggaagguggcagacaaguuauuugcguguacaccgacgauuuuacugacaggcuggggguccuggaggcagauuccgccauccgggcugccggaauuaaaugucucuuaacauauaagccugacguguacaccuaucugggcaucuaccgugcaaaccgcuggcaucuuugcccaacguuguacgagucuagauuccagcugggugggagcgccaggggcucccgggugcuagaucgagcuaauaacgucgaacucacuuga

SEQ ID NO: 53539 - RNA, 594 nt, Artificial Sequence
  derived and/or modified sequence opt3 from C11orf73__Homo_sapiens__NP_057485
auguucggcugccugguggccgggagacucguccagaccgcugcacaacagguugccgaggacaaguuuguguucgaucuucccgacuacgaaagcaucaaccacguaguggucuuuaugcugggaacaauuccuuucccagaggguaugggcggguccguguauuuuucuuacccggauucaaauggaaugcccguuuggcaguuguuaggcuucgugacuaacgguaaaccuagugcgauauuuaagaucagcgggcugaaauccggagaaggcucucagcauccauucggcgcuaugaauauugucaggacgcccucgguggcccaaaucgggauuucaguagagcuacucgacagcauggcacagcagaccccuguuggaaacgccgcugugaguuccgucgauucuuuuacacaguucacucaaaagaugcuggacaauuuuuauaacuucgcaagcuccuuugccgugucacaggcucagaugaccccaagucccagcgaaauguucaucccugccaaugugguccuuaaaugguacgagaacuuccagcggcgccuggcgcaaaauccauuguuuuggaagacauga

SEQ ID NO: 53540 - RNA, 444 nt, Artificial Sequence
  derived and/or modified sequence opt3 from C11orf74__Homo_sapiens__NP_001263656
augagcgcccacauguccggccuggagaucauggacgaagaucagcucauuaaggacgugcuugauaaauuccugaacugccaugagcaaaccuacgacgaagaguuuuugaauacauucacucacuuaucucaggaucugcuacuccugcccggggaagucgagcaggacguuucaacgaguauaccuagcuguaucccauuuguggcucagccgccuaccugcgagguaaagcccaaaccauccgugaagagaauggauaaacaaacagaagagauucuuggagacgaaguccagcuguucucuuuggaugaggaguuugacuaugauaacgugaugcucacuucgaaguucucacccgcagaaaucgagaauauuaaggaacuguguaaacagcagaagaggaaagacaccagcccugaucuggagaagaguugcgacuga

SEQ ID NO: 53541 - RNA, 1536 nt, Artificial Sequence
  derived and/or modified sequence opt3 from C11orf80__Homo_sapiens__NP_001289013
auggugcugaagaaauuccucaaggagauccagagcauucuucccggcauauccgccaaacugaccuggacaucugaagaggggucauacagucaagacaugacuggagucacgccuuuucagaugaucuucgaaguugaugagaagccaagaaccuugaugacagacugcuuagugauuaaacacuuucugaggaagaucauuaugguacauccgaaggugcgguuccacuuuagcgucaaagugaacgguauccuauccacugaaauauucggcguugagaaugagcccacccucaaccuggggaauggaaucgcccuucugguggauucucagcauuaugucucgcgcccuaacuuuggcacaauugaaucacacuguagccgaauccauccaguguugggucaccccguaauguuguucauuccugaggacguugcagggauggaucugcugggagaacucaucuuaaccccagccgcggcucugugccccaguccuaagguguccucuaaucagcuuaaccguauaagcuccgucucaauuuuucucuacggcccacugggccuaccgcucauccugaguacuugggagcaacccaugacaaccuucuuuaaagacacgagcucucuuguggauuggaagaaauaucaccuguguaugauuccuaauuuggaccucaaccuggauagagacuuagugcugccagaugucuccuaccagguugagucaagcgaagaggaccagagucagacuauggauccccaagggcagacccuccuucuguucuuguuuguggacuuccauucugccuucccuguacagcagauggaaaucuggggaguguauacacuacugacuacccaccucaaugcaauccuggucgagucccauagcgugguucaagguucgauucaguuuacaguggacaagguccuugaacagcaccaccaagccgcuaaggcacagcagaaacugcaggccucuuuguccguggcuguaaacucaauaaugaguauccucaccggcagcacgagguccucuuuccggaagaugugccugcaaacuuuacaggccgcggauacacaggaguuucgcaccaaacugcauaagguuuucagagagauuacucagcaccaauuucuacaucacuguagcugcgaagugaaacagcucacacuggagaagaaagacucagcacaggggaccgaagaugccccagacaauaguucccuugaguugcuggcugauacgagcggacaggccgaaaacaagaggcucaagcggggcucuccccgcaucgaggagaugcgagcacugagaucagcuagggccccgaguccuagcgaagcggcuccccggcguccagaggcaaccgcugccccucuuacaccccgcgguagagaacauagggaggcucacgggcgggcccuggcaccaggacgagccuccuugggcucucgccucgaagacguccugugguuacaagaggugucgaaucugagcgaguggcuaucccccucaccuggcccauga

SEQ ID NO: 53542 - RNA, 1035 nt, Artificial Sequence
  derived and/or modified sequence opt3 from C11orf87__Homo_sapiens__XP_011541119
augggccccaaggggagcgacgccgugcagggagguagagucuggaccggcagggagcggaaagggggacugcgcacacgauccccucguggcgguccagaauggguucucgggagagugggaucuaggcggcgccaccaaccgagaggcaggcggaaggaggaaucacgccgaaguggcaaccuuguaccccugcagagaaaaggggagaggggagauguguucgaagucgugagcgcucggaucucccgugcaccuuugacuccauggucucccugcuuaccugccguugcgccacuggugcuagguucgcucgcucauccccugccucuucagggcgccguccugggaggggugggcucaguauuguuucucgcaggucgcaaugggguuccaaagagaggaagccuggugggccuggccccgcccaguccugcuccaauguccgcaagggcccccaaagagcuccgguuagcucugccuccaugucuuuugaaccgaacguucgccucucccaaugcgagcggcuccgggaacaccggagcacgcgguccgggcgccgucgggucaggaacaugcauuacucaggugggccaacagcuguuucagaguuucagcucuacccuagugcucauaguccugguuacacuuaucuuuugucugauuguguugucccucucaaccuuccacauccauaagagaaggaugaagaaacggaagaugcagcgcgcucaagaggaauacgagagagaccacugcagcgguagucgugggggcggaggccugccuaggcccgggcggcaggccccaacucaugcaaaagaaacacgauuagagagacagccuagggauucucccuuuugugcuccauccaaugccagcucgcugucuuccucaagucccggacucccuugccaggguccaugugcgccgcccccuccacccccugccagcuccccacaaggcgcacacgcugccucuagcugccuugacaccgcuggggagggacuguugcagacgguagugcuaucauga

SEQ ID NO: 53543 - RNA, 2037 nt, Artificial Sequence
  derived and/or modified sequence opt3 from C11orf95__Homo_sapiens__NP_001138408
auggagcccggcggggaccacagaagcagguccucuggaggucggggcgggccuggaccagccguggcuucagcacgcggccgacgucugccgcccgccgguaguagcggguccgcggaaccugaggaagaugagggaggccaggaccuccaacuugaaggcggggcucugggaucuugggguucggccccauugcccucaagcagagcaaggggcccugccaguuccgggcggaaguacucugaucauugcgaggcucgcgcaagcagaccaggaaaauccaggauccccggccgggaccaccgccgauauuaccaugaucacuggagauuagaguaucugauggacuucaacccugccaggcaugguauggucuguaugguuugcgggucaagucuagcuacccucaagcugagcacaauuaaacggcacauacgucagaagcacccauacucucuucauugguccccgcgcgaaaaagaggugaucucaaauagcugggaugcccaccugggauugggcgcguguggcgaagcagaggggcucggaguacagggugccgaggaagaggaagaggaagaggaggaagaggaagaggaaggcgcuggggugcccgccugcccuccaaagggacccggcaaggccccugcuggugggggcuguagaaggcagcggcgaggaggcccagucgcaccccgcgcgagaaggcugcggcugagugccucucgcagagcagggggauccaggggucucggcgcucgucgguuagagcgaagacugaaagagagccuucaaaacugguuuagggccgaaugcuugauggacuaugauccgcgcgggaaucggcugguguguauggcuugcgggagagcccuaccuucgcuccaucuggacgauauuagggcacacguucuugaggugcaccccggcucucuggguuuguccgggccacagcgcucagcccuccugcaggcuuggggcggacagccugaagcguuaagugagcugacucaaagcccacccggcgacgaucucgcaccccaggaccuuacggggaagucccgagacucugccagcgcugccggagcaccuucaagucaggaucuguccccaccggacgucaaagaagaggccgguugggugcccgagcggccuggcccagcugaagaggaagaggaguuggaagagggggaaggagagcgugccggcguacccgguagaagcccuagggggcgcgcacaucggagacacccacaggaaagguggcgacuagaguaccugauggagcucgauggcggacgccggggccugguuuguggggugugcggaggcgcgcuugcuucucugaagaugucaaccaucgaaagacauauuaggcgucgccaccccgguaguacacggcuugggggaccgguccaagcccucaucgcaagagaguggagcgaaaaagccgcucaucuguuagcccugggcccuccaaggcccgaguccccucagggucccauaccaccuggcacugcagcugccucugacgaagggggaggcgaugaggaggaggaacccgaagaggaagaggaggaauggggagacgugccacuaucgccgggagcgccucucgagcgacccgccgaagaggaggaagaugaggaagacggccaggagccaggugggcuggcuuugcccccuccacccccuccgccacccccuccacccccucggagccgcgaacaaagaaggaacuaucagccgcgguggcgaggagaguacuugauggauuacgacggcuccagacgcggucugguguguauggucugcggcggggcacucgccacccugaagguuucaacaaucaagaggcacauucuucaggugcaccccuucaguauggauuuuaccccagaggaacgucagacuauccuggaggcuuaugaagaggccgcauugcggugcuacggacaugaaggcuucgggccucccgcgccagccccuagagacggaggcgcugaccucaaaucuggugccguauguagggcauga

SEQ ID NO: 53544 - RNA, 1131 nt, Artificial Sequence
  derived and/or modified sequence opt3 from C12orf10__Homo_sapiens__NP_067653
augggccaccaguuccugagagggcuccuuacccuguuguuacccccuccaccgcuguacacaaggcaucggaugcuaggacccgagagcgugccuccacccaagcgcucccgaucuaaacucauggccccuccacguaucgguacucacaacggcacguuucauugcgacgaagcucuggcaugugcccuucugagauugcuccccgaguauagggaugcggaaauuguccggacccgcgacccugagaagcuggcuucaugcgauauaguuguggacguagggggagaauacgauccaagaaggcaccgguaugaccaucaccaacgcaguuucacagagacuaugagcucccugucuccgggcaaacccuggcagaccaagcucucgucagccgguuuaaucuaccugcacuuugggcauaaacuuuuggcacagcugcuaggaacaagcgaggaagauaguauggugggcacccucuaugacaagauguacgagaauuucgucgaagagguggaugccguugacaacggcauuucccagugggcugagggggaaccucgauaugcacugacuacaacccuuucugccagaguggcuaggcugaauccaacguggaaccaccccgaucaagacacugaggccggauuuaagcgggcgauggauuugguccaggaagaguuccuccagcgucuggacuuuuaccagcauagcugguuaccugcacgcgcccugguggaagaggcucucgcccaaagauuccagguagacccauccggugagaucguugaacuugcaaaaggcgcuugucccuggaaggagcaccuguaccacuuggaaucagggcuaaguccgccuguggccaucuuuuucgucauuuauaccgaucaggcgggacaguggaggauacaaugcgugcccaaagagccacauagcuuucagucucggcugccucuccccgaaccauggcgaggccugcgcgacgaggcccuugaucagguguccgguauccccggguguauuuucguccacgcaucaggauuuaucggcggccaucacacaagagagggggcucugagcauggccagggcuacuuuggcccaacggaguuaccucccucagauuucuuga

SEQ ID NO: 53545 - RNA, 1083 nt, Artificial Sequence
  derived and/or modified sequence opt3 from C12orf42__Homo_sapiens__NP_940923
augagcaccgugaucugcaugaagcagagagaggaagaguuccugcucacaauuaggcccuuugccaaccggaugcaaaaauccccuuguuacauaccaaucgucucuucagcuacucuuugggaccgcaguacgccgagcgcaaagcacauucccugcuaugaacgaaccuccguuccuuguucucguuucaucaaucauaugaaaaacuuuucggagucaccaaaguucagaagccugcacuuuuugaauuuccccguguuuccugaaaggacacagaacaguauggccugcaaacgguuacugcauacuugucaguacauuguaccacgcugcuccgugucuaccgucagcuucgaugaggaguccuaugaagaguuuagaucaagucccgcgccuagcucugaaacagacgaggcuccacuaaucuucaccgccaggggcgagacugaggaacgggcacgcggggccccgaagcaggcuuggaacuccucauuucucgaacaacuggugaagaaacccaauugggcacacagcguuaauccugugcaucuugaggcccagggaauacacaucagucgacacacaagaccaaagggucagccccugucuuccccuaaaaagaacagcggcucggcugccaggccaucuaccgcgauuggguugugucggcguucccagacgcccggagcacuccaaucaacuggcccgaguaauaccgaacuggagccugaggaacgcauggccguccccgcuggugcccaggcacauccagaugacauccagagcagacugcucggggcuuccggaaacccugugggcaaaggcgccguagcgauggcccccgagauguuaccaaagcacccccauacaccuagggaucggcgaccacaggcagacacuucucugcacgggaaucuugcuggagccccguugccccugcuagcuggugccagcacccacuucccuucaaagcgccucauuaaaguuugcaguuccgcaccacccagaccuacaaggcgguuucauaccguguguagccaagcccugucucgcccagucgugaacgcucaccuucauuga

SEQ ID NO: 53546 - RNA, 666 nt, Artificial Sequence
  derived and/or modified sequence opt3 from C12orf43__Homo_sapiens__NP_001273127
auguucugccagaaccccggcgccgcuaauagccaacuguccaccucucagccuucacucagacacaaggugaacgagcaugaacaggacgggaaugagcuucagacaacuccagaauuuagggcacacgucgccaaaaagcugggagcguuguuagauaguuucaucacgauuagcgaggcugccaaagaaccggcaaaggccaaaguucaaaagguggcucuggaggacgaugguuuucggcuauucuuuaccuccguacccggcgggcgcgagaaggaagagucuccucagccacgacguaaaagacagcccucgucaagcaguuccgaagacucugaugaggaguggaggcggugucgcgaagcagccgugagcgcuuccgacauacuccaggagucagccauccauaguccuggaacagucgaaaaggaggcgaaaaagaaaagaaagcugaagaaaaaggccaaaaagguggcaagcguugauucugcuguggccgcaacuaccccaacauccauggcuaccguccaaaaacagaagucaggcgaacuuaacggugaccaggugagccuggggacuaaaaagaagaaaaaggccaaaaaggcgagugagacaucucccuucccuccagccaaauccgcaaccgcuauuccggccaauuga

SEQ ID NO: 53547 - RNA, 1245 nt, Artificial Sequence
  derived and/or modified sequence opt3 from C12orf50__Homo_sapiens__NP_689802
auggagaugcagcaaaacugcagcaucuccuguuucugggaaacccagccccugggcugcgugaagauuucuuguauauuuuaccacucaaaaccuagaaauaucaacggacucuuccuuccaccgaguagcaauauuacacugcagaaggagauccaggaagggauucccuugcaaucccagucucaggagccuuuaaaaccacaggaaaacaucucgaggcccauacaucacccucugguccuaaagacuaauuuugaggaggaagaggaaguugacgagcaaaacgaugccucaagccucuggacgaaaaccccagaggaaaucgaggaaaagcgggcuauuaaggagaugugcuauaaaaguggugaauacuaucgcuuccauacacccccugacauccuguccucuaagagcaugacuccaaccgcagagaaacagcuugagaagccgcuggaaaauggcuccgaguugcaggaaggggauucacucacagugcccaccaaacugagucaguacgagcgacaaggagaaauuaagacuagccugcacggcaagccuaaaacagacaucgccgcguuugagaacggugggggagauuguuauguaccacagcgugugauauuccucggcgucgacgagucugaggcuuuaaccgaagaaaaggagauuacgaucuccaaaugcucaaauacuaaggauaacaaagacagcccccauccuaagcacagucugaccacaagacuugugccaacuacccacguuuugaaugccacagaaaacauuucuaugaaauguagggaggaucccuccagcaugaaugacgugcagccggucaagaagccucauuuuaaaggcgugaagaaacggaaguggaucuacgaugagccccaaaacuucccaaauucggggaugcagcgcgcaguacaggccccuagaccccagaacaaaaugucuuaucacaggaacaauaagaaccggaaugcugaaaacgcauccuacauccauguucaacgcgacgccgugcgaaccgucgcucugaaugccccaucaagaaguaggcccacgcacggaagcuacaacaaggugcacgcgaaucgggagccuaaaccaaaccuauccccggauaaguauacuucuacaagcuacaaugacucagcauggcguaaacgcauucccuuuaguaagaccuauuccaaaagcgaaaagauauacccugagccaagaaggaacgguucuaaguga

SEQ ID NO: 53548 - RNA, 381 nt, Artificial Sequence
  derived and/or modified sequence opt3 from C12orf57__Homo_sapiens__NP_001288763
auggccagcgcuuccacccagcccgcagcccugucugcggagcaagcuaaggugguccucgccgaaguuauccaggcauucucagccccugagaacgcugugagaauggacgaagcaagggauaaugccugcaacgacaugggcaaaaugcuucaguuuguacugccaguggcuacacagauucaacaggaggucauaaaggccuacggguucaguugugauggagaagguguguugaaauuugcgcgguuaguuaagagcuaugaggcacaggacccggagaucgccucccugucuggcaaacuaaaggcucucuuccugcccccuaugacucuuccaccccacgggccugccgcaggaggcucgguggcugccucauga

SEQ ID NO: 53549 - RNA, 813 nt, Artificial Sequence
  derived and/or modified sequence opt3 from C12orf5__Homo_sapiens__NP_065108
auggccagauucgcucugaccguggucaggcacggcgagacacgguuuaacaaggagaaaaucauucaggggcaaggaguugacgaaccccucagcgaaacugguuucaagcaggcagccgcggcuggcauauuucuuaauaacgugaaauucacgcaugccuuuuccucugaucugaugcgcaccaagcagacaaugcacgggaucuuggagcgaucaaaauucugcaaggacaugacuguaaaguacgauagucguuuaagagaaaggaaauauggaguggucgagggcaaggcacugagcgagcuacgggccauggcuaaagcagcccgcgaagaguguccuguguuuaccccaccggguggggaaacacucgaccagguuaagaugagaggaauugauuucuuugaguuccugugccaacuuauccugaaagaggcugaccagaaggaacaguuuucccagggcucucccucgaauuguuuggagaccucacucgccgaaauuuucccucugggcaagaaccauagcaguaaagucaauuccgauucugggaucccaggacuggcggcaagcgugcucgugguaucccacggugccuacaugaggucauuauuugacuauuuccugacugaucuuaagugcaguuugcccgcuacacugagccggucugagcuaauguccguuaccccuaacacgggcaugucacucuucauaaucaauuuugaagaggggcgcgaggugaaaccaacuguccaauguauuugcaugaaccugcaggaccaucuuaauggacugaccgaaacacgauga

SEQ ID NO: 53550 - RNA, 501 nt, Artificial Sequence
  derived and/or modified sequence opt3 from C12orf65__Homo_sapiens__NP_001181924
augagcaccgugggccuguuccacuuucccacaccucucacuagaaucugcccagccccgugggggcuuaggcugugggagaaguugacguuacugucccccggaauugcugucaccccuguucagauggcagguaaaaaggacuacccagcccuacucucucuggaugaaaacgagcuugaggagcaauucgugaaaggccaugggcccggaggccaggcgacaaauaagacuucaaacuguguagugcugaaacacauaccuagugguaucgucgugaagugccaucagacccggagcguugaccagaaucgcaaguuggcucgaaaaauucuccaagaaaagguggaugucuuuuauaacggggaaaauuccccagugcacaaagagaagcgugaagccgccaaaaagaagcaggagaggaaaaagagagcaaaagaaacacuggagaagaaaaagcugcucaaagaguuaugggaaucuucgaagaagguacauuga

SEQ ID NO: 53551 - RNA, 1407 nt, Artificial Sequence
  derived and/or modified sequence opt3 from C12orf66__Homo_sapiens__NP_001287869
augggcgagagcaucccccuggccgcuccugugccagucgaacaggcaguucucgagaccuucuuuucccaccuugggauuuucucuuacgacaaggccaaagauaacguggaaaaggagagagaagcgaauaaaucagcuggagguaguuggcugagcuuguuagccgcacuggcccaucuagcugcagccgagaagguauaucacucccucacauaccugggccaaaaacuugggggacagucguuuuucucuaggaaggacucaauacggacuaucuauacgagccugcauaacgaguugaagaaaguggucaccggccgcggugcucucgggggaacagccccgcacguggaagaacugcugagucaucucuccgaacaguuaugcuuuuucguucaggcgcgaauggagauugcagauuuuuacgagaagauguauacucugucuacccaaaaauucaucaaugccgaggagcuugugggcuugcuggacgcuauuaugaagaaauacagcucccguuuucaccaccccauccuaucaccucucgaaaguagcuuccagcuggaggucgaugugcuuugucaucuguugaaggcccaggcacagguaucugaauggaaguuucucccaucccugguuaacuuacacucagcucauacaaaacugcaaaccuggggccagauauucgagaagcagagagagacuaaaaagcaccucuuugggggacagagccaaaaagccgugcagcccccucaccuuuuccugugguugaugaagcugaaaaauaugcuacucgcgaaguucaguuuuuauuuccaugaagcccugucuaggcagacaaccgcauccgagaugaagacgcuuacugcuaaagccaacccagacuuuuucgguaagaucagcucguuuauucggaaauacgaugcugccaaugucucucugaucuucgacaaccgcggcuccgaaucauuucaagggcacggauaccaucacccccauaguuauagagaggcaccuaagggcguggaucaguacccagccguggucagcuugccguccgacaggcccguuaugcacuggccuaaugugauuaugaucaugaccgaucggacaucugaccucaacagccuggaaaaaguagugcacuucuaugaugacaagguccagucaacuuacuuuuuaacccgcccagagccccauuucacaauagugauuaucuuugagaguaagaaauccgaacgagacagccacuucauuucuuuucugaaugagguuucacuagcucucaagaacccuaaaguguucgcgagucugaagccagguagcaaaggguccugcuaucaguguaauuacuucgucgcauuuugccuuaacuauucuaaguugcugcuccaaagaaaguga

SEQ ID NO: 53552 - RNA, 192 nt, Artificial Sequence
  derived and/or modified sequence opt3 from C12orf75__Homo_sapiens__NP_001138671
augggcugcgggaacagcaccgccacauccgcuggagcaggucagggccccgccggggcggcuaaggacgugacugaggaaucugucacggaggaugacaaaagaaggaauuacggaggcguuuaugugggucugccuucagaagccguaaacauggugaguagccaaaccaagacaguccggaaaaauuga

SEQ ID NO: 53553 - RNA, 438 nt, Artificial Sequence
  derived and/or modified sequence opt3 from C12orf77__Homo_sapiens__NP_001094809
augauccccaagcuggccaccccuagagacauuagccuccuugugauaaaagaggcuuccucuagggcacggaacaauauccagauucuggauccauuggaccacaucgcccgcuuaacaaacuacacucugacgucaugcuucaguagcaauaaggucccgaccaugcccggcucccuaccuacagggucuaaacaaggaaacguucagacucucgauucgauucgauggaugccagcgacccccgugccugcuccagaaugucaucagaaguaugccaucucaacagagaccgcauuucccacucugagcacauucaugaauaccgaaaagaguguaaaagguuccaacgccgacuuuacgaagcguaauccuagauggagguuccuuuuuggcauauacugcucucugcaccaugcuaugacuaucuucauuuga

SEQ ID NO: 53554 - RNA, 735 nt, Artificial Sequence
  derived and/or modified sequence opt3 from C14orf166__Homo_sapiens__NP_057123
auguucagaaggaagcugaccgcccucgacuaccacaaccccgcuggcuuuaauugcaaagaugagacagaguuccggaacuuuaucguguggcuugaagaccagaagauucgccauuauaaaauagaagaucgagggaaucugcguaacauccacagcuccgacuggccuaaguucuuugagaaauacuugagagaugucaauuguccauucaagauucaagacaggcaggaagcaaucgauugguuacugggacuagccguucggcucgaguauggugacaacgcggagaaguacaaagaucuggugccggacaauucuaagacugcugauaacgccacgaaaaaugcagaaccccuuauuaaccuggacguaaauaacccugauuuuaaggccggcgugauggcuuuggcaaaucuccugcagauccagcgccaugacgacuaucuggucaugcucaaagccauaagaaucuuagugcaagagaggcugacccaggaugcuguugccaaggcgaaccagacaaaggaagggcuuccaguggcauuggacaaacacauucugggauucgauacuggcgacgccguccuaaaugaggcugcccagauccuccggcugcuucauauugaggaacugcgcgaguugcaaaccaagaucaacgaagcaauaguggcuguacaggccauuaucgcggaucccaaaacagaccaccgacucgguaagguugggagauga

SEQ ID NO: 53555 - RNA, 378 nt, Artificial Sequence
  derived and/or modified sequence opt3 from C14orf177__Homo_sapiens__NP_872366
augcacagaaaggagcccggcgccaggcuggaagcuacccgcggggcagcccggccucauaaacagggaacaaagccaaugaucacucgaccgagcgugucccaacucggugagggcaaaugccccucuucacagcaccuucagagucugcgucauaacaagcagcacgcguugacguuaaccaaagcuagauguugcggggaauguagcacaugcuucuguacugaggaaaaguccgagugccaaaggcaugaggaaaccucuccuggaucguguaaucaccagauuaugucagccagcacaauaagugcauuuugcgccaccccacgguucaagcagcuguuuaaaggcacugucgagcagaugucccaaauguga

SEQ ID NO: 53556 - RNA, 423 nt, Artificial Sequence
  derived and/or modified sequence opt3 from C14orf1__Homo_sapiens__NP_009107
augagcagauuccugaacgugcucagguccuggcuugucaugguuucuaucauugccaugggcaauacccugcagucauuucgggaccacacauucuuguacgagaaguuauauacugggaaacccaaccuggugaauggacuacaagcucgcacguuugguauauggacccuccugaguagcguaauccgaugccuuugugcaauugauauccauaacaagacacuguaccacauuacuuuguggaccuuccuccuggcccugggccauuuucucuccgaauuauucguguaugggacagcggcuccuaccaucggaguccuggccccacuuaugguggcaucuuuuucgauauugggcaugcugguuggucuacguuaccucgagguggaaccggucucaagacagaaaaagaggaauuga

SEQ ID NO: 53557 - RNA, 537 nt, Artificial Sequence
  derived and/or modified sequence opt3 from C15orf32__Homo_sapiens__NP_694585
augaacaagagaaccagcguggacgccuccaaagaggaucugcaccccgcugacccucagucuggcgaaggggucccaccgaauaggaagaacacaaaaacuucaccccggggagaggguacggcaccuccauucagugcccgccccugcguuuggacccucugugaaaugcuuagcauccuggcguuggugggcguauuacauccuuuuuaccgauccaauaaccaaguguaucagaagcugaaaacacaccuacguugccagucuucgagagucgaugggcucaugcugaagccaacucuucugacccccucacagcucaagagcccugagggacauuugauucugccaacauucaaucaccuggugauaaggcauauccucgacccgaaacaaaucuuuuguguugcugaugugugcaccgacuguaaguucaacugcggcaguauugaacggcaccagaaacgccacuuaaugagagucucccaggauugggagcaucugauuagguaccggaaucagaucugucuuucuuga

SEQ ID NO: 53558 - RNA, 846 nt, Artificial Sequence
  derived and/or modified sequence opt3 from C15orf41__Homo_sapiens__XP_011520412
augauccugaccaaggcccaguacgacgagauugcucaaugccucgugagcguucccccuacaagacagucccuuaggaaacugaagcagcgguucccaucucagucacaagcaacuuuguuaaguauauuuagccaggaauaucagaaacacaucaagcgcacgcaugccaaacaccauaccuccgaggcgauugaaucuuacuaucagcgauaccugaacggcgucgugaagaauggggcugccccgguacuacucgaucuggcaaacgagguggacuaugcccccucgcuuauggcucgucugaucuuggaaagauuccuccaagagcacgaggaaacaccuccaucaaagagcauuaucaauaguaugcugagggaucccucccagauaccugacggaguccuggcaaaccagguguaccaguguaucguuaaugauugcuguuaugguccacucguggacugcauuaaacaugccaucggccacgagcacgaagucuuacugcgggaucuuuugcuggagaagaaccuaucuuuucucgacgaggaucaacugcgcgcuaaaggguacgacaagacucccgauuucauucuucaggugccuguagccguugaaggacauaucauacacuggauugagagcaaagcguccuuuggcgacgaauguucacaucacgcauaccugcacgaucaguucuggaguuauuggaauagauuugguccaggguuggugaucuacugguauggauucauucaagagcucgacugcaacagggaacggggcauccuguuaaaggccuguuuuccgaccaauaucgucacacugugccauagcauugcuuga

SEQ ID NO: 53559 - RNA, 252 nt, Artificial Sequence
  derived and/or modified sequence opt3 from C15orf48__Homo_sapiens__NP_922946
augagcuucuuucagcugcucaugaagagaaaagagcuuaucccccugguggucuucaugaccguugccgcuggcggggcauccucuuuugccguguacucauuguggaagacagacguaauuuuagauaggaaaaagaacccugaaccaugggagacuguggacccgacggucccccaaaaacugauaaccaucaaucagcaguggaagccuauugaggaacuacagaacgugcaacggguuacaaaguga

SEQ ID NO: 53560 - RNA, 540 nt, Artificial Sequence
  derived and/or modified sequence opt3 from C15orf53__Homo_sapiens__NP_997327
auggagcugcagggcgcccaagaagaccucgggaucagccuuuccucucccagaaggaaccacgagacccggccuggaucaaaggcuaaaggucgcaguagcauuugccugcaggcauccguguggauggccggcgggaaguugcgauuacgugcgucugaacaucugacacagggacaccagcaagagcuaagagauuggaaucucggcgaagacgcuucgcugcuuuucucaaaaagcccauuuggugccgggaagcugauacaggcaccggcccaugucuucaggcaguguuggguucagggaaacgcuuggaucaguugcauuacuaaauuugauuccaagcggucucccgagguggcaagcuccccuucauacuugacgguaccacgcagaaguccccucccuguguuccugaggccaagcgaccggugugucugcggcggcuguuaucuggggaagucuacccgcagacgagccugccaaucccucuuaucagauccccugggagugacauuuccuacucagaccaggccauga

SEQ ID NO: 53561 - RNA, 882 nt, Artificial Sequence
  derived and/or modified sequence opt3 from C15orf59__Homo_sapiens__XP_005254426
augaacaucagaggcgcccccgaccuggggcagccuagcgaugacccauccucuggaggugagagggaacggauucgccaacgaaugaagauggugauaggccagcucgaggggauccuucgugaacugaaagaggucgcuaaggaauugagagagguugugucacagauugauaaauuaaccagugacuucgauuuugagcuggaaccggacgauuggacaacugcaacgguaagcuccaccucuucgucagacaaggccggaaugggcggucccuucgaucuagggcaccucgacuuuaugacagcggauauccugagcgacaguugggaguucugcuccuuucuugaugugucuacuccuagcgacuccgucgacggaccagaaucaaccaggcccggcgcuggcccugauuaccggcugaugaaugggggaacaccaauucccaacgguccucgcguggagaccccagacaguagcucugaggaagccuucggcgcagggccgacuguuaaaucccaguugccccaaagaacaccuggaaccagggagcgggugcgcuuuucagauaagguccucuaucaugcccuguguugcgacgaugaagagggcgacggugaacaggagguggaggaagaggaaguagggcugccacccgagccugcucacacggaagcacaugccggaccacacaagcccagcccggcuccuuacaaaagucgaagaucuccccucacuuccaggcauagcggcucgaccuuagccccagagcagacacggcguguuacucgcaauucuuccacccagacagugucagauaagaguacccaaacgguccugccuuauacugcgacaagacagaaagcaaggggcaagaacuga

SEQ ID NO: 53562 - RNA, 828 nt, Artificial Sequence
  derived and/or modified sequence opt3 from C16orf72__Homo_sapiens__NP_054836
auggaggaaagaaaggaggaaggcgaggccgaaauccaggagcacgggcccgagcauugguucagcaaaugggaaaggcaaugccuggcugaggcagaacaggacgagcagcucccuccagagcuucaggaagaggccgcggcugccgcacaaccggaacacaagcagcagaaacuguggcauuuguuucagaacuccgccaccgcuguggcacaauuauacaaggaucgggucugucagcagcccggacugucucuauggguuccuuuccagaaugccgcuacagccgugacuaaccucuauaaagagucaguagacacgcaccaacgcaguuuugauauugguauacagaucggcuaccagcgacguaauaaggacgugcuggcgugggucaagaaaagaaggcggaccauucgcagagaagaucuuaucagcuuccugugcgggaaggugccacccccuaggaacucccgggcaccaccccgcuugacaguugugucuccuaaucgagccacuucgaccgagacaucaagcagugucgagaccgaccuccaaccauuuagagaagcuauugcccugcauggacuguccggcgcaauggcuucuaucagcgugagguccucaacuccggguagucccacacacguaagcucuggguccaacgccucacggcgucgcaauggacuccacgauguugacuuaaacaccuucauaagcgaggaaauggcgcugcaucuugauaauggcggcacgagaaaaaggaccagugcccaguguggggacgugaucacugauucuccuacacacaagcggaaccgaaugauuuga

SEQ ID NO: 53563 - RNA, 231 nt, Artificial Sequence
  derived and/or modified sequence opt3 from C16orf74__Homo_sapiens__NP_996850
augggccugaagaugagcugccucaaaggguuccagauguguguguccucuucaaguagcucccacgacgaagcccccguccuuaacgauaagcaucuggacguuccugauaucauuauaaccccaccgacacccacuggaaugauguugccuagagacuuagguucuacgguguggcuggaugaaaccggcucgugcccagacgauggggagaucgaccccgaggcuuga

SEQ ID NO: 53564 - RNA, 798 nt, Artificial Sequence
  derived and/or modified sequence opt3 from C16orf78__Homo_sapiens__NP_653203
augagcgagcagcaaauggaccugaaggaucucaugcccaccaaaagaaaguacauguggaaaacagccgaagacaggcggauguccgaucuuacuugcgugcuggagugguuggaacgccgacagggcaagaaaaagcaggcuccugagaagcagaaaccaaaggucguuacgguguuaaaacguaacaagaaaaaggaagagaagaaagggaagggacugaugaccgcaagagguggcaauaggcgggacacagagacuucucaacaggcccuagggaaacgcuucagaaaggaugcggcuucauauaggagucucuacggaguagaacagaaaggcaagcaccugagcauggugccggguuccuauaucaaagacgggcccaagaagucugauaccgacauuaaagaugccgucgacccugagucgacacagcggccaaaccccuuucgccgacaaucaauagugcuugauccuaugcugcaggaaggaaccuucaauagccagagagcaacuuuuaucagggacuggaguaacaagaugccagauauggccuacgagcggaaauugaagucccucauggagaaaucuacagaacccaagauggagaccaugcguaugcugaagccugaagagguucugagcugucgcuaucucagauuauccaaagaaaauauuaggacgcugcuuaaguugugcaaagacgcuggcaugaacguggacauccauccacacauggucgaggaggauauugacgcaaagaaaguguucacuggcaucccgucaauggcccuguga

SEQ ID NO: 53565 - RNA, 720 nt, Artificial Sequence
  derived and/or modified sequence opt3 from C16orf95__Homo_sapiens__NP_001182053
augagagccagcaggucucccccuuccccacggcgcugccaccaucaccaugaggcuaccggcgcagccucaggggcggcugccggagguccgggcgcagggugugugggacugugccgacucgcccuuacacccagugcucaggacggccguaacagcacuuuccaaacguacaagaaagaagucugucugccuagacacuccaugcauccaggucccugggcaaucugcugugagugccagaccagguuugggggacgguugccuguuucucgcguggaagccgcuuuaccauauuggguaccccugucgcuaagaccuaggaagcagucacagaaaacagugcaauucccaauuccgcagacugccaagaugugucccugccucugucaccgguuuggcggccgccugccuaugccacgagaucaggcggucaugcccuacugggugccucagguucuuagaagccaacagcagauagugaggcggcagcaaagucugaaagggauccaggcaccauugcucgacgccugcuguuggcacaauugcuggcguauuugcggagaugagugucugcuguccaaguuccagcaacuccaggcucccuaucaggaccaguuaccggccccugcagcucgccugcuucccuugggucugcuaacccuccugcaagccaucccaagagucauuauggcgaucaggcagugcuuuggcguguga

SEQ ID NO: 53566 - RNA, 666 nt, Artificial Sequence
  derived and/or modified sequence opt3 from C17orf51__Homo_sapiens__NP_001106905
augggcgaaaagagcagaaggaaagggcccgccccucggcacgcugacggaaagcugggucgaaccugcgaucauccauacgcaccgugguccuucacacccucuucacgcgccccuacugcgugggugcguccacccuguccugucugggcuaguagacuccaggagcacagcccagagcccaggcgggcccgcgcaccuccaacgagaagggcccaagcugcacuuuaugccccggcucugcgguugcgcgaccauuuagaucgauuuuccauccugaugaccucuugcacaucguggcuacaggcgccccaggccccuggccucuguagagacgaacagucaagcaggauuaguguuccacaacuguccggggcacccauacuucugccugauuuggagggaacuaaacucucuaacuuccaggaaagcuccccacugccccacaagcaugagcggaaagacaagcguucaaccccggaggaagagggccgcagugccccugaaaagaucauucagagccugaaacucugccccggugggcacagaccagcuucuuuauccucaggauguccugccggcugcaggcugagcuuuaaucuucccccaaguauguugcugucugugcagaaguguugcaugcccuccagccuaaaaacauguuga

SEQ ID NO: 53567 - RNA, 1944 nt, Artificial Sequence
  derived and/or modified sequence opt3 from C17orf53__Homo_sapiens__NP_076937
auggccugcagccugcagaaguuauucgcuguggaggaagaguuugaagaugaggauuuccuuuccgcagucgaagacgccgagaacagauuuaccggcucucugcccguuaaugcggggagguugcggccugugucaagucgcccacaagagacaguacaggcucagagcucccgauuacugcuacuccacccgacugcccccucugaagcacugggacuuccugaucuggacuugugucucccagccucgucaacgcccagcgcugauagucguccuuccugcaucggugcagccccacugagacccgugucuaccagcuccucauggauuggcaaccagaggcgggucacagugacugagguucugcgcgaaaccgcuagaccucaaaguagcgcccuccauccauuacugacauucgagucucagcagcagcaagucgggggauuugagggcccggaacaggacgaguucgauaaagugcuugcguccauggaauuggaggaacccgguauggagcuggaguguggggugucaagcgaagcaauaccuauccuaccagcccagcagagggagggaaguguacucgcuaagaaagcccggguuguggaccugucuggcuccugccaaaagggccccgucccugcaauucacaaagcugggaucaugagcgcccaggaugaaucgcuugacccagugauucagugucgcacuccccgaccgccucugagacccggagcggugggucauuugccagucccuaccgcccucacaguucccacccaacagcugcacugggaggugugcccacagaggucucccguacaggcauuacaaccucugcaggcugcccggggcacgauccaguccucaccacagaaucguuuuccgugucaacccuuccagaguccuagcuccuggcucucugggaaggcucaucuuccacgccccagaacuccuaacagcucaugcaguaccccauccaggacaagcucuggacuguuuccccggauaccguugcagccucaggccccagugucaaguaucggcagccccgucgguacuccuaaggggccccaaggagcacuacagaccccaauugugacaaaucaccugguucagcucgugaccgccgcuucccgaacgccucagcaacccacucacccaucuacacgcgcgaaaaccagaagguucccgggcccugcaggcauccugccccaucagcagucggggcggagccuugaagauauuauggucuccgccccacaaacucccacacacggagcucuggccaaguuucagaccgagaucguggcaucaagucaggccucuguagaggaagacuucggucgcggcccuugguugacgaugaaaagcacccucgggcuggaugagagagacccauccuguuuucucugcacauacucaauaguuauggugcugaggaagcaggcugcccuaaaacaacucccccguaacaaggucccuaauauggcagugaugauuaagagccugacucggucuaccauggacgcguccgucguguucaaagauccgacaggagaaaugcagggcacuguucaucgacuuuugcuggagaccugucagaacgaacucaagccagguagugugcugcuucugaaacagaucgggguauucagccccucuuugagaaaucacuaucucaacgucacaccuaauaaccuggugcacauuuacuccccagacucaggcgauggaaguuucuuaaagcccagccaaccuuuuccgaaagacucgggcuccuuucagcaugauguugcugccaagcccgaggagggguucaggaccgcacagaaucuggaagccgaggcuucuccagaagaggagcuaccugaagccgacgaucucgacggacugcuuagcgaguugcccgaagacuuuuucugcgguacuucaaguuga

SEQ ID NO: 53568 - RNA, 711 nt, Artificial Sequence
  derived and/or modified sequence opt3 from C17orf64__Homo_sapiens__NP_859058
auggaggccagcgacggccagggaggggaaggugauaagccccuggagcaagugaccaacgucuccugccucgaaacaucuucaagugcuagcccugcaagagacucccuuaugaggcacgccaaaggccuggaucaggacacuuucaagacguguaaagaguacuugcggccauuaaagaaauuucugcgcaagcuacaucucccgcgagaucugccccagaagaaaaagcugaaauauaugaagcagucucuuguuguguugggggaccacaucaauaccuuccuccaacauuacugccaggcgugggaaauuaaacacuggcguaagaugcuguggagauuuauaucgcuguucucagagcucgaggcuaagcaguuaaggcggcuguauaaauacacaaagagcagucagccugccaaauuucuuguaacuuucugugcauccgaugccccagaacgcucuuugcuggcugacagagaggauagccuacccaagcucugccaugcauggggacugcacuccaacaucucaggcaugaaagaaaggcuuaguaauaugcaaaccccuggucaggggagcccacugcccggacagccucggucucaggaccacgugaagaaagauuccuugcgcgagcucucacaaaagccaaagcugaaacgaaagagaauuaaagaggccccggaaacacccgagaccgaaccuuga

SEQ ID NO: 53569 - RNA, 1140 nt, Artificial Sequence
  derived and/or modified sequence opt3 from C17orf96__Homo_sapiens__NP_001124149
auggagacccugugccccgccccuagacucgcugugccagcaagcccgaggggcucccccuguucuccuacaccacggaagcccugccgcgggacucaggaguucucaccucuuugucugcgagccuuggcguuuugcgcuuuagccaaaccacgugcaaguagccugggacccgguccuggcgagcuagccgcuagauccccaguccucagggggccgcaagcaccccugcggccuggaggcugggccccagacggucuuaagcaccugugggcucccacggggcgcccuggaguuccaaacaccgccgcgggcgaagaugcagacguggccgcuugucccagaaggggcgaggaagaggaagggggagguggcuucccgcauuuugggguacggucuugcgccccucccggacgcuguccagcaccuccccacccacgagaaucgacaacuucauucgcuagcgccccuccuagaccagcgccgggcuuggagccccagagggguccugccgcaaguccaccccaggaaccuuccucucggccacccagcccgccugcugggcucuccaccgagccagccggacccggcacagcuccucgucccuuucugccaggccagccugccgagguggaugggaaucccccaccggcagccccugaagcucccgcggcaucaccaaguaccgccagccccgcuccugccgcaccaggagaccugcgccaagagcauuucgauagacucaucaggcggucuaaauuauggugcuacgccaaggguuuugcucuggacacucccucccuucgacgcggcccugaaagaccgccagccaaagggcccgcaaggggagcggcuaagaagcggcgcuugccugccccacccccuagaacagcacagccgaggcgucccgccccaacccugccuacgacuucaaccuucagccuacucaacuguuuucccugcccacccgcucuggucgugggcgaggauggugaccuuaaacccgccaguucucugcgguugcagggggauuccaagccaccgccugcacacccccucuggcgauggcagaugggcggaccagcuguucccgaaccuccaggccugaaauucugggggauuaauauggacgagagcuga

SEQ ID NO: 53570 - RNA, 1602 nt, Artificial Sequence
  derived and/or modified sequence opt3 from C18orf54__Homo_sapiens__NP_001275909
auggccaagagcaaaaccaagcacagacugugcucccaggagucuucagugagugcucuccuugcaagcuguacacuguccggcucuaacucgucaaauagcgacgggaguuuccauuacaaagauaaguuguauagguccgccucucaagcguuacaggcuuacaucgacgauuuugaccugggacagauuuaucccggugccagcacuggcaaaauaaacaucgaugaagacuucacgaauaugucccaguuuugcaacuacauuuauaagccuaauaacgcauucgagaaucuagaucacaagaaacauucaaacuuuaucaguugucggcgccacaccgucaaugacauugauagcaugucucucacaacugacgaucugcuucgacugccagccgacggguccuucucauacaccuauguuggaccgagccaucguacaaguaagaaaaacaagaaaugcagaggcagguuggguucucucgauaucgaaaagaauccccacuuucaagggccuuacaccuccaugggaaaggacaacuucgugacuccaguaauacggagcaauaucaacggcaaacaguguggccgccugaagaaucccaaacugaugaacagaacaaacaauugcauuucggagucuucccucucauuuccuaagaaaaguagcuucaaggacuccucugaacacagcuuagagaaaaacuacccaagguggcugaccucacagaagagugaucuuaauguguccgggaucacgagcauucccgacuuuaaguauccugucugguugcauaaccaggaucugcuaccagacgcuaauucucaacggguguaccagaucuucaaagaugaccaguguucaccgcgccacagucaucaggcacaaggaacuagccgacucauaaacaagcuggauugcuuugaguaugccuucgaacccuccaauuucucuaacucgcuuagcgacgauaaagagcugguuaaugaauacaagugugacuuugagcacucccagugccagugugagaacccuuugcucccaggucaaucaaccaaacccuucaguggcgauaagauugaacuguuaauccugaaggcuaaaagaaaucucgagcagugcacagaggaacuuccuaagucuaugaaaaaggacgacagcccaugcucccuggauaaauuggaagccgacaggucaugggagaacauucccgugacuuuuaagagcccggucccuguaaauucugaugacagcccccagcagaccagucgggcgaaguccgcaaaaggggugcuagaggauuuccugaacaaugacaaccaaucuuguacacucuccggaggcaagcaccaugguccaguugaagcccugaaacagaugcuuuuuaaccugcaggcugugcaggagcguuucaaucaaaacaagaccacggauccuaaagaagagaucaagcaggucucagaagacgauuuuaguaaguugcagcucaaagagagcaugauccccauuacucgcucgcugcagaaggccuuacaccaucuguccagacuaagggaccucguggaugacacaaauggggagcggucuccaaaaauguga

SEQ ID NO: 53571 - RNA, 1686 nt, Artificial Sequence
  derived and/or modified sequence opt3 from C18orf8__Homo_sapiens__NP_001263271
augggcgaggaagacuacuaucuggagcucugcgaaagacccgugcaguucgagaaggccaacccugucaauuguguuuucuucgaugaagcuaacaaacaaguguuugcaguaaggagcgggggagccaccgguguggucgugaagggcccagacgaucggaauccgaucuccuuccgcauggacgauaaaggggagguuaagugcauuaaauuuucucuugagaacaagauacuggcggugcagcgaacaucaaagacugucguguugcccgaaaaacguaguuuaaagcugcuaaaaagccacaaucucaacguaaauugguacauguauuguccugaguccgcuguuauccugcuuucuacgaccgugcuggaaaacgucuugcagccauuccauuuuagagccggaacaaugucgaagcuccccaaauucgagauugagcugccugcagccccaaagucaacuaagcccagccugagugaaagggacaucgcuauggcaaccauuuacggccagcucuauguguuauuucugcggcaccauucccgcacaucuaauagcaccggugccgaggugguccuuuaccacuugccuagagaaggggcuugcaaaaagaugcauauccugaaacuaaacaggacuggaaaguucgcccucaauguuguggauaaccugguagugguccaccaccaagacacagagaccuccgugauauuugauaucaaacuucggggcgaauuugacggcucaguuacguuucaucacccagugcugccggcgcgcaguauucagcccuaucagaucccuauuacugggccagcagccgucaccagccagucucccgugccuuguaaguuguacuccucaagcuggaucguauuccaaccagauauaauuaucagugcuucucagggauaccucuggaaucugcagguuaaauuagagcccauugugaaccugcucccggacaagggucgacuuauggauuuccuguugcagagaaaggagugcaaaauggucauccuauccguguguagccaaaugcugucggaaucugacagggccucccucccugucaucgcaacaguguuugacaagcugaaucaugaguauaaaaaguaccuugaugcugaacagucauaugccauggcgguugaggccggccagagucggagcucuccccuguugaaacguccagugcgcacucaagcaguacucgaccaguccgaugucuacacccacgugcugagcgcuuucguugaaaagaaggagaugccucacaaauuugugauugccgucuuaauggaguauauaagaucacugaaccaguuccagaucgcugugcaacauuaccuacacgaacucguaauuaagacacuggugcagcauaaccuguuuuauauguugcaccaguuccugcaguaccauguucucagugacuccaaaccccuggccugccuucuguugagccucgagucuuuuuacccacccgcacaccaacugucauuagauaugcugaagaugcuacagaguaggcucaaaaccacguguuucagcauccaguauuccgccuuucuuaauucugaaacuucggucugcgagggggcuccuauaagccaccagggaaacacagugaagaauaugcuuuuguucuccaaccgguuucuggaaaccaagcucuga

SEQ ID NO: 53572 - RNA, 459 nt, Artificial Sequence
  derived and/or modified sequence opt3 from C19orf12__Homo_sapiens__NP_001026896
auggagagacucaagagccacaaacccgccaccaugacaaucaugguggaagacauuaugaagcugcuuugcucccugucuggcgagaggaaaaugaaggcugcagucaaacauucagggaagggagccuugguuacuggugcgauggcuuucgugggcggguuaguaggaggcccuccaggucuggccgucgggggagcagugggcggccuacucggggccuggaugacgaguggacaguuuaagccggugccccaaauacugauggaacuuccuccagcugagcagcagcggcuguucaacgaagcagccgcuaucauucgccacuuggaguggaccgaugccguucagcucacagcgcuggugauggguagcgaggcacugcaacagcagcucuuagccaugcuggucaauuacgugacuaaagaacuucgagcugagauccaguaugacgauuga

SEQ ID NO: 53573 - RNA, 648 nt, Artificial Sequence
  derived and/or modified sequence opt3 from C19orf18__Homo_sapiens__NP_689687
auggacaaggugcagagcggcuuccugauccucuuucuuuuccugauggagugccaauugcacuuaugucugcccuacgccgaugggcuacauccuacaggaaacauuacaggucucccaggcuccaaaagaucucagccgcccaggaauauaacuaaggaaccuaaagucuuuuuccacaagacgcagcugccagggauccagggagcugcaucacggaguaccgccgcgagccccacaaacccuaugaaauuucuucgcaauaaggcuauuauccgacaucguccagcccugguuaaggugauuuugaucuccucuguagcauucucgauagcccucaucugcggcauggcuauuucauauaugaucuacagacuggcacaagccgaggaaaggcagcagcuggagagccucuauaaaaacuuacggauuccccugcuuggugacgaagaggaggggagugaagaugagggagaauccacucacuugcugccugagaaugagaacgaacuagagaaguuuauccauucugugauaauuagcaaacgcuccaagaauaucaaaaagaagcucaaagaggaacagaacucagucaccgaaaauaagaccaaaaacgcuagucacaauggcaagauggaggaccuguga

SEQ ID NO: 53574 - RNA, 399 nt, Artificial Sequence
  derived and/or modified sequence opt3 from C19orf24__Homo_sapiens__NP_060384
augggccccagagugcugcagccuccacuccuucuguuguuacuggcccuacuccuggcugcacuuccgugcggggccgaggaagcgagcccccugaggccugcucaagucaccuuguccccacccccugccguuacaaacggaucucagccaggugcaccccacaauucaacucauacgcggccuccaggcgccagugggagcgcucucacccgcuccuucuacgugauccugggauuuuguggccugacagcacucuauuucuuaauucgagccuuucgucugaagaaaccgcagagaaggcgguacggucuuuuggcuaacacugaggaccccaccgaaauggccucucuggauucggacgaggaaacaguauucgagucacgcaaucuaagauga

SEQ ID NO: 53575 - RNA, 1362 nt, Artificial Sequence
  derived and/or modified sequence opt3 from C19orf26__Homo_sapiens__NP_689982
augcagcccaccgccacaauggcuacugcagccacgaccacaacuaccacaaccgcgacuguggcucugacaaccagcugggacaacgccacgggcagaccuacugcagagccagauccgauccucgacaauuacguccuucugguugugguaauguccuuguucgucgggggaaccuuaguggugcugucugguguucuacuccugugcaagagguguugggaugugcaccaacggcuuaaccgcgccauggaagaggcugagaaaacaacuaccacauaucuggacaauggcacccaucccgcacaggauccugacuuucgaggggaagauccagaaugccaggacgccgagacggagcguuucuugucaacuuccagcacaggaagaagggucuccuuuaacgaagcugcccucuucgagcagucucggaagacccaagauaaaggccgcagauacacucugacagaaggugacuuucaccaucugaagaaugcgaggcucacccacuuacaucugcccccucuuaaaauugugacgauacacgagugugauucgggggaggcaucaagcgccaccacaccacaccccgcuaccaguccuaaggccacuuuggcaaucuuccagccaccgggaaaggcucugacaggccgguccguaggccccucuagcgcccuaccuggggacccauauaacuccgcggccggagcaacugauuuugcugaaauuucacccagugccagcucugacuccggugagggcaccucacucgacgcugggacacgcagcaccaaagccggaggcccuggugcagccgcugggccaggagaagcgggccccggcaguggggcaggaacuguucugcaguuccuuacgcgacugagaaggcaugccucuuuggauggugcuuccccguacuuuaaggugaaaaaguggaaacucgagccuagccagcgggccgcaucgcuggacacacguggcucucccaagcgccaccauuuccaaagacagagggccgcuuccgaaucaaccgagcaggaggaaggggaugccccacaggaggacuuuauccaauauauugcacgggcgggagaugcugucgccuucccucacccccgaccauuuuuagcaagucccccuccagcccugggccgcuacuucagcguggacgguggggcuagaggcggaccggugggccccugcccuccaagucccccuccaaggcggccccgcgaaagaucuccggggccugucgauacuaggagcccagccucaaguggaaaggcacccccucgugguggccucaccggggcuacaucccccgccuggacccggggaggcaaacagggugagacuggguga

SEQ ID NO: 53576 - RNA, 321 nt, Artificial Sequence
  derived and/or modified sequence opt3 from C19orf33__Homo_sapiens__NP_277055
auggaguucgaccugggagccgcucucgaacccaccagccagaagccuggggugggagcaggucacggcggggauccaaaacuuuccccgcauaagguccaaggaagaucugaggccggcgcgggucccgggccuaaacagggacaccauucaaguagcgacuccucuucgucaagcagugauuccgacacagauguuaagucucacgcugccggcagcaaacagcaugaauccaucccaggcaaggcaaagaaacccaaggugaaaaagaaagagaaggggaagaaagaaaagggcaaaaagaaagaggccccucacuga

SEQ ID NO: 53577 - RNA, 648 nt, Artificial Sequence
  derived and/or modified sequence opt3 from C19orf40__Homo_sapiens__NP_689479
auggagaagaaucccccugacgauaccggcccagugcacgucccgcuggggcauaucguugcuaacgaaaaauggagaggaagccagcucgcucaagagaugcaggguaagauuaaacuuauauucgaagacggccugacacccgauuuuuacuuguccaacaggugcuguaucuuauaugugacugaggcagaccugguagccgggaauggauaccggaagcgccuagugcgaguccguaacucuaauaaccucaaaggcauugugguuguggaaaagacgagaaugucagagcaguauuucccugcgcugcagaaguuuaccguccuugaucuggguaugguguugcucccaguagcuagucaaauggaggccagcugccugguuauccagcuggugcaggaacagacaaaagagcccuccaagaauccucucuuagggaaaaagagggcacugcuuuugucugaaccaucgcugcuacggacuguccaacagauucccggagugggcaaagugaaggccccucuccugcuucagaaguucccaucaauccagcaacugagcaacgcuaguauaggcgaguuggagcaggucguugggcaggcaguggcccaacagauccacgccuuuuucacccagccgcgcuga

SEQ ID NO: 53578 - RNA, 1518 nt, Artificial Sequence
  derived and/or modified sequence opt3 from C19orf45__Homo_sapiens__XP_011526294
auggccaccggcgcucugcuccccugcagcagaccuuguccaauguccaggcuugacuuccugaaggcaucucacuuuucauuggggccggauuuacggcugcaugagggaacaaugcgcacuacgagucaccgagacuucgccuaccccgcggcuacccgugaaccuccaagccuacagcccccuccagcccuccuguuucccauggauccuagaugggacagggaggaacggguguccgaggcacaucgcgccuucccaccgcccucuacaccuccaugggaacuucugcaagcucaggcaagagagaggacuuuggccaugcaggcugguaaccuccaucugcacgaggaugcccacgcgggcaucgggcugucgaaugcacacgccgcuuauggauggcccgaacucccugcccggacccgcgagcgaauuagaggcgcaagguuaauauuugaccgggauucacugccacccggugaccgugauaaacuucgcaucccgccuacaacccaucaggcuuuguuucccccacacgacgccagaccucaacccagggcgccaagcugccaucuagggggacccaacacucugaagugggauuacacacggcaggacggcaccaguuaucagcgacaguuccaagcccucccuggcccaccggcacugcgcuguaaaagagcuuccucuggggucgaacuuggagauugcaagauuagcuacgguuccacguguucagagcagaaacaggccuauaggccccaggaccugccugaggaccgguacgauaaggcucaagccacugcacacauccacugcguuaauauucgcccaggcgacggguuguucagagauaggaccacaaaggccgaacauuuuuaugcucgugagcccgaaccuuucgugcuccaccaugaccagacuccagagagucacauccugaaaggaaacuggugucccggcccggguagcuuagauaccuuuaugcaguacuucuacgggcaaccuccacccccuacacagcccccaucucggcauguaccucacgaaaagcugcagucccacgugacccucggagagcccaaacuucugaagcgauuuuucaaaacgacuaugggcucagacuauugcccaagcgaguggagacagguccaaaaggcgccgaauuugcaucuacagcagaguuaccugccuaggggcacaggggaguucgauuuucucaccaugaaccagaagaugcugaaaccccaccgcacuccacccgcaccugugacagaagaaaugcuucaacgguguaaguauucucauauggagccaccccugggagguuugagauucuuuuccacccaguacaaagacgaguucccuuuuaaguaucagggcccggccgcucucaggcugaaaaauccacaggaaggguucguucccuuaggaacgccucaccaacgcggcugccgagagaagauagauccacuggugccccagccuccgauguaccuaugucccagccagcaguga

SEQ ID NO: 53579 - RNA, 354 nt, Artificial Sequence
  derived and/or modified sequence opt3 from C19orf48__Homo_sapiens__NP_001277083
augaccgugcuggaggccguccucgaaauccaggcuauuacaggcagcagacuucuguccaugguucccgggccugcaaggccaccgggaucuugcugggaccccacucaauguacgcggaccugguuguuaucacacacaccucgccgacguuggauaaguggucugccaagagccagcugcaggcuaggcgaggaacccccuccacuccccuacugugaucaggcguauggggaggaacuguccauccggcaucgcgagacuugggcuuggcuuucuagaaccgacacagccuggccuggagcaccaggcgugaagcaggccaggauucugggugaguugcuccugguauga

SEQ ID NO: 53580 - RNA, 1914 nt, Artificial Sequence
  derived and/or modified sequence opt3 from C19orf57__Homo_sapiens__NP_077299
augaccaagaggaaaaagcugagaacaagcggcgaggggcucugucccccuaaaccacuuaagaacccgcggcugggagacuucuacggugacccccaguccucuauguugggcugcuuacaccauccugaagaaccagaagggaaacugggacccgugccuucaacucaacagcacggcgaggaaccagguaaggccgucaguagcucccccgacgaggagacggggucuccuugccgccuacuccgacagccagaaaaggagccggcuccccugccuccaucgcaaaauucauuuggacguuucguuccccaauuugcaaaaagcagaaagaccgugacaaggaaagaagagaugaaggaugaggaccggggcaguggcgccuucucccuugaaacuaucgcggagucuagcgcucaguccccugggugucagcuguugguagaaacccucggagugccacugcaggaggccacagaacugggugaucccacccaagcagacucagcccgcccggagcagaguagccagucuccuguccaggcugugcccggcuccggggauucacaaccagacgauccucccgacagaggaacuggccucagcgcaagucagagggccucucaggaucauuuauccgagcaaggugcugacgauagcaaaccagaaacagaccggguucccggggacggaggccagaaggagcaucugccuucgauugauucugaaggcgagaagccagaccgcggggccccgcaggaaggaggugcgcagcgaaccgcaggcgccgggcuucccggaggcccucaagaggagggugauggggugccaugcacgcccgcuuccgccccuacuucaggcccagcacccggauugggcccggcuaguuggugucuggaaccugggagcgucgcccagggauccccagacccccagcagaccccuucuagaauggguagggagggcgaagggacacacagcucacuaggaugcaguucccucggcauggugguaauagcggaucugagcacugaccccaccgagcuugaggagcgggcccuggagguugcagguccagaugggcaggcuucugccaucaguccugcuucaccccgucgcaaagccgcagacggcggacacagaagggccuugccaggcuguacaagccucaccggggaaacgacuggagaguccggugaagcuggccaggaugggaagccgccuggagacgugcuggucggccccacagcgucuuuagcacuggccccagguucgggggagagcaugaugggcgcuggagauuccggccacgccucacccgacaccgggccuugcgugaaccagaaacaggagccaggacccgcacaagaagaggccgaacucggcggucagaaucuugagcgggaccuggaaggguuucgagugaguccucaggcuucugucguuuuggagcaucgcgagauugccgaugacccgcuacaggaaccaggagcacaacagggcauccccgauacuacaagcgagcuggcgggucagagagaccaccucccucauuccgcugaucaaggcaccugggccgacucacuggcaguggaacuugauuuccuguuggacagccagauucaggaugcccucgacgcuucugauuuugaggccccacccgaacagcuguucccuuccgggaacaagccgggacccuguuggccaggcccuaguagccacgcaaauggggaccccguagcuguggccaaagcgcaaccaucuagguuaaucaugggaacgcaccgggaucuggaggccuuuaagcgccuaaacuauagaaaaaccaagcucggcgguaaggcuccucugcccuacccauccaaagggccgggaaauauaccuaggggcgaucccccauggcgugagcuuuga

SEQ ID NO: 53581 - RNA, 2763 nt, Artificial Sequence
  derived and/or modified sequence opt3 from C19orf68__Homo_sapiens__NP_955373
auggagagacccgaaccuccaccgggcaccgccgcugggcaggaggaacaagagcugagggaacgggcauucuuuagcugggccgaguucucccgcuuuuucgacgcguggugccagcagcgacucgcucuauuuuucgugaagucuucaaugcaccuggcccguuguagaugggcaagugcucccccuuuguacacauuaaucgauguccugaaauauagcuacguuaggcuagugugcaaggacguacgggccccaucccgccccgcagugggaccuccacagcccgguuguccugccuuuauuauagucaaacucucuccacugagagauaggcuugugguuacugagugccaacugacgcauucgcacccggcuugucccuuggaguucgccuauuacuuucggccuggccaucuccuggcgaacgcaugccugccagugcgcaccacaaauaagaucucaaaacaguucgucgcccccgcugacgugcgaagacucuuaagcuauuguaaggggagggaucacggaguacuggacgcccuucauguuuuggaaggccuguuucggacugauccugaagcaaaggugaaacuugucuucguggaggaccaggcuguggucgagaccguguuuuuccucacaagucguacccgcgcccugcuuagaagguucccacggaugcuguugguugaucgacuccccggucugcagggggcguuagaccugcucgccguacuuugcguggauggauccggccgcgcaagacaagcugccuguugcgucgcuaggccgggcacuccuucucuguugcgguuugcccuagcaagccugcuccaguccgcccccgacgugaaggggcgcguuagaugucugacagcuggaccagaaguggcggcacagcuuccugccgucaggcagcuguugcccugcgcucgugugcaaauuugccgggcccagggucucgagacccuguucucaaaagcacaggaauuaggcggggccggacgagaggauccaggccuguggaguagacuauguaggcucgcuggugccagcucucccgcagcguacgacgaagcucuggccgagcuucacgcacacgggccugccgcuuuuguagacuauuucgagcgcaacugggaaccacggagagauauguggguuagguuucgcgccuucgaggcagcucgagacuuggaugccugcgcgcuggugcggggacaucguagaaggcuccugcgccggcuuuccccgucaagaggcgucgcccaaugucugagggacuugguggcuaugcagugggcagaugccgcuggcgaagccguccccgaggggccugacggagguggcccauggcucgaagaugagcccgggcgaggagcacagggcgagaaugaacgcgugcggggucuggagacgggggacuggggcggagcgccuaaggaaggcagcaucuggagaggggcccagauggagaaagaaugggcuagggccuuagagacucgugauuggggaggugcacaauuugagggcgaaaaggggcgcgcucugcagauucgggacuggagaggaggcaggcuagagaaccagaagccacgaggucucgaagggggcguucugcggggaaguaaacuugagaagggccacuugcgcgggcccgagaucagagauuggaggggaccgcagcuggaaggugagaaagacuggggccucgaaggguacguguggcggggaucucaacuggaggaccaggccuuacgaggccuggaagguuacaccuggagaguagcacagcuugaggaucgcagguccacaacugacuugcgugggacccaguucgauuaugagcgggucagaagccucgaaggcucgccuuggaggggagcccaacugcaugacgagcgcgcuggcgggcuacgaacagcggaauggaagggaccacagucugagguggaaaaaggcagaggucuggagguucggaaucucagggggauaccccuggagaagucccuugaauuggccccugagaacggagaucagcgcggcccccagugggaagacgagcguagacgggguccagaaaucgcagaggagaggggcgcucgcgugggggucaaacgaagacggggacuggaagauauuguguuaguacaacucggcgacaccagggugacggggauggagaauggagauggcgguggggcccgcucaguuggaccuaagaguagagccggcagggguauggaauggggcgacgcugggggacggugccugggccuugggaacggagucgugagcggcacucccguggguacaguccuggagggguccccagagugggcagccgcgcguucugaacacuuggcugccggagauggccuccaggaggguggcgaagacgggccgcgcgagccuaagcgacuguguagacccccaggagaagaggagguugauugggaaccccuagcaaaauuuagggccgcuugcggcccugagcuggcagaccucguggccgaggaacuggcguucgcucggcagcacgggacccgcggauuucauuggacuggcgccgguuucgcacuuaaggacgggacaagcgacuuuuucuuggauggagcccugaccagauguucaugcaguauccacgcugccaggcgguuaccaugucgacaucucuucgcagcuagacugcuuacgggcgccgcgcuguuucacauggaucuacuccgcgacugcuggggcagggcccccgaaccuuga

SEQ ID NO: 53582 - RNA, 426 nt, Artificial Sequence
  derived and/or modified sequence opt3 from C1D__Homo_sapiens__NP_775269
auggccggcgaggaaaucaacgaggacuaccccguggaaauucacgaguaucugagcgcuuucgaaaauuccauaggggcagucgaugagaugcucaagaccaugaugucuguuucaagaaacgagcuucugcagaaauuggacccuuuagaacaagccaagguggaucugguaagugcguacacacuaaauagcauguuuuggguguaucucgcuacucagggagucaacccaaaagagcauccggugaagcaggaacuggagaggauccggguuuacaugaaucgcgugaaagagauuacggacaagaagaaagccgguaaacuugaucgaggcgcagccucccguuucgucaagaacgcucugugggaacccaagucuaaaaaugcaucgaagguggccaacaaggggaaaucaaagagcuga

SEQ ID NO: 53583 - RNA, 957 nt, Artificial Sequence
  derived and/or modified sequence opt3 from C1GALT1C1__Homo_sapiens__NP_689905
augcugagcgaguccucuucauuccucaagggcgugaugcuugggaguaucuuuugcgcccugauuaccauguugggacacauaagaaucggucauggcaacaggaugcaccaucacgaacaucaccacuuacaggcucccaauaaagaggacauucugaagaucagcgaagaugagcggauggaacuauccaaaucuuuccgcgucuacuguauuauccucguuaagccuaaagacgugucgcugugggcagccguaaaggagacauggacuaagcauugcgauaaagcggaguuuuucucaagcgaaaacgugaaggucuuugagaguauaaauauggacacgaacgauauguggcuuaugaugcgaaaggcuuauaaauacgccuucgacaaauaucgugaucaauacaauugguuuuuccuggcaagaccaaccacauuugccaucauugaaaacuugaaguauuuccuccugaagaaagacccgucccagcccuuuuaccuggggcacacuaucaagucuggagaucucgaguaugugggcauggagggugggauuguuuuaagcguggaauccaugaaaaggcuuaauucacuguugaacaucccugagaaguguccagaacagggaggcaugauauggaaaauuagugaggacaagcagcuggcugucugccuaaaauacgcaggcguguucgccgaaaaugcugaggaugccgacgggaaggauguauuuaacaccaagagcguuggacucucuaucaaagaggcgaugacauaccaucccaaucaaguggucgaagguuguugcuccgacauggcagugaccuucaacggccugacuccuaaucagaugcacgugaugauguauggggucuaccggcuucgcgccuucggacacauuuuuaacgacgcucugguuuucuugccacccaauggcucagauaacgacuga

SEQ ID NO: 53584 - RNA, 1116 nt, Artificial Sequence
  derived and/or modified sequence opt3 from C1GALT1__Homo_sapiens__XP_005249869
augagcgagauccacuucagagaaauggccuccaagucuuggcugaacuuucucaccuuccuuugcggcucagcuauuggguuucuguuguguagucaguuauucagcauacugcuaggagagaaaguggacacacaacccaauguccuccauaacgauccucacgcaaggcauuccgacgauaauggucagaaccaccuggaaggccagaugaauuuuaacgccgacucuucgcagcauaaggaugagaauacugacaucgcggaaaaccuuuaccaaaaaguucggauucugugcugggugaugacggggccacagaauuuggagaagaaagcuaagcacguaaaggccaccugggcacagcgcuguaacaaagugcuguucaugucaagcgaggaaaauaaggauuuuccggccgucggacugaaaacaaaggagggccgagaccagcuguauuggaaaacuaucaaggcuuuccaauacgugcacgaacauuaucucgaggaugcagacugguuuuuaaaggccgaugacgauaccuacguuauucuggacaaccuucguugguugcugaguaaauaugaccccgaggaaccuaucuacuucgguagaagguuuaagccauaugugaaacagggguacauguccggaggcgcuggcuacguccuaucuaaggaggcccucaaacgguucguggaugcguuuaagacagacaaaugcacccacagcuccucaauagaagaucuggcacuugggcgcuguauggagaucaugaauguagaagccggagacaguagagauacuauugguaaggagacauuccaucccuucguuccugagcaccaccugaucaagggcuauuugccaaggaccuuuugguacuggaacuauaauuacuaucccccuguggaagggccaggaugcuguagcgaccucgcugucucuuuccauuacguggauuccacgacuauguaugagcuggaauacuuaguguaccaccuccggccguauggcuaccucuaucgcuaccagcccacccuuccugagcgaauccugaaagaaauuucacaggccaacaagaacgaggacacaaaagucaaguuggguaauccauga

SEQ ID NO: 53585 - RNA, 1737 nt, Artificial Sequence
  derived and/or modified sequence opt3 from C1orf106__Homo_sapiens__NP_001136041
auggagagcaaggacgaaguguccgauaccgacucuggcaucauucugcagucagggcccgauaguccugucagcccaaugaaagagcucacacacgccguucauaagcaacagagagcucuugaagcaaggcuggaggccugcuuggaagaguuacggcgccugugucuacgagaggcggaacucacuggaacgcugccggcugaguacccccuuaaaccuggugaaaaggccccaaaagugcguagaaggauaggcgcagccuauaagcuggacgauugggcuuugcaccgggaggacccccucuccucucuggagcgccagcuggcacuccaguuacaaaucaccgaagccgcuagaaggcugugccuugaggaaaacuugucgcggcaggcccgccgacagagaaagcauucaaugcugcaggaggagaaaaagcuacaagaacuccagaggugucugguagagcggcgucgcaauagcgaaccuccacccgcggcagcccuuccucuggggagagaguugagugcuuccgaugacucuagccucuccgauggacuguuacuggaagaggaagagucacaggugccaaaaccgcccccugagaguccagcacccccuagcaggccacuucccccgcagacacucgaaggccugcaaccuacuggucccgaggcagggucuccagaacgggcuccuguccagaacucccccuggaaggagaccucauuggaccacccauacgaaaaaccccgaaagagcagugagccuuggucugaguccagcucgccagccacaaccccgcaggauggacccucugcguccucacuauggcugcucgaaccugccaguuaucaugugguuccaauucgcggcgugcccggccaauggcaggggagaacuagcgccccugcuacaccagagauccagggaaggcggggucagucccaaucucugcgcgucgacagcuucagagccggccccgaagggaggggacguucagcuuuuccgcggcgaagaccuacccacuacacggugacuguaccagauaguugcuuccccgccaccaagccuccccuuccacacgcagccugucauuccugcagcgaggacucuggcucagacguuaguagcauuucccacccuacaucucccgguucgagcuccccagauaucucauuucugcagccguugaguccucccaaaacucauaggcaccgcggggcuugggugccagcgggaucucgggagcucgucgcacaccaucccaagcuguuacugccuccaggcuauuuccccgccggcagauacgugguggucgcugaaagcccucuaccgccaggggagugggaacucaggcgcgccgcacccggaccugccuaugaggaagaggguaccccacugcgauaccagcggcuuguucccucccguucaagaauagugaggacaccuagcuugaaagacucuccggcuggccgcgggcuguccaaggccgcaguaagugaggaacucaaaugguggcacgagcgggcgagacugaggagcacccgaccccauucucuugaucgccagggagcuuuucgggugagaucccugccauugggcagggaagguuucgggcgugcccucggcccucgcgcacaaguccccacgguguguguucugcggagaucaccagacggagccccugugcaggucuuugugcccgagaagggcgaaaucauuagucagguauga

SEQ ID NO: 53586 - RNA, 798 nt, Artificial Sequence
  derived and/or modified sequence opt3 from C1orf109__Homo_sapiens__NP_001289959
augagcgagaagagaaggcggcuggacgcccgcaacccccucaaacaggaaaccgcucuuucccgacugccuuucccacguggcaaucaaggguuguuacagaaggcagaggccgggagagcgagguggcugacaccggugauccccgcucuauggaaaacugaagccgguggcucuccugagaagaugacgcaggaucggccacuccuggcaguccaggaagcccuuaaaaagugcuuucccguuguggaggagcaacaggggcuguggcagucagcuuugcgcgacugucagccucuccugaguagccuguccaaccucgcagaacaauuacaggccgcucagaaucugagauucgaggauguaccagcccuuagggcguuucccgacuugaaggaacggcugcgccgaaaacagcuaguggcaggagauauuguccucgacaagcugggcgagagacuugccauacuguugaaagugagggauaugguuucuucgcacguggagcgggucuuccaaaucuacgaacagcaugcugacaccguggguauugaugccguacuccagccuucagcaguuagcccaaguguggcugacaugcuggagugguuacaagauaucgaacgucacuaucgcaaguccuaccugaaaagaaaguaucuccuuucuagcauucaguggggagaccuggccaacauccaggcguugccgaaggccugggauaggauauccaaagacgagcaucaggaccuaguccaagauauccugcucaaugugucauuuuuccuggaagaguga

SEQ ID NO: 53587 - RNA, 909 nt, Artificial Sequence
  derived and/or modified sequence opt3 from C1orf110__Homo_sapiens__NP_848645
auggagagacacauggugaggggccagcuguacaagcauuucgaccucgaacggaaaaacgccaagcaagcugaggcacgccuugaucagcgacugcagcguuugaaagucaucugcuuauaucacguuaagcugcuaacuugggaacagagacaacuccagaaagagcugcagaggcuucagcaagccgaaacaaugaagaagaaauuuagcuccuaccuggggaauggauuccagaagcggcccgaggacguguugguauuuucuccucagggucgccagaaacauagagcgccacaagcuaagaaaaugagggcccucgcaacucggauggcccaggauacguguaagucaaagagucaggugccgcccagccacgacgcuggccugaaagauccuaugaaguccaaaaagcaaccacugucucagaacaaucgcaccgcaugcuucauuaaagagcagccccaggcccaagaaaaggacucggucaacccuucaaaagauguggacccaagcaaggggauaaguguucccugucagaaucaggagguguccacaaacacuaucgaacagggaccuucuagcuccccagcuucagauaguggcauggccugcgcggacgagacccgaagcaaggaugucgcacucaaaccggacgguaauacagggaagcaaauucccccuaaacauauggagugugccggaucuuuugaaggcgaguucaccaagccaaccuuuuuagaacugcuuuccaaagcuagaaacgcccacuauuugaggcaccgggugcccccugagucagaacgucugcuaagcaucggcgagauuuucgggcauggagagaguucuuccagccgcgcagguaaggaaugcgagaauagaguaccaucgaaguuucucccccuguga

SEQ ID NO: 53588 - RNA, 2736 nt, Artificial Sequence
  derived and/or modified sequence opt3 from C1orf112__Homo_sapiens__XP_005245374
augagccaggagggcgccgugcccgcuuccgcagucccucuggaagaacucucuucauggccagaggagcuuugcagaagggaacugccgaguguuuugccccgguuacugagccuaucccaacacucugacucguggaucgagcauauucagauacucaagaucauuguggagauguuccugccucacaugaaccaucuuacccuggaacagacauuuuucucacagguauugccaaaaacugugaagcucuuugaugacaugauguacgagcugacgagccaagcccgcgggcugaguucccagaaucucgaaauccagaccacauuacgaaacauucugcagacuaugguccaacuuuugggagcgcugaccgguugugugcagcacaucugcgcuacacaggagucuauaauccuagagaauauucagagccuccccuccucaguucugcauaucauuaaaaguaccuucgugcacuguaagaacagcgaaucugucuauuccggcugccuucaccuggugucagauuugcuccaagcccuguuuaaagaggcauacagcuuacagaagcagcugauggaacuccuugacaugguauguauggauccucugguugacgauaaugacgauaucuugaacauggugauagucauucauagucuacuggacaucugcucugugauuuccagcauggaucacgccuuccaugcuaauacuuggaaguuuaucaucaaacaaucgcucaagcaccagucuauuauaaaaucccagcugaagcacaaagacaucauuacaucacuuugugaggauauccuguucaguuuucauagcugcuugcagcucgcagaacaaaugacccaguccgacgcccaggacaacgcugauuaucgucuguuccagaagacguuaaagcuguguagauuuuucgccaauucucuacuccacuacgcgaaagaguuucugccauuccuuagcgacucaugcuguacuuugcaucaacuguaucuccagauacacaguaaguuucccccuucccuguacgcaaccaggauuagcaaagcccaucaggaggaaaucgcuggggccuuucuugugacacuggauccauugaucucucagcuccugacuuuccaaccguuuaugcaggucguuuuagacucaaagcuggaucuacccugcgagcuccaguucccucagugccugcuuuuggugguagugauggacaaacugccaagucaacccaaggaaguccagacccucugguguacagauagccagguguccgagaccacgacucggauuucucuguuaaaagcaguuuucuauucguucgaacaaugcagcggagagcugucccuuccugugcacuugcagggccucaagucaaaggguaaagcugaggucgccgugacacuguaccagcacguauguguucaucuaugcaccuuuaucacaaguuuccacccaucucuguuugcggaacucgacgccgcacugcuuaacgcuguguugagcgccaauaugauuacaucccuguuagcuauggaugccugguguuuccucgcacgcuacgggaccgccgagcugugcgcucaucacgucacgauaguggcgcaccuuaucaagucaugucccggagaaugcuaucagcugauuaacuugagcauccuccugaaaagacuauuuuucuuuauggcaccgccucaucaacuggaguucauccagaaguucucucccaaagaagccgagaaucucccacuguggcagcacauuuccuuucaggcccuuccucccgaguugagggaacaaaccguccaugaggugacaacuguuggcaccgcugaaugucggaaguggcugagucgcagccgaacauuaggcgagcucgagucucugaacacugugcuuuccgcacugcuagccguaugcaauucagcuggggaagcccucgacaccggaaagcagacagcaauaaucgaggucgugagucagcugugggcguucuugaacauuaaacagguugcugaucaaccauacgugcagcagaccuuuagccuguuacucccccugcuugguuucuuuauccaaacucuggacccuaaguugauucuccaggccgucacgcugcagacaucgcuacugaaacuugaacucccagacuaugugagacuggcaauguuggauuucguauccucucugggcaaguuauuuaucccggaggccauacaggacaggauccuccccaaccugagcuguauguucgcccuucuguuggcugaucggucauggcuccuggaacaacacacccuagaggcauuuacucaguucgcugaggggaccaaucaugaagagauugugccucagugccugaguuccgaagagacuaaaaacaagguugucucuuuucuugaaaagaccggauucguggacgagacugaggccgcgaaaguggaacgugucaagcaggagaaaggcaucuuuugggaaccauucgccaauguuacaguggaggaagcuaagcgcagcucccuccaacccuacgcaaaaagagccaggcaggaguucccuugggaggaagaguaucggucagcucugcacacgauugccggugcauuggaagcgaccgagagcuuacugcagaaggggccagcccccgcuuggcucaguauggagauggaagcccugcaggagcgaauggauaaacuuaagcgcuacauccacacucugggauga

SEQ ID NO: 53589 - RNA, 429 nt, Artificial Sequence
  derived and/or modified sequence opt3 from C1orf115__Homo_sapiens__NP_078985
augaccgugggcgccagacugaggagcaaggcugaguccucucuccuucggcgcgggccccgaggacgugguagaacagaaggcgacgaggaagcagccgcgauccuggagcacuuggaauacgcugaugaggccgaggcagccgcugaaucagggacgagugcagccgacgagaggggaccuggcacucggggugcucgcagaguccauuucgccuuacugccagaaagguaugagccgcuagaggaacccgcgccuagcgagcagccacggaaacgcuaccgaagaaagcucaaaaaguaugggaaaaacguuggaaaggugauuauaaagggcugcagguacguagugaucggccugcaaggguuugcagccgcuuauuccgcccccuucgcagucgcuaccucugugguuucguuugugcgguga

SEQ ID NO: 53590 - RNA, 1929 nt, Artificial Sequence
  derived and/or modified sequence opt3 from C1orf127__Homo_sapiens__XP_011539059
augagcaccuuccccacauccucucacucaggccuguuuaguccuagcuccgggcaucucaucccacuuugccugauuccgcccuuguuaucuucggugccuacucuggccaugagauucaggaacgcucgggacaaggagaaauuugcauucgccggacgcuguugggucucauuucagccagaaagcgagguucuagugcacauacccaagcaacgacucggucugguaaaacguggcaguuacaucgaagagacgcuuucccugagauucuugagggugcaucagucuaauauuuuuauggucaccgaaaacaaggauuucgugguugugagcaucccugcggcugggguccuccaggugcagcggugccaagagguaggaggcacaccagguacucaggccuuuuaucgcguugaccugucccuggaguucgcagaaauggccgcucccgugcucuggaccgucgagucauuuuuccaguguguggggaguggaacagaaagcccugcaucuaccgccgcuuuaagaacuacaccauccccgcccucaccuggcccagagacgcccccugccggcgugccacccgcggcaagcagucaggucugggccgcugggccggccgcacaagaguggcugucuagggaucuuuugcaccggccuuccgacgcucuggccaaagcgcgccuauggcuccauccccugccaaugguuagcucgaaggaaucuggaccucaggagguguccaagggucuuggccccuuucugcagaccgccaaaccagcacgaagagggcagacuucagcuaguauuuugcccaggguagugcaagcccagcggggaccucagccaccgcccggcgaagcugguaucccugggcacccaacacccccugccacccucccaagcgagcccgucgaaggagugcaagcauccccguggcguccucgcccaguucugcccacucacccugccuuaacccugcccgugucuagcgaugcuucaaguccauccccucccgcgccaagaccggagaggccugagagccuccuugucucuggccccucagugacacugaccgaaggcuuggggacgguacggccagagcaggaccccgcaaagaguccuggaagcccacuacugcuccgaggucuguccucuggcgauguugccgcucccgaaccuauaaugggggagccgggacaggccucggaagaguuccagccacuugcacgccccuggagagccacucuggcugccgaggaauuggugagccauagguccccuggcgagccacaagaaacaugcucagguaccgaggucgaacggccccgccagacugggccuggccucccgagagagggagcaaggggccacauggaccugaguucuagcgagcccucccaggauaucgaagggccaggauuaucaauucugccugcgcgugacgcuacauucagcacccccucugugcggcagccagauccuuccgccuggcuaaguagcggucccgagcucacgggcaugccacgagucagacuggcagccccgcuugcuguguugccuauggaaccccugccacccgagccuguuaggccagccgcacuccugacccccgaggcuucuuccguagggggaccugaccaagcccgcuaccuugaaucagcgccgggcuggccagugggucaggaggaauggggcgucgcccauacaaguucgcccccuagcacucagacccuguccuugugggcucccacaggggugcuccugccaucuuuaguugagcuggaauauccuuuucaggcaggacggggcgccagccuacaacaggagcucacugagcccacccuggcucuuucagccgaaagucacagaccaccugaguugcaggauuccguggaagggcugucugagaggccgagccgcuga

SEQ ID NO: 53591 - RNA, 1416 nt, Artificial Sequence
  derived and/or modified sequence opt3 from C1orf141__Homo_sapiens__XP_011539768
auggccgagaagauccuggaaaaacucgacgugcuugauaagcaggcugagauuauacuggcaagaaggaccaaaaucaaccgguugcaaagcgaaggccgcaagacaacuauggccauucccuuaacguucgacuuucagcuggaguucgaagaggcgcuagcuaccuccgccucuaaagcaaucucaaagauuaaggaggauaaaaguugcagcaucacaaaguccaaaaugcacgucucuuuuaagugugaaccugagccacgaaaaucgaauuucgaaaagucaaaccuccguccguuuuucauacagacuaauguuaagaacaaagagagcgagaguaccgaacccguggaggaacaucugaaguccagaucuaucaggccuuaccuuuaucugaaagacacaaccgagauggaaaaugccgggccauugaacguacucuacagccagcaccggcaggcuugccgcagaucccugggaucaacugauuuuagucccauguucaauauucaaagcaacgcacauaagaaagagaaggacucuacacuguuuaccgcccagaucgagaaaaagccuaggaagccacucgauuccguggguuuacuggaaggcgaccggaauaaacgcaagaaaucaccccagaugaacgauuucaauauuaaggagaacaaaagcguccgaaauuaucaacuuaguaaguacagaucugugaggaagaaauccuugcugccucuauguuuugaagacgagcucaagaacccacacgcuaaaaucguuaaugugagcccgacgaagacugucaccucgcauauggaacagaaagauacaaaccccauaauuuuccacgacacugaguaugugcggaugcugcuucugaccaagaaccguuuuucuucccacccuuuggagaaugaaaacaucuacccacauaagcgcacaaauuucauucucgagagaaacugcgaaauccugaaaucaaucauugggaaucagaguaucagcuuauucaagccccagaaaaccaugccuacgguacaaaggaaggauauacagauuccaauguccuuuaaagccggacacacuacaguugacgacaagcugaagaaaaagaccaacaaacagacucucgagaaucggucuuggaacacacuuuauaauuucagccaaaacuuuucaagucugaccaagcaguucgugggcuacuuggauaaagcggucauccaugaaauguccgcacagacggguaaguuugagcgaauguucagcgccgggaaacccaccucuauaccgacaucaagugcucuaccugugaaguguuacagcaagcccuuuaaauauauuuacgagcugaauaacgugacuccacucgacaaucugcuuaaccuguccaaugaaaucuugaacgccucuuga

SEQ ID NO: 53592 - RNA, 4485 nt, Artificial Sequence
  derived and/or modified sequence opt3 from C1orf167__Homo_sapiens__XP_011539574
augaagagaaggcugagcggcgugcggacccgccagaacaaaggggaccaacucggagguggccgagcccaccuuaucaagcagacacguccccugacugucgaguggacgaaagauaccccuguuccagaaccgauggaguugagauccgacgcuucucauaaggaaaaugugucacccaaaccugcagccuuaccaaagcccgagcagaggcgguuccgcagaagucuggggauuggacuaagcggcaggcacgaucaguggguaccugguugccaaguggaacgcgggggaccagcggcuacacccuccccuggcgccguccucgaccaggagccaugucgggugcagacuaaccuggcaucuccgggcccccgacuugggcuggccuugaaggauaccacaggacagcucguuaauucgucauuuuggcaacagagcaaccugcagagucuggcuagaaggcggcaggguaaagcacgugaguucgccauacaacaguccaaucucucuaucaacgaaaccagcuccccucauuuaugcccagagcccggcgggucaaguggaccucacaagcugccauggggcccccuuuugagccaggaaccgcuggcucgcccuucuuccugucuaagacaaucaggucuccccgccccagggacuccuagcggagacuuuaggcccacagaggcguucgcaccacuggauggccauacccagcccggccuucggaguuggggagggcuggguucuuggcgaucccgcuuggugggcgagccucucacgcuggaagacuuagccgucccaagccagaaucagacucaagcuccgucgagagccgcagugcaccagcugcucgcuucuguacacugccuugcccaggaggcggccaggcugcggugucaggcaccccaagaaccuccaggggcuguucagcaggauuuguggaccggaggcggucagcccuuuuccgcccauccucaaccaucacagcccgugcuagcuaguagcgacgggcgcagaaggcgucugcggggccaccgagagacagccgcauuccucgaaacuccggccucccugucugauagcugggcucagucaaaacuuaugaguccugagaccacacugggaaccagaacgaaggacuccuugaacccagagcagggccugcccccugcgcauccccucgggagcggagauucuugcucaccauggagucaagacgguagggcacagcgcggcgacccuagcuuacccagaggggucggaucccggggcacugauccauguucuucggccuuuagcaauacagcuugggguguguccccgaaacagaagggggaagagggcgccccuagggaacgcgugcaccgagaggaggaacggaccgcauuccaccugucagacacuguccccgccaguucugcuagcaagaacaaagcccaaaauauuacagcaccagaguccgaagcgaucugcuggcagcuacucucacguuguuuuagaagcuggaggcaucugguuaagcgccagcgggagcccgcugccgcagccguggcucuuggaagauggcaguugcugaggaaaugccuccaagcccuguggcuucgagaagcacagcuggaggcugccuggggccaguacaccaagguauugcucgugcgcucuuuccgggaauggagaaaccuggcguuacagcaaaaacagguccagccucacaugcaggccgggccaggaagucccccuuccaggcgugcucaagguaagggccugagccuagggcgcucuacggugguugauccggcacagcgguccagacucgagcauaccucaccaggaagucugagggaggaagagauugcccagcgacuuuugagccacccccggcaacgcacagacucgagacaugaaagggugcagauccugcaggcucuccagcuggccgucuuuuucuuauggugucaacagaaaaagcgggcacgacaggagagagagacucugcgcaaggcgaccagggccacacagcguacuggcuccuuuccucaggcuuggcacucuaccgccgccgguguggcuuggguagccccacuuagcccccaacaccagcgggcaugguugugcagaugcuucggggccuggcagcaauucguucagaggggcucacgcuaucgagaucaucucgcugacagacggacaggaacccugaggaaaugucuagaacagugggugcgcaugaagcagcugcgugagagugauggcgcgaaagucacucaacucucccugugcagacagaaggccgggcgggaagcaguguacacggcuggaccuggcgccuguggucuuggggccgucggacaggcucaaggccagcaggagcaggguaggggcucuuugcaagacgcaugcuggacacuggccuuauguugggcgcuccugcuuuggaaaaugcgccuguuucagcgacagugggcuaauagcuucuuucagggguugcaacagagaaugcuccagcggucccugaggugguggcaccuacgcgcccugggaccggaugcaaccucaagcugcacuaagacccccagugcccucgaaccacugucuuccagcacacuucaggacucguuggagaaggugccuagagcucccacccugccagauacuuuacaaggcucacuccugugggcagccgggcagaggcagcaaggacagugucuucugcuauggcaggcgcgggcucagcaauuccagggcacagcccguugguaucagcauacgcgccagcgaagaauauuucucucuuggaguaggugggcaaccgcccaaugggcuuggcgggagcuggccucccaccgcgcaugggacagaacuugcagggcuguuuugggucuguggcggcagcgauuacuccagagcagacugguggaauggugggcccaggagcgcggguggaggcuugcgcgggacgcccugugucacuggcauucuugcuggcaaggacagcaguucuugcacgaaaaaugucagacauggguacaaguccaucuccagggccugcagaaggugguuuuucguagcuggcaacaggcagcugcccaccagagaugcaccgugacaaggccugagcagcuacugcuucaauccuacuuccaggcuuggugcgaagucgugcgcgauacugguguacuccgggcacagcaucaggccuuucaagacggccugcgaagaagggccuugggggcuguguucgcgaccuggcgcgaggcacaggagguugccgcuggagcccaggaacagcgggucgcacaagccucacuggcuagauggcguaguuguggccagcaggggcaagaggauggacagcagaaaaaggcgagggcaccccaggcauuuccagcuuggccgguggccccuggcaugcaccacgaagcacaacagcaggccggugagagcgcuggggcccaggcggcacaaugcuggacgugguguugggccuuaugggugcaugaaucuugccggggacaggucucccgcgcucacgccucauggaaaccccgagcuuggguucucgaggcaagugugcagagcgccgugagaggcgguguacagagggcuauccugacccaacuucggccagccgagcugcgcagauucuugaggacaguccagcuccgagugcggcugggccuacccggggcaggaaagacucguuccuguuggacccaggcgacagaacugguuccuccagcccccucucuucaaugcucgcucggcgggagacgcaagccuaggggaacugcuugggcccagcgguguagagagcauagccugugcccggcauuucaguuguggccacaguggcccggccaaucauccugggugccugguuuaccccuguggacccgcgaccaggggccaagggcucacaguucuccugaaccccgagccuguaaagcacagagcaaggcccauaaacggagacucagggcucgcuccugccguauucuggagaagcaggcgcaagcccacggaucagcacuucuguuggcucuaaaaggccacgaugcccugggccaucaggaggaagucccagccgcaccugugccgcgggggacggcuucuagagccgcgggauuccccgcuggucagguuccaggcagcgggauggccgcacucggaggcuguccuaggggucgcgccgcuggggcagaccccgcccagggaguggcgccagagaugggccuggcugauguagucgccgcagacccugccacagcuaguggcuccgccgugaccgcagcugggcgaugggccuucaagaaguggcaccaacggcuugcggccagaagccccaggcgcggagcagcuucuucaccgagaccaugguccaaaccuggucccaagggcccagaaagugggcaggaggccgcacgggcucccaggggauggggcuuaggugccgaacauggggcccagcugcagcucuga

SEQ ID NO: 53593 - RNA, 708 nt, Artificial Sequence
  derived and/or modified sequence opt3 from C1orf204__Homo_sapiens__NP_001127705
augggcaugcuggcccccgggccucuccagggaagaaggccacggaagggucacaaaggccaagaggacgcuguggcaccggggugcaaggccagcggacgcggcucccgagucacccaucuucuggguuaccccacacagaacguuucucguucauugagaaggaaauaugcgccuccacccugugggggaccugaagauguggcuuuagccccaugcacugcagccgcugcaugugaggccggccccaguccuguauacgugaaggucaaaagcgcugaaccagccgacugcgcggagggcccggugcaguguaagaaugggcugcuaguuuccucuccccacugcgaggaaccuugugcacauucgugcgcccacccaggacuucccccucaucuggugcacaagcucccacugucauauuugcagacgcaagauaccgacgcugccagccggcgcaucaacgcaccccucgcugccgguuggaguuggcugagacuguggcucgucacauuagcguccggcguggauuucccgcagguaucugccuggaugagggcacugccuagccccgacuguccagggcuucggacuaccggagagcagaugcagaaauugcugcuaaaggaaaauaaaguuaagacacgcaaauccaagcgaagaucaggcgaggguagucaccucaccacuagcauucuggaacaauga

SEQ ID NO: 53594 - RNA, 819 nt, Artificial Sequence
  derived and/or modified sequence opt3 from C1orf226__Homo_sapiens__NP_001078844
auguucgagaaccugaauacugcccucacacccaaacuucaggcuagcagauccuuuccucaccugucuaagccaguggcaccgggcucagcccccuuggggaguggagaaccugguggcccaggguuaugggucggaagcucccaacaucugaagaaccuaggcaaagcgaugggugcuaagguuaaugacuuccucaggcggaaagagcccucuucgcuggggucagugggaguaacugaaaucaacaagacggccggcgcacagcuugccagcggcaccgaugcugcaccugaggccuggcuggaagacgagcgcaguguguugcaggagacauuuccacgacucgaucccccuccaccgauuacucguaagagaacccccagggcucugaaaacaacccaggacaugcugauauccucucaaccuguccucagcuccuuagaauacgggacugagccaucacccggacaggcccaggauagugcgccuacagcacagccagacgugcccgccgaugcuagccaaccggaagccaccauggagcgggaggaacgcgguaagguucugccuaauggcgaggugucucuuuccguccccgacuugauccacaaagauucacaggacgaaagcaagcugaaaaugacggagugcagaagggcaaguucuccaucccuaauugaacggaacggguucaagcucagccugucgccuaucucucuugcugaguccugggaggauggaucacccccaccccaggcccgcaccaguagccuggacaaugaaggcccucauccagauuugcucuccuuugaguga

SEQ ID NO: 53595 - RNA, 1323 nt, Artificial Sequence
  derived and/or modified sequence opt3 from C1orf228__Homo_sapiens__XP_011539646
augaccagcaucaaggagcaggccgcuauuuccagacugcucucuuuccuucaagaaugggacaacgcaggcaaaguggccaggucacacauacuggauaaguuuaucgagacaaaucaggggaaaacugcgcccgaauuggagcaggaguucagucagggagcuagcuuauuucugguccggcuaacgaccucccuccgcauuacauacaugacugacucuugccuggaaaaacuucugcgaucgaucgguauuuucuugucagccguuagcaguaaccguuaucucaucgaguuucuggaagugggcgggguacugacccucuuagagauacugggacuugaaaagaucaaggaggaggcaaagaaagaauccgugaaguugcugcaagucauugccaauucuggcagaacauacaaagagcuaaucugugaaagcuauggugugagguccauugcugaguuccucgcaaagucaaaaagugaagagacccaggaggaaguucaggugcugcuugauagccugguccaugggaacccuaaguaccagaaucaaguguauaagggauugaucgcccuccugccaugcgagucuccgaaagcucagcaguuaucccugcagacucuccggacagcccaacccauaauuggcaccacgcacccuucaaucguagacuguguucuuaaggugcugggcacuaugcauuuggaaguccaguacgaggcgauugaacuaaucaaagaucuggugggguaugacgugcgccaggcacuccugaagggacuugucgcccuguugaucccaagcguuaaagagauuaguaagcuccaagcuaaaauacugucugaucccuccguguuacagcugaccccuagccuaccaauguuucuccagcaggccgcagcugccaaggcgaucgguguacuggccagaaacgacaugucgauugcagaggaacuuuuguaccugagggugguccggggccucauggcugccauggggaauacagaucacucuaacucccaacgccuggcuucacuuacucuggagugcuucgugcagauguuucccuugguugccgaacaugugcgaaaguguaugggagaggaacucuaccagcuguucuuaaguaaugcagaggaccuguauaugaaaaucgauagcauacaggccgacauucuagcugcgaacaccgucaaugugacaaaggcacucugccugcacggcuccucuuacagcaugaacacccuuuaugguucaagagauagugcccaaauggcuuacuugacgcacuuugaggaagacguagaguccaaagaauga

SEQ ID NO: 53596 - RNA, 1296 nt, Artificial Sequence
  derived and/or modified sequence opt3 from C1orf27__Homo_sapiens__NP_001157717
augggcagaaccuacaucguggaggaaacagucgggcaguaucugagcaacauuaaucuccaaggaaaggccuucguuuccggucuucugauaggccaguguucuucacagaaagacuacgugaucuuggcuacuaggacgcccccuaaggaggaacagagugagaacuuaaaacacccaaaggcaaaacuggauaaucuagacgaagagugggccaccgagcaugcgugccaaguaagccggaugcuccccgggggacugcuugugcugggcgucuuuauuaucacaacuuuggaacucgcuaacgauuuccagaaugcccugcgccgacugauguuugcaguggagaaguccauuaaccguaagagacucuggaauuucaccgaagaggagguuucugaaagggugacauuacacaucugcgccucgaccaaaaagauauuuugucggacuuaugacauccaugauccgaaaucaagcgcucgcccugcagacuggaaguaccagaguggucuguccucuagcuggcuuuccuuggagugcacaguccacauuaacauccauauuccacugucagccaccagugugagcuauacgcuagagaaaaauacuaagaacgggcucaccagaugggcuaaggaaaucgaaaauggaguauaccugauaaacggccagguuaaagaugaggacugugaucuucuggagggccaauugcucaauucugaccacagguccacagccacugugcagauuugcucagggagcgucaaccugaagggagcggugaaaugucgggcauauauccacaguucuaagcccaaagugaaggaugccguccaggcuguuaaacgcgacauuuuaaauaccguggccgaucgaugcgaaaugcuguucgaggaccuccuucugaacgaaaucccugagaagaaggacuccgaaaaagaguuucauguauugccauacagaguguucgucccccuaccugguagcacagugaugcugugugauuacaaguuugacgaugagucggcagaagagaucagggaccacuucauggaaaugcucgaucauaccauucagauagaggaccuggaaaucgcugaggagacgaacacugccugcaugucuuccucaaugaauagucaagcgagccuugauaacacagacgaugaacagccaaaacagccgauuaagaccacuaugcuguugaaaauccaacagaauauaggcguuauugccgcauuuacaguggcuguccucgccgcugggaucuccuuccacuauuuuucugacuga

SEQ ID NO: 53597 - RNA, 330 nt, Artificial Sequence
  derived and/or modified sequence opt3 from C1orf61__Homo_sapiens__NP_001307383
augggcacccuggggagcaucuucucccccggagccgguggcuuuugcacaacucucccuccaucuuuccuuagaguggacgauagggcuacgucaaguaccacagacagcucccgggcaccgucuucgccccgcccuccagggucaacuagccacuguggaauuaguacccgaugcacagagcguugucugugcgucuugcccuuaagaaccucccagguuccugaugugauggccccacaacaugaccaggaacccaagaggcggauguacuuuauauggcugggcuggaucccuucugauaaaccaagccagcuaacugagcgcuga

SEQ ID NO: 53598 - RNA, 588 nt, Artificial Sequence
  derived and/or modified sequence opt3 from C1orf86__Homo_sapiens__XP_011539224
auggaggccgcuagaaggccccggcugggccucagccgccgacguccuagaccagcagggggaccguccgguggcaggcccugguuccuucugggaggggacgaacgggagcgcuugugggccgaauuacugagaaccgugucuccugagcuaauccucgaucacgaagucccaucacugcccgcguuuccuggccaggagccaaggugcggucccgagccuacagaaguuuucacuguggggccaaagacguuuaguuggaccccguuucccccugaccuuuggggaccaggccggagcuaccgccuguugcauggcgcugggggacaccucgagucccccgcccgaucucugccucaaagaccagcacccgauccguguagggccccucggguagaacagcagcccucgguggagggugcugcagcccugcguucaugcccaaugugucagaaagaguucgcuccucgcagcaagaacaguuccggcaugagaaggcaucggucucccaaacucgccgcgaauaacaauaacaauaagcgaaaagggcgcgcaagaugguuaacaccagucauucccgcccuguga

SEQ ID NO: 53599 - RNA, 762 nt, Artificial Sequence
  derived and/or modified sequence opt3 from C1QB__Homo_sapiens__XP_011540361
augaugaugaagauccccuggggcagcauuccugugcugaugcuccuucuguuguuagggcugauagacaucucccaggcccaacuaucuugcaccggaccaccggcuauucccgguaucccuggcauuccagggacacccggaccugauggccagccagguacucccgggaucaaaggagagaagggccucccuggccuggcaggggaccacggagaguucggugaaaaaggcgauccagggauaccgggaaaccccggcaaggucgguccuaaagggccaaugggacccaagggcggcccuggggccccaggagcgcccgguccgaagggcgaaucaggggacuacaaagcuacgcagaagaucgccuuuagugcaaccagaacaauuaauguuccucuuaggcgggaucagacuauccgcuucgaccaugugauuaccaacaugaauaacaauuaugagccccgaagcggaaaauuuacauguaagguaccaggccuguacuauuucaccuaccacgccuccucucgugguaacuugugcgugaaucucaugagagggagggaacgggcucaaaaagucgugacuuuuugugauuaugcauacaacacauuccagguuaccacgggcggaauggugcugaagcuggagcagggcgagaaugucuuucuccaggccacugacaagaacucguuacuggggauggaaggagcuaauucaaucuucagcgguuuucuuuuguucccugauauggaggccuga

SEQ ID NO: 53600 - RNA, 849 nt, Artificial Sequence
  derived and/or modified sequence opt3 from C1QBP__Homo_sapiens__NP_001203
augcugccccuccuuagaugcgugccuaggguccugggcagcuccguugccggguugcgggcugcagccccagcgucuccguuccgccaguuacugcaacccgcuccucgacuauguacccguccauuuggacuccugucagugagagccgguagugagaggcggcccggccuucugcgcccuagagggccaugcgcauguggaugcggcugugguagcuugcacacagacggggauaaggccuucguagacuuucucuccgaugaaaucaaagaggaaaggaagauucagaaacauaagacucugcccaaaaugucuggaggcugggagcuggaacucaacggcacggaggcuaaguuagugcggaaggucgcaggggagaaaauaaccgugacauucaauaucaacaauucgauuccuccaacuuuugacggagaagaggaaccgucacagggucagaagguugaggagcaagaacccgagcugaccagcacaccuaacuucguggucgaagugaucaaaaaugaugacggcaagaaagcccuuguauuggauugccacuacccagaggacgaaguugggcaggaggaugaggcugaaagugacaucuuuuccauucgcgaggugucuuuccagagcaccggagaauccgaguggaaggauacuaacuauacacugaauaccgacucacuagauugggcccucuacgaccaucugauggacuuucuugcggaucgaggcgucgacaacacguucgcagaugaacugguggaguugaguacugcccucgagcaccaggaauauauaaccuuucuggaggacuuaaagagcuucgugaaaucucaauga

SEQ ID NO: 53601 - RNA, 777 nt, Artificial Sequence
  derived and/or modified sequence opt3 from C1QL1__Homo_sapiens__NP_006679
augcugcucgugcuugucguucugauccccguguugguaagcuccggcgggccugagggacacuacgaaauguuagguaccugcagaauggugugugacccauauccggccaggggccccggggcuggagcacggacagauggcggugacgcccugucugagcagucaggggcgccuccacccaguacucuaguccaaggaccucagggcaagccaggccgcacggggaaacccggaccuccagguccgcccggcgauccugggccacccggaccugugggcccacccggugaaaagggggagccgggaaaaccugggcccccaggccucccuggggcuggagguagcggcgccauuuccaccgcaacauacacuaccguuccccgaguggccuucuaugcugggcugaagaacccacaugaaggauacgagguccuuaaauuugacgaugugguaacaaaucugggcaacaauuaugacgcagccucugguaaguuuaccugcaacauacccgggacuuacuucuucacauaucacguuuugaugcguggcggagauggcaccucgaugugggcugaccucuguaagaauggccaggugagagccucagcgaucgcacaggaugccgaccaaaacuacgauuacgcuagcaauagugucauucugcaucuggacgccggagaugagguguuuaucaaacucgacgguggcaaggcacacgggggaaacuccaauaaauauucuacguucagcggcuuuauuaucuacuccgacuga

SEQ ID NO: 53602 - RNA, 768 nt, Artificial Sequence
  derived and/or modified sequence opt3 from C1QL3__Homo_sapiens__NP_001010908
auggugcugcuccuugucauccugauucccguuuuggugagcuccgccggcaccucugcucacuacgagauguuagggacaugcagaaugguaugugacccuuauggagguacuaaggcaccaucaacggccgcgaccccggauaggggccugaugcagagucuacccacauucauacaagggccuaaaggagaagcuggccggccagguaaggccgggccccgcggaccuccaggcgagcccggcccuccagggccgaugggacccccuggugaaaaaggcgagccagggcgacagggacuccccggcccuccaggugcacccgggcugaacgccgcuggagcaaucagcgccgcuacuuacuccaccgugccgaagauugccuuuuaugcgggccuuaaacgucagcaugaaggcuacgagguccugaaguucgacgaugugguuacaaauuuggggaaccacuaugacccuaccacuggaaaguuuacaugcucuauccccgguauuuacuucuuuaccuaucaugugcucaugagaggcggggauggaacgucgaugugggcagaccuguguaaaaauaaccaggucagggccucagcuaucgcccaagaugcagaccagaauuacgauuacgcuagcaacagugugguacugcaccucgagccaggcgacgaaguuuauauaaaguuagauggugggaaagcccauggcggaaauaacaauaaguacuccacuuucucuggcuuuaucauuuaugcggacuga

SEQ ID NO: 53603 - RNA, 846 nt, Artificial Sequence
  derived and/or modified sequence opt3 from C1QTNF1__Homo_sapiens__NP_112230
augggcagcagagggcagggacugcuccuugccuacugccuguuguuagcuuucgcauccggucuggugcuaucuagggucccccacguucaaggcgagcagcaggaaugggaggggaccgaagaacucccuucaccaccggaccaugccgaacgggcggaggagcagcacgaaaaguaucgccccagucaagaucagggacugccugcuagccgaugucuucguugcugugacccaggcacauccauguaccccgccacugcagugccucagaucaacauuacgauacugaaaggugagaagggggauagaggagacaggggcuugcagggcaaauaugggaagaccggaucugccggugcucggggccauacagggccaaaaggacaaaagggcucgaugggugcacccggggaacgcugcaagucacacuacgccgcuuuuagcguaggaaggaaaaagccuaugcauaguaaucacuauuaccagacugugaucuucgauaccgaguuugucaaccucuaugaccacuucaauauguuuacaggcaaauucuacuguuacgugccaggccuguacuuuuucucccugaacguucauaccuggaaucagaaggagacuuaucuccacauuaugaaaaacgaagaggaaguggucaucuuauuugcccaggugggggauagaucuauuaugcaaagccagucccugaugcuugaguugcgggaacaggaccaaguauggguucgccuguauaagggagagcgagagaaugcgaucuucucagaggagcuagauacauacauaaccuuuagugguuaucucgugaagcaugcaacggaaccguga

SEQ ID NO: 53604 - RNA, 741 nt, Artificial Sequence
  derived and/or modified sequence opt3 from C1QTNF3__Homo_sapiens__NP_112207
augcuguggagacagcucaucuacuggcaacuucuggccuuguucuuuuuacccuucugccugugucaggacgaguauauggaaagcccucagaccggcgggcuaccaccggauugcuccaaguguugccacggagacuacucuuuuagggguuaucaggggcccccuggcccacccggaccuccaggcauucccgguaaccaugggaauaacggaaauaacggcgcuacaggccacgagggggcaaaaggagaaaagggugauaaaggcgaccucgggccucggggagagcgcggccaacaugguccaaagggggaaaaaggauacccgggcauacccccugagcugcagaucgccuucauggcgucacuugcuacucacuuuaguaaucagaacagcggcauuaucuucuccucuguggagacgaauauugggaacuuuuucgaugucaugaccggacgauuuggugccccaguuucgggcguguauuucuuuacauucucaaugaugaagcaugaagacguagaggaaguguacgucuaucugaugcacaaugggaacacuguguuuagcauguacaguuacgagaugaagggaaaauccgauaccucuagcaaucacgcaguuuugaagcucgccaaaggcgacgagguguggcugcguauggguaacggggcucugcauggcgaucaccagagauucuccacauucgcaggauuucucuuauucgaaaccaaguga

SEQ ID NO: 53605 - RNA, 732 nt, Artificial Sequence
  derived and/or modified sequence opt3 from C1QTNF5__Homo_sapiens__NP_001265360
augagaccccugcucgugcuucuguuguuaggccuggccgcugggagcccuccacuagacgauaacaagaucccgucccucugccccggacacccuggucugccaggcacccccgggcaucacggaucucagggccuuccugguagggacgggcgggauggacgcgacggcgcaccaggcgcccccggggagaaaggagaagguggccgaccugggcugccaggaccgcguggcgaucccgguccuagaggggaggcgggaccagcuggccccacaggcccugccggggaauguucagucccacccaggagugcauucagcgccaagcgguccgagucucgcguuccgccucccucggacgcuccauugccuuuugauagagugcucguaaaugaacaaggacauuacgacgcagugacugguaaauucacgugccagguccccggcguguauuacuuugccguucacgcuaccguguauagggccucacugcaguucgaucuggucaagaacggggagagcauugcguccuuuuuccaguuuuucggaggcuggccaaaacccgcaagucucucugguggggccauggugcgguuagagccugaagaccaaguauggguucaggugggcgucggagauuacauaggcaucuaugcuagcauuaagacagacuccacuuuuucaggguuccugguguacagugauuggcauagcucuccaguguuugccuga

SEQ ID NO: 53606 - RNA, 837 nt, Artificial Sequence
  derived and/or modified sequence opt3 from C1QTNF6__Homo_sapiens__NP_872292
augcaguggcugagagugagggagagccccggcgaagccaccgggcaccgggucacaaugggaacugcugcacucgguccuguuugggccgcgcuucuguuguucuuacugaugugcgagaucccaaugguggaacuaacguuugaccgcgcuguagccuccggcugucaacgaugcugugauucugaggacccgcucgaucccgcacaugugucaagugccagcuccucugggcguccucacgcucugccagaaauuagacccuacauaaacaucaccauucuuaagggagacaaaggcgauccugguccaauggggcugcccggauauaugggcagggagggcccucagggggagccaggaccgcaggguucgaagggcgacaaaggggaaaugggaucacccggcgcaccuugccagaagcgguucuuugccuucagcgucggucgcaaaacagcuuugcauaguggggaggauuuucaaacucuccuguucgaaagaguguuuguuaaucuggacggauguuucgauauggccaccggccaguuugcggcaccacucaggggcaucuacuucuuuuccuuaaacgugcacucuuggaauuauaaggagacauacguccauauuaugcacaaccagaaggaggccgugauccuguaugcucagcccagcgaacgguccauaaugcaaucacagaguguaaugcuugacuuggccuacggggaucgcguuugggugcgacuguucaaaagacagagggagaaugcaaucuauagcaacgacuuugauaccuacauuacuuucucuggacaccuaaucaaggcugaagacgacuga

SEQ ID NO: 53607 - RNA, 891 nt, Artificial Sequence
  derived and/or modified sequence opt3 from C1QTNF7__Homo_sapiens__NP_001128642
augagcagacaggagcccaagauguucgugcugcucuacgucaccuccuuugccaucugcgcuucuggccaaccuagggggaaccagcuuaaaggagaaaauuauucaccacgguacauuuguaguauaccgggucugcccggcccuccagggcccccuggagcaaacggcagcccagguccccacgggcgcaucggauugccuggccgagacggccgugaugggagaaagggagagaaaggugaaaagggcacagccggguuaaggggaaaaacuggcccacugggucuagcgggggagaagggagaccagggcgaaacgggcaagaaagggccgauuggacccgagggugagaagggcgaaguugggccuaucggaccacccggcccuaaaggugaucgcggggagcagggcgacccaggacuccccggcgugugccgguguggguccauuguacugaagucugcuuucucggugggaaucaccacaucauauccggaagagagacuuccuauaaucuuuaauaaaguccuguucaacgagggugaacauuacaaucccgccacuggcaaguuuauuugcgcauucccagggaucuauuacuuuagcuaugauauuaccuuggccaacaagcaccucgcuaucggacuggugcauaauggccaauacaggauaaaaacauucgacgcaaacaccgguaaucacgauguugccaguggguccacugugauuuaccugcagccugaggacgaagucuggcucgagaucuuuuucacagaucagaacggcuuauuuucugaccccggaugggcugauagccuguucuccggcuuucuuuuguauguggacaccgauuaccuggacucaauuagugaagacgaugagcuauga

SEQ ID NO: 53608 - RNA, 324 nt, Artificial Sequence
  derived and/or modified sequence opt3 from C1QTNF9B-AS1__Homo_sapiens__NP_001014442
auguggauccugagcaaccucaugggcaccuccgaggaagggaaucuucugucuacagugucacccacugucaaggccuuguucggaaaaacgagaguuaguccuauuuuuccauucagcccgaggucccccuuucagccuuuaauaccacggacccccgguucuccuuggggcccaguggggcccgcuucgccucugggaccaggcuucccgaucggucccauggggccuggaaagccaguaggccccaaaggcccuaugcuaccacucgggcccucaggaccgguggguccuacaagcccccuguuuccauucugcccuuga

SEQ ID NO: 53609 - RNA, 2118 nt, Artificial Sequence
  derived and/or modified sequence opt3 from C1R__Homo_sapiens__NP_001724
auguggcugcucuaccuucuggugcccgccuuguucugcagagcuggcgggagcaucccuauuccacagaaguuauuuggagaggucaccuccccgcuguuccccaaaccuuauccaaacaauuuugaaacaacuacgguuauaaccgugcccacagguuacaggguaaagcuaguguuccaacaguuugaccucgagccuucugaaggcuguuucuaugauuacgucaaaaucucagcagacaagaaaagucuggggcgguuuugcggacagcuuggcagcccacuggguaaucccccugggaagaaggaguucaugucccagggaaacaaaauguugcucacuuuucacaccgauuucucuaacgaagagaauggcacaauuauguuuuauaagggcuuccuggccuacuaucaagcgguggaccuggaugagugugcuucgcgcucaaaacucggggaagaggacccacagccgcagugccagcauuuaugucacaacuacguuggagguuacuuuugcagcugucgacccggcuaugaacugcaagaggaucgucauaguugccaggccgaguguuccucugaacuuuacaccgaggcaagcggguauaucuccucauuggaauacccuagaaguuauccacccgaccugaggugcaauuacagcauucggguggagcgcggacuaacucuccaccugaaguuccuugaaccuuucgauaucgacgaucaucagcagguccacuguccauaugaccaacugcagauauacgccaacggcaaaaauaucggugaguuuugcgggaagcagagacccccggauuuggacacaucuuccaacgcuguggaccuccuguucuuuaccgaugagucaggagacagcaggggcuggaaguuacgguacacgacugaaauuaucaaaugcccucaacccaagacccuggaugaguucacaauuauccagaaucuccagccacaguaucaauuucgcgacuacuucauagcaacuuguaaacagggcuaucagcuuauugaagggaaccagguacugcacaguuuuaccgccguuugccaagaugacggaacauggcaucgagcuaugccuagauguaagaucaaagauugcggucagcccaggaauuugccaaacggcgacuuccgguacaccacgacuaugggggugaauacauauaaggcccguauucaguacuauugucacgagcccuacuacaaaaugcagacccgcgcgggaucuagagaauccgagcaaggcgucuauacuugcacagcacaggguaucuggaagaacgagcagaagggggagaaaaucccuaggugucuaccagugugcggcaagccggugaaccccgucgagcagcggcaacgaauuauaggaggccagaaagccaagauggggaauuuuccuuggcagguuuucaccaacauccauggacgcgguggcggggcucugcucggagauagauggauucugacggccgcacacacccuuuacccaaaagaacacgaggcucaaagcaaugccucgcuggacguguuuuugggccauacaaacguagaagaacucaugaagcuggguaaucaccccaucaggcgggugucuguccauccugauuaucgccaggacgaguccuacaacuucgaaggggacauagcguuacuggagcuagaaaauucagugacucucggcccaaaccugcuucccauuuguuugccggauaaugacaccuuuuaugaucugggacucaugggcuacguuaguggguucggagugauggaggagaagaucgcccacgaccugagauucgucaggcuuccuguggcaaacccacaggcuugcgaaaauuggcugcgugguaaaaaccggauggauguauuuagccagaauauguucugugccggccaucccuccuugaagcaagacgcuugccagggggauucuggaggcguuuuugccgugcgagacccuaacacagauagaugggucgcaacugguaucgugagcugggggauuggcugcucaaggggauauggcuucuacaccaaaguccucaauuacguggacuggaucaagaaagagauggaagaggaagauuga

SEQ ID NO: 53610 - RNA, 564 nt, Artificial Sequence
  derived and/or modified sequence opt3 from C1RL__Homo_sapiens__NP_001284572
augcccggcccuagagugugggggaaguaccuguggaggagcccacacuccaaaggaugcccgggugccaugugguggcuccuucuguggggcgucuugcaggcuugucccacccgggggucuguuuuacuggcacaagagcuaccucagcagcucacaucaccaggauaucccgaaccuuacggcaagggucaggagaguagcacugacaucaaagccccagaaggguucgcggugcgccugguauuucaagauuucgaccuugagcccucccaggauugcgcuggagacucugugacgauuucguuugucggcucagauccuagccaguucuguggccagcaagggaguccacugggacgaccgcccggucagcgugaauuuguguccucuggcaggagcuugagacucaccuuccggacacagccuuccucagagaacaagacugcccaucugcacaaaggguuucuggcacucuaucagaccguuggagagugcccaaguuggggcugucgcgaaggugccagcgugcccucucaugacccugggauauucaagccauga

SEQ ID NO: 53611 - RNA, 2067 nt, Artificial Sequence
  derived and/or modified sequence opt3 from C1S__Homo_sapiens__XP_005253817
auguggugcaucgugcuguucagccuccuugccugggucuacgcugagcccaccauguauggcgaaauucuguccccuaacuacccacaggcauauccgucugagguugaaaagucaugggacauagaggugcccgaaggguacggaauccacuuguauuuuacacauuuagauauugagcugagugagaauugugccuacgacagcguacaaaucauuuccggugauacugaagagggcagacuaugcgggcagaggucuucgaacaauccucacucaccaaucguggaagaguuccagguccccuauaacaaacuccaggugauauuuaagagcgacuucaguaaugaggaacgguuuacgggauucgcggcuuacuacguugccaccgauaucaacgaguguacagacuuuguggaugucccuugcucccauuucuguaauaacuuuauuggcgguuauuucugcucuuguccacccgaauacuuucugcacgacgauaugaaaaauugcggggugaacuguagcggagacguauucacugcacuuaucggcgagauugccuccccuaauuauccaaagccguaccccgaaaacucacgcugcgaguaucaaauccgacuggagaaaggcuuucagguuguggucaccuugcguagagaagauuucgacguggaggcugcagauagugccgggaauugucucgacagccugguguucgucgcuggagacaggcaguuugguccuuacugcggccauggguucccaggaccccugaacauagaaacaaagucuaaugcccucgauauuaucuuucagaccgacuuaacuggccaaaagaaagguuggaagcugcgguaucacggggauccuaugccaugccccaaagaggacacaccgaacuccguuugggaaccugcgaaggcaaaauacguguuccgcgauguagugcagauuaccugucuugacggauuugaggucguggagggcagaguuggcgccacgucauucuacagcacuugccagaguaacgggaaguggucuaauuccaaguugaaaugucagcccguggauugcggaaucccagaaagcaucgagaacgguaaggucgaagacccugagucgacccuguuuggcucugugauuagguauacaugugaggaacccuacuauuacauggagaaugggggaggcggugaauaucacugcgcugggaacggcuccuggguaaaugagguucuaggaccagaacuccccaaaugugugccugucugcggcgugccacgggagccguucgaggaaaagcaacgcauaaucgggggaucagaugccgacauuaaaaacuuucccuggcaggucuucuuugauaauccuugggcugguggcgcacugaucaacgaguacugggugcuuacugccgcgcauguuguggaagggaaucgagagccaaccauguauguaggaaguacaagcguccagaccuccagacuggccaagucuaaaauguugacgcccgaacacguguucauacauccuggcuggaagcuccuggagguuccagaggguaggacuaacuuugacaaugacauugcauuagugcggcugaaggaucccgucaaaauggggccgacagugagcccuaucugucucccaggcaccucaagugacuacaaccuuauggauggagaccugggcuugaucuccggguggggacguacugaaaagcgcgauagagcuguaaggcuaaaagccgcucggcugcccguggccccucuccgaaagugcaaagagguuaaggucgaaaagcccacagcagacgccgaggcuuacguguucaccccaaauaugauuugugcggguggcgaaaaagggauggauagcugcaagggagacucuggcggugcauucgccgugcaagauccuaacgacaaaacgaaguuuuaugcugccgggcuggucucauggggcccccagugcggaaccuacggccuuuauacacgcguuaaaaauuacguggauuggaucaugaagacuaugcaggagaacaguaccccaagagaggacuga

SEQ ID NO: 53612 - RNA, 3534 nt, Artificial Sequence
  derived and/or modified sequence opt3 from C20orf194__Homo_sapiens__NP_001009984
auggacguguacccgccuagaaggcagggccugccacgggcccgcagccccgggggauccucucgagguucacccagugucagcugcucccgucucagacaaguucagucuauccuuacccagucgucaaagagcaggccugauggcauucuguguauauuggggaucgacagucgguauaacgagggaugccgcgaauuagcuaauuaccugcuauucggccucuauaaccagaauacauccgauuuugagaaaacugguuucucugaagaggugcuggacgauguaauuauccuuauuaagagcgacuccgugcaccuguacuguaacccagucaauuuuagauauuugcuccccuacguggcacauuggaggaaccugcacuuccauugcaugacggaaaaugaguaugaggaugaagaggccgcggaagaguuuaaaaucaccucauucguugacauggugcgggauuguagucgcauagggaucccuuacagcucucaaggacaucugcagauuuuugacauguucgucguggagaaguggccaaucguacaggcuuuugcccucgaaggcauuggcggggauggauucuuuacaaugaaauacgaguuacaggacguuucccugaaccuuuggaauguguauucaaagauggaucccaugagcuuggaaagucugcuaucugacgaccucgucgcauucgagcaccaauggacuuccuuuuucgccaacuucgauaccgaaaucccuuuucugcuugagcugagcgagucgcaggcuggugaaccauuccgaucuuacuuuucccacggcaugauaucaagucacauuacagagaauagcccgaacagacagcccuucguguuguuugggaaucauuccaccagggaaaaccucaaugcaggaaacuucaacuuuccuucugagggccaccuggugcggagcacugguccagggggaucauucgccaagcauauggucgcucagugcguuagucccaaaggcccuuuagccuguucccguacauauuucuucggcgcgacccacgugccauaccuugggggagacagcaagcuccccaaaaagacggaacaaauccgccuucugucucagauuuaugcagccguaaucgaggcuguguuggccgguaucgcaugcuacgcuaaaacuucaagucuaaccaaggccaaggaggucgcggaacagacacugggcagcgggcucgauuccuuugagcugauuccguucaaagccgcacuuagaucuaagaugacuuuucacauacaugcugugaauaaccaaggaaggaucguuccucuggacucggaagauagcuuguccuucgugaaaaccgccuguauggcugucuaugacauucccgaucuccugggcgguaaugggugcuuaggcucagugguauucagugagucuuuucugacaagccagauccuaguuaaggaaaaagacggaaccgugacgacugagacauccucagucgugcucaccgccgcagucccacgguucuguagcuggcugguggaggauaacgaaguuaagcugucugagaaaacucagcaggccgugcgaggcgacgaauccuuuuuggggacauaccugaccggaggugagggcgcuuaccucuauaguagcaaucugcaaucuuggccugaggaagggaacguacacuucuuuuccucaggacuucuguucagucauugccgccacagaagcauaauuaucucgaaggaucauaugaacuccaucucuuuuuacgacggcgacagcacgucaaccgucgcggcauugcucauugauuucaagaguucccuguuaccccaucugccagugcacuuucacgguucuagcaauuuccuaaugaucgcccucuuucccaaauccaagauuuaucaggcuuucuacucagagguuuuuagccuguggaaacagcaggacaauagugggauaucucuuaaggugauccaagaagauggcuuguccgucgagcagaaaaggcugcacagcucggcccagaagcucuuuucagcacugucucagccugccggagaaaagcggaguuccuuaaaacugcuuagcgcuaaguugccagagcucgacugguuccugcaacauuuugccauuucuagcaucucccaggagccggugaugcgcacacaccuacccguacugcuccagcaggcagaaaucaacacuacccacagaauugagucagauaaagugauaaucaguauuguuacaggccugccugggugccaugcgagcgaacuuugugcuuucuuggucacucugcacaaggagugcggaagguggaugguguaucgucaaaucauggacucuuccgaauguuuucaugccgcacacuuccagcgguacuuaucaagugcccucgaggcucagcaaaaucgaagcgccagacaguccgcauauauuaggaaaaagacccgccugcuugugguccugcaggguuacacagauguuaucgacguggugcaggcuuugcaaacccauccagauucuaacguaaaggccucguuuacuauaggcgcgaucacggccugcgucgagcccaugagcuguuacauggaacaccgguuccucuuuccuaaaugccuggaccaguguucacaggggcuaguguccaauguuguguucacaagucacaccacugagcagagacauccacugcucguccaacugcagucucuuauuagggcugcaaaccccgccgcugccuuuaucuuggcagaaaauggaauugugacccgcaacgaggauaucgaacugauauuaagcgagaacuccuucucaucuccggagaugcuccgaagccgguaucugauguacccuggcugguaugaagguaaacuuaaugcggggaguguuuacccacugauggugcagauuugcguaugguuuggccguccccuagagaagacaagauucgucgccaaguguaaagcuauccaguccagcauuaagccuucucccuucucaggaaacaucuaucacauacucggcaaggugaaauuuuccgacagugaaaggaccauggaggugugcuacaauacucuggccaacagcuugucgaucaugccaguccuggaggggccuacacccccaccggauucuaaguccguuagccaagacucaaguggacagcaggaauguuauuuaguguucauuggcugcucucucaaagaggacuccaucaaggauuggcugcgccaaagcgcaaaacagaagccucagcggaaagcucuuaagacgagagguaugcugacccagcaagaaauuaggucaauccauguaaagcgacacuuggagccccucccagccggguacuuuuacaauggaacucaguucgugaacuuuuucggcgacaaaacagauuuucauccccugauggaccaguucaugaaugauuaugucgaagaggcaaaccgcgagauagaaaaguacaaucaggagcuagaacaacaggaguaucacgaccuguuugaacuuaaaccuuga

SEQ ID NO: 53613 - RNA, 618 nt, Artificial Sequence
  derived and/or modified sequence opt3 from C20orf196__Homo_sapiens__NP_001290406
auggccgcuagagacgcaaccagcggcucccugucugaggaaucaagugcccucgaucuucccagcgcgugcgacaucagggauuacgugcugcaggggccuucccaagaggcuaacucugaagccuucucgucauuggaguuucacagcuucccauauaguuccgacgucgauccggacacaucuaauuuaaacauugaacagaauaacagcuggacugcagagaauuuuuggcuggaucccgccguuaagggacaguccgagaaagaagaggacgauggucuacggaagucacucgaccgcuucuacgaaauguuuggccauccucagccagggagugcuaacagccugucugcauccguguguaaaugccuuucacaaaagauaacgcagcugcgaggacaggagagccagaaauaugccuugcguaguuuccaaauggcuagaguaaucuuuaauagggauggcuguucugugcuccagcggcacucccgcgacacccauuucuacccccuggaggaagguagcacaucgcuggaugacgagaagccuaacccagggcucucuaaggacauuacucacuuuuuacugcagcagaaugucaugaaagaucuuuga

SEQ ID NO: 53614 - RNA, 600 nt, Artificial Sequence
  derived and/or modified sequence opt3 from C20orf27__Homo_sapiens__NP_001034229
auggccgcugcaaacaagggcaaaugccugcccgggguggucggacucgcccaggcgcuuccuguugguccaggcagaagggcuaucgccgcagggaauaagccgcgggugcgcagcauucgauucgccgcuggacacgacgcagagggcucccauucucacguacauuuugaugaaaaacugcacgacucaguggucauggugacccaagagagugauagcuccuucuugguuaaggugggguuuuuaaaaauacugcaucguuacgaaaucacauucacucuacccccuguccacagacucucuaaggacgugagggaggccccaguacccucgcugcaccuuaagcuguugucaguugugccugucccagaagguuauagcgugaaaugugaguacagugcucauaaggagggagugcucaaagaagagauucugcuggccugcgaaggcggcacggggaccuguguccggguuacagugcaggcgcgcguaauggauagacaccauggaacucccaugcucuuagacggugugaagugcgucggcgcagagcuggaguaugauuccgaacacucugacuggcacggguuugauuga

SEQ ID NO: 53615 - RNA, 414 nt, Artificial Sequence
  derived and/or modified sequence opt3 from C20orf85__Homo_sapiens__NP_848551
auggcccagaagccccugagcaccgcugcagccgagagaaugaaccucgugggccaagacgaaaucuggaaauacaggcuuaaggcggaguccgaagcucggcagaauuggccucagaacuggggguuccugacaacuccauuugaggaauugauuaaaugcgaggaggauuuaccgacgcccaagccuaaaauagaacugccagagcgcuuccgaauccgucccgucaccccuguugaaaaguauauuaagguguuuccaucucccccuguaccacagacaacucaaggauucaucgguuggagaucagccgugccgggccuaaauaaaugucucgagcuggacgaugcaauuaggaguugcaagggggccuuugcucgggagcuuuguuggcccaaacagggaguccacuga

SEQ ID NO: 53616 - RNA, 768 nt, Artificial Sequence
  derived and/or modified sequence opt3 from C21orf2__Homo_sapiens__NP_001258369
augaagcugaccagaaaaauggugcucacaagggccaaggcuagcgagcuucacuccguccggaaacugaacugcuggggcucucgcuugacugacaucucaauuugucaggaaaugcccaguuuagagguuauaacgcugagcguaaauuccaucucuacccuagaaccugugucgcgaugccaacgucucucagagcuguaccuuagaaggaaccggauuccaagccuggcagaauuguucuaucucaaggggcugccgcgccugagagugcucugguuagccgagaaucccuguugcggaacaaguccucauagguaccggaugacuguccugcgcacccuuccacgauugcagaaacuggauaaccaggcggugacagaggaggaacuauccagagcucucucugaaggugaggagaucaccgccgcacccgaaagggagggcacugggcacggaggcccuaagcuguguugcacacuuagcucccugucaagugccgcugaaaccggucgggacccauuggauagcgaggaagaggcaacgggggcccaggacgagcguggacucaagcccccuucucgcggccaauuuccaucccugucagcuagagaugccagcaguucucauaggggccggaauguuuuaacugcgauucugcuccuucugcgagaauuggacgcagaggggcuagaagccgugcagcagaccgucggaucccgccugcaggcucucagaggugaggaagugcaagagcacgccgaguga

SEQ ID NO: 53617 - RNA, 807 nt, Artificial Sequence
  derived and/or modified sequence opt3 from C21orf33__Homo_sapiens__NP_004640
auggccgcugugagaguccugguugcaagcaggcucgccgcggcuuccgccuucaccucucuuucacccggcgggcggacaccuagucagcgcgcagcccugcacuugagcgugccacgaccggcugcacguguagccuuagugcuguccggaugcggugucuacgacggcacugagauccaugaggcuucugccauucuagugcaccucucgagagggggagcggaaguucaaauauuugcacccgaugugccucagaugcaugucaucgaccacacgaagggccagccaucagaaggugagagcaggaacgugcugaccgaaagugcccggauugcucgcgggaaaaucacagaucuugccaaucuguccgcagcuaaccaugacgccgcgauuuuccccggaggcuuuggcgccgcaaagaauuugucuacuuucgcuguagaugggaaagacuguaagguuaacaaagagguggagagaguccucaaggaauuucaccaggccggaaagccuaucggucugugcuguauagcuccagugcuggccgcaaaagugcucaggggcgucgagguuaccguggggcacgaacaagaggagggaggcaaguggcccuaugccgguacagcugaagcgaucaaagcauuaggggccaagcauugcguaaaagagguggucgaagcucacguggaucagaagaauaagguugugaccacuccugccuucaugugugagacagcacugcauuacauucacgacggaaucggcgccaugguccggaaagugcuugaauugaccggcaaguga

SEQ ID NO: 53618 - RNA, 873 nt, Artificial Sequence
  derived and/or modified sequence opt3 from C21orf59__Homo_sapiens__NP_067077
auggugcugcuccacgucaagagaggcgacgagagccaguuccuucugcaagcccccggguccaccgaauuggaggaauuaacaguucagguggcuaggguauacaacggacggcugaaagugcagcgccuaugcucugagauggaagaacucgcagagcaugguaucuuucugccuccaaauaugcagggccuuacugaugaccaaauugaggagcugaaguugaaagaugaauggggagagaagugugucccgucagggggcgccguguucaaaaaggacgauauaggucgacguaacgggcaggcgcccaaugagaagaugaaacagguucucaagaaaacgaucgaagaggcuaaggccauuaucaguaaaaagcaaguggaagcaggagucugcgugaccauggagaugguaaaggacgcccuggaucagcugagaggcgcuguuaugauuguguauccuaugggccucccacccuacgacccuaucaggauggaauuugagaacaaagaggauuuaagcgggacacaggcaggacugaaugucauaaaggaagccgaggcucagcuuuggugggccgcgaaagaauugcggcgcacuaagaaacuguccgacuauguggguaagaacgagaaaaccaagaucauugcaaagauccagcaaagaggccagggggccccagcuagggaacccauuaucucuucggaggagcagaaacaacuaaugcucuacuaucaccggcgccaggaggaacugaagcgacuugaagagaaugaugacgaugccuaccugaacucaccuugggcagacaauacagcuuugaaaagacauuuccacggagugaaggacauaaaauggaggccacgguga

SEQ ID NO: 53619 - RNA, 660 nt, Artificial Sequence
  derived and/or modified sequence opt3 from C21orf62__Homo_sapiens__XP_011545334
auggcucccccuagcagacacugccugcuccuuaucuccacccugggcguguucgccuugaacuguuuuacaaaggggcagaaaaauucuacuuuaauuuucacgagggagaacaccauacggaauugcucauguagugcagacauccgcgauugcgacuacagccuggccaaccuaauguguaauugcaagacaguccucccacuggcgguugaacgaacuuccuauaacggacaucuuaccauuugguuuacagauaccucugcucugggucacuugcucaauuucacucuggugcaagaccugaaacucucguuauguucaacaaacacccugccgacggaguaccuugccaucugcggcuugaagcgucugagaauuaauauggaagcaaaacaucccuuuccugagcagagccuacucauccacagugggggagauuccgacucuagggaaaagccaauguggcugcauaagggcuggcagcccuguauguauaucagcuuccuugauauggcccuguuuaaccgggacuccgcuuugaaaucauacaguauagagaauguaacuagcauugcaaacaauuucccugauuuuucuuauuuccgcaccuuuccaaugcccuccaacaagucauacguggucacauucaucuauuga

SEQ ID NO: 53620 - RNA, 894 nt, Artificial Sequence
  derived and/or modified sequence opt3 from C21orf91__Homo_sapiens__NP_001093890
augaacgaggaagaacaguucgugaauaucgaccugaacgaugacaauauuugcagcgucuguaagcucggcaccgauaaggaaacacuuuccuuuugccacauauguuucgagcugaacaucgaagggguucccaagucugacuuguuacacacuaaaucacugagaggacacaaggauugcuuugagaaauaccaucuaauugccaaucaagguuguccuaggaguaagcucagcaaguccacguaugaggaagugaaaaccauccugucuaagaaaauuaacuggaucguacaguacgcucagaauaaggaccuugauucggacucagagugcagcaaaaacccacagcaccaucuguucaauuuucggcacaagccggaagagaaguugcucccccaauucgauagucaggugccuaaauauuccgcaaaguggauagacggcucugccgggggaaucagcaacuguacacagcgcauucuggagcagcgagaaaauacugauuuuggccuguccaugcuccaagacucaggugcgaccuuaugccguaacaguguccuguggccacacagccauaaucaggcucagaaaaaggaggaaacaaucucuucccccgaggccaacgugcagacccaacacccucauuacucaagagaggagcuuaauagcaugacuuugggggagguugaacagcugaacgcaaaacuacuccagcaaauucaggagguguucgaggaacugacacaccagguccaggaaaaggauagucuugccucucaacugcacgugaggcauguagcuaucgagcaguugcucaaaaacuguuccaagcugccaugcuuacagguuggacggaccggcaugaaaagccaucugcccauaaauaacuga

SEQ ID NO: 53621 - RNA, 1095 nt, Artificial Sequence
  derived and/or modified sequence opt3 from C22orf29__Homo_sapiens__NP_078903
augcccagagggaggugccggcagcaaggcccucgcaucccaauuugggccgcugcaaacuacgccaaugcgcacccguggcagcagauggacaaggcuagccccggaguggccuauaccccucuggucgauccauggauagagcgacccuguugcggugacacaguuugugugcguacuacgauggaacagaaauccaccgcaucuggcacaugcgggggaaagccugccgagagaggcccacucgcuggucauaugcccucaaguaggccucaccggguagauuucuguugggugccagggagcgacccgggaacuuuugauggcucccccuggcuucuggaccgcuucuuggcacaauuaggcgauuacaugucuuuucauuucgaacacuaucaggacaacaucucgagagucugcgagauucugaggcggcuaaccgggcgcgcccaggcuugggccgcgccuuaccucgauggagaccugccacuucccgaugacuaugaacuguuuugucaggauuugaaagaggugguucaagacccuaauucauucgcagaguaccaugccguggucacaugcccacucccccuggcuagcagucagcugccgguggccccucagcuccccguaguucgacaguauuuagcaagauuucuggaaggucuugcuuuggacaugggcaccgccccaaggucccugccugcggccauggcaacucccgcugugucugggagcaacuccgucucacggagugcccuauucgagcaacagcucacaaaggaaagcaccccaggacccaaagagccuccagugcugccgucuuccacguguucaagcaagcccggcccuguggagccagcuaguucucagcccgaagaggccgcaccuacuccagucccccgucuuuccgaaagcgccaauccgccugcucaacgcccagaucccgcgcacccuggugggcccaagccacagaaaaccgaggaagagguucuggagacagaaggagaccaggaggugucguugggcacuccucaggaaguaguggaggcacccgaaaccccaggcgagccgccucucucucccggguuuuga

SEQ ID NO: 53622 - RNA, 7062 nt, Artificial Sequence
  derived and/or modified sequence opt3 from C2CD3__Homo_sapiens__NP_001273506
augaagcagagaaaaggccaagggagcggagguuccaggggccggaagaaacgcgggcugucugacaucucacccaguaccagccucccuccacuuguggagggacagcugcgaugcuucuugaaguuaacagucaaccguguuauuuggaaaauagccaagccgcccacuugugugcugguaagagugaggugguggggcgaaacguccgaugguacccuauuuugcccucgggacgcucuccagacagagccaaaggcaguccgcacuaccacaagauacgccaucaggugugggcccaaacaguucaccucuuaucugacugauauggcggugcuuguucuggaagugauuacaaaguuggacggacucccuaucggccggguccaaauuaauggccuggcucagcugucgccaacccaccagaucaacggguuuuucacgauagugucaagcacuaguaaaaagcucggagaguuacagguaucccuggcccuugaacccuugucugagaccuacgauagcuaucauccucugccaacaacugacaugaccgagaauguucuacucuccaaacaagguuuucgcgaaaacacagagccgucaaguacccaguuccaggugcccagccgaccuagagauauccacacgauuaagaucgacggcaaggaacuggcagccaauucuuccaggucaacuacaccacgggggaaagaucaugucugcuuugcugagaaccccgacaccauuaaggauagcaguuucggacuucagcacucucugaauuccggccaaagcuuggagucggugacucucaaaggucgugcaccucgcaagcagaugucucuguuaaacuccucagaauuucagccacaaaucagaacaguggccaaaagucauagcgacuccuguauacugucuagcaauaaccuccccaccaaggaucuucugucagcuuugcuagagcaggggaauaaacugaggaacgccauggucauuagugcgaugaaguccagcccggaaacgucuaugcuccuggaccagguucacccucccaucaaugaggacucacuucgggcaaguacccagauucgagccuucagccgcaacagauuuaaggaucacaucgaagaccaucuguugccauccacagagaauacuuucuggaggcacgauaccaaagcugacacacgggccauccaacuccuguuaggaucugcagagcugucgcagggcaacuuuugggauggccuagggagcccucccgacuccccaucacccggaagugauguguacugcauuucugaacucaacgacccucaguaugaucagagccugcuugagaauuuguucuacacugcuccaaaguccgacaccucaauaagcgauuuccugucugaagaggacgacaucguaccguccaaaaagauuagucaaagcacagcccucgcgcgcucuuccaaagugcuggaaucaagugaucauaagcuuaagaaaagaagcgccgguaagaggaaccguaaucuggucgagcagcagauguugucggagacccccgaagacgcacagacuaugacgcucuccguggaucggcuggcuuuacugggccgaacacacucuguuagaaucauaauugagaccaugggggugccuccagacagcccccaaaugacuccuggaaaaaagucauaugccggcccacccccgaaagucaccacagcuaagaagaggaccuuuuucguggaauaccacuuuccuguagguuucagugaguccgggcuaggcaaaacugcccucaucacagaaguugugcgccuggcaucuagcaagaucacggauggaaaagucaaguuucagcagcgguucguguuuccaguccaguucggcgggcccaugauugagcauugguggaacuccaaucuuaccuuucaaaucuacgugaaaaagacuccucagaagaaacccgagguuauuggaucagugagcuugagucugagagccguaauacagucugaacuccuguccuucagcgaccaauuaccaguccagcaggagaacggucagucgccuuuuggcccccugaaggugacaauggaacuuaucaccgauaauaaagacuucacagggauuaacacuaaguugucaggaaauacccacuauacgccacucugugcuccgaccucuccuaacaaagcgcugcccgagcuaaaucaagauaugacaugcacuaagaacccacagaaucugaaccagauccaugaggaaaccgcaaaaaaggcccagaaucucguucugcccaacaggaagaguccuuccccaguggcuccccacccuagcacauuugucgccacuccggcaucucauaaccuugugaaucaaaccaacggcacgacaaaagagagcgccuugcuguuacacguacuccugauggugccagacgguaaggauuucaucuccggggaaucagagaaacagagucccuguaauguuuaccuuaacugcaagcuguucagcaccgaagaggucacucgcucugugauugcuuggggcacaacccagccuguguuuaauuucucccaggucauaccaguuucauugaguagcaaauaucucgagcgacugaagaacaaugugauggugaucgaaacuuggaacaagguacggucccccggacaagacaaacuacugggccucgucaagcugccucuucaccaguuuuacaugucuuucaaagaugccaagauuucgcguuugcuguuagacgcacaguauccggugguugcgguggacagcuacaugcccgucaucgauguguuuucagggcaucaaaauggaucccucagaguuuuccuggcuauggguaguucuaaccagauuauggcccuucagaggcugaaaaaugaggaaggcacccuaccaccuuuuagcccccgcccagcacacuuccucgaccagccuacagccgcuuccguggccauggcagaggaucgggggaacggacugauggaacauuguuuugagauccacauagagaugguaaagggcuuggcuccccugcaagccacggucuggggugaagcggacugcuaugugcaguacuacuucccagugcagcacucacagucuagcgucuuaaaggggccggaguuucucgaaaauggcaucacccugaaaccuuucagaacugccacaacccuuugcguucccgauccaauuuuuaacagugagcaucaccauucccuguugcuccccgcugaagugccuguacaaaggcugcuacugagcgcauucucugcccagggacuugugccaggcgggggaguccaguucgagaucuggugucgauauuacuaucccaaugugcgcgaccagaagguugcuaaaggcacacucccucugucacggauuugcgccauggugacuacccaacacagagaggaugucgguauccagacguuuaacuugccgcugacaccaaggauagaaaaccguaaggaguuacgcaaucaguccagugggcuccuggacgugggacuucgguacagaaggagcccccgaaccgcagaaggcguucuggcggcccggacugugucgauuucuguccagaucauucgcgcuugugguuugcaagccgcagcuaaagcccucgcagagagagagccugcccugcaguucuccgcuaccguaggcgugaacgcgagcguuacaacucaucuaucauuucugccccagggggaacaaaggcggacccacccaguggccugcaguuucuguccugaguuuucucaccaugucgaauucacaugcaaucuugugacgcagcacuguuccggagaggcaugcuuucucgcugaacuguuggaguucgccgagguaaucuuugccguguaucaugaaaacaccaagagcgcuucagauauaaucaguauugagagcuguaaggaauacuuacugggcgucguuaaagugcccacuaaggagcuccugaucaaacgauccgggauuacaggaugguauccaaucauacuuccugaagacggcggucugccgcacggguuggagcuaaugcagaagauugugggaggccuggagcucucuaucagcuucacccauagaggugaucgcgaaaggguccuggaggcagccgaacaccuuggcugguccuuugagaauucauuaaaagacuucgugcguauggaugaaggggagcccgcgacuguuacaaucucuaccccacggcuguggcucccuauucacugcguauugcuggcuggacauaaccacauccauaagaauacguacuguuaccucagauauaaauucuacgaccacgaggccuuuuggacuccccugaagaagccaaaagaaagugugaacaagaaacagauuauggucaccuucaaggcaucgaaaagggccgaggugacacgcggcccuagccuucugugguauuuucgagaagagagauuggagauacaaguuuggcgggcuuacgggaaugacuccguggaaaggccccaccagaccgauucuuggaucggaucagcauaugucgaccuagcccgccugggcgagcguagcgcgagaacucucacaguguccgguguauacccguuauucgggcggaacgcuaguaaucugucuggagccgcacuuaggguccaugugguucugagcucacucuccagucacuuggaaccaacccaugagcuggauagcauggacugcucuucccacucagaaagcgagcagcucccucgccgaaacgaugaggugcagcugucgcccccagaagucauuucuugccaucaaaagagucccgccuccacacaggugccuuguagcucaacuaccgcugagguuagacuuacgcaggaaggcccggccgaccuagaugguacauuugcaguguccauccuggucgagcgggcuaugcacuugucuuuaaagggcagcccccugaccgaaaggaaagugaguauuccauccugcuguguaagcuucgccacugcggacgagucuucaccuguguauacccagguugucgagaauacagauagucccaucuggaacuuucaacagcagucccgccucagcaaggaacugcuucuggacccucaacagacucucguguucaaaguguggcacaagggggaugaggaaagagucauaggauuugccucuguagacuugucgccacugcuaucaggcuuccaguuugugugcgggugguacaauaucaccgacuucagcggagagugucagggccaaauuaaaguugcaguguccccccuggaaagucucauccauuuuaaggaggagaggcaggcucggcguggugucgaaacgucuaagagccuuauuccuaucuacuccccauucucauuccccgccagugauacauaugcugcauuuucuagccacauggcccgccagacccuggaccaguuagcccaugcuuccucaaaagaguuggauuucagcucuccggggcgauccgacacuacaagaagucaagcgagcaggcacgaagagcacgugcagaacauacggcgcuuucaugagucgcugcaccuccagggagaagcaccucugccaugcgaugacaagcuuaccacuuccccccugucuucacagacaagcauucucaccaguuugagaaaaaaccuguccgaguuagaucaaauccagagguacuuccggcagaagcuaacgaaaccuuuucugccacucucuccccagacucaaaccgccaucagccagcaucaggaaucaugucgagaccaccuuggcccgggcgcuuccagucuggauccugggagccaaugcauuuuggagaagucuucaaaucugguucuccagguguccagccugauaacagaccuucagaccaucacaagagauucucaggccgcacucaguucgcaucgcgccaggucccggagcaacaaggcuacuacccugcccgacgcgcaagauacggaagccuugcaggagcguuguacaaugccagacgagccucuggucagagcacccgacaaaggaacugauucaccaucucccccuccauuagaagagaccagcaaugguggcaggaugcuacacgaaucccugcgccacgcugugccgauuacacggaugcagaguucagaggacaccgaagccgggcccgcauauucugaugaggacuacgaggaagauaucauugagccucgaacucucaacgaaaucaccacaguaacggacaagacuagcccaugguccagugugauaagcgauaccuccgagguuaucucuccccagccugacgaaguccaaagagagggaccaucaugccccagcccuggcccguucuguagggaggaacuuauggugaaaucguccuuucugaguucuccagagcgcgccgugaauccccauuugccucggcaggguagccccucacagucccuggucgcuugcgaaugcgaggccucuaaggcgagaguugggggagagagugcaagcgccaacccacagccuauucccuguccaacacucuccggcgcucaacagucaagcaccuucgugggcuggucuaguccgcagacugaucaaaauaaagaaccuaaguccgaggcccccgcugaaaacgaggcagccacaagcgaacugggggacucagcugauucuuuuaagaaacuuccauuaaaucuggccucccagucgcguagggagaaccacaagggacccccuaucgacagcagugauauucggcagcgccagguaaccacggguucugagacuuccacaaaacaaagccucuugcugccaggccccaucguggucccuaauuucuuucuaccgccacagcagcuggaagcaucacuccgaaugcuuagucuguccgcgaccuugcccccugccgcuaccacugaccaggacaagagcgaggccacaagaggggcacugucucaaaggccaugccggccccgcccuaacucacucccccugaauuuaccagaagaggaaacccuuagaauagcuaggauuuucagcucccaguauucucagaaagauuga

SEQ ID NO: 53623 - RNA, 1110 nt, Artificial Sequence
  derived and/or modified sequence opt3 from C2CD4A__Homo_sapiens__NP_997205
auguggugccuggagagacucaggcuuggccccgaaugucugcggcgcagcggggacugguuguuaccuggacgagcccguggugcuaaguccagaaccacagcagccugcgcgaacgugcugacuccagauaggaucccggaguucuguauucccccucggcuaaugccacgccucgcucuggccgcacuuagaaauucuugggucgaagaggccggcauggacgaaggggcuggaaggacggauugggacccccggucacaggcagcccugaguuugccucaccucccacgcguucgaaccgcuuacggcuuuugcgcccugcuggagagcccccauacaagaaggaaagagucccucuuacugggugggccuccagcgccgcggccccgugcacacacuuauggaggcggcgggggaccugaugcccuuuuggguacccugcgcgugccaagagcucccggcccugccacaccagcagcucccggguguccgaggccuccccaagacgcccuagcgcggcgaccacgcggaugcagacuccugaggguaccugauggccuucugucucgggccuugcgcgcagguagaucgaggcgucucacccgggugcgaucagucagcagugggaacgaagacaaggagagaagggcuggaucccagucucccgcccgcgcuccaagcacuucacccccuuccagucgggugccauucccggaaagacuggaggccgagggcacaguugcauuaggcagggccggggaugcucugcgccucgcggcagaauacugucccggaaccggucgacuucggcugcguuugcuaagagccgagagcccugcuggcggggccccaggacccagggcagugucuugccgccugucccucguccugcggccuccaggcacggcccuuagacaguguucaacugugguagguaggagccgaaaagcuaguuuugaccaggauuucugcuuugacgggcugucugaagaugagguucgccgguuggccgugagagucaaggcaagggacgaaggccguggacgcgagcggggcagacuccuggggcaaggagaguuaucccugggugcgcuacuccugcuuuga

SEQ ID NO: 53624 - RNA, 1095 nt, Artificial Sequence
  derived and/or modified sequence opt3 from C2CD4B__Homo_sapiens__NP_001007596
augagacugcucgagaagcugugcagcuccgccgcugggucuucagcacccaaaccugccuucgcgaaggugcugaccccaaacaggaucccggaauuuuguauucccccucgguugccagcucccugcacauuagagaguccuauacgcgccgcagccgucccacgacguugugcugcagaaagcgaccuguggcccagagccgcugaugaggacgccggcaggacugauugggacccucggucccaggcggcacuaucucucccacaccuuccgcgcguuagaacgaccuacggauucugcgcccuucuggaaucgccccauacaaggcggaaagagucauugcuccuggguggcccuccagcuccccgcccucgagcccacagcugugggggaggcggugggccagaugcaccccugggaacucucugcggcccgagaggcccugggcccgcuaccccagccgcgccuggaggucccagguuaccacaagacgcccuggcagcuggcccccggcguugucgccuuuugagagugccugaugggcugcuaaguagggcccuccgggcuggacgaucccgcagacuggccaggguacggucugugagcuccggcaaugaggacgaggaacgcagagcagguucagaaaguccagccagggcuccguccucuagcccccuuucaagccgugcgccucugccagagcgguuggaggcaaaggggacagucgcccucggacgagcuggcgaugcccugagauuagcagccgaauauugccccggcaccaggcgccugcggcucagacuucugagggcugagaguuuguuugggggagccccugguccacgcgcagugcgaugucggcuaucucugguucuccgucccccgggcacugcgagauggcagugcuccgcuguggucgggaggagccgcaaagccucguucgaccaggauuuuuguuucgacggacugucugaagaugaggugcggagacuugcaguaaggguuaaggcccgagacgaaggccgcggucgggacagagggaggcuguugggccagggagagcucucccugggcgcuuuacugcuacucuga

SEQ ID NO: 53625 - RNA, 3165 nt, Artificial Sequence
  derived and/or modified sequence opt3 from C2CD5__Homo_sapiens__NP_001273104
augcccggcaagcugaaagugaagaucgucgccgggagacaccucccuguuauggacagggcuagcgaucuuaccgacgcauucguggagguaaaauuuggaaacacaacuuucaagacggauguguaccugaaauccuugaauccacaguggaacucugaaugguuuaaguucgaggucgacgaugaagacuuacaagaugagccgcugcagauuaccgugcuagaccaugauacauauucagccaaugacgcgauagguaagguuuacaucgauauugacccccuccuguauagugaagcugccacugugaucagcggcugguuuccuauuuacgauaccauccacgggauacggggagagaucaacgucgugguaaaaguugaccuuuucaaugaccugaaccgcuuucgacaguccucuugcggcgugaaguucuuuuguacaaccucgauuccaaaaugcuaucgugcagucaucauucaugguuucguggaggaauugguggucaaugaggaucccgaauaccaguggaucgacagaauaaggacuccucgggccucaaacgaggcucgccaaagacucauuagccugaugaguggggagcugcagaggaagaucggacucaaaguuuuagaaaugcggggcaaugcagugguaggcuaucugcaguguuuugaucuugagggggaauccggauuggugguccgcgccauugguacagcuugcacccuggacaagcuaucuagcccagccgcguuccuccccgcauguaacuccccuucaaaggagaugaaagaaaguccacuggugcacccgcccagccauggcugccgaucuacgcacaauuccccuauccacacugccaccgggucaagacuuacacagaacuuuagcguuagugugccaacucugaucuacaccggaaugggcucugguuccgcugggaaggagggaggccccuucaaagccuugcucaggcaacagacacagagcgcacuggagcagcgggaguucccauuuuucaccuuaacggcuuuuccucccggcuuccugguccaugugggaggaguaguuucggcccguucugugaagcuccuugaucgcauucacaauccggcguuugucgguauaaugggcaacacuagauccuacaaacuguuggacuggaacucauucaauagugaugagccugaaacaagggacgccuggugggcagagauccggcaagaaauuaagagccaugcuaaagcccuagggugucacgcuguggucggauauuccgagucuaccagcaucugcgaggaaguguguauacugucagccaguggcacugcagccguucucaacccccgauuucugcaggaugguacaguggaggggugccuugaacagcgccuggaggaaaauuugccaaccagauguggcuucugccacauuccuuacgacgagcucaacaugcccuuuccagcucaucugacguauugcuacaauuguaggaagcaaaagguacccgaugucuuauucaccacaaucgaccugccuacugacgcgaccgugaucggaaaaggcugccuaauucaggcacggcucugucgccugaagaaaaaggcccaggcugaggccaacgcaacagccaucuccaaucuuuugccauuuauggaauaugagguucacacucagcugaugaacaaacucaagcugaaggggaugaaugcucuuuucggacugaggauucaaauaaccgugggugaaaacauguugaugggccucgccagcgcaacaggggucuaccuggcggcuuuaccgacccccggaggcauccagauugccgguaaaacuccuaaugaugggucuuaugagcagcauaucucacacaugcagaagaaaaucaacgacacgauugcaaagaauaaagagcuguacgaaauaaacccacccgagaucagugaagagauuaucggcagcccuauuccagaacccagacaacguucccggcuacuccgaucucagucggagagcuccgaugaggugacagaacuggaccuuucacauggaaagaaggaugccuuuguauuggagaucgacgauaccgacgcuauggaagaugugcacagucugcucacugacguuccgccuccaucuggcuucuacagcugcaauaccgagauaaugcccgggaucaacaauuggacauccgaaauucagauguucaccucagucagagugaucaggcugagcucuuuaaaccugacuaaccaggcccuuaauaaaaacuuuaaugauuugugugagaaccuccugaagucccuauauuucaaacugcgcaguaugauuccuugcugucucugccacgugaauuuuacagucagccugcccgaggacgaacuuauccaaguuacggugaccgcaguggcuauaacuuucgauaagaaccaggccuugcagacaaccaaaacaccaguagagaagucucugcagcgggcguccacugacaaugaagaguuacuccaauuuccucuggaacuuuguucagacagucugcccagccauccauucccgccugccaaggagcacuuggagucggcuuccucuaacagcgggauucccgcagcccagagagauaggugcucaaguuggaucgaacucauuaaacugaaggcucagaccauccgccgagguuccauaaaaacgaccaugacagucgagaaggccucuccagugggcgacgggaauuuucggaaccguagcgcacccccuugugccaauuccacuguuggaguggucaaaaugaccccacuaucauucauccccggcgcgaagauuacaaaauaccuggguaucauuaacauguuuuucaucagagaaacuaccagccucagggaggaagggggcgugaguggauuucugcaugcuuucauagccgaaguuuuugcaauggugcgcgcucacguagccgcacuuggcgggaaugccgucgugucuuauauuaugaagcaaugcguguucauggagaacccuaauaagaaccaggcucagugcuugaucaacgucuccggagaugcgguuguguucguacgggaaagcgaccuggagguggucucgucacagcaaccgacgacaaauugucagucuaguugcaccgaaggcgaggugacuacauga

SEQ ID NO: 53626 - RNA, 2259 nt, Artificial Sequence
  derived and/or modified sequence opt3 from C2__Homo_sapiens__NP_000054
augggcccccugaugguccucuucugccuucuguuuuuguacccuggguuagccgacagcgcuccauccuguccgcagaacgugaauaucucuggagguaccuucacacugucacacggcugggcacccgggagucuacucacuuauagcugcccucaaggacuguacccaucccccgccucuagacuuuguaagucgucaggccaguggcagacgccuggugcgaccaggagccugaguaaagcuguuugcaagccagugcggugucccgccccuguauccuuugagaacgggauuuauacaccacgcuugggaucuuacccggugggcggcaaugucagcuucgaaugcgaggauggguuuauacuccgaggaucccccgugcgucaguguagaccuaacgguaugugggacggcgaaacugcaguuugcgauaauggggccggacauuguccaaaccccggcaucucacugggugcugugaggaccggguuccgguuuggacacggcgacaaaguccgcuauagaugcaguagcaaucuggugcucacaggcaguuccgagagggaaugucaagggaacggaguauggucagguaccgagccuauuugccggcagccauacagcuaugauuuccccgaggacguugcaccggccuuaggcacuucuuuuucucauaugcugggggcuacaaauccuacccagaagacgaaagaaucccuuggacgcaagauccagauucaacgaagcggccacuugaaccuguaccuacuccuggauugcucgcagucuguguccgagaaugacuuccuuaucuuuaaggaaucagccagucugauggucgauagaauauucagcuuugagaucaacguguccguggcgauuaucacuuucgcaucugagcccaaagucuugaugagcguucucaaugacaacucaagggauaugaccgaagugauuaguucccuggagaaugccaacuacaaggaccaugaaaacgguacagggacuaauaccuaugcugccuuaaacagcguauaccugaugaugaauaaccagaugcggcuccuuggcauggagacaauggcauggcaggaaauccgucacgcuauaauucuguugaccgauggaaaaucuaauaugggcgggucaccaaagacggccguggaccacauccgcgagauucuaaacaucaaucagaaaagaaacgacuaucuggauaucuacgcgauuggagucgguaagcucgacguggauuggagggagcugaaugaacuuggcaguaagaaagacggggagcggcaugccuucauacugcaagauacuaaggcauugcaccagguuuuugaacauaugcucgacgugagcaaacugacagauaccaucuguggagucggcaacauguccgcuaaugccucugaccaagagcgaacuccuuggcacgugacaauuaagcccaaaucgcaggaaaccugccgcggugcuuuaaucagcgaucaguggguacugacggccgcacacuguuucagagacgggaacgaucauucccuauggaggguuaaugugggcgacccaaagucacaguggggaaaagaguuucucauagagaaggccgucauuagucccggcuucgacguguuugcuaagaaaaaccaagggauccuggaguucuauggagaugacaucgcgcuuuugaagcuggcacagaaagucaagaugucuacccacgcccggccuauuugccucccauguacaauggaagcuaaucuggcccuucgcagaccgcaggguagcacuugcagggaucaugaaaacgagcuguugaacaaacaguccgugcccgcacacuuuguugcccucaauggcucaaagcugaacaucaauuuaaagauggggguggaauggaccagcugugcugagguagucucucaagagaaaacaauguucccuaaccugacugacgugcgugaaguugugaccgaucaguuucuaugcuccggaacacaggaggacgaaaguccauguaagggcgagagcgguggggccgucuuccucgagcggcgauuuagauucuuucaggugggccugguaucuuggggacuuuacaaucccugcuugggcuccgcagauaaaaacucaaggaagcgcgcgccucggaguaaagugccacccccgagagacuuccauauuaaucuguucaggaugcaaccuuggcuccgccagcaccugggggauguuuuaaacuuucugccacuuuga

SEQ ID NO: 53627 - RNA, 5955 nt, Artificial Sequence
  derived and/or modified sequence opt3 from C2orf16__Homo_sapiens__NP_115642
auggagcugacccccggcgcccagcaacaggggaucaacuaccaggaacucacaagcggauggcaggacgugaaguccaugaugcuugucccugagccaacuagaaaauucccgucugguccccuguugacgucaguuagguuuaguaauuuaagcccugaaucccaacagcaggaugugaagucucuggaguucaccguagaaccaaaacuacagucggugaagcacgucaaacucucaagcgugagucugcaacagacaauuaaguccguugagcuugcucccggcucucugccucagcgggugaaguauggggagcagacuccacgcaccaacuaccaaauaauggaaagcuccgaguugaucccccgaccuggacaucaguuugcaaaauaugccgaaaugauuccacagccgaaguaccaaauccccaaaucagcgaaucucauuaguaucccuauauaucacgcuacagagagcucugagauggcccagggccuggcauacaaggguaucgacaccgucgaaaaauccguggggcugacuccaaagcucacaggacgugccaaggagucauuaggcaugcugcuucagcccgauuugcagguaccuaaauucguugaccugaccccaauggugagagaucaaggcagcaaguuucuagggcucacgcccgaaaaaaguuaucagauucuggagacuauggaacuucugucucaguccaggccgcgggucaaggacgugggagaguuguacaugaaaccucuccagcaaaccguggaguacgaagguaucacacccgagcugaagcauuauuucacugaagcuaugggcuuaaccgcagaggcccgcauucaggcuaacgaauuuuucgggaugacaccaaaaccuaccagccaggccacgggauuugcggagagaucgcccaggcugugcccacagaaucucgagugugucgaaguuaucucugagaagcggcuucaaggcgaagaguccgugguacugauacccaagucauugcaccaugugccugauagugcaagcgguaugacuccagggcuaggacaccgcgucccggaauccguggagcugacaucuaaaagcggcguucagguggagaagacccuccagcugacucccaaaccucagcaccaugucggcucaccagggauuaucaguggacuuggucaccaagugcccgaauccguaaaccugacaugcaagcagugguugcagauggaggaaagccucgagguuccucugaaacaaaccucucaggugauuggccaugaggaaucagucgaguuaacgagugaagcccgacagcacagagaggugagcauggggcugaccaaguccaagaaucagucuaugaaaucgccaggaacaacucccggcccgcuagguaggaucgucgaauucaugcggaucagcccugagccacucgaccaagugaccgaguccgcucguacacagcugcagguugcccagucagaagaggugauucuuauagauguacccaaggucgugcaaaguguuaaagugacuccugggcccccauuucagaucgucaagucugugaccauuccucgccccacaccacagaugguagaauacaucgaguugaccccgaaacugcaguaugugagaccuagcgaacaccauacuggccccugucuccaagacguuaaguccacgaagcugauaacaaaaccaaagcaccagauucuugagaccgucgagcugacuggauuccagaucgugaaaaccauguugauccccggcccuucacuccaaauugugaagagcgaagagcuggcaccagggcccaucccucaggucguugaaccgauuggaguggcuuuagagucugguauagaagccaucaacugcguggaucugcuaccaaggccccaucuccaggagcugauuguaccugcggagcuuacaccaucccccuguacccaggucaaaagugccgaauugacuagcccucaaacaucuccguuugaggaacacacgauccugacccauaagcagggccuccaggcagugaaguccacuguuaucaaaacagagcccccaaaggugauggagaccgaagaccugaauuuagggcacgucugccagaaccgggauugucaaaaacugacaucagaggaacuucaggugggaacugacuucagucgauucuugcagagcucguccaccacgcucauuucuagcucaguucgcaccgcuagugagcugggcggucuaugggacuccgggauacaggaagugucuagagcccuggauaucaagaauccuggcacagacauucuccaacccgaggagacuuacaucgauccaaccaugauucagagccugacauuuccucuugcuuugcacaaccaguccucagacaaaacugccaauaucguagaaaaccccugcccagagauacugggagucgaugugaucagcaaggaaaccacgaaaaggaagcagauggaggaauuagagaauagucuccaacggcaucugccgcagucuuggcgcuccagaagcaggacauuccaggcagagucgggcgugcaaaaggggcuuauuaaaucauuuccuggacgucagcacaacgucugggaaucucaugccuggcggcagcgacugcccagaaaguauuugaguaccaugcucaugcuggguaacauccuaggcacuacaauggagaggaaacuguguucccagaccagccucgcugaacgcgcgacugcagacaccugccaaucuauucagaaucuguucgggaucccagccgagcuuauggaacccagccaguccuugccugagaagggaccaguuacaauaucacagcccagugugguaaaaaacuacauucaacggcacacguuuuaucacggccauaagaagagaauggcucugaggaucuggacccgcgguagcacuucuuccauuauccagcaguacucagggacacgagugcggauaaaaaagaccaauaguacauucaacggcaucagccaggaggucauucaacacaugccuguguccugugccggaggccaguuaccgguucucgugaaaucugaaucgagccugucaaucuuuuacgaucgugaggaccuugucccaauggaagaguccgaggauagucagucugacagccaaacuagaauuuccgaaucacagcauucucugaagcccaauuaucuaagccaggcaaaaaccgauuucagugagcaguuucaacuccuggaagacuugcagcugaagaucgccgcuaaguuacucaggucccagauaccucccgacgugccaccuccccuggccagcgggcuuguucugaaauacccaauuugcuugcagugcggacgcuguucuggccucaacugccaccauaagcugcaaacgacaucagguccuuaucuacugaucuacccgcagcuucaccucgugcggacccccgaggggcacggagaagucagacugcauuugggcuucaggcugcgaaucgguaaacgcucccagauuaguaaguaucgggagagagauaggccaguaauccgucgcagcccuauuucgcccucucagcggaaagcaaagauauacacucaagcguccaagagcccaaccucaacaaucgacuuacagaguggcccuucucagucccccgcuccggugcagguuuauauuagaagggggcaacgaagccggccagaucucguggagaaaacuaagacccgcgccccuggacacuacgaauuuacacagguccauaaucugcccgagucagacagugaaagcacgcagaacgagaaaagagcaaaggugaggaccaaaaagacuuccgauucuaaauacccaaugaagcggaucacaaagcgacuuagaaaacaccgcaaguucuauaccaauagcaggacuacaauugaaucccccucacgugagcuggccgcucauuugcggagaaaaaggaucggcgccacccaaacgucuacugcaagucucaagcgccagccuaaaaagccgucgcagcccaaguuuaugcagcugcuauuccaaagccugaaacgagcuuuccagaccgcccacagaguaauagcguccguggggcggaagccagucgacggaacaaggccugauaaccuuugggccucuaaaaauuacuaucccaagcagaacgcucgcgacuacugucucccuucaagcaucaaacgugauaagagauccgcagacaagcugaccccagccggcaguacuauuaaacaggaggauaucuuguggggugggacaguucaaugccggucugcucagcagcccaggcgcgccuauagcuuucagccucgaccauuaagacugcccaagccgaccgacucacaauccggaauugcauuccagacagcgagugugggccagccucuccggacugugcaaaaagauagcucuuccaggucaaagaaaaauuuuuaccgcaacgaaaccagcucgcaggagucuaagaaucugaguacgccagguacaagaguccaggccaggggccggauccuucccggguccccugugaagcguaccuggcaccgccaucugaaagacaaguugacucacaaagaacauaaccacccaagcuucuaucgagagagaacccccaggggaccgucagaacggacacgccacaacccuuccuggagaaaucauaggucucccagcgagcggagucagcgauccagccuagagagacgccaccauucuccaucacaaaggagucacuguuccccuagccggaagaaccauucuucgcccucagaacguagcuggagauccccaagucagaggaaucacugcucucccccugagcgcagcugucacucccugucagaacggggccuccauaguccaucucagcgaagccacagagggccgucccagaggcgccaucacucacccagcgagcggucucacagauccccuagugagcguagccauaggucguccucugaacggcgccaccgaucaccaagccaaagaagucauaggggacccuccgagcggucucacugcagcccuucagaacgcagacauagguccccaagucagcgaagccaccggggccccucugagcguagacaccauucaccuuccaaacgcagccacaggucuccggcucggagaagucaucgcucgccauccgaaaggagccaccacucacccucugagcgaagccaucacuccccuagugagcggagacaucacucacccucugaaaggagccauuguuccccaagugagcgcagccacugcuccccuucugaacgucggcacagaucacccagcgagaggcgccaucacucgccauccgaaaagagucaucacucuccgagcgagcgaucacaucacuccccuucugagcggagaaggcacaguccccuggaacgcagcagacauucccuuuuagagcggucacacaggagcccaucugaacgucgaagucaucgcuccuuugagagaagccaccggaggauaucagaacgcucucacucccccucggagaagagccaucugaguccucucgagagaucucgguguuccccaagcgaaaggcgaggucacucaaguuccgggaaaacuugccauagccccucugagcguucacacagaagcccuuccggaaugcgccagggccggaccucugaaaggagucauagaucgagcugcgagcgcacgcggcacuccccgucagagaugaggccaggucgacccucuggcagaaaccacuguagcccuagugaacgguccaggcgcucaccauugaaggaggggcugaaauacucuuuccccggagaacguccuagccauucccucaguagagacuuuaagaaucagacaacccugcuuggcacuacacacaaaaaccccaaggccgggcaaguuuggcgaccagaggcaaccagguga

SEQ ID NO: 53628 - RNA, 447 nt, Artificial Sequence
  derived and/or modified sequence opt3 from C2orf40__Homo_sapiens__NP_115787
auggccgcuagccccgcaagaccugccgugcuggcgcucaccggccuugcucuguuguuacugcuaugcugggggccaggagguaucuccggcaacaagcucaaacugaugcuucagaagagggaggccccgguccccacaaaaacuaagguugcaguggacgaaaauaaagccaaggaguuccuggggucuuugaagcggcaaaaacgccagcucugggaucgaacgcguccugaaguacagcagugguaccaacaguuucuguauaugggauucgacgaggcuaaguuugaagaugacauuaccuacuggcugaacagagauaggaauggccacgaguauuacggugacuauuaccagcggcauuaugaugaggacucagcaauagggccacgcagucccuacggauucagacacggcgccagcgugaacuacgaugacuauuga

SEQ ID NO: 53629 - RNA, 834 nt, Artificial Sequence
  derived and/or modified sequence opt3 from C2orf43__Homo_sapiens__NP_001269649
auggacagcgagcugaaggaagagauccccgugcacgaagaguucauucucugcggcggggccgaaacccagguccuuaaauguggaccuuggacagaucuguuucaugaccaauccguuaagagaccaaaauuguuaauauucaucauuccggauucuaacgcucaggagaucaaggacauuuacggucugaauggccagaucgagcacaaacuagcauuucucaggacucaugugcccaaggauaugaagcugguacuuauagggcacucaaucggaaguuauuucacgcugcagauguugaaacgggugccugaacucccagucauucgcgccuuucugcuguuccccaccaucgagcgaaugagcgaauccccuaacggccguauugcgacaccacucuuaugcugguuuagauacgugcuguauguuacugguuaccuuuugcugaagcccuguccugagaccaucaaaucucuacucauaaggcgggggcugcaagugaugaaucuugagaacgaguucucgccacugaauauuuuggaaccguuuugccucgcuaacgccgcauaucugggaggccaggaaaugauggaggucgugaagcgcgacgaugaaacaaucaaagagcauuuauguaagcugaccuucuacuauggcacuauugaccccuggugcccuaaggaguacuacgaagauaucaaaaaggacuuuccagagggggauaucagacucugugagaaaaauauuccccacgccuucauaacacacuuuaaccaggaaauggcugacaugaucgcagauucacuuaaggacgaccugagcaaaauguga

SEQ ID NO: 53630 - RNA, 876 nt, Artificial Sequence
  derived and/or modified sequence opt3 from C2orf47__Homo_sapiens__NP_078796
auggcccuggcugcaagacuccuuccccaguuccugcacagcagguccuugccuugcggcgccgugcgguuacgcaccccagcggucgcugagguucgacugccgucugccacacuauguuacuuuugccguuguagacucgggcugggagcagcccuuuuccccaggucagcucgggcacuggccgcuagugccuugccugcgcaagguagccgcuggccagugcucuccucucccggccugccugcagccuuugcuucguucccagccugcccccagagaucauauagcacugaagagaagccucagcagcaucagaaaacgaagaugaucguacugggguuuaguaacccaauuaauugggugaggacccggauaaaagcauuccucaucugggcuuacuuugacaaggaguucuccauuacagaauuuucugaaggagccaaacaagcguucgcccacgucagcaaguuacugucccaguguaaguuugaucuuuuggaggagcugguggcaaaagaaguucuacaugcucucaaggagaaagugacuucacugccggacaaccacaagaaugcccuugcugccaacaucgaugaaauugucuucaccaguacaggcgacaucagcauauauuacgaugagaaaggucgcaaguuugugaauauccugaugugcuucugguauuugaccucugcaaacauucccuccgagacucuccgaggggccucaguauuccagguuaagcugggaaaucaaaacguggaaacaaaacaguuacugagcgcuaguuacgaguuucagagagaguucacccagggcgucaagccugacuggacgaucgcgaggauugaacauucuaaacuccuugaauga

SEQ ID NO: 53631 - RNA, 1188 nt, Artificial Sequence
  derived and/or modified sequence opt3 from C2orf57__Homo_sapiens__NP_689827
auggcccugcccggcuacccucucgggaacguggacgauagcagauccaaggacucuccagcuggagagccgcagggucaagucccccuuaccgcagauguucuggccgugucaaguagcguagcguccacagacuggcaggauaucgaccaggcuucuuucaaaacugccacgccuagggcaauuucgaccucaggcgauaaggacaaaagcgccguggucccagaacacgggcagaagacaccccggaaaauaacuccuuuguuaccaagucaaaaucccuccccucuacaggugucuaugagccugcagaacccagcuugggaucgccagguucaagacgcacgaaccucccagucacucguggucuuuccgagucaucugcuuggaaaggauaagaugagccagauggccucugugcccgagcgugaaccugaguccgcuccaucagcccccagcgcggaacugcagaguacacaacacauggaggcacagccuguagagucugacgccgaucauguuaccgcuggcgccaauggucagcacgggccacaagcagcuuccacuacaaaaagcgccgaagagaaggcggaacaucccaaagccccgcacccugaggcagaggcuuugcccucggacgaaucuccaguggccaugggagcuaacgucguggacucccucggcgaucugcagaccugguucuuuccucccccacccgccggcucagugaguccuagcccagggccgcacgaggucgcacugggaagaaggccccucgacuccucuuuauauacggccagcgaagaaaauucauacaugcggaguaugacuucccugcuugaucgcggugagggcagcaucucuucauuggcugacauucugguuuggagugagaccacaauggggauggcgaucgcaacuggauuccuagauagcggccauuccaccguggccgaccuccugcacucuucggguccuagccuuagauccguaccaucacugguggggagugucucuagcgcuuuuuccucaggauuggugagcggcacaucuuccgcccucaggaccauuacgcggguucuggagacuguggaacagcgcacagucgagggcauccgaagugcaaugagauauuuaaccagccaucugacucccaggcaggcccaagcugauccuaacuacgacuga

SEQ ID NO: 53632 - RNA, 747 nt, Artificial Sequence
  derived and/or modified sequence opt3 from C2orf61__Homo_sapiens__NP_001157033
auggaccagcccgccguggcuaccgcaagcacauccaucagagaggaucuggucggcggggaaucuuucauuacugccucaaagccugcgcaaaagacgaguagcuuugagagggaaggaugguggcggauagcucucaccgacacaccaaucccggguacuuaccaccuuaagaccuucauugaggaaucccuguugaaccccguuaucgccacauauaauuuuaaaaacgagggccgcaagaaaccuccauuagugcagcgaaauaaccccguacugaaugaucuaccucaguacaugccacccgacuuccucgaucugcuuaagaaacagguggcaaccuauucuuuuaaagacaagccucguccaucgccgucaacucuggucgauaaagaccagagcuugcaacucagucccgggcaguacaacgugcugccugccccaguucccaaguaugcuuccagaucuugcguguucaggagcacaguccagcgguuuccuaccacguacuucauuccacaugagggacccggcccgggucacuauaaugugaaaaugccucccacuuccucaguaaccaguuguuuucaaagccgcguuccaagauuccugccuucuugcuccaagacacccgggccaggagcauacacuacccucaggcaguuucccaagcagucaccuacaaucgccaaaaugggccaggaacauagcuuauucuuuaacaauaacaauuggcugcuuaaguga

SEQ ID NO: 53633 - RNA, 1449 nt, Artificial Sequence
  derived and/or modified sequence opt3 from C3AR1__Homo_sapiens__NP_004045
auggccagcuucuccgcugagaccaacucuacagaccugcucucacagcccuggaaugaaccuccagugauccuuaguauggucauucugagcuugacuuuucuacugggccuaccggggaacggacucguucuguggguggcaggucuuaagaugcaaagaacgguaaauaccauaugguuccugcacuugacacucgccgaucugcugugcugucucuccuuacccuuuucucuggcgcaucuugcuuugcagggccaguggccuuacgggagguuccugugcaaacuaaucccaucgauuaucgugcucaacauguuugccucagucuuccugcuuacugcaauuagccuggaccgguguuuggugguuuuuaagcccaucuggugccagaaucaccgcaacgugggaauggccuguaguauaugcggcuguaucugggucguggcuuucguaaugugcauuccuguuuuuguguaucgagagaucuucaccacagauaaucauaaccguugugguuacaaauuugggcucuccucuagccuggacuauccagauuucuacggagaccccuuagaaaauagaucccuggagaacauuguccaaccuccaggcgaaaugaaugauaggcucgacccgucaaguuuucagaccaacgaucaccccuggacugugccuacaguguuccagccacagaccuuccaacggcccagcgcagacucucuuccucgcggcuccgccagacugacgucacagaauuuguauagcaacgucuuuaagccagcugauguugugagucccaaaaucccgucuggguucccuauagaggaccaugagacuucccccuuagauaauagcgacgccuuucugucgacccaccucaagcuguucccaucugcguccucaaacaguuuuuacgaaagcgagcuuccucagggauuccaggacuauuacaaccugggucaauuuacagaugacgaucagguacccacuccauugguggcaauuaccaucacaaggcucgucgugggcuuccuguuacccuccguuauuaugaucgccugcuacucuuuuaucguguuccggaugcagcgcgggcgauuugcuaagagccaaucaaaaaccuucagagucgccgugguaguuguggcagucuuucugguguguuggacgccuuaucacauuuucggaguccuaagucuccugacugacccagaaacaccgcuuggcaagaccuugauguccugggaucaugugugcauagcucuggccagcgccaauucuugcuucaaccccuuucucuacgcgcugcuugguaaagacuucaggaagaaagcacggcagucaauccaggggauucuggaggcugccuuuagugaggaauugacucguagcacacacuguccuuccaauaacguuaucucugagcgcaauucgaccacgguguga

SEQ ID NO: 53634 - RNA, 4992 nt, Artificial Sequence
  derived and/or modified sequence opt3 from C3__Homo_sapiens__NP_000055
augggccccaccagcgggccuucccugcuccuucuguuguuaacacaucugccacuagcccucggaucuccgauguacucaaucauuacucccaacauacugagacuugagagugaagagacgauggugcuggaagcucacgacgcacagggugaugucccuguuaccgugacaguacacgacuucccaggcaagaaauuggugcucagcuccgagaagacuguccugacccccgccacaaaucauauggggaacgugaccuuuacuaucccugcgaauagggaguucaaaucugaaaagggacggaacaaauuuguuacagugcaagcuaccuucggcacgcaggucguggagaagguaguucuggugucgcuccagucagguuauuuauuuauucagacugauaagaccaucuacacaccagggagcacuguccuguaucgcauuuucaccgugaaucacaaacuuuugcccgugggacgaacagucaugguuaacaucgaaaauccugagggcauaccagugaagcaagacagucuguccucucagaaccagcuaggcguacucccgcugagcugggauauccccgaacuugugaauauggggcaguggaaaauucgugccuacuaugagaacuccccucaacaggucuuuucaaccgaguucgaagugaaggaguacguucugccaaguuuugaagugaucgucgagcccacggaaaaauucuauuacauuuacaaugagaagggauuggaggugacuaucacagcaagauuucucuaugguaagaaaguagaaggcaccgccuucguuauauuugggauucaggacggagagcagaggaucagccugccugaaucuuuaaagcggauuccaaucgaggauggcuccggugaagugguccugucacgcaaagugcuccuugacgggguccaaaaccccagagcugaggaucuggugggaaagagcuuguacguuagugcaacugugauccuacauucuggcuccgacaugguacaggccgagaggagcggcauuccgauagucacaucgccuuaucagauccacuucaccaaaacgcccaaguacuucaaaccagggaugccuuuugaucugaugguguucguuaccaaucccgacggaucuccagcuuaucgggugcccgucgccgugcaaggugaagauacaguacagucccucacucagggcgacgggguggcgaagcugucaauuaacacccacccuagucagaagccacuuagcaucacaguucgcacuaaaaagcaagagcuguccgaagcagagcaggccacccgaacaaugcaggcuuugccguacucuaccgucggaaauagcaacaacuaucuccaucugucaguguuaagaacugaacugaggcccggcgagacgcuaaaugugaacuuucuccugcggauggaccgugcccacgaggcaaaaauacgcuacuacacauaucuuauuaugaauaaggguagauugcugaaagcugggaggcagguccgggaaccuggccaagaucucguugugcugccacuuaguaucaccacugacuucauccccuccuuucgacugguggccuacuauaccuugauuggagcgagcggccagcgcgagguagucgccgauucuguguggguugacgugaaggauucaugcgucgggagucucgugguuaagagcggacaguccgaagacagacagccugugccaggucaacagaugacacugaaaaucgagggcgaucauggggcaaggguagucuuaguggcuguggacaagggagucuucguucugaacaaaaagaauaaacuaacccagucuaagauuugggaugugguagagaaggccgacauaggcuguacucccgguucggggaaagauuacgcuggcguguuuagcgacgccggacucacauucacguccucaaguggccagcaaaccgcacagcgggccgaacugcagugcccgcaaccugcugcgcgcagaaggcguucuguccagcuuacugagaagcggauggacaaaguggggaaguauccaaaagaauugcgaaaguguugcgaggauggaaugagagaaaaccccaugagguuuagcugucagcgccggacaagauucaucucccugggugaggcaugcaagaaaguuuuucucgacuguugcaauuacauuaccgagcugaggcgccagcacgcccgagcuucacacuuaggccuggcccggagcaaccuugaugaagacaucaucgcagaggaaaauauugugucucguuccgaguucccugaaaguugguuguggaacgucgaggaucucaaggagcccccuaaaaaugggauaagcacaaagcugaugaacaucuuucuaaaagacucuauuacuaccugggaaauccuggccguguccaugucagauaagaaaggaauuuguguugcugacccauucgaggugacggucaugcaagauuucuuuaucgaccucagacugcccuauaguguagugaggaaugaacagguugagauacgcgccgugcuuuacaacuaccggcagaaucaggaauugaaggucagaguggagcuguuacauaacccagcauucugcagccucgcgaccacaaagaggcgacaccaacagacuguaaccaucccgccuaaaucgucccugucugugcccuaugucauuguuccacuuaagacaggccugcaggagguggaagugaaagcugccgucuaccaucacuuuaucagcgauggugugcgcaagucauugaaaguuguacccgaggggauucggaugaacaagacuguggcagucagaacccucgacccugaaaggcugggccgugagggagugcagaaggaggauaucccacccgccgaccuaagugaccaaguuccugauacggaauccgagacacgcauacugcuccagggcaccccgguggcucagaugacugaagacgccgucgaugcagagcggcugaaacaucuuauugugacaccaucuggguguggagaacaaaauaugaucggcaugacccccacuguaauugcuguccacuauuuggacgagaccgagcagugggaaaaguucggucuggagaaaagacagggggccuuagaacucaucaagaaaggauacacacagcaacuggcguuuaggcagccuagcuccgccuucgcugcauuugugaagcgagccccaucaacguggcuuaccgcuuauguugugaaggucuucagccuggccgugaaccuaauagcaaucgauagucagguucucugcggcgcggugaaauggcugauuuuggagaagcagaaacccgacggugucuuucaagaagaugccccugugauccaccaggagaugauuggcgggcugcggaauaacaaugagaaggacauggcuuuaacugccuucguacucaucucucugcaggaagcaaaagauauaugcgaggaacaggugaacucccuuccgggaagcauuacaaaggcuggcgacuuucuggaggccaauuacaugaacuugcaacgcucguauaccguugcaaucgccggguacgcucucgcgcagaugggaagacugaagggcccccuacugaauaaauuccuuacaacugccaaggauaaaaacaggugggaagacccagguaagcagcucuacaaugucgaggcaaccucauaugcucuguuggcccuguuacagcucaaagauuuugacuucgugccucccgugguccgguggcugaacgagcaacgauacuaugggggaggcuacgguucuacgcaggccacauucaugguauuucaggcucuugcacaauaucagaaggacgccccagaucaucaggaacugaauuuggacgugagucuccagcugccuuccagaagcucuaaaaucacccaccgcauucauugggagagcgcgucccuacugaggucagaagagacuaaggagaacgaaggcuucaccguuacagcugaggggaagggacaaggcacucuuaguguggucaccauguaccacgccaaagcaaaggaucagcucacauguaauaaauuugaccugaaggugacgaucaaacccgccccagaaaccgagaagcguccgcaggaugcuaagaacacuaugauuuuggaaauaugcacacgguauagaggggaccaggaugcaaccaugagcaucuuagacauuucuaugaugacuggauucgccccugauacagacgaucugaaacaacucgcgaacggcguugacagguacaucuccaaguacgagcuggacaaggcuuuuucagaucgcaauacccuuauuaucuaucuggacaaagugagucacagcgaggaugacuguuuggccuucaaaguccaucaguacuuuaacguggaacuaauacagcccggugcaguaaagguguaugccuacuauaaucuggaggaauccugcacgcgauucuaccacccagagaaggaagaugggaaacucaacaagcuguguagagacgagcuuugccggugugcugaggaaaauugcuuuauccagaaaucugaugacaagguuacuuuagaggaaaggcuggauaaagccugugagcccggagucgacuauguguacaagacccgccucgugaagguccaauugucgaacgauuucgacgaauacauuauggcaaucgagcagacaauuaaaagcggcucagaugagguucaggugggucaacagcguaccuuuaucuccccuauaaagugcagagaagcucugaaacucgaggaaaagaaacauuaucugauguggggccuuaguucugacuucuggggagagaagccaaaucugagcuacauuaucgggaaggacacuuggguagagcacuggcccgaagaggaugaaugucaggacgaggaaaaccagaaacaaugccaggauuugggcgccuucacagaguccaugguggucuuugggugcccuaauuga

SEQ ID NO: 53635 - RNA, 1704 nt, Artificial Sequence
  derived and/or modified sequence opt3 from C3orf17__Homo_sapiens__NP_056227
augauggccgcugugcccccuggccuggagccauggaacagagucaggaucccgaaggcagggaaucggagcgccguuaccgugcagaaccccggagcggcucucgaccuuugcauugccgcaguaauaaaagaaugucaccuggugaucuuguccuuaaagucucaaacacuggaugccgagacugacguccuaugcgcugugcucuacucaaaucauaaccgcaugggucgacacaaaccucaucuggcacuuaagcagguugaacagugucugaaacguuugaagaauaugaaccucgagggcaguauucaggaucuguucgaacuguuuagcuccaaugagaaccaaccacucacgaccaaggugugcgucgugcccucucagccuguaguugaguuagugcugaugaaaguccuuggggccuguaaguugcugcuaagacuccuggacugcuguugcaaaacauuccuucugacugugaagcacuugggacuccaggaauuuaucauucugaauuuagugauggucggccugguuucgaggcucugggugcuuuauaaagguguacugaagcgguugauccuacuguacgagccacucuucgggcugcuucaggaaguggcucgcauacaacccaugccuuauuuuaaggauuucaccuuuccaucagacaucacagaguuccugggacagccguacuuugaggccuucaaaaagaaaaugcccauugcguuugcagccaagggcaucaacaaauugcucaauaagcuguucuuaauuaacgaacagagcccuagagcuagugaggaaacccugcuaggcaucuccaaaaaggccaagcagaugaaaauaaauguccaaaacaauguggaucucgggcagccaguuaagaacaaaaggguguuuaaggaggaaucuagcgaguucgacguccgggcauucuguaaccagcugaaacauaaggcuacucaagagacauccuuugauuucaagugcucacagagucgccuuaaaaccacgaaguauagcucucagaaagugauuggaacuccccacgccaaguccuuuguacagcgauucagagaagcggagucauuuacccaauugagcgaagagauccagauggccguugugugguguaggaguaaaaagcugaaggcacaggcuauuuuccucgguaauaaacugcuuaagucuaaccggcugaaacacuuggaagcccagggcacaucccucccuaagaaacuggagugcaucaagacuagcaucugcaaucauuuacugcgugggucgggaauuaagaccucuaaacaccaucuacgccaaagaaggucccagaacaaguuucuccggcgacagcgcaaaccacagagaaagcugcaaucaacacuuuugagggagauacagcaguucagucagggcacccggaaaagcgcuacggacacuuccgccaaguggcgccugucucacuguacaguccacagaaccgaucucuaccccaauagcaaacaacuguuaaacucaggugugaguaugccggucauccagacuaaggaaaagaugauucaugagaaucugagggggauccacgaaaacgagacagacuccuggaccgugaugcagauaaauaaaaacagcacgucuggaaccauuaaggaaacagaugacaucgacgauaucuuugcacuuaugggcguuuga

SEQ ID NO: 53636 - RNA, 489 nt, Artificial Sequence
  derived and/or modified sequence opt3 from C3orf18__Homo_sapiens__NP_001165212
augaacagcagaaccgccuccgcuaggggcugguucucuucacggcccccuacaagugagagcgaccuggaaccagcaacugaugggccggccuccgagacgaccacacucucucccgaagcgacuaccuuuaaugacacacgcaucccugaugcugccggagguaccgcaggcguggggacuaugcuucugucguucggaauuauaacagucaucggcuuggccguugcuuuagugcuguacauucgaaagaaaaagcgucuagagaaacucagacaccagcugaugccaauguauaacuuugaccccaccgaggaacaagaugagcuugaacaggagcuguuggaacaugguagggacgcagccucaguacaggcugccacgagcgugcaggcgaugcaagggaagacuacccucccuagucagggaccacugcagcggcccucccgccuggucuucacagauguggcaaaugccauccacgcuuga

SEQ ID NO: 53637 - RNA, 2349 nt, Artificial Sequence
  derived and/or modified sequence opt3 from C3orf20__Homo_sapiens__NP_001171887
auggccagacaggugaggacccaccaagagacacugaaccgguuccagcagcagagcauccaucuccuuacugaacuguugcgcuuaaagaugaaagcuauggucgaguccaugucuguuggcgcaaauccccuggacauuacgcgacguuuuguggaagccucacaacuacuccaccugaacgcgaaggagauggcuuucaauugccuuauaaguaccgccgggagaagcggauacuccucuggucagcuguggaaagaaucguuggcaaacaugucagccaucggcguaaauagcccuuaucagcucauuuaccauaguuccacagcuugucugucuuuuagccuguccgcagggaaggaggccaaaaagaagaucggaaaaucaaggacuaccgaggaugugaguaugccaccgcuccaccggggcgucgguacacccgcuaacagcuuagaguucucugacccuugcccagaagcccgcgaaaagcugcaggagcuuuguagacauauugaggcggaaagggcaaccuggaaagggcggaauaucuccuaucccaugauauugcgcaacuacaaggccaaaaugccuucacaccugaugcuagcucgaaagggagauagccaaacuccaggccuccacuaucccccuacagccggcgcacagacccugaguccaacgucucauccguccagcgcuaaucaccauuuuucgcagcacugccaggaggggaaggcccccaaaaaggcguucaaauuucacuacacuuucuaugacggaucuuccuuuguguacuacccuucagguaacguugccgugugucaaaucccaaccugcuguagaggcaggacaauuacuugccuuuucaaugauauccccggguuuagucuguuggcacucuucaacaccgaaggacagggcuguguccauuauaaucugaagacaagcugcccuuacguguuaauucuggacgaggaaggugggaccacgaacgaucagcaaggauauguaguucacaaaugguccuggacuucucggacagagacccuccuuagccuggaguacaaggugaaugaagagaugaaauugaagguccuaggccaggacucaaucacugugacauuuaccagucugaacgaaacggugacccucacagucuccgcuaacaauuguccacauggcauggccuaugauaagcgucugaaccgcagaauaagcaauauggacgauaaaguuuacaagaugucuagggcucuugccgagauuaaaaagcgguuccagaaaacugugacccaguucaucaacucaauucuguuggcagccgggcucuuuacaaucgaauaucccacuaagaaggaggaggaagaguucguacgauuuaaaaugcgcaguagaacccacccggaaaggcugccuaaguuaagccuguacuccggagagucucuacuccggucgcaaagcggucaucuggaauccucaaucgcugagacacuuaaagacgagcccgaaagugcgccagugucuccuguccgcaagaccacuaaaauucacacgaaggcaaaggugacaagcagaggcaaagccagggaggggcguucccccacccggugggcugccuugccaucagauugcccccugguucuccgaaagcugaugcuuaaagaagacacuagagcaggaugcaagugucuggugaaagccccuuuggucagcgacguggagcucgagagguuccuguuagcuccacgcgauccgucucagguacugguuuuuggcauaaucuccagucagaauuacaccagcacaggucagcuacaauggcuccugaacacccuuuauaaucaccagcagcgggggagaggcucucccugcauucaguguagguacgacuccuaucgcuugcugcaauacgaucucgacucaccucugcaggaagauccacccuuaauggugaagaagaacagugucgugcagggaaugauccugauguucgccggcgggaaacuuauauuuggaggucgagucuugaauggcuaugggcucagcaagcagaaccugcuaaaacaaauuuuccggucgcagcaggacuacaagaugggauauuuucugccugaugacuacaaauucuccgugccaaauucuguucucagccuggaggauucagaaagugugaagaaagcagaguccgaagacauccaaggcucuagcuccucacuugcguuggaggauuacguagagaaggaacugagcuuagaggcugaaaagacucgugagcccgaagucgagcuccauccgcugaguagagacucuaaaaucacauccuggaagaaacaggccagcaagaaauga

SEQ ID NO: 53638 - RNA, 513 nt, Artificial Sequence
  derived and/or modified sequence opt3 from C3orf35__Homo_sapiens__NP_848029
augaagaccauggccacaagaaaaaggugcaagcugagccggacuggccccgaguucgaaaacgugaucaaacgccuccuuugugcucgaacguuucacacccguauugggggagaccugacacaugguauaaucaauagaggcaggcgggcaaacgccgagcagaugggguugcaaggauccgcgcagcacuucaauauuuuuccuuuagaucuguggacucagggcaagaaaaccgaaguccagaagcgcgaggguacagacucuaucccagcugccgggagaucaggaaccgcaaaccaaccgaguauugcuccccauaggugccuauucagccggggcaucacugcccucgauggccugaagcgcgggcgaggauguaauggugcagcccaccuuguuagaggcgacgcuuggaaaacaaagcugggggaaccuuggguguccauagccuuggcgcucgcaggaccaggcgccauccugauucuggagcucucuugguuuuuagguuga

SEQ ID NO: 53639 - RNA, 729 nt, Artificial Sequence
  derived and/or modified sequence opt3 from C3orf56__Homo_sapiens__NP_001007535
augggcaccggggccagcgagaagcaggcugaacaaaaagugagaagggcauucgaggccuccgaagaggcgcacggaacacuggcugccucuacucccugggucgcaauggguucagccuacggcaguugcacgugucucggggcucagccuguuaccgaccuugcacuguggccagugaucuauagcugcaugggauuuuccccgcaggccuaccccgcuuucugggccuauccuuggguauuguacggcgguuauuuauggaugggguacccacccccugcggcacuggugccaucugucuggcuauauuggcggggagccucgucauuugauccccucauuggcagcccuuaccuggcugcccuugcaccaaaccuguucccguuucccaugaaguucccuccaacauacaguuuggcuucccccacucucggcggggccaccucuagccauuguccucaggugggaugcuggacaccagcguccucagcaccccgcgccgcuguugaagguccgagucgaggcgccccuuaucugaaaaccuguaaggcucccccaagcgagugggccucucguuuugggauaugggcaccucugcccugcuguuccucagagcucagaccauuacccccuagcccaaucgaagacagucaacuggauccgggaugcucuagguccagcucgcggucucccugucgcgccagaaggcggcuuuucgagugcuga

SEQ ID NO: 53640 - RNA, 666 nt, Artificial Sequence
  derived and/or modified sequence opt3 from C3orf58__Homo_sapiens__NP_001127942
augaaaagcgagaacggcaccguggucggguccuuccccucugacgaaggauggccuuuugccaaguaccugggugcuugcggcagaaugguugcagugaauuauguaggggaggaacucuggucauacuucaacgccccaugggagaagaggguggaucuugcguggcagcugauggaaaucgcugagcaauugacaaauaacgacuuugaguucgccuuauaucugcuagaugucaguuuugacaauuucgcagugggaccgcgggauggcaaaguuauuauaguggacgccgaaaacguccucguggcugauaagcgccugauccgacagaauaaacccgagaacugggacguaugguacgaaagcaaguuugaugacugugauaaggaggcaugccuuuccuucucuaaagagauucugugugcccgugcuacuguugaccacaauuauuacgccgugugccagaacuugcucucgagacaugcgacguggagggguaccucagggggacugcugcacgauccuccaagcgaaaucgcaaaggacggccggcucgaggccuuacuggacgaaugugcuaaucccaaaaagcgcuauggcagauuucaggccgcaaaagagcuuagggaauacuuggcucaacugaguaacaauguccgguga

SEQ ID NO: 53641 - RNA, 1692 nt, Artificial Sequence
  derived and/or modified sequence opt3 from C3orf67__Homo_sapiens__NP_940865
augaucaagagaaaaauuuggugcaaccuguguauagaccucguggccuucaccagcgagaucuuuaagggcgcugucuuccagucccuugaugggauuguugugucugcaaauugcaaacugaggaagaucuuuacauugaaaucaaagccccaagacacugccgauaaggacgcgguauacggagugccuuucaguacggaugaaccaaccgacauuaucccgcggagcugucaguuaaugacagaugucccccacgugacucagcugcuaaacaugaccaaacuccgccagacagagauaaaguuugguggccauccucugcgauccgcugaaucugaccaauucaucaaucgugggaccucgauuacuagaaacucuaaaaaucaggauguuugccacaucgccuuuggaagcaaggugcuuggcccacccccucugagugguaggcggaacaauaugaaaauuuccucugagacaguccgcagcgugggguccaagaacaauagaucaugucagccaaguaccguagaaaagugcguuaacggaacggagaugagcgcauugcucauccccgagucugaggaacagggcaauaaagaaaacauacaucaaauuaagcagacugugccuauccacgccgcuaaucugcauauuaugcacccacacccgccccaggagccuuccgcagacaaaaacaauaacaggcggcgccugcgacucaagucaaccagcagagagaggacagaaacuccaaguggcucauccagcgggaacaaucggaucgaggauaaagccucgaccaucuuaacaaccgucucucagcaaggagcugaacugcuuaacuccgguacguugggcccccagucaccugaccagagugaugaguggauuuucccagaaaaugccgaccauauaagcuaucuggcguccucucgucaaagccuacuccugggggacgauucauguaaccccagucaccuuuggcuggaggcauccaaggagagcgaacaugaccagcaggccgaggaaucucagucagugccgaaagauaucuuuacuuucaguagccgcccuagauccgcuccccacggaaagacacaaaccaugucuccagaggaauugucguuuauucucgaccugaaggaggauaauagcgugacuuccagggacacacagucagaggaugacuucuacggcggugauaguucugaagaggaauaugacuggcggaacuaccagccuagccagauguccgagucagaauuacaaaugcuggccagccuccgauggcagcagaaugaggagcuugaagaugcagggaccucucacggacuguccgcuagucaggucgacaacugcaauguuagcaucucuacguccucagacgauaccacaacuuggaacaguuguuugcccccacccgugaaucaaggccgccauuaucagaaagagaugaacccuccaagcccgucgaaucccagagacuggcuaaacaugcuguccccuccaauaguacccccuucucagcagccagccgaacaaaggcccgauagcugcgagucacucagugugcagggcgaggaagaccuguccgucgaggaagaugaggaagugcuuacccuguuguacgacccgugucucaauugcuauuuugauccucagacagggaaguacuacgagcugguuuga

SEQ ID NO: 53642 - RNA, 303 nt, Artificial Sequence
  derived and/or modified sequence opt3 from C3orf79__Homo_sapiens__NP_001094807
augcacgugugcgaccugcagaagcucgucagaauccaacuugccuucaccacauuucccuggauguucagcugucaucuguugccuacuccagaguuauccucuaaaaggaaccagugccugcuauacaagacgucaggcugucucacccagaugccgauucuguaugggcaccccgcuacacuucugaaagauuacauauugcaggcaauccuccaaccuggaaagaaaauucaggguggcacugaaauccagcgggggaguuuugccaaucaguaucaaaccgacgcgagccaucuguga

SEQ ID NO: 53643 - RNA, 5097 nt, Artificial Sequence
  derived and/or modified sequence opt3 from C4A__Homo_sapiens__NP_001239133
augagacugcucuggggccuuaucugggccagcuccuucuuuacccugucuuugcagaagcccagguuacugcuauucucaccuagugugguccaccucgggguuccacugagcgugggaguacaacuucaggacgugccgcggggucaggucgugaaaggcuccguuuuucugcgcaaccccucucgaaauaacgugccuugcucgccaaaggucgauuucacauugucaagcgagcgugacuuugcucuccugagucugcaggugccccucaaagaugcaaaguccuguggguuacaucaacugcuuagaggaccugaaguacaguugguugcccacucuccauggcugaaagacagccuauccaggacuacgaauauucagggcauaaaccuccuguucucaagucggcgcggucaucuuuuucugcagaccgaucaacccaucuacaauccugggcagagagugagguaucgggucuucgcguuggaccagaagaugcgcccaagcacagauacuauuaccgugaugguggagaacucucacggacuccgagucagaaagaaagaaguuuacaugccguccucaaucuuucaggacgauuucgugauucccgacaucagcgagccuggcacauggaagauaagugcuagguuuucugauggccuggaauccaauagcucgacccaauucgagguaaaaaaguauguguuaccaaacuuugaggucaaaaucacucccgggaagccuuacauucugacagugccaggacaucucgacgaaaugcagcuugauauccaggcccgguauauuuacgguaagcccguucaaggcguggcauauguccguuucgggcuguuggacgaggacggaaaaaagaccuucuuucgcggccuagaaucucagacgaaacuggugaauggucagucccacaucucacucaguaaggccgaguuccaggaugcucuggagaaacuuaacauggggauaacugaccugcaaggauugagacucuacguagcagccgcuauuaucgaaagcccgggcggcgagauggaagaggccgaacugaccuccugguacuuuguuucuagcccuuucucauuagaucugaguaagacaaaaaggcaccuagugcccggggcgccauuucuccugcaggcacuuguccgggagauguccggaagcccugccucugguauucccgugaaggucucagcuacugugaguagcccaggcuccguucccgaggugcaggacauccagcaaaauaccgaugggucuggacagguaucgaucccuauuauaaucccacagacaauuagcgaauugcagcuguccgucucagccggcaguccgcaucccgcaaucgcucgacucaccguggccgcgccuccaucuggugggcccggcuuccugagcauagagcgcccugacuccagaccacccaggguuggagauacgcuuaaccugaauuugcgggccgugggcucaggggcaacuuuuagccacuauuacuauaugauucucucucgcggacaaaucgucuucaugaacagagaaccgaagaggacacugaccuccgugaguguauuuguggaccaucacuuagcuccuagcuucuacuuuguugccuucuauuaccacggugaucauccagucgcuaauucucugcguguggacgugcaggccggcgcaugcgaggggaaacuagaacucuccgucgauggagccaagcaguaucggaacggcgagucaguuaaacugcaccuugagacugacaguuuggcucugguggcgcucggugcacuggacacagccuuauacgcugccgggagcaagucgcauaaaccccugaacaugggcaagguguuugaagcaaugaauuccuacgaucuuggauguggcccugggggaggugacucugccuugcagguauuccaagcugccggccucgcauucagcgauggggaccaguggacccugucacgaaagagacuaaguugccccaaagagaagacgaccaggaaaaagcgcaacgucaauuuucagaaagcgaucaacgaaaagcugggacaauaugcuuccccaacagccaagcgguguugccaggauggcgugacuagacucccuaugaugaggucuugugagcagcgcgcagcccgaguucagcaacccgacugccgggaaccauuccugagcuguugccaguuugcugagucccuucguaaaaagucaagagauaaaggucaggccggguugcagagggcacuggagauuuuacaagaagaggaccucaucgaugaagacgauauuccggugcgcagcuucuuuccugagaauuggcuguggcgggucgagaccguggacagauuccagauacuuacacugugguugcccgauagucucacuaccugggaaauccacggccugucucuauccaagacaaaaggacuguguguugcuaccccagugcagcucaggguauuucgagaguuccaucugcaccuucgcuugcccaugagcguccggagauuugaacagcuggaguuaaggccugugcucuacaacuaucuggacaagaaucuuacugugucgguccacguuucaccaguggaaggccugugccuagccgggggaggcggucucgcgcaacagguacuggugcccgccgggucugcucguccugucgcauucagugugguuccgacggccgcugccgcaguguccuugaaggucguggcgcgcggaagcuuugaguucccaguuggcgacgccgugucuaaaguccugcagauugagaaggaaggugcuauccaucgggaggaauuaguauacgagcucaacccccuggaucacagaggcaggacacuugaaaucccugggaauagcgacccaaacaugauucccgauggagacuuuaauuccuaugugcgaguuaccgccucagauccucuggacacuuugggcagugagggggcacucagcccgggaggcguggcuucucugcuacggcugccccgcgguugcggggagcaaaccaugauauaccuugccccaacacucgcagccuccagauaucuggauaaaaccgaacaguggucaacuuugccucccgagacaaaggaccaugcugucgaucugauccagaaaggauacaugaggauucagcaauuccggaaggcggacggcaguuacgccgcaugguuaagccgagauuccucuacguggcucaccgcuuucgugcugaaaguacuuucgcuggcccaggaacagguggguggcagcccagagaaguugcaggaaacuucaaacuggcuccugucccaacagcaggccgacgggaguuuucaggauccuugucccguccuagacagaucuaugcaaggaggccugguugggaaugacgagacaguggcucuuaccgcauucgugacaaucgcccuccaccacggacuggcggucuuucaggaugagggcgcugaaccauugaagcagcgcguggaggccagcauuuccaaagcaaacucauucuuaggugaaaaggccucugcugggcugcucggagcacaugccgcggcuaucacugccuaugcacugacccuuacgaaagccccgguugaccuguugggcguagcucacaauaaccuaauggccauggcacaggagaccggugauaaccuguacuggggcagcgugacagggagucaauccaaugcugucagcccuacucccgccccaaggaaccccucugacccuaugccacaggcgcccgcccucuggauagagaccacagcauaugcucugcuucauuuacugcuccacgaaggaaaggccgagauggcugaucaggcaucagccugguugacucgucaaggcuccuuucaggggggauuccggaguacccaggacacggugaucgcccuggaugcucucagcgcguacuggauugcaucgcauacaaccgaagagagaggccugaauguuacucuuucuuccacagguaggaacggguuuaaaagccacgcccugcaguugaauaaccgccaaauccgaggacuagaagaggagcugcaguucucacucggcaguaagauuaaugugaaggucggcgggaacucuaaaggaaccuuaaaggugcugagaacuuauaauguacuugacaugaaaaacaccacaugccaggaucugcagaucgaagucacggugaagggucacguugaguacaccauggaagcuaaugaggacuaugaagauuacgaguacgacgagcucccugccaaagacgauccggacgcaccauugcaacccgugacuccucugcagcucuuugaaggccggaggaaccgccguagacgggaggcccccaagcugacaucccuuagcgauagguaugucucacauuucgaaaccgaggggccacacgugcuacuguacuuugacaguguuccuacaagccgcgaaugugugggauucgaggcuguccaggaggugcccguaggcuuggugcagccagcguccgccacuuuauaugauuacuauaauccugaacgaagaugcucuguuuucuacggugcaccgagcaagucccggcugcucgcuacccuguguucagccgaggucugccaaugugcagaagggaaaugccccaggcagcgcagagcccuugagaggggacugcaggacgaggauggcuaucggaugaaguuugcuuguuacuacccacguguggaauauggcuuccaagugaaaguccuccgcgaggacucucgagccgcguuuagauuguucgaaacgaagauaacacagguacugcauuuuaccaaagaugugaaggcagccgcuaaccagaugaggaauuuccuaguucgggccaguugccgccugagacucgagccugggaaggaauaccuuauuaugggacuggacggugcuacuuaugauuuagagggccacccccaguacuugcuggacucgaacagcuggaucgaggaaaugccauccgagaggcucugucggucuacccgacaaagagcagccugcgcucagcugaacgauuuucuucaggaauaugggacacagggaugccaaguguga

SEQ ID NO: 53644 - RNA, 5235 nt, Artificial Sequence
  derived and/or modified sequence opt3 from C4B_2__Homo_sapiens__NP_001229752
augagacugcucuggggacuuaucugggccagcuccuucuuuacccugucuuugcagaagcccagguuacugcuguucucaccuagugugguacaccucgggguuccacugagcgugggagugcaacuucaggacgugccgcggggucaggucgugaaaggcuccguuuuucugcgcaaucccucucgaaauaacgugccuugcucgccaaaggucgauuucacauugucaagcgagcgugacuuugcucuccugagucuacaggugccccucaaagaugcaaaguccuguggguuacaucaacugcuuagaggaccugaaguacaguugguugcccacucuccauggcugaaagacagccuauccaggacuacgaauauucagggcauaaaccuccuguucucaagucggcgcggucaucuuuuucugcagaccgaucaacccaucuacaauccugggcagagagugagguaucgggucuucgcguuggaccagaagaugcgcccaagcacagauacuauuaccgugaugguggagaacucucacggacuccgagucagaaagaaagaaguuuacaugccguccucaaucuuucaggacgauuucgugauucccgacaucagcgagccuggcacauggaagauaagugcuagguuuucugauggccuggaauccaauagcucgacccaauucgaggucaaaaaguauguguuaccaaacuuugaggucaaaaucacucccgggaagccuuacauucugacagugccaggacaucucgacgaaaugcagcuugauauccaggcccgguauauuuacgguaagcccguucaaggcguggcauauguccguuucgggcuguuggacgaggacggcaaaaagaccuucuuucgcggccuagaaucucagacgaaacuggugaauggucagucccacaucucacucaguaaggccgaguuccaggaugcucuggagaaacuuaacauggggauaacugaccugcaaggauugagacucuacguagcagccgcuauuaucgaauacccgggcggcgagauggaagaggccgaacugaccagcugguauuuuguuuccucuccuuucagcuuagaucugucaaagacaaaaaggcaccuagugcccggggcgccauuucuccugcaggcacuuguccgggagaugaguggauccccugccagcgguauucccgugaaggucucugcuacugugucaaguccaggcagcguucccgaggugcaggacauccagcaaaauaccgauggguccggacagguaucuaucccuauuauaaucccacagacaauuucggaauugcagcugagcgucuccgccggcucaccgcaucccgcaaucgcucgacucaccguggccgcgccuccaaguggugggcccggcuuccugucuauagagcgcccugacagcagaccacccaggguuggagauacgcuuaaccugaauuugcgggccgugggcuccggggcaacuuuuucacacuacuauuacaugauucucagccgcggacaaaucgucuucaugaacagagaaccgaagaggacacugaccucuguguccguauuuguggaccaucacuuagcuccuaguuucuauuuuguugccuucuacuaucacggugaucauccagucgcuaauagccugcguguggacgugcaggccggcgcaugcgaggggaaacuagaacucucugucgauggagccaagcaguaccggaacggcgaguccguuaaacugcaccuugagacugacucauuggcucugguggcgcucggugcacuggacacagccuuauacgcugccgggaguaagagccauaaaccccugaacaugggcaagguguuugaagcaaugaacucguaugaucuuggauguggcccugggggaggugacuccgccuugcagguauuccaagcugccggccucgcauucucugauggggaccaguggacccugagccgaaagagacuaucaugccccaaagagaagacgaccaggaaaaagcgcaacgucaauuuucagaaagcgaucaacgaaaagcugggacaauacgcuaguccaacagccaagcgguguugccaggauggcgugacuagacucccuaugaugagguccugugagcagcgcgcagcccgaguucagcaacccgacugccgggaaccauuccugucuuguugccaguuugcugagagccuucguaaaaaguccagagauaaaggucaggccggguugcagagggcacuggagauuuuacaagaagaggaccucaucgaugaagacgauauuccggugcgcucauucuuuccugagaauuggcuguggcgggucgagaccguggacagauuccagauacuuacacugugguugcccgauagccucacuaccugggaaauccacggccugagucuaucuaagacaaaaggacuguguguugcuaccccagugcagcucaggguauuucgagaguuccaucugcaccuucgcuugcccauguccguccggagauuugaacagcuggaguuaaggccugugcucuauaacuaccuggacaagaaucuuacugugagcguccacguuucgccaguggaaggccugugccuagccgggggaggcggucucgcgcaacagguacuggugcccgccgggucagcucguccugucgcauucucugugguuccgacggccgcugccgcagugaguuugaaggucguggcgcgcggauccuuugaguucccaguuggcgacgccgugagcaaaguccugcagauugagaaggaaggugcuauccaucgggaggaauuaguauaugagcucaacccccuggaucacagaggcaggacacuugaaaucccuggaaauucugacccaaacaugauucccgauggagacuuuaauagcuacgugcgaguuaccgccuccgauccucuggacacuuugggcucagagggggcacucaguccgggaggcguggcuagccugcuacggcugccccgcgguugcggggagcaaaccaugauauaucuugccccaacacucgcagccucuagauaccuggauaaaaccgaacagugguccacuuugccucccgagacaaaggaccaugcugucgaucugauccagaaaggauacaugaggauucagcaauuccggaaggcggacggcucauaugccgcaugguuaagucgagguagcuccacguggcucaccgcuuucgugcugaaaguacuuucucuggcccaggaacaggugggcgggucgccagagaaguugcaggaaacuagcaacuggcuccugucacaacagcaggccgauggauccuuucaggaccuaaguccugucauccacagaucuaugcaaggcgggcugguuggaaaugaugagacaguggcucuuaccgcauucgugacaauugcccuccaccauggccuggcggucuuucaggacgagggugcugaacccuugaagcagcgcguggaggccagcaucuccaaagcaucaucuuucuuaggggaaaaggccagcgcuggacugcucggcgcacacgccgcggcuauaacugccuacgcacugacccuuacgaaagccccagcugaccugagggguguugcccauaacaauuugauggcaauggcucaggagaccggcgauaaccuauauugggggaguguaacaggaucccaaagcaacgccgugucuccgacuccugcgccccguaauccaucagaccccaugccucaggccccagcacuguggaucgagaccacagcuuacgcccuccugcaccuuuuacugcaugaaggcaaggcugagauggcagaucaggccgccgcuuggcucacucggcaaggguccuuucagggaggcuucagaaguacccaggacacggucauugcguuggaugcacugagcgccuauuggaucgcuucgcacacaaccgaagagaggggucucaacgugacucugucuuccacagggcgcaauggauuuaaaagccacgcccuucagcugaacaaucgacaaauuagaggcuuggaagaggagcuacaguucucacugggcaguaagaucaacguuaagguaggggguaauucuaaagggacccucaaggucuuacggacuuacaacgugcuggacaugaaaaauaccacaugucaggaucuucagauagaaguaacggucaagggccauguggaguauaccauggaagcaaacgaggacuacgaagauuacgaguaugacgagcugcccgccaaagaugacccugacgcuccgcuccaaccaguuacucccuugcagcuguuugaagggaggcgcaaucguagacggagggaggcgccuaagguggucgaggaacaggaaucccgcgugcacuacacaguuugcauuuggcgaaacggaaaggugggccucagcgguauggccaucgcagaugucacccugcuuucaggguuccaugcucuaagagccgaccuggagaaauugacaaguuuaagcgaucgguaugugucccacuuugagacugaaggaccccauguacugcucuacuucgacucugugccaaccagcagggaguguguuggcuucgaagcaguccaggaggugccugugggccugguccaacccgccuccgcuacgcuuuaugauuacuauaauccagagcgcagaugcucaguauuuuacggggccccuucuaagaguaggcugcucgcgacauuguguucggcagaagugugccagugugccgagggaaaaugcccgcggcagcgucgcgcucuggaacgaggucuacaagacgaggauggcuacagaaugaaguucgccuguuauuaccccaggguugaauauggguuucaggugaaaguccugcgggaggacagccgcgcugcauucagacucuuugagaccaagauuacucaggugcuucacuucaccaaggauguuaaagccgcugccaaccagaugaggaauuuucuggugcgggcauccugccgauuaagauuggaaccaggaaaggaguaccugaucaugggccucgacggugcgacauaugaucuggaagggcacccucaauaccuucuggacucuaacucauggauagaggaaaugcccagcgagcgccucuguagguccacucggcagcgugccgcuugcgcccaguugaacgauuuccugcaggaguauggaacccaaggcugccaggucuga

SEQ ID NO: 53645 - RNA, 5235 nt, Artificial Sequence
  derived and/or modified sequence opt3 from C4B__Homo_sapiens__NP_001002029
augagacugcucuggggccuuaucugggccagcuccuucuuuacccugucuuugcagaagcccagguuacugcuauucucaccuagugugguccaccucgggguuccacugagcgugggaguacaacuucaggacgugccgcggggucaggucgugaaaggcuccguuuuucugcgcaaccccucucgaaauaacgugccuugcucgccaaaggucgauuucacauugucaagcgagcgugacuuugcucuccugagucugcaggugccccucaaagaugcaaaguccuguggguuacaucaacugcuuagaggaccugaaguacaguugguugcccacucuccauggcugaaagacagccuauccaggacuacgaauauucagggcauaaaccuccuguucucaagucggcgcggucaucuuuuucugcagaccgaucaacccaucuacaauccugggcagagagugagguaucgggucuucgcguuggaccagaagaugcgcccaagcacagauacuauuaccgugaugguggagaacucucacggacuccgagucagaaagaaagaaguuuacaugccguccucaaucuuucaggacgauuucgugauucccgacaucagcgagccuggcacauggaagauaagugcuagguuuucugauggccuggaauccaauagcucgacccaauucgagguaaaaaaguauguguuaccaaacuuugaggucaaaaucacucccgggaagccuuacauucugacagugccaggacaucucgacgaaaugcagcuugauauccaggcccgguauauuuacgguaagcccguucaaggcguggcauauguccguuucgggcuguuggacgaggacggaaaaaagaccuucuuucgcggccuagaaucucagacgaaacuggugaauggucagucccacaucucacucaguaaggccgaguuccaggaugcucuggagaaacuuaacauggggauaacugaccugcaaggauugagacucuacguagcagccgcuauuaucgaaagcccgggcggcgagauggaagaggccgaacugaccuccugguacuuuguuucuagcccuuucucauuagaucugaguaagacaaaaaggcaccuagugcccggggcgccauuucuccugcaggcacuuguccgggagauguccggaagcccugccucugguauucccgugaaggucucagcuacugugaguagcccaggcuccguucccgaggugcaggacauccagcaaaauaccgaugggucuggacagguaucgaucccuauuauaaucccacagacaauuagcgaauugcagcuguccgucucagccggcaguccgcaucccgcaaucgcucgacucaccguggccgcgccuccaucuggugggcccggcuuccugagcauagagcgcccugacuccagaccacccaggguuggagauacgcuuaaccugaauuugcgggccgugggcucaggggcaacuuuuagccacuauuacuauaugauucucucucgcggacaaaucgucuucaugaacagagaaccgaagaggacacugaccuccgugaguguauuuguggaccaucacuuagcuccuagcuucuacuuuguugccuucuauuaccacggugaucauccagucgcuaauucucugcguguggacgugcaggccggcgcaugcgaggggaaacuagaacucuccgucgauggagccaagcaguaucggaacggcgagucaguuaaacugcaccuugagacugacaguuuggcucugguggcgcucggugcacuggacacagccuuauacgcugccgggagcaagucgcauaaaccccugaacaugggcaagguguuugaagcaaugaauuccuacgaucuuggauguggcccugggggaggugacucugccuugcagguauuccaagcugccggccucgcauucagcgauggggaccaguggacccugucacgaaagagacuaaguugccccaaagagaagacgaccaggaaaaagcgcaacgucaauuuucagaaagcgaucaacgaaaagcugggacaauaugcuuccccaacagccaagcgguguugccaggauggcgugacuagacucccuaugaugaggucuugugagcagcgcgcagcccgaguucagcaacccgacugccgggaaccauuccugagcuguugccaguuugcugagucccuucguaaaaagucaagagauaaaggucaggccggguugcagagggcacuggagauuuuacaagaagaggaccucaucgaugaagacgauauuccggugcgcagcuucuuuccugagaauuggcuguggcgggucgagaccguggacagauuccagauacuuacacugugguugcccgauagucucacuaccugggaaauccacggccugucucuauccaagacaaaaggacuguguguugcuaccccagugcagcucaggguauuucgagaguuccaucugcaccuucgcuugcccaugagcguccggagauuugaacagcuggaguuaaggccugugcucuacaacuaucuggacaagaaucuuacugugucgguccacguuucaccaguggaaggccugugccuagccgggggaggcggucucgcgcaacagguacuggugcccgccgggucugcucguccugucgcauucagugugguuccgacggccgcuacagccguguccuugaaggucguggcacgcggaagcuuugaguucccaguuggcgacgcggugucuaaaguccugcagauugagaaggaaggugccauccaucgggaggaauuaguauacgagcucaacccccuggaucacagaggcaggacccuugaaaucccugggaauagcgacccaaacaugauucccgauggagacuuuaauuccuaugugcgaguuacugcuucagauccucuggacaccuugggcagugagggggcccucagcccgggaggcguggcaucucugcuacggcugccccgcgguugcggggagcaaacaaugauauaccuugcuccaacccucgccgcauccagauaucuggauaaaacugaacaguggucaacauugccucccgagacgaaggaccaugccgucgaucugauccagaaaggauacaugaggauucagcaauuccggaaggcugacggcaguuacgcggccugguuaagccgagguuccucuaccuggcucacugcauucgugcugaaaguacuuucgcuggcucaggaacaggugggcgggagcccagagaaguugcaggaaacaucaaacuggcuccugucccaacagcaggccgauggaaguuuucaggaccuaucuccugucauccacagaagcaugcaaggcgggcugguuggaaaugaugagaccguggcccuuacagcuuucgugacuauugcacuccaccauggccuggccgucuuucaggacgagggugcggaacccuugaagcagcgcguggaggcuuccaucucaaaagccucuagcuucuuaggggaaaaggcaagugccggacugcucggcgcucacgcagccgcgauaaccgcuuaugcccugacgcuuaccaaagcaccagccgaccugagggguguugcucauaacaauuugauggccauggcacaggagacaggcgauaaccuauacuggggguccguaacuggaagccaaucuaacgcugugucaccgaccccugccccccguaauccauccgaccccaugccucaggcgccagcccuguggaucgagacaacugcauaugcucuccugcaccuuuuacugcaugaaggcaaggccgagauggcugaucaggcagccgccuggcucacccggcaagggaguuuucagggaggcuucagaagcacgcaggacacagucauugcuuuggaugcgcugucggcauacuggaucgccucucacaccacugaagagaggggucucaacgugacacuguccagcaccgggcgcaauggauuuaaaucacacgcucuucagcugaacaaucgacaaauuagaggcuuggaagaggagcuacaguucagucugggcucuaagaucaacguuaagguggggggaaauuccaaagguacucucaaggucuuacggaccuauaacgugcuggacaugaaaaauacaacgugucaggaucuucagauagaaguaaccgucaagggccauguggaguacacuauggaagccaacgaggacuaugaagauuacgaguacgacgagcugcccgcaaaagaugacccugacgccccgcuccaaccaguuacacccuugcagcuguuugaagggaggcgcaaucguagacggagggaggcuccuaagguggucgaagagcaggaaagccgcgugcacuauaccguuugcauuuggcgaaacggaaaggugggccucucagguauggcgaucgccgaugucacacugcuuaguggguuccaugcacuaagagcugaccuggagaaauugacuagcuuauccgaucgguacgugucucacuuugagaccgaaggaccccauguacugcucuauuucgacagcgugccaacguccagggaguguguuggcuucgaagccguccaggaggugccugugggccugguccaacccgcaucagccacacuuuacgauuauuacaauccagagcgcagaugcucuguauuuuauggggcuccuaguaagucgaggcugcucgccaccuuguguagcgcggaagugugccagugugcagagggaaaaugcccgcggcagcgucgcgcccuggaacgaggucuacaagacgaggauggcuacagaaugaaguucgcuuguuacuaucccaggguugaauacggguuucaggugaaaguccugcgggaggacucccgcgccgcuuucagacucuuugagacuaagauuacccaggugcuucacuucacaaaggauguuaaagcagccgcuaaccagaugaggaauuuucuggugcgggccucuugccgauuaagauuggaaccaggaaaggaguaucugaucaugggccucgacggugcaacuuacgaucuggaagggcacccucaauaucuucuggacucaaacagcuggauagaggaaaugcccuccgagcgccucuguaggaguacccggcagcgugcggccugcgcucaguugaacgauuuccugcaggaguacggaacacaaggcugccaggucuga

SEQ ID NO: 53646 - RNA, 1794 nt, Artificial Sequence
  derived and/or modified sequence opt3 from C4BPA__Homo_sapiens__XP_005273308
augcacccuccuaagaccccaagcggcgcccugcauagaaaaaggaagauggcugcauggccguucucccggcucuggaaagugucugaccccauccuuuuucagaugacacugauugccgcguuguuaccugcuguccuggggaacugcggaccacccccuacucuaucauucgccgcaccaauggauauaacgcucaccgagacacgcuuuaagacugguaccacacugaaauacaccugucuucccggcuauguucgaagucacagcacucaaacacugaccugcaauuccgacggggaauggguguacaacacguucuguaucuauaagcguugcagacauccuggagaguugaggaauggccagguagaaauuaagacugaucucucuuuugguucgcagaucgaguucucauguagcgaaggguuuuuccugauuggaaguaccacaucccggugcgaggugcaggaccgcggcgucggcuggucucacccacugccgcaaugugagaucgugaaaugcaagcccccuccagauauaagaaacgggaggcauagcggagaagagaauuuuuacgccuaugguuucuccguuacuuacucaugugacccccgguuuagucucuuaggccacgcuagcaucucuugcaccguggaaaacgagacaauuggggucuggcgcccuuccccacccaccugugagaaaaucacgugccgaaagccggaugugucacacggagaaaugguaagcggcuucgguccuauuuauaauuacaaagacacuaucguuuuuaagugccagaagggguucgugcugagaggaaguucugucauacauugugaugcagacuccaaauggaaccccagcccacccgccugcgagcccaauucguguauuaaccuuccagauaucccccacgcuucuugggaaacauacccuaggccaaccaaggaggacguguauguggucggcacuguuuugcgguaccguugccauccgggcuauaaacccacaaccgaugaaccuacgaccgugauuugucagaagaaucugcgcuggacaccauaccaggggugcgaggcccuauguugccccgagccuaaacucaacaauggagaaaucacucaacacagaaaguccaggccagcgaaccacuguguauauuucuacggugacgagaucucauuuaguugccaugaaaccagccgguucuccgcaauuugucagggcgacgggacauggucuccccgaacuccgagcugcggagauauaugcaauuuuccuccaaaaaucgcccacggccauuauaagcagucaaguuccuacagcuucuuuaaggaggaaauuaucuacgagugugacaaagguuauauacugguggggcaggcuaaacuuucuugcucauacagucacuggagcgcccccgcaccucaauguaaggcucugugccgcaagcccgaguuggucaacggcagacucuccguggauaaagaccaguauguugaaccagagaacgugaccauucagugugauucuggauacggcgucguggggccucaaucgaucacaugcagcggaaauaggaccugguaucccgaaguaccaaagugugagugggaaacuccggaggguugcgagcagguucugacgggcaagcgguuaaugcagugucugccuaaccccgaagacgugaaaauggcccucgaggucuacaaacuuucccuggaaaucgagcaguuggagcuacaacgcgauucagcgagacagaguacacuggacaaggaacucuga

SEQ ID NO: 53647 - RNA, 759 nt, Artificial Sequence
  derived and/or modified sequence opt3 from C4BPB__Homo_sapiens__NP_001017365
auguucuuuuggugcgccuguugccugaugguggcuuggagagucagcgcauccgacgccgagcacugucccgaacucccuccaguugauaacucuaucuucguggcgaaggagguagaaggccagauucuugggaccuacgugugcauaaaaggauaucaucuggucgguaagaaaacauuguuuuguaaugcuucaaaggagugggacaacacuacgaccgaaugcagguuaggccacuguccggaucccgugcugguuaauggggaguucaguagcuccggaccugugaacgucucugacaaaaucacauuuaugugcaaugaucauuacauucuaaagggcucgaaccggucacaaugucucgaggaccacacuugggccccacccuucccuaucugcaagagccgcgauugugacccacccgguaauccugugcauggguauuuugaaggaaacaauuucacccugggcaguacaauuuccuacuauugcgaggaucgauacuaucuuguaggcguucaggaacagcagugcguggacggggaguggucuagcgcacugccagucuguaaauugauccaagaggccccgaagcccgaaugcgagaaagcucuccuggcauuucaggaauccaagaaccugugugaggccauggaaaauuucaugcagcagcucaaagagucaggaaugaccauggaggaauuaaaguacagucuggagcuuaagaaagcugaauugaaggccaaacugcuauga

SEQ ID NO: 53648 - RNA, 753 nt, Artificial Sequence
  derived and/or modified sequence opt3 from C4orf22__Homo_sapiens__NP_001193926
auggaccaggaggaaggccugaaggcccucgauaacaucgugacccaauucaaugcuuacgaggacuuucuugauagccagauuacaacugucgaccuguauuacuuggaagaugagacguuagcaagacagcugguugaacuaggguauaggggaaccggugagcgggugaaacgcgaggacuucgaagcccgaaaggcggcuauagagaucgcccgucucgcagaaagagcccagcagaaaacacugacuuccgcuggcaaggaucuucaagacaacuuucugaccgcauuggccaugagggaggaggauaaucggucugggaaacucucacugaaccagcaggaaacagacgcugcccacauucugaagaagcaacucgcgaguguaaucuucauucgcgauagaaauagccauggacaggagaucuccggcuacauagacuaugcacacagguuaaaaaccgaagauuuugagguguacuucacugguaagaaacggcugcuuccccgcccuacagacaucucuuuuuauaacugggacgccgauauugcugucucaaauucgagcccaaacuaccaggugaucgccgacaauccggaaggguugcuguuccgauacaagagagauaggaaaauucuaaacguugaccccaaggcacagccuggagauaauaguacccggaucacgauacucacugagcuguaugugcaagcugucauuuuugaccauaucucccgucgcaagaccuga

SEQ ID NO: 53649 - RNA, 531 nt, Artificial Sequence
  derived and/or modified sequence opt3 from C4orf26__Homo_sapiens__NP_001193910
auggccagaaggcacugcuucagcuacuggcugcucguguguuggcuugucguuaccguggcugaggcacuguccacauuuuauuugcagcaacauaucaacuuacacauggacaagaaacgguaccugcgccuacucgaaauucauaagauaaugcgaacucugcccacggcccguucucuucacucaccucugcauuugccaagaggcguaaggagucaggggccgagccccucccagcggcacccuggagugccaucuaucuucuuucacgagggucccgaaucgauucucggcuuccagaccgaucugucaagccugcaaggggucacaacuguguuucauaguucccacuucaucggacauaccguuacacucuuaauuggcaucucuccugaggaagacagccgcgaggaggcgcaccugagaaaagcugaaagggaggaaaagccaaaacacaccgaggccaagaagucccuuucauuucggaaaaagcagcagaaagauuucugcuuuauauuccgcaauuga

SEQ ID NO: 53650 - RNA, 1041 nt, Artificial Sequence
  derived and/or modified sequence opt3 from C4orf27__Homo_sapiens__NP_060337
auggugggcgggggagguaagagaaggcccggcggggagggaccucagugcgagaaaaccacagacgucaagaaaagcaaguucugugaagccgauguuuccucugaccugcggaaagaaguggagaaccacuacaagcucucacuuccagaagauuuuuaucauuucuggaaguuuugcgaggagcuggacccggaaaaacccagugauagcuuguccgcuucuuuaggccugcagcuaguagguccuuacgacauccucgcagggaagcacaaaacuaagaaaaagucgacgggacugaauuucaaccuucauuggcgcuuuuauuacgauccacccgaguuccaaaccauuauaaucggcgacaauaagacacaguaucacaugggcuacuuucgagauucaccugacgaguucccaguguaugucgggauuaacgaagccaaaaagaauuguaucauugugcccaacggagauaauguuuuugcggcugugaaacuguucuugacuaagaaacuccgugagaucaccgacaagaaaaagauaaaccugcugaagaauaucgaugaaaaacucacagaggccgcaagagaauuagguuacagccuggagcagaggaccgucaagaugaaacaacgggacaagaaagugguaacuaagacauuucauggcgccgggcuuguugugccugucgacaagaacgaugugggauaccgcgaauugccagagaccgacgcugaucugaaaagaauuugcaagacgaucguggaggcagccagugacgaagagaggcuaaaggcuuucgccccgauucaggaaaugaugacuuuuguccaguucgcgaaugaugagugugacuauggcaugggucucgaacuggggauggaucuuuucugcuacggaucccacuauuuucacaaaguugcaggccagcuguugccccucgccuacaaccuguuaaaacggaaucuguucgcugagaucauagaggaacaucucgccaaccgcucucaagagaauauugaccagcuugcagcuuga

SEQ ID NO: 53651 - RNA, 399 nt, Artificial Sequence
  derived and/or modified sequence opt3 from C4orf32__Homo_sapiens__NP_689613
augugcagcgccggcgagcugcucagagggggagacgguggcgaaagggaugaggacggggaugcucuugcagaacgggaggccgcgggaaccgaaugggaccccggcgcuuccccucgccgacguggucagagaccaaaggagucugagcaagauguggaagacucacagaaccacacaggggagccggucggagaugacuacaaaaagaugggcacucuguucggcgaauugaauaaaaacuuaaucaauaugggguuuacgaggauguauuucggagagcggauuguugagcccgugauaguaaucuuuuucugggugaugcugugguuucuaggucuccaggcccugggccuugucgcagugcuguguuugguuauuaucuacgugcagcaauga

SEQ ID NO: 53652 - RNA, 600 nt, Artificial Sequence
  derived and/or modified sequence opt3 from C4orf33__Homo_sapiens__NP_001093253
auggacuucaagaucgagcacaccugggauggcuuucccgugaaacaugaaccugucuucauuagacugaacccaggggacaggggaguuaugauggauauaagcgccccguuuuuccgggaucccccugcuccacucggugagcccggcaagccuuuuaaugaacuuugggacuacgaggugguagaagcauucuuucugaacgacaucacagagcaguauuuggagguggaauuaugcccacacgggcaacaucugguccuacuccuguccggacgccgaaauguguggaaacaggagcuuccccugucuuuccguaugucaagaggcgaaacuaagugggaggguaaagccuacuugccuuggaguuauuuuccaccgaacguuacgaaguucaauagcuuugcgauucacggguccaaggauaaaaggucuuacgaggcucucuaucccgugccucagcaugaacugcagcaaggacagaagccagacuuccacugucuggaguacuuuaaaucguucaacuucaauacccucuuaggcgaagaguggaagcagcccgaaucagaucuguggcuuaucgagaaaugcgacauuuga

SEQ ID NO: 53653 - RNA, 354 nt, Artificial Sequence
  derived and/or modified sequence opt3 from C4orf36__Homo_sapiens__XP_011529917
auggccuacggcgugcccagaaagaacaccgucaaaacaauccugagggggagcugcuauaauguucaggagccuugggacauugcucuccuugcaaagacuugguccacgaaccuggccaauauaaaauugccauucuuagaagagaucucuuuuggagguucagugcaacugaccaaguguacaacuauuaaagauggccuacucccgagugcggaaagcaucaagcuggagcgggaauacgagguaaagcgccuuugcaaacugaagugucaggagaacaccuccaaagaaauucaguugcuccugcgagagcgucccgcugggcugagaaggccucucccaucuaaguga

SEQ ID NO: 53654 - RNA, 288 nt, Artificial Sequence
  derived and/or modified sequence opt3 from C4orf48__Homo_sapiens__NP_001135408
auggcucccccuccagccugcagaagcccgaugucucccccuccaccccugcuccuucuguuguuacugucccuagcacuccugggcgccagggcgcgggcugagccugccgggucagcagugccagcccagagucgccccugugucgacugccacgcuuucgaauuuaugcaacgagcacuucaggaucugcguaagaccgccuguagcuuggacgcuagaacagagacucuccugcugcaggccgaaaggcgggcgcucugcgcauguuggccugccggacauuga

SEQ ID NO: 53655 - RNA, 609 nt, Artificial Sequence
  derived and/or modified sequence opt3 from C4orf51__Homo_sapiens__XP_011530499
augagccacuacuucuaucugacaccccagauccuccuuccuuuuuccccacugaccucucaagaguucgacuugauuagaaggaaggccggcgcuucauggcaggaugaaacucgguggagugacagcuccgugacgaccuacacagggucuuaucgcaaaaagcaguuagauaaaucgaugugcucacaguuuagcuuccgagcaggacaacaugagccggaauguaagcagaugagucugacuaacuccucugccugccaccuacucuguugggcggguacccaggagacaaccgacauaaaaggccuguuucccgauaucacucguccuuucaaaaagagcuuugacgucaaacaugggguugcucaccagauuugggauuucggagacugcuuuccaacacccccuaauuacggcaaguauugugugagaccaaagaagcccgcccaagaagcacuuaucaacuacuccaggcgggguaaagggguacugaagcauuugcacggacgcugcgauucagagaguaagguguguagcucugaggacuccgaagccgauagauauucagacuacggcuggggcgggccuagcaguccauucaauuga

SEQ ID NO: 53656 - RNA, 1053 nt, Artificial Sequence
  derived and/or modified sequence opt3 from C5AR1__Homo_sapiens__NP_001727
augaacagcuucaauuacaccacacccgacuauggccacuacgaugacaaggauacucuggaccucaacacgccuguggauaaaaccuccaauacacuuagagucccagacauccuggccuugguuauuuuugcugugguauucuuaguggggguccugggaaacgcccuagugguuugggugacugcauuugaggcgaagaggaccauaaaugcuaucugguuccucaaccuggccgucgcagauuuucuuucuugccuggccuugccgauucucuucacaucaaucgugcagcaucaccauuggcccuuugguggcgcugcauguaguauucugccuagccugauccucuuaaauauguaugccuccauacugcuuuuggcuaccaucucugccgaccgguuccugcuaguauuuaaaccaauuuggugccaaaacuuccgcggggcgggacucgcauggaucgccugugcuguugccuggggccuggcacuucuguugacuauucccucguuucucuaccgagugguccgugaagaguauuucccuccaaaggugcugugcgguguggauuacucacacgacaaaagaagggaacgggcugucgccaucguucgcuuagugcugggguuucucuggccccuucugacauugaccauauguuauacguucauucuacugagaacuuggagcaggcgggcgacccgcaguacaaagacucucaagguaguggucgccgugguugcauccuucuuuaucuucuggcugccuuaccaggugaccggaauuaugaugucuuuucuugagccaagcuccccgacauuccuguugcucaauaaacuggauucauuaugcgucaguuuugcuuacaucaacuguugcaucaaucccauuauauaugugguagccggccagggcuuccaggggcgacugagaaagagccuaccuucucuccugaggaacguucuuaccgaagaguccgugguccgggagucaaaaaguuuuacgcguagcacuguggacacaauggcucaaaagacccaggccgucuga

SEQ ID NO: 53657 - RNA, 1014 nt, Artificial Sequence
  derived and/or modified sequence opt3 from C5AR2__Homo_sapiens__NP_001258679
augggcaacgacagcguguccuacgaguauggggauuacucugaccugucagauagacccgucgacugccucgauggagccugucuugcuaucgacccucugaggguugcaccauugccguuauaugccgcgauuuuccugguggguguacccggcaaugcuaugguggccugggucgcagggaagguggcccggcgccgaguuggagcuaccuggcuacuccaccuggcaguggccgaucuucugugcuguuugagucucccuauacuggcugucccaaucgcccguggcggucauuggcccuacggggcggugggaugcagagcacugccuagcauuauccucuuaacaauguaugccuccguacugcuuuuggcugcccugucugcagaccuauguuuucucgcucugggcccagccugguggucgacuguucagagggcgugcggcgugcaagucgccuguggggcagcuuggacgcuugcccuguugcucaccgugcccucagcuauuuaccggcgccugcaccaggaacauuucccugccagauuacagugcguggucgauuauggagguagcaguuccacagagaacgcaguuacugccaucagguuucuguucggcuuucucgggccacuuguggcuguagcgucuugucacagcgcacuguugugcugggccgcucggcgcugucgaccgcuaggaaccgccauaguggucggcuucuuugugugcugggcacccuaccaucugcucggucugguucuuacaguggccgcuccuaauuccgcccuguuggcaagagcgcucagggcugaaccacugaucgucggguuagcccuggcacacucaugccuaaaccccaugcuguuccucuacuuuggacgggcccagcuucgucgcaguuugccugcugccugucacugggcacugagagagagccaaggccaggacgaaucuguggauuccaaaaagucaaccagccaugaccucguaagugagauggagguuuga

SEQ ID NO: 53658 - RNA, 5031 nt, Artificial Sequence
  derived and/or modified sequence opt3 from C5__Homo_sapiens__NP_001726
augggccugcucgggauacuuugcuuccugauauuuuugggaaagaccuggggucaggagcaaacauacgugauaagcgcccccaaaaucuucagagucggcgcuuccgaaaacauuguuauccagguguauggguacacugaggcauuugacgccacgauuucuaucaagucauauccugauaaaaaguucaguuacagcuccggacacguucauuuaucuucggagaauaaauuucagaacucagcgauucugaccauccagccaaagcaacugccgggcggucagaaucccgugagcuaugucuaccucgaggugguuaguaagcacuucuccaaaucuaagaggaugccuauuacauaugacaacggguuucuguucauccauacugauaaaccaguguacacccccgaccagagcgucaaggugcggguauacucccuuaaugaugaccugaaaccugcuaagcgcgaaacaguuuugaccuuuauugauccagagggaucagagguggacauggucgaagagaucgaucacauaggcauuaucaguuuccccgacuuuaagauuccuagcaacccacgauauggcauguggacuaucaaagccaaguacaaagaagauuucucuacaaccgggacggcauauuuugaggugaaggaguacgugcucccgcauuucuccgucucaaucgaacccgaguauaauuucauuggauacaaaaacuuuaagaauuucgaaauaacuaucaaagcccguuauuuuuacaacaagguugugaccgaggcugacguauacauuacauucgguaucagagaagaucugaaggacgaccagaaagagaugaugcaaacugcaaugcagaauaccaugcugauaaacggcauugcccaggugacauuugauagcgagaccgcugucaaggaacucaguuauuacucuuuagaggaccugaauaacaaauaucuuuacaucgccgugacgguuaucgaauccacugggggauucagcgaggaagcggagauuccuggcaucaaguauguguugucgccauacaaacugaaucuagucgcaacaccccucuuucugaagccugguauuccauaucccauaaaggugcagguaaaagauucucuugaccaacugguugggggagugccggucaccuugaacgcccagacuaucgaugugaaccaggagacauccgaccucgauccuucaaagagugucaccaggguggacgauggcguugcuagcuucgugcugaauuuacccuccggcguaacgguccuggaauuuaacgugaaaaccgacgccccagaucucccugaggaaaaucaagcacgggagggguaccgcgcuauugccuacucuagccuuucacagaguuaucuguacaucgacuggacagacaaccacaaggcguugcuaguuggagaacaccugaauaucauugugacucccaaauccccauauauagauaagaucacccauuacaacuaucucauucugagcaaggguaaaaucauucacuucggcacaagagagaaguuuucugacgccucauaccagaguaucaauauacccgucacucagaacauggugccuagcuccaggcuucugguauauuacaucgugaccggggagcaaacagcagaauugguuucugauucggucuggcucaauauugaggaaaaauguggaaaccagcuacaggugcauuuaagcccagacgcugaugccuacuccccgggccagaccgugucacugaauauggcuacugguauggacaguugggucgcccuagcagccguugauucugcuguguauggggugcaacggggcgcgaagaaaccccucgagcgcguauuccaguuucuggaaaagagcgaccuuggaugcggcgcagggggagguuugaacaaugccaacgucuuccaccuggcuggccucacguuccugacaaaugccaacgcagaugacucccaggaaaacgaugagccuuguaaggaaauccuucgaccaagaaggacccugcagaaaaagauugaggaaaucgccgcuaaauacaagcacucagugguuaaaaagugcuguuaugacggggccugcgugaauaacgaugagacuugugagcaacgggcagcgcguauuagcuugggaccccgcugcauaaaggcuuuuaccgaauguugcgucguggccucucagcucagagcaaauaucucccauaaggacaugcagcugggcagguuacacaugaagacacugcuaccuguuaguaaaccagagauucggagcuacuuccccgaaucuuggcucugggaggugcaucugguaccgcgacgcaagcagcuucaauuugccuugccugacucccugaccacuugggaaauccagggugucgggauaucaaacacaggcaucuguguggcugauacggugaaagccaaggucuucaaagacguuuuucucgagaugaauauuccauauagugugguaagaggagagcagauccaacugaagggcaccguguacaacuauaggacuagcgggaugcaguucugcgucaagaugucggcaguggaaggaauuugcacauccgagucucccguuaucgaucaccaggguaccaaaagcucaaagugugugcggcagaaagucgaaggcaguuccucucauuuagugacauuuacuguucugccucuugagauaggguugcacaauauuaacuucagccucgaaaccugguuuggaaaggagauccuggugaaaacgcuacgcgucguacccgagggcgugaagagagaauccuacucagguguuacccuggacccaagggggaucuacggcacaauuagccgucggaaggaguucccuuaucgaaucccccucgaucuggugccaaaaacugaaauuaagagaauacuuagugucaaaggauugcuggugggcgagaucuuaucugcuguacucucccaagaggggauuaauauccugacccaccuuccgaagggaagcgccgaagcggagcugaugucgguggucccuguauuuuacguguuccauuauuuggaaacaggcaaccacuggaauauuuuucauucagacccccucaucgagaaacagaagcugaagaaaaagcuaaaagaagguaugcugucuauaaugaguuacaggaacgccgauuauuccuacagcguguggaaagggggaucugcuagcacuuggcucaccgcauucgcccugcgcguccuuggccaggugaauaaauauguugagcagaaccaaaauuccaucugcaacucauugcugugguuaguagagaacuaccagcucgacaaugguaguuucaaggaaaacagccaguaccagccaauuaaacugcaaggcacgcuucccguggaggcucgggaaaauucucuguaucuaacagccuuuaccgucaucgggauuagaaaggcauucgauaucuguccucucgugaagauagacacugcgcugauuaaagccgauaacuuuuugcuggagaauacauuaccagcucaguccaccuucacucucgccaucucagcauacgcucugagucuuggagacaagacccacccccaguuuaggagcaucguuuccgcccugaaacgcgaagcauuggugaagggcaacccuccgauuuaucgauucuggaaagauaaucuccaacacaaggacucuucggucccaaacacagggacggcccggaugguggagaccacugcuuacgcgcugcuaacaagccugaaucuuaaggacauaaacuauguaaaucccgucaucaaauggcucucagaggaacagcguuacggaggcgguuuuuauuccacccaggauacaauuaacgccaucgaggggcugacugaauacaguuugcuggugaagcaguuaagacucucuauggacauugauguuagcuacaaacauaagggagcacugcacaauuauaaaaugaccgacaagaacuuccuuggcaggccuguggagguccuguugaaugaugaccucaucguguccacggguuuuggcucagggcuggcuacaguucaugugaccacugucgugcacaagaccucuacaagcgaagagguaugcaguuucuaccuaaaaauagauacucaagacaucgaggccucccauuaucgcggauacggcaacagcgauuauaagcggauuguggccugugcuucuuacaaaccaucaagagaagaguccaguagcgggucgucucacgcaguuauggacaucucccugcccaccggaauuagcgccaacgaagaggaucuuaaggcgcucgucgagggcguggaccagcuguuuacagacuaucagaucaaagauggucacgugauauugcaguuaaauucaauuccuaguucugacuuccugugcgucagguuccgaaucuuugaacucuucgagguaggguuucuguccccggcuacguucaccguguacgaauaccaucgccccgauaagcaauguacuauguuuuauagcacaucaaacaucaagauucagaaaguuugcgagggagccgcauguaagugcguggaagccgacuguggccagaugcaggaggagcuugaucugaccaucagugcugaaacucggaaacaaacagcaugcaagccagagauagccuacgcguauaaagucagcauuaccuccaucacgguggaaaauguuuucgugaaguacaaggcuacuuugcuagacauuuauaaaaccggugaggccgucgcagaaaaggauucugagaucacauuuaucaaaaaggugaccugcacuaacgccgagcugguaaaaggcagacaguaccucauuauggggaaggaagcucugcagaucaaauauaauuucagcuuuagguacaucuacccucuugacuccuuaacauggauugaguauuggccccgugauaccacauguucaucuugccaggccuuccuggcaaaccucgacgaauuugcugaggauaucuucuugaauggauguuga

SEQ ID NO: 53659 - RNA, 1329 nt, Artificial Sequence
  derived and/or modified sequence opt3 from C5orf22__Homo_sapiens__NP_060826
augagcgacuccgccggcgggagagcuggacugaggcgguaccccaagcugccugugugggucguugaggaucaccaggaagugcuuccauucaucuaucgcgcaauugguucuaaacaucugccggccucaaacguaaguuucuugcacuuugacagccaucccgauuuacugauaccugugaauaugccagcggacaccgucuuugauaaggagacacuauucggcgaacucuccaucgagaacuggauuaugcccgcuguguacgccgggcacuuuucucauguuaucugguuccacccuacuugggcacaacagauucgagaaggacgucaccauuuucuggugggcaaagacacgucgaccacaacuaucagagucaccucaacagaucacuauuuccuuagcgacggucuguacgugccagaggaucaguuggagaaucagaagccccuccaacuggacguaauaaugguuaaaccuuauaagcugugcaacaaucaggaagagaacgaugccgugaguuccgcuaagaaaccaaagcucgcauuagaagacucugagaauaccgccagcacuaacugugauuccucaagugaggggcuggaaaaagacacagcuacccagaggagcgaccagacgugccuugagccgucuuguuccugcucaagcgaaaaucaagagugucagacugccgcgaguaccggagaaaucuuggagauucugaagaaaggcaaggcauuuguccuagauaucgaccucgauuucuuuucugugaagaaccccuucaaagagauguuuacacaggaagaguacaagauucugcaggaacuuuaucaauucaaaaagccuggcacuaaucugaccgaggaagacuugguggauaucgucgacacacggauacaucagcucgaggaucuggaggccaccuucgcugacuuaugcgauggggacgaugaagagacgguucagcgcugggccuccaacccaggaauggaaagccuggugccccucguacaaucgcuuaaaaagagaauggaggugccugacuacgaaaugguccaccaggcaggucugacuugugacuacucugaguugccacaccauauuuccacagagcaggaaaucgagugccuaauucagucagugcacuaucugcucaaaaaucugcccaacccgacccuuguuacuaucgcuaggaguagccuggaugacuacuguccuuccgaucaaguggacacaauccaggaaaaggucuugaauaugcuccgggcccuguauggcaacuuagaucuccagguguacgcggccgagucucccccaagcuga

SEQ ID NO: 53660 - RNA, 621 nt, Artificial Sequence
  derived and/or modified sequence opt3 from C5orf30__Homo_sapiens__NP_149988
auggagguggacaucaacggcgaaagcagauccacccugacaacucuccccuucccuggggccgaggcuaauucuccaggaaaggcagaagccgagaaaccgaggugcucaaguacgcccuguagcccuaugcggcgcaccgucuccgguuaccagauucuucacauggauucuaacuaucugguuggcuuuacaacuggggaagaguuguuaaagcuggcgcaaaaaugcaccggaggcgaggaaucgaaggcugaggccaugccaucacuacgaagcaaacagcucgacgcaggucuggcccguaguuccagacuuuacaagacaaggucucgguauuaccagcccuaugaaauaccugcugugaaugggcgcagaaggcggcgcaugccaagcuccggagauaaguguaccaaaucacugcccuacgagccuuauaaggcauugcauggcccacucccgcugugccugcucaaaggcaagcgagcccacaguaagagcuuagacuaccugaaccuugauaaaaugaucaaggagcccgcugacacugaaguauugcaguaccaacugcagcaucuaacacucagaggggauaggguguucgcccggaauaacaccuga

SEQ ID NO: 53661 - RNA, 1917 nt, Artificial Sequence
  derived and/or modified sequence opt3 from C5orf34__Homo_sapiens__NP_940968
auggccgcugagcugagaaugauccucuacgaagacgauagcgugcagguccaauauguugacggcuccacccuucagcugucucccugcgggucagaguucuuguuugaaaagaguccuccagugagcgcacacccguuagagcagcccgaaaggauucggcagcgcacacauuucguaauauccacuuaccgagagcaacugcagcgugcccuagauuuuagaaacucuucggcgacguguccuuuccucucagagaccaucauuccaagcgaaaggaaaaagcacaucuuuauugacaucacagaggugcgguggcccagucuggauacugacggaaccaugauauauauggaauccgguaucgucaaaauuacaucucuugauggccaugcuuaccugugcuugccucgcagccagcacgaguucaccgugcauuuucucuguaagguuucccagaaaucagacaguagcgccgugcugucugagacuaauaacaaggcaccaaaggauaaacuggucgaaaagacagggaaaaucugcauuagaggaaaucuccccggccaaagguuaaagaacaaagagaaugaguuccacugucagaucaugaaguccaaggagacccugaaaaagaugucaugcgugaacgguacggaagggcgggaggagcuuccuagcccaggaacuaaacacaccuguguauauacauggguuaagcagugcuggaguguggccgcuuguccggaagaguggaaauaccccuugucucuggcacuacauuuucacaauaagauauccaacaugagcaaaauugacgcccauaucacucagucgcgcuuccucaccucugauauuuccgaagaacgaggcaaggucgugucagugcugccuagagcucuuagucugagcugcccagucccccacuugcacagguggaauuuuugugacucccuccugcaacggcagucugaugaauauagcuacccugaguuaguuaagauggugugguacaaaggcguaacauaucgucugacccaucagaacaugaacucaaucgagaucuacaguggggacggauccguguucaagagcgaaggugccuauuuuggcaauuacuucacguauuacucuauucaagaggggucaggaaaacgcgaagagaagacuuauagugucaauaaccucccacccgacagaccgggcagcccuuucacaguggguucccuuauaaaacaggcgaccaggauccugcagcacugcguuaagaugcgguugucucuaucgcauaauuaccgaauuugcuguuggaagauggugcccgggaucaacgauagcaacauacugccacucguccugaaagaaucccuuauuccuucagugggacgcuuucuggcauacagugacgauaagguacacgccaucuucuuggacggcaucacucucacacugaauuggaacuuuucuagccccauugagaaaagacagguuaaucaaggcuuaaaccugggguggugcaagcuaaccuucccagauggacaggagcagcucauccagauugaacaucccgagccuuaugaaagguacgugacgaccgucacauccuggugucggcgccugacucaaaccucaccaagagagaugccgacacacucaucuuccagugugcuucaggagaauuggagcgucgcuucugaauuggagaaaauacagaaguuuaaccugcuccuggaaaauuccgguauccuuaaccagauuucaaauaagaaaaacgagcaacagaguuucgaccacuauaagcccggcagcucggaaacucuguugggggaggugaaugagaacaggguuuccaucgcccucaaaaagaccucugaaauccugcaugauauugacugcuuacugagcaauagcaaaaaguga

SEQ ID NO: 53662 - RNA, 213 nt, Artificial Sequence
  derived and/or modified sequence opt3 from C5orf38__Homo_sapiens__NP_001281266
augguggcccccgcugcaagagucuuccugagggccguucgggcggcucucaccagcacagugccugaccuucugugcuuguuagcccgcggcuccccacgagggcuggcaucuggacgucuaccgcucgccguacacucagcucagcauggucccggcaguggggcaccuuggcugagaaucgccaggcgggcucuuagccaacgcauuuga

SEQ ID NO: 53663 - RNA, 9594 nt, Artificial Sequence
  derived and/or modified sequence opt3 from C5orf42__Homo_sapiens__NP_075561
auggaaaucagacuggaaauucucacaagcacaggcauuaagcagaaaaagcccuggccuaggguguccuggcuugggaaagaaaaggaagccgucuuccuguuggacgauaaauuuaucaacgaaauuaauuuacugucuggaaagaucaagaaaaagauuccaucacuccaaccguuccucaaagacguuaucgugcugacuacgaguagcaacgaugcuuggcuugccggugugcugaccacaggcgaauuguuucucuggaauaaggaccaagauugccugaaaacuauacccaucaccgagaagccuaaggagaugauuaaagccacaguggcguccucucugcggcucuacuuauaugucucggggaacggaaagcgcaucgugcugauuaccccaucaggcuguaucuuccuuugggaauacuuggagcugaaaaauauacuuagcaguaagucccucucucuggcuggucgauggagccagguuauucccgaagaggccgugcuucugccuuccacugaggacaaagaagcagucgugaacgccguauuuaucaagaaugaguuguucggggauugcugucucugcucauuuacauucuauaguggagaaugucugaaauuaaccuuucuggcuauucguuggcacgagaacguuuucacgagcgugagaucucucccauaccauguccacugggcacagcaagacugccaucuuuguucccugauccccaagugcgaaucagugaagucaaggggcgccuugaucagugcuuuuucucgggauggccugacucuggccgugacccucaaucagaaagacccuaaggcgacacagguccuguucauuaacacucuuaauuuuguuacccuguguggguccuugaaaggaugcagcaacaagucgccagugguaccggcaacacucauacgcucuuauugggugggugauaucuccuggacccacgacucacuguucuuagccuguaugcugaaaagaggcagucuaguccuccugacgugccagggggagcuuuugacucugauuacauucggaugcagcaucgaguuuggccccgcugaguucauaccucuccauccacugauuaccuacaggccccaacaguuuacuuuccaggauuccaauaacucuguggacagcucagccagugacuccgauccuaugcggcagcgcuuuagcaucaaggcacacucucgacuuccauaucugguuaucucagacgguuacauggugacaaccuugagauuccucgauagucugagccccuccguccacaugaggucuuuacugcuagacucgacgcaacggcucgagaagauuuaccagagcgugauccuguccaaaccgaaggggaaaggacuuaauuugcguucacugaacagucuccgcucuagccuguuagaacaucagggcaacgaguccucagcugauuuuaccguaccuaaguuccugcaagccgaagagacaauuaaugagaacgcggccgacuuucaggauuucgaagcagaggaaacuaaugagggcagacacuuucccgacaaccuuuguccauucuggaauaaaagggaugacguuuugugcagcucuaugaaggaagggcggcucgaguuugcuuccauguucgauaccauacaugccaaggacgacagugaggaaacagaucgaacuaucaccgagcugcacagcauucagaaaucucuacuggcugccuggacaaucggaaucuccaagaccgugacugagaaaaaucucaugcugaauuauauugucguguguauaacgcacuucuuuuacauccuucaguucauuaagugcccuuuucccaaauuggaccuggucuuaucaaagaguagccgccauaacgcauggauccucuguauuuuccaacuguuucaccagugccuuucgauccauuauugggauauaagauacaagcaggacgugggucaccugaucaaauugacauccaauaccguuaagcuccugcuaacucagcaacagaaaggccagcuguucucugagaagcuccuggccuguuuuuaucuuuugaaaaugguggcugauaaccugaaugggguauacauuuuacagccagaggucaucagcgcgucagcagacggaaguaagauuaccgcccaagauucccucgugguucccaucuuccagauguuucaggacucuggcuuccagaaaaacuggagcuggaacuccuuuuucaagauacauccucaaguggucaacccagugcagcagccgggucacaggcugcuuauucuguggcggauccuauauaagaaaacacucugguaccaagcucagcugaaucgcagaguacccgaagccgauucacaguugaccgagaagaugacucacgaagcaagcacagugaaaagucuguuaugccaucuccaggccaaccugcaaucuacgggggacugucuuaaccagacccuggaguugaaguccauuaauggcgaagagugcuuucuccugggaagcuacgagaaaucgguucagcuauggaagaaggcucugcaggaaaucgaggaaaaaggcgggaggcguacuuauuuccuucaaauacgguacuaucucucacuguuguacugucaccuguauucuuacaacuuaaaugaugcccagggacucugcgaccagcuggcacgagagauccuuagauggagucagcugccugucaaggaaaacaaagauuucuccggugcggcuaagagccauuuugagugcggcaugguagggggagugcacccagaggccgcagucaggguugugcaaucuauggcccgcuucauggcugccuauuuuacaaaucagcaguuguguauucuacccccucaccaugugaacguacugccaccccuacacaucaaaaccgaacagagcuuccggcugauuccgcuucagcauuccaaggucgcaucagugguuagagaccagaaucucaguaacguguggacagucgaguacgcucuggaauuguuauuuaucggcggucuggugccugaggccguuuggcucgcguacaagcugggggacuggaaaacuagcgugucuauaggcguagccuuccagcuauuuugcaagagggauuccaauuucaugcgcagcaaaaagaaaagucugaacuugccacuacgaaugacccccgcucaaauuuuucaggaaaagcugcaguguguccucggacagccugcaagccuggaggccaagaaugagaugggcuccaaauauaagcaauucacggaccccaucgaagaggaagaugcuaaccuuuuauuugggucugugcaggaggugcugaaagccucggucauggcagacgcggauauccucagcgagaccuuccaguugcugauugacucagccaaggauuucuccaaacggcucuggggacugguuccauuuggucuuuaccugccugcucccccauuguauugcccgcagccugccauccuaagugaagaggacggcgaugaccugcucuuaaaggcagagaaaaauaaccgucaaaaggugucugggauucugcagagaguacuucuacucuucagggcugcccaguguagcuuucccguggcacagugguacauauugcaacugcgcugggcccggaaggucaugcagaaaaucagaaugaagggaucccucccaucacugucucccuucccucagagccuucuaaauuauugcaaaggcgguauugcauuuuucaggccaggggcggccggcgaucacaagcuggacgaggugaguauccgagcaauuggauguuuucgcgaauugugcgcuuuauguuggaugcugcauguucgggauaaacucuccuacagcugcagacaauaucagaaggccagggagaacgugaagggcgagaaagaccuggaagucgaguucgacucuuguaugaucgaacacugccuuucagccguggagugggcuuaccguaugcugcccuuuucccgcuucuuuaacauggaagaacucauacaggauaucauuuugagucugaucggggagcuaccuccgauucggaagguugcagaaaucuucgugaaagccuuuccauaccccgaggacgucagaguaccucugagggauaaguaucacagccuccaucagcgacuucggcacugcgugguuaaaggaccacaaacagaagagaugaugucgguggucaugcauucuauacagaaggugcgcguaaaggcgcugaaaagagugcagaggaauauuggcuccuucgaagucaacaucugggagcccaucgaggaagagaagccugacgaagcuccggguguugaucgguacagcuuagggacuucauugagucgaucuacccugacagagcucggagacuccguggugcacagcgaugccgacacuuucucagaggcacugagugucgaagagaaaagcagaauuaauauauaucagcgcaacgcccccaaucauauggaacuuaccuccauccacaagccaacggauaaaaggaagauguguaaccaaaaggagaauccuaccaaaaaggaagaccacgagaaacugucucagaacacccuccccgugauuggcguuugggaguuugaacgugaugacgacgaguacaucaaguucuuggaucuguuuuuaagcuauauucuagaacgggaccugccauacuccagagaugcugacaucccuuuccucacuucauuuucugguaaacuuagggagcaugaacugaauaguuugcuguucgauguacacacaacccucaagcgccaucagucgaagacuaaaagccagaacguguuucgagcaggcuccugcuucgucguggcccccgagucuuaugagucagaaaagagcuccagucugaaugacgaguacgggaugcaccuugaaaaccaaaaacucucuagcucaguucuggugaaucagggaauaaagccauuuuugcaguacccguccaacgaggucaauaaaaacgaaggcaugagugggcuguucggauuaaagcaaagaagcaucuauaaaauucaggaugacacccgggagaagugucuaauccagaggucuuccaaccacauauuuuggacaccuaagucaaucaaaacgcgccguugcauauucaaggcgauucaguguaaugauaucaacccccaagaggaccugccacucgcucuuaauaccuuuggcagcaucgguagacuguuggaauggaugauucgguggucgaacaggcgccugcucugcgauucugggaucacugagaguuccagcgaauacucacccgugauacgaguaaaaacauccaccgccgcaauucugacaucucuuugguuacuggagcagccuuauuucgccacuuacaaggcuaaaaaugccaucauuaagauggucgagaacagagacaccggaugucagaucggcccaaauauagaacgggagagcaagagugaugcugguggcuccguggcuguugccacgcccgggggaacagaagagaggaacggccagaauaaaagcugccaaaacauucucaaucgcaugccuaccgaagcgaagaacccggacaucaaagagaucaaugacgauauuaucucuauuacucauaacaccaagaaagaguucauagacaucgaugaaaauuugcuggagguggaagccuuuacagaggaagagauggacaugcacauuucagauuaugaggaagacaucgaggaaagugucgggggauucagauccccaagccuagcaaucuguaugaugacucugccccagcagcucgaggaagaguuuaccgaggaagugcagugccaaagggaggaaccucuugagacaauuauggaggaaaagucuacggagcagaagggcaugauagaggcuuucucgcaucccggucacaccacuccacagucaaugcagguugauacaagcuccgagaucaguucugcccaaauuagcaccuacaaagaaaaguccucaagugugccucuguugaucucuaacggggucaauguggcuagccagcccccagcaccuacuccgcagaaaacacaacggaacgaguuuaccgcccagcugcccgacuguuccgagucaguacgucagaugcuccaggaugaaauguucaagcuggugcaauuacagcagauuaacuuuaugagccuuaugcagaucguuggaucuuccuucgccaaucugccagacacgcaacagcucguccagcagagucaaagcgugcaucuaggcgagucgcaggaauccaaccugcgcgguugcggcgauguggaggacucuaauaaaaacuugaaggaacgauuuuucauaaagccucagucaaugggggagaaugcuagagagcccaggaaaaacagcccacacugccacgaaggaacuaucccuaguggccaaaauuccaccgggaacguccagaauguaccccauggaucuauuccgcugugucagcucaacggccagccacggaagaaagguccuauccccagcucacaaaaucuuccauccacaaguuuuuaucccgcgccugcagggaacacccaccuguacuugcugagcacuccgucugugguucagaaggcaccccgccucauuccacaugcuaaaacauucucaccuggagauggcuuucccuuacugcaguucaaguccaaacaggaguuccaaccucuuuuucugcacaccggcagcaucccacaggugcccuucagaccucuaccacagcccagggaagccugggggcucucugacaguuuucagccggcacugccucaacgggccgcucagacaacuccagcgucgcacuugaaugucucccaguacaacaccgaggcccgaaagaaggaaguggagcagaaaacgugggcagagacaguuauaaccgaaauucccaaucaugugaaccuggaccaguaugucggacaggagaaccucacuccucagcaagauagcucaguguucaucaagccagaaaaacuuuuugacguaaagcccgguacccuggagauuucuccgcaccauagcuucggcuuaccucuguuguaccucccccugaaaccaccuaauauguuucccuccacaaguagagcuucaaucacugugccaucuacccccauacagccuaucgccgaggaacgcaaguauccaaggcuaagccuucugcacucccaucucaguccggagaaccggugcaagaaaacgcagcugauucccuuggaaaaucugaucgcauucaagcagagccaacagaaacucacacacaaccuuuuugagcagggggaugccggacaucugcaauuacugaagguuaaaauugaaccuccagagguccgucaaggcaaggacuccaagaaaagacagaggcgccgggcugagaaggaauugcaggagaaacgaugugaaaagcucagaaggaaacccaaugugaccuuccgcccugagaacucuaucauaaauaacgaugacucagaaauuaucaagaagccaaaagagcagcaagagcacugcgguagccacccccuggaugacuuugaugugccuuucgaaaugcuacaggacgauaauacuucggccgggcuucauuuuauggcguccgucaagaaaaaggcaaucggaagucaggacgccucuacaaacaccgacccggagcacgaaccacugacugcuccccaacuccugguuccugauguguacuugaauuuaaaacugagcucagagauguccgaaaagcccuggucuccaaguauuccucacacaguaaccaaccucgagcuucccgugcgggaggaaccaagcaaugacaacgucaucaaacagcaguccgaucaucuggccgugccgucaagcgcugagcuacacuauauggcagccucuguuacgaaugcugugccuccccauaacuucaagagucagggccugccaaagcccgaguucagauuuaaaggccaauccacuaagagcgacucagccgaggauuaccucuuguggaaacgucugcagggggucucugcagcguguccugccccauccucggcugcccaccagcuugagcaucugagcgcaaagcuccagaaaauagacgaacaauuacuggcuauucagaacaucgccgagaauauugaacaggauuuccccaagccugagauguuggaccugcacugcgauaagaucggaccgguagaccacauagaauuuaguucugguccagaguucaaaaagacccucgcauccaaaacaaucagcauuucagaggaagugagguuucuuacccauauggaugaggaagaccagagugauaagaaagagacauccgaacccgaguucagcaucacugagaacuauucuggccaaaagaccuguguuuuuccuacggccgacucagcugugagccuguccucuaguucggaccagaauacaacuagcccagggaugaacuccucagaugaacuaugcgagucugucagcgugcacccccugcagaugaccggacucacagacauugcggauaucauugacgauuugaucauaaaggacggcgucaguuccgaagaacugggucuuaccgaacaagccauggggacuucacggauucagcauuacucuggacgccacagccagcgaaccgauaaagagagaagggagauccaggcauggaugaagcggaaacgcaaggaaagaauggcuaaauaccugaaugaguuagccgaaaagaggggccaagagcaugacccuuucuguccccgauccaacccacucuauaugacaagucgggagauccgucugagacagaagaugaaacacgaaaaggaucgcuugcugcucagcgagcacuacucuaggcggauuucacaggccuauggccuuaugaaugaacugcuauccgagagcgugcagcugccgacgcucccucaaaaacccuugccaaacaagccuagucccacucagucuuccucgugccagcauuguccaagcccuagaggggaaaaucagcacggacauucauuucugauaaaccgccccgguaaaguuaaguacauguccaagccgucuuauauccacaaaaggaagaguuucggccaaccacaggggagcccuuggccccacggaaccgcaacauuuaccauucagaaaaaggcuggcggugccaaagcggcugugcgaaaggccacucagucaccaguaacauuccaaaaaggguccaaugcacccugccauagcuuacagcacaccaagaagcauggaucugccggccuugcuccucagacgaaacaagugugcgucgaguacgagcgggaagagacuguugugaguccguggacaaucccauccgaaauucacaagauccugcaugagagccacaacucacuccugcaggacuugucucccaccgaagaggaggaaccugagcaccccuuuggcgucgggggaguggauucgguaagcgaauccaccgguaguauacugucuaaacucgacuggaaugcaaucgaggacaugguggccucaguugaagaucagggccuuagcgugcauugggcgcuggaccuauga

SEQ ID NO: 53664 - RNA, 348 nt, Artificial Sequence
  derived and/or modified sequence opt3 from C5orf63__Homo_sapiens__NP_001157950
augcugugguuccagggcaacagcaugcaacucgccagauccucuuuugggcuuuuccugaggaauugcucagcuaguaagaccacauugcccguguuaacucuguuuacgaaagacccuuguccacuaugcgaugaggcaaaggaaguccucaaaccguacgagaaccgguucauccugcaggaaguuaauauuacccuucccgagaacagcgugugguaugaacgcuacaaguuugacauaccuguauuccaccugaauggacaguuuuugaugaugcaucgagugaacacauccaaacucgagaagcagcugcugaagcucgagcaacagucuacugguggcuga

SEQ ID NO: 53665 - RNA, 2805 nt, Artificial Sequence
  derived and/or modified sequence opt3 from C6__Homo_sapiens__NP_000056
auggccagaaggagcgugcuguacuucauccuccuuaacgcucugauuaauaagggccaggcaugcuuuugugaccacuaugccuggacccaauggacauccugcucuaaaacuuguaacucagggacgcagagucggcaucgccagauagucguugauaaguacuaucaggagaauuucugcgaacaaaucuguagcaaacaggagacccgagaaugcaacuggcagcguugucccauuaauugcuuguuaggagacuuugguccuugguccgauugugacccaugcaucgagaagcagucuaaagugagaucgguacugaggccgucacaauucggcgggcagcccuguacagcgccucuaguggcuuuucagccaugcauucccagcaagcucugcaagaucgaagaggccgauuguaaaaacaaguuccggugcgacaguggacgcuguauagcaagaaaacuggagugcaauggcgaaaacgauuguggugacaauuccgaugagagggacugcgggcggacuaaggccgucuguacccgcaaauacaacccuaucccaucugugcagcuuaugggaaauggcuuucacuuccuggcuggcgaaccccgaggggagguuuuggauaacagcuuuacaggagguauuugcaagaccgugaaguccucaagaacaaguaauccuuauagggucccagcaaaccucgagaaugugggcuucgaaguacaaacagccgaggacgaucugaaaaccgacuuuuacaaggaccugacgagccucgggcauaacgaaaaccagcagggaucuuucuccucacaaggcgguagcaguuuuucuguuccgaucuucuauuccagcaaacggucggagaauauuaaccacaauucugcuuucaagcaggccauccaggcgucccauaaaaaggauucaaguuuuauacguauucacaaagugaugaaggucuuaaacuucacuaccaaggcaaaagaccugcaccuuagcgauguguuuuugaaggcccugaaucaucuaccccucgaauacaacuccgcucuguacucucgcaucuucgacgauuuugggacacacuauuucacuagcggaucacuuggcggcguguacgaccuguuguaucaguuuaguuccgaggagcucaaaaauagcgggcugaccgaagaggaagccaagcauugugucagaauugagacuaaaaagaggguuuuauucgcaaagaaaaccaagguggaacaccggugcacgacuaacaaacugucugagaagcacgagggaucauuuauccaaggugcugagaaaaguaucagccucauucgaggcgggcgcuccgaauacggagccgcgcuugccugggaaaaggggucuucgggucuggaggaaaagacauucagcgagugguuggaguccguaaaagaaaauccugcagugauagauuuugagcuagcuccaaucgucgaccuggugagaaacauucccugugccguuaccaagaggaauaaccuccggaaagcucugcaggaauaugccgcaaaguucgauccuugccagugcgccccaugucccaauaacgggcgcccgacucuuucaggcacagagugccugugugugugccagaguggaaccuacggcgagaauugugaaaaacaaucuccugacuauaagagcaacgcugucgaugggcaguggggaugcugguccucauggagcacgugugacgcgaccuacaagagaucuaggacacgugagugcaacaaucccgcaccacagcgggguggcaaacgaugugaaggggagaagagacaggaagaggacugcacuuuuuccaucauggagaacaauggacaaccuuguauaaacgaugacgaagagaugaaagaaguggauuugcccgagauugaagccgacaguggcugcccacagcccguaccuccagagaaugguuucaucaggaacgagaagcagcucuaccugguuggggaagauguggagaucagcugcuuaaccggcuucgaaacagucggauaucaguacuuucgcugucugccggacggcacuuggcggcaaggggauguggagugccagagaaccgaauguauuaaacccgucgugcaggagguucuaacaaucaccccuuuccaaaggcucuaucgcauuggagagucuauagaacugacuugcccaaaggguuuugugguagcuggccccucccgauacacgugucagggcaauucauggacaccuccaaucaguaacagccuuaccugcgagaaagacacuuugaccaagcugaagggacauugucagcucggccagaaacaaucggguuccgaaugcauuuguaugucucccgaggaggauugcagccaccauucagaagaccugugugucuucgauacagacaguaaugauuauuuuaccuccccggccugcaaguuccuugcagagaaaugccugaacaaucagcaguugcacuuucuccauaucgggucuugucaggacggccggcaacuggaauggggauuagagcguacuagacugagcuccaacucaacaaagaaagaaagcugcggcuacgacacguguuaugauugggagaagugcagugccucuaccuccaagugugugugccuacucccuccacaguguuucaaagggggaaaucagcuguacugcguuaagaugggcagcucgacuucagagaaaacacuuaacaucugugaaguggguaccauuaggugcgcuaaucgcaagauggagauauugcaccccgggaaaugucuggccuga

SEQ ID NO: 53666 - RNA, 699 nt, Artificial Sequence
  derived and/or modified sequence opt3 from C6orf106__Homo_sapiens__NP_073595
auggagggcauggacguggaucuggaccccgaacucaugcagaaguucagcugccuugggaccacagauaaagacguccugaucuccgaguuucaaagauuguuaggauuccagcugaacccugccgguugugcauuuuuccuagauaugacuaauuggaaccuccaggcugccauuggcgcguacuaugacuuugaaucuccaaauauaucaguuccgaguaugagcuucguggaggauguaacgaucggggaaggagaguccauucccccugacacccaguuugugaagacauggaggauccaaaacucugaugucauuugggugauccugucgguugaggugggcggucuucugggggucacucagcaguugagcucauucgaaaccgaguuuaauacacagccacaccggaaaguggaaggaaacuucaaucccuuugcuaguccucaaaagaaccgccaguccgacgagaauaaccucaaagauccaggcggcucugaguucgacagcauauccaagaauaccugggcccccgcaccugauacuugggccccagcuccggaccagacagaacaggaccaaaaccgacugucacagaauaguguaaaccugagccccucuucccaugcaaauaaccucucaguugugaccuacagcaagggguuacacggaccuuauccauuuggucagaguuga

SEQ ID NO: 53667 - RNA, 1692 nt, Artificial Sequence
  derived and/or modified sequence opt3 from C6orf10__Homo_sapiens__XP_011512542
augaccgugcuggagaucacacucgccgucauucuuacucuguugggcuuagcuauacuggcaauccuacucacgagaugggccaggugcaagcagagcgaaauguacauuucccgguauucuucagagcaaagugcgcgccugcuugacuacgaagaugggcgaggaagccgucacgcuuauuccacccagucugacacaucguacgauaacagagagaggucaaaacgggacuauacucccagcaccaauagucugguuuccauggccucuaaguucagcuugggucagacagaacucauccugcugcucauguguuuuauuuuagcacugucccgcucaaguaucggcagcauaaaaugccuucagaccacugaggagccuccaucuagaacagccggggcuaugaugcaauucaccgcaccgauccccggagccacgggcccuauuaaguugucccagaaaacuaucgugcagaccccaggucccauuguacaguacccugggucaaacgcuggaccacccagcgccccuaggggcccaccgauggcgcccaucauaauuagucaacggacagcacgcaucccucaggugcauacuauggauucuuccggcaagauuacccugacaccagucgugauccuaaccggguauauggacgaagaacucgccaagaaaagcuguucgaagauccagauucugaaaugcggagguacggcucgaucucaaaauuccagagaagagaacaaggaggcccuuaaaaaugauauaaucuuuacuaacucaguugaaagucugaaaagcgcacacauuaaggagcccgaaagggagggcaaagggacagacuuggaaaaggauaaaaucggaauggaggugaaggucgacuccgaugcuggcauaccuaaacggcaggagacccagcucaagauuucugaaaugagcaucccacagggucaaggggcccagaucaaaaagucagugagugacguaccccguggacaggagucccagguuaagaaaagcgaaucuggcgugccgaagggccaagaggcgcaggucacuaaaucagggcuggugguguuaaagggacaggaagcccaggucgagaaaagugagauggguguuccucgcagacaagaaagccaggugaagaagucccagucuggcguaucgaaagggcaggaggcacaagugaagaaaagggaaagcgucgugcugaagggacaggaggcucagguugaaaaauccgagcucaaggugcccaagggccaggagggucaagucgaaaagacagaggccgaugugccaaaggaacaggagguacaggagaaaaagucagaagcugggguucuuaaaggcccugagagucaagugaagaauaccgaagucucugugcccgagacgcuggaaagccaggucaagaaauccgagucaggaguguugaagggccaggaggcccaggagaaaaaggagagcuucgaagacaaagggaacaaugacaaggagaaagaacgggaugcagagaaggacccaaacaagaaagagaagggagauaaaaauaccaagggugacaaaggcaaggauaagguuaaagggaagcgagaaucugagauuaacggagaaaaauccaagggcaguaaacgcgccaaggcuaauacagguagaaaguacaacaaaaagguggaggaauga

SEQ ID NO: 53668 - RNA, 978 nt, Artificial Sequence
  derived and/or modified sequence opt3 from C6orf15__Homo_sapiens__NP_054789
augcagggcagaguggccgggagcugcgcuccccugggacuccuucuggucuguuugcacuuaccuggucuguucgcaagguccaucggcguuguggaggaaaagguaucucaaaaccuagggaccaaucucccacagcugggacagccgucaaguacaggccccagcaacuccgagcauccucagccagcccuugacccccggucuaaugaucuggcgcgcgugccuuugaaacucucggucccagcuucagacgguuuucccccugccgggggaagcgcagugcaacgauggccaccgaguuggggccugcccgccauggauuccuggccuccagaagaccccuggcagaugauggcugcagccgcugaggaucgucugggcgaagcccucccugaggaguuaucuuaccugagcuccgcggcagcccuugcuccagggucaggacccuugccgggugaaaguagcccugacgccacuggccugucucccaaggcaucccuacuccaccaggauucagagagcagaaggcugccacggaguaacucucuuggggcuggaggcaaaauucugucccagcgcccucccuggagcuugauacauagaguucucccagaccaccccugggguacgcugaauccuucggugucuuggggagggggcggcccagggaccggaugggguacaaggccgaugccccauccugaaggcaucugggggauuaacaaucaaccacccggaacuuccuggggcaacaucaaucgguauccuggugggucauggggcaacauuaaucgcuacccaggaggcaguugggggaacaucaaucgauaucccggagguagcuggggcaacauacacuuauacccggggaucaauaacccuuucccacccggaguccugagaccucccggcuccucuuggaacauuccagccgguuuuccuaaucccccaagcccgaggcuccaguggggguga

SEQ ID NO: 53669 - RNA, 714 nt, Artificial Sequence
  derived and/or modified sequence opt3 from C6orf25__Homo_sapiens__NP_079536
auggccguguuccugcagcuccuuccccuguuguuaagcagagcucaaggcaacccuggggcaucccuggacggaaggccaggugaucgggucaaucuaucuugcggcgggguuucacacccgauccgcugggugugggcccccaguuuuccugcguguaagggacucagcaaaggccgacguccaauucugugggcuuccucuucggguacccccacaguaccuccacuucagcccuucguggggagacugaggucauuggacagcggaauacggcgccucgagcugcugcucagugccggcgauuccggcacguuuuucugcaaggggagacaugaagacgagucuaggacugucuuacacgugcugggagaucggaccuacuguaaagcaccugguccaacacauggcagcguuuauccgcagcuuuugaucccccugcuaggggccggacucgugcugggccuuggugcucugggguuggucugguggcuccaccgccgacugccuccacagcccauuagaccuuuaccaagguuugcacugucacccccgcauuccaguacuugcgaaaaccgggccccugaggcuagcaagggaggccgugcccaagacucucgcggccccgggccaggaaccgaaccugcgcucugugguuccggccccucaagcccacagcaggcacccccugccgugcacagugggccaugcuga

SEQ ID NO: 53670 - RNA, 885 nt, Artificial Sequence
  derived and/or modified sequence opt3 from C6orf47__Homo_sapiens__NP_067007
auguuccugagaaggcucggcggguggcuuccccggccuuggggacgccgaaagccaaugcguccggaucccccuuacccagagcccagaaggguggacagcuccucugaaaacucagguagugacugggauagcgccccugagaccauggaagacgucggccacccaaaaacaaaggauuccggggcucugcggguuucuggagcagccucggagcccucaaaagaggaaccucagguggagcaauugggcagcaagcgcauggacaguuuaaaaugggaucagccaaucuccucuacucaggaaagcgguagacuggaggcugggggagcguccccgaagcuaaggugggaccauguagauucaggcggcacgcggcgccccggggugaguccugaaggaggucucagcgucccaggccccggggccccucuggagaagccaggacgaagagagaaacuucugggcugguugaggggugaacccggggcaccgucucgguaucucggaggcccugaggaaugccugcagauuuccaccaaucugacacuccacuuacuggagcuuuuggccucagcucugcuagcacucuguagccguccccugcgcgccgcucuugacacucugggcuugagagggccacucggacugugguuacauggucugcucaguuuucuugccgcgcugcacggcuugcaugcagugcuaucucugcucaccgcccacccucugcacuucgcuugccuuuuugggcuguugcaagcccucguucuggcaguguccuuaagggaacccaacggagaugaggcugccacagacugggagagcgaaggccuggagcgggaaggugaggaacagcgaggggauccaggcaagggacuauga

SEQ ID NO: 53671 - RNA, 228 nt, Artificial Sequence
  derived and/or modified sequence opt3 from C6orf48__Homo_sapiens__NP_001274413
auggagaggagcuucguguggcuguccugccucgacucugauucauguaaccuuaccuuuagacugggcgaagucgagagucacgccugcagccccuccuuguuauggaaucugcuaacacaguaccucccuccaggggcuggacauauccugcggacuuauaacuucccgguucuuucuugugugucgucaugccaccugauugguggcaagaugcccgaaaauuga

SEQ ID NO: 53672 - RNA, 1044 nt, Artificial Sequence
  derived and/or modified sequence opt3 from C6orf89__Homo_sapiens__NP_001273564
auggaccuggccgcuaacgagaucagcauuuacgauaagcucuccgaaaccguggaccuugucagacagacaggccaccaaugcgggaugucugagaaagcaauagaaaaguucaucaggcagcuguuggagaaaaaugaaccccagcggccuccaccgcaguaucccuuacugauuguuguguacaagguacuagccacucucggacugauccuucugacggcguauuuugugauucaaccuuucucaccauuggcucccgagccuguccucaguggugcccauaccuggcgcagccugauccaccauauacgacugaugucccucccaaucgccaaaaaguacaugucugagaacaagggcgugcccuuacacgggggagaugaagaccguccuuuuccagauuucgacccgugguggacaaaugauugugagcagaacgaaucggagcccauuccugcaaauugcacuggcugugcucagaaacaucugaagguuaugcuuuuggaggacgcaccaagaaaauuugaaaggcugcacccccuagugaucaagaccgguaaaccucuccuggaggaagagauucagcacuuccuuugccaauauccagaagccacagagggguuuucagagggauucuuugcuaagugguggcgguguuuccccgaacgcugguuuccguucccuuaccccuggagaaggccacugaaccggagccagauguugcgcgagcucuuuccugucuucacccaucugcccuucccaaaggaugccaguuuaaauaaaugcuccuuucugcaccccgaaccugugguaggcucuaagaugcauaaaaugccagaccucuucaucauaggcagcggggaggcgaugcuucagcugauuccgcccuuucagugucgaagacacugccaauccguugcaaugccuaucgaaccaggagauauugguuauguggacacuacacacuggaaggucuacgugaucgccaggggcgugcagcccuuggucaucugugaugggaccgcuuucucagagcuauga

SEQ ID NO: 53673 - RNA, 2532 nt, Artificial Sequence
  derived and/or modified sequence opt3 from C7__Homo_sapiens__NP_000578
augaaggugaucagccuguucauucucgucggcuuuauaggggaguuccaguccuuuucuucagccaguagccccguuaacugccaaugggacuucuacgcuccuugguccgaauguaauggaugcaccaaaacacagacuagaaggcggucuguggcaguauauggucaguacggcgggcagccaugugugggaaacgccuuugagacgcaaucgugcgaaccgacccgcggcugucccacagaggaagguugcggggagcgauuccguuguuuuucaggacagugcaucagcaagagucuugucuguaauggcgauuccgacugcgaugaggacucugcggaugaagacagaugugaggauagcgaaaggcggccuuccugcgacauugauaaaccacccccuaacaucgagcugacuggcaauggguauaacgaguugaccggacaguuccgcaauagagugauuaacacaaagucauuugguggccagugcaggaaaguuuucaguggggacggaaaggauuuuuaccgguuaagcggcaaugugcugucuuauaccuuccaagucaagaucaacaaugacuuuaacuacgaguucuauaauuccacuuggucauacgugaaacacacaagcaccgagcauacgaguucuucccgcaagaggagcuucuuuagaucgucuuccucaaguagcagguccuacacuucucacaccaacgaaauacauaaagguaagagcuaucagcuacucguaguugagaauacaguggaagucgcucaguucaucaacaacaauccagaguuucugcagcuugccgagcccuucuggaaagaacugucacacuugccuagucucuacgauuauuccgcauaccggcgucugauugaccaauaugggacucauuaccugcagagcggaucucucggcggcgaguaucgcguguuauuuuacguggacucagaaaagcugaagcagaacgauuucaauagugucgaggagaaaaaguguaaaagcuccggguggcacuuuguugugaaguucucuucgcacggaugcaaagaacuugagaacgccuugaaggcugcaagcgguacccaaaauaacguacugagaggcgaaccauuuauccgagggggaggcgccgguuucauuuccgggcuaucauaccucgagcuggacaauccggcuggcaacaaacggcgauauagugccugggcggaaucugugacaaaucuuccccaggucaucaagcagaagcugaccccuuuguacgagcucgugaaagaaguuccaugugcaagcgugaagaaacuguauuuaaagugggcccuggaggaguaccucgaugaauuugaccccugccauugucgcccuugccagaacggaggccuugcuacggucgaggggacucacugucugugccauuguaaaccauauacauucggagccgcaugcgaacaagguguguugguaggcaaucaggcugggggaguugauggcgguugguccuguuggucaagcuggucucccugcgugcaggggaagaagaccagauccagggagugcaacaauccgccucccaguggcggaggccggagcugugucggggagacuacagaaucuacccagugcgaggacgaagaacuagaacaucugcgccuccuggagccacacuguuuuccucuuucccuggugcccacggaguucugcccaucacccccugccuugaaagauggauucguccaagacgaagguaccauguuuccagugggcaagaacguuguguacacauguaaugagggguauagucucauaggaaacccgguagcgagaugcggcgaagaucugaggugguuagucggugagaugcacugucagaaaauugccugcgugcugcccguucuaauggacgggauccagagccacccucagaagccauucuacacugugggcgaaaaagucaccgugucguguuccggaggcaugucucucgaggggcccagcgcauuucugugcggaucaagucuuaagugguccccugagaugaagaacgcucguuguguacaaaaagaaaauccauugacacaggccgugcccaagugccagcggugggagaaacugcagaacucucgaugcguuuguaagaugccguacgaaugcggcccuagccucgaugucugugcucaagacgagagauccaaaaggauucugccacuuacugugugcaagaugcaugugcugcacugucagggucgcaauuauaccuugacagggcgggacucaugcacccuccccgccagcgcagaaaaggccuguggagcuugcccucuguggggcaaaugugaugcggagaguucuaagugcgucuguagagaggcauccgaaugcgaggaagaggguuucagcaucugcguugaggugaacggcaaagaacagacuaugucggagugugaagccggggcuuuaaggugccgcggacaaucaaucucugugacgaguauucgacccugugccgcagagacacaguga

SEQ ID NO: 53674 - RNA, 309 nt, Artificial Sequence
  derived and/or modified sequence opt3 from C7orf49__Homo_sapiens__NP_001230683
augaacgaggccgaaaucguggacgucgcucugggcauucucauagagagcagaaagcaggaaaaagcaugcgagcaacccgcccuugcgggggcugauaauccugaacacuccccaccguguucuguuucaccccauaccaguagcggauccucuucggaggaggaagacucagguaagcaggcccuggcaccuggcuugagcccaagucagaggcccgggggauccucuagcgccugcucccggucaccugaggaagaggaggaagaggauguguuaaaauacguacgcgaaaucuucuuuaguuga

SEQ ID NO: 53675 - RNA, 462 nt, Artificial Sequence
  derived and/or modified sequence opt3 from C7orf57__Homo_sapiens__NP_001254795
augcccgacuacauggugcacgaggaguucaacccugaucaggccaauggcagcuaugcuuccagaagggggccauuugacuucgauaugaagacagucuggcaacgggaggcagaagaacuggaaaaagagaagaaaaagcuccgccuuccggccaucgacucuaaauaccugucaaaggcgggaacacccuuggguccuaagaacccagcuggcagucgacugagcuuucccccuguuaauggguauaaagaugagugguuacagcagcagcaacgugccgacuccgauaagagaacuccaaaaacgucuagggcaucggugcuaucacagagcccccgggaccucgaaggaccucaggaugccgcucgccugcaggacgcagaggccagugaaggcccagaggauaccccgggucccgaggaauccguaucugcuagcaccccugccgagcuuaaguga

SEQ ID NO: 53676 - RNA, 1218 nt, Artificial Sequence
  derived and/or modified sequence opt3 from C7orf60__Homo_sapiens__NP_689769
auggagcccggcgccgggggaagaaacaccgcuagggcacagcgggccgguagcccuaauacaccaccgccccgcgaacaagagcgaaagcuggaacaggagaaacucuccggcguggucaagucuguucaccguagacuuaggaaaaaguaccgggaagugggggacuucgauaaaaucuggcgcgagcauugcgaggacgaagagacucugugugaauaugcgguagcuaugaagaacuuggccgauaaucacugggcaaagacgugcgagggagagggcagaauugaaugguguugcucaguguguagggaguacuuucagaacggugggaaacggaaggccuuagaaaaagacgagaagcgcgcuguccuggcaaccaaaacaacuccugcccuaaauaugcaugaaaguagccagcucgagggacaccugaccaaccuuuccuucacaaauccagaguuuauaaccgaacuguugcaggcuucuggcaagauccgacuccuggaugugggcucgugcuucaaccccuuucugaaguucgaggaauuucucacuguugggauugacaucgugccugccgucgagucaguguauaaaugugauuucuuaaaucugcaacuucagcagccauugcaacuggcgcaggacgcaauugaugccuuucuaaagcagcucaaaaaccccaucgacagccugccuggagaacuuuuccauguaguuguguuuagucuguugcucuccuacuucccaucuccguaucagagauggauaugcuguaagaaagcucacgagcuguuaguccugaauggucuccuucugaucauuacacccgauagcucccaccaaaacaggcaugccaugaugaugaagucauggaaaaucgcaauugagaguuugggcuuuaagcgguucaaguacagcaaauucucucacaugcaucuaauggcuuuucguaagaucucccugaaaaccacgucagaccucgugagccgcaauuauccugggaugcuguacauaccacaggauuucaacaguauugaagacgaggaauacucuaaucccuccugcuaugugagaagcgacaucgaggaugaacagcuugccuacggauuuacugagcugccugacgcgccauaugauucggacucuggcgagucccaagccucaaguauucccuucuacgaauuggaggauccgauccuccuguuaagcuga

SEQ ID NO: 53677 - RNA, 762 nt, Artificial Sequence
  derived and/or modified sequence opt3 from C7orf62__Homo_sapiens__XP_011514206
augagcuucuccgugcacaaccagaagggcucuaaaagaccccugccucucgagccacuucuguuuuugcaagucccgaggucaaauuacuuacauuuccaggaagagaagcagcggcugcaccuaaagaaguuucuccuggaccgcauguuccuuguugccaaaauccaggcuaacguggaacgaaaggauguagcagacuauuacgagcaaauguuucagagugugcugaagcaucacuugggggaagccgucaccggacuccugcugauuuaucccacaagcauacuccauaucuuagaguccucuucggauacucuguacaaagugcuuuuggacuauauuggucacguuaaggaugagacgguguucuuuauccagcagaugaaaauuaucgucauaucacacaauaucccuaugcgucuguucaugcaauggcaugugagcguaauuaagguuccagugauguaccuagacgaugucacccagagucagucccucaaagaagugaucacagacuuucugacucagacccacaaacuuucucuguauuugugccaaacaaugaaggugggcaccaaagggcccggagauaaccuccaucaggucgcgccugaccuguuacugccagagcagauuaucaaguaccucuguaaaagcgaagaguucauggaucccgcuacuuuuauaaauauguacaacagaccuauucacaucacacuugacuccgagguuguguggccagccccgucaagguucuga

SEQ ID NO: 53678 - RNA, 456 nt, Artificial Sequence
  derived and/or modified sequence opt3 from C7orf65__Homo_sapiens__NP_001116537
augagaauggcccccaccgagagcacagaaggcaggcggcuguggccugggccacgcgagggagguuccggcaaggaaacuacgucugagaaacucucaaaccuuccgcgaccccacaguuacagcccuaagcgugcugacgcagaauccuucagaggggugccagccgcguuuaaaaagugcagggaggucuuccgggcuuguuggggaucucgcgagcuguuguuuuuauucaaagccaucucggaagcaggccccgcccaaaauucaugcgguauuacccuggagaaggcugggggacuagaagauacaggcagccauuggcucaguugggcaagauguaagguucuguauauaaacggcuuuacugacccuuggaaagaugcccaggcuuggauccuuauuguguccugcaagaaagggaagggaaccccagagagggagggucggaauuga

SEQ ID NO: 53679 - RNA, 369 nt, Artificial Sequence
  derived and/or modified sequence opt3 from C7orf69__Homo_sapiens__NP_079307
augggcuuccacuuuugcaucuggauuauauuccugcuucccccuccauguaagaaaugccucagcccgcccaccaugaaccugagaccuccaaaguccugugggaauguguuuuacugggucuugguuuuaaacucuggacugcuauauaaauucugccagacaaucaaguguagggccaauuggcggcccgcucgcgcaccucgagguuggaacgaggccacugaacgucaucaagagagaaggacgcagauggaaaccgagaugggcgggauuucaacaacuuacuggcaccggcucugcaccuguacagaccgcagagcggaaaaacuggugauggauggaaauaacugcugguuucauaaguga

SEQ ID NO: 53680 - RNA, 1317 nt, Artificial Sequence
  derived and/or modified sequence opt3 from C7orf72__Homo_sapiens__NP_001155306
auggacguggagauccaggauacccccggcaagauuagcauauccaaaagaucuauccugucagggacagucgaaaacauugacuacccucacuauugcgaucuccuuaggaagaugaauaugccauucguuaaaggacuggagaaccggcauaauuacggucgcuuugaaaagaaauguaacccggccuucuugaaguuucaccccuauccuccaaguguguuacccgacuaccaucugcacgauccuuauccacccccuuacggcccacauuauccgcuauucccccuccgagacgauguaacucugggggacagcugcuccggauuuaugucuccuggcggugaugcugaccuuaauccagggaucggacguacgauucccacccugguggauuucucggacgucaagccucaacacagagugccaaggcccgauacaggcuuucagacuaccaucaaacggcagaagauauugucagaggaacuccagcaaaaccgcagauggaauagcagggagguuccggacaucaguauucgggcacgccugggcggguggacauccccucugaaagugacuccccuccagccacaccaugagggacgaucuuuaagccacaucuucaccuuugacgaagaggccacauguaccgaugaaggugagccucugguccagacgaacaagaaaugcaaugcgaaggacuccuucuacaagucaaguacucagaaagccuacgaggaugugcccugggacaagaugcuuccacccaaauugguaccugaagagaccacacuggaaaaggccgcagauccaauuagccaauguuuuacucuaaaaagauauaagggcguuccggccaucacccagauggugggggagcucugggacagguuccagacacggucuuuucuggcucccgucaaaccuauaaacuucguguccucaagcagucguucuaaguacauuccacuuuauaccggacaugugcaguccacgaaugcagaugacgucgauaacccccugggcgacaucgccagcuuggcuaagcaacgcuacucgaaaccucucuauacuaauacaucuagagccgcgaacauuccagguuacaccgggaagguucacuucacugcaacacaccccgccaauuccaacaucccgucaaccacgccuaguccagauagcgaacugcauaggguguuucagaaagagauggcuguagacuuauuccggcaccaggcuccccugucccgacucgugaccacaguccgcccuuauaaccccuuuaauaagaaagacaaggagacuaucgauuacuga

SEQ ID NO: 53681 - RNA, 1122 nt, Artificial Sequence
  derived and/or modified sequence opt3 from C8orf34__Homo_sapiens__NP_001182568
augagcucuccccuggccuccgagcucucagaacuugcugcacugagaccuggcuucagguugagugccccacacgcgcggguggcuccgcgcgccgcaacccaugcccgagggcgugguagagcuagccacgcaggacagcccagguuacgguccucuugcccuggcccaucgcccgggaagcgcagagucguuccuucaggaggcgcccaaccaagggugcugcccgcucuaagcagucggucccaucucuuuccuauggccucucacccacagacacgcauccaggcguaccuggagaaaaacaagauugguccgcuuuucgaggaacugaugacuaaauugauaacggaaacccccgaccagccuaucccauuucucauugaucaucugcaaagcaagcaggggaaucgaggacagcugcagagaacacucuccggcucagcagccuuaugggcugagagugagaaaagcgaaucuaagggcacuaggcgggacuuccguuccuaugauaagcccuggcaacugaacgccaaaaagccuaaaaagucaaaaagcgaccuugcaguaaguaauaucucuccacccuccccggauagcaagucguugccucgcucuguggagcaccccaaguggaacuggagaaccaaaccacaguccagggacuuugaugaacugaaucacauucuacaggagucaaagaaacucgggaaggcucuggagaaccuuagucggagcaucgccauauccgacgaacuggauaaagagacagucaccuucaauucuagcuugcuccgaccucgcgugaucggagaauggauugguagagaggaaaacgacgcggauccccuggccgcagagauguuacagccacccaucccuaggucaaagaaugaccaaugggagagugaagauuccggcagcucuccagcugggucacugaaaauggagccgaagaacaagggacucaaacagcagcaacagcagcauaagaaacuucuggccgcuauguugagucaggacagcuuugaauccauucacucucccacuccuucgguuacagaggaagacaucgauaaugaggacgaugccauggagcuacugggcaacuucaagaauuga

SEQ ID NO: 53682 - RNA, 624 nt, Artificial Sequence
  derived and/or modified sequence opt3 from C8orf37__Homo_sapiens__NP_808880
auggccgaggaccuggaugaacuccuugacgagguggaaagcaaguucugcacccccgaucuguugagaaggggcauggucgagcagccuaaaggguguggagguggcacacacuccucugaccggaaccaagcuaaggcaaaagaaacuuuacgcucaacggagaccuuuaagaaagaggaugaccuggauagucuaaucaaugaaauucucgaggaaccaaaccuggacaagaagccgagcaaacuuaaguccaaaucuucggggaauacaucaguucgagccagcauagagggacugggcaagaguugcucccccguguacuugggugggucuagcaucccuuguggaauuggcacuaacaucuccuggcgugcgugcgaucaucucagauguauugcuugcgacuuccugguagugucauaugaugacuacaugugggauaaaaguugugacuaucuguuuuucaggaauaacaugccagaguuucacaagcucaaggccaaauuaaucaagaaaaagggcacccgggcauacgccugccaguguagcuggcgcacaauagaagaggucaccgaccugcagacugaucaucagcuuagaugggugugcgggaaacacuga

SEQ ID NO: 53683 - RNA, 624 nt, Artificial Sequence
  derived and/or modified sequence opt3 from C8orf46__Homo_sapiens__NP_689978
augaugcaccagaucuacagcugcuccgacgagaacauugaaguguucaccacagucauacccucuaagguuucaaguccugccagaaggcgggcuaaaagcucccaacaucugcucacuaagaaugugguaaucgagucugaucuuuauacgcaccagccacuggaauuguuaccgcaucgcggcgaccgacgugaucccggggacagaaggcgguuuggacgccugcagaccgcaagaccuccaacagcccaccccgcgaaggcuucggccaggccuguggguauuucagagccaaaaacuagcaaccuauguggcaaucgggcauacgggaaaagucucauucccccugucccacgcaucuccgugaagaccucugccagcgcuucccuggaagcaacagccaugggaaccgagaagggcgcuguucuuaugcgagguucaagacaucugaaaaagaugacugaggaauauccggccuugccccagggggcggaggcaagucucccucugacaggaagcgccucuugcggcgugccaggcauccugaggaaaauguggacccggcacaagaaaaaguccgaauacgucggggcuacgaacucagccuucgaggcagauuga

SEQ ID NO: 53684 - RNA, 960 nt, Artificial Sequence
  derived and/or modified sequence opt3 from C8orf48__Homo_sapiens__NP_001007091
auggccaucugccccgagcuggcucagaccgacaagagcgcacucgccaaccuuuccgaugaaacagagacucugaaaaauuucacggacgaagugcaaaccucuucaaguuuuagcuccucuggcgggagacagucgucaccuuugacaagcggaaguaaguuagagagggaaaaacagacuccaucccuggagcagggugauacccaaucugagcuacucgacuacaagaacuaugagaaaaagcugagcaagaaauggauuaauuaccuuaagcugaaagauuccaacuucgaacggcaccagccggacacaaaguugcccaccgaaauaacucgcgucucagaugaggagcucaaugcgcugcagaguuauuguacaaugaaaaucaaccugauucaucgacguggcgacagcaagaagaaaaccucuuccagacacaagaaacuccauuuagggcuggauguugaggcuucagaaagggacgccuuuagcugcacggugccugaugaacuuuugaaucggaucuacuucaagaacaugcgcacuaccccaaaacaggaggcagccgcuaagcaacacauuaguuaucagugucccuacugcaauagaaaaagggcagaacuggcccuaucugcuuuucucaagcagaagaaaacacugcuugaguccuuccuguugcaggagcggaucgacgaacaucuccacacuaaggauuuucugacccgcauaggagaggcccaccaagacuucccucgauuaagcgacgauccaagaaucauuuggaaaaggcugacagaaaagucgcauauccgguauucuggcuuugagcguuccgaaaccgagcagaaaaugcagcgcgacgguaacucagcgugucaccuccccuucagucuuccuuuucugaagagauugacgcuaauuaagccagagcugguaaucgugaaugauaacgucuga

SEQ ID NO: 53685 - RNA, 321 nt, Artificial Sequence
  derived and/or modified sequence opt3 from C8orf4__Homo_sapiens__NP_064515
augaaggccaaaagaagccaccaggcuaucauuauguccaccucucugagggugucacccaguauacauggcuaccacuucgacacagcaagccggaagaaagccgucgggaacaucuuugagaauacugaucaagaaucccucgagcgccuuuuccgaaacucuggagacaagaaagcggaggaacgugcuaagauuaucuuugccauugaucaggacguugaagagaagacgagagcacugauggccuugaaaaagaggaccaaagauaaguuauuccaguuucugaaacuacggaaguauucgaucaaggugcauuga

SEQ ID NO: 53686 - RNA, 672 nt, Artificial Sequence
  derived and/or modified sequence opt3 from C8orf86__Homo_sapiens__NP_997295
augagaccccugggcaaggggcuccuuccugccgaggaacugaucaggagcaacuugggagugggucgguccuuacgcgacugccugucucagucaggcaaacuagcugaggaacucgggaguaagcgacugaaaccagcaaaguucggaaccgagggcaaagaacgugucgagcaaagaacagagaggcagcggacugguagcuccaaggaaccgcgcaugcagauuauauguagaaggcgguggcgcgagcccccuccacgacuucugugggggugcuugaugcccagagcccagccucuccugcacguuacggcguacgaaaauaccggacauugggagaggcuggcuucugugguaucgucaaagacacaacagccaacugugaucagccacaguuccauuucuaucaccuuuagccauuaucccccugccacacucgauuccuucuuaguccuggagccaauuaaacuuuuuccggugucaaguuugcggagcccccugugucuaaacugcggcucuugucgugaauccauccgcauaucaggcgagcucaucgggaaugcacacagcccugccccacccagaaccccugaacuggagacucuuggaugggacaagcaggcuguucugaguggugcacaggugauuuuggucugcgccgaaguguga

SEQ ID NO: 53687 - RNA, 1680 nt, Artificial Sequence
  derived and/or modified sequence opt3 from C9__Homo_sapiens__NP_001728
augagcgccugcagauccuucgcuguggcaaucuguauucuggagauaucuauccucaccgcccaauacacaacuucauaugaccccgaacuuacggagaguagcggcuccgcgucucacauugauugcaggaugucgccuuggucagaauggagccaaugugacccaugccugcggcagauguuucgcagucgauccaucgaggucuucgggcaguuuaacggaaagcguuguaccgaugcuguuggugacagaaggcagugcgugccgacagaacccugugaggaugccgaggacgauugcggcaaugacuuccaauguucuacugggcggugcauuaaaaugcgcuugagauguaacggagauaaugacugcggcgauuuuagcgacgaagaugacugcgaguccgaaccuaggccacccugucgggaccgcguaguggaggagucagaauuagcacgaaccgccgguuacgggaucaacauacugggaauggauccucuaaguacaccauucgacaaugaguuuuauaacggccucugcaauagagauagggacggcaacacccugacuuacuaucggcgucccuggaaugucgcuagccuuaucuacgaaacaaagggggagaaaaacuuccgcaccgaacauuaugaggagcagauugaagcauuuaagucuaucauucaggagaaaacguccaauuucaacgccgcuaucucacugaaguuuacuccuaccgaaacaaauaaggccgagcaguguugcgaagagacugcgagcaguauaucuuugcacggaaaagguuccuucagauuuagcuacucgaagaacgagaccuaccaacucuuccugucuuauuccaguaaaaaggagaaaauguuccugcaugugaagggcgaaauucaccucgggagguuuguuaugcggaaucgagauguggucuuaacaaccacguucguggacgauaucaaggcacugccaacuacauacgaaaaaggagaguauuuugccuuccuugaaaccuacggcacucauuauucaagcuccgguucuuugggagggcuguacgagcuaauuuauguacucgacaaggcuagcaugaaacgcaagggcguugagcugaaagauaucaagagaugucuuggcuaccaccuggacgugucauuggccuuuagugaaaucuccgucggggcagaguucaacaaagaugacugcgugaagaggggagaaggucgggcugugaacauuacaagcgagaaucucauagacgaugucguuucucugauccgcggcgggaccagaaaguacgccuuugaguuaaaagaaaagcugcucaggggaacggugauugacguaaccgauuucgugaacugggcgucaaguaucaaugacgccccgguccuuauaagccagaaacugucccccauuuauaacuuggugccuguuaagaugaaaaaugcacaccuaaagaagcagaaccuggagcgugcuaucgaagauuacaucaaugaguuuucugugcggaaaugucauacaugccagaacggcgguacugucauucucauggacgggaagugucugugcgccuguccauucaaauuugaaggcaucgcuugcgagauuucgaagcagaaaauaagcgagggacuucccgcccuggaguucccuaaugaaaaguga

SEQ ID NO: 53688 - RNA, 699 nt, Artificial Sequence
  derived and/or modified sequence opt3 from C9orf106__Homo_sapiens__NP_001012733
auggccuacguggcucugagcgacaagccccaccucuccggcgaggucggggaagaggcauguucuucauggaacccuccacuuuucaguccgagaccccugccuagguuguggccauuacccggaaccccuuuucugccaauccgggcccuacccuucagcgcguccucuucggguaaaucaagccucguuccuaguccauccucuagcgcucauuccggcuuucgcacaccgugccuggggcccgauugccuucuguguacucagggaugcgaauugcacgagggccgaaaucauauggccgugcacucauguguagcacgugccuggccuggugacccacaagaagugagacaucucaacccccugcugugcgauccugggagucaggucgagccaagcuggcccuggcacccgggacucgagcaggcugcagccucuugggugggcaaucacguuuccccugcucauaggcaggccuuacggggccacucacuggggagcgcgcuucgcgcauugaugcccggaggucauuguccacugugcgugccuuguaagagaggcugcaaccuaaggggagggcggggcaaacacgguccccgcccauguugcccccuccugcgaaaguucccuguccuuccagugcacccguggcccuuuccuugcgccguaugggacaguggguggucuuguagauga

SEQ ID NO: 53689 - RNA, 690 nt, Artificial Sequence
  derived and/or modified sequence opt3 from C9orf135__Homo_sapiens__NP_001010940
auggacagccuggauagauccugccaggacuggugugauaggaagcaacacuggcucgagaucgggcccccugaccuuguggaacggaaaggcucucugaccuugcgcucacaucacaagaaauacaguaagccagucuuaguuuauagcuggcaucgagaucgugaggccuucccgaaaggauacgacauugaaggucccgagaaggugaagaaacugugcaacuccacauauagaaggcuaggcacugaugaaucuccuauauggacgucggagacccacgagaagcucucacagaugugucugaauacagaauggguagagaugaaaagcaaggcacuucugaacgaagagacugugaguuccgggaucauugagcgggucaccggauugccagcuacaggcuuuggugccguguucccccgccauccuccagacuggucuaaaaugugcgcgcucaccacuuacagcgaagauuauguucccccuuacgacuaucagccacacgcuuacccgugucaggaugacuacuccaucgugcacagaaagugcaggucacaauuuacagaucugaaugggaguaagcgguucggaauuaacaccuggcaugacgagagcggcaucuaugccaauucugacgucaaacagaagcuguacccccucacguccggcccuauagugccaaucuga

SEQ ID NO: 53690 - RNA, 720 nt, Artificial Sequence
  derived and/or modified sequence opt3 from C9orf152__Homo_sapiens__NP_001013011
auggagggccugcccugcccuuguccagcccucccgcacuucuggcagcuuagaagccaucugauggcugaaggguccaggacccaagcacccggaaaggguccuccauugucuauccaguuuuuacgggcccaguacgagggccugaaacgccagcaacgaacacaggcgcaccuacucgugcugcccaaagggggaaacacuccugcuccagccgaaucaauggucaaugcaguuuggauuaacaaggagcguagaaguagccuuucccuggaagaggccgacucugagguggaaggcagguuggaggaagcugcacaggguugccuccaggcccccaagucgccuuggcauacgcaccuggagaugcauugucugguacaaaccucaccacaggauacaagccaccaggugcaccaucgggggaaacucgucggaagugaccagcgcuuaccgcccgagggcgauacucaccuguucgaaaccaaucaaaugacacagcagggcaccgggauaccugaggcugcccaacuuccaugccaggugggaaacacucagacaaaggcgguugaauccgguuugaaguuuucuacccaguguccccugagcaucaaaaauccucauagauccggcaagccagcauauuaccccuucccgcaaaggaaaacgccucggauuucacaggccgcucgcaaccuagggcucuauggaagugccuga

SEQ ID NO: 53691 - RNA, 1326 nt, Artificial Sequence
  derived and/or modified sequence opt3 from C9orf156__Homo_sapiens__NP_057565
augagaggccuggaggaaagcgggcccaggccuaccgccacaccaugcggaugugugaagccggcucucgagacugguaaccuucugacggaacccgucggcuacuuggaguccugcuucucugccaaaaaugggaccccucggcagccaucaaucuguaguuauagccgcgcaugcuuacguauucgaaagagaauauuuaacaaucccgaacacucccugaugggacuagagcaauucucucauguuuggauccucuuuguguuccacaaaaacggccaucugucguguaaggcgaaaguacagccuccaaggcuuaauggugcuaagacagggguguuuucaacucggagcccccaccgcccuaacgccauuggacugaccuuggcaaagcucgagaaagucgaaggcggcgccaucuaccugagugggauugacaugauccauggaacaccagugcuggauauaaagccguauaucgcugaguacgacucuccccagaauguuauggaaccucucgcagauuucaacuuacagaauaaccaacacaccccaaauacugugucccagagcgacuccaaaacagauucaugcgaccagagacagcugagugguugugaugagccccaaccucaccauagcaccaagaggaaaccaaagugccccgaggaccggacgucugaagagaacuaucuuacucacuccgauaccgcccgcauucagcaggcuuuuccgaugcaucgagaaaucgccgucgacuucggcuuggagucaagaagggaucagagcaguucuguggcggaggaacaaauugggccuuacugucccgagaaguccuuuagcgaaaaaggaacagacaagaaacuggagcggguagaaggcgcagccguucuacaggguucgcgugcugagacucagccaauggccccucacugccccgcagggcgcgcugauggagccccaagaucugugguccccgcgugggugaccgaagccccuguggcaacacucgaggucagguucaccccacacgcugagauggaccugggccaacuuuccucacaggacguuggccaggccaguuuuaaguauuuccagagcgcugaagaggccaaacgggcaaucgaagccgugcuguccgcugauccgcgaucuguauaccgcagaaaguugugucaagacaggcucuuuuacuucacgguggauauagcgcaugucacuugcugguucggggacggauuugcagaggugcugcggauuaaacccgccagcgaaccuguucacaugacagguccagugggcucauuagucagucugggguccuga

SEQ ID NO: 53692 - RNA, 366 nt, Artificial Sequence
  derived and/or modified sequence opt3 from C9orf170__Homo_sapiens__NP_001001709
auguggagcagaaggggccugggggugucccgggcuccccuccaccuucuguugggagucugggguccuucuggccgcaccgggggacagcgaaagggcgccucauuagcacguccagguagagggggacuggccaguugcagcguuggcgcgaacggcaaaagggacgugcuauuccuccggaagacacugacuaauacgguagaggauauccaaauugacaacuuucgcagaaaauccgaucuuggggugggaucuccggacuggaagaaucuguugauagaugucaccagggaagaccaugagaacucgcagaauaacucaaaacggcgcuguaaggugaauugcgaaacagaucagcgauga

SEQ ID NO: 53693 - RNA, 855 nt, Artificial Sequence
  derived and/or modified sequence opt3 from C9orf171__Homo_sapiens__NP_001269886
augcccgaggccagaagcuccggcccugaccugaccagguggcggaagcagcaacagccagugcgccgaacagucucucagguuugcccgcccccucguagaccacucacuguggcugauaucaggucagggauggaaaacgagcggcuuggaguagugcgcgacaguauguuccagaauccccugauugucaaagcagaauuggguaagccuagagagaggagcuacuccuuaccaggcauaaacuuuaauuaugggcuguacauccggggacuagauggcggugugcccgaagccauugggcgcuggaacguuuucaaacaacagccuacguguccacacgagcucacccgaaauuauaucgcgaugaacagaggagcugugaaggccggccuggucacagcaagggagaaucuucuguaccggcaguugaacgacauucguaucucugaucaggacgaucgcagaaugaaaaaggaaccgcccccucucccacccaauaugacuuuuggcauaagggcccggccuucgaccccauucuuugaccugcugcaacaucgauaucuccaguuaugggugcaggagcagaaggcuacacaaaaagcaaucaagcuggagaaaaagcagaaaguaguucuugggaaguuguacgaaacccgcucaagccagcugagaaaguauaaacccccggugaagcuagauacucucuggcacaugccucauuuccaaaaagucggaaggcaccuggacacauuucccaccgaggccgaucggcagcgcgcucuuaaggcccauagagaagagugcgcggugaggcaggguacgcugcguaugggcaacuacacucacccauga

SEQ ID NO: 53694 - RNA, 1701 nt, Artificial Sequence
  derived and/or modified sequence opt3 from C9orf3__Homo_sapiens__NP_001180260
auggacauccagcuggaucccgccagagacgaucucccucuuauggcuaacaccagccacauucuggugaagcauuacgucuuggacuuagauguugacuucgagucccaagugauagaaggcacaaucguacuguuucuagaggaugggaauagguucaaaaagcagaacucuucaauugaagaggcaugccagagugaaagcaauaaagccuguaaguuuggaaugccagagccgugccacauccccgugacuaacgcgcggacguucuccucugagauggaauauaaugacuuugcuauuuguucgaaaggugagaaggauaccucagacaaggauggcaaccaugacaaucaggaacacgccagcgggaucaguuccucuaaauacugcugugauacaggaaaccauggcagcgaggacuuccuccugguccuugacugcugugaucuguccguguugaagguugaggaaguggacgucgcagccgugccuggucucgagaaauuuacucgcucaccagaacugaccguaguuagugaggaguuccgaaaucaaauagugcgugagcuggucacacuccccgcuaacagauggagggagcaguuagauuauuacgcacggugcagccaggccccuggguguggagaacugcuuuuugacaccgauacuuggucuuugcagauccgcaagacaggcgcucaaaccgccacggacuucccacacgcgauuagaaucugguauaaaacuaagcccgagggcagguccgugaccuggacaucagaucagagcgggcggccuugcguguacacugucggaaguccaauuaauaaccgcgcacuguuuccgugucaggaacccccuguugccaugucuaccuggcaggcuacagugcgagccgcagcuuccuucguagugcuaaugagcggugaaaauucggccaagccaacccaacucugggaagaguguucuuccugguauuacuacgucacgaugcccaugccugcgucaacuuuuacaaucgccgugggcugcuggaccgagaugaaaauggaaacuuggaguagcaacgaccuggcaacagagagaccauucucccccucugaagcuaauuucaggcacguuggggugugcagccauauggaguauccgugccgguuucagaacgccucagcuaccacgcaggaaauaauuccucaccgugucuucgcccccgugugucuuaccggagcaugccaagagacacuguugcgccucaucccaccuugucugagugccgcucauuccguauuaggcgcgcaccccuuuagcagacuggauguucucauugugccagcaaacuuccccucucuugguauggccucaccucacaucauguuucugagucagagcaucuugacugggggaaaucaucuaugcggcaccaggcugugucacgagauugcucaugccugguucggccucgcaauaggggcccgggacuggacagaagaguggcuguccgaaggauuugcuacucaccuugaggaugucuucugggccaccgcacagcagcuggcgccauacgaggcucgagaacaacaggaguugcgcgccugccucagauggaggcggcugcaggacgaaaugcaguguucuccggaggaaaugcaaguguuacgcuuuccccaugucgguggcugcucggggagcuucuccuga

SEQ ID NO: 53695 - RNA, 1386 nt, Artificial Sequence
  derived and/or modified sequence opt3 from C9orf43__Homo_sapiens__NP_001265558
auggaccugcccgaugagagccagugggacgaaaccacaugcggccucgccgugugucaacacccucagugcugggcuacuaucagaaggauugagcgggggcauccacgcauacuuggauccucuuguaagacgccgcuggaugcagaagacaaauugcccgucuuaaccguuguggauauccuggacucagguuucgccgcgcaccaucuaccugagugcacauuuacuaaggcucacagucuccugagccaguccucuaaauucuacucgaaguuucauggccgaccacccaaagggcuuccugauaagucacugauuaacuguaccaaucguuugccaaaguuccccguacucaaccugaaugaaacacagcugccuugcccagaggacgugagaaacauggucgugcucuggaucccggaggaaaccgagauucacguuagccaacacggcaaaaagaaaaggaagaauagugccgugaaauccaagagcuuuuuaggacugucugguaaccaguccgcagggacucgggucggaacacccggcaugaucgugccuccacccaccccuguacagcuuucagaacaguucaguagcgacuuuuugccacugugggcccaaucugaggcucuaccccaggaucuccugaaggagcuucugccgggcgggaaacagacgauguuguguccugaaaugaagauaaaacucgcaaugaugaagaaaaaucugcccuuagagaagaaccgcccagauuccguuaucucaagcaaaauguuccugaguauucauagacucacucuugaaaggccugcccugcgguaucccgagcgcuugaagaagcuacacaaucugaaaaccgaaggauaccgaaagcagcaacagagacagcaacagcagcagcaacagcagaaaaaggugaaaacaccaaucaagaagcaggaggcuaaaaagaaagccaagucugaccccgguauucaauccacuagccauaaacacccugucaccacagugcacgauaggcucuauggcuaccggacccugccagggcagaacucggacaugaagcagcagcaacagauggagaagggaacgacuucuaaacaggacuccacagaacguccgaagaugaauuauuacgaucaugcggacuuucaccauucagugaaaagucccgagcuuuaugaaaccgagccuacuaacaaggauaucagcgcaccagucgacgccguucccgaagcucaggccgcacgccagaaaaagauauccuucaauuuuucugagauuauggcuagcacaggcuggaacucagagcugaaguugcucagaauccugcaagauaccgacgaugaagacgaggaagaucagaguuccggugccgaguga

SEQ ID NO: 53696 - RNA, 888 nt, Artificial Sequence
  derived and/or modified sequence opt3 from C9orf66__Homo_sapiens__NP_689782
augagacacagcguggccaggcccacccggcugccucgccgacucuccccauucugggacccggcuacaugcaagaaccuugagggcggggcaggagaagucguucgugguagagaucccaggcggcugcgcacuucuagaucaacggagaucuugggcgaagacuuagccgggccuagugcgggagcugccgcaaggccagccgcucccccuccacagccccgggagccuggcgcaccaggucugcgccgagccccgcccagaaccaggauggauagcuccgggcuaggaccuuguucugaagcuccacuccauacaucggccggccugucaggccggaaucuucgugcggcagggggagugcugcccguagacuuggagcgcgagagagccgcucucugcgccaggcaaagcggucacggcccuccagcagugcgguggcugcuggggagucgaggagcugaauccggcggucucgcccgcagaagggucgcggccgagcaugcacagcccucugcuaacuuagugugucggagcgcccuggaaacuuccgcuuuuccgccuucaaaacccaagaguccacgcgggagaguuagggcccguagcucugauggacggcuucgacacccugcauggagagccggcuccggcgggaggggaggucgcggccccucagcugaguuggcgagccgguacugggggagaaggcgcgcacugccaggagccgcugaccuacgacccaaaggcgcccgggcagaugaccguagaccucucagggccggucgcaagcugcaucuuccagaggcugcccggcugccggggaaugugggcaaaaguggagaaccccacaaggcaggcgaggucgggaaccacccuagagauucuuga

SEQ ID NO: 53697 - RNA, 1446 nt, Artificial Sequence
  derived and/or modified sequence opt3 from C9orf72__Homo_sapiens__NP_060795
augagcacccugugucccccuccauccccggccguggcuaagacagagaucgcacucucuggcaaaucaccccuucuggccgcgacuuucgcuuacugggacaacauuuuggggccuagagucaggcacauaugggccccaaagacggaacagguuuuacugagugauggagagaucaccuuucuagcaaaucauacacucaacggugaaauucugcggaaugccgagagcggcgcuaucgacgugaaauucuuuguacuuuccgaaaagggggugauuaucgucucucugauauucgauggaaacuggaauggcgaccgcucgacuuaugguuugucaaucauucucccccaaaccgagcugagcuuuuaccugccucuccaccgagugugcguugaucguuuaacacauaucauuagaaaagggaggaucuggaugcacaaggagcggcaggaaaacgugcagaagauaauucuggagggaaccgaacgcauggaggaccagggccaaaguaucauuccaaugcuuacuggcgaggucauccccgugauggaauugcuguccucuaugaaaagccauuccguaccugaggaaaucgauauugcagacacaguucuaaaugaugacgauauaggggacucaugccacgagggauuccuccugaacgccaucaguagccaccuucagaccugugguugcucuguggucgugggcuccucagcugaaaaggugaauaaaauugucagaacgcuguguuuguuucucacuccagccgagaggaagugcagccggcugugugaggcggaaaguucuuucaaauaugaguccggguuauuuguucagggacugcucaaggauagcaccggcucguucgugcuuccguuucgccagguaauguacgcacccuauccuacaacucauaucgacguggacgucaacaccgugaagcaaaugccacccugccacgaacauauauacaaucagcgaagauauaugaggucugagcugacagccuucuggcgggcuaccuccgaagaggauauggcccaggacacgauuaucuacacugaugagucauuuacaccugacuugaacaucuuccaggauguucuacaccgugacacccuggugaaagcauuccucgaucaagucuuucagcugaagccaggucuuagucugcgcagcacuuucuuggcucaguuucuccugguguuacacagaaaagcccugacacuaauuaaguacaucgaagacgauacccaaaaagggaagaaacccuucaagucccucaggaaucugaagauugaccuugauuugacggcggagggagaccugaacauaaucauggcccucgcagagaaaauuaagccgggccugcauucuuuuaucuucggccggccuuuuuauaccagcguacaggaacgagacguucuuaugacauucuga

SEQ ID NO: 53698 - RNA, 474 nt, Artificial Sequence
  derived and/or modified sequence opt3 from C9orf85__Homo_sapiens__NP_872311
augagcucccagaagggcaacguggccagaucuaggccccaaaaacaccagaauaccuucucauuuaagaacgacaaauucgauaagaguguccagacuaaaaagaucaaugcuaagcugcaugacgggguuugccagcgguguaaagaggugcucgaauggcgcguaaaguacagcaaauauaagccucuuuccaaaccaaagaagugcgugaaaugucugcaaaagacagucaaagauucuuaccacauuaugugccgaccgugugcaugcgaguuggaagugugugccaagugcgguaaaaaggaggacauaguuauccccuuaaacaaagaaacggagaagauugagcauaccgaaaauaaccugucgucaaaucaccguagaagcuguaggcggaacgaggaaagugaugacgaucuagacuuugauaucgaccucgaggauacaggaggcgaccaucagaugaauuga

SEQ ID NO: 53699 - RNA, 1029 nt, Artificial Sequence
  derived and/or modified sequence opt3 from C9orf91__Homo_sapiens__NP_694590
auggccugcgagccucagguggacccuggcgcuaccgggccacugccgcccagcuccccuggauggucugcacucccagguggcucacccccuggguggggacaagaacuucacaacggccagguccugacaguuuugagaaucgauaauacuugugccccaauuaguuucgacuuaggugcggcugaggaacagcugcagacgugggggauacaagugcccgccgaucaguacaggagccuagcagaguccgcccuccuggaaccucagguacggcgcuauaucauuuacaacucucgaccaaugcgucuugcuuuugcaguggucuucuaugugguugugugggccaauaucuacucgaccucacagauguuugcucugggaaaccauugggccggcauguugcucgucacacuggcggcagugagccugacucucaccuuaguacugguuuucgagagacaccaaaagaaagccaauacaaacaccgaccuuagguuggcugccgcaaauggcgcucugcuacggcaucgcgugcuccugggggucacugauacaguggagggaugccagagugugauucagcuuugguuugucuauuucgaccuggaaaacuguguucaguuuuuguccgaucacgugcaagagaugaagaccucucaggaaagccuccugagauccagguuaucacagcugugcguagugauggagacgggugucaguccggccacugcggagggccccgaaaaucucgaggacgccccucuucugccagggaacagcugucccaaugaacggccuuugaugcaaaccgagcuacaucagcuggugccagaagcagagcccgaggaaauggcucgccagcuccuggccguuuucggaggcuacuauauccgacuucuggugacaucucaguugccgcaagcuauggguacuagacacaccaacuccccuaggauacccugcccaugucagcucaucgaggccuacauucuggggacaggaugcugucccuuuuuagcacgguga

SEQ ID NO: 53700 - RNA, 507 nt, Artificial Sequence
  derived and/or modified sequence opt3 from C9orf9__Homo_sapiens__NP_061829
augaacgaggugaaggaaagccugagauccaucgagcagaaauacaaacucuuccaacagcagcagcuuaccuuuacagccgcucuggaacacugcagggagaaugcacaugacaagauucggcccauaucuucaaucggccaaguccagaguuauauggaacacuacuguaacagcuccacugaucgccgaguuuuguuaauguuccuggacauuugcucugagcuaaauaagcucugucagcauuuugaggccgugcacucggggacgccuguaaccaacaaucugcuugaaaaaugcaagacacuggugucacagagcaacgauuugaguucccuccgugcgaaguauccacaugacgucgugaaucaccugucuugugaugaggcuagaaaccacuacggagguguugugagccugaucccgcucauuuuagaccugaugaaagaauggaucgcccauuccgagaaacuucccaggaaggucuugcaacacggcacuaccuga

SEQ ID NO: 53701 - RNA, 987 nt, Artificial Sequence
  derived and/or modified sequence opt3 from CA10__Homo_sapiens__NP_001076003
auggagaucgugugggaaguccuguuccuccuucaggccaacuuuauuguuugcauaagcgcucaacagaauagccccaagauccacgagggcuggugggcauacaaagaagugguacaggggucuuucgugccugucccaucauuuuggggacuggugaacagugccuggaauuuguguagcguugguaagagacaguccccggugaacauugagaccucucauaugaucuucgaccccuuuuuaacaccucugaggauuaauacuggcgggcggaaagucucgggaacgauguauaacaccggccgccacgugucacuacgacucgauaaggaacaucugguaaauaucagcggugggccaaugacauacagucaccgucuugaggagauaagacugcauuucggauccgaagacucucaaggcagcgagcacuugcucaacggccaggcguuuuccggggaaguucagcugauccacuauaaucaugagcuguacacuaacgugaccgaggcugccaaaucacccaauggacucgucguggugaguauuuucaucaaggucagcgauucuuccaaccccuuuuuaaauaggaugcugaaccgggacacaauuacccgcaucacuuauaagaaugaugcauaccuuuugcagggucugaacauagaggaacuauauccagaaacaucauccuucauuaccuacgacggcaguaugacgaucccuccuugcuacgagacugccucuuggauuaucaugaacaaaccaguuuauaucaccagaaugcaaaugcacucccucaggcugcuuagccagaaucagccgucgcagauuuuucugucuauguccgauaacuuccggcccgugcaaccuuugaauaaccgcuguauacgaacaaauaucaacuuuucacuccaggggaaggacugcccaaauaacagagcucagaaacugcaauacaggguaaaugaaugguuacugaaguga

SEQ ID NO: 53702 - RNA, 987 nt, Artificial Sequence
  derived and/or modified sequence opt3 from CA11__Homo_sapiens__NP_001208
augggcgccgcugcaagacugagcgcccccagggcgcucgugcuuugggcugcccugggggcagccgcucacaucggaccugcaccagacccggaggauuggugguccuacaaggacaacuugcaggguaauuucguccccggcccuccauuuuggggguuaguuaacgccgcuuggucucugugcgccgugggaaaacggcaaucacccguagauguggaacuaaagcgcguccucuaugacccuuuccugccaccccuucgacugaguacuggcggugagaaauugcgugggacacucuacaauacuggaagacaugugagcuuucugccugcgccaaggccgguugugaacgucuccggcggcccccugcucuauucucaccgguuaucggaacugcgccuuuuguucggggcaagagauggagccgguucagagcaucagauuaaucaccagggcuuuagcgcugaagugcagcugauacauuucaaccaagagcuauacgggaauuuuagugccgcauccaggggaccuaacggccucgcuauccugucucuuuucguaaauguugccagcacguccaacccauuucugucacgguugcucaaucgcgacaccauuacacgaaucaguuauaagaacgaugcguacuuccugcaggacuuaagccuggagcuccuuuuucccgaaucuuucgguuuuauuacuuaucaggggucccugucaaccccuccauguagcgagacagugaccuggaucuugauagauagagcccuaaauaucaccagucugcagaugcacucucucaggcugcuuucccaaaaucccccgagccagauuuuccagucgcugucuggaaacucccggccuuugcagccccucgcacaccgugcucugcgcggcaacagagacccaaggcauccugaacggcgaugccgcggccccaacuacagauuacacgucgauggggugccacauggaagguga

SEQ ID NO: 53703 - RNA, 1065 nt, Artificial Sequence
  derived and/or modified sequence opt3 from CA12__Homo_sapiens__NP_001209
augcccaggaggagccugcacgccgcugcagugcuccuucuggucaucuugaaggagcagccuuccucuccagccccgguuaacggcucaaaauggaccuacuucgggcccgacggagaaaauaguuggagcaagaaauauccuuccugcgguggcuuacugcaaucuccaauugaucuacauucggacauacuccaguacgaugcgucacugacaccccuugaguuucagggguauaaccugagcgcuaauaagcaguucuugcucacuaacaauggacacagugugaaacugaaccugccuuccgacaugcauauccaaggccuccagucucgguacagcgccacgcaguuacaucugcacugggguaauccaaacgauccccacggguccgaacacaccguaucaggacagcauuuugcagccgagcuucacauugugcauuauaauagugacuuguacccugaugcuagcacagcaucuaacaaguccgaaggccuggccguccuagcugugcucaucgagaugggcucauucaauccaagcuaugacaagauuuuuagucaucugcaacacguuaaauacaaggggcaggaggccuucgugccgggauuuaacaucgaggaacuucugcccgaacgcacugcggaguacuaucgauaccgugguucuuugaccacaccuccauguaaucccaccguccucuggacuguguucagaaacccuguacagauaucccaggagcaacuguuagcacuggaaacagcccucuauugcacccacauggaugacccaagccccagggagaugaucaauaacuuucggcagguucagaaauucgaugaacgccuuguguacacgucguuuucucaaguccagguguguacugcugccggccuguccuuggggauuauccuaucacuggcacucgcuggcauucugggaaucugcauaguggucguugugaguauuuggcuuuucagaagaaagagcaucaaaaagggugacaacaaggggguaauuuauaaaccggccaccaagauggagacagaagcgcacgccuga

SEQ ID NO: 53704 - RNA, 789 nt, Artificial Sequence
  derived and/or modified sequence opt3 from CA13__Homo_sapiens__NP_940986
augagcagacuguccuggggcuacagggagcacaacgggcccauccauuggaaggaguucuuuccuauugccgacggagaucagcaaucuccaauagaaaucaaaaccaaggaagugaaauaugacucaagucuccggccgcuuagcauuaaguacgaucccuccucugcuaaaaucauuagcaauucaggucacagcuucaacgucgacuuugaugacacagagaauaagaguguucugcgcggcgggccuuugacuggauccuaucgauuacgucaggugcaucugcacuggggcucugcagaugaccaugguagcgaacacaucguagaugggguguccuacgccgcggagcuacacgucgugcauuggaacucagacaaguauccaaguuucguugaggcugcccacgaacccgauggacucgcagugcugggcgucuuucuucagauaggcgagccuaauagccagcugcagaaaaucacggacaccuuggauucuauuaaggaaaaagggaagcaaacaagauucacuaacuuugaccuccugucccugcucccacccucaugggacuacuggaccuauccuggaucguuaacagugccaccgcugcuugagaguguaaccuggaucguuuugaaacagcccauuaauaucucuucccagcaacuggccaaguucaggagccuacucugcacugcugagggugaagcagccgcuuuucuggugucgaaccaucggccuccacagccccuuaagggccgcaaagucagagccucuuuccacuga

SEQ ID NO: 53705 - RNA, 786 nt, Artificial Sequence
  derived and/or modified sequence opt3 from CA1__Homo_sapiens__XP_011515886
auggccagccccgacuggggcuacgaugacaagaacgggccugagcagugguccaaacuguauccaaucgcuaauggaaacaaucaaucuccgguggauauuaagaccucagaaacaaaacacgacacgagucucaagcccauaagcgucuccuacaacccugcaacugccaaagagaucauuaauguuggucauucuuuccacgugaacuuugaagauaaugacaacagaucgguacuuaagggcgggccauucucagauagcuauaggcuguuucaguuccauuuucacuggggaaguaccaaugagcauggcuccgaacacacaguggacggugucaaguacucugcggaguugcacguggcucauuggaacagcgccaaauauuccucauuagcagaggccgcuaguaaggcagaugggcuggccguuaucggagugcuaaugaaagucggcgaagcuaaucccaagcuccagaaagugcuggacgcccuucaggcgauuaagacuaagggcaaacgggcaccuuucaccaacuuugauccaagcacacuguugcccucuucccucgacuucuggaccuacccugggucacugacucacccaccgcuguaugagagcguaacauggaucauaugcaaggaaaguaucucuguuuccagcgagcaacucgcccaguuucgcucguuacugucuaauguggagggagauaacgcuguccccaugcagcauaauaaccgaccuacccagccacuuaaaggucguacggugagagccuccuucuga

SEQ ID NO: 53706 - RNA, 783 nt, Artificial Sequence
  derived and/or modified sequence opt3 from CA2__Homo_sapiens__NP_000058
augagccaccauuggggcuacgggaagcacaacggacccgagcauuggcacaaagacuucccuaucgccaagggugaaagacaguccccaguggauauugacacccauacagcuaaauaugauccgucucugaagccccucucagucaguuacgaccaagcaacuagccuuaggauacugaauaacggccacgccuuuaauguugaguucgaugacucccaggauaaagcgguguugaaagggggaccuuuagacggcacguaucggcugauccaguuucacuuccauugggguucucuagaugggcagggaucggaacacaccguagacaagaagaaguacgcugccgagcuccaucuggugcacuggaacacaaaauauggcgauuuuggcaaggcaguccaacagccagacgggcuugccgugcugggaauuuucuugaaaguugguucagcuaagcccggccuccagaagguggucgaugugcuggacagcaucaaaacuaaggggaaaagugcagacuuuaccaauuucgauccucgcggacugcucccagaauccuuagacuacuggacauaucccggcucucugaccacuccuccacuuuuggagugcguaacauggauuguucugaaggagccgaucagcguguccucagaacagguccuaaaauuucgaaagcucaacuucaauggugagggggaacccgaggagcugaugguggauaacuggcguccugcccaaccacuuaaaaauagacagauaaaggcuaguuuuaaguga

SEQ ID NO: 53707 - RNA, 783 nt, Artificial Sequence
  derived and/or modified sequence opt3 from CA3__Homo_sapiens__NP_005172
auggccaaggaguggggcuacgcuagccacaacgggcccgaccauuggcacgaacuguucccuaaugcaaaaggagagaaccaguccccaguggaacuccauaccaaggauaucagacacgacccgucucuucaacccuggucagucaguuaugaugguggcagcgccaaaacaauucugaauaacgggaagacuugcaggguuguguuugacgauacguacgaccgguccauguugcgcggaggcccuuuaccaggucccuaucgacugcgucaguuccaucuacacugggggucuucggaugaccacggaucagagcauaccguagauggcgugaaauacgcggcugaacuccaccugguccauuggaauccuaaguauaacacauuuaaggaggcccuuaaacagagagacggcauagcagugaucgggauuuuccugaagaucggacacgagaauggugaauuucagauuuucuuggaugcccucgacaaaaucaagacuaaaggcaaggaggcuccauuuaccaaguucgaucccagcugucuguuuccugcaugcagggacuacuggacauaucaagggaguuucaccacuccaccgugugaagagugcauaguuuggcugcucuuaaaagagcccaugacaguguccucugaccagauggccaagcugcggagccuuuuguccucagcugaaaacgagccuccagucccccuggugaguaauuggcgcccuccacagcccaucaacaauagaguaguuagggccagcuuuaaauga

SEQ ID NO: 53708 - RNA, 939 nt, Artificial Sequence
  derived and/or modified sequence opt3 from CA4__Homo_sapiens__NP_000708
augagaaugcugcucgcccuucuggcuuugagcgcagccaggcccuccgcgucugcugagucacacuggugcuacgaagugcaggccgagaguagcaacuauccuuguuuagucccaguuaaguggggcgggaauugccaaaaagaccggcaguccccgaucaacauugugaccacaaaggcaaaaguagauaagaaacugggacgcuucuuuuucucugguuacgacaagaagcagacuuggacggugcagaauaacggccauucggucaugaugcuacucgaaaauaaagccucaauaagcgggggaggccugcccgcuccuuaucaagcaaagcagcuucaucugcacuggagugauuugccauacaaagguuccgagcacucucucgacggggaacauuuugccauggagaugcacaucgugcacgagaaggaaaaaggaaccagccgaaacguuaaggaggcucaggaucccgaagacgagauugccgugcuggcguuccuggucgaggcaggcacacaggugaaugaaggcuuucaaccucucguagaggccuuauccaacaucccaaagcccgaaaugucaacuaccauggcugagaguagccugcuugauuugcugccuaaagaagagaagcuacgucauuauuucagauaccucgggucucugacaaccccaacuugugacgagaaaguuguguggacagucuuuagggaaccgauucagcuucaccgggagcagauccuggccuucucccagaaguuguauuacgauaaagaacaaaccgugucaaugaaggacaaugugcgcccccuccagcagcugggacaaagaacggucauaaaaagcggugcaccuggcaggccauuacccugggcucugccugcccuccuugggccaaugcuggcgugcuugcuagccggauuucugcgguga

SEQ ID NO: 53709 - RNA, 918 nt, Artificial Sequence
  derived and/or modified sequence opt3 from CA5A__Homo_sapiens__NP_001730
augcugggcagaaacaccuggaagacaagcgccuucuccuuucucguggagcagaugugggcuccccuuuggucuaggucaaugcggccugggcgcuggugcagucaacgaagcugugcauggcagacuuccaauaacacgcugcacccauuguggaccgucccgguuucugugcccggagguacacgucagucgccuaucaauauucaguggagagacucaguauacgauccacaauuaaaaccccugagggugagcuaugaagccgcgaguugccuauacauauggaacacuggcuaucucuuccaggucgaguuugacgaugcuaccgaagccuccgggaucucuggaggcccucuggagaaucauuaccggcuuaagcaguuccacuuucauuggggugcagugaacgaagggggaagcgagcacacaguugacggccaugccuauccagcugagcugcacuuggugcacuggaacuccgucaaauaccagaauuauaaggaagcagugguaggcgagaaugggcucgccguuauuggaguguuccugaaacugggugcucaucaccaaacccuccagcgcuuagucgauauccugcccgaaauuaagcauaaggacgccagagcggcaaugaggccuuuugauccaucaacucuuuugccgacauguugggacuacuggaccuacgccggcagucugacgacucccccucuaaccgagagcgugacauggaucauacagaaagagccaguggaagucgcucccucucagcucuccgccuuccggacucugcuguuuucagcacuuggggaggaagagaagaugaugguuaacaauuaucgcccuuugcaaccacucaugaaccgaaaagugugggcuagcuuccaggccaccaaugaaggaacaagaaguuga

SEQ ID NO: 53710 - RNA, 885 nt, Artificial Sequence
  derived and/or modified sequence opt3 from CA6__Homo_sapiens__XP_011540385
augugcagcaccaugagagcccuggugcuccuucuguccuuguucuuacugggcgggcaggcucaacacgucucugacuggacauacucagagggagcacuagaugaagcccauuggccccagcacuauccugcgugugguggccagaggcagaguccaaucaaccuccaacggacuaagguucgcuacaauccgagccugaaagggcuuaacaugacgggauaugagacccaggcuggcgaauuucccauggugaauaacggucauacaguacagauuucccugccuucuacuaugcgaaugaccguggccgacgggacagucuacauagcacagcaaaugcacuuccauuggggaggcgccucgucagagaucagcggcagugaacacaccguggaugggauucgucacguuaucgagauucauaucgugcacuauaauuccaaguacaaaucuuaugacauagcucaggaugcaccagacggauuggccguccucgcugccuuuguggagguaaagaacuaccccgaaaauacuuacuauagcaacuucaucucccaucuggcgaauauuaaauacccuggucagagaacaacccugacgggccucgauguucaggacauguuaccaaggaaccugcaacacuauuacacuuaucacgggucacuuaccacacccccuugcacugagaaugugcauugguuugucuuggcagauuucgugaagcugagucggacccagguguggaagcuagaaaacagccuccuggaccaccgcaauaaaacaauccauaacgauuacagaaggacccagccacuuaaucaccgggucguugagucuaacuuuccgaaccaagagaauuguauucccgccggacugaucuga

SEQ ID NO: 53711 - RNA, 873 nt, Artificial Sequence
  derived and/or modified sequence opt3 from CA8__Homo_sapiens__NP_004047
auggccgaccugagcuucaucgaggauaccguggcuuuucccgaaaaggaggaagacgaggaagaggaggaagagggcgucgaauggggguacgaggagggaguugaauggggucucguguucccugaugcaaacggcgaguaucaguccccaauuaaucuuaacucuagagaagccagguacgacccgucacuguuggauguacgguuaagucccaauuauguggucugccgcgacugugaggugacaaacgaugggcacacuauacaaguuauccugaaaagcaaguccgugcuaucuggaggcccucucccacagggucaugaauuugagcuguacgagguccgauuccacugggggcgugaaaaucagagaggaucggagcauacggugaacuuuaaagcguuccccauggaacuucaccugauucauuggaacucaaccuuguuuggcagcaucgacgaggcuguaggcaagccucacgggauugccaucauagcacucuucguucagaucggaaaagaacacgugggucugaaggccgucacagagauucugcaagauauccaguauaagggcaaaaguaagacuauuccaugcuuuaaucccaauacccucuuaccugacccacugcuuagggauuacuggguguaugagggguccuugacaaucccgcccuguucugaaggagugaccuggauacuguuccgguacccucuaacuauuagccagcuccagaucgaggaauuucgcagacugaggacacaugucaaaggcgcugagcuuguugaagguugcgacgggauucugggagauaacuuccggccaacccaacccuuguccgaccgcgugauccgagcagccuuucaguga

SEQ ID NO: 53712 - RNA, 1026 nt, Artificial Sequence
  derived and/or modified sequence opt3 from CAB39__Homo_sapiens__NP_001124322
augcccuucccuuuuggcaagagccacaaauccccagccgacaucgugaagaaccugaaagagucuauggcuguccucgaaaagcaggauauuucagacaaaaaggcagagaaggccaccgaagagguuaguaaaaaucuuguggcgaugaaggaaauacuguacgggacaaacgagaaagagccgcaaacugaagcuguagcccaguuggcacaggaguuauauaauagcggacugcuauccacgcucguggccgaucugcagcuuaucgacuucgaagguaagaaagaugucgcucaaauuuuuaacaauauccugagaaggcagauuggcacccggacacccacuguggaguacaucugcacccagcagaacauauuguucaugcuccugaagggguaugagucuccugaaaucgcacugaauuguggaauuaugcuccgcgagugcauccgacaugaaccauuagccaagauuauccuguggucggagcaauuuuacgacuucuuucguuauguugaaaugucaacauucgauauagcuagcgacgccuuugcgaccuucaaagaucuuuugacuagacacaagcugcuaagugcagaguuucucgagcagcauuacgacagguucuuuuccgaauaugagaaacugcuucacucugaaaacuacgugacaaagcggcagagccugaaauugcucggcgagcuguuacuggaucgccauaauuucaccauuaugacgaaguacaucuccaaacccgaaaaccucaaacuuaugaugaaucuguugagagacaagucaaggaacauucaguucgaggccuuucacgucuucaagguguuuguagcuaauccuaacaagacucaaccaauccuagauauccugcucaaaaaucaggccaagcugauugaguuccuuaguaaauuucagaacgaccggaccgaagacgagcaauucaacgaugaaaagacauaucugguuaagcagauacgcgacuugaaacgacccgcacagcaggaggcuuga

SEQ ID NO: 53713 - RNA, 1014 nt, Artificial Sequence
  derived and/or modified sequence opt3 from CAB39L__Homo_sapiens__NP_001274268
augaagaaaaugccccuguucagcaagucccacaaaaacccugccgagaucgugaagauucucaaagacaaucuugcuauacuggaaaagcaggauaagaaaaccgacaaggcaucugaggaagucucaaaaaguuugcaagccaugaaggagaucuuaugcggcacaaacgaaaaagagccaccgacugaggcgguugcucagcuggcccaggaacuauacagcuccgggcuccuggugacgcuuauugcagaucugcaguugaucgacuuugagggaaagaaggauguaacccaaauuuucaauaacauccucagaaggcagauagguacacggucucccacuguggaauauaucucggcccauccucacauucuguuuaugcugcucaaaggcuacgaggcuccacagaucgcauuacgcugugggauuaugcugcgagagugcauccgucaugaaccccuugccaagauaauuuuguucucaaaucaguuuagagacuucuuuaaauaugucgagcugagcaccuucgauaucgcuagugacgccuuugcgacauucaaggaucuacucaccaggcacaaagugcugguugcagacuuucuugaacaaaacuacgauacuauuuucgaggacuaugaaaagcuguugcaguccgagaauuacgugacaaaacggcagucucucaagcuguuaggagagcugauccucgaucgccauaacuuugccaucaugaccaaguauauuagcaaaccugaaaaucuuaagcugaugaugaacuugcuaagagacaaauccccaaauauacaguucgaggcuuuccacgucuuuaagguguucguagccucaccccacaaaacgcaaccuaucguugaaauucugcucaagaaccagccaaagcugaucgaguuucuuaguagcuuccagaaagaaaggacugacgaugagcaauuugcagacgagaagaauuaccugauaaaacagauucgggauuugaagaaaaccgcuccguga

SEQ ID NO: 53714 - RNA, 6663 nt, Artificial Sequence
  derived and/or modified sequence opt3 from CABIN1__Homo_sapiens__NP_036427
augauccggauugccgcucugaaugcaagcuccaccauagaggacgaucacgaaggcucuuucaaaucacauaaaacccagacuaaggaggcccaagaagcggaggcuuuugcccucuaccacaaagcacuugaccugcagaagcaugauagguucgaagagagugccaaggcuuaucacgaguuguuagaagcaagccugcuacgggaggccguguccucuggggacgaaaaggagggacucaagcaucccggucugauccuuaaauacucgacguauaagaaucuggcucaguuggccgcgcagcgcgaggaucucgaaaccgcaauggaguuuuaccuggaagccgucaugcuggacucaacagauguuaaccucugguauaaaauuggccacguggcuuuacgacugauccguauuccucuugccagacacgcauucgaggaaggguugaggugcaauccagaccauuggccgugucuggauaaccuaaucacuguacucuacacccugagcgacuauacaaccugccuuuacuuuauauguaaggcucuggagaaagauugccgguacaguaagggauuggugcucaaggagaaaaucuucgaggaacaacccugucugcgcaaggacuccuuaagaauguuucugaaaugcgauaugucuauucacgacgucagcguguccgccgcggaaacucaggccaucguugacgaggcacucggccuuaggaagaaacggcaggcucugauugugcgcgaaaaggagccugauuugaagcuaguccagccaauccccuucuuuacauggaagugucugggugagucacuccuggccauguauaaucaucuuaccacgugcgaaccuccacgacccagucuggggaagagaauagacuugagcgauuaccaagacccuucucagccacucgaguccucaauggugguaacuccgguuaacgugauucagcccagcaccgucaguacaaauccugcuguggccguggcagaaccagucguuucuuauacuuccguggccaccaccagcuucccccugcacucgccuggauuacuggagacaggcgcuccaguaggcgauaucucugggggagacaaauccaagaaaggugugaagaggaaaaagauuucagaagagaguggcgagacggcgaagcggcguagcgcacgcgucagaaacacuaaauguaagaaagaagagaagguggauuuucaggaacuacucaugaaauuccugcccuccaggcuucggaaguuggacccggaggaggaagaugacucuuuuaauaacuacgagguucaaagcgaagccaagcuggagucauucccuaguaucgggccccagcgacucuccuucgauagcgcuacauuuauggaaucugagaaacaggacgugcacgaguuccugcuugaaaaucugaccaacggaggcaucuuggagcucaugaugcgcuaucugaaggccaugggucauaaauuuuuagucagauggccaccugggcuggcagaagugguacuaucaguuuaccacaguuggaggcggcauagcacuucccuccccaauccacugcuucgcgacugcucuaacaagcacauuaaagauaugauguugaugucgcugagcuguauggagcuccaacuggaccagugguuacugacaaagggaagauccucagccgugagucccaggaauugcccugcuggcauggucaacggccguuucgggccagauuuuccgggaacccauugccuuggugacuugcuccagcugucuuucgccagcucccagcgggaucuauuugaagacggcuggcuggaguucgugguccgaguguauuggcucaaggcaagauuucuggcgcuucaaggggauauggagcaggcuuuggaaaacuacgacauauguacggagaugcugcagucaagcaccgccauccagguugaagcaggagccgagaggcgcgauauugugauccgguuacccaaucuccacaacgacucuguagucucccuggaagagauagauaaaaaucuuaagagucuggagagaugccagagcuuggaagagauucagaggcucuacgaagcuggcgacuauaaagccgugguucaucugcuacgcccuacacuguguacuucugguuucgaucgagcaaagcaucucgaguuuaugaccuccaucccagagcggcccgcucagcugcuuuugcugcaggacucauuacuccgucugaaagacuacagacaaugcuucgaauguagugauguggcccuuaacgaggcgguccagcagauggugaauagcggggaagccgcugcaaaggaggaauggguagccacagugacucagcugcuaaugggcaucgagcaagcucucucggccgacuccucuggaagcauucugaaaguuucaaguuccaccacaggcuuggucaggcugaccaacaauuuaauccaggugauugauugcucuauggcagugcaggaggaagcgaaggagccucacgucagcuccguucucccauggauaauccugcaucgcauuaucuggcaagaagaggacacuuuucacucacuuugucaccagcagcagcugcaaaaccccgccgaagaggggaugagcgagacgccgauguugccuaguucucucaugcugcuaaauacagcucaugaauaucugggacggagauccuggugcuguaacagcgauggugcccuucucagguucuacgugcgagugcugcagaaggaguuggcagcuucgaccucagaagacacucacccauauaaagaggaacuggagaccgccuuagagcagugcuucuacugucucuauucuuuucccaguaagaaauccaaggcacgcuaccuggaggaacacagcgcccagcaaguagaucuuaucugggaagacgcucuguucauguuugaguacuucaaaccuaagacauugcccgaguuugauucuuauaagaccagcacugucuccgcggaccucgccaaucugcuaaaacggauugcaacaauagugccaagaacggaaaggccugcucugucacuugauaagguuagugccuacaucgagggcaccagcacugaagugcccugccucccagagggggccgacccgucuccucccgucgugaacgaacuguauuacuuguuagcugauuaucacuucaaaaauaaggagcaguccaaagcaauuaaguuuuacaugcaugacaucugcauuuguccaaaccguuucgacucaugggccggaauggcgcuggcucgcgccagucggauccaggauaagcucaauagcaacgagcugaaauccgacggccccauauggaagcacgcaacaccuguucuuaacugcuuuagaagggcccuggaaaucgauucuucgaauuugagccuauggauugaguaugguaccaugucauacgcucugcacuccuucgcaagucgacagcucaaacaauggagaggggaacugccacccgagcuugugcagcagauggaaggccgcagagacucuauguuagagacagccaagcauuguuuuacuagcgcggcuaggugcgagggagauggcgacgaagaggaauggcugauccacuacaugcucgggaaaguagccgagaagcaacagcagccuccgaccgucuauuugcugcauuaccggcaggcaggacacuaucuccaugaagaggccgcucgauacccaaagaaaauucacuaucacaaucccccugagcuggccauggaagcacuugagguguacuucagacugcaugcuuccaucuugaagcuacuggguaaaccagauucaggcgugggggccgaaguccucguuaauuuuaugaaggaggcggccgagggacccuucgcacgcggcgaagagaaaaacacgccuaaggcuucugaaaaagagaaggccuguuuaguggacgaagauagccacaguuccgcugguacccugccggggcccggcgcaagccuuccaucuucauccggaccuggccugacaagucccccauauacugccaccccuauagaccaugauuacguaaagugcaaaaagccccaccaacaggccacaccagacgacaggagccaggauucgacugcuguggcgcucucugacuccagcucaacccaggauuucuuuaaugagccgacgaguuugcuggaggggucucguaaauccuacacagaaaagcggcucccuauucugagcucacaagcaggagccaccggcaaagaccuucagggugcuacugaggaaagagggaagaacgaggaaagucuagagagcacagagggauucagggccgcagaacagggcguccagaagcccgccgcugagaccccagcguccgccuguauccccgguaaaccuucugcaagcacuccaacccugugggauggcaagaaacgcggggacuugcccggagaaccuguggcuuuuccgcaaggcuuaccagccggggcagaggaacagcgacaguuccugacagagcagugcauugccuccuuuagacucugucugucacgguucccccaacacuauaagucucuuuacaggcuggcuuuucucuauacguacaguaaaacccaucgcaauuugcagugggcccgugauguucugcuaggaucgagcaucccuuggcagcaacugcagcacaugcccgcgcagggccucuucugcgagagaaacaagacuaacuucuucaacgguauauggcggaucccaguggacgaaauugauaggccuggguccuuugcauggcauaugaaucgcucuaucguccuucuguuaaagguguuggcccagcugcgagaccacucaacacuccugaaaguuagcuccaugcuucaaagaacccccgaucagggaaagaaauaucugcgggacgcugauaggcaagugcucgcccagcgcgcuuucauuuugacagucaagguacuggaggacacuuuaagugaacuagcagagggcucugagagaccagguccuaaaguguguggccugccgggggccaggaugaccacggacguuagccauaaggcuucacccgaagauggacaagagggccucccacagccuaagaaacccccacuugccgacggguccggaccuggccccgaaccgggugggaaggugggacuguugaaccaccggccagucgcaauggaugcgggcgacagugccgaucagagcggugagcguaaagacaaggaaucuccucgcgcuggccccacagagccaauggauaccuccgaggccacugugugccacucagaccuggaacgaacacccccucuccugccggggagacccgcaagggaucggggaccagagagccgcccuacagaacuuucgcucgaggaacugucuaucagugcuagacagcaacccacuccuuugaccccagcccagcccgccccugcaccagcucccgcgacaacgaccggcacuagggccgggggacauccggaggagccucugucccgguuaagccgaaaaagaaagcuacuggaagacacagagucaggcaagacccuccuucuggaugcauaccgcguauggcagcaaggucagaaagggguggcuuaugacuugggaagggucgaacggauaauguccgagacuuacaugcugauuaagcagguugaugaagaggccgcccucgagcaggcagugaaauucugccaagugcaccugggcgcugccgcgcagcgucaggcuucuggcgacacaccaaccacgcccaagcauccuaaagacagcagagaaaacuuuuucccagucacugugguucccaccgccccggauccuguacccgcagacagugugcagaggccauccgaugcccacacaaagccucgccccgcucuugcagccgcgaccacuaucaucacauguccacccagcgcuucugccucaaccuuagaccaaaguaaagauccugggccaccgcggccccaccgaccugaggcaacaccauccauggccagccugggacccgaaggugaggagcucgcuagagucgccgaaggcacuucuuuuccuccacaggagcccaggcauucgccucaggugaagauggcaccgaccucaagcccagcugaaccccacugcuggccugccgaggcggccuuggggacgggagcagaacccacauguucccaggagggcaagcugcgcccagagccucggagagacggugaagcucaagaggccgcaagugaaacccagccccuaucuagcccaccgacugcugccuccucaaaagccccuaguucugggagcgcgcagcccccagagggacaucccggcaagccugaaccaucccgugcuaaaucaaggccccugccuaacaugccgaagcucguuauuccaagcgcagccaccaaauuucccccugagaucacagugacuccacccaccccuacgcuucugucucccaagggcuccauuagugaggaaacaaagcagaaauugaaaagcgcuauacugucggcccaauccgcagccaauguccggaaagagucucucugccagccagcucuggaaguguuagagaccucaagccaggaaaguucccuugagucugagacugaugaagacgaugacuacauggauaucuga

SEQ ID NO: 53715 - RNA, 1902 nt, Artificial Sequence
  derived and/or modified sequence opt3 from CABLES1__Homo_sapiens__NP_001094089
auggccgcugcagccgcggcugccaccacagcagccugcagcuccggcucugcugggacugacgcagccggagcuucaggucugcagcaacccccuccacagccgcagccccagccugccgcggcagccccagcucaacccccuccagagcccccuagaaagccaaggauggauccgcggcgccgacaggccgcacucaguuuccuuacgaacaucagccuggacggccguuugcccccucaggaugcugaauggggaggaggcgaggaagguggggccgcgaaaccaggagccggcggcgcauguggggcuagaaccagguuuuccuuacuggccgcugccgagcggggagguugcauugcacuagccgcucccggcacuccugcggcagggcucgccgcuggaucuggcccaugucugccccagccgucgucacuuccuccccugauaccaggugggcacgccacagugagcggaccuggcgucgcacgcggcuucgccagucccuugggggcugggagagccuccggugaacaauggcagccacccaggccugcaccacucgcggcuugcgcccagcugcagcugcucgacggcucuggggcagccggacaagaggaguuagaagaggaugacgcuuuuaucagcguucaggugccggccgcagcuuuccugggcuccgguacccccgggucaggcaguggaagccggggccgccuuaauucuuuuacacaggggauuuugccuaucgccuucucccgaccaaccucacaaaacuacuguagccuggaacagcccggacaggguggcaguacuucugcguuugagcagcuacaaagauccaggcggcgucucauuagccagcgcucgucucuggagacacuugaagauaucgaggaaaaugccccucugagaaggugccggaccuuguccgggucaccacgacccaagaacuucaaaaagauacauuuuaucaaaaauaugcgccagcacgacacgagaaacggaaggauuguacucaucaguggccggcgcagcuucuguuccauuuucucugugcugccguauagagauagcacucaggucggugacuuaaagcuggaugggggcaggcaaucaaccggagcugugagucucaaggagaucauaggccuugaagggguugagcugggagcagacgguaaaacaguguccuacacucaguucuugcuaccuaccaaugccuuuggcgcucgucggaacacaauugauagcaccucuucauucagucaguuccgaaaucugagccauagaucccucucuaucgggagggccucgggaacgcagggcagccuggacacugguuccgaccuuggggauuuuauggacuaugauccaaaccuguuggacgauccccaauggccuugcggcaagcacaaacgcguccucauuuuccccucauacaugacaaccgugaucgacuauguaaagccaagugaucugaaaaaggacaugaaugagacuuuuaaggaaaaauucccucauaucaaguuaacacugucuaaaauucggagccuaaagagagagaugaggaaacucgcacaggaagauuguggacuggaggaacccaccguugcgauggccuuuguguacuucgagaaacuugcuuugaagggcaagcugaacaagcagaaucgcaaacucugcgccggggcauguguccugcuugcugccaagauaggauccgaccugaaaaagcacgaggugaaacacuugaucgauaagcucgaagagaaguuucgacugaaccggcgugaauuaauugcauucgaguuuccagugcuggucgcccuagaauuugcucuccaucugccggagcacgagguuaugccucauuauagaaggcuugugcagucaagcuga

SEQ ID NO: 53716 - RNA, 663 nt, Artificial Sequence
  derived and/or modified sequence opt3 from CABP2__Homo_sapiens__NP_057450
augggcaacugcgccaaaagacccuggaggcgggggccuaaagacccacugcaguggcucggaagcccgccccgcgguuccuguccuucuccaucaaguagccccaaggagcaaggcgauccugcuccaggggugcagggauacuccguccuuaauucucugguuggccccgcaugcaucuucuugcgaccuucgauugccgcgacccaguuagaccgugaacugagaccagaggaaauagaggaacuacagguggcuuuucaagaguucgauagggaccgggaugguuauaucgggugucgcgagcucggagccugcaugagaacacugggcuacaugccgacugaaauggagcuuauugaaaucucacagcagauuagcggcgggaaaguagacuuugaggauuucguggagcugaugggacccaaguugcucgcagaaacggccgacaugaucggugucagggagcugcgggaugcuuuucgcgaguucgacaccaacggcgaugggcgaauaagugugggagaacugagagcagcccucaaggcuuuacugggcgaaaggcuuucccagcgggagguugacgagaucuugcaagauguggaccugaauggugacgggcuagucgauuuugaagaguucgugcguaugaugucucgcuga

SEQ ID NO: 53717 - RNA, 513 nt, Artificial Sequence
  derived and/or modified sequence opt3 from CABP4__Homo_sapiens__NP_001287824
augaccgagcccuggcuggcccucggcacaagcuggacucuuccucugcaggacagagaauuggggccagaggaauuagaugagcugcaagcugcauucgaagaguuugacacggauagggacggauacaucucccaccgggagcuaggugauugcaugcgcacccucggcuauaugccgacagaaauggagcugcuugaagugucucagcauauuaagaugcgaaugggagggcgugucgacuucgaggaguuuguugaacugauaggccccaaauugagagaggaaacugcccacaugcucggugugagggagcugcggaucgcguuccgcgaauuugauagagacagggaugggcggauuaccguagcugagcugcgcgaggccgugccugcacucuuaggagaaccacuggccggccccgagcuugacgaaauguugcgagaggucgaucugaacggcgacgggacaguggauuucgacgaauuuguuaugaugcuaucaagacauuga

SEQ ID NO: 53718 - RNA, 1188 nt, Artificial Sequence
  derived and/or modified sequence opt3 from CABS1__Homo_sapiens__NP_149113
auggccgaggacggccugcccaagaucuacagccacccuccaaccgaauccucuaaaacaccgacugcugcaacgauuuucuuuggggccgauaacgcgauacccaagucagagaccacaaucaccagugaaggagaccaugugacuagcgucaaugaguauaugcucgaauccgauuucucuacaaccacugacaacaaacuuacagcuaagaaagagaagcugaagucggaggaugacauggguaccgauuuuauuaaaucaacgacucacuugcagaaggaaaucaccagcuuaacaggcacuaccaauaguauuacaagagacuccaucaccgagcauuucaugccuguuaaaauagggaacaucucuagcccagugacgacuguaucccugauugauuuuucaacagacaucgccaaggaagauauucuacucgcaaccaucgacacuggagaugccgagauaaguauuacaagcgaggugucuggcacccugaaagacuccucagcuggugucgcagacgcccccgcuuucccuaggaagaaggaugaagccgacaugagcaauuacaacaguucuaucaaauccaaugugccagcggaugaggcaguucaagugacggacagcaccauucccgaagccgagaucccuccagcuccggaagagucguuuacaacuauccccgauauuaccgcccuugaggaagagaagauaacagaaaucgaccugucugucuuggaggaugacacuuccgcaguggcuacccucacagauucagacgaaaaauucauuaccguauuugagcugacuacgagugccgagaaggauaaagacaagcgggaagacacacugcucaccgaugaggaaacuaccgagggggcgagcaucuggauggaacgcgacacagccaacgaggcagagacccacuccguuuuacugacugcuguggaaucucgauaugauuucgucgugccugccagcauagcuacaaaucuuguggaggaaucaaguacggaggaggacuuguccgaaaccgauaacacugagacagucccaaaaauuaccgaacccuuuagcggaacaacuucuguucuggacaccccugauuacaaggaggacacgucaaccacagaaacugauaucuucgagcuacucaaggaggaaccagacgaguuuaugaucuga

SEQ ID NO: 53719 - RNA, 1482 nt, Artificial Sequence
  derived and/or modified sequence opt3 from CABYR__Homo_sapiens__NP_036321
augaucagcuccaagcccagacugguggucccuuacggccucaaaacccuucuggaggggauuucuagggccguuuugaagacaaacccaucaaauauaaaccaguucgcugcagccuauuuucaagaauuaacuauguaccggggaaauacgaccauggacaucaaagaucuggugaagcaguuccaccagauuaaaguagagaaguggagugaagguacaacuccgcagaagaaacuagagugccucaaggaacccggcaaaaccagcguggaguccaaggucccuacacaaauggagaaaucuaccgacacugaugaagacaacgugacacgcaccgaguauucggauaagacgacucaguuuccaucaguuuacgcggugcccgggaccgaacagacagaggcugucggaggccugagcaguaagccugccacuccaaaaaccacaaccccaccuuccucuccaccgcccacggcagugagcccugaguucgccuauguaccagcugaccccgcacagcuugccgcucaaaugcuggguaagguuuccucaauccauagugaucagagcgacguguugauggucgauguggccacuucuaugccuguggucauuaaagaaguuccauccucagaggcggcagaagacgugaugguagccgcuccccucguguguagcgggaagguccuggaggugcagguugugaaucagacaaguguccacguggaucugggaucucaaccgaaagaaaacgaggccgagccuuccaccgcaagcucgguaccccuccaggacgaacaggagcccccugcuuacgaucaagcccccgaaguuacuuuacaggcggacaucgaggugaugucuacaguccauauauccucaguguauaaugacgucccagugaccgaaggcguuguguacaucgagcagcugcccgagcagauuguaaucccuuuuacggaucaagucgccugccuuaaggaaaacgagcagaguaaagaaaaugagcagagcccacgaguguccccgaagucuguuguggaaaagaccacaagcggcaugaguaaaaagucagucgaguccgugaaauuggcacagcuggaggaaaacgcuaaguacagcucuguauauauggaggccgaagcuacugcccuacucucagacaccagucugaaagggcaacccgaggugccugcacagcuucuggaugccgagggagcuauuaagaucgguagcgaaaaguccuugcaccucgagguugaaauaacaucuauugucucggacaauacuggccaggaggaaagcggggagaacuccgugccacaggagauggaaggaaaacccgugcugucaggcgaggcggcagaagccguccauagugguaccucuguuaagagcuccucagggccuuucccacccgcuccggagggauuaacagccccugaaaucgagccagagggcgaaagcaccgcagaguga

SEQ ID NO: 53720 - RNA, 6786 nt, Artificial Sequence
  derived and/or modified sequence opt3 from CACNA1A__Homo_sapiens__NP_001120693
auggccagauucggcgaugaaaugcccgcuagguacgggggagguggcagcggggcagccgcgggaguggucguuggcuccggugggggacggggcgcuggcgggucucgccagggaggucaaccuggcgcccagcgaauguauaagcagucaauggcacagcgugccagaaccauggcucuguacaacccaaucccggugaggcaaaauugccucacgguaaaccggagucuuuuucuguucagcgaagauaaugugguccgcaaauaugcaaagaaaauuacugaauggcccccuuuugaauacaugauauuggccacgaucauugcuaacuguaucguguuagcccuggagcagcaucugccagacgaugacaagacccccauguccgaaagacucgaugacacagagccuuauuucauugggaucuuuugcuucgaggcgggaauaaaaaucauugcacugggcuuugccuuccacaaggguucuuaccuuaggaauggguggaacguuauggauuuuguggucgugcugacuggaaucuuggcuaccguaggcacagaguucgaccuccggacccugcgcgccguucgagugcugagaccacucaaguuagucucgggcauucccucacuacagguggugcuuaaaagcaucaugaaggcaaugauaccuuugcugcagauugggcuacuccuguuuuucgcuauccuuauuuuugccaucaucggacuggaguucuauauggguaaauuccacacuacauguuuugaagagggcaccgaugacauucaaggggagaguccagcgccgugcggaacggaagaaccagccaggacuuguccuaauggcaccaagugccagccauacugggaaggucccaacaaugggauaacacaguucgauaacaucuuguuugcaguccucacuguuuuccaguguauuaccauggagggcuggacagaccuguuauacaauuccaacgaugcuucuggaaauaccuggaacuggcuguauuuuaucccucucauaauuaucggcagcuucuuuaugcuuaaucugguguuggggguacuauccggagaguucgccaaagagcgggagcguguggaaaaccgcagagcuuuucugaagcucaggcggcaacagcagaucgagcgagaacugaacgguuacauggaguggauuucaaaggccgaagaggucauccuugcagaggacgaaacggacggcgagcaacgccauccauucgauggggcccugagaaggacuacaauuaaaaagaguaaaaccgacuugcucaaucccgaagaggcugaagaucagcuggcggacauagcaagcgugggaucuccguuugcccgggcuuccaucaagucagccaaauuagagaacagcacuuucuuucacaagaaagagcgcagaaugagguucuauauucgucggaugguuaagacacaggcauucuacuggaccgugcugagucuagucgcccucaauacgcugugcguggcuaucguacauuauaaccagccugaauggcuuucugacuuuuuguacuaugccgaguucaucuuucugggccucuucauguccgaaauguuuauuaagauguacggucuggggacccgacccuacuuccacagcucguuuaauuguuucgacugcggcguuauaaucggaucuauuuuugaggugaucugggcagucauuaaaccaggcacauccuucgggaucucagugcuuagagcgcugagguugcuccgcauauuuaaggucacuaaauauugggcuagucugcggaacuuagugguuagccugcuaaauuccaugaagucuaucauuagccuccuguuccuuuuguuucuguucaucgugguauucgcccuccugggaaugcaauuauuugguggccaguucaacuuugaugaggggaccccucccacaaauuucgacacuuuuccagcagccauuaugaccgucuuccagauccugacaggagaagauuggaacgaggugauguacgacggcauaaaaucacagggugggguucaaggcggaaugguguuuaguauuuauuucaucguccuuaccuuguuuggcaauuacacucuccugaacguguuccuagcuauugccguagauaaucuggcaaacgcucaggaacucacgaaggacgagcaggaagaggaggaagccgcgaaucagaagcuggcccuucaaaaagcuaaggagguggcagaaguuucccccuugagcgccgcuaacaugucuaucgccgucaaagagcagcagaagaaccagaaaccugcaaagucagugugggaacaaagaacaagugagaugaggaagcagaaucuguuagcgagccgcgaggcccucuauaacgaaauggacccagaugagcgauggaaagcugccuacacccggcaucugcguccggacaugaagacucaucuugauagaccccugguggucgacccucaggaaaauaggaacaauaacaccaauaaaucccgcgcagcugagccaacaguugaucaacgguuggggcagcagagagccgaagacuuucucaggaagcaggcacgauaucacgaucgcgcccgggaccccucuggaucggcuggccuggaugcgagaaggccuugggccgguagccaagaggcagagcuaucccgugaagggccauacggacgcgagucagaccaucacgcucgggaaggcagucuggagcagcccgguuucugggagggcgaagccgagagagggaaagccggagauccgcacaggcgacaugugcaccggcagggcgggucucgcgaaagcagauccggaucaccuaggaccggcgcugacggugagcaucggcgacacagagcacaucgcaggccaggggaagagggacccgaggauaaggccgaacgucgggcgagacacagggagggcagccgcccugcucgagguggcgaaggggagggagaaggccccgacgggggagagagacggaggcgccaccgucauggcgccccagcaacuuacgagggugacgccagacgggaagauaaggagaggcgccaccgaagacggaaagaaaaccaggggucuggagugccuguauccggccccaaucucaguacaacgaggccaauacaacaggaccugggucgccaggauccgccucuugcugaggacaucgauaacaugaagaauaacaaauuggcaaccgccgaaagcgcggcuccccauggcucucuggggcacgccggauuaccacagucccccgcaaagaugggcaauucaacugacccugggccaaugcucgccauucccgcuauggccacaaacccucaaaaugcagcuaguagaaggaccccgaacaacccaggaaaucccagcaacccuggcccacccaaaacaccugaaaauucgcugaucgucacuaacccguccgguacccagacaaauucugccaagaccgcgcggaaacccgaucacacaacuguggacauucccccugccugucccccaccucuuaaccauaccguugugcaggucaauaagaacgcaaaucccgauccacugccgaagaaagaggaagagaagaaagaagaggaggaagacgaucguggggaggacggaccuaagcccaugccacccuauagcucaauguucauccuaaguacaacuaacccucuccgccgacugugccacuacauauugaaucugagauauuuugaaaugugcauuuuaauggugaucgcuauguccucuaucgcccucgcugcagaggauccaguucaacccaacgccccuaggaauaacgugcugcgguacuucgacuauguauuuaccggcgucuucacguuugaaauggugauuaaaaugaucgaccuuggccugguguugcaucagggggccuacuuccgcgaucucuggaauauucuggacuuuauagucguuagcggagcucuaguggcguucgcauuuacagguaacuccaagggcaaggauaucaacaccauuaaaucacugagaguacuuagggugcuccggccgcugaagacuaucaaacgauugccaaagcugaaagccgucuucgacugugugguuaauagcuuaaagaacguguuuaauauucucaucgucuauaugcuguucauguuuauauucgcugugguugccgugcagcuuuucaaggggaaauuuuuccacugcacagaugagaguaaggaguuugaaaaagacuguagaggaaaguaccuguuguacgagaaaaacgaagucaaggcacgcgauagggaguggaagaaauaugaguuccauuacgacaauguacucugggcccugcuaacccuguuuacugugucuaccggcgaggguuggccccagguucuuaagcacuccguggaugcuacauucgagaaccaagggccuagccccggauaucggauggaaaugucgaucuuuuacgucguguauuucguaguguuuccauucuuuuucgucaauauuuuuguugcgcucaucauuaucacguuccaggagcagggcgacaaaaugauggaagaguacucacuggaaaagaacgagcgugccugcauagauuucgcaauuucugcuaaaccuuugaccagacacaugccccagaauaagcaaaguuuucaguauaggauguggcaguucgugguguccccaccuuuugaguacacuaucauggccaugaucgcauuaaacacaauuguccugaugaugaaauucuacggcgccagcguggcuuaugaaaaugcccuccgcguuuuuaacauaguauucaccucucuguuuagccuugagugugugcugaaggucauggcguucgggaucuugaauuacuuucgggacgcauggaacauuuucgacuuugugacaguucuaggauccaucacugauauucuggugaccgaguucgguaauaacuuuaucaaucucucauuccugcgacuuuucagagccgcuagguuaauaaagcugcuccgccagggcuauacgauccggauuuugcuguggacauuuguccaaaguuucaaagcccucccguacgugugccugcuuaucgcuaugcuguuuuucauuuaugcaaucauagggaugcagguauuuggaaacauuggcaucgacgucgaggaugaggacagcgaugaagacgaguuccagaucaccgaacauaacaauuuuagaacuuucuuucaggccuugaugcuacuguuccguucugcuaccggugaggccuggcacaacauuaugcucuccuguuuaucagggaagcccugcgauaaaaauaguggaauccugacaagggaauguggcaacgaguuugcauacuucuauuuugugagcuucauauuccuuugcuccuuucugaugcucaauuuguucguugcggugauuauggacaacuuugaguaccugacucgggauucuucgauccucggcccacaucaccuggacgaauacguccgcgugugggccgaguaugauccugcugccugugggaggauucacuacaaggacauguauagccuucuaagaguuaucucacccccacugggauuggguaaaaagugcccucacagaguggcaugcaagcgguuacugcgcauggaucuccccgucgcugacgacaauaccgugcacuucaacuccacacugauggcccuuauaagaacggcacuggauauuaaaaucgccaagggcggggcugacaaacaacagauggaugcggaacucaggaaggagaugauggccaucuggccgaauuugagucagaaaacccuggaccuacugguaacuccacauaagucuacagaucucaccgugggaaagauuuacgcagcuaugaugaucauggaauauuaccgacaaagcaaagccaagaaacuucaggccaugcgggaggagcaggaccguacuccucugauguuucagagaauggaacccccaucccccacacaagagggcgguccugggcagaacgcauuaccgucaacccaguuggaucccggaggcgcucugauggcccacgaaucuggccucaaggagagcccaaguuggguuacgcagcgcgcgcaagaaauguuccagaaaacugggaccugguccccugagcagggacccccuacagacaugccaaauagccagcccaacucucaaucagucgagaugagggaaaugggucgggauggcuauuccgacagugagcauuaccugccuauggaagggcagggacgagcugccagcaugccacgccuucccgcagagaaucagaggcgacggggcagaccgagggguaacaaucugucgaccauuucugauacuuccccuaugaagcgcagcgccucagugcucgggccaaaggcucgucgguuggacgauuacagucuggagagagugcccccugaagagaaccaaaggcaccaccagcgccgacgggacagaucucauagggcauccgaacgcagcuuaggaagauauacagacgucgauaccggccuaggcacagaccugucaaugacuacccagaguggggaucucccaagcaaagagcgggaccaggaaaggggacgucccaaggaucgaaaacaccgccaacaucaccaucaccaccaucaccaucaccacccgccucccccagacaaggauagauacgcccaggagcggccugaccaugguagggcgcgcgcuagagaucagcggugguccaggucucccagcgagggccgagaacacauggcccaucgucaguga

SEQ ID NO: 53721 - RNA, 7020 nt, Artificial Sequence
  derived and/or modified sequence opt3 from CACNA1B__Homo_sapiens__NP_000709
auggugagauucggcgacgagcuggggggaagguacgguggccccgggggaggcgaacgggcccgcggugggggagcuggcggcgcagggggaccugguccaggcgggcuccagccgggacaacgaguccuuuauaagcagagcaucgcccagcgugcgagaaccauggcucuguacaaccccauuccuguuaaacagaauugcuuuacagugaacagguccuuguucguauuuucugaggauaaugugguccggaaguaugccaaacgcauaacugaauggccacccuucgaguacaugaucuuagcaacgauuaucgccaacuguauugugcuggcucuagaacaacaccucccugacggcgauaagaccccaaugucagagagacuggacgauacagagcccuauuuuaucgguauauucugcuuugaagcagggaucaaaauuaucgcccuuggauucguuuuucauaagggcaguuaccugaggaauggcuggaacgugauggacuucgucgugguauugacugggauucucgcuaccgccggaacagauuuugaccugcggacccugcgcgcgguucgagugcucagaccuuuaaagcuggucagcgguaucccaucccuucaggugguguugaaaucuauaaugaaggcaauggucccgcugcuacagauuggccuccugcuuuucuuugccauccugauguucgcuauuaucggguuggaguucuauaugggaaaauuucacaaggccuguuuccccaauucgacugaugcagaaccuguuggcgacuuuccaugcgguaaagaggcucccgccaggcucugugagggggauacagaaugccgggaguacuggccuggcccaaacuucggaaucaccaauuuugacaacauucuguucgcgauauuaacgguguuucaguguaucacuauggaaggcuggaccgauauucuguacaauacaaacgacgccgcagggaauacuuggaacuggcucuauuucaucccccuuauaauuaucggaucauuuuucaugcugaauuugguacuaggugugcugagcggcgaguuugcuaaggaacgugagcgcgucgagaacagaagggccuuccucaagcugcggcgacaacagcagaucgaacgcgagcuuaacggguaccuggaauggauuuuuaaagcugaggaagugauguuggccgaggaggacagaaaugcagaagagaagaguccgcucgauguucugaaaagggccgcuaccaagaaaucccggaacgacuuaauccaugcggaagagggagaagaucgcuucgcagaccugugcgccgugggcucuccuuucgcuagagccagccuaaaguccgguaaaacagagucaaguagcuauuuuaggcguaaggagaagauguuccgguuuuucauucgaagaauggucaaagcacagucuuuuuacugggugguacucuguguuguggcccugaauacccuuugcgucgcuauggugcacuauaaccaacccaggcgcuugacgacuacacuguacuucgccgaauuugucuuccucgggcuguuucuuaccgagaugucccugaagauguauggcuugggaccacggucauacuucagaagcaguuuuaauuguuucgauuuuggcgugauaguugggucuguguucgaaguagucugggcagcgaucaaaccuggauccagcuucgguauuucggugcucagggcucugcgcuuacugcgaaucuuuaagguuacuaaauacuggucuucccuacggaaccucguggucucacugcuuaauaguaugaagagcaucauuuccuugcuguuccuccuguuuuuauucauagugguauuugcccugcuuggcaugcaguuguucgggggacaguuuaacuuccaagacgagacacccaccacgaauuuugauaccuucccagcagccauccucacaguguuucagauucugacuggcgaggacuggaacgcuguuauguaucaugguaucgaaucucaggggggcgucagcaagggaauguucucaaguuucuacuuuauugugcuaacccuguucggcaauuauacacuccugaacguguuucuugccaucgcagucgauaauuuggcuaacgcccaggagcugacuaaagacgaagaggaaauggaggaggcggccaaucaaaaguuagcucuccagaaagcaaaggaaguugccgaggugucccccaugagcgcugccaacauaucuaucgcagcgcgucagcagaacucagccaaagcuagaagugugugggaacaaagggccagccagcugcgccuucagaaucugcgggcauccugcgaggcuuuguacucugaaauggauccugaggagagacucagguucgccaccacacgacaccugcgcccagacaugaagacccaccuagaccggccgcugguagucgaacucgggagagauggagcaaggggccccgugggugggaaggcccguccugaggcugcggaagccccagagggaguugaccccccucgccggcaucacagacauagggauaaagacaagacuccagcagcuggcgaucaggaccgagccgaagcccccaaagcugagucgggugagccgggcgcacgggaagagcgcccuagaccacacaggagccacuccaaggaagccgcggggcccccugaggcucggucagagcgaggaagaggccccgggccagaaggaggccgcaggcaucaccgucgggguaguccugaggaagccgcagagagagaacccaggcgccaucgagcccacagacaucaagauccaucuaaagagugcgcuggggcaaagggagagcggagggcccgccaccguggcgguccgagagcgggcccucgggaagcugagagcggggaagagcccgccaggcgccaccgagcaagacauaaggcccagccagcucacgaagccguggagaaagagacgacagaaaaggaggcaaccgaaaaagaggcugaaauugucgaggccgacaaggagaaagaacugcggaaccaucagcccagggagccucacugugaucuugaaacuuccggaaccgugacaguuggcccaaugcacaccuugcccucaacuugccugcagaagguggaggagcaaccugaagacgcggauaaucagcgcaacguaacaagaauggggagccagccgccagaccccaauacgaucguccauauuccugugauguuaaccggaccacucggcgaggccacugugguccccucugguaacguugaucuggaaucccaagcagaggggaaaaaggaaguggaggcugacgacguaaugaggaguggaccucggccgaucgugcccuauagcucuauguuuugucuuuccccaacaaaucugcuacgucgcuucugccacuacauagucaccaugcgauauuuugaggugguuauucucguggucaucgcccugucaaguauugcuuuggcagccgaagauccugugagaacagacagccccaggaacaaugcccugaaguacuuagauuacaucuucacuggcguuuuuaccuucgagauggugauaaaaaugaucgaccucggucugcuucugcauccaggcgcuuauuuucgggauuuguggaacauucucgacuucaucgucguaucgggggcgcugguggcauuugccuucuccggaucuaagggcaaagauauuaauacgaucaagagccuacgcguucugagagugcuuaggccucucaaaaccauaaagcggcugcccaaguugaaagcugucuucgacugugugguaaacucacugaagaauguguuaaacauucucaucgucuacaugcuguuuauguucaucuuugccguuauugcagugcagcuuuucaaagggaaguuuuucuauugcacagaugaaaguaaagagcuggaacgagacuguagaggacaguacuuggauuaugagaaggaggaaguggaggcccagccacgccaauggaagaaauacgacuuucacuaugauaauguccucugggcucugcuaacucuguucaccguguccacaggcgaagguuggccgaugguucuuaagcauucuguagacgcgacuuacgaggaacaggggccuagccccggauacaggauggagcucuccaucuuuuauguggucuacuucgugguuuuuccauucuuuuucgugaacauuuucgucgcccugauaaucauuaccuuucaggagcagggcgacaaagugaugucagaaugcagcuuggagaagaacgaacgggcauguaucgauuucgcuauuagugccaaacccuuaacgcguuauaugccucaaaauagacagucuuuucaguacaagacauggaccuucguagucuccccacccuuugaguauuucaucauggcaaugauagcccugaacacugugguucucaugaugaaguuuuacgacgcuccuuaugaguacgaacugaugcuuaaaugccugaauaucguguucacaagcauguuuucgauggagugugucuugaagauuaucgccuucggcgugcuaaacuacuuuagggaugcguggaauguuuucgacuuugugaccguccuggggucaauuacugauauccucgugaccgaaauagcagagacaaacaauuucauuaaccugucuuuccuucgcuuauuucgggccgcucgacugaucaaacucuugagacagggauauacgaucaggauucugcucuggaccuucguacaaaguuuuaaggcccugccguacgugugccuucugauagcuauguuguucuuuaucuaugcaauuaucgguaugcagguuuucggcaauauugcccuagacgaugacacuuccaucaaccgccacaauaacuuucggacauuccugcaggcucucauguuacuguuuagaagcgccaccggggaagcauggcacgagauaaugcuuucuugccugagcaaucaagcgugugaugagcaggccaacgcuacagaaugcggauccgacuucgccuacuuuuauuucgucucauuuaucuuccucuguaguuucuugaugcugaaucucuuuguggcagugauuauggauaacuucgaguaccugacucgugacagcucuauccuuggcccacaucaccuagacgaauuuauuagggucugggcugaguaugaucccgccgcaugcggucggaucuccuacaacgacauguucgaaaugcugaaacauaugucaccucccuugggguuaggaaagaaauguccagcccgcguagcuuacaagcgacuggugagaaugaauaugccuauaaguaacgaggauaugaccguucacuuuacgagcacacucauggcgcugauuaggaccgcccuugagaucaagcuggcacccgcuggcacuaaacagcaucagugcgacgccgaacuccggaaggagaucuccguggucugggccaauuugccacaaaaaacccuggaucuacuggugccuccgcacaagcccgacgaaaugacaguuggcaaaguguaugcagcucucaugauuuucgauuuuuacaagcagaacaagacuacccgcgaccagaugcagcaagccccagggggacuuucucagauggguccugucucgcuguuccaccccuuaaaagcgacauuggagcagacgcagccagcugugcugagaggcgccaggguauuucuccgacaaaagagcucaaccucccugaguaaugggggagcaauccagaaccaggaaucuggcauaaaagagagcguguccugggguacucagcggacacaagaugccccucaugaggcucgucccccgcuugaaagagggcacucaaccgagauuccaguuggacgcucuggcgcacuggccgucgacgugcagaugcagagcaucacuaggcggggcccugauggggaaccccaaccaggacucgagagucaggguagagcggcuuccaugccccgcuuggccgcagagacacagccugugaccgacgccagcccgaugaagaggucuauuucaacgcuggcucagcgaccccggggcacucauuuauguuccaccacaccagauagaccucccccuagucaagccagcucgcaccaccaucaccauaggugccaccgccgucgggacagaaaacagaggucucuagaaaaggggccaucccugagcgcagacauggauggagcucccucaagugccgucggcccuggucucccacccggggagggaccgaccggcugucgccgagaacgggagagaaggcaggaacgcggcagaucucaggagcggaggcaaccuuccagcucaaguagcgagaagcagcguuucuauuccugcgaccgauuugggggacgcgaaccacccaaaccuaagccaucucuuagcucccaucccacuucaccgacagcgggucaggagccuggcccccacccacaggggucuggaaguguuaauggcucgccucuguugagcaccuccggugccucuacacccgggagaggaggccggaggcaacugccacagacuccccucaccccucgcccaucaaucacguacaaaacagcaaacagcuccccgauacacuucgcuggcgcccagaccagucugcccgcauuuucuccugggagacuuagccggggacucucagaacauaaugcucuguugcaaagggauccacugucccagcccuuagccccugguagucgaauuggcagcgacccauaucuagggcagcgucuggauucugaggccuccgugcacgcgcuccccgaagacacucuuaccuucgaggaggcuguagcaacaaacucaggaagaagcucgcgcacuucuuacgugaguucccugaccagccagucacauccuuugcggagggucccgaauggcuaucacuguacgcugggucucuccucugggggcagagcccgccacagcuaccaucacccagaucaagaccauuggugcuga

SEQ ID NO: 53722 - RNA, 6417 nt, Artificial Sequence
  derived and/or modified sequence opt3 from CACNA1C__Homo_sapiens__NP_000710
auggugaacgagaauaccagaauguacauccccgaagagaaccaccagggcagcaauuauggguccccuaggccagcccaugcuaacaugaaugcaaacgccgcggcuggacuggccccggaacacauucccacaccuggugcagcccucucuuggcaagcugcaauagacgccgcucggcaggccaagcuuaugggcucagcggggaaugcaacuaucaguacggucagcuccacccagcgcaaacgacagcaauacggaaagccaaaaaagcagggcucuacaacugccacccgucccccuagagcucuguugugcuuaacacugaaaaacccaauuaggcgggccuguaucucgauuguugaguggaagcccuucgaaaucauaauccuacucaccauuuuugcaaauugcguggcucuggccaucuauauuccuuucccagaggaugacucaaacgcgacuaauagcaaccuugagcgcguagaauaccuguuuuugaucauauucacaguggaggccuuucucaaggucauugcauauggucugcuguuccauccgaaugcuuaccucagaaacggguggaauuuacuggauuuuaucauugugguugugggacuuuucagugccaucuuggaacaggcuaccaaagccgacggcgcaaacgcccugggcgggaagggagcugguuuugaugucaaagcgcuaagggcauuccgggugcuccgcccccugcgacuuguauccggcguuccuucucugcagguggucuugaacagcaucauuaaggccauggugccacuccugcacauagcuuuacuggugcucuuugucaucauuaucuaugccauaauugggcuugagcuguucaugggaaaaaugcauaagacguguuacaaucaagagggcaucgcagacguucccgccgaagaugacccuuccccaugcgcuuuggagacuggucacgggagacagugucagaacggaaccgugugcaagcccggcugggauggcccgaaacacgggaucacaaauuuugacaacuucgccuucgcaaugcuaacuguauuucaguguauuaccauggaaggauggacagaugugcuguacugggucaaugacgcgguggguagggauuggccuuggaucuauuucguuacccucauuauaaucggcucauuuuucgugcugaaccuuguccuggggguguugaguggagaguuuagcaaggaacgggagaaagcuaaggcccguggcgacuuccaaaaacuccgcgagaagcagcagcuggaagaggacuuaaaagguuaccuggauuggauuacgcaagcagaagacaucgaucccgagaaugaagacgaggggauggaugaggaaaagccaagaaacaugucuaugccuacuuccgagacagaaucaguaaauaccgagaacguugccggcggagacaucgaaggcgagaauugcggggcuaggcuagcccaucggauuagcaagaguaaauuuucucgauauuggcgcagauggaacagguucugucggcgcaagugcagagcagcugugaaauccaaugucuuuuacuggcucgugauauuccuggucuuucuuaacacuuugacaaucgccagcgagcacuauaaucagcccaacuggcugaccgaagugcaggauacggcgaacaaggcccuccuggcucuuuucaccgcagagaugcuguugaaaauguacucgcucggacugcaggccuauuuuguuucuuuauucaauagguucgacuguuuugugguaugcgguggcauucuggaaacaauccuagucgagacuaagauuauguccccacucgggaucucagugcugcguugcguucggcuuuugcgaauauucaagaucaccagauacuggaacagucugagcaaucucguggcuucccuguuaaacucugucaggagcauugccucacugcuuuugcuccuguuucuauucaucauuaucuuuagucugcucggaaugcaacuguucggcgguaaauuuaauuucgaugagaugcagacacgccgguccacuuuugacaacuucccccagagccuuuugaccguguuucagauacugacaggggaagauuggaauucuguaauguacgacggcauuauggcauauggaggcccuucauucccagggauguuaguguguaucuacuuuauuauccucuucauaugcggaaacuauauccugcuuaauguuuuccuggcgauugccgucgacaacuuggcugaugccgagagucucaccagcgcacaaaaggaagaggaagaggagaaagaaagaaagaaacuggcuaggacugccuccccggagaagaagcaggaacuaguggagaaacccgcagugggugaaucuaaggaggagaaaaucgaacugaagucgauuacggccgacggcgagagcccuccagcuacaaaaaucaauauggaugaccuccagcccaacgaaaaugaggauaaguccccuuacccaaaccccgaaaccacuggggaggaggacgaagaggaaccggagaugccugucggaccacgcccccgaccucugucagagcuucauuugaaggaaaaagcgguucccaugccagaggccagugcauuuuucauauuuucuagcaauaaccgguuccgucugcagugucacagaauugugaacgauaccaucuuuacaaauuuaauccucuucuuuauucugcuuuccucaaucagccuggcugccgaagacccugugcaacacaccucuuucaggaaccauauucuauuuuauuucgauauaguauuuacuacaaucuucacgauugagaucgcccucaagaugaccgcuuacggcgcauuccugcacaaagguuccuuuugccgcaauuauuucaacauuuuggaccuguuagucgugaguguuagccucaucucuuuugggauacaguccucagccaucaauguggucaagauucugcgggugcuuagaguucugaggcccuugcgagcgaucaaccgcgcuaaaggccucaagcaugugguacagugugucuucguggccauucggacuaucggaaauauagugauugucacaacccugcuacaguuuauguucgcaugcaucggcguucaacuguuuaaagggaagcuuuacacauguagugauagcucgaagcagacugaagccgagugcaaaggaaacuacaucaccuauaaggacggcgagguggaucacccaauuauacagccgagauccugggaaaauucuaaauucgacuuugacaacguacucgcugcaaugauggcccuguucacggugagcaccuuugaggguuggccugaauugcuguacaggucaaucgauagucauacagaggacaaggggcccauuuauaauuaccgugucgaaaucuccauuuucuuuaucauauauaucauuaucauugcguucuucaugaugaacaucuuugugggauucguuauagugacuuuucaagagcagggcgagcaggaauacaaaaauugugaguuagauaagaaccagcgccaaugcgucgaauaugcucucaaggcccggccacugagaagguacauucccaaaaaucagcaccaguacaaggugugguauguugugaacucuaccuacuucgaguaucuuauguuuguccugaucuugcucaacacaaucugucuggcaaugcagcacuacggucaaagcugccuauucaaaauugccaugaauauccugaacaugcuuuuuacuggccucuucaccguagaaaugauacugaaguugauugcuuuuaaaccuaagcauuauuucugcgacgccuggaauacguuugaugcauuaaucgugguuggguccauuguggacaucgcuauaacagaggucaacccagccgagcacacccaguguucacccagcaugaaugcggaagagaacagucgaauuucuaucacuuucuuucggcuguuccgcgugaugagacucguaaagcugcuuuccaggggagaaggcauccggacacuguuguggaccuucauuaaaagcuuucaggcccuaccuuacguggcacugcucaucgucaugcuguucuuuauuuaugcuguuauagggaugcagguguucggaaagaucgcccuuaaugauacuaccgagauuaaccgaaauaacaauuuucaaacauucccgcaggcuguguuacugcucuuuagaugcgcaacgggcgaggccuggcaggacaucauguuggccuguaugccagguaaaaagugcgcucccgaaucggagccuucaaacucuaccgaaggggagacuccauguggaaguuccuucgcggucuuuuacuucaucagcuuuuacaugcugugcgcauuccucauuauaaaucuguuuguggccguuaucauggauaacuucgacuaucuuacacgcgauuggucuauucugggcccccaucacuuggacgaauucaaaaggaucugggcugaguacgauccugaggccaagggucguauuaagcaccuagacguagugacccugcuccggagaauccaaccgcccuuaggcuuugggaaacuguguccacauagggucgcaugcaagcgccuugugagcaugaauaugccucugaacuccgacggaacaguuauguucaaugccacucucuuugcuuuggugcgaaccgcgcugagaauaaaaacggaaggcaaccucgagcaggccaacgaagagcugcgggcaaucauuaagaaaaucuggaagaggacaucaaugaaacuucuagaucaggucgugcccccagcuggggacgaugaaguaaccgucggaaaguucuaugccacuuuucugauucaggaguacuuccgcaaguuuaaaaagcguaaagagcaaggcuugguggguaagccuagucagagaaaugcauuaagccugcaggccgggcuccggacccugcacgacaucggacccgaaauaaggcgcgcuauuucuggcgaucuuacagccgaggaagagcuggacaaagcgaugaaggaagcaguuuccgccgcuucagaggaugacaucuuccgaagagccgguggccucuuugggaaccaugugaguuauuaccagagcgauggacgguccgcuuucccacaaacuuuuaccacacagaggccguugcacauuaauaaggcaggcucuucgcagggggacacggagagcccuucacaugaaaaacuggucgauuccaccuucacucccaguucuuauagcuccacaggaucaaacgccaauaucaacaaugcuaacaauaccgcccuaggccgccugccaagacccgcagguuacccuucuacugugagcacaguugaggggcacggaccaccccucaguccugcgauaagggugcaggaagucgccuggaagcuuuccagcaaccggugucacucucgugagucacaagcugccauggcaggccaggaggaaaccucccaggacgagacguacgaagugaaaaugaaucaugacacugaggcuugcagugaaccgagccuguuaucgaccgagauguugucuuaucaggaugacgagaaccgccaacugacacucccagaagaggauaagcgagacaucagacagucccccaaaaggggcuuucugcggagcgccucacuugggcgcagagcaaguuuccaccuggaaugucucaagaggcagaaggaucggggaggugacauuucucaaaaaaccguauugccucugcauuuagugcaccaucaggcccuagcuguugcgggccuguccccccuccuucagcgaagccacucaccagccaguuucccuagacccuuugcaacuccaccugcuacaccggggagccgcggauggcccccacagccuguccccacccugagguuggagggcguggaauccucugagaagcugaauagcuccuucccaucaauccacugcgguucuugggccgagacaacuccugggggaggcggcaguucggccgcacggcgugugagacccgucagccucaugguaccgucccaagcuggggccccaggaaggcaguuucaugguucugcgucaagccugguggaagcuguucuuauuuccgagggccucgggcaguucgcccaggauccuaaauuuaucgaagugaccacgcaagagcuggcagacgccugcgauaugacaauagaagagauggagagugcugcagacaacauuuugucuggaggcgccccccagagcccaaauggugcgcuguuacccuucgucaacugucgcgaugcugggcaggaccgggccggaggcgaagaggaugcaggcugcgugcgagccagagggaggccuucagaagaggagcuacaggacucccgcguuuacgugaguagccuguga

SEQ ID NO: 53723 - RNA, 6546 nt, Artificial Sequence
  derived and/or modified sequence opt3 from CACNA1D__Homo_sapiens__NP_000711
augaugaugaugaugaugaugaagaaaaugcagcaccaaagacagcagcaggccgaccaugcuaacgaggcaaauuacgccaggggcacccggcugccccucagcggggaaggaccuacaucccaaccaaacucuucaaagcagacugugcuuaguuggcaggcggcuaucgaugccgcacgccaggccaaagcugcacaaacgaugagcaccuccgccccgcccccugucgguucucugucgcagcgaaagcgucagcaguaugcuaaaucaaagaagcaaggcaauagcaguaacuccagaccagccagggcguuguucugcuuaucucugaauaaccccauucggcgcgcauguauaagcaucguugaguggaaaccuuuugacauuuucauccuacucgccauuuuugcuaauugcguggcccuggcaaucuacauaccauuccccgaagaugacuccaacucaacaaaucacaaccuugagaagguagaauaugcuuuucugaucauuuucacuguggagaccuuuuugaaaaucauugccuacgggcuccugcugcauccuaaugcguaugucagaaacggauggaaucucuuagauuucgugaucguuauagugggccuguuuagugucauucuugagcaguugacaaaggaaaccgagggugggaaccacagcucuggaaaauccggcggcuucgacgugaaggcccugagggcauuucggguacuacgcccacuccgacugguuucaggggugccgagccuucaggucgugcugaauaguaucauuaaggcuauggugcccuugcuccauaucgcccuguuaguccuguucguuaucauuauauacgcuaucauuggacucgaacuuuuuaucgguaaaaugcacaagacuuguuucuucgccgauucugacauaguggcagaggaggauccugccccaugcgcuuuuuccggcaacgggagacaauguacagcgaacggaaccgaaugcaggagcggcuggguaggucccaaugggggaauuacgaacuucgacaauuuugcauucgccaugcugacuguguuucaguguaucaccauggagggcuggacagaugucuuguauugggugaacgacgcuaucggcugggaauggccuuggguuuacuucgugucgcuaauuauccuggggucuuuuuucguccucaaucuggugcuuggaguacuguccggugaguuuucaaaagaacgggagaaggccaaagcacguggcgauuuccagaaguugcgcgagaaacagcaacucgaagaggaccugaagggguacuuagacuggauuacucaggccgaagauauagacccagagaacgaagaggagggaggcgaagaggguaagagaaauaccaguaugcccacaagcgaaaccgaguccguuaacacggaaaaugugucuggggagggcgagaacaggggaugcuguggcagccuguggugcugguggcggcgacgcggggcugccaaagcaggaccgucagguuguagaagguggggccaggcgaucaguaaguccaaacuaagccggcgcuggagaagguggaaucguuuuaaccggcgaagaugcagggcugccgucaagucugugacuuucuauuggcucgucauugugcugguuuuucuuaauacauugaccaucucaagugaacacuacaaccagccugauuggcugacucaaauccaggacauugcaaauaaagugcuccuggcccuuuucacaugcgagaugcugguaaagauguauagcuuggggcuccaggcuuacuucgucucccuguuuaaccgcuucgauuguuuugugguuugcggaggcauaaccgaaacgaucuuaguggagcuggagauuaugucuccccuagguaucucggucuuccggugugugagacuccugaggauuuuuaagguaacccgccauuggacaagccuuuccaacuugguggccucacugcucaauaguaugaaaucuaucgcaagccuguuacugcuuuuguuccucuuuauaaucauuuucucccugcuagggaugcagcuguuuggcggaaaguucaacuuugacgaaacucaaaccaaacgaucaacauucgauaauuuuccacaggcucuccugacuguuuuccagauccuuaccggcgaggacuggaacgccgucauguaugaugggauuauggcguacggagguccuagcucuuccggcaugaucgugugcauauauuucauuaucuuguuuauuugugggaauuacauccuguuaaacguguuccucgccauagcugucgacaaucuggcagaugccgaaagucuuaacacagcucagaaggaggaagccgaggagaaagaacggaagaagaucgcacguaaagagagccuggaaaauaagaaaaacaauaagcccgagguuaaccaaauugcgaauucugacaacaaagugaccaucgacgauuacagagaagaggacgaggauaaggacccauaucccccuugcgaugugccaguaggagaagaggaagaggaagaggaggaagacgagccggaaguccccgccggcccuaggccacgccggauuuccgaguugaauaugaaggagaaaaucgcucccauaccugaagguucagccuuuuucauucucaguaagacuaacccaaucagaguggggugucacaaacugaucaaccaucacauuuuuacgaaucuaauccugguuuucauuaugcucagcucggcagcucuggccgcagaggaucccauaaggucccacucuuuucgaaacacaauccuuggcuacuucgacuaugccuuuaccgcuauuuucacuguggaaaucuugcugaagaugaccacauuuggagcguucuuacauaaaggcgccuucugccgcaauuacuuuaaccuccuggauaugcuugucguggggguuagccuggugucauucggaauucagaguuccgcaaucucuguagucaagauacuacgggugcucagagugcugaggccguugcgugcuaucaaucgcgccaaaggccugaagcacgucguucaguguguguuuguagccauucggaccaucgguaacauuaugaucgugacuacauuacuccaauucauguuugcuugcauagggguccagcuguucaagggaaaauuuuauagauguacggacgaggcaaagagcaauccugaagagugcaggggccuuuucauucuguacaaagauggugacguggauuccccaguugugcgagagcggaucuggcagaacucagacuuuaauuucgacaacgucuugagcgccaugauggcgcucuuuaccgugaguacuuucgaaggcuggcccgcucugcuauauaaggccaucgauucuaauggggagaacauuggaccuauauacaaucaucgcguugaaaucuccauuuuuuucaucauuuacaucauaaucguggcauucuuuaugaugaacauuuucgucggcuuuguaaucgugacauuccaggagcaaggggaaaaagaguauaagaauugcgagcuggacaagaaccagagacaguguguugaauacgcccuuaaagcuaggccccuccggcgauauauuccaaagaacccuuaccaguauaaauuuugguacguggucaauagcucgcccuucgaguauaugauguuugugcugaucauguugaacacccugugcuuagcaaugcaacacuacgaacagucaaagauguucaaugaugccauggacauacucaacaugguauuuacaggaguguucacugucgagaugguucugaaagugauugcguuuaagccaaagggcuacuucucugaugcuuggaauaccuuugacagucuuaucgugaucgguuccauuaucgaugucgcccugagcgaagcagacccgacggagucugagaacgugccuguucccaccgccacaccagggaauagcgaagaguccaacagaauaucaauuacuuucuuccgcuuguuuaggguaaugcgucucgugaaacugcuaagucggggagaaggcaucagaacccugcuuuggacauucauuaagagcuuucaggcucuccccuaugucgcccuguugaucgcaauguuauucuuuauauacgcugugauugguaugcagauguucggcaaaguugccaugagggauaauaaccaaaucaaucgcaacaauaacuuucagacuuucccucaggcggugcugcuccuguuucgaugugccaccggggaggcauggcaagagaucaugcuugcuugccugccaggaaaguugugugaccccgaaucugauuauaauccuggcgaggaauacacgugcggguccaacuucgccauugucuauuuuaucucauucuacaugcuaugugcuuuucugauuauaaaucucuucguggcaguaaucauggacaacuucgauuaucugacaagagacuggaguauucuuggaccgcaucacuuagacgaguuuaaacggaucuggagcgaauacgauccagaggccaagggcaggaucaagcaccuggacgucgugacccucuugcgccguauucagcccccucuggguuucgggaaacucugcccacauagaguugccuguaagcggcugguggcuaugaacaugccccuuaauuccgauggaacugucauguuuaacgcgacacuguucgcauuggugaggaccgcccuaaaaauaaagacugagggcaaucuggaacaggcuaacgaggaacuccgcgccguuaucaaaaagauuuggaaaaagaccucuaugaaguuacuggaccagguggucccuccggcaggugaugacgaggugacaguaggcaaauuuuacgccacguuccuuauccaagauuauuuucgaaaguucaaaaagagaaaagaacaggggcuggugggaaaguaccccgcuaagaauaccacuauugcgcuccaggccggcuugcggacacugcacgacaucgggccagagauaaggcgcgcaaucucgugcgaucuccaggacgaugagccugaagagaccaaaagagaagaggaagacgacguuuuuaagaggaacggagcucugcuuggcaaucaugucaaccacgugaauagcgaucggcgugacucacuacaacagacaaacacuacccaccgcccccugcaugugcagcgaccauccauuccucccgccagugauacggagaaaccauuguucccgccugcagguaauucugucugucacaaccaucacaaucauaacagcaucgggaagcagguacccacauccaccaaugccaacuuaaacaaugcuaacaugucaaaagccgcgcacggaaagagaccaucuauuggcaaucuggagcacgugagcgaaaacggccaucacaguucccauaagcacgacagggagccccaacggcgcagcucuguuaaaagaacuagguauuacgaaaccuauauccggucagauuccggggacgagcagcucccuacaauaugccgagaggauccagaaauucauggauacuuuagagacccccacugccugggugagcaggaauauuucaguagcgaggaauguuacgaggaugacucgucuccuacuuggucccgccagaauuacggcuauuacagcagguauccggggcggaacaucgauucagagcguccaagaggauaccaccauccccaaggcuuucuugaagacgaugacaguccugugugcuaugacucuaggcgcuccccccggcgaagacugcucccaccuacccccgcaagccacaggcgcucaaguuucaauuucgaguguuugcggagacagagcucccaggaagaggucccaucuagcccuauuuuuccgcaucguacagcccugccccuacaccugaugcaacagcagaucauggcuguggccggucucgauuccucaaaggcucagaaauacucuccaagucacucgacgaggagcugggcaaccccucccgccacuccaccuuaucgggacuggacacccugcuacaccccgcuuauacaaguugaacaguccgaggcucuggaucaggugaacgggucuuuaccaucauugcaucgcagcuccugguacacugacgagccugauaucaguuaucgaacauucacccccgccucucugacggucccaagcucauuuagaaauaagaacuccgacaaacagaggagugcagauagccucguggaagcgguacugauuucugagggacuuggccgguacgcccgcgaccccaaguucguguccgcuacuaagcacgaaaucgccgaugcaugugaccugaccauugaugagauggaaucagcugccagcacacucuugaauggcaacguuagaccuagggcaaauggggacgucggaccgcugucgcaucgacaagauuaugaguuacaggacuuuggucccggcuacucugacgaggaaccagauccugggcgggacgaggaagaucuagccgacgagaugaucugcauaaccacucuguga

SEQ ID NO: 53724 - RNA, 6813 nt, Artificial Sequence
  derived and/or modified sequence opt3 from CACNA1E__Homo_sapiens__NP_000712
auggcaagauucggagaggcuguggucgcaaggcccgggucuggagacggugauuccgaccagucucggaaccgccagggcaccccuguuccagccucagggcaggcggcugccuacaagcagacuaaagcacagcgagcccguacuauggcucuguauaauccgauccccgugcggcaaaacugcuuuacgguaaauaggagucucuucauuuuuggagaagauaacauagugcggaaguacgccaagaaacuuaucgacuggccuccauucgaguauaugauucuggccaccaucauugcuaauuguaucgucuuggccuuagaacagcaucugcccgaggaugacaaaacaccuaugagccgcagacuagaaaagacugagccauacuuuauaggcaucuucugcuuugaggcggguauuaagaucguggcacucggguucauuuuucacaaaggauccuaucugaggaacggcuggaauguuauggauuucaucgugguccuuucuggcauacuggccaccgcugggacacacuuuaacacccauguggacuugcggacucuccgcgccguacgaguucugagaccccugaagcucgugucgggcauuccuucauuacagaucguccugaaaagcauuaugaaggcaauggugccacuuuugcagaucggucugcuacucuucuuugcuauccugauguucgccauuauaggccuugaguucuacagugggaaacugcacagggcguguuuuaugaauaacuccggaaucuuggagggcuucgauccgccccauccuugcggugugcaaggguguccagccggauaugaaugcaaggacuggauuggccccaaugauggcaucacacaguuugacaacauacucuucgcaguccugaccguuuuucaguguauuacgauggagggguggacuaccguguuauacaauacaaacgaugcucugggagccacuuggaauuggcucuacuucaucccucuuaucauuaucgguagcuuuuucguacugaacuuggugcuaggcguccugagcggggaguuugcuaaggaacgggagcguguggaaaaccgcagagccuucaugaaacucaggcggcagcaacagauugagcgagaacugaauggauaucgcgcauggauagacaaggccgaggagguuaugcuugcugaagagaacaaaaaugcgggcaccuccgcacuggaaguguugagaagggccacaaucaagcggucacgcaccgaggcuaugacgagagacaguagcgaugaacacugcgucgacauuucuuccguggguacuccacucgccagggcaucaaucaaaagcgccaagguagaugggguuaguuacuuucgucacaaagagcggcuguuacgaaucucuauuagacauauggugaagucccaggucuucuauuggauagugcugagccuagucgcucucaacacagccuguguggcaaucguucaccauaaucaaccccaguggcugacccaccuuuuguacuaugcggaguuucuguuccucggccuguuccuucuggaaaugucguugaagauguacggaaugggcccgaggcucuauuuucacucuuccuucaacugcuuugacuucggggugacuguaggaucaauuuuugaggucgugugggcuaucuuccgcccugguacaaguuuuggcauuagcguucugcgggccuuaagacugcuaaggaucuucaaaauaaccaaguacugggcaucccuccgcaaucugguggucucucuuaugagcucaaugaaaaguaucauuuccuugcuguuucuccuguucuuauuuaucgugguauucgcccugcuugggaugcaguuguuuggaggccgauucaacuucaaugaugguacgcccagcgcuaacuuugacaccuucccagccgcaauuaugacaguguuucagauccucacuggggaagauuggaaugagguuauguacaacggcauacggucucaaggaggcgucucaagugggauguggagcgcuauuuauuucaucgugcugacccuauuuggaaauuacacacugcucaacguguuccuggccauugcggucgacaaucuugccaacgcucaggaauugacuaaggaugagcaggaggaagaggaagcauuuaaccagaaacaugcccugcaaaaggcuaaggagguuuccccuaugucugcccccaauaugccaucgaucgagcgugacagaaggcgccggcaccauaugagcaugugggaacccagauccucacacuuaagggagcgacgccggagacaucacaugagugugugggaacagaggaccucucagcuccguaaacacaugcagaugagcucccaagaggcacugaaccgcgaagaggcgccuacaaugaauccacuuaacccgcugaaucccuugucaagccucaacccucugaaugcccauccaucucuauaucggagacccagggcuauagagggucuggcccucggccuggcacuugaaaaguucgaggaagaacgaaucuccagagggggaaguuugaaaggcgaugguggggaccgcagcucugcucuggacaaccagagaaccccuuuaucccucggccagagggaaccacccuggcuggcccggccgugucacggaaauugcgauccuacucagcaagaggcaggcgggggagaggccgugguaacguuugaagaccgagcuagacaucgccagucacagaggcguagucggcacagaaggguccgcacagagggcaaggaaagcucguccgcgucucgaagcagaucagccagucaagagcggucccuugaugaagcaaugccaaccgagggugagaaagaccacgaacugagggggaaccauggagcuaaggagcccacuauucaggaagaacgcgcccaggaucuacguagaaccaauucucucauggugagccggggcuccggucuggccggcggguuggacgaggcugauacaccucugguuuuaccccacccagaacucgaggugggaaagcaugucgugcugaccgaacaggagccugaaggcucaagcgagcaagcacuucuggggaacguucaguuggacaugggaagggugaucagucagucugagcccgaucucuccugcauuacugccaauacagacaaagcgacgaccgaaagcacuucgguaacagucgcuaucccagauguggacccgcugguggauucaaccgucguucacauaucuaacaagacagacggcgaggccaguccucuaaaagaagcagagauucgcgaagacgaggaggaaguggagaagaaaaagcagaagaaagaaaagcgagagacugguaaagccaugguaccccauuccagcauguucaucuuuucuaccacgaauccaaucagacgggcuugucacuacauugugaaccugagguauuucgaaaugugcauccuucucgucauugcagccagcuccauagcgcuggcugccgaggaucccguguugaccaacucagagcgcaauaagguucugagauacuucgacuauguguuuacaggggucuucacuuuugaaauggugaucaaaaugauugaucaaggauuaauccuccaggacggcaguuacuucagggaucuguggaacauucuugacuuuguuguggucguaggugcacugguggccuucgcuuuggccaaugcacucggcaccaacaaggggcgggauaucaaaacaauaaagagccugcguguucuacgcgugcugcgaccucuuaagacuaucaaaagacucccaaagcugaaagcugucuuugacugugugguaaccucuuugaagaauguguucaacauuuuaaucgucuacaaacuguuuauguucauuuuugccguuaucgcggugcaacucuucaagggaaaguuuuucuauugcacggauuccucaaaagacacagagaaggaauguauaggcaauuacguggaucacgagaaaaacaagauggaggucaaagggagggaauggaagcggcaugaguuccacuaugacaauauuaucugggcccugcuuacccuguuuacugugaguacaggagaaggcuggccccagguuuugcaacauagcguagaugugaccgaggaagaccgcgguccuuccagaucuaacaggauggagaugucgaucuucuacgucguguauuuuguuguguucccguuuuucuuugucaauauuuucguggcacuaauaaucauuacuuuucaggagcagggggacaagaugauggaagagugcagccuggagaagaacgagcgggcuuguaucgauuucgccauuucagcuaagccacucacccgauacaugccccaaaauagacacacauuucaguaucgcguauggcauuucgucguguccccuaguuuugaauacacgaucauggcaaugauagcccugaacaccguugugcuuaugaugaaauacuauucugccccaugcacuuacgaguuagcucugaaguaucucaauaucgcguucacaauggucuucagcuuggagugugugcugaaaguuauugcauuuggauuccucaacuacuuuagggacaccuggaacaucuucgauuuuauuacagugaucggcuccauaacugaaauuauccugaccgacucaaaacuugucaauacgucugguuucaacaugagcuuucugaaguuguuccgggccgcucgucuaaucaaacugcucagacagggcuauacaauuaggaucuuacuguggaccuuugugcagaguuucaaggcccuucccuacguaugccugcucauagcaauguuguuuuucauuuaugccaucauugggaugcaaguguuuggaaauaucaaacuggaugaggaaucccacauaaaccgccacaauaacuuccggagcuucuuuggcucucucaugcugcuuuuccgaucagcuacuggggaggcguggcaggaaauuaugcuauccugucugggagagaagggcugcgagccugacaccacagccccgaguggucagaaugaaaacgagagaugcgggacugauuuggcauacguuuacuuugucagcuucaucuuuuucuguucguuuuuaaugcugaaucucuucguggcugugaucauggacaacuuugaauaucugaccagggauucuuccauucuuggaccccaucaccuggacgaguucguccgcguaugggccgaguacgaucgggcagccugcggcagaauccauuauacagaaauguacgagaugcucacguugaugagcccaccucugggccuagggaaacguugucccucaaagguggcuuauaaaaggcugguucucaugaauaugccaguggccgaagacaugaccguccacuuuacaaguacacuuauggcgcugauucggaccgcauuagacauaaagaucgccaagggaggugcugaucgccagcaauuggacucugagcugcagaaagaaacucucgccauuuggccucaccugucccagaagaugcuugaucugcucgugcccaugccaaaagcuagcgacuugacaguuggcaagaucuacgcagccaugaugaucauggauuauuacaaacagucaaaggugaagaaacaacgacagcagcuggaggagcagaagaacgcuccgauguuccaaagaauggaaccuaguagcuuaccccaggagauuauagccaaugcaaaagcgcuaccauaccugcagcaagaccccgucuccgggcucucuggaaggagcggcuauccuuccaugucaccacuuucuccccaggauaucuuucagcuggccugcauggacccugcugaugacggucaguuccaagaacggcagaguuuggugguaaccgauccgucgagcaugcgcagauccuucucuacgauuagggacaagcgaucaaacagcuccuggcuggaggaauuuaguauggagcggucuagcgagaauacuuacaaaucacguagacgcuccuaucauaguagccucaggcugucugcccaccggcuuaacuccgauucagggcauaagagcgacacccacagaucgggaggccgcgaaaggggccgaucuaaggagcggaaacaucuccugaguccagacguguccagauguaauagcgaagagagggggacacaggcagauugggaaucacccgagcgccgucagucccggucuccuagcgagggaagaagucaaacccccaacaggcaggguacuggcuccuugagcgaaucuucaaucccaaguguuuccgacacaagcaccccucgccgaucucggagacagcugcccccagucccuccgaagcccaggccauuacuaucguacucaagccugauucgccacgcuggguccaucaguccucccgccgauggaucugaggaaggcagcccacucacaucccaggcacuugagucaaacaaugccugccugacugagaguucuaacagcccucacccccaacagucccagcaugcuucaccgcaaagauauauaagcgaaccauacuuggcgcugcacgaggacucucaugccuccgauuguggugaagaggaaacccucacguucgaggcagcuguggccacaagucuggggcggagcaauaccaucggaucggccccuccccuuaggcacuccuggcagaugccaaacggccacuaucgucgacgcagacggggcgggcccggaccugguaugaugugcggcgcagugaauaacuuacugucugacacugaggaagaugacaaauguuga

SEQ ID NO: 53725 - RNA, 5901 nt, Artificial Sequence
  derived and/or modified sequence opt3 from CACNA1F__Homo_sapiens__NP_001243718
augagcgaguccgaaggcgggaaggacaccacacccgagccuucuccagccaacggagcugguccgggccccgaaugggggcugugcccuggaccacccgcaguggagggcgaaucaaguggugccagcgggcucggaacuccuaaaagaaggaaucagcacuccaagcauaaaacggucgcgguugcuucugcccaacggucgccacgcgcacuuuucugucugaccuuggccaaccccuuacgacguucaugcaucagcauuguggaguggaagccuuuugauauacugauccuacucacaauuuucgcuaauuguguagcacugggcguguacaucccauuuccggaggacgauaguaacacugccaaucacaaccuugaacaggucgaguauguguuccugguuauuuuuaccguggaaacagucuugaaaaucguggcuuacggccucguacugcaucccuccgccuauauaagaaauggguggaaccugcucgacuucaucauuguuguggucggauuauuuucugugcugcuugagcaggguccuggcaggccaggggaugcgccccacaccggaggcaagccugguggguucgacgugaaggcauugcgggccuuucgcguccugagaccacuaaggcucguuagcggagugcccucccugcauaucguacuuaauucaauuaugaaagcucuggugccguugcuccacaucgcccuguuaguccuguucgugauaauuaucuacgcaauuaucggccucgagcuuuuucugggccggaugcacaagacuugcuauuucuuggggagugauauggaagcugaggaagacccuagccccugugccucuuccggaucaggucgcgcgugcacacuaaaccagaccgagugucgaggcagauggccagggccuaauggaggcaucacgaacuuugauaauuucuucuuugccaugcugacuguuuuccaaugcgugaccauggaagguuggacagacguccucuacuggaugcaggaugcaaugggguaugagcugcccuggguguacuuuguaagccuuguuauuuucggcaguuuuuucgugcugaacuugguccucggagugcugucuggcgaguuuuccaaagaaagggagaaggcuaaagcccggggggacuuccagaagcagcgugaaaagcaacagauggaggaagauuuacgcggauaccuggacuggauaacucaggcugaggagcuagacauggaagauccaagcgccgacgauaaucucgguccccagcuggcagagcuuaccaacagaaggcggggccgauugcgcugguuuucgcauucuacaagauccacccacucaacgaguagccaugccucccugccugcuucugacacugggagcaugacagaaacccaaggagaugaggacgaagaggagggcgcgcucgcaucauguacuaggugccugaacaaaaucaugaagacacgggucugucgcagacuuaggcgugccaaucgggugcugcgagcuagaugcaggcgcgccguuaaaaguaacgcaugcuauugggccguguugcuccugguauucuuaaauacccugacgauugcuuccgaacaccacggucagccagucuggcuaacccagauccaagaguacgccaacaaggugcuccugugucuuuuuacaguugaaauguugcugaaacucuaugggcugggcccgagcgcauacgugucuucauucuuuaaucgguucgauugcuucgucguguguggaggcauauuagagacuacccugguagaggugggggcgaugcagccccuuggaauuaguguuuugagaugcgucaggcuccugcgcaucuuuaaggugacacgacauugggcuagccuauccaaccugguggccucucuccugaauucgaugaaaagcaucgcaucccuuuugcuguuacucuuccuguuuauuaucauuuucucacuucuggguaugcaguuguuuggcgggaaguucaacuuugaccagacucacaccaagcggaguacauucgauaccuuuccucaagcccuccugacugucuuccagauacuaacgggagaagacuggaauguugugauguaugauggcaucauggcuuacggugggccauuuuuccccggcaugcugguguguauuuauuuuaucauccucuucauuugcggaaacuacauacugcuuaauguauucuuggccaucgcagucgacaaccuggcuucuggcgacgccgggacagcgaaagauaagggaggcgagaaaagcaaugaaaaggacuuaccucaggagaacgaaggucucgugccagggguugagaaagaggaagaggaaggagcccguagagagggcgcugauauggaagaggaggaagaggaagaggaagaggaggaagaggaagaggaggaagagggugcaggcgggguggaacugcuucaggaggucgugcccaaggaaaagguugugccgauuccugagggauccgccuuuuucugucugucacaaaccaauccacuaaggaaaggcugccauacucucauccaccaucacguauuuaccaaccugauuuuggucuucaucauacugagcucuguguccuuagcugccgaggaccccauccgcgcacacaguuuucggaaccauauucucggguacuucgauuaugcguuuacaagcaucuucaccguggaaauucugcuuaagaugacugucuuuggagccuuccugcacagaggcucuuuuuguagguccugguucaauauguuggaccuccugguugugucaguaagucuaaucagcuucgguauacauucguccgcuauuucuguggucaaaauccugcgagugcuucgcguucuccggccucugagagccauuaacagggcaaagggguugaaacacgugguccagugcguguuuguugcuauccguacaauaggaaauaucaugauugugacgacccuguuacaguucauguuugccuguaucggcguccagcucuucaaggguaaguuuuacacuugcacagaugaggcaaaacacaccccccaagaaugcaagggcagcuuccugguauauccagacggggaugugucacgcccucuuguucgggagagacugugggugaacagugacuuuaauuucgauaacgucuuguccgccaugauggcucucuuuacagugucuacuuucgaaggauggcccgcgcugcuauacaaagccauugacgcauaugcugaggaucauggcccaaucuacaauuauaggguagagauaagcguguuuuucauugucuacaucaucauuaucgccuuuuucaugaugaacauuuucguuggguuugugauaaucaccuuccgagcccagggagaacaggaguaccagaauugugaacuggacaagaaccaacggcagugcguggaguaugcucuuaaagcacagccgcuccgcagauacauuccuaagaauccccaccaauauagggucugggccacggugaacuccgcggcuuuugaauaccugauguucuuguuaauccugcucaauaccguugcccuggcaaugcagcauuaugagcagacagccccauuuaacuacgcuauggacauucuuaauaugguauucacuggccuguuuaccaucgagaugguguugaagauaaucgcauucaaacccaagcacuauuuuacagaugccuggaacacuuucgacgcgcuaauugucguggguucaaucguugauauugcugugaccgaagucaacaaugggggacaucugggcgagagcagugaagacucuucccggaucagcauaacguuuuuccgacucuuuagagugaugcgccugguaaaacuuuuaucgaagggugagggcauuaggacacugcucuggaccuucaucaaaucauuccaggccuugccuuacgucgcacugcucaucgccaugauuuuuuucauauacgcugugaucgggaugcaaauguuuggaaagguugcccugcaggauggcacucagauuaaccguaauaacaauuuccagacauuuccacaagcagugcuucuguuguuccggugugcuaccggggaggccuggcaggaaaucaugcuagcgucucugcccggaaacagaugcgacccugagagugauuuuggcccgggugaagaguucacuuguggguccaauuuugccauugcauauuucaucagcuuuuucaugcucugcgcuuuuuuaauaaucaaccuguucgucgccgugauuauggacaauuucgauuaccuuaccagggacuggucuauccugggaccacaccaccucgaugaauuuaaacgcauuuggagcgaguaugaccccggcgcuaagggccgaaucaagcauuuggauguuguggcacugcucagacggauacagccuccacugggguucggaaaacuuuguccccacagggucgccugcaagcgccuaguggccaugaacaugccucugaauuccgacgguacaguaacguuuaacgcuaccuuguucgcguuagugcguacuucacugaaaauuaagacagagggcaaucucgaacaggcaaaccaagagcugagaaucguuaucaaaaagauuuggaagcggaugaaacagaagcuucuggacgaagucaucccgcccccagaugaggaagaggugaccguggggaaauuuuacgccacauuccucauacaggacuauuuuaggaaguuccgccgaagaaaagagaagggauugcugggcaaugaugcugccccuaguacuagcucugcacuacaagccggucugcggucccuccaggaccuugggcccgaaaugaggcaggcucugaccugugauacggaggaagaggaagaggagggacaggaaggcgucgaggaagaggacgagaaggauuuagaaacaaacaaagcgaccaugguaucacaaccaagugcccgcagaggcagcgggauuuccgugucuuugccuguuggagacaggcugcccgauucgcucagcuuugguccaucagacgaugaccggggcacuccgaccuccagucagccuucugugccccaggcagggagcaacacacaucgucgcggauccggcgcucugaucuucacuauuccagaggaagguaauucacagcccaaggggaccaaaggacaaaacaagcaggacgaggaugaagaggucccugaccgacuuucuuaccuggaugagcaggccggcacaccacccugcagcgugcucuugccuccgcacagagcacagagguauauggacggccaucugguuccacggcgcagauuacuacccccuacgcccgccgggaggaaaccaaguuuuaccauccaaugucugcagcggcagggauccugcgaagaucucccuauacccgguacuuaccaccgaggcagaaauagcgggccaaaccgcgcucagggaucuugggccacaccuccgcaaaggggccggcuucuguacgcgcccuugcugcucguggaggaaggugcagccggggagggauaucugggccguucauccggcccacuuagaaccuucacuugccuccacgucccugggacacauagugaccccagccacggaaagagggguucggcugauucucugguggaagccguauugauuuccgagggccugggguuauuugcucgcgacccacgguucguggcacuagccaagcaggagaucgcugaugccugucgacugacccucgacgaaauggauaaugcagcgagcgaccuucuggcccagggaacgucaaguuuguacucugaugaggaauccauccugagcagauucgacgaggaagaccucggcgaugagauggcuugcguucaugcccuguga

SEQ ID NO: 53726 - RNA, 6945 nt, Artificial Sequence
  derived and/or modified sequence opt3 from CACNA1G__Homo_sapiens__NP_001243253
auggaugaagaagaggauggcgccggggcugaagagagcggacagcccagauccuucaugaggcugaacgaccucucuggugcaggcgggcggccuggaccaggcucagccgaaaaggauccggguagugcggacagcgaggcugaggggcuucccuacccugcccuggcaccaguggucuuuuucuauuugucccaggauucucgcccccgaucguggugcuuacguaccguuuguaauccuugguuugaaagaaucucaaugcuggugauucuacucaacugcguaacacugggaauguucaggccaugugaggacaucgccugcgauagccagcggugucgcauccuucaggcuuuugacgauuucauuuuugcauucuuugccguggaaauggucgugaaaaugguugcucugggcaucuucggcaagaaaugcuacuugggggacacuuggaauagacucgacuuuuucauugugaucgccggaaugcuggaguauagucuggaccuccagaacgucuccuuuucugcggugaggacgguacggguuuuacgcccccugcgagcaauaaauagagugccuagcaugaggauccuugucaccuugcugcuagauacacucccaaugcuggguaacgugcuucuguuguguuucuucguguuuuucauuuuuggcaucgucgggguucaacucugggccggacuguuacggaaucguugcuuccugccggagaacuuuucccucccccuuucaguggaccuggaacgcuacuaucagacugagaaugaagacgagaguccuuucauuuguagccagccaagagaaaacggcaugaggucuugccgguccguacccaccuugcgaggugaugggggaggcggcccuccaugugggcuagacuacgaggcuuauaauucaagcaguaacacaaccugcgugaauuggaaccaguacuacacuaauugcucugccggagagcacaaccccuuuaagggugcaaucaacuucgauaauauaggcuaugcuuggauugccaucuuucaagucauuacacuggaaggguggguggacaucauguacuucguuauggaugcgcauuccuuuuauaacuucaucuacuuuauucuccugauaaucgugggcagcuucuucaugauuaaucuuugucuggucgugaucgccacccaguuuucggagacgaaacagcgcgaaucucaguugaugagagagcaaaggguacgguuccucuccaacgcaucaacucuggcuaguuuuagcgaaccgggauccugcuaugaggaguuacugaaguaccuaguuuauauacuccgcaaggccgcuagaaggcuggcccaggugucucgugcagccgguguccggguggggcuuuugagcagcccugcuccccugggcggacaggaaacccaaccaaguuccagcuguucucgaucacacagaaggcucaguguccaucaccuggugcaucaccaccaucaccaucaccaccauuaccaccuuggcaaugggacacugcgcgcgccucgggcaagccccgagauucaggacagagaugccaacggauccaggcgcuugaugcucccacccccuucuacuccagcucugucgggugccccgcccggcggggcagaaagcguucauuccuucuaccacgccgacugccauuuagagccugugcgaugucaggcuccacccccucggucaccaagugaagccucuggacguaccguaggcagcgguaaagucuaucccacagugcacaccuccccgccuccagagacgcugaaggagaaagcccuaguugaaguggcggcuucaagcgggcccccuacucucacaucucugaauauacccccaggcccuuacuccaguaugcacaaacuuuuggagacccagagcacuggagccugccaaucuuccuguaaaaucucaagucccugccugaaggcagauagcggcgccugugggccagacucgugcccguauugugcuagagccggagcuggugaagucgagcucgcugauagggagaugccugacuccgacucugaagccguguacgaguuuacacaggaugcgcagcauagcgaccugcgcgauccccacucacggagacagaggaguuuaggcccagacgccgaacccuccucuguacuggcuuucuggcgacuuauuugcgauaccuuucgcaagaucguggacagcaaauauuucgggcggggaauuaugauagcaaucuugguuaacacgcucuccaugggcauugaguaccaugaacaaccugaggagcugaccaaugcccuagaaaucucaaacaucgucuuuacaagccuguucgcucucgagaugcugcuuaaguugcugguguaugguccauuuggguacauuaaaaaucccuacaacauauucgauggcgugaucgucguuauuagugugugggaaaucgugggacagcagggcgggggauuaucuguacucagaacuuuuaggcugaugcguguccuuaagcuggugcgcuucuugccugcccuccagcggcaacugguugugcuaaugaaaaccauggacaaugucgcaacauucugcaugcugcucaugcuguuuauuuucaucuuuuccauacuuggcaugcacuuguucgguuguaaguuugcgagcgagagagauggggacacucugccggauaggaaaaacuucgacucguuacucugggccaucgugaccguuuuucagauucugacacaggaagauuggaauaaggugcuuuauaacggaauggcuucaaccucuaguugggccgcacuguacuucaucgcucuaaugacuuuuggcaacuauguacucuucaaucuguuggucgccauucugguggaggguuuucaggcagaggaaaucuccaagcgagaggacgccagcggccaauuaucuugcauacagcucccaguggacagccaagggggagaugcuaacaaauccgaaucagagcccgacuucuucaguccuagccuggauggcgacggggaucggaagaaaugucuugcgcuggucucuuugggagaacacccagagcuccgcaagucccugcuacccccucugauuauccauacggccgcaacaccgaugucacuucccaaaaguaccagcacuggccucggugaggcucuggggccagccuccagaaggaccucuucgagcggaucagccgaaccuggcgcugcacacgagaugaagucacccccaagugcccggucuagcccucauucccccuggucagcggcuucuagcuggacaagucgaagauccagccgcaauucuuuggguagggccccaucacugaagcgucgguccccgaguggcgaaagaaggagcuuacucucgggggagggacaagagucucaggacgaagaggaauccagcgaggaagaacgcgcauccccugcaggcagugaucaccgacauagagggucucuggagcgggaagcuaaauccagcuuugaccuucccgauacccugcagguuccaggauugcacaggacugcaucaggccgcgguagugccagcgagcaccaggacugcaacgggaaguccgcgucuggacgucucgcuagagcccugcggcccgaugacccuccacuagauggcgacgacgcagaugacgaagguaaucugagcaaaggcgagagggugcgcgccuggauucgagcuagacuucccgccuguugccucgaacgggauuccuggucagcauacaucuucccuccgcaaucuagguuucgccuguugugucauagaauaaucacacacaagauguucgaccauguaguguuagucauuaucuuucugaacugcauuacgaucgcuauggagaggccaaaaauagauccccacagugccgagcggauuuuccucacccugucgaauuauaucuuuacugcgguguuccuugccgaaaugacaguuaagguggucgcacuggggugguguuuuggagagcaggcuuacuugcguagcuccuggaacgugcuagacggccugcucguucugaucucugugauugauauccuugucucaaugguaagcgacuccgggaccaagauuuuaggaaugcugcgcgugcuccgauugcugagaacacucaggccucugcggguuauaagucgcgcccagggccuuaaacugguggucgaaacuuugaugucuagccuaaagcccaucgguaauauugugguaaucugcugugcuuucuuuauuaucuucgggauacugggagugcagcucuuuaaaggcaaguucuucgucugccaaggcgaggauaccagaaacaucacgaauaaaucagacugcgcagaagccuccuauagguggguucggcauaaguacaacuuugauaauuuagggcaggcccugaugagucuuuucgugcuggcuagcaaggacggauggguggacauuauguacgauggucucgacgcggucggcguggaucagcagccaaucaugaaccacaauccuuggauguugcuguauuuuauuucuuuccuccugaucguugcauuuuucguacuuaacauguuugugggggucgugguugagaacuuccacaaaugucgacaacaucaggaggaagaggaagccagacgcagggaggagaagcggcuacguagacuggagaagaagaggcgcaaagcucagugcaagcccuacuauuccgacuacucacgguuucgauuguuagugcaccaucuguguaccagccacuaucucgaucuguucauaacaggagucauuggccuuaaugugguaacuauggccauggagcacuaccaacagccacagauccuggacgaagcacucaaaaucugcaacuauauuuuuaccgucauauucguguuggagucgguuuuuaagcugguggccuucgguuucagaagguuuuuccaggaucgcuggaaucaacuagaccuggcuaucguccuccuuucuauuauggggaucacacuggaagagauugaggugaacgcgaguuuaccuaucaauccgacuauaauccggauuaugagaguuuugcguaucgccagggugcugaagcuccugaaaauggcagucggaaugcgggcacuucuggauaccgugaugcaggcccucccccagguaggcaacuugggccuguuauuuaugcuacuguucuuuauuuucgcagcccucgggguggaacuuuuuggagaccuggagugugaugaaacgcauccaugcgaggguuugggccgccacgcuacauuccgaaauuuugggauggccuuccugacccucuuuagaguuuccacuggagacaacuggaauggcaucaugaaggauacacugagggacugugaccaggaaucaaccugcuacaacacugucauaucaccuauuuacuucguguccuuugugcuuaccgcgcaauucguccucguaaaugugguuaucgcagugcugaugaaacauuuggaggagucuaacaaggaagccaaagaggaagcugagcuggaagccgaguuagagcuagaaaugaagacacugagcccccagccacacaguccucucgguucccccuuccuuuggccgggggucgagggaccagauagcccugacucucccaagccaggcgcucugcaucccgcagcccacgcucggucagccagucacuuuuccuuggaacauccuacggaucgccagcuguucgacaccaucagccuccugauucagggcucucuugagugggaguuaaaacugauggaugaacucgcagggccgggaggucaacccucggcguuuccaucagccccuagcuugggcggguccgacccccagaugcagccucacccaacugagcugcccggaccugaucuacugacagugagaaagaguggcguuucuaggacccauagccucccaaaugacuccuauaugugucgacacgguucaacagcugaagggccccuuggacaccggggcuggggccugccgaaagcccagagugggucuguguugagcguccauucccaaccugcagauacuucauacauccugcagcucccaaaggacgcuccccaccuguuacagccucauagcgccccaaccuggggaacgauacccaaacuuccgccucccggucguucuccacuggcacaaagaccucuccgcaggcaggccgcuauucggacagauucccuagacgugcagggccuggggaguagagaggauuugcuggcggaaguaagcggacccucgccaccccucgcccgcgcauauuccuucuggggccagucuucaacccaagcucagcagcacagcaggagucauuccaagaucucuaagcacaugacuccuccagccccgugccccgguccugagccaaacugggggaaaggacccccugagacccgaagcucacuugaacuggacacagaguuguccuggauuaguggcgaccugcucccacccggcgggcaggaggagccuccgagcccacgggauuuaaagaaauguuacucuguggaagcccaaucaugccagagaaggcccacuuccuggcuggacgagcagcgccgucacagcaucgcaguuucuugccuugauaguggaucgcagccucaucuggguaccgaccccuccaaucuaggcgggcaaccacucggaggcccugguagccggcccaagaaaaagcugucaccaccgucuauaacaauugauccucccgagagccaggggccaagaacgcccccuuccccaggcaucuguuugaggcgccgagcucccaguucagacucuaaggauccucuggccagcggaccgccagacuccauggcggcuagucccagcccuaaaaaggauguccucucccuuucuggccugucaagcgacccagccgauuuagaccccuga

SEQ ID NO: 53727 - RNA, 7044 nt, Artificial Sequence
  derived and/or modified sequence opt3 from CACNA1H__Homo_sapiens__NP_001005407
augaccgaaggagccagagcugcugacgaagugagagucccccugggggccccuccaccgggacccgcggcucucguuggugccuccccugaauccccaggcgcacccgggcgggaagccgaacgcggaucugaacuuggcgugucaccuagcgaaagcccagcugcagagcgaggugccgaacugggggcugaugaggaacagcguguacccuacccugccuuggcggcaaccguguucuuuugcuuaggacaaacuacgagaccaagguccuggugucugcggcuagucugcaacccgugguucgagcacgugucuaugcucguuaucaugcugaauugugugacccuuggcauguuucgccccugcgaggacgucgaauguggcucggagagaugcaacauucuggaagccuucgaugcuuuuauuuucgccuuuuucgcaguggagaugguaaucaagaugguugcuuuggggcucuuuggacagaaauguuaucugggugacacauggaauaggcuggauuucuuuauuguggucgccggcaugauggaauacucacucgacgggcauaacgugagcuuaagugcgauccggacugugcgcguccugcgaccucuuagagccauuaauaggguuccauccaugcggaucuuggugacccugcuacucgauacacugcccaugcuuggaaacguacuguugcucugcuucuuuguguucuucauauuuggcaucgucggugugcagcugugggcaggguuacugcguaaucgcuguuuccucgacucugcuuuuguuagaaacaauaaccuuaccuuccugaggccuuauuaccagacugaggagggagaagagaauccauuuauuugcagcucccggcgagauaacggcaugcaaaaguguucacacauccccggccgcagagaauugaggaugccgugcacacuagggugggaggccuauacccagccucaggcugaaggagugggugccgcacggaaugccugcauuaacuggaaucaguacuauaacgucugucgcaguggcgacagcaacccccauaauggggcuaucaacuucgauaauauaggauacgcguggauugcaaucuuucaagugauuacgcuggagggcuggguagacaucauguacuauguuauggaugcccacucuuucuacaacuuuaucuauuucauucuccugauaaucguggguuccuuuuucaugauuaaucuuugccuggucgugaucgcuacucaguuuucagagaccaaacagagagaaagccaguugaugagggagcaacgugcccggcaucucaguaacgacucuacacuggcauccuucagcgaaccagggucguguuacgaggaauuacugaaguaugucggccacauauuccgaaaagugaagagaaggucucuacgccucuacgcccgguggcaguccagauggaggaagaaaguugacccuucagcugugcagggacaaggccccgggcaccgccagcgacgggccggacgucauacugcaaguguacaccaucuggucuaucaccaccaucaccaucaccaucaccacuaccauuuuagccacgguuccccaagaaggcccggcccugagccaggggcgugcgauacccgccuugugcgggcuggagccccgcccucuccuccaagccccggcagagguccuccagacgcagagucaguucauaguauuuaccacgccgauugucacaucgaagggccccaggagagggcucgaguggcccaugcagcugccacagcggccgcuuccuugcgccuggcaaccggccucggaacgaugaauuauccgacuauccugccuagcggcgucgggucuggaaaggguucaacaaguccaggccccaaagggaagugggccggaggcccucccgguaccgggggccacggaccacuuagccugaacuccccugaccccuacgagaaaauuccacaugugguaggcgagcacggguugggacaggcuccgggccaucucucuggucugucggugccuugccccuuaccaagucccccugccgggacucugacaugugagcuaaaguccugcccauauuguacccgggcacucgaagaucccgagggagaacugucaggcagugagucuggugacagcgauggcagagggguuuacgaguucacgcaagacgucaggcacggagaucguugggacccuacccgcccgccacgggcgacagauacucccggcccugggccaggaagcccccagagaagggcccagcagcgagcugccccuggcgagccggguuggauggggcggcuuugggugaccuuuucaggaaaguugcgcagaaucguggacagcaaauauuucucuaggggcauuaugauggcaauacuggucaauacacucuccauggguguugaguaccacgaacaacccgaggaacugacuaacgcuuuagagaucaguaauauuguguuuaccagcauguucgcccuggaaaugcuuuugaagcuccuggcaugcggcccacuaggguauauccggaacccuuacaauaucuuugacggaauuauagugguaaucucugucugggagauugugggccaggccgaugggggacuguccguucuccgaacauucagacugcuucgcguguugaaacuggucagguuuuuacccgcucuccgucggcagcuggugguucuugugaagaccauggacaacguagcgacuuucuguacgcuguugaugcucuuuaucuucauauuuucaauccugggcaugcaucuauucgguugcaaauucagucugaagacagauaccggggacacugucccagauaggaaaaauuuugacagccuccugugggccauagugaccguguuccagauccuuacacaagaggauuggaacgucguuuuguacaacggaauggcaucgaccuccucuugggcugcccuguauuuuguggccuuaaugacuuucggcaauuacguacucuuuaaccugcuuguggcuauucuggucgaagguuuccaggcagagggcgacgccaauaggagcgauacagacgaagauaagacgucagugcacuuugaggaagacuuccauaagcuacgcgagcuccagaccacugagcugaaaaugugcaguuuggcgguuacaccuaacgggcaccuggaaggacgaggcuccuuaucucccccacucaucauguguaccgcugccacaccgaugccuacucccaagagcuccccauuucuggaugcagcccccucacuuccugacagcagacgggggaguucuuccagcggagacccaccccugggcgaucagaaaccuccggcuucguugaggucaucuccaugcgcacccugggguccuaguggggccugguccagccgccguucuagcugguccucacucggcagagcgcccagucugaagcggaggggccaauguggcgagcgcgaaagccuacugucuggggagggaaaagguuccaccgacgaugaggcugaagacggccgagccgcaccagggccuagagccacgccccuucggagggcugagucacucgauccacgcccucugagaccggccgcauugcccccaaccaagugcagggaccgggauggacagguggucgcucugccuagugacuucuuuuuacguauugauagccaucgcgaagacgccgcggagcucgaugacgauuccgaagacucuuguugccugcgacuucacaaggugcuggagcccuauaaaccacagugguguagaucgagggaggccugggcauuguaccucuucagcccucaaaaucgguuccgcguuucaugccagaaggugaucacacacaaaauguuugaccaugucguacugguguucauauuucuaaacuguguuacuauugcucuggaaagacccgauaucgacccgggcuccaccgagaggguguuccuuagugucucuaauuauauuuuuacagccaucuucguggcugaaaugaugguaaagguggucgcacucggucuguugagcggggagcacgccuacuuacaguccucauggaaccugcucgauggacugcuuguucuggugucuuugguggacauagucguggccauggcuagcgcgggcggcgcaaaaauccuagggguucugcggguacuccgacugcuuagaacuuuacgcccacugagggugauuagucgggccccuggacucaaguuggucguggaaacccugaucuccagccuccgucccauugguaauaucguucugauaugcugugcauuuuucauuaucuuuggcauccuuggggugcagcuguucaagggaaaauuuuauuacugcgagggcccagauacgagaaacauuucuacaaaggcccaaugcagggcagcccauuaccgcuggguccggcgaaaauauaauuucgacaacuugggucaggcucuaaugucacuguuugugcucuccaguaaggauggguggguaaauaucauguacgacggauuagaugcggucggcguggaccagcagcccguucaaaaccacaauccuuggaugcugcuuuauuucauuagcuuccugcucauagugucguuuuucgucuugaacauguuugugggcguuguggucgagaacuuccacaaauguagacagcaucaggaagccgaggaagcaaggcgccgggaggaaaagagacugcguaggcucgagcggcgccgaagaaaggcucagaggcggccguacuaugccgauuacucucccacccgcagauccauccacagccugugcacuucacauuaucuugaccuauuuauuacauucaucauuugugugaauguaaucaccaugaguauggagcacuacaaccaaccaaaaucucuggacgaagcauugaaguacugcaauuauguguuuacuauaguuuucgucuuugaggccgcuuuaaaacugguggccuucggguuuaggcgauucuuuaaggaucgguggaaccagcucgaccuggcgaucgugcuucugucccucaugggaauuaccuuggaagagaucgagaugagcgcagcccugccuauuaaucccacaaucauacguauuaugagaguccuacgcaucgcuaggguacugaaacuccuuaagauggccacggguaugcgggcucuguuagauaccgugguucaggcauugccucaagugggcaaccuggggcuccuguucaugcuucuguucuuuaucuacgccgcucucggagucgaauuguucggcagacuggaguguucagaagacaauccaugcgaggguuuaagucgccaugccacuuuuagcaacuucgggauggcauuucuaacacuguucaggguguccaccggagauaauuggaacggcauuaugaaagacacacuccgagaauguucucgggaggauaagcacugccuuagcuaucugcccgcguuguccccuguuuacuuugugacuuucguccugguggcccaguuuguacucgugaauguugucguggcugugcugaugaagcaccuugaggaaucaaacaaagaggccagagaagacgcagagcucgaugcugaaauagagcuggagauggcccagggcccagggucugcaaggcgcgucgacgccgaucgucccccguugccucaggaaaguccaggagcucgggacgcgcccaaucugguugccagaaaggugucgguaagcaggauguuaucccuaccuaacgauucuuauauguuccgcccagugguccccgcaucagcuccgcauccucgaccccugcaagagguggaaauggagaccuacggugccggcacgccacucgggagcguugccuccgugcacaguccucccgcagaaucuugugcuagccuucagaucccacuggccgucucaucccccgcgcggaguggagagccuuugcaugcucugagcccaagaggcacagccaggucuccgucccucucacgccugcuuugcagacaggaggcaguacacaccgacagcuuagaagguaaaauugacucgccccgggauacucuggacccugccgagccaggggaaaagacccccgugaggccuguuacacagggaggcucucuccaaaguccaccccguuccccucgaccggcuagcgugcgcacuagaaaacacaccuuuggccagcggugugucucauccaggccagcagcccccgggggagaggaggcggaggcuucugauccugccgacgaggaagugagccauaucacaaguuccgcaugccccuggcagccaacggccgagccucacggucccgaagcuagcccagucgccggcggggagcgcgauuugagacggcuguauucuguggacgcacagggauuccuagauaagccgggcagggcugacgagcaauggcgaccuucagccgaacuggguaguggggagcccggcgaagcgaaggccuggggaccagaggcagaacccgcucucggcgcccgucgcaaaaagaaaauguccccuccaugcauuagcguugagcccccugcagaggaugaagggucugcuagaccgucggccgccgagggagguucaaccacucuucggaggagaacaccaagcugugaagcgacaccccaucgcgacucccuggagccuacugaaggcaguggggcuggaggcgauccagcagccaagggugagcggugggggcaggcuucuugcagggccgagcacuugacagugcccagcuuugcauucgaaccucuggaccucggcguacccuccggagauccauuccuggacggcucacauagugugaccccggagucucgagccagcuccucaggggcuaucgucccuuuagaacccccagagagcgagccucccaugccaguuggagacccucccgagaaaagacggggucuuuaccugacggugccgcaguguccacucgagaagccuggcucucccuccgcgacuccagcccccgggggaggcgcagaugacccugucuga

SEQ ID NO: 53728 - RNA, 6672 nt, Artificial Sequence
  derived and/or modified sequence opt3 from CACNA1I__Homo_sapiens__NP_066919
auggccgaaagcgcuucucccccuagcucaagugcagccgcgccagcugccgaaccgggcgugaccacagagcaacccgggccuagauccccacccuccucuccuccaggacuggaggaaccccucgacggugcagacccucacgucccacauccggaccuugcccccaucgcuuucuuuugucugaggcaaacuacgucgccucggaauugguguauuaagaugguuugcaauccaugguucgaaugugugucaauguuggugauauuacugaacugcgugacccuaggaauguaccagcccugugacgacauggauugccucagcgaccgcuguaaaauccugcaggucuuugaugacuucauuuuuaucuucuuugcaauggagauggugcuuaagaugguugcccuggggauuuucggcaagaagugcuauuugggcgauacauggaaucgacucgacuuuuucaucgugauggcugguauggucgaguacagucuggaucugcagaacauaaaucucuccgccauccguacugugagaguauuaaggccucugaaagcgauuaaccggguuccaucuaugcgcauccuugugaauuugcugcuagacacccuccccaugcuggggaacguccuucuguugugcuuuuucguguuuuucauuuucggaaucauaggcgugcaacucugggcaggccuguuaagaaauaggugcuuucuggaagagaacuucacaauucagggggaugucgcccucccgccuuauuaccagcccgaagaggacgacgagaugccauuuaucuguagccuuuccggagauaaugguauuaugggcugccacgaaaucccuccccugaaggagcaggggcgggaaugcuguuugucaaaggacgauguuuaugacuucggagcuggccgccaagaucuaaacgccaguggucugugcgugaauuggaaccgauacuauaauguauguagaaccgggagcgcaaacccacauaaaggagcuaucaacuuugacaauauuggcuacgccuggauagugaucuuccaggucauuacucucgagggcuggguggaaaucauguacuauguuauggaugcgcacucuuuuuacaacuucauauauuuuauucugcuuaucaucgugggguccuucuuuaugauuaaucugugcuuggucgugaucgccacacaguucucagagaccaagcagagggagcaucggcucaugcuggaacaacgucagcgcuacuuaagcaguucuacgguagcauccuaugcugagcccggagacuguuacgaagagauuuuucaguauguuugccacauacugagaaaagccaagaggcgggcucuaggucucuaccaagcccugcagagccgacgccaggcacuuggcccugaagccccagcuccggcgaaacccgggccucacgcaaaggagccaagacauuaccacggaaagacuaaaggccagggugaugaggggaggcauuugggcucgcggcacugucaaacccugcacggacccgccucuccuggcaacgaccauuccgggcgcgaacucugcccacagcacucaccccuggaugcuacaccgcauacucuugugcagccuaucccagccacccuggcaagugaccccgccagcuguccuugcugucagcacgaggacggaagaaggcccuccgguuugggcucuacagauagcgggcaagaaggaucaggcagugguuccagcgcugggggcgaggacgaagccgauggagacggcgcacguucuucagaggauggggcgaguagcgagcucggaaaggaagaggaagaggaggaacaggcugacggugccgucuggcugugcggcgauguguggcgggagacccgagcaaaauuaagagggauugucgacuccaaguauuucaauaggggaaucaugauggccauccuggugaacacgguuucuaugggcauugaacaucacgagcagccagaagaacuaacuaauauacucgagaucugcaacgugguauucacaucgauguuugcucuggaaaugauucuuaaauuggccgcauucggucuguuugauuaccuccgcaauccuuauaacaucuucgacagcauuaucgucauaaucuccauuugggagaucguggggcaggcugauggcggacugucaguuuuacggaccuuuagacugcuuaggguguugaagcucguccgcuucaugcccgcccugcgacggcagcuagugguacugaugaaaacuauggacaauguggcgacauuuuguaugcuccugaugcuuuucauuuuuaucuucaguauauugggcaugcacauuuuugggugcaaguucucucugcguaccgauacgggagacaccguuccagacagaaagaacuuugauagcuuacucugggccaucgucacaguguuccagauucugacucaggaagacuggaaugugguccuuuacaacggcauggcuuccaccucaccgugggcaagccuguauuucguugccuugaugacauuugguaauuacguacucuucaaccugcuaguggcuauccugguagagggguuucaggccgaaggagaugcaaacaggucuuauuccgacgaggaucaaaguagcucuaauauagaggaguucgacaaacuccaggagggccuggauuccucaggugacccuaaacuuugucccaucccaaugacucccaacggccauuuggauccuagucugccauuagggggacaccucggccccgcgggggccgcuggaccugccccgcgccugagccuucagccagaccccaugcuggucgcacuaggcucgcggaaauccucugugaugagccucgguagaaugucauacgaucaaaggagucuguccucuagccgauccucauacuaugggccuuggggacgcagcgcugccugggcaagucggagaucuuccuggaauagcuugaagcauaaaccacccucggccgaacacgagucacuguuaucugcugaaaggggcgguggcgcgcguguuugcgagguggccgcagacgaggggccuccgcgcgcugcaccccuccacaccccacaugcccaccauauucaccauggaccucaccuggcucaccggcauagacaccauaggcgaacacuuagucuggauaaccgggacuccgucgacuuggcagaacucgugcccgccguuggcgcgcacccacgcgcugccuggagagcagccgggccugcucccggacaugaggauuguaauggcaggaugccaagcaucgcaaaggacguguuuaccaagaugggugauagaggggaccgaggagaagaugaggaggaaauugacuacacucugugcuucagaguacgcaaaaugaucgaugucuauaagccggacuggugugaggugagggaagauuggucuguguaccuauuuagcccugagaaccguuuccggguccugugccagacgauaauugcccacaaacuuuuugacuauguugugcucgcguucaucuuucugaauuguaucacaauugcuuuggaaagaccccagaucgaggccggcuccaccgagaggauuuuccugacuguaucaaacuacauauucaccgcaaucuuugugggugaaaugacauuaaaggucgugagucucggccuguauuucggggagcaggccuaccuucgcagcucuuggaauguucuggauggauuuuugguguucgucuccauuaucgacauugugguuucacucgcuagugccggcggggcaaaaauccugggagugcuacgaguccugagacuucuccggacccugaggccauugcgcguaauaagccgugcucccggcuuaaagcuggugguugaaacucucaucuccucucugaagccuauugguaacaucgugcuuauuugcugugccuuuuucaucauauuugggauucugggaguccaauuguucaaaggcaaguuuuaccacugccuaggcguggacacaagaaauaucacgaaccggucggauugcauggcggccaauuauagguggguacaucacaaauacaacuucgacaaucuggggcaggcacucaugagccuguuugugcuugcuucaaaggauggaugggucaacaucauguauaacgguuuagacgccguugcuguggaucagcagccagugaccaaucauaaccccuggaugcugcucuacuucauuuccuuuuugcugauagucaguuucuucgugcucaauauguuuguuggcguaguggucgagaacuuccacaaaugucgccaacaccaggaagcagaggaggcccgaagacgggaagagaagaggcugcgcagacuugaaaagaaaaggcggaaggcccagcgucugccuuauuacgcuacuuauugccauacacgcuugcuaauccacucuauguguaccagccauuaccuggacauuuuuaucacauucauuaucugccucaaugugguuacuauguccuuagagcacuacaaccagccgaccucacuggaaacggcgcuuaaauauuguaauuacauguuuaccacaguguucguccuggaggcagugcucaaguugguagccuuugggcugcgaagauucuuuaaagauagguggaaccaacucgaccuggcuauaguccuucuaucugugaugggaaucacucuggaggaaauugagaucaaugccgcauugccaauuaaccccaccaucauacggauuaugcgcguuuuaagaaucgccagggugcugaagcuccugaaaauggcuacaggcaugcgggcgcuucuggauacugucgugcaggcccucccucagguugguaauuuggggcugcuauucaugcugcucuuuuucaucuaugcagcucuuggaguggaacuguuuggcaaguuagucugcaacgacgagaaucccugugagggcaugagccgacaugccaccuucgaaaacuucgggauggcauuuuugacgcuguuccaagugaguacaggagauaauuggaacgguauuaugaaggacacccucagagauugcacucacgacgagcgcuccugucugagcucucuucaguuuguaucaccacuguacuucguguccuuuguucucacagcccaguucgucuugaucaacgugguggucgcuguacugaugaaacacuuagacgauaguaauaaggaagcccaggaggacgcggaaauggaugcagagcuagagcuggaaauggcccauggccucgggccuggacccaggcuuccaaccggcagcccuggugcuccggggcggggacccggcggcgccgggggagguggcgacacugaagggggacugugccguagauguuauucgccagcucaagaaaacuuguggcuggauucugugucccucauaauuaaagacagccuggagggcgaacuuaccaucauugauaaucucucagguaguaucuuucaccauuacucuuccccugcagggugcaagaaaugccaccacgacaagcaggagguucagcuggccgagacagaggcuuucagcuugaacucagauaggaguagcuccauacuguuaggagacgaucuaucucuggaggaccccacggccuguccaccuggccgcaaggauagcaaaggcgaacucgaucccccggagccaaugcgggugggggaccuuggagaaugcuuuuucccucuguccucaaccgcagucucucccgauccagagaacuuuuugugugagauggaagagauucccuucaacccugugcgaaguuggcugaagcaugacucgagccaggcgccgcccuccccauuuucuccugaugccucaagcccccuccugccuaugccagcugaguucuuccaccccgccguuuccgcaagucaaaaagguccugagaagggcacugggacaggaacccuuccaaaaaucgcuuuacagggcucuugggccagccugagaucacccagggugaauugcacacucuugcgccaggcaacugguuccgacaccagucuggaugccagcccgucuuccucagcugggagccuacagacgacacuggaggacucgcucacccuuucugauaguccucggagagcgcugggaccacccgccccugcaccaggcccccgugcuggcuuguccccggccgccaggcggcgccugagccuccgagggagaggacuguuuucauuaaggggucuucgggcacaucaacgcucccacucuagcggcgggaguacuuccccuggauguacccaucacgacagcauggaucccucugacgaagagggcagagguggggcuggcggaggcggggccggaucagaacacagugagacacuguccagccucucucuaacuucgcuguucugcccaccucccccacccccugcgccagguuugaccccggcuaggaaguuuucaagcacauccagucuggccgcacccggccgaccucaugccgcugcacucgcccacgggcuugcgcggucuccaagcugggcugccgaucguuccaaggaucccccuggacgggccccacugcccaugggcuuggguccucuggccccgccaccccagccucuccccggggaauuagagccaggcgacgcugccucaaaacgcaagagguga

SEQ ID NO: 53729 - RNA, 5622 nt, Artificial Sequence
  derived and/or modified sequence opt3 from CACNA1S__Homo_sapiens__NP_000060
auggagcccaguuccccucaggacgaaggccugagaaagaaacaaccaaagaaaccggugcccgagauccucccuaggccaccccgggcacuuuucugccugaccuuggaaaacccuuuacgcaaggcuuguauuucuaucgucgaguggaaaccauuugaaacaaucauucuguugacuaucuucgcuaauugcguugcccucgcgguguaccugcccaugccugaggaugacaacaauucacuuaaccugggguuggagaagcucgaauacuuuuuccugauuguauuuaguaucgaggcugccaugaagauaaucgcauacggauuccuguuucaccaggaugccuaucuccgaagcgguuggaauguguuagacuucacgauugucuuucugggcguguucaccguuauccuugaacaggugaacgucauucagucccauacagcuccaaugucuucgaaaggggcaggauuggaugugaaggcccugcgugcuuuuagaguacuaaggccgcuccggcugguuucaggcgugcccagccuucaagucgugcugaauaguaucuucaaagccauguugccucucuuucacauagcgcuguuagugcuguucauggucauuaucuacgcaauuaucggucucgagcuuuucaaggggaaaaugcauaagacuuguuauuuuaucggaaccgacauuguugccacaguggagaacgaagaaccaucccccugcgcucgcaccggcucuggcagaagguguacuauaaaugggagcgaaugccggggagguuggccuggcccaaaccacgggaucacacauuucgauaauuuuggauucuccaugcugaccguauaccaguguauuacgauggagggcuggacugacguguuguauugggucaacgaugccaucgguaaugaauggcccuggauauacuuugugacccuaauucugcucgggucauucuuuauccugaaccuuguucugggaguguugaguggcgaguucacaaaggagcgcgaaaaagcaaagagccgaggcacuuuucagaaacucagagagaagcagcaacuggacgaagauuuaaggggguacaugucuuggaucacccagggagaggucauggacguggaagauuuccgggaggguaaacugucccuagacgagggcgggucagacacagaaagccucuaugagauugcuggacugaauaagaucauucaguuuauacgucacuggcgccaguggaacagaaucuucagguggaaaugccacgauauuguaaagaguaagguguuuuauuggcuuguuaucuugaucgucgcccugaacacccucucuauugcguccgaacaucacaaucaaccgcuguggcuuacgcggcugcaggacauagccaaccgaguguugcucagccuguucacuacagagauguuaaugaaaauguauggccugggucuacgccaguacuucaugucgaucuuuaauagauucgauuguuuugucgugugcucugggauucucgaaauccugcuuguugaguccggcgcaaugaccccuuugggaauuucagugcugagguguauccggcuccugcgcauauucaagaucacuaaauauuggacaaguuuaagcaaccugguagcuucccuucuaaauucuauuagaagcaucgccucacuccugcuacugcucuuucuguucauugucaucuuugcucuuuugggcaugcaacuguucgggggaagguacgacuuugaggauaccgaagugcgucggaguaacuucgacaauuuuccccaggccuuaauauccguuuuccaggugcucacgggugaggauuggaccagcaugauguauaacggcauuauggcauacgggggaccaucuuacccuggcaugcuggucugcaucuauuuuauuauccuuuucgugugcgguaauuacauacuguugaacguauuccucgccaucgcuguggacaaucuggcggaagcagagucacuaacaagugcccagaaggcuaaagccgaggaaaagaagcgaagaaaaaugagcaaggggcugcccgauaaauccgaggaagagaagucuacuauggccaaaaagcucgaacaaaagccaaaaggcgagggcauucccaccacagccaagcugaaaaucgacgaguuugaaucgaacguuaaugaggucaaggauccuuauccaagcgcugacuucccgggagacgaugaagaggacgaacccgagauuccucuuuccccaaggccccgcccuuuggccgagcugcaguuaaaagaaaaggcagugccaauccccgaggcgagcucauuuuucauauuuucuccgacuaacaagauucgggugcucugucauagaaucgucaaugcuaccugguucacaaacuuuauccugcuuuucauucugcuaagcuccgccgcacucgccgcugaagauccuaucagggccgacucaaugcgcaaccagauucugaaacacuuugauauaggguucaccagcguuuuuacuguggagaucguguugaagaugacgacauacggagcauuccugcacaaagguucuuucugccgaaauuauuuuaacauguuagaccuccugguagucgcugugucccuuauuaguaugggccuggaaagcucugccaucuccguugugaagauuuugcggguccuccgugugcugagaccacuaagggcgaucaaucgcgccaaagggcugaagcauguugugcaguguauguucguagcuauaucaaccaucggaaacauuguccuugugacuacccuccugcaauuuauguucgcaugcaucggcgugcaguuguuuaaagguaaguucuuucgguguacagaucugaguaagaugaccgaggaggaaugcagaggguacuauuacgucuacaaagacggcgaucccaugcagauugaguuaaggcaccgagaauggguucauagcgacuuccacuuugauaaugugcucucggccaugaugucccuguucacuguaucuacauuugagggauggccucagcuucuguauaaggcuaucgacagcaacgccgaggaugugggccccauauacaauaaccgcgucgaaauggcaauuuucuuuaucaucuauauuauauugaucgcguucuucaugaugaauauuuuugugggguucguuaucgugacguuucaagagcagggagaaaccgaguacaaaaacugugaacucgacaagaaucagcggcagugcguccaauaugcccugaaagcuagaccacuaagguguuacauuccuaagaaccccuaucaguaccaggugugguacaucguuacuucaaguuauuucgaguaccugauguuugcccuuauaaugcucaauacaaucugccugggcaugcaacauuauaaccaguccgagcagaugaaucacauuucugacaucuugaacguggcauucaccauuaucuuuacauuagaaaugauacugaagcucauggcuuucaaagcccgugguuacuuuggggauccauggaacgucuucgacuuucugauuguaaucggaagcaucauugaugugauccuuuccgagauagacacuuuccuggcaucaagcggcgguuuguauugucuaggcgggggaugcggcaauguugauccggacgaaagugcccgcauuucuuccgcauuuuuccggcuguucagagugaugaggcucaucaagcugcuuagccgagcggaggggguccggaccuuacuguggacguuuauuaaaucguuccaggcccucccuuacguggcauugcugaucguaaugcucuuuuucauauaugcugugauuggaaugcaaauguuuggcaagaucgcccuggucgaugguacccagaucaaccgcaauaacaauuuccagacauuuccccaggccguucuucuguuguucagaugcgcuacuggggaagcauggcaagagauucuacuggccuguucauacggaaaacucugcgacccagagucugauuacgcgcccggcgaagaguauaccugugguacaaacuuugcuuacuauuacuucaucaguuuuuauauguuaugcgccuuccuggugauuaaucuuuuuguggcagucauaauggacaacuucgauuaccugacuagggacugguccauccucggcccucaccauuuggaugaguucaaggccauuugggcugaguaugacccagaagcaaaggggcggaucaaacaccuggacgugguuacccuccugcgaagaauccagcccccucuuggauuuggcaaguucuguccgcaucgcguagccugcaaaaggcuaguggggaugaauaugccacugaacagcgauggaacggucacauuuaaugcgaccuuguucgcuuuagugcguacugcccugaagauuaaaacagagggcaacuuugagcaggcaaaugaggaacuccgggccauaaucaagaagauuuggaaaagaaccucuaugaagcugcuugaccagguuauacccccuauuggugaugacgaagugacugucgggaaauucuacgcuaccuuucugauccaagagcacuucaggaaguuuaugaaacgccaggaggaauacuauggauaccgaccaaagaaagauauagugcagauccaagccggccucagaacaauugaggaagaggcagcucccgaaaucugucggacgguaagcggugacuuggccgcggaggaggaacuggagagggccauggucgaagcagcuauggaggaaggcauuuuccgccguaccgggggacuauuuggccagguggauaacuuccuggagagaacuaauucccucccuccgguuauggccaaccagcggccccuucaguuugcugagaucgaaauggaggaaauggagucaccaguguuccuggaagacuucccucaagaucccaggacaaacccauuagcacgcgccaauaccaacaaugccaacgcuaaugucgcguaugggaacaguaaucacagcaacucucauguguuuuccucaguucacuacgagcgagaguucccugaagagacagaaacucccgcaaccagaggacgggccuugggccagccaugcagggugcuggguccgcauaguaagccuugugucgagaugcucaaggggcugcuuacgcagcgcgcuaugcccagaggacaggccccacccgcaccuugccaauguccaaggguggagagcuccaugcccgaagaccggaaaucuucgacaccuggcagccugcacgaggaaaccccgcauucacguuccacucgcgagaauaccagucgaugcucugccccagcuacagcgcucuugauacagaaggcccugguaagaggcggguuaggaacucuagcagcugaugccaacuuuauuauggcaaccggucaggcccuggcugacgccugccagauggaacccgaggagguggaaaucauggcgacagagcuccuuaaaggcagggaagcaccugaggggauggccagcucccugggauguuugaaucugggcucaucucucgguagccuggaccaacaccaggggagucaggaaacgcuuauucccccacggcucuga

SEQ ID NO: 53730 - RNA, 3276 nt, Artificial Sequence
  derived and/or modified sequence opt3 from CACNA2D1__Homo_sapiens__NP_000713
auggccgcuggcugccugcucgcacuuacccugacauuguuccagagcuuacugaucgggcccuccucugaggaaccuuuuccaucagccgugacuauuaagaguugggucgacaaaaugcaagaggaucuaguuacgcucgcgaagaccgcuagcggagugaaccagcugguagacauauacgaaaaauaucaggaucuuuacacaguggagccgaauaacgccagacagcuggucgaaaucgcagccagggacauugagaaguugcucuccaaucggucuaaagcucuggugcgccuggcacucgaggccgaaaagguucaagcugcccaccaguggcgagaggauuucgcgucgaacgaaguggucuauuacaaugcaaaggacgauuuagaccccgagaaaaacgauucagagccugguagccagcguaucaagccaguguuuauugaagacgccaauuucggcagacagaucaguuaucaacaugcugccguacacauacccacugauaucuacgagggguccaccauuguucugaacgaacuuaauuggacaucugcauuggacgagguguuuaaaaagaacagggaagaggauccuagccugcuauggcaggucuucggauccgcuaccggccucgcccgguauuacccagcgucacccuggguggacaauagucgcacuccuaacaaaaucgaccuguacgaugugagaaggcggccaugguauauucagggugccgcaagcccgaaggacaugcuuauccuggucgauguuucuggguccgugucaggauugacacucaagcugauacgcaccagcguaagugagauguuagaaacgcugucugacgaugacuuugugaaugucgcuuccuucaacagcaaugcccaggaugugucguguuuucaacaucucguucaggcuaacgugcgaaacaaaaagguccuuaaagacgccgugaauaacauuacugcaaagggcaucaccgauuacaaaaagggcuucucuuuugccuucgagcagcuguugaauuauaacguauccagagcuaauugcaacaaaauuaucaugcuauuuacagacgggggagaagagagggcgcaagaaaucuucaauaaguacaacaaggauaaaaagguucggguguucacuuuuucagucggucagcacaauuaugaccguggccccauucaguggauggcaugugagaacaaaggguacuauuacgagauaccuaguaucggagccauucgcaucaauacccaggaauaccuggacgugcucggcagaccaaugguccuggcuggugauaaggccaaacaagugcaguggacaaacguuuaucuugacgcacuggaguuggggcucgugauaaccggaacgcugcccguauucaauauuacuggccaguuugaaaacaagacaaauuuaaagaaccagcugauccuaggcgucauggggguggauguuagccucgaggacaucaaaaggcugaccccucgguucacucuuugcccaaacggauacuauuuugccauugaucccaaugguuacguguugcugcauccgaaccuccaaccuaagaaucccaaaucccaggaaccagucacacuggacuuccuugaugcugagcuggagaacgacaucaagguggaaauucgaaauaaaaugauagauggcgagucuggggaaaagaccuuucgcacguugguaaagagccaggacgagagauauaucgauaaaggaaacaggaccuacacauggacuccugugaauggcaccgacuauucacucgcccugguuuuacccacauacaguuucuacuauauuaaggcaaaacuggaggaaacuaucacccaggcgcgguccaagaaagguaagaugaaggauagcgagacacuaaaaccagacaacuuugaagagucuggguacaccuucaucgcuccccgcgacuauuguaaugaucucaagauuucagacaacaauacugaauuucugcuuaacuucaaugaguuuauagauagaaaaacgccuaacaauccaaguugcaacgccgacuugaucaacaggguccugcucgaugcaggcuucacaaaugagcuggugcaaaacuacuggagcaagcagaaaaauauuaagggagugaaagcccguuucgucguuaccgacggcgggaucacucggguguauccgaaggaagcuggagagaacuggcaggaaaaucccgagaccuacgaagauuccuuuuauaagcgaucuuuagacaacgauaauuacguguucacagccccuuacuuuaacaaaucggguccaggcgcauaugagagcgggauuaugguauccaaggcugucgagaucuacauacagggaaaacugcuuaagcccgccgugguuggcaucaaaauugacgugaauaguuggaucgaaaacuucaccaagacuucaauuagagauccuugugcggguccagucugcgacuguaagcgcaauucugaugugauggacugcguuaucuuggacgaugggggcuuucuccugauggccaaccacgacgauuauacaaaucaaauaggaagguucuuuggcgagauugaccccagccuaaugcggcaccuggugaacaucuccguauacgcuuucaauaaaucauaugauuaccagagcgucugugaaccgggggcagccccuaagcagggagcuggucauagaucugccuaugugccauccguggcagacauucuccaaaucggcuggugggcgacggccgcugccuggaguauacugcagcaguuucuuuugagccugaccuuccccagguuacucgaggcagucgaaauggaggaugacgauuuuacugcuucucuguccaaacagucaugcaucacagagcaaacccaguacuucuuugacaacgauaguaagagcuucucggggguucuugacugcggaaacuguucccgcauuuuccacggcgaaaaacugaugaauacaaacuugaucuuuauuaugguggagucuaaggguacuugcccuugugacacccgacuccugauccaggccgaacagacgagcgaugggcccaauccaugcgacaugguaaagcaaccucgguaccguaaaggccccgauguguguuucgacaacaauguccuagaggauuauaccgacugcggaggcgugucagggcugaacccaagucucugguacauaauuggaauccaguuucugcuuuuguggcugguuuccggcucuacacauagauuacucuga

SEQ ID NO: 53731 - RNA, 3438 nt, Artificial Sequence
  derived and/or modified sequence opt3 from CACNA2D2__Homo_sapiens__NP_001005505
auggccgugcccgcuagaaccugcggcgcaagcaggccugggccagcccggacagcgcgcccguggcccggaugugguccucacccaggccccgggacucgacguccuacguccggaccacccagaccucuguggcuccuucugccauuguuaccgcugcuagcugcccccggcgcaucugccuacucauucccucagcaacauaccaugcagcacugggcuaggcggcucgagcaggaagucgacgguguuaugcgcaucuuugggggagugcagcaacugagagagauuuauaaggauaacaggaaucuuuucgaaguacaggagaacgaaccacagaaacugguggagaaggucgcaggcgacauagagaguuugcucgaucggaaagugcaggcccugaagcgccuggcugacgccgcggaaaauuuucaaaaagcacaucgauggcaggauaacaucaaggaggaagacauuguuuacuaugaugccaaggcugacgccgagcucgaugaccccgagagcgaagauguggagagaggcuccaaagcaucuacauuaaggcuggacuucaucgaagauccuaauuuuaagaacaaagucaauuacucguaugcugccgugcagauuccaacugacaucuacaaggggucaaccguaauacuuaacgaguugaauuggacagaagcgcuggagaacguuuucauggagaaucggcgucaggaccccacccuacucuggcaaguguuuggaagcgccacuggugucacacgcuauuacccggcaaccccuuggagagcucccaaaaagaucgaucuguacgacgugaggcggcgaccaugguauauucagggcgccaguuccccuaaggauauggugaucauugucgacguuucugggagcguguccggacuuacgcugaaauugaugaagacuucaguaugcgaaaugcucgauacccugagugacgaugacuacgugaacgucgcuagcuucaaugagaaagcccagcccgugucuuguuuuacacacuuaguucaagcaaacgugcgcaauaagaaagucuucaaggaagccgugcagggcaugguagcuaaagguacuaccggguauaaggcgggauuugaguacgcauucgaucagcugcagaacuccaacaucacaagagccaauugcaacaagaugauaaugauguuuaccgacggcggcgaagauaggguucaagacguguucgagaaauauaauuggccaaaccggacgguccgcguguucacuuuuucagucgggcagcauaauuacgacgugacaccccuccaguggauggcuugugccaacaagggauauuacuucgagauuccuagcaucggugcaauuagaaucaauacccaggaauaccuugauguucugggcaggccaaugguguuggccgggaaagaggcuaagcaaguacaguggacuaacgucuaugaagacgcccuaggacugggccucgugguuacagguacccugccgguguuuaaucuuacgcaggaugggcccggcgagaaaaagaaccagcugaucuugggagucaugggcauugacguggcacucaaugauauaaagcgucugaccccuaacuacacauuaggggcgaauggauauguauucgcuaucgaccugaacgguuacgugcuacuccacccaaaucugaaaccccaaacuaccaacuuucgggaaccuguuacacuugauuucuuggacgccgagcuggaggaugaaaacaaggaggaaauucgaagaaguaugaucgacggcaauaaagggcacaagcagauaaggacucucgucaaaucucuggaugagcgcuauauugacgaggugacccggaacuacacaugggugccaaucagauccaccaauuauagccuuggacuggucuugcccccguacucgacuuuuuaccuccaggcaaaccugucugaucagaucuuacaaguuaaguauuucgaauuucugcuaccuuccucauucgagagugaaggccauguguuuauugccccaagggaguacugcaaggaccucaaugcuagcgacaacaauacggaguuccugaaaaacuuuaucgaacuuauggagaaggugacacccgauuccaaacaguguaauaacuucuugcugcacaaucucauucuggacaccgguauaacucagcaauuaguagaacgcgucuggcgagaucaggaccugaacaccuauucucuuuuggccguguucgcagcuacagaugggggcaucacccggguuuuuccuaauaaggccgcggaggacuggacugaaaaccccgagccauucaaugccagcuuuuaccguagaucacucgauaaccauggauauguguucaaaccuccccaccaggacgcucugcuaaggccacuggaacucgagaacgauacagucggcauucuggugaguacggcaguugagcuuuccuuggggcgccggacccugagaccggccgugguaggagucaaguuagaccucgaggcuugggccgaaaaguuuaaagugcuggcaagcaauaggacucaccaggaucaaccucagaagugcggucccaacucucauugugaaauggacugcgaggugaauaacgaagaucuucugugugucuugaucgacgacggcggguuccucguucugucaaaucagaaccaccagugggaucaagugggacgauuuuucagugagguagacgcgaaucuaaugcuggcccucuacaacaauagcuuuuauacacgcaaagaguccuacgauuaccaggcugccugcgcaccacagcccccuggcaaccugggugcugccccaagagggguguucguccccaccguggcagacuuucuuaauuuggccugguggacaucugcugcggccuggucgcuguuccagcaauuacucuauggccugaucuaccauagcugguuucaggcagauccugcugaagccgagggauccccggaaacucgggagucaaguugcguuaugaagcagacccaauauuacuucggcucugugaacgccagcuauaaugcuauuauagacugugggaacugcuccaggcuuuuccacgcacagcgucugacgaauaccaaccuacucuuugucguggccgagaaaccacuguguucacagugcgaagcgggacgcuugcugcagaaggagacacauugucccgcugauggcccugaacaaugcgaguuaguucagcggccaagauacaggcgagguccccacaucuguuucgacuauaacgccacugaagauaccagcgacugcgggcggggagcaucuuuuccuccgucccucggcgugcuggucagucuucagcuguugcuccugcuaggucugcccccacgcccucagccccaaguacuugugcacgccagcagaaggcucuga

SEQ ID NO: 53732 - RNA, 3276 nt, Artificial Sequence
  derived and/or modified sequence opt3 from CACNA2D3__Homo_sapiens__NP_060868
auggccggccccgggagcccuagaagggcuucccggggagcaucugcccugcucgcggcugcccuucuguacgcagccuugggugacgugguccgcucagagcagcaaaucccauuaaguguugugaagcugugggcuagcgcauucggcggggaaauuaaauccauagccgcuaaguauucuggaucgcagcuacuccagaaaaaguacaaagaguaugaaaaggauguagccaucgaggaaauugacggccugcagcuugugaagaaacuggcgaagaacauggaggagauguuucacaaaaagucagaagcaguccgacguuugguggaggccgcugaagaggcccaucucaaacacgaguucgaugcagaccugcaauacgaauauuuuaaugcuguucugaucaacgagagagauaaggacgguaauuuccucgaauuagggaaggaguuuauucuggccccgaacgaucauuucaauaaccuucccgugaauaucagcuugagugacguccaggugccuaccaacauguacaauaaagauccagcgauaguaaacggaguuuauugguccgaaucucugaauaagguguuugucgacaacuucgauagggaccccagccuaaucuggcaguacuuuggcuccgccaaaggcuucuuucggcaguacccugggauuaagugggagccagaugagaauggagugaucgcauucgacugccgcaacagaaaaugguauauucaagcugccacaucacccaaggacguggucauccucguugaugugagugguagcaugaaaggccugaggcuuacuauagcuaagcagacgguaucuuccauucuggacaccuugggggaugacgacuuuuucaauaucauugccuacaacgaggaacuccacuauguggaaccuugucugaacggaacauuaguccaggcagaucggacuaauaaggagcauuuccgcgaacaccuggauaaacucuuugccaagggcaucgguaugcuugacaucgcucugaacgaggcguucaauauuuugucagauuuuaaccacaccgggcagggaagcauaugcagucaagcaaucaugcuaauuacagacggcgccguggauaccuacgacacuaucuucgcuaaauauaauuggccagaccgaaagguuagaauauuuacauaccugauuggcagggaggccgcauucgccgauaaccucaaauggauggcuugugccaauaagggguuuuucacccagaucucuacgcuggcagacgugcaggaaaacgucauggaguaucuucaugugcugucccggccgaagguaaucgaucaagaacacgacguuguguggacugaggcguacauugauagcaccuugccccaggcucagaaacucacagacgaucagggaccuguccugaugacuaccguggccaugccagucuuuucgaagcaaaaugaaacacguucuaaagguaucuuacugggcgugguugggaccgacgugcccguaaaggagcuacucaaaacgauuccuaaguacaagcugggaauacauggcuaugcauucgccaucacuaacaaugguuacauucuuacacacccagaguugcgccugcucuaugaagaggggaaaaagagaaggaaacccaacuacuccucagucgaucugagugaaguggagugggaggaccgggaugacguucuucgaaaugcuauggugaaccgcaagaccggcaaauuuagcauggaagucaagaagacuguggauaaaggaaagagaguacuggugaugacaaaugacuauuacuauaccgacaucaaaggcacgccguucuccuuggggguugcccucucuaggggacacgguaaguacuuuuuccggggcaacgucaccaucgaggaagggcugcaugauuuagagcacccugacgugagccuggcagaugaauggucauacugcaacacagaccuacaucccgagcaccgccaucucagucagcuggaggcuauuaaacuuuauuugaagggaaaagaaccacugcuccagugugauaaggagcugauacaggaaguguuauucgacgccgucguuuccgcgccuaucgaggccuacuggacuagccuggcucuuaauaagucugaaaacucagauaaaggcguggagguggcauuuuuggguaccagaacagggcucaguaggauuaaucuguucguaggcgccgagcaacuaacuaaccaggacuuucugaaggcuggagauaaagaaaauaucuucaacgccgaccacuuuccccucugguaucgucgggcagcggagcagauuccaggcagcuucgucuacuccauccccuuuucuaccgggccugugaauaagucgaacguugugacagccagcaccuccauacagcugcuugaugaacgaaaaucaccagucguggcugccguuggaauccaaaugaaguuggaguucuuucagagaaaguucuggacugcaaguaggcagugcgcuucucuggacgguaaauguagcauuuccugcgaugacgaaacggugaauuguuauuuaaucgacaacaauggcuuuauucucguaucagaggauuacacacagaccggggacuucuuuggagagaucgaaggcgccgucaugaacaagcugcuuacuauggguagcuucaaacgcauaacccuguaugauuaccaagcaaugugccgggccaauaaggagucuuccgacggggcucacggcuugcucgauccguacaacgcguuccugagugccgugaaauggauuaugacagaacuugugcuguuucucgucgaguucaaucuguguagcugguggcauucugacaugaccgcaaaggcucagaagcuaaaacagacuuuggagcccugcgauacagaauauccugccuuuguuuccgagagaacgaucaaggaaaccacuggaaacauugccugcgaggacuguucaaaaaguuucgugauccaacagauaccaagcucgaaccuguuuaugguaguggucgauuccucuugcuuaugugaaagcguggcucccaucacaauggcaccuauugagaucagguacaaugagucacucaagugcgaacgccugaaagcccagaagauucgacggcguccagagaguugucacggcuuccaucccgaagagaacgcgagagaaugcgggggagcuccgucccuucaggcccaaaccguucugcuacuccugccuuugcuguuaaugcucuuuucuagguga

SEQ ID NO: 53733 - RNA, 3414 nt, Artificial Sequence
  derived and/or modified sequence opt3 from CACNA2D4__Homo_sapiens__NP_758952
auggugugcggcuguagcgcccugcucccccuuccuaacccaagaccgaccaugcccgcuacaccuaauuuccuggcaaacccauccucuucaaguagguggauccccuugcagccuaugccagucgccugggcguuuguucaaaagacuagcgcuuuacuguggcuacuccugcuugggacgucccugucucccgccuggggacaggcaaagauuccuuuggagaccgugaagcucugggccgacacauucgguggcgaucuguacaauacuguaaccaaauauucggggucacugcucuuacagaagaaauacaaggacguggaaagcagucugaagauagaggaagucgauggacuugaguuggugcggaaauuuuccgaagacauggagaacaugcugcgccgaaagguugaggcugugcagaaucuagucgaagcagccgaggaagcugaucucaaccacgaguucaaugagucucugguguuugacuauuacaacagcguacuuaucaaugaacgugaugagaaaggcaacuucguugaacugggugccgaguuuuugcucgaauccaaugcgcauuucucaaaccugccagugaauacaaguauuagcucuguccaauuaccgaccaacguguauaauaaggaccccgauauccugaacgggguguacauguccgaggcacucaacgccgucuuuguugagaauuuccagagagacccuacucuuacauggcaguauuuuggaucagcuaccggcuucuuuaggauuuacccaggcaucaaauggacgcccgaugaaaacggggugauaacuuucgacugccggaaucgcggaugguacauccaggccgcaaccagcccuaaggauauuguaauccugguggacgucagugguucuaugaagggcuugagaaugacaauugcuaaacacacuaucaccacaauacuagacacccugggggagaacgauuucauuaauaucauugccuauaacgacuacgugcauuauaucgaaccauguuuuaagggaauccucguucaagcggauagggacaaucgggagcacuucaaacugcuuguggaggaacugauggucaagggcguggguguaguugaucaggccuugcgcgaggcauuucagauucucaaacaguuccaagaagcuaagcaggggucccugugcaaccaggccauaauguuaaucagcgacggagcuguggaggauuacgaacccgucuuugagaaauauaauuggccggacuguaaggugcgagucuucacguaccugauuggcagagaagugucguuugccgauaggaugaaguggaucgcaugcaacaauaaaggcuauuacacucaaauaucuacacuagccgacacccaggagaacguuauggaguaccuccaugugcugucccggccuaugguaauuaaucacgaucacgacaucaucuggacugaggcuuauauggacucaaaguuguugaguagccaggcgcagucccugacacuccugaccacggucgcaaugcccguguucucuaaaaagaacgaaacccguagccaugggauucuucugggaguuguggguucagaugucgccuugcgcgaacucaugaaacuggcuccaagauacaaguuaggcgugcacggguaugccuuucugaauacaaacaacggauacauccuaagucauccugaccucaggccccuguaucgggagggcaagaaacuuaagccaaaacccaauuacaacuccguagauuugagcgagguggaaugggaggaccaagcagaaucucugcgaacugccaugauuaaucgcgagaccgguacacucucaauggauguuaaggucccuauggacaaagggaagagagugcuguucuuaacuaacgauuacuuuuucaccgacauaagugauacaccauuuagccugggcgugguccuuuccaggggacacggcgaauauaucuugcucgggaauaccucuguugaggagggacugcacgaccuacugcauccggaucucgcucuggccggugacuggauuuacuguaucacugauaucgaccccgaccaccggaaacuuucgcaguuggaagcaaugauucgcuuccugacgagaaaggauccugacuuagagugcgaugaggaacucgugagggaagugcuguucgacgcgguagucacagcuccaauggaggccuauuggaccgcacuugcccugaacaugagcgaggaauccgagcaugugguugauauggcuuuucuuggcacucgugccgggcuccugcggucaagucuauucgugggaucugaaaaggucagcgaccgaaaauuucugacccccgaggaugaagcauccguguucacacucgacagauuuccucugugguacaggcaggcuucagagcacccagccggcagcuucguuuuuaaucuucgcugggcggagggucccgaaucugccggggagccgauggugguaaccgcuuccacugcagucgccgugacaguggauaagcggacggcuauagccgcagcggccggcguccagaugaaauuggaguuccugcaaagaaaguuuugggcugccaccaggcaguguaguacuguugacggaccuugcacacagagcugugaagauucugacuuagauugcuucgugaucgacaacaauggcuuuauucucaucuccaagcgcucacgagagaccgggcgguuccugggagaaguagacggugcagugcuuacacagcugcuaaguaugggcgucuuuagccaagugacuauguaugauuaccaggcuaugugcaaaccaucgucccaucaccacucugccgcacagccccucguuagcccuauuucagccuuccugaccgcuacgcguugguugcugcaggaguuaguccucuuccugcuugaauggaguguguggggguccugguaugacagaggagcggaggccaagucuguguuucaucacagccauaaacacaagaaacaagauccccugcagccaugugacaccgaauacccuguuuucguguaucagcccgcaaucagggaggcuaacggcauagucgagugcgguccaugucaaaagguauuugugguucagcagauccccaauuccaacuugcuccugcuagugacagauccuacuugcgacuguucaauuuucccgccaguccugcaggaagccaccgaggugaaauacaaugccagcguaaagugcgaucgcaugcggagucaaaaacuuagaaggcgacccgacucuugucacgcuuuucauccugaagagaacgcacaggauugcgggggcgccuccgacacaagcgcgucgccaccccuccuguugcugccugugugugcuuggggauuacucccgcagcugcuucgcuga

SEQ ID NO: 53734 - RNA, 1797 nt, Artificial Sequence
  derived and/or modified sequence opt3 from CACNB1__Homo_sapiens__NP_000714
auggugcagaagaccagcauguccagaggccccuacccuccaucucaagagaucccgauggaagucuucgaccccucaccucaggggaaauauaguaagaggaaaggacgguuuaagcgcagcgaugguuccacaucuucggacacuacgucaaacagcuucguucgacagggcagugccgaguccuacaccucucguccaagcgauuccgacgugucacuggaagaggauagagaagcucucaggaaagaggcagagcggcaggcccuugcgcaacuggaaaaggcuaagacaaaacccguagccuuugcagugcgcacuaaugucggguauaacccuaguccaggagacgaggugcccguucagggcguggccauuaccuucgaaccuaaggauuuucuucacauaaaagagaaguacaauaacgacugguggaucgguagauuagucaaagaggggugcgaagugggauucauuccaagcccgguaaagcuggauucucuaaggcuccugcaggagcagaaguugcggcaaaaucgccugggcuccucaaaaagcggcgacaacaguucuuccagcuugggggauguugugacaggaacccgaagacccacuccuccagcuucggcaaagcagaaacagaagucuacagaacaugugcccccuuaugacgucgugccauccaugaggcccaucauucucgucgguccgucacugaaaggcuacgagguuaccgauaugaugcagaaggcccuguuugacuuccucaaacaccgguuugacgggcguaucaguauaacgcgcgugacugcugauaucagcuuagccaagagauccguacugaauaacccuucuaagcauauuaucauugaaaggagcaauacccggucaagucuugcggaggugcaauccgagaucgaacgaauauucgaguuggcacgcacacugcagcuagucgcccucgacgcugauacuauuaaccaccccgcccagcugagcaaaaccucucuugcaccaaucauuguguauaucaagaucacaucaccuaaaguucugcaaagauugauuaagaguaggggaaaaagccaguccaagcaucucaaugugcagauagcugccucugaaaagcuggcgcagugucccccagagauguuugacaucauuuuagaugaaaaccaacuggaggacgccugcgagcaccucgcagaauaccuugaggcuuacuggaaagccacccaucccccuucgagcacgccaccgaauccccuguugaaccggacuauggcuacagccgcacuagccgcuuccccugcgccagucucaaaucugcagggccccuaucucgcaaguggugaucagccucuggaacgcgccaccggggagcacgcuucuaugcacgaauacccaggagagcuuggccagcccccgggccuguauccuagcucccauccacccgggagagccggaacuuugagggcacucucacgucaagacacauucgaugccgacaccccugguagccggaacucugcuuacacggagcugggcgauuccuguguggacauggaaaccgaccccagugaggggccaggauuaggcgauccugccggugggggcacacccccagcacgacagggaagcugggaagacgaggaggaagauuaugaggaggaacugacugacaacagaaauaggggccgcaacaaggcgcgguacugcgcugaagggggagguccgguacuaggcagaaauaaaaacgagcucgagggguggggaaggggcguuuauauccgcuga

SEQ ID NO: 53735 - RNA, 1818 nt, Artificial Sequence
  derived and/or modified sequence opt3 from CACNB2__Homo_sapiens__NP_000715
augcagugcuguggccuggugcacagaaggcggguccgcguuagcuacggguccgccgacucuuauaccucacgacccagugauagcgacgugucccucgaggaagaucgugaggcuguaagaagggaagcagagcggcaagcccaggcgcagcuugaaaaggcuaaaacaaagccuguggccuucgcaguccgcacuaacgugucuuacucggccgcucaugaggacgauguuccagugccgggaauggcaaucucauuugaggccaaagacuuccugcacgucaaggaaaaauuuaauaacgauugguggauugguagauuggugaaggagggcugcgaaauaggguucauccccagcccuguaaaguuagagaauaugaggcugcagcaugagcaacgggcuaaacagggaaaguuuuauaguuccaaaucuggcgguaacagcuccucaagucuaggggacauuguuccaagcucucgcaaguccacgcccccuucaagcgccaucgauauugacgcgaccggacucgaugcagaagagaaugacaucccagccaaccaccgaagucccaaaccuucugcuaauuccgugacaagcccacauucgaaggaaaagagaaugccguucuuuaaaaagacugagcacacacccccuuacgaugucgugccaucuaugaggcccgugguccugguuggcccuucccuuaaaggcuaugaagugaccgacaugaugcagaaggcccuguucgacuuuuugaaacaccgguucgaggggcguauaucaaucacccgcguaacugcagauauuagucucgcuaagagaagcgugcugaacaauccauccaaacaugccaucauugagaggucuaacacacggagcucacuggcggaaguccagagugagaucgaacgaauauuugagcucgcccgcaccuuacaacuggugguucuugacgcagauacgauuaaucaccccgcucaguuguccaagacuagccuggccccgaucauuguguacgucaagaucucuucaccuaaagugcuacagagacucaucaagaguaggggaaaaagccaggcuaagcaucugaacguacaaaugguugccgcagacaaacuugcccagugucccccagaacuguucgaugugauuuuggacgagaaucagcucgaggaugcuugcgaacaccuggcggacuauuuagaggcauacuggaaggccacccacccucccuccucuucgcugccaaacccccuccuuagccggacacuggcuacuuccucauugccucuaaguccaacccuggccucuaauagccaagguucccagggcgaucagcgcacagacagaucagcaccgauaaggagcgccucucaggcugaagaggaacccuccgucgagccugugaagaaaagucaacaucguucuagcuccucagccccacaccauaaccaccggagugggaccagccgaggacucucgagacaggagacguuugauuccgaaacucaggagucuagggacagcgcauacgucgaacccaaggaggacuauucacaugaucacguggaccacuacgcgagucaucgcgaucacaaccaucgggacgagacacacggcuccucugaucacagacauagggaaagccgccaccgaucccgggacguugaucgugagcaggaccauaaugaauguaacaaacaaagaucaaggcacaagagcaaagaucgcuauugcgagaaggacggugaagugaucaguaagaaacggaaugaggcuggggaguggaacagagauguauacauuaggcaguga

SEQ ID NO: 53736 - RNA, 1455 nt, Artificial Sequence
  derived and/or modified sequence opt3 from CACNB3__Homo_sapiens__NP_000716
auguacgacgauagcuaugugcccggcuucgaggacuccgaagccgggucugcugauucauacaccaguagaccuagccuggacuccgaugucucucucgaggaagacagggagucggcacggcgcgaaguugagucacaggcccaacagcagcuugagcgagcgaagcacaaaccaguggcuuuugccguacguacaaacgugagcuauugcggaguccuggaugaagaguguccggugcaggguaguggcguuaauuucgaagcaaaggacuuuuugcauaucaaagagaaguacuccaacgauugguggauugggagauuagugaaagagggaggcgacauagccuucauccccucuccucaaaggcuggaaagcauucggcuaaagcaggagcagaaggcucgcagauccgguaauccaucaagucucagcgauaucgggaacaggcggucucccccuccaucccuggcaaaacagaagcaaaaacaggccgaacacgugcccccuuaugacgucguaccaucaaugcgcccgguugugcuugucggacccagccugaagggcuacgaggugacugauaugaugcagaaggcuuuguuugacuuccucaaacaucgauuugacggcagaauuaguaucacgagggugaccgccgaucugucucuggcgaagcgguccguccucaauaacccugggaaacguacaauaaucgaacgcagcucggcaagaucuuccauugccgagguucagucagagaucgaaaggauuuucgaguuagcuaagagucugcaacuugugguauuggacgccgauacuaucaaucacccagcacagcuggcuaaaaccagccuagcccccauaauuguguuugucaagguguccucuccuaaaguucuccagcggcugauccgaagccgcggaaagucacaaaugaaacaucuuacagugcagaugauggcguaugacaagcugguccagugcccacccgaaaguuucgaugugauuuuggacgagaaccagcucgaagaugccugugagcaccuggcagaguacuuagaaguauacuggagagcuacccaccauccggccccuggucccggccugcucgggccaccuuccgcuauccccggacuucaaaaucagcagcuguugggcgagaggggugaggaacacagcccacuagaacgggacucucugaugcccucagaugaggccagugagagcucccgccaggcauggacugggucuucgcaaagaagcuccaggcaucucgaagaggacuaugccgaugcuuaccaggaccuguaucagccucaccgucagcacacaucaggacuuccaagugcgaacggccaugacccgcaagaucggcuguuggcacaggacucugaacacaaucauagcgaucgaaacuggcagagaaauaggcccuggccuaaggacuccuacuga

SEQ ID NO: 53737 - RNA, 1563 nt, Artificial Sequence
  derived and/or modified sequence opt3 from CACNB4__Homo_sapiens__NP_000717
augagcuccucuucauacgccaagaacggcaccgcugacgggccccacaguccuacaagccagguggcaagaggaacuacgaccaggcggucccgccugaaacgaucugaugguucgacaacuucaaccagcuucauccuccgucaaggcagugccgacuccuauacaucuagaccaagcgauuccgacgucucacuugaggaagauagggaggcgauucggcaggaacgcgagcagcaggcugccauacaacuggaaagagcaaagaguaaaccgguugccuuugcugugaagaccaauguaagcuacugcggggcauuggacgaggaugugcccgucccuucuacugccaucuccuucgacgcuaaagacuuuuuacauauuaaggagaaguauaacaaugauugguggaucggaaggcuggugaaagaaggcugugagauugguuucaucccaucaccccuacggcucgaaaacauacgcauccagcaggagcagaagcgagggagauuucacggaggcaaaagcaguggcaauucuuccagcucgcugggggagaugguuucuggaacauucagggccaccccuacguccacugcgaagcaaaaacagaaggugaccgaacauauuccacccuacgaugucgugccuucaaugcggccaguaguucuuguggguccgagucugaagggcuaugaggucacagacaugaugcagaaagcauuguuugauuuccucaagcaccguuuugacgggcgcaucagcauuacuagagugaccgccgacaucucccuggcuaaaaggucugugcugaacaaucccagcaagcgggccauaauugaacgaucaaacacacgcaguucccucgcagagguccagagcgaaaucgagagaauuuucgaguuagcuaggucucugcaacuuguuguguuggaugccgacaccaucaaucauccugcgcagcugaucaaaacgucacuagccccaauuauaguacacgugaaggucaguagccccaaagugcuccagcggcugaucaagucccgcggaaagucucaaucgaaacaccuuaacguucagcugguggcagcugauaaguuggcccagugcccuccagaaauguuugacgucauucucgaugagaaucagcuggaagacgcuugugagcauuuaggcgaauaccuggaggccuauuggagagcaacucacacaaccagcuccacucccaugacaccgcuccuugguaggaaccuggggucaaccgccuugaguccuuaccccacggcuaucucuggacuacaaagccagcguaugcggcauuccaaucacucaaccgagaacagcccaauagaacgaagaucucugaugacauccgaugagaauuaccacaacgaaagggcgcgcaaaagucggaacagacucucuagcuccucacagcauaguagggaccacuauccucugguggaggaagauuaccccgacagcuaucaggauacuuacaagccacaucgcaaucgaggcucgcccggcggguauucccacgacucucggcaucgucuuuga

SEQ ID NO: 53738 - RNA, 972 nt, Artificial Sequence
  derived and/or modified sequence opt3 from CACNG2__Homo_sapiens__NP_006069
augggccuguucgacagaggggugcagaugcuccuuaccacagucggagccuuugcugcauucagccugaugacuaucgccguugguacggauuacugguuguauuccaggggcgugugcaagaccaaaucuguaucagagaacgaaacaaguaagaaaaaugaggaagugaugacucacagcggguuauggcggaccuguugccuggagggaaacuuuaagggccuauguaaacaaauugaccauuuccccgaagaugcggacuacgaggcugauacagccgaguauuuucuccgcgcaguccgagccuccucuauauucccuauccugucggugauucuucuguuuauggguggguugugcaucgcugcaucagaguucuacaagacccgucacaauauuauccucagcgccggaauauuuuucguuagugcuggccuguccaacaucauuggcaucauuguguauaucucugccaaugcgggggacccaagcaaguccgauaguaaaaagaacucauacagcuauggauggucuuuuuacuucggugcacuguccuuuauaauugccgaaauggucggcgugcucgcuguacauauguucaucgacagacacaaacaguuaagggccacugcacgggcuacagauuaccugcaggccucagcgauuacccgcaucccgagcuauagauacagguaucagcggcgcagucgaucuuccagcagaucgacggaacccucucauuccagggacgccucaccuguugggaucaagggauucaauacucuuccaaguaccgagauuagcauguacacauugucccgggauccccugaaagcagcuacuaccccuacagccaccuauaacucugaccgugauaauagcuuucuacaagugcacaacuguauacagaaggagaauaaggacucacuccacaguaacacggcuaaucgcagaacuacaccagucuga

SEQ ID NO: 53739 - RNA, 948 nt, Artificial Sequence
  derived and/or modified sequence opt3 from CACNG3__Homo_sapiens__NP_006530
augagaaugugcgacaggggcauccagaugcugauuaccacagugggggccuucgcugcauuuagccucaugacuauagccgucggaacggauuacuggcuuuauucccgggguguuugucgcaccaagucuacaucagacaacgagaccagucguaaaaaugaagaggugaugacucacagcggccuguggcgaacaugcuguuuggaaggggcguucagaggaguaugcaagaaaaucgaucauuuucccgaggacgcugauuacgaacaagacaccgccgaguauuuacugagggcagugcgggccuccucugucuucccuauucuaucggugacucuccuguuuuucggcggucuuuguguugcugcaucagaguuucaccgcagcagacauaacgugauccugagugccgggauuuucuuugucuccgcuggauugucuaauaucauaggcaucauuguguacaucagcgccaacgcgggcgauccagggcagagggacuccaagaaaucauauaguuacggauggagcuucuauuuuggugcauucucuuuuauuaucgccgaaauaguaggcguuguggcuguccacauuuacaucgagaagcaucagcagcuccgggccaagucccacucagaguuccugaaaaagagcacauucgcacgccugccgcccuaccgauauagauuuaggcggcguaguucuucccgcagcaccgaaccuagaucgagggaucucucuccaauuuccaaaggguuccacacgauccccucaacugacaucaguauguuuaccuuaagccgggauccuuccaagauuacaaugggaacucugcuuaauucugaccgagaucaugcuuucuugcaauuucacaacagcaccccaaaagaguucaaggaaucacugcauaauaaccccgccaaucgcagaacaaccccuguguga

SEQ ID NO: 53740 - RNA, 984 nt, Artificial Sequence
  derived and/or modified sequence opt3 from CACNG4__Homo_sapiens__NP_055220
auggugagaugcgacaggggccugcagaugcuccuuaccacagccggggcuuucgcagccuuuagccugauggcgaucgcuauuggaacugauuacugguuguauuccucugcccacauauguaacgguacgaauuuaaccauggacgaugggcccccuccacggcgcgcacgaggggaccugacacauucaggacuauggcgugucugcuguaucgagggcauuuacaagggucacugcuucagaaucaaccauuuuccggaagauaaugacuaugaucacgacaguagcgaguaccuccugaggauuguucgggccuccucuguguuccccauccuuucgacuauacuguugcuccugggcggacuguguaucggcgcuggccgcauuuauucaaggaaaaacaauaucguacucagcgcagggauuuuauuuguggccgcuggacugaguaacaucauagguauuaucgucuacauuuccucuaauaccggcgauccuagcgacaagagagaugaagacaaaaagaaccauuauaauuacgggugguccuucuacuuuggagcccuuucauucaucguggcggagacaguuggcguguuggcagucaacaucuauauugagaaaaauaaggaacugcgguuuaagaccaaacgcgaguuccuaaaggccaguucuucuuccccauacgcucgaaugcccucauauagauacaggcggcgucgcagcagaaguucuuccaggagcacugaagccucgccuucucgggauguguccccaaugggucucaaaauaacaggggcaauccccaugggagagcugucaauguauacccuuagucgagaaccucugaagguaacgacugcugccagcuacuccccagaccaagaggcgagcuuuuugcagguucacgacuucuuucagcaggaucucaaagagggcuuccacgugagcaugcugaaccgcagaaccacaccggucuga

SEQ ID NO: 53741 - RNA, 828 nt, Artificial Sequence
  derived and/or modified sequence opt3 from CACNG5__Homo_sapiens__XP_011522915
augagcgccugcggcagaaaggcucugacccuccuuuccucuguguucgcagucugugggcugggauuguuagguaucgccguuucaacagacuacuggcuguaucuagaggaaggcgugauuguaccccagaaccaaaguacugagauaaaaaugagccuccacuccgggcuguggagggugugcuuucuugcgggagaggaacggggccgcuguuucacgaucgaauacgucaugccuaugaauacccagcugacaucugagucgacugugaacguuuugaagaugauucgaucagcuaccccauuuccgcucgugagccuguucuuuauguucaucgguuuuauucugaauaacaucgggcauauacguccccacagaacaauccucgccuucgucaguggaaucuuuuucauuuuauccggccugucucuugugguaggcuugguucuguauauuagcuccaucaaugaugagaugcuaaacaggaccaaagacgcagaaacuuacuuuaauuauaaguacggguggucauucgccuuugcugcaauaaguuuccuccugacagagagcgccggagugaugucugucuaucuuuucaugaaacgguacaccgcugaagauauguaccgcccucauccagguuuuuauagacccaggcuguccaacugcucagacuacagcggccaguucuugcacccugaugccugggugcgggggcgcaguccaucugacauuuccagcgaggcgucgcuccagaugaacucuaauuaucccgcacuguuaaaguguccugauuacgaccaaauguccucaaguccaugcuga

SEQ ID NO: 53742 - RNA, 570 nt, Artificial Sequence
  derived and/or modified sequence opt3 from CACNG6__Homo_sapiens__NP_114103
augauguggagcaacuucuuucugcaggaggaaaauagaaggcggggcgccgcugggcgccgacgugcacacggacaagguagauccggccucacccccgagagggaagggaaggugaaacuugcccuguuguuagcggcugucggagccacacuggcaguucuaucugugggcacugaguucuggguagaacucaacacguacaaggccaaugguucagcugugugcgaggcagcccaucuggggcuuuggaaggcuuguaccaaacggcuguggcaggccgacgucccuguggaucgcgacacaugcggaccagcggaguugccgggcggccuccugcugcucguuaguuuagaaguguuuagacacagcgucagggcacugcuucagcgggugucccccgagccuccacccgccccucgcuugacuuaugaauacucuuggucgcugggguguggaguaggugcuggccuaauccuccugcuuggggccggaugcuuccuguugcucacccugccaucauggcccuggggcagcuuauguccuaaacgaggucauagagcaacauga

SEQ ID NO: 53743 - RNA, 1110 nt, Artificial Sequence
  derived and/or modified sequence opt3 from CACUL1__Homo_sapiens__NP_722517
auggaggaaagcauggaggaagaggaaggcggguccuacgaggccaugauggacgaucagaaccacaauaacugggaggcugcaguggacggauucagacaaccccugccuccaccgcccccuccaucuucaauccccgccccugcgagggaaccacccgguggccagcuccuugcugucccugccguuaguguggaucggaaggggccaaaagagggacugccgaugggcccccagccuccacccgaagcaaaugguguaauuaugaugcuuaagagcugcgacgccgcugcagccguggcuaaagccgcgccugcaccaaccgccuccucuacaauaaacaucaauacuucgacgucaaaguuuuuaaugaacgucauuaccaucgaggauuauaaaagcacauacuggcccaagcuggacggggcuauugaucagcuacucacucaaaguccgggagacuauaucccuauauccuacgagcagaucuauucuuguguguacaagugcguuugucagcagcauagcgaacaaauguauuccgaucugauuaaaaagaucaccaaucaccuugagcgcgugucaaaagaacugcaggccagucccccagacuuguacauugagcgauucaacaucgcacucggccaguacaugggcgcucugcagagcauagucccucuguuuauuuauaugaauaaguucuacaucgaaacaaaacucaaccgugauuuaaaggacgaucugauuaaguuguuuaccgagcauguggccgagaaacacaucuauucuuugaugccccugcuacucgaagcgcaauccacuccauuccagguaacacccucaaccauggccaauaucguuaaggggcuguacacgcuuagaccugagugggugcagauggcaccaacucuguuuagcaaauucauuccgaacauauugcccccugcugucgaaagugagcucucugaauaugccgcucaagaccagaaguuucagagggagcugauccagaauggauucacccggggugaccaaucccgcaaaagagccggcgaugaguuagcauacaacagcucgucugccugcgcuuccucaaggggguaucgguga

SEQ ID NO: 53744 - RNA, 558 nt, Artificial Sequence
  derived and/or modified sequence opt3 from CACYBP__Homo_sapiens__NP_001007215
augcagcaaaagagccagaaaaaggccgagcugcucgacaacgaaaaacccgcugcaguggucgccccuaucaccacaggcuacacuguuaagauuuccaauuaugggugggaucagucugacaaauucgugaagauauacaucacgcuuaccggaguacaccaggugccaacagagaacguccaagugcauuuuacugaaagaucauucgaucuguugguuaagaauuuaaacgguaaaaguuauagcaugauugugaauaaccugcuaaagccgaucuccgucgaggggucuucgaaaaaggugaaaaccgacacaguacucauucugugcaggaagaagguugaaaauacccggugggauuaccuuacucagguggagaaagaguguaaggaaaaagagaagcccucauaugacacagaaaccgauccuagcgagggccugaugaacgucuugaaaaagaucuacgaggacggagaugacgauaugaaacgcacgauaaauaaggcguggguggaaagucgagagaagcaggcuaaaggcgacacugaauuuuga

SEQ ID NO: 53745 - RNA, 6678 nt, Artificial Sequence
  derived and/or modified sequence opt3 from CAD__Homo_sapiens__NP_004332
auggccgcucuggugcucgaggacggcagcguccuuagagggcagcccuucggagcagccguuuccaccgcgggugaagugguauuucaaacaggcauggugggguacccugaggcucugacugauccaucuuauaaggcccagaucuuggucuuaacguacccgcugauuggaaacuauggcauacccccugacgaaauggaugaguucggucuaugcaaaugguuugaaucaagugggauccacguggcagcccucguugugggagaguguugcccaacccccagccauugguccgcuacaaggacucugcacgaguggcuucagcagcauggcauuccuggccugcaaggggucgacacccgggaauugacaaagaaacuccgcgagcagggaucucugcuggguaagcucgugcagaauggcaccgaaccaucgucauuacccuuccuggauccuaacgcacgaccacuuguaccggagguuagcaucaaaacuccccguguguuuaauacagggggagccccuagaauuuuggcucuggacuguggccuaaaguacaaccagaucaggugccucugucaacggggugccgaggucaccguggugccaugggaucacgcgcuggacagucaggaauaugaggggcuuuuccuguccaauggacccggcgauccugcaucuuacccaagcgucguuuccacguugucacgcgugcucagugaacccaacccgagaccuguauuuggcauaugccuggggcaucaguuacuggcccucgcuaucggagccaagacuuauaaaaugagguacgguaaucggggccacaaccagcccugucuucugguggggagcggacgcugcuucuugaccucucaaaaucacggcuuugcagucgagacagacucccuaccagcugauugggccccucuguucacuaacgcgaaugacgguucaaacgaagggauugugcauaauagccuccccuuuuucaguguucaguuucacccagagcaucaggccggccccucugauauggagcugcuuuucgacaucuuccuggaaaccgugaaggaggcaacagcuggaaacccuggcgggcaaaccguccgagaaagauugacggagaggcucuguccaccgggaauucccacuccugguuccggccugccacccccucggaaaguguuaauccuggggagcggaggccuaucgauaggucaggccggggaauuugacuacucuggcucccaggcuauuaaggcccucaaagaggagaauauccagacacugcuuauuaacccaaacaucgcaaccguacaaacuucacagggauuggccgauaagguuuauuuccugcccaucacaccgcacuacgugacccaggucauucguaaugaacgcccugacggcgugcuccugacguuugggggacagaccgcucuuaacugcggugucgagcugacaaaggcgggcguguuggcaagauaugggguuagggugcucggaacuccaguagaaaccauagagcugacagaagaucggcgagccuucgcugcccgcauggcagagaucggcgagcacgucgcccccagugaagcugccaauagcuuagagcaagcacaggcggcugccgaaagacuggguuacccugugcuaguuagggcagccuuugcucucgggggccugggauccggcuucgccucuaaccgggaggagcuuagcgcauugguggcucccgccuuugcgcauacuucacagguccugguggacaaaagucucaagggguggaaagaaauugaguaugaaguagugcgcgaugccuacggaaauuguguuaccgucugcaacauggagaaucuggacccauuaggcauccacacaggugaauccauagugguggcuccuagccagacccugaacgauagagaguaucaacuuuugaggcagacugcaauuaaggucacgcagcaucucgggaucguuggagagugcaaugugcaguacgcccugaaccccgaaucugagcaauacuauaucauugaagugaaugcucgucuaucacggaguagcgcccuggcauccaaagcgacaggcuacccacucgccuauguagcugccaagcuggcacuugguaucccguugccugagcugcgaaacucugucaccggcgggacugcugccuucgaacccucgguggacuacuguguugugaaaauuccaagaugggauuuaagcaaguuucucagggucuccaccaagauaggaucaugcaugaaaagugugggcgagguuauggggaucggacgcucuuucgaggaagcauuucagaaggcccugcggaugguggacgagaauuguguaggcuucgaucacacagucaaacccgugagcgacauggaacuugagaccccuacugacaagagaauuuuuguggucgcugcggcccugugggcagguuauuccguugauagguuguacgaacucacacgcaucgaccgaugguuccugcaucggaugaaacguaucauugcucacgcccagcuacuggagcaacacagagggcagccacuccccccugaucugcuucagcaggccaagugcuugggauucucagacaagcaaauagcucuggcaguguuaagcacggagcucgccguaaggaaacugcgccaggaacuuggcaucuguccggcggugaagcagauugauaccgucgcugccgaguggccagcacagacuaacuaucuguaccuaacauacugggguaccacacaugaccucacuuuucggaccccccacgugcugguuuugggcucugggguguauagaaucggauccagugucgaauucgauuggugcgccgugggcuguauucaacagcugaggaaaaugggguacaagacgaucaugguuaauuauaacccugagaccgugagcacagacuacgauaugugcgaccgauuauauuuugaugagauaucuuucgaagucguaauggacaucuacgagcucgaaaacccagagggagugauucuguccaugggcggucagcuucccaauaacauggcuauggcacugcaucgccagcaaugucggguuuuggggacuucaccugaagccaucgauagugcggagaauagauuuaaauucagcaggcuccuggacaccauuggaaucucgcagccgcaguggcgugagcuauccgaccuggaaucugcucgccaauuuugccagacagugggcuaucccugugucgugcggccaagcuacguacuuucaggugccgcaaugaacguggccuacacugauggcgaccucgagagauuccugaguuccgcugccgcagucucuaaggaacacccuguugugauaagcaaguuuauucaggaggcuaaagaaaucgauguggacgccgucgcguccgauggggugguugccgcaauugcuaucucagagcacguagagaaugccggagugcauagcggcgacgcuaccuuggucacgcccccacaggauauaacagcaaagacccuggaaaggaucaaagccauugugcacgccguugggcaagaguuacaggugacuggaccuuucaaccuccagcugaucgcuaaggacgaucagcuuaaagucauugaaugcaaugugcgaguaagucggucuuuucccuucgucuccaagacacugggcguggacuugguugcgcucgcaacccgcgugaucaugggugaggaagucgagccaguggggcugaugacuggaagcggcguugugggcgucaaggugccgcaauuuucguucucaagacuagccggggcugauguagugcugggaguugagaugaccucuacaggugaagucgccggcuucggggagaguaggugcgaagcauaucuuaaagccaugcucuccacgggauuuaagauaccuaaaaagaacauucuguugaccaucggcagcuacaaaaauaagucugaguuacugcccacugugcggcuccuggagagccuugguuauucccuguacgcuucauuggggacagcggacuucuauaccgaacauggagugaaagucacagccguagauuggcacuuugaggaagcaguggacggcgaguguccaccccagcgaaguauccuagaacagcuggcugagaagaacuucgagcucguuauuaaucugagcaugagaggcgccgggggacgcaggcuuucuuccuuugugacuaaggguuaccguacccggagauuagcagccgacuucucagucccucugaucauugauauaaaaugcacgaagcucuuuguggaagcuuugggccagaucgggccagcccccccucugaaaguucauguggacuguaugacaagucaaaagcucgucaggcugccgggacuuauugaugugcacguacaccugcgcgagccaggcgguacccauaaagaagacuucgcgagcgggacugcagccgcuuuggccggaggcaucaccauggugugcgcuaugcccaacacacgaccucccauuaucgaugcaccagcccuagcucuggcccagaagcucgcagaggcgggcgccagaugugacuuugcuuuauuccugggggccuccucugaaaaugcaggaacucuugguaccguugcuggcucggccgcagggcugaagcucuauuugaacgagacauuuagcgagcugcggcucgauucagucgugcaguggauggaacacuucgagacguggccuucccaucugcccauaguggcccacgcugaacagcaaaccgucgcggccguucuuaugguggcacagcuaacucagaggaguguacauaucugccacguggcucgcaaagaggaaauucuguugaucaaggccgccaaagcacguggauuaccagucacaugugagguggcuccucaccaucuguuccucucucacgacgaucuggagagacuuggcccggguaagggggaaguucggcccgagcugggaagcaggcaagacguggaagcccucugggagaauauggcggucauugauugcuuugcuuccgaccaugccccacacaccuuggaggaaaaauguggcucacgcccucccccaggcuucccugggcuggagacuaugcuaccccugcuccuuacagcaguaucugaaggacgacugagcuuagacgauuugcugcagagacuccaccauaacccgcggaggaucuuucaccugccaccucaggaggacaccuacguggaaguugaucuugagcaugaguggacgauacccagucacaugccauucuccaaggcccauuggacucccuuugaaggucagaaggugaaaggcaccguccgcagagugguccugaggggggagguggcuuacauugacggacaaguucucgugccuccgggcuauggucaggauguacggaaguggccccagggggcagugccacaguugccucccagcgccccugcgacaucugaaaugaccacuacaccagagcguccccgccgaggaaucccuggccugccagacggcagauuccacuuacccccgaggauccaccgggcuucagauccugggcuaccagccgaagagcccaaagagaaguccagucgcaaagucgcagaaccugagcugaugggaaccccagacgguacaugcuaccccccgccucccguuccaagacaagccagcccucagaaccucggcacucccgggcuucugcauccacagaccucgcccuugcugcacucucucgugggacagcauauucuguccguccaacaguuuacgaaggaucagaugagccaccuuuucaauguggcucacacacucaggaugaugguacaaaaggaacggucacuggacauauugaaaggcaaggugauggccaguauguuuuaugagguuucuacccgaacuuccagcucauucgcagcugccauggcgagacuggguggggccguguuaaguuuuagcgaagcaaccuccucuguccagaaaggcgagagccuagcugauuccgugcagacaaugucauguuacgccgacgucgugguucugcgccauccucagccaggagcaguagagcucgcugccaagcacugcaggcggccggugaucaacgccggcgauggggucggagaacaucccacucaagcgcuucuggacauuuucaccauccgugaggaauuggguacggugaauggcaugacaauuaccaugguuggggaccugaaacacggaagaacugugcauucucucgcuugccugcuuacacaguauagggucaguuuacgcuacguggcaccuccaucgcugcggaugcccccuaccguacgagccuuuguggcuagcagaggcacuaagcaggaggaguucgaauccaucgaggaagcccucccagauacagacguuuuguauaugaccaggauacagaaagagcgcuucgguucuacgcaagaauacgaggcauguuuugggcaguucauccugacuccccacauuaugacccgggccaagaagaaaauggucgugaugcacccuaugccgagagugaacgagaucucagucgaaguugauagcgacccacgugcugcguacuuuaggcaggccgagaauggcauguauauucggauggcacuacuggcuacagugcucggacgcuucuga

SEQ ID NO: 53746 - RNA, 1245 nt, Artificial Sequence
  derived and/or modified sequence opt3 from CADM1__Homo_sapiens__NP_001091987
auggccagcgugguccugcccuccggcucucagugcgcugcagccgcggcugccgcagccccuccagggcucagacuuaggcuguuguuacugcuauucucagcugcagcccucaucccgaccggagacggucaaaaccuguuuacaaaggauguuacugugauugagggcgaaguagcuacgauaaguugucaggugaauaaaagcgacgauuccgucauccagcuucugaaccccaaucggcagaccauuuacuuccgcgacuuucgaccuuugaaggauucucguuuccaacuccugaacuuuucgucaagcgagcugaaagugagucucacaaauguuuccaucucugacgaagggagauauuucugccaguuauacacugauccaccccaggagagcuauaccacaauuaccgugcuggucccuccaaggaaccuuaugaucgacauacagaaggauacugccguggaaggagaggagaucgaaguaaauuguacagcgauggcauccaaacccgccaccacgauucggugguuuaagggcaacacugaguugaaggguaaaucagaaguugaggaguggagugacauguacaccgugacaagccaacugaugcuaaagguccacaaagaagaugacggggugccugugaucugccaggucgagcauccagcuguuacuggaaaucuccagacccagcgcuaucuggaagugcaauacaagccgcagguacacauucagaugacauauccccuucaaggccugaccagagagggcgaugccuuggaacucacgugugaggcaaucgggaaaccucagccagugauggucacuugggugaggguugacgacgagaugccccagcaugcugugcugucuggaccuaacuuauucauaaauaaccugaauaagacagauaacgguaccuaccggugcgaagccuccaauauugucggcaaggcgcacucagacuacaugcucuauguguacgauagccgcgccggggaggaaggaaguauccgagcaguagaccaugcuguuauuggcgguguggucgccguggucguguuugcuaugcuuugucuguugaucauccuagggagauauuucgccaggcacaaaggaacuuacuuuacacacgaggcaaagggcgccgaugacgcugcggaugcagacaccgccauuauaaacgcugaaggcgggcagaacaauucugaggagaaaaaggaauauuucaucuga

SEQ ID NO: 53747 - RNA, 1308 nt, Artificial Sequence
  derived and/or modified sequence opt3 from CADM2__Homo_sapiens__NP_001161146
augaucuggaagagaagcgccgugcugagguucuacuccgucugcggccuccuucugcaggggucucaaggacaguuucccuugacccagaacguuacagugguagaggguggcacugcuauuuuaacgugucggguggaccagaaugauaacaccucacugcaauggaguaauccugcacagcagacacuauauuucgacgauaaaaaggcccuccgcgacaaccgaauagaacugguccgugcgagcuggcacgagcuuuccaucucugugucggauguuucacugagcgacgaagggcaguacacuugcaguuuguuuaccaugccagugaaaacauccaaggcuuaucucaccguccugggagugccggagaaaccccaaauuucuggcuucagcuccccuguaauggaaggugaucugaugcagcucacuuguaagacaucagggaguaagccagccgcagacaucagaugguuuaaaaaugauaaggagauuaaagacguuaaguacuuaaaagaggaagaugccaacaggaagaccuucacggugagcucuacucuggacuuucgggucgaucgcuccgacgacggaguggcugugaucugcagagucgaucaugagucacuuaaugcaacuccccagguugccaugcaaguguuggaaauacacuauacaccuagcguaaagaucauuccaaguacucccuucccucaggagggccagccacugauccuaaccugugagucuaaaggcaagccgcuccccgaaccugugcuguggacaaaagacgggggagagcuuccagaucccgacaggauggucguguccggucgggaacugaacauuuuguuucucaauaagaccgauaacggcacguaccgcugcgaggcuacuaauacaaucgggcagagcucggccgaauauguucugauagugcaugacgucccuaacaccuuacugccaacuacaauuauccccucucucaccacggcgaccgugacaacuaccguagcaauuacaacuuccccgaccacaucagccaccaccaguagcauccgagauccuaaugcucuugccggacaaaacggccccgaccacgcacugaucggugggauuguugcuguggucguguucgucacguuguguuccauauuucuacugggaagauaccucgccaggcauaaaggcacauaccugaccaaugaggcgaagggcgccgaggaugcaccagacgcugauacugccaucauuaacgcugaagggucucaggugaacgccgaggagaaaaaggaauauuucaucuga

SEQ ID NO: 53748 - RNA, 1197 nt, Artificial Sequence
  derived and/or modified sequence opt3 from CADM3__Homo_sapiens__NP_001120645
augggcgcccccgcugcaagccugcuccuucuguuguuacuguucgccugcuguugggcgccugggggagcuaaccuaucccaggacgauucucaaccauggaccucagacgagacaguggucgccgguggcacuguugugcucaagugccagguaaaagaucacgaagacaguagccugcagugguccaauccggcacagcaaacgcuuuacuuuggggagaagagagcccugagggauaaccggauccaguuggugaccucuacaccccaugaacucucgauuucaauaagcaaugucgcucuggcagacgagggagaauauacuuguaguaucuucaccaugccugugcgcacagccaaaucccugguuaccgugcucggcauuccacagaagcccaucauuacugguuacaaaucuagcuuacgagagaaggauacagcuacccugaacugccaguccucagggaguaagccugccgcgcgucuuacguggagaaaaggagaccaagaguugcacggcgaaccaacuaggauccaggaggaucccaauggcaagaccuuuacagucucuagcuccgugacuuuccagguaacccgggaagacgauggggcaucaauaguuuguagcgugaaccaugagagucugaaaggagccgaccgcucuacaucccagagaaucgagguccuauauaccccuacggcuaugauuaggccagauccgccccacccucgggaaggucaaaagcuccugcuucauugcgagggccgcgggaauccagugccccagcaguaccugugggaaaaagagggaagcgugccuccauugaagaugacucaagaaucggcccucaucuuucccuuccugaacaagucugacuccggcacauaugguuguaccgcaacuucaaauauggggaguuacaaggcuuauuacacauuaaacgucaaugacccgagcccuguucccuccucuagcucaaccuaccacgccauuaucggaggcauaguggcguuuauuguauuccugcuccuuaucaugcugaucuuuuugggccacuaucuaauucgacauaaagggacguaccugacccacgaggccaaaggaagugaugacgcaccagaugcugacacagccaucauuaacgcugaggguggccaguccgggggagaugacaagaaagaauauuucauauga

SEQ ID NO: 53749 - RNA, 1167 nt, Artificial Sequence
  derived and/or modified sequence opt3 from CADM4__Homo_sapiens__NP_660339
augggcagagccaggcgguuccaguggccccugcuccuucugugggcugcagccgcggggccuggagcuggucaagaggugcagaccgaaaacgucacaguugccgagggcgggguggcagaaaucacuugccgcuugcaccaguacgacggaagcauuguagugauacagaauccagcccgacaaacguuauuuuucaacggcacccgugcucugaaggaugagagauuucagcuagaagaguucuccccgaggcggguccgcaucagacucucugacgcaaggcuggaggaugaagguggguauuuuugucagcuuuacacagaggacacucaucaccagauugccacccugacaguguugguugcucccgaaaauccuguggucgaggugcgggagcaagccguagaaggaggcgagguugaacucucaugccuggugccacgcagucgacccgcggcaacccugagaugguauagggaucggaaagagcucaagggcgucagcuccucucaggaaaacgggaaaguguggucgguggccucaacuguccguuuccgcguugacagaaaggaugacggagguaucauuaucugugaggcucagaaucaggccuuaccuagcggccauaguaaacaaacacaguacgugcuggauguacaguauuccccaaccgcaaggauacacgcuucucaagccgugguccgggagggggacacgcuuguguugacuugcgcgguuaccggaaacccccgaccuaaucagauccgcuggaacagaggcaaugaaagccugccagagagggccgaagcagugggugagacacuaacucucccggggcuggucuccgcugauaacggaaccuacacaugugaagccucaaauaagcauggccacgcucgggcccuuuaugugcugguaguuuacgaccccggcgcaguggucgaggcccagaccagugugccuuacgcuauugucgggggaaucuuggcgcuccugguguuuuuaauuaucugcguucugguggguaugguaugguguagcguccgccagaagggcucuuaucucacgcacgaggcauccgggcuugaugaacaaggagaggccagagaggcuuuccugaacggcucagacggucauaaaaggaaggaagaauuuuucauauga

SEQ ID NO: 53750 - RNA, 3768 nt, Artificial Sequence
  derived and/or modified sequence opt3 from CADPS2__Homo_sapiens__NP_001009571
augcuggaccccagcuccucugaggaagagucagaugaaggccucgaggaagagaguagagacgugcuugucgccgcugggagcucccagagggcaccuccagccccgacccgggagggacgccgagaugcgcccggucgugcuggcgggggaggcgccgcaagaucuguuucgccuucaccaagcgugcugagugaagguagggacgagccccaacggcaguuggaugacgaacaggagcgcagaaucagguuacagcuguacguauucgugguccggugcauugccuauccuuuuaacgcuaagcaaccaacagauauggcacgccgacagcagaaacuaaauaagcagcaacuccagcugcuuaaagagagauuccaggccuuucugaacggggaaacucagauaguggcugacgaggccuucuguaaugcgguuagguccuacuaugaaguguuuuugaagucugaucgggucgcacguauggugcaaagcggaggcugcuccgccaacgacuuccgcgagguauuuaaaaagaauaucgaaaagagaguuaggucacuccccgagauugauggccugaguaaagagacggugcugagcucuuggaucgcuaaguacgacgccauuuaucgaggggaagaggaucucuguaaacagccuaaccggauggcauuauccgcugucucagaacugauccuuagcaaggagcaguuguacgaaauguuccaacagauacugggaaucaaaaagcuagagcaccagcuccuguauaaugccugccagcuugacaacgcggacgagcaagccgcacagauucgcagagaacuggaugguagguugcagcucgcugacaagauggccaaagagcggaaguuuccaaaauucaucgcuaaggauauggaaaauauguacauugaggaacugcgcaguucugugaacuuacugauggccaaucucgagucccuuccggugagcaaaggcgggcccgaguuuaagcugcagaaauugaagagaucgcaaaacucugcauuccuagacaucggagaugaaaaugagauacagcuguccaagucagacgucguucucaguuuuacccuggaaauugugaucauggagguacagggccuuaaaagcguggccccuaacaggauugucuacuguacaauggagguggaaggugagaagcugcagacugaucaagcugaagcgucccguccacagugggggacccagggagacuucacaaccacucauccccggccuguugugaaagucaaguuguucacagagucuaccggcgugcucgcacuggaagauaaagaguuaggccgaguaauccuguauccaacgagcaauucaaguaaguccgccgagcuacacagaaugguugugcccaagaacagccaggacucugaucucaaaaucaagcuggcugucaggauggacaaaccggcccauaugaagcacucaggguaccuuuaugcauugggacaaaaaguguggaagcgcuggaagaaacgguacuuuguccuggugcagguuagucaguauacuuucgccaugugcagcuacagagaaaagaaauccgagccucaagaacucaugcagcuggaggguuauaccguggacuacacagauccccauccaggccuucaagggggauguauguuuuucaacgcuguaaaggaaggcgacacugucauuuuugccucugaugacgagcaggauaggauacugugggugcaggcaauguaccgcgcgaccggucagucguauaaaccuguucccgcuauccagacacagaaguugaauccaaaagggggcacccuccacgccgacgcacaacuguacgccgaucgauuccagaagcacggaauggacgaguuuauuagcgcuaaccccugcaaguuagaucaugccuuccuguuucggauccuacagcgucagacgcucgaccacagacugaaugauuccuauucaugucuuggcugguucaguccugggcaaguguuugucuuggacgaauacugcgcaagguauggagugcgcgguugucaucggcaccugugcuaccucgcugagcugauggaacacucugagaacggcgccguaauagauccaacuuuacugcauuauagcuucgcguuuugcgccucccacgugcaugggaauagaccggacggaauuggcacaguuucagucgaagagaaagagagguucgaagagaucaaggaacgacuuagcucuuugcucgagaaccagaucucccacuuccgcuacuguuuucccuucggucggccugagggggcucugaaagcaacccuaagucugcucgaaagagugcugaugaaggacauugccacuccaauccccgcugaggaagugaaaaaggucguuaggaagugccuugagaaagccgcauugauuaauuacacacgucugaccgaauaugcgaagauagaggagacgaugaaccaggccagcccugcucgcaaauuagaagagauccuccaucuggccgaacuuuguauugaggugcugcaacagaaugaggagcaccacgcagaggcuuuugccugguggccagauuugcucgcagaacaugccgagaaguucugggcucuguuuaccguggacauggauacagcgcuagaagcccagccccaggacucuugggauuccuucccgcuguuucaacuccugaacaauuuccuucggaacgacacuuugcugugcaauggcaaauuucacaagcauuuacaggagaucuucguaccucucgucgugagauacguugaucugauggaaucaaguaucgcacagagcauucacaggggauuugagcaggagaccuggcaaccagugaacaauggcucggcuacauccgaagaccuuuucuggaagcuggaugcccuacagauguuugucuucgaccuccacuggcccgagcaggaguucgcccaucaccuggaacagcgauugaaacugauggcuucugauauguuagaggcaugugugaagcggacucgcaccgccuuugaacucaaacugcaaaaggcgagcaaaacaaccgaccuuagaauaccugcuucaguuugcacuauguucaacgugcugguagaugccaagaagcagaguacgaaauugugugcacucgacgggggacaggaguuugguucccaguggcaacaguaucauucuaagaucgacgaucugauugacaacagcgucaaagaaaucauuucccuacuggugucaaaguucgugagcguccuugagggcguucucaguaaacugucuagguacgaugaagggacauuuuucuccagcaucuugucguuuaccgugaaggccgcugcaaaguauguagacgugcccaaaccaggaauggaucuggccgacacuuacauaauguucguccggcagaaucaagauaucuuacgagagaaggugaacgaggaaauguauauugagaaacucuuugaccagugguacucaucuaguaugaagguuaucugcguguggcugaccgauagacuugaccugcaguugcacauuuaccagcucaaaacacugaucaagauagucaaaaagaccuaucgcgauuucaggcuacaaggcgugcuggaagguacucuuaauuccaagacauacgacacgguucaucgucggcucaccguggaggaagcgacugcuagcgucucugaagggggcggacugcagggcauuacaaugaaagacagcgaugaggaagaggaaggguga

SEQ ID NO: 53751 - RNA, 4062 nt, Artificial Sequence
  derived and/or modified sequence opt3 from CADPS__Homo_sapiens__NP_003707
augcuggaccccagcuccucugaggaagagucagaugaaaucguggaggaagagaguggcaaggagguccucgggagcgccccuuccggagcuagacuuucuccaucgaggaccucagaagguagcgcaggcagugccgggcugggaggcgguggggcgggagcuggcgccggcguuggggcaggagguggcgggggauccggcgccucuagcggugggggagcuggcggcuugcagccguccucacgggcagggggaggucgccccaguagcccuucuccauccgugguaucagagaaagaaaaggaggaguuagaacgacugcaaaaagaggaagaggaacguaagaaaagacuacagcucuacguguucgucaugaggugcauugccuaucccuuuaacgcuaagcagccuacagacauggcccggcgccagcaaaagauaagcaaacagcagcugcagacugugaaggauagauuccaagcguuucuuaauggcgagacgcagaucauggcagacgaggccuucaugaacgcuguucagaguuacuaugaaguguuucugaaaucugauagggucgcccggauggugcaguccgggggauguagcgcaaaugacucgcgcgagguauucaagaaacacauugaaaagcgaguuagaucuuugccagagaucgauggccucuccaaggaaaccgugcugucaaguuggauggcuaaauuugacgccauuuacaggggugaggaggauccccggaagcaacaggcgcguaugacagccagcgcagcuuccgaacugauccucucuaaagagcaguuauaugaaauguuccaaaacauacuggggaucaagaaauuugagcaucagcuuuuguacaaugccugccagcuggacaacccugaugaacaggcugcccaaauucgcagagagcuagacggcaggcuccagauggcagaucagaucgcccgggagcgaaaguucccaaaauuugucagcaaggaaauggagaauauguauauugaggagcugaagucaagugugaaccuucugauggcuaauuuggaguccaugccggugagcaaaggaggcgaauuuaagcuccagaaacugaagcgcucucacaacgcgucaaucauagacaugggggaggaaagugagaaucaauuaagcaaauccgacgucguucugucuuuuucgcucgaagugguaauuauggaggugcagggacuuaagagccuggcacccaacagaaucgucuacuguacuauggagguggaagguggcgagaaguugcagaccgaucaggccgaagcauccaaaccuacaugggggacccaaggagacuucucaacuacacaugcccuaccagcaguuaaggugaaacuguucaccgagaguacgggcguccucgcccuggaagauaaggagcuugguagggugauucugcaccccacuccuaauucuccaaaacagagcgaguggcauaagaugaccguauccaagaacugccccgaccaggauuugaaaaucaagcucgcuguucggauggacaaaccgcagaauaugaagcacucaggguaccugugggccaucggcaaaaacguguggaagcgcuggaagaaaagauuuuucgucuuagugcaagucagccaguauacauuugcaauguguucuuacagggaaaagaaagcggagccucaggaacugcuacaacucgauggauauacuguggacuacaccgauccccagccaggccuggaagggggacgugcuuucuuuaacgccguuaaggaaggugacacagugauuuucgcauccgaugacgagcaggaccggauacuuuggguacaggccauguaucgagcuaccggccaaagucacaaaccugugcccccaacucagguccagaaguugaaugccaaagggggaaacguuccccagcuggaugcaccuaucagccaauuuuacgcugacagagcccagaagcauggcauggaugaguucauuucuuccaauccaugcaacuuugaccacgcgucacucuucgaaauggugcagaggcugacgcuugaucaucgccugaaugacaguuauagcuguuuggguugguuuucgccggggcaggucuucgugcucgaugaguacugcgcccggaacggcguaagaggaugucacaggcaccugugcuacuuacgcgaccugcuagaacgagcugagaauggcgcaaugaucgaucccacacuccugcauuauuccuuugccuucugugcuucucacgugcaugggaaccggccugacggaauaggcaccguuacugucgaggaaaaggagcguuucgaagagauuaaagaaagacuuaggguguugcuggagaaucaaaucacacacuuucgcuacugcuucccauuuggucggcccgagggggcccucaaggcaacccugagcuuacuggaaagagugcuuaugaaagauaucgucacgccuguuccacaggaggaagugaagaccgugauuaggaaaugcuuggagcaggcggcccucguaaacuauucacgacugagugaauacgcuaagaucgaggagaaucaaaaggacgccgaaaacgucggacgccuaauuacacccgcuaaaaagcuggaggauacuauacggcucgcugaacuggugaucgagguucuucagcagaaugaggaacaucacgccgagccgcacguggacaaaggcgaagcauucgccuggugguccgacuugauggucgagcaugcugaaaccuuucugucuuuauucgcgguggauauggacgccgcacucgagguucagccuccagauacaugggacagcuuuccccuguuccaacuucugaacgauuucuugagaacugacuauaaucucuguaacgguaaguuccacaaacaucugcaggaucuauuugcuccucuggugguaagguacgucgaccucauggaguccucaauugcccagagcauccaccguggcuucgaacgcgagaguugggaacccgugaagucucugaccuccaaccuuccaaaugugaacuugccuaaugucaaccugcccaagguuccaaauuuaccggugaacaucccucucgggauuccccagaugccaacauuuagcgcccccucguggauggcugcaauauaugaugccgacaauggaucaggcaccucugaggaucuguucuggaaacuugacgcgcugcaaacuuucauccgggaucuacacuggccugaagaggaguuugggaagcaucucgaacagagacugaaauugauggcuagugacaugauugaguccugcguaaagaggacgcgaaucgccuucgaagugaaacugcagaagacaagccggucuaccgacuuucgcgucccacagagcauuuguacuauguucaacgugaugguugaugcaaaggcccaauccaccaaauuaugcucaauggagaugggacaggaacaccaguaccauaguaagaucgacgagcucauagaggaaacagugaaagagaugaucacccugcuugucgcuaaguuugugacuauucuggaaggcguuuuggcaaaacucagcagauacgaugaggguacacuguucucuuccuuucuaucauucacggugaaggccgcgaguaaauaugucgacguacccaagccugggauggauguggcugacgccuacguuaccuuugugaggcacagccaggauguccugcgggacaaggugaaugaagagauguauaucgagcgacuuuucgaucaaugguacaacuccucuaugaauguaauuuguacuuggcucacagacagaauggaucugcaguugcauaucuaucagcugaaaaccuuaauacgcauggugaagaaaacauacagggacuuucgucuccaaggaguccuggacucgacucuuaacagcaagaccuaugaaacgauucggaauagacugaccguugaggaagcaacagccucaguguccgagggcgguggcuugcaggggaucaguaugaaagauucugacgaggaagaugaggaagacgauuga

SEQ ID NO: 53752 - RNA, 2520 nt, Artificial Sequence
  derived and/or modified sequence opt3 from CAGE1__Homo_sapiens__NP_001164163
augaacaaggacuaccagaaauucuggagcucccccucugauccugugcacuuugaggucgacaccucacaugaaaagguugagaguaugagcgaauccgauacaaugaaugugucuaaccugucgcaaggcguaaugcucucacacagcccaaucugcauggagacuacggggaccacaugugaccuuccgcagaaugaaauuaaaaacuucgagagagagaaugaauaugagaguacucugugcgaagaugccuacggaaccuuggacaacuuacugaaugauaacaauauagagaacuauuccacaaaugcucuaauccagcccguggacaccauuucuaucagcucccucaggcaguuugagacugucuguaaguuccauuggguggaagcauuugaugacgagaugacagaaaaaccugaguuccaaucacagguuuacaacuaugccaaggauaauaacauuaagcaggacaguuuuaaagaagagaauccaauggagaccagcgugucugcgaacacggaucagcuggguaacgaauacuuccggcaacccccuccacgcucacccccucuuauccacugcucaggcgagaugcugaaguuuacugaaaagagcuuggcuaagaguauagccaaagagucugcacucaauccaucccagccgcccagcuuccuguguaagaccgccgucccuucgaaggaaauccagaacuauggggagauuccagagaugucuguguccuacgaaaaagagguaacagcugaaggaguugagcgacccgaaaucgugucaacuuggaguagcgcaggcauuuccuggcguucugaggccugcagagagaauugugaaaugccugacugggagcagagcgcugaaucacugcaaccaguccaggaggacauggcccucaacgagguguuacagaagcugaaacauaccaauaggaagcaagaagugcggauccaggagcuucagugcaguaacuuguaccuggaaaaacgcgucaaggagcuacagaugaaaauaacaaagcaacagguuuuuauugaugugaucaauaagcucaaagaaaacguagaggagcugauugaagacaaguauaaaaucauccuugagaagaaugauaccaaaaagacgcugcagaacuuggaagaggugcucgcgaauacucagaagcaucugcaagaauccagaaacgacaaagagauguuacagcugcaguucaagaaaauuaaggcaaauuacgucugucuccaggagagguauaugacagaaaugcaacagaaaaacaagagcgugucucaguaccuugagauggauaagacccuguccaaaaaggaagaggaaguugagcgguugcagcaacugaaaaaggagcuggaaaaagccacugcuagugcccucgaccugcuuaagcgcgagaaggaagcacaggagcaggaguuucugagcuugcaagaagaguuccagaaacucgaaaaggagaaucuggaagaacgacagaaauuaaaguccagacuggagaaacuacucacacaggugaggaaccugcaauucaugucugaaaacgagcggaccaagaauauaaaacuucagcagcagaucaacgaagucaagaaugagaacgcuaaguugaaacaacagguggcccguucggaggagcagaauuauguacccaaguuugagacggcgcagcugaaagaucaacucgaagagguucuaaagagcgacauuaccaaagauacaaagacuacccacuccaaccuucugccggacugcucaccuugugaggaacgcuugaaucccgccgauaucaagagagcaagucagcucgcuucuaaaaugcacagccuguuagcccugauggugggucuacucacaugccaggacauaauuaacuccgacgcugaacacuucaaggagucagagaaagucagcgauaucaugcugcaaaaacuuaaaucuuugcaucugaagaagaaaacucucgacaaggaacuguuaaaacacaaggauaggaucaccacauuucgggagcugauugccaaagaaaaggcauuccaggaccacgccaucaaggugauugauugcgacuccgaugaggcuaaaaguauacgagacgucccaacccuuuugggggcgaagcucgauaaauaccauagccugaaugaggaacuagacuuucugaucacuaagcucggacaucugcuugagucuaaagaaaaccacuguaaucgcuugauugaggaaaacgauaaguaucagagacaccugggcaauuuaaucaaaaaggugacguccuacgaggagaucauugaaugcgcagaccagaggcucgccauaucacauagucaaaucgcucaccuggaggaacggaacaagcaccuugaggaucugauucgcaaaccuagagaaaaggccaggaaaccccguagcaagucguuggagaaucauccaaaauccaugacaaugaugcccgcacucuucaaggagaaccggaacgaccuggacuga

SEQ ID NO: 53753 - RNA, 786 nt, Artificial Sequence
  derived and/or modified sequence opt3 from CALB1__Homo_sapiens__NP_004920
auggccgagagccaucugcaguccucucucaucaccgcuucacaauucuuugaaauuuggcuucacuucgacgcagauggcaguggguaccuggagggaaaggaauugcagaacuuaauacaggagcugcagcaagccaggaaaaaggcgggucuagaacucagccccgagaugaaaacauuuguggaccaguauggccagagagaugacgggaagaucggaauugucgagcuggcucacguucuuccuacugaagagaauuuccuguugcucuuucggugccagcaacugaaauccugugaagaguucaugaagacguggcgcaaguacgauaccgaccauucuggcuuuaucgagacagaagaacugaaaaacuuccucaaggauuuacuggaaaaagccaauaagacuguggacgauaccaaacuugcagaguauacagacuugaugcugaagcuauuugauucgaacaaugacgguaagcucgaacugaccgagauggcccgacuucugccaguacaggagaacuucuugcucaaauuucaggggauuaagaugugcggaaaagaguucaauaaggcuuuugagcuguacgaucaggacggcaacggcuauaucgacgaaaaugaguuagaugcacugcucaaagaccuuugugaaaagaacaaacaagaucuggacauaaauaacaucacuacauacaagaagaauauuauggccuugucagaugggggaaaacuauaucguaccgaccuggcucucauccugugcgccggugauaacuga

SEQ ID NO: 53754 - RNA, 816 nt, Artificial Sequence
  derived and/or modified sequence opt3 from CALB2__Homo_sapiens__NP_001731
auggccggcccccagcaacagccuccauaccugcaccucgcugagcuuaccgcaagccaguuccuggaaaucuggaagcauuuugacgccgaugggaacggauauauugaggguaaagaauuggagaauuucuuucaggaauuagagaaggcgagaaaaggcuccgggaugaugucuaagucagacaacuucggagagaaaaugaaggaauuuaugcaaaaguacgauaaaaauagugacggcaagauagagauggcugaacuggcccagauccuaccgacagaggagaacuuccuccugugcuuuaggcagcacguggguagcuccgcagaguucauggaagccuggcggaaauaugauacugaccgcucuggguacauugaagcuaaugagcuuaagggauuucugucggauuugcucaaaaaggcaaaccgacccuaugacgaaccuaagcugcaggaguacacgcaaaccauccugcguauguucgaucucaauggcgacggcaaauuagggcugucagagaugagcagacuuuugccaguccaggaaaacuuucugcuaaaguuccagggaaugaaacucacaagugaggaauuuaaugccauuuucacuuucuaugauaaggacagguccgguuacaucgaugagcaugaacuggacgcccuucugaaagacuuguacgagaagaacaaaaaggagaugaauauacagcaacucaccaacuaucggaagucuguuaugagccuggcugaagcgggcaaauuauaccgcaaggaucuggagaucgugcucuguuccgaacccccuauguga

SEQ ID NO: 53755 - RNA, 387 nt, Artificial Sequence
  derived and/or modified sequence opt3 from CALCA__Homo_sapiens__NP_001029125
augggcuuccagaaguuuagccccuuccuggcccucuccauccuugugcuguugcaagcugggucuuuacacgcagccccuuuuagaucagcgcuggagaguagcccagcugacccggccacccuauccgaagaugaggcaaggcuccugcuugccgcucugguccaggacuacguucagaugaaagcaucugaauuggagcaggaacaagagcgggagggaucgcgcauuauagcccagaagcgagcuugcgauacagccacuugugugacgcaucgucucgcgggucugcugucaagaagcggcgggguagugaaaaacaauuucguccccaccaacgugggaaguaaggcauuuggcaggcggcgcagagaccuccaggccuga

SEQ ID NO: 53756 - RNA, 384 nt, Artificial Sequence
  derived and/or modified sequence opt3 from CALCB__Homo_sapiens__NP_000719
augggcuucagaaaguuuagccccuuccuggcccucuccauccuugugcuguaccaggcugggucuuugcaagcagccccuuuuaggucagcguuagagaguagcccagacccggcuacccuguccaaagaagaugcccggcuacuccuggcagcccuuguccaggacuauguucagaugaaggcuucugagcugaaacaggaacaagagacacagggaucgucaagcgcagcccagaagcgcgcuugcaacacugccacgugugugacccaccgauuggcgggucuccugagucguuccggcgggaugguaaaaucuaauuucgugcccacaaacgucggaagcaaggcauuuggcagaaggcggcgcgaucugcaggccuga

SEQ ID NO: 53757 - RNA, 1821 nt, Artificial Sequence
  derived and/or modified sequence opt3 from CALCOCO1__Homo_sapiens__NP_001137154
auggaggaaagcccccuguccagagccccuucuaggggcggggugaacuuccucaaugucgcucggaccuacaucccaaacacaaagguugagugccacuauacucuuccgcccggaacgaugccuucagcaagugacuggauugguauauuuaaaguggaagccgcguguguacgcgauuaccauaccuucguguggagcuccgucccagagucuacaacugacggcucgcccauccacaccucagugcaguuucaagaaccucgaccaauggaugagcugguuacauuggaggaagcugacgggggaagcgauauuuuacuggugguccccaaggccaccgugcuacagaaucagcucgacgagagucagcaagaacguaacgaucugaugcagcuuaaacugcaguuggagggccagguaacugagcucagauccaggguucaagaacuggagcgggcacuggccacagcucgccaggaacauaccgagcucauggaacaguauaaggguaucucuagaagccacggggagauuacggaggaaagggacaucuuaucccggcagcaaggagaucauguggcacgcauacuggagcuugaagacgauauccagacuauuucagagaaagucuugaccaaggaaguggagcuggaccgacuaagagauacagugaaggcccucacuagggagcaggaaaaacugcuuggccaacugaaggagguccaggcugacaaagaacagagugaggccgaauuggagccucucaaggagcagcugcggggcgcgcaagaauuagcagccagcucucagcagaaagcuacccugcucggggaggaacuugccuccgcagcugccgcgcgugaccgcacaaucgccgagcugcacagaucaagguuggagguugcagaagugaauggacggcuagcugagcugggucuccaccugaaggaagagaagugccaguggagcaaagaacgagccggccuucugcaaaguguagaggcugagaaggauaaaauuuugaagcucucugccgaaauccugcgcuuagagaaagcagugcaggaagagagaacccagaaccaggucuucaagacggaacuggccagggagaaagacuccagccuagugcaacucucggagucuaagcgggaacugacugagcuucgcuccgcuuugagaguucugcagaaggaaaaagagcagcuccaggaagagaagcaagagcugcuugaauacaugaggaaacuggaggcgcguuuggaaaagguggcagaugagaaauggaaugaggacgccacaaccgaagaugaggaagcugccgucgggcucucauguccagcagcccugacugacagugaggaugaaagcccggaggacaugcgguuacccccuuauggacugugcgagcgaggcgauccagguuccucucccgcugggccuagagaagccagcccccuagugguaauaucacagccagcaccgauuaguccucaucucuccggacccgcggaggacucuagcucagauagugaagcugaggacgaaaagagcguucugauggccgcagugcaguccggcggcgaggaggccaaccuuuugcugccagaacucgggucugcuuuuuacgacauggccucgggauucacagucgguacccugagcgagacguccaccggcgggccugcaacacccacuuggaaggaauguccaaucugcaaagagagguuucccgcugaaucagauaaggacgccuuagaggaucacauggacggacauuucuuuuucaguacccaagauccuuuuacauucgaguga

SEQ ID NO: 53758 - RNA, 1413 nt, Artificial Sequence
  derived and/or modified sequence opt3 from CALCOCO2__Homo_sapiens__NP_001248319
auggaggaaaccaucaaggaucccccuacaagcgccgugcugcucgaccacugccauuucucccaggucauuuuuaacucuguugagaaauucuacauaccaggcggggacgugacuugucacuauacguuuacccaacauuucaucccgagaaggaaggauuggauuggaaucuuucgggcuuucaaaugcuuucaggacaaacuugaacaggagcuguugaaauggcgcucacagggucaaaaguuacagguaggcuggaagacaacucgagaauacuauaccuucaugugggugacacugcccauugaucuaaauaacaaaagugcaaagcagcaggagguccaauuuaaagccuacuaucucccuaaggacgaugaguacuaucaguucuguuacguggacgaagaugggguugugcguggagcgagcaucccauuucaguucagacccgagaaugaagaggacauacuggucgugaccacucagggcgagguagaagagaucgaacaacacaacaaagagcuuugcaaggaaaaucaggagcugaaggauuccuguauuucuuugcagaaacaaaacucggacaugcaggcugagcuccagaagaaacaggaggaacuggaaacacugcaaucaaucaauaagaaacucgaguuaaagguuaaagaacagaaggauuacugggagaccgagcugcuucaguugaaggaacagaaccaaaagaugagcagugagaaugaaaagauggguauuaggguggaccagcugcaggcccagcuauccacgcaagagaaagaaauggagaagcucguccagggggaccaggauaaaacugagcagcuggaacaacuuaagaaggagaacgaccaucuguuuuugucucucaccgaacagcggaaagaucagaagaaacuggagcaaacaguggagcagaugaagcagaaugaaacuaccgcaaugaaaaagcagcaagaguuaauggacgaaaacuucgaucugagcaagcgccucuccgagaaugaaaucauaugcaacgcccuucagagacagaaagagaggcuggagggagaaaaugacuugcuaaagcgggagaacucacgccugcucaguuauaugggccuggauuucaacagccuuccuuaccaggugccaacaucugacgaaggcggggcucgacaaaaucccggacuggcauaugguaacccuuacuccggcauucaggagucaagcaguccaucuccguuguccaucaaaaagugucccauuugcaaagccgaugacaucugugaucacacccucgaacagcagcaaaugcagccucugugcuuuaauuguccaaucugcgacaagauuuuccccgcuacggagaagcagauauuugaggaccacgucuucugccauagcuuauga

SEQ ID NO: 53759 - RNA, 1527 nt, Artificial Sequence
  derived and/or modified sequence opt3 from CALCR__Homo_sapiens__NP_001158209
augcaguucagcggcgagaagaucuccgggcaaagagaccugcagaaaucuaagaugagguuuaccuucacaucacggugccucgcccuuuuucuguuguuaaaccaccccacuccuauucugccagcuuucaguaaucagacguacccgaccauagaacccaaaccuuuucuauauguggucggacgcaagaaaaugauggaugcacaguacaaguguuaugaccgaaugcaacagcucccagccuaccagggugagggccccuauugcaaccguacaugggauggguggcuguguugggacgauacuccugcgggaguucuuagcuaccaguucugcccagacuauuuucccgauuucgacccuuccgaaaaggugaccaaauacugugaugagaagggcguaugguuuaaacauccagaaaauaacagaacauggucuaauuacaccaugugcaacgcuuucacuccggagaagcugaaaaaugccuauguguuguacuaucucgcaaucgucggucacucgcugucaauuuuuacacuggugaucagccucgggauuuucguguuuuucaggaaguuaaccacgaucuucccccugaacuggaaguaccggaaagcccuuaguuugggaugucaacgcguuacucugcauaagaauauguuucuaaccuauauacucaacuccaugaucauuaucauucaccuggucgaggugguaccuaauggcgaacuuguuagaagggacccagugucuugcaaaauccugcauuucuuucaccaguacaugauggcuuguaacuauuucuggauguugugcgagggcauauaccuccacacacugauugucguggcaguguuuacugaaaagcagcgguuacgcugguacuaucugcucggguggggauucccccuugucccuaccacaauccaugccauuacccgagcuguuuacuuuaaugauaacuguuggcugagcguggagacgcacuugcuauauaucauccaugguccaguaauggccgcgcugguggucaauuucuuuuuccuccugaacauugugagaguucuugugacuaaaaugagggagacacacgaagcagagucccacauguaccugaaggccgucaaagcuaccaugauauuggugccccuccugggcauccaguuuguaguuuucccguggcggccuucaaacaagauguuagggaagauuuaugacuacgugaugcauagucugauccacuuucaaggauucuucgucgccacuauauauugcuuuugcaauaacgaagugcagacaaccgucaaacgucagugggcacaauucaagauucaguggaaucagcgcuggggcagaaggcccagcaaccggucugcucgagccgcggccgcagcugccgaggcuggugauaucccaaucuacauuugucaucaggaacuacgcaaugagccugccaacaaucaaggggaggaauccgcagagaucauuccccucaacauaaucgaacaggagucaagcgccuga

SEQ ID NO: 53760 - RNA, 1386 nt, Artificial Sequence
  derived and/or modified sequence opt3 from CALCRL__Homo_sapiens__NP_005786
auggagaagaaaugcacccuguacuuccucgugcuucugcccuuuuucaugaucuuggucacagccgaauuagaggaaagcccugaggacuccauucagcugggcguuacuagaaacaagauaaugacggcucaauaugaauguuaccagaaaaucaugcaggauccaauucagcaagcagaggggguguauugcaauaggaccugggacggauggcuauguuggaacgauguagccgcggguacagagucuaugcagcucugcccggacuacuuucaggauuucgaccccucagaaaaggugacuaaaaucugugaucaggacggcaauugguuucggcacccugcuaguaaccgcaccuggacaaauuauacccaaugcaacgucaauacucaugagaaggugaagacagcccugaaccuuuucuaccugaccauuaucgggcacggauugagcauagcaucccuccugaucucucugggcaucuuuuucuauuuuaaaucgcucucaugucagcgaauuacguuacauaagaaucuguucuuuagcuucguuugcaacaguguggucacuauuauccaccuuaccgccguggcuaauaaccaggcauugguagccacaaauccaguuuccuguaaagugucucaguuuauacaucuguaccuaauggguugcaacuacuucuggaugcucugugaagggauuuaucugcacacucuuaucgucguggcuguguucgccgagaagcaacaccugaugugguacuacuuuuugggauggggcuucccccucauuccugcgugcauccaugcaaucgcccguagccuguauuauaaugauaacugcuggauuuccucagacacccacuuacuguacauaauccauggcccaauuugugcugcccuccuugucaaccuguuuuucuugcuaaauaucguuagagugcugauaacaaaacucaagguaacccaccaggcagagaguaaccuguauaugaaggcugugagggccacgcuuauucugguccccuugcucgggaucgaauuugugcugaucccuuggcggccagagggaaaaauugcggaagagguuuacgauuacaucaugcacauuuuaaugcauuuccagggucugcuagugagcacuauauuuugcuucuuuaauggcgaaguccaagccauccuccgcagaaacuggaaucaguauaagauucaguucgggaacucuuuuuccaauucagaggcacugaggagcgcuaguuacacagugucuaccaucuccgacggaccgggcuauagccacgauugucccucggagcaucuuaacgguaaaucuauccacgacauugaaaauguauugcugaagccugagaaccucuacaauuga

SEQ ID NO: 53761 - RNA, 1617 nt, Artificial Sequence
  derived and/or modified sequence opt3 from CALD1__Homo_sapiens__NP_004333
auggacgauuucgagagaaggcgggaacugcgccgacagaagcgugaggaaaugagacucgaggccgaaaggaucgcuuaccaacggaacgacgaugacgaggaggaagcagcccgcgagagaaggcggcgcgcgcgacaggaaagacuuaggcagaaacaggaggaggaaagccugggccaagugaccgaucaggucgagguuaaugcucagaacuccgugcccgacgaagaggccaagacaacuacgaccaauacacagguagaaggggaugacgaggcagccuuuuuggagcgguuagcucgucgcgaagagagaaggcaaaaacggcugcaggaagcacuagagcgacagaaggaguucgauccuacuauuaccgacgccucucucucacugccaagucgcagaaugcagaacgauacagcugagaaugagaccacugaaaaagaggaaaagagcgaguccaggcaagaacgguaugagauagaggaaacagagaccgugacgaagucuuaccagaaaaacgacuggcgcgaugccgaagagaauaagaaagaggacaaggaaaaagaggaagaggaagaggagaagccgaagagaggaucgaucggugaaaaccagauuaaagacgagaagaucaaaaaggauaaagaacccaaggaggaagucaaaucauuuauggacaggaagaagggcuucacugaggugaaaagccaaaauggggaguuuaugacccacaaacuuaaacauacagaaaacacuuucagucguccuggaggccgggcguccguugauaccaaggaggcagaaggugccccacagguggaggcugggaaacgacuggaagaguugagaaggcgccggggagagacagaaucugaggaauuugagaagcucaagcagaaacagcaagaggccgcacuggaacuggaggaacucaagaaaaagagagaggaaaggcgcaaagucuuagaggaggaagaacagcgacggaagcaggaagaggcugaccguaagcugagagaagaggaggaaaagaggcgccuuaaggaggaaauugagcggagaagggccgaagcggccgagaaacgacagaagaugcccgaggauggcuugagcgacgauaaaaagccuuucaagugcuuuaccccaaaaggcuccucacugaagaucgaagaacgcgcagaguuccuaaauaaaagugugcaaaagagcucugggguaaaauccacgcaccaggcugccauaguuucaaagaucgacagccggcucgagcaguauacaagugcuauugagggaacuaaaucugccaagcccaccaagccugcagccuccgaucugccagugccggcugaaggugucagaaacaucaaaagcaugugggagaagggcaauguguuuucgucucccacugcggcagggacaccuaacaaagaaaccgccggacuuaaggugggcgucuccucaaggauuaaugaguggcugacgaaaaccccagacgguaacaagagucccgcuccuaagccaagcgauuugcgucccggggacguuuccucuaaacgcaaccucugggaaaagcagagcguggacaaaguaacaucaccgacuaagguguga

SEQ ID NO: 53762 - RNA, 1041 nt, Artificial Sequence
  derived and/or modified sequence opt3 from CALHM1__Homo_sapiens__NP_001001412
augauggacaaguucagaaugaucuuucaguuccugcaaagcaaccaggaguccuuuaugaauggcauuugcgggauaauggcccucgcuucugcacagauguacucagccuucgauuuuaacugucccugccuuccuggauauaaugcggcuuacagugccgguauccuguuggcaccaccguuagugcuguuccuacucggccuggucaugaacaauaacguuagcaugcuugccgaagaguggaaaaggccccuggggcggcgcgcuaaggacccugcaguguugcgauauauguuuuguuccauggcccagcgugcucucauugccccaguagugugggucgcggugacccugcuggauggaaaaugcuuccucugugcauuuugcacagccguucccgugucugcuuuaggcaaugguucgcuggccccugggcuuccagcacccgaauuggcuagacugcuagccagggucccuuguccagagaucuacgacggagauuggcuccuggcgcgggaaguggccguacgcuaucuuagaugcauuucacaagcacugggcuggagcuucguuuugcucacuacgcuguuagcuuuuguggucaggagugugcggccguguuucacccaggccgcuuuucugaaguccaaauacuggucucacuauaucgacauagagcgcaaacucuucgaugagacaugcacugaacaugccaaggcauucgccaagguguguauccagcaguuuuucgaggcuaugaaccacgaccuugaacugggccauacccacgggacauuggcgaccgcacccgccagcgcugccgcaccuacuacaccagauggagccgaggaggaacgagagaagcuaagagguauuaccgaccaaggcacgaugaauaggcugcucacuuccuggcauaaaugcaagcccccucugcggcuugggcaggaggaaccaccccugaugggaaacggcugggcuggugggggaccgcguccuccccgcaaagaagucgccaccuacuuuucaaagguuuga

SEQ ID NO: 53763 - RNA, 972 nt, Artificial Sequence
  derived and/or modified sequence opt3 from CALHM2__Homo_sapiens__XP_006717946
auggccgcucugaucgcagagaacuucagauuucucagccuuuucuuuaaguccaaagacgugaugauuuucaauggccuggucgccuuggggaccguuggaucucaggaauuauuuucagugguagcguuccacugccccuguaguccugcuaggaacuaccuguauggucuagccgcaauaggcgugccagcccucguccuguuuaucauugggaucauucuuaauaaccauacauggaaucugguggcugagugccaacaccggcgcacuaagaacuguagcgcagccccgacguucuugcuccuguccucuauccugggacgagcugccguugcgcccgugaccuggucggucauaucacucuuacguggcgaagcauacgugugcgcccugagcgaguuuguagauccuaguucccuuacagcuagagaagaacauuucccaucugcccacgcaacugagaucuuggcuagguuucccuguaaagaaaauccugacaaccugagcgauuuccgggaggaaguuucccgcagacuaagguaugagucacagcucuuugguuggcugcuuauugggguggucgccauccugguguucuugaccaagugccucaaacauuacuguaguccacugagcuaucggcaggaggcguacugggcccaguaucgcgcaaaugaagaccaauuauuccagcgaacagcugaggugcacucuagaguccuggccgcuaacaauguuaggcgguuuuucggauuuguggcccucaacaaggaugacgaggagcuuauugcaaauuuccccguagaaggcacccagccucguccacaguggaacgccaucacuggcguguaccuguaccgcgagaaucaaggguugccgcuauauuccagacugcacaagugggcucagggacucgcggguaacggcgcagcccccgauaacgucgagauggcucugcuuccuucauga

SEQ ID NO: 53764 - RNA, 1035 nt, Artificial Sequence
  derived and/or modified sequence opt3 from CALHM3__Homo_sapiens__NP_001123214
auggacaaguucagaaugcuguuucagcacuuccaaagcuccucugagucagugaugaacggcaucugccuccuucuggccgcugucaccguuaaauuguacaguagcuuugauuucaauugucccugcuuagugcauuauaacgcacuguacgggcuaggacuccugcuuacaccuccacuggccuuguuucucuguggucugcuggcgaauaggcaguccguagugauggucgaagaguggcggcgcccggcuggccaccgacguaaggaccccgggauuauaagauauauguguucuucggugcuccagagggccuuagcagccccucugguuuggauccuuuuggcucugcuagauggaaaaugcuucgugugcgcauuuucaagcagugucgacccagaaaaguuccucgauuuugccaacaugacucccucccaggugcaacuguuccuugcuaaaguaccuuguaaggaggacgaacugguucgggauucuccagcccgcaaggcggugagcagauacuugaggugccucucccaggcaauuggcuggucagucacgcuguuacugaucauugccgcuuuucucgcccggugucuucgccccugcuucgaccagaccguguuucugcagcgaagauauuggaguaauuacguggauuuggagcaaaaacuauucgacgagacauguugcgaacaugcaagggauuucgcucaccggugcguccugcacuuuuucgccagcaugcguucugagcuccaggcgcgcggucugagaagggggaacgccggacggcgacuugaacugccugcaguuccagagccgcccgagggcuuggacuccggcucagggaaggcucaucuccgcgccaucagcaguagagaacagguggauaggcuguuaucuacuugguauuccagcaaaccuccacuggaccuagcugccucgcccggacucugugguggcgggcugucucaccgggcaccuacccuugccuugggaacacgccugucccagcauaccgacguauga

SEQ ID NO: 53765 - RNA, 450 nt, Artificial Sequence
  derived and/or modified sequence opt3 from CALM2__Homo_sapiens__NP_001734
auggccgaccagcugaccgaggaacaaaucgcugaguucaaggaagcauuuagccucuucgauaaagacggcgaugggacaauuacuacgaaggagcuuggaaccgugaugagaucccugggucagaaccccacagaagccgaguugcaggacaugauaaaugaggucgaugcggacggcaacgggacuaucgauuuuccugaguucuuaaccaugauggcuaggaaaaugaaggacacagauucugaagaagagauucgggaggccuuucgcguuuucgacaaagauggaaauggcuacaucucagcagccgaacugcgacacgugaugaccaaccuaggugagaagcucacugacgaagagguagaugaaaugauucgugaggcugacaucgacggggauggacaggugaauuaugaggaauuuguccaaaugaugacagcaaaguga

SEQ ID NO: 53766 - RNA, 450 nt, Artificial Sequence
  derived and/or modified sequence opt3 from CALML3__Homo_sapiens__NP_005176
auggccgaccagcugaccgaggaacaagugacagaguucaaggaggcuuuuagccucuucgauaaagacggcgaugggugcaucacuacgagagaacuuggaaccgucaugaggucccugggucagaaccccacagaagcagaguugcgggacaugaugucugagauugaucgcgacggcaaugggacuguugauuuuccugaguucuuaggaaugauggcccgaaagaugaaagacaccgauaacgaagaagagauacgugaggcguuuagaguguucgacaaggauggcaaugguuuuguaucagcugccgaacugaggcacgugaugacacggcuaggggagaaacucagugacgaagaggucgaugaaaugauccgcgcagccgacaccgacggagauggccaggugaacuacgaggaguucguuagagugcuggucagcaaguga

SEQ ID NO: 53767 - RNA, 441 nt, Artificial Sequence
  derived and/or modified sequence opt3 from CALML5__Homo_sapiens__NP_059118
auggccggcgagcugacccccgaagaggaagcucaguacaagaaagcauucagcgccguggacacagaugggaacggaacuaucaaugcgcaagagcucggugcugcccuuaaggcaacgggcaaaaaccuguccgaagcccaguugagaaaguuaauuucugaggucgacucagauggggacggagagauaaguuuucaggaguuccugaccgcugccaaaaaggcaagggcuggccuagaagaucuccagguugccuuucgggcguucgaccaagauggugacgggcacaucacaguggaugaacugcgccgagcaauggccggacuuggccagccucugccacaggaggaguuggacgcuaugauucgugaagccgauguagaccaggauggcagagugaauuaugaggaauuugcaaggaugcucgcucaagaguga

SEQ ID NO: 53768 - RNA, 660 nt, Artificial Sequence
  derived and/or modified sequence opt3 from CALN1__Homo_sapiens__NP_001017440
augcccuuccaccaugugaccgccggccugcucuacaaggggaacuaucuuaauagaagccuguccgcuggaucugacucagagcaguuggcaaacaucagugucgaagaguuagaugaaauuagggaggccuuucggguucuggaccgcgaugguaauggcuucauaagcaaacaagaacuagggauggcgaugcgaucccucggauacaugccuucugagguggagcuggcuaucauuaugcagcgucuugacauggauggcgacggucagguagauuuugacgaguucaugacaauccuggggccaaaguuggugucgucagagggaagagauggcuuucucggcaacacuauugacagcaucuucuggcaguuugauaugcaaaggauaacgcuggaagaacugaaacacauccucuaucaugccuuccgggaccacuuaaccaugaaggauauugagaauaucauuaucaacgaagaggaaagucugaaugagacauccgggaacugccagacugaauuugagggaguccauucucagaaacagaaucgccaaaccugugugagaaagagccuuauaugcgcauucgccauggcuuuuauuaucuccguuauguugauugcagccaaccagauccugaggucagguauggaguga

SEQ ID NO: 53769 - RNA, 1155 nt, Artificial Sequence
  derived and/or modified sequence opt3 from CALR3__Homo_sapiens__NP_659483
auggccagagcucuggugcagcucugggcaaucugcaugcuuagggucgcccuggcgaccguuuacuuccaagaggaauuuuuggacggcgagcacuggcggaaccgcugguuacagagcacaaaugauucccgauucgggcauuuucgucugucuucaggaaaguucuauggucacaaagaaaaggacaaaggccuacagacuacgcagaacgggagauuuuacgcuauuagugccagguucaagcccuuuagcaauaaaggaaagacccucgugauacaauauacaguaaagcaugagcagaaaauggauuguggcgguggguacaucaagguguucccugcagacauugaucagaaaaaccugaauggaaagucccaguauuacaucauguuuggcccagacauuugcggcuucgauaucaaaaagguccacgugauacuucauuuuaagaacaaauaucacgaaaauaagaaacugauccgguguaagguugacggguucacucacuuguacacccucauucugcgcccggaucugucuuacgacgugaaaaucgauggacaaucgauugagucagguagcaucgaguaugacuggaaccucacaaguuuaaagaaagaaaccucccccgccgagucuaaggauugggaacagacuaaggacaauaaagcucaggacugggagaagcauuuucuggaugcaagcacauccaaacagucagacuggaacggcgaucuugacggggauuggccugccccaauguugcaaaagcccccuuaccaggacggacugaaaccagagggcauacacaaggaugucuggcuacauagaaagaugaaaaauaccgacuaucucacgcaguacgaucugagugaauuugagaacauuggugcuaucgggcuugaacuguggcaagugaggagcggaacuauuuucgacaauuucuugaucaccgaugacgaggaauaugccgacaacuucggcaaggcgacauggggcgagacuaaagggcccgagcgggaaauggaugcaauccaggccaaggaggaaaugaaaaaggcucgcgaggaagaggaggaggaacuccugucuggaaagauuaaucgacacgaacacuacuuuaaccaguuccauagaaggaacgaguuauga

SEQ ID NO: 53770 - RNA, 1254 nt, Artificial Sequence
  derived and/or modified sequence opt3 from CALR__Homo_sapiens__NP_004334
augcugcucagcgugccccuucuguugggcuuacuggggcuagccgucgcugagccugcaguuuacuucaaggaacaguuucucgacggagaugguuggaccuccagauggaucgagucuaaacacaagucagacuucggcaaauuugugcugaguagcgggaaguucuauggagaugaagagaaagacaagggccuucaaacaucccaggaugccagguuuuacgcgcugucugcuucguucgaaccauuuucaaacaagggucagacuuugguagugcaguucacggucaaacaugagcaaaauauugacugcgggggaggcuaugugaagcucuuuccgaacagccuggaucagaccgacaugcacggcgauagugaguacaauauaauguucgggcccgacaucuguggaccugguacuaaaaagguucaugugauuuuuaacuauaaaggcaagaauguccugaucaacaaggauauucggugcaaagacgaugaguucacacaccucuacaccuuaaucgugcgcccagacaauacauaugaaguaaagauagacaacucccagguugaaucugggagccuggaggaugacugggauuuucuucccccuaaaaagaucaaagacccagaugccuccaagcccgaggacugggaugaacgagcaaaaauugacgauccuaccgacucaaagccagaggauugggacaagccggaacauauccccgacccugaugccaaaaagccagaggacugggaugaagagauggacggagagugggaacccccugugauucagaauccagaguacaaaggcgaauggaagccccgucaaaucgauaacccggacuacaaagguacuuggauacacccugagauugauaaucccgaauauaguccagacccuagcaucuacgcuuaugauaacuucggggucuugggacuggaccuauggcaagugaagucuggcacaauuuucgauaauuuucucaucaccaacgacgaggcauacgccgaggaguucggcaaugaaacguggggagugacuaaggcugccgaaaaacagaugaaggauaaacaggacgaggaacagagacugaaggaggaggaagaggacaaaaagaggaaggaagaggaggaagcggaggauaaagaagacgaugaggacaaggaugaagacgaggaggaugaagaggacaaagaagaggaugaagaggaggacguccccgggcaggcaaaggaugaacuuuga

SEQ ID NO: 53771 - RNA, 948 nt, Artificial Sequence
  derived and/or modified sequence opt3 from CALU__Homo_sapiens__NP_001124146
auggaccugagacaguuccucaugugccuuagccuguguaccgccuuugcuuuguccaagcccacagagaaaaaggauagggugcaccaugaaccucaauuaucugacaaaguccacaacgaugcacagucauucgacuacgaucaugacgccuuucugggcgcggaggaagcuaagacuuucgaucagcuaacgccagaggaaaguaaagagcggcucgggaugaucguugacaagauugaugccgacaaggauggauuugugaccgagggugaacugaaaagcuggauaaagcacgcacagaaaaaguauaucuacgacaauguagagaaccaauggcaggaguucgauaugaaucaggacggccuuauuuccugggacgaauaucgcaacgugacauacgggacuuaucuggaugacccggaucccgacgauggauuuaauuacaaacagaugaugguccgagacgagcguagauucaagauggccgauaaggacggcgauuugaucgcuaccaaagaagaguuuacagcauuccuccauccugaagaguaugacuacaugaaggauauugugguucaagaaaccauggaggacaucgacaaaaacgccgaugguuuuauagaccuggaggaauacaucggggauauguauucucacgacggaaauacugaugagccagaaugggugaagacagagagggaacaguucgucgaguuucgggacaaaaaccgcgauggcaagauggacaaagaggaaaccaaggauuggauucugcccucggacuacgaucacgcugaggccgaagcgagacaucucguguaugagucagaccagaauaaggauggcaaauuaacgaaggaagagaucguagacaaauacgaccuguucguugggagccaggcaacugauuucggagaggcccuugugaggcacgacgaauuuuga

SEQ ID NO: 53772 - RNA, 654 nt, Artificial Sequence
  derived and/or modified sequence opt3 from CALY__Homo_sapiens__NP_056537
auggugaagcugggcugcagcuucuccgggaaacccggaaaggacccuggugaucaggacggcgccgcuauggauucugucccacucaucucaccgcuugacauuagucaacugcagcccccuuugccagaucagguugugauaaaaacccagacagaguaccaauuaagcucccccgaccagcagaacuuuccugaucuggaagggcagagacuaaauuguucucacccagaggaaggaaggcggcuccccacugcacgcaugaucgccuucgcgauggcucugcuuggcugcguacugauuauguauaaggccaucugguacgaccaauuuacguguccugaugguuucuugcuccgacauaaaauuugcaccccacugacacuggagauguauuacacugaaauggacccggagcgucacagaucgauccucgcagccauaggggcuuaucccuuaucaaggaagcauggaaccgagaccccugcagccuggggcgauggcuaccgggcugccaaggaggaacgcaaagggccaacacaggcgggagcagccgcugccgcaacugaacccccugguaagccaagcgcuaaagccgagaaggaggcggccagaaaagcagcuggcagugccgcucccccgccugcccaguga

SEQ ID NO: 53773 - RNA, 1074 nt, Artificial Sequence
  derived and/or modified sequence opt3 from CAMK1D__Homo_sapiens__NP_065130
auggccagagagaacggcgaaagcuccucuucauggaagaaacaggcugaggacaucaagaaaauuuucgaauuuaaggagacccuggggacaggagcauucagugaagugguccucgccgaggagaaagcgacugguaaacuuuuugcuguuaagugcauacccaagaaggcccugaaaggcaaggaaagcuccaucgagaaugaaauugcaguguugaggaaaaucaagcacgagaacauuguagccuuagaggauaucuacgaaucuccuaaucaucuguaucuagugaugcaacucgucucagggggagagcuguucgaccggauaguggaaaagggcuuuuacacggagaaagaugcuucgacccuuauccgccagguucuggacgcaguguauuacuugcaccgaauggguauuguccaucgugaucucaagccagaaaaccugcuguauuacagccaggacgaggagaguaaaaucaugauuuccgauuucgggcucucuaagauggaaggaaaaggcgacgugaugagcacagccuguggcacuccgggguauguagcucccgagguuuuagcccagaagccuuacuccaaagcgguggauugcuggucaaucggagucauagcauacauucugcuuugugguuauccacccuuuuacgacgaaaaugauaguaaguuguucgagcaaauccugaaggccgaauaugaguuugacagcccuuacugggaugacauuucugacuccgcuaaagauuucaucagaaaccuaauggagaaggacccaaauaaaagguauaccugcgaacaggccgcacggcaccccuggaucgcuggcgauacagcccucaacaagaauauucaugagucagugagcgcgcagauacgcaaaaacuuugccaagaguaaguggagacaggcauucaaugcuaccgccguggucaggcacaugcggaaacugcaccuugggucuucccuggacagcucgaacgcuucuguuuccucaaguuugagccucgccucccaaaaggauugugcauacguggccaaaccugaaucucugagcuga

SEQ ID NO: 53774 - RNA, 1431 nt, Artificial Sequence
  derived and/or modified sequence opt3 from CAMK1G__Homo_sapiens__NP_065172
augggcagaaaggaggaagacgauugcagcuccuggaaaaagcagaccacaaacaucaggaaaacuuucauuuuuauggaggugcuggggucuggagccuucucagaagucuuucucguuaagcaacggcuuacggguaaacuguucgcuuugaaguguauaaagaaaagucccgcauuucgcgacagcuccuuagagaaugaaaucgccgugcugaagaaaauuaagcacgagaacaucguaacccuagaggauauuuacgaaucuacaacucauuauuaccucgugaugcagcuggucucgggcggggagcuuuucgaccgaauccuggaacguggaguguauaccgagaaagaugcgucauugguuauacaacaggugcucagcgcugucaaguaccugcacgagaauggcaucgugcauagagaccugaagccugaaaaccucuuauaucugacaccagaggaaaauaguaaaauuaugaucaccgauuuuggucuuuccaagauggagcagaacgggauuaugucuacugccugcggaacaccgggcuacguagcacccgaaguuuuggcccagaaaccuuauagcaaggcuguggacuguugguccaucggcgucauaaccuacauucugcuaugcggguacccacccuucuaugaggagacggaaucaaaacucuuugagaagaucaaagaaggauacuaugaguucgaaaguccuuuuugggaugacauuagcgagucugcaaaggauuucaucugucaucugcuugagaaggacccaaaugaaagguacacuugcgagaaagcccugucccaccccuggaucgaugguaacaccgcuuugcaccgggacauuuauccuucagugagccuccagauacagaagaauuuugccaaaaguaaguggcgccaagcguucaacgcagccgcugugguccaccauaugagaaaacugcacaugaauuuacauucuccaggcguuaggccggaaguggagaaccggcccccugaaacacaggccuccgagacuagccgcccaucgucucccgagaucaccauuacagaagcaccuguacuggaccacuccguggcucucccagcccuuacccagcugcccugucagcacgggcgaagaccgacggcgccuggaggcaggucauugaauugccuagucaacgguagucugcauaucagcuccucucucgugcccaugcaccaagggagccuggccgcaggaccauguggcugcuguucaaguugccuuaauauaggcuccaagggaaagagcucuuacugcucagagccuacucuguugaaaaaggcuaacaaaaagcagaacuucaaaagugaaguuauggugcccgucaaggccagcggguccucucauugucgggcuggucagacaggcgugugccucauuauguga

SEQ ID NO: 53775 - RNA, 1113 nt, Artificial Sequence
  derived and/or modified sequence opt3 from CAMK1__Homo_sapiens__NP_003647
augcugggcgccguggaggggcccagauggaagcaggcugaagacaucagggauauuuacgacuuccgggauguccucggaaccggugcauuuagcgagguuauacuugccgaagacaaacgcacacaaaagcugguggcgaucaaaugcauugcuaaggaggccuuggaaggcaaagagggguccauggagaacgaaaucgcaguauuacacaagauuaagcauccuaauaucguggcccuggaugacauauaugagucuggaggccaccuauaccucaucaugcagcuggucucagguggggaacuuuucgaucgaauuguggagaaaggauuuuauacugagcgugacgcuaguagacugaucuuccagguuuuggaugcagugaaguaccuccaugaccugggcauuguccacagggaucugaaaccagaaaaccucuuauauuacagccuggacgaggauuccaagaucaugauaucugacuuuggccuuucgaaaauggaagacccggggucaguguugagcacggccuguggaacccccgguuauguagcuccugagguucuggcccagaagccauacaguaaggcgguggauugcugguccauuggcgucaucgcauacauucuacucuguggguaucccccuuucuacgacgaaaaugaugccaaacuguuugagcaaauccuuaaggcugaguaugaguucgacucuccauacugggaugacaucagcgauuccgccaaagacuuuauucggcaucugauggaaaaggaucccgaaaaacgcuucacaugcgagcaggcauugcagcacccuuggauagcuggagacacugcccucgauaagaacauccaccagucagugagugaacaaauuaaaaagaauuuugccaagagcaaauggaagcaggcguucaacgcaaccgcuguggucagacauaugaggaaacugcaguuaggcacaucucaggagggucaagggcagaccgccucccacggagagcugcucacuccaguugcuggcggcccggccgcaggguguugcugucgggacugcuguguggaacccggaacagagcuuucaccuacccugccacaucaguuguga

SEQ ID NO: 53776 - RNA, 1470 nt, Artificial Sequence
  derived and/or modified sequence opt3 from CAMK2A__Homo_sapiens__NP_057065
auggccaccaucacaugcacuagauucacggaggaauaccagcuguuugaggaacucggcaagggggcuuucagcguggucaggcgguguguuaaagugcuugcaggacaagaguaugccgcgaagauuauaaacaccaaaaagcuguccgcucgcgaccaccagaaauuggaacgagaggcccguaucugcagauuacugaagcaucccaauauuguaaggcuacacgauucuaucucagaggaaggucaucacuaccucauuuuugaccuggugacaggcggggagcuuuucgaagauaucgucgcacgggaguauuacagugaggccgacgcuagccauuguauacagcagauccuggaagcaguguugcacugccaccaaaugggaguugugcaucgcgaucucaagccugagaaccugcugcucgccuccaaauuaaagggcgcugccgucaaacuggcggacuuuggucuugcaauugaaguggagggggaacagcaggccugguucggauuugcuggcacuccaggcuauuugucuccggagguacugagaaaggaucccuacgggaaaccuguugaccuaugggccuguggagugauccucuauauucugcuugucgguuacccacccuucugggaugaggaccagcacaggcuguaccaacagaucaaggcaggcgcuuaugauuuuccuucgccagaaugggacaccgugacacccgaggccaaggauuugauaaauaaaaugcucaccauuaacccuucaaagcggaucacugcggccgaagcacugaaacauccauggauuagccaccgcaguacaguggcuuccugcaugcaccgacaggagaccgucgacuguuuaaagaaauucaaugccagaaggaagcugaaaggggcuauccucacgacuaugcuugccacccggaacuuuucuggaggcaagagcggugggaauaagaaauccgacggaguuaagaaacguaagucaaguagcucugugcagcugauggaauccucagagagcacaaacacuaccaucgaggaugaagacacaaaaguacgcaagcaagagauuauaaaggugaccgaacaguugaucgaggcaauuaguaauggcgauuucgaaucuuacacgaaaaugugcgacccgggcaugacugccuuugagcccgaggcucuagggaaccuggucgaaggacucgauuuccauagauucuauuuugagaaucugugguccaggaacagcaagccugugcacacaaccauccuuaauccacauauacaccugaugggugacgaaucggcguguauugcauacauccggaucacucaguauuuggaugccggcgggauuccccgaacagcucaaucugaggagacccgcguuuggcauagaagggacggaaaauggcagaucgugcacuuccaccgguccggcgccccuucaguccucccacauuga

SEQ ID NO: 53777 - RNA, 2001 nt, Artificial Sequence
  derived and/or modified sequence opt3 from CAMK2B__Homo_sapiens__NP_001211
auggccaccacagugacuugcacgagauucaccgacgaguaccagcuguaugaagauaucggcaagggggcuuuuagcgucguuaggcggugugugaaacucugcacaggacacgaguacgcagccaagauuauaaacacuaaaaagcuguccgcgcgcgaccaucaaaaacuggaacgagaggcucguaucuguagauuguuaaagcacucuaauauuguaaggcugcaugauucaaucagugaagaggguuuccacuaucuaguguuugaccucgucaccggcggggagcuguucgaagauauuguggcccgggaguacuauagcgaagcagacgccucccauugcauccagcagauacuugaggcuguucugcacugucaccagaugggagugguccaucgcgauuugaagcccgagaaccuccugcuggcaucuaaaugcaagggcgccgcugugaaacucgccgacuuugguuuagcgaucgaaguacaaggggaucagcaggcaugguucggauuugccggcacaccuggcuaccugucgccagagguucuuagaaaggaagcauaugggaaaccgguggacauuugggccuguggagucaucuuguacauucugcuaguggguuacccuccuuucugggaugaggaccagcacaagcucuaucaacagaucaaggcaggcgcuuacgauuuuccaucacccgaaugggacaccgugacuccugaggccaaaaaucugauaaaccagaugcuuacaauuaauccagcgaagaggaucaccgcccaugaggcacugaaacaccccugggucugccagcggagcacgguugcuaguaugaugcaccgccaagaaacuguggaguguuugaagaaauucaacgcccgaagaaagcucaaaggggcuauucugaccacaauguuagccacuaggaauuuuuccguaggacggcagaccacagcacccgccaccaugucuacggcugcgagcggcacuacaaugggucugguggaacaggcaaagucccuccuuaacaagaaagccgacggggucaagccacaaaccaauucaacuaaaaacagugcugccgcaacaagcccgaagggaacccugcccccugccgcuuuggagccacagacgaccgugauccauaaucccguugauggcaucaaagaaucuuccgacucagccaacacaacuauugaggaugaggacgcaaaggcgccucgugugccagauauacuaagcaguguccgcagaggcucuggggcucccgaagccgagggaccgcugccuugccccuccccagcaccuuucagcccccucccagcccccucgccuaggaucucugacauucuuaauuccgugcggcgagguucaggcaccccagaagcugaggggccgcuuagugccggacccccuccaugucugagccccgcauugcucggcccucuguccucuccaagcccccgcaucucagauauauuaaacaguguaagaagggguuccgggacaccggaagcugagggcccuagcccaguuggacccccucccugcccaucuccuacuauucccggcccacugccgaccccuucacggaagcaggagaucaucaaaacaaccgaacagcuaauugaggccgugaauaacggggacuuugaagcguaugccaagaucugcgaucccggacucacgaguuucgagccagaggcucuggguaaccuugucgaaggcauggacuuccaccgcuuuuacuucgagaauuugcuggcuaaaaacagcaagcccauucauacuacaauacucaauccucacgugcaugucaucggggaagaugccgcuuguauugccuauaucagacugacccaauacaucgacggacagggcaggccacguacuucccagucugaggaaacccggguguggcaccgaagagacgguaaauggcagaacguucacuuucauugcucgggggcacccguggcgccucuucaauga

SEQ ID NO: 53778 - RNA, 1500 nt, Artificial Sequence
  derived and/or modified sequence opt3 from CAMK2D__Homo_sapiens__NP_001212
auggccagcaccacaacuugcacgagauucaccgacgaguaccagcuguuugaggaacucggcaagggggcuuucuccguggucaggcgguguaugaaaauccccacaggacaagaauaugcagccaagauuauaaacacuaaaaagcugucugcgcgcgaucaccagaaacuugagcgagaagcucguaucugcagauuguuaaagcauccuaauauuguuaggcugcacgacucaaucagugaggaggguuuucauuaccuaguguucgaucucguaaccggcggggaacuguuugaggacauuguggcccgggaauauuacagcgaggcagaugccucccacuguauccagcagauacuugagucugucaaccauugccaccugaauggaaucgugcaccgcgacuugaagccagaaaaccuccugcuggcuucgaaaucaaagggcgcagccguuaaacucgcugauuucgguuuagccauugaggugcaaggggaccagcaggcgugguuuggauucgcaggcacaccgggcuaucugagccccgaaguccuuagaaaggauccuuacgggaaaccaguggacaugugggccuguggaguaaucuuguauauucugcuaguugguuaucccccuuuuugggaugaggaccagcauaggcucuaccaacagaucaaggcuggcgccuacgauuucccaagucccgaaugggacaccgugacuccugaggcaaaggaccugauaaauaaaaugcuuacaauuaacccagcuaagcggaucaccgccuccgaggcgcugaaacacccguggauuugccagcgcucuacggucgccagcaugaugcaucgacaggaaacuguggauuguuugaagaaauuuaaugcaagaaggaagcucaaaggggcuauccugaccacaauguuagccacucggaacuucuccgcugccaagucacugcucaagaaacccgacggagugaaggagaguaccgaaagcucuaauacaaccaucgaggaugaagacgucaaagcacguaagcaagagauuauaaaaguuacggagcagcuuaucgaagccauuaacaauggcgauuuugaggcuuacacuaagaucugcgacccuggucugacagcguucgaaccagaggcauuggggaaccuaguggaaggaauggauuuccaccgcuuuuauuucgagaaugcccuguccaagucaaacaaacccauacacaccauuauccucaauccucauguacaccuggugggcgacgaugcugccuguaucgcauacauuagacuuacucaguauauggacggcagcgggaugccaaagacaaugcaaagugaggaaaccagggucuggcaucggcgagauggaaaauggcagaacgugcacuuucaucgcucugguucccccacgguuccgaucaagccucccugcauuccaaacggcaaagagaauuucagcgggggaaccucgcuguggcagaacauauga

SEQ ID NO: 53779 - RNA, 1488 nt, Artificial Sequence
  derived and/or modified sequence opt3 from CAMK2G__Homo_sapiens__NP_001213
auggccaccacagcuacuugcacgagauucaccgacgauuaccagcuguuugaggaacucggcaagggggcauucagcguggucaggcgguguguuaaaaagacauccacucaagaguaugccgcgaaaaucauuaacaccaagaaacuuucugcucgcgaccaccagaagcuggaacgagaggcccguauaugcagauuguuaaagcaucccaauaucgugaggcugcacgauucaauuagugaagagggauuucauuaccuaguauucgaccucgugacagguggcgagcuguuugaagauaucgucgcacgggaguauuacagcgaagccgacgcuucccacuguauucaucagauccuugagucugugaaccacauacaccagcaugauaucguucaccgcgaccugaaaccugagaauuugcuccuggcaucgaagugcaaaggggccgcugugaagcuggccgauuucggacucgcgauugaaguccaaggcgagcagcaggcaugguuugguuucgccgggaccccaggauauuuaucaccggaagugcugagaaaagaccccuacggcaagccuguagauaucugggcuuguggcguuauucuuuauaucuugcuggugggguacccacccuuuugggacgaggaucagcauaagcuauaccaacagauaaaagccggagcauaugacuucccuagcccagaaugggacacugucacacccgaggcuaagaaccucauuaaucagaugcugaccaucaacccugccaaaaggauuacggcggaucaggcccuuaagcacccaugggugugccaacggaguacuguggcauccaugaugcaccgccaggagaccgucgaaugucugcgaaaauuuaaugcuagaaggaaguugaaaggugccauccucacaacuaugcugguuucucggaacuucagcgcugccaaguccuuacugaauaagaaaucagacggcggggugaaggagccgcagaccacaguagugcauaacgcaaccgauggaaucaaaggcaguacggaaagcugcaauacuacaaccgaggacgaagaucucaagguccguaaacaagagauuauaaagaucacugagcagcuuauugaagccaucaacaauggugacuuugaggcuuacacaaagauaugugaucccgggcugaccucuuucgaaccugaggcguugggaaaccuaguggaaggcauggacuuccacaaauuuuauuucgagaaucugcucuccaagaacucaaaaccaauucauacgaccauccugaacccccacguucaugugaucggcgaggaugcagccugcauugcuuacauccgccuuacacaguauauugacgggcagggaagaccuaggacuagccaaagugaagagacccgggucuggcaccgacgcgaugguaaguggcugaaugugcacuaccauuguucuggcgccccagcagcccccuugcaguga

SEQ ID NO: 53780 - RNA, 1422 nt, Artificial Sequence
  derived and/or modified sequence opt3 from CAMK4__Homo_sapiens__NP_001735
augcugaaggugaccguccccagcugcuccgccucuucauguaguagcguuacagcuuccgcagccccuggcacugcgucucucgugccagacuacuggaucgaugggucgaacagagacgcucuuucagauuucuuugagguagaaagcgagcugggaaggggugccacgaguauuguguaucggugcaaacagaagggcacccaaaaaccguacgcauugaaggucuuaaagaagacaguggacaagaaaauaguucgcacugaaaucggggugcugcuacgacucucccaccccaauauuaucaagcugaaagagauuuucgaaaccccuacagagaucucucuuguccuggaguuggugaccggaggcgaacucuuugaucguauaguagagaaggguuauuacagcgaaagagacgccgcugaugcaguuaaacagauccuggaggccguggcuuaucugcaugagaacgggauuguccacagggaccucaagccagaaaauuuacuguacgccacucccgcgccugaugcaccacuuaagaucgccgacuucggauuguccaaaauuguggagcaucaggugcugaugaagacagucuguggcacccccggcuauugcgcuccugaaauccuacgggggugugccuacggaccagagguugauauguggucaguggguauaauuacguacauccuccugugcggcuuugaaccguucuaugacgagcgcggggaucaguuuauguucagaaggauucuuaacugugaguacuauuuuaucagucccuggugggacgaaguaagccugaaugcaaaagacuuggugcggaagcucaucguccuggauccuaaaaagcgcuuaacuaccuuccaagcucugcagcacccaugggugacaggaaaagccgcgaacuuuguucauauggacacugcccagaagaagcuccaggaguucaaugcacgaagaaaacuuaaggcugccgugaaagcugucguggccucuuccaggcugggcucagcaagcaguucucacgguuccauucaagaaagccacaaggccucgcgggaucccucuccuauacaggacgggaacgaggauaugaaagcuaucccagaaggagagaagauucagggcgacggcgcgcaggcagccguaaagggggcucaagccgaguugaugaaaguucaggcacuagaaaaggugaaaggagccgauaucaaugcugaggaagcccccaagauggucccgaaagcaguggaggacgguauaaaggucgcggaucuggaacucgaggagggccuggcugaagagaaacuuaaaaccguggaagaggccgcagccccucgugaggggcagggauccucagcuguuggcuuugaagugccccaacaggacguaauucugccagaguacuga

SEQ ID NO: 53781 - RNA, 1518 nt, Artificial Sequence
  derived and/or modified sequence opt3 from CAMKK1__Homo_sapiens__NP_757343
auggagggcgggcccgccgugugcugucaggacccuagagcugaacuggucgagaggguugcagccaucgaugugacccaccucgaagaggcggacggagguccagaaccgacacggaacggcguagaucccccuccacgcgcucgagccgcaagcgugauucccggguccacuucucgucuucugccugccagaccaucauugagugcuaggaaguuaagccugcaagagcggcccgcaggauccuaccuagaggcccaggcuggcccuuaugccacggguccagcgucucauauaucgccgcgcgcauggagaaggcccaccaucgaaucacaccaugucgccauuagcgacgcugaggauugcgugcagcucaaucaguacaaacugcaaagugaaaucgggaagggagccuauggcguugugcggcuugcauacaacgaguccgaggaccgccacuaugcuaugaaaguccugucuaagaaaaaguugcucaagcaguacggcuucccucgaagaccacccccuagggggagccaggccgcgcagggagguccagccaaacaacugcugccccucgaacggguguaucaggagauugcaaucuuaaagaaacuggaucauguaaauguugugaaacuuauagaagucuuggacgauccggcugaggacaaccuguaccuaguguuugaucuccugcguaagggcccugugauggaaguccccugugacaagccauucuccgaggagcaggcccgccuuuaccugagagauguuaucuuggggcucgaauaucugcacugccagaagauugugcacagggacaucaaaccuucaaauuuacugcucggagacgauggccauguaaagauugcugacuuuggugugaguaaccaauucgaggggaaugaugcccagcuuagcucuacagcaggaacucccgccuuuauggcuccagaagcgaucuccgacucaggccagagcuucaguggcaaagcacuggaugucugggccaccggggugacauuguacuguuuuguuuauggaaagugccccuucauagacgauuuuauucuagcucugcaccggaaaaucaagaacgagccuguggucuucccagaagaaccggagauuucugaggagcucaaagaccugauccuuaagaugcuggauaagaaucccgaaacccgaaucggugugccugacauuaaauugcauccauggguaacuaagaacggcgaggaaccccucccuuccgaggaggaacacuguagcguuguggaggucacagaagaggaggugaaaaauucgguccgccugauaccaucuuggaccacggugaucuuaguuaaguccaugcugagaaaaaggucauuugggaaccccuucgaaccgcaagcccggcgcgaggaaagaaguaugagcgcaccuggaaaucuacucgugaaggagggcuuuggugaagggggcaaguccccagagcugcccggaguacaggaggaugaagccgcuucuuga

SEQ ID NO: 53782 - RNA, 1767 nt, Artificial Sequence
  derived and/or modified sequence opt3 from CAMKK2__Homo_sapiens__NP_001257414
augagcuccugcgugucuucacagcccaguagcaacagagccgcuccucaagacgagcugggcgggaggggauccucuucgucagaaagccagaagccaugugaggcacuccggggucuuaguucccugucuauccacuugggcauggagagcuucauugucguuaccgaaugcgaaccggggugugccguggauuuaggacuggcgcgcgaccgaccccuagaggcugauggccaggagguaccucucgacacauccgguucacaggcccguccacaucugagugggagaaaacuuagccugcaagaaaggucucagggaggcuuggcagccggcgggucccucgauaugaauggacggugcauaugucccucacugccuuacagcccagugaguucuccccaguccagcccucgccugccaagaaggccgacugucgagucgcaccaugugucuaucacggguaugcaggacugcguucaacucaaccaguauaccuuaaaggaugaaauuggcaaaggguccuacggaguggucaagcuggcuuauaaugagaacgacaauacauacuaugcaaugaaagugcuuucaaagaagaaauugauccggcaggccggcuuuccccgccgaccuccacccagagguacuaggccugcuccagggggauguauucagccccggggcccgaucgagcaaguauaccaggaaauagccauccugaagaaacuagaucacccuaacguugugaagcucgucgaggugcuggacgaucccaaugaagaccaucuuuauaugguguucgagcuggucaaccagggcccaguuauggaagugccuaccuugaaaccccucagugaggaucaagcgcguuuuuacuuccaggaccugauuaaggggaucgaguacuuacacuaucagaagauuauccaccgcgacauaaaaccaagcaaucugcucguaggagaagauggucauauuaagaucgcagacuuuggcguguccaacgaguucaaagggucugaugcccuucugagcaauacagucggaacccccgcuuuuauggccccugaaucauugagugagacuagaaagauuuucuccggcaaagcacuagacgugugggcuauggguguuacacuguacugcuuuguguucgggcaguguccauuuauggaugaaaggaucaugugccuccacagcaagaucaaaucucaagcccuggaguucccggaccagcccgauauugcggaggaccuuaaggaucugauaacccggauguuggacaagaacccugaaucacgaaucgucgugccagagauuaaacuccaucccuggguaacgcgccacggcgccgaaccucugccaagugaggaugaaaauuguacuuuaguugaggugaccgaggaagaggucgaaaacagcgugaagcacauccccucccuggcaacagucauucuagugaaaacuaugauaagaaagaggucuuuuggaaauccguucgagggcucgcggcgcgaggaaagaagccucuccgcuccugggaaccugcuuaccaaaaagccaacaagggagugcgaaucauugagugagcugaaggaagcccgucagcggcgacagcccccuggacauagacccgcuccaagggguggcgggggaucugcccucguucgcggcagcccuugcguggaguccuguugggcacccgccccagguucaccggcucggaugcacccucugagacccgaggaagcgauggagccagaauga

SEQ ID NO: 53783 - RNA, 972 nt, Artificial Sequence
  derived and/or modified sequence opt3 from CAMKMT__Homo_sapiens__NP_079042
auggagagcagaguggccgacgcuggcaccggggaaacagcaagggccgcgggagguucccccgcugucggcugcacuacgcgggggccuguugugucugccccacugggagcagcccgcuggaagcuccuucgacagguacugaaacaaaagcacuuggaugacuguuuacgucaugugucagucagaagguucgagaguuuuaaccuguucagcgugaccgaaggcaaagagcgggaaacagaggaggaaguuggugcuugggugcaguacacuuccaucuuuugcccggaguauucuauuucgcuacgccacaauucagggagccucaacgucgaagaugugcugaccaguuucgacaauacaggaaacguauguauauggcccuccgaggagguucuugcauacuauugccugaagcauaauaacaucuuuagagccuuggcugugugugaacucggcggcgggaugaccugccuggccggacugauggucgcgauuucugcagaugugaaagaggugcucuuaacugacgguaaugaaaaggccaucaggaacguccaggauauuaucacacggaaucagaaggcuggcguuuucaaaacccaaaagauaagcuccugugugcugcgcugggacaacgagacggauguaucacagcuugaagggcacuuugacaucgugaugugcgccgauuguuuguuccuggaccaguaccgagcaagucuagucgaugcuauuaaaagacuccugcagccuaggggaaaggccaugguguuugcgccacggcguggcaauacucuuaaccaauucugcaaucuggccgagaaagcagguuuuuguauccagcgccaugagaacuaugacgaacacauuagcaauuuccacucuaaguugaagaaagagaaccccgacaucuacgaagagaaccuccauuauccucuguuacugauacucaccaagcacggguga

SEQ ID NO: 53784 - RNA, 891 nt, Artificial Sequence
  derived and/or modified sequence opt3 from CAMLG__Homo_sapiens__NP_001736
auggagagcauggccguggcuaccgacggcggggaaagacccggagucccugcagguuccggccugucugccucacagaggcgggcggagcuccgccgacguaaacuucugaugaacagugaacaaagaaucaauaggauuaugggguuccaccggccaggaagcggcgcugaggaagagucccagacaaagucuaagcagcaggauucggacaaauugaacucauuaagcguuccgaguguguccaagcgcguagugcugggugauucugucagcacugggacgaccgaccaacagggaggcguggccgagguuaaaggcacacagcuaggggauaagcucgacuccuuuauaaagcccccugaaugcucaagugaugugaaucuggagcuuagacagaggaaccggggagaccugacugcagauagcguccaacgcgguucucgacauggcuuggaacaguaccucuccagauucgaggaggccaugaaacugaggaagcagcugaucucagaaaaaccaagccaggaggacgggaauaccacagaagaguuugauaguuuccggauuuuucgucucgugggaugugcuuuacuggcacuuggcguacgcgccuucguuugcaaguauuugucuaucuuugcucccuuccugacccuacaacucgccuacaugggucuguauaaauacuuuccuaaguccgaaaagaaaauuaagacuacagugcuuaccgcggcacuguugcucagcgggaucccagccgaggucauaaacagaucgauggacacguauucuaaaaugggagagguguucacugaucuguguguguacuuuuucaccuuuaucuucugccacgaauuacuggacuauuggggcuccgagguccccuga

SEQ ID NO: 53785 - RNA, 522 nt, Artificial Sequence
  derived and/or modified sequence opt3 from CAMP__Homo_sapiens__NP_004336
augggcaccaugaagacacagagagacgggcacagccugggaagguggucccucgugcuucuguuguuaggucuggucaugccccuagccaucauugcucaaguucucucuuacaaagaggcagugcugcgggccauagauggcaucaaccagcgcucaagugacgcgaaucuuuaucgacuguuggaucucgacccucguccaacuauggauggggacccggauacgcccaagccugugagcuucaccguaaaagaaacagucugcccaagaacuacccagcagucccccgaggacugugauuuuaagaaagacggacuggugaagaggugcaugggcacaguuacccugaaccaagcucgggguucuuucgauauuucgugugacaaggauaauaaacgcuuugcccucuuaggggacuucuuuagaaagucaaaagaaaagaucggaaaagaguucaagaggauugugcagcggaucaaggacuuucugcgcaaccuugucccucgaacugaaagcuga

SEQ ID NO: 53786 - RNA, 4809 nt, Artificial Sequence
  derived and/or modified sequence opt3 from CAMSAP1__Homo_sapiens__NP_056262
augguggacgccagcggcagagcugcagccgagggguggaggaagauggaagcgcccccugauggagcugccgaccuggucccacucgaucgguacgacgcagcccgcgcuaaaaucgcagccaaccuucaguggauuugcgcuaaggccuauggucgagauaauauaccggaggaccugcgugaucccuucuacguugaccaauaugaacaggagcacaucaaaccuccagugauuaaguuguuacuguccucugaacuauacuguagaguaugcucacucauccugaaaggcgaucagguggcggcacuucaggggcaucaaagugucauucaggcccugagcaggaagggaaucuaugugauggaguccgacgauacccccguuacagagucugacuugucgcgggcuccuauaaagaugucagcccacauggcaaugguggaugcucucaugauggccuacacugucgaaaugaucagcauugagaaagugguagcgaguguuaagcgcuuuuccacguucucugccagcaaagaacugccauaugaccuggaggacgcaaugguguuuuggaucaacaaggucaaucucaaaaugagagagauuaccgaaaaggaggugaaguuaaaacagcagcugcuugaaucccccgcucaucaaaaggugagguaccggcgcgagcacuugucagcccgacagaguccuuacuucccacugcuagaagaucucaugagagacggcagcgauggugcugcccugcuugcagucauccauuauuacuguccggagcagaugaaacuggacgauauaugcuugaaggagguuacaucuauggccgacucccucuauaacauuaggcuguuacgggaauuuucaaaugaguaccugaacaaauguuucuaucucacucuugaagauaugcuguacgcucccuuggugcuaaagccuaauguaaugguguuuaucgcggagcuguucuggugguuugaaaacgucaaaccagacuucgugcagccccgugauguucaagagcucaaggacgcaaagaccgugcugcaccagaaaagcagucgcccuccaguccccauuucuaaugccacaaagagauccuuucuugggagcccggcugccggaacccuggcagaguugcagccucccgugcaacucccagccgaaggcugccacaggcauuaucugcacccugaggaacccgaguacuuaggcaaagggacugcugccuucucgccaucucauccccugcuaccucuccggcagaagcagcagaaauccauccaaggagaagauaucccagaccagcgacaccgcucaaacagucugacaagaguagacggucagccgaggggcgcagcgauugcuuggcccgagaagaagacccggccugccagccagccaacgcccuuugcacuucaccaugccgcuuccugugagguugauccuucuagcggggacucaauaaguuuggcccgcuccaucagcaaagauucucuggcaucaaauauugugaaccucacuccacaaaaucagccccacccgaccgcuacaaagagucauggaaaaagccugcuuuccaacgucucuaucgaagacgaggaagaggagcugguggccauagucagagcggaugugguuccucagcaggccgacccagaguuccccagggcuucgccucgugcauugggccucacugccaaugcucggagcccccaaggucagcuggauaccuccgagucaaagccagacaguuucuuuuuagaaccucugaugcccgccgugcuaaaaccagcaaaggagaagcagguaauuacaaaagaagaugagcgaggggagggaagaccgaggucuaucgucagccgccggccuuccgaaggcccccagccacucgugagaaggaagaugaccggcucacgcgaccugaaccgaacguucacucccaucccuugcagcgaguuuccaauggggauugaucccacagaaaccggaccucuuucuguugagacugcgggugaaguguguggcgggccguuggcccugggaggcuucgacccauuuccccaagguccuuccacagauggguucuuucuccacgucggccgggcugacgaggacaccgagggacgucuguacgugaguugcagcaaaucuccaaacucccaugauucagaacccuggacguuacugagacaggacagugauagcgacguaguggauaucgaggaagccgagcacgacuucaugggcgaagcacacccuguugucuuuucgagguauauuggggaggaggaauccgcuaaacuucaggaggauaugaaagugaaggaacaugaggacaaggaugacgccucuggacgcagcucaccguguuugaguaccgcaucccaaaugucuagcguguccauggccucagguagcgucaaaaugacaaguuucgcugagcggaagcuccagagacuaaauucuugcgaaacuaaauccagcaccucgucaucucagaagacaacucccgaugcgagugaguccugcccagccccucugaccacauggaggcagaaacgagaacaaagccccucucagcacggcaaggacccagcaagccugcucgcuuccgagcugguucagcuucauaugcaguuggaagagaaacgccgggccauagaggcccaaaagaagaaaauggaagcucugucagcaagacagagguuaaagcucgggaaagccgcguuucugcacguggugaagaaaggaaaggcugaggccgcaccuccccuucguccagaacacuucgccaaggaguacagucagcauaacggcgaagauuguggugacgcuguaagcaaaaccgaggacuuucuggucaaggaggaacagcgcgaggaauugcuccacgagccgcaagauguggacaaagaaucucuggcauucgcccagcagcauaaggcgaaagauccuguugcucuacacgagcuggagcggaauaaggugaucuccgccgcacuccuggaagacacugucggggaggugguugaugugaacgaaugcgaccuuucaauugagaaguugaaugagacgaucaguacacugcaacaggccaucuuaaaaauuagccagcagcaagaacagcuccugaugaagucccccaccguaccaguccccggcucuaaaaacaauucgcaggaucauaaggugaaagcuccugugcacuucgucgagccacuuagccccacuggaguugccggccacagaaaggcaccuaggcuggggcagggacgaaacucacgguccggucgcccggcugaacuaaaggugccaaaagacagaccccaaggcaguucuaggagcaagaccccuacacccuccguagagacccucccacaucugcggccuuuucccgccucaucucacccacgaacuccuacagauccgggguuggacagcgcgcuggaacccaguggagauccacauggcaaauguuuauucgacuccuauagacuccacgacgagagcaaucagcgcacgcugacccuuucuucauccaaggaugccaacauacugagugagcagaugagcuugaaagaagugcucgacgcaucggucaaggagguggguucuuccagcucagauguuagugggaaagaaucugugccugucgaggaaccccugaggucccgugcuagccuaaucgagguggaccugucagaucuuaaggccccagacgaggauggcgaacucguuagucuggacggaagcgcugauuugguguccgagggcgaccagaagccuggggucggauuuuucuuuaaagaugaacaaaaggcagaggacgaacuggccaaaaagcgggccgcuuucuuacucaaacagcagagaaaggcggaggaggcaaggguacgcaagcagcaacuggaagccgagguggaacuuaaacgagaugaggcuagacggaaggccgaggaagacaggguucgcaaagaggaagagaaggcacguagagaacugauuaaacaggaguacuugcggaggaagcagcaacagauccucgaggaacagggccuggguaagcccaaaucuaagccgaaaaagccacgcccuaaaagcgugcaucgagaggaauccugcucagacucugggacuaaguguaguucgacacccgauaaucuaagcagaacccaguccggaucuucacugagccuugccuccgcugcgacaacugagccagaaaguguccacucuggcgguacccccagccaacggguggagucaauggaggcccucccuauucuguccaggaacccgagucgcagcacggacagagauugggaaaccgcaucugcugccuccucauuggcaagcguagccgaguauacaggccccaaguuauuuaaagaaccaucgucuaagaguaauaaaccuaucauacacaacgcuaucucccauugcugucuggccgggaaggugaaugagccccacaaaaacagcauucucgaagaacuggagaagugcgacgcgaaccauuacaucauucuuuucagggaugcaggaugucaguuucgggcccuguauugcuacuacccugacacugaagagaucuauaaguugaccggcacagggccaaagaauauaacuaagaaaaugauugauaagcuauacaaauauucauccgaccguaagcaguucaaccugauccccgcuaaaaccaugucugucagcguugaugcccucacgauucacaaucaccuguggcagccuaagcgcccagcugugcccaagaaagcacaaacacgaaaguga

SEQ ID NO: 53787 - RNA, 4470 nt, Artificial Sequence
  derived and/or modified sequence opt3 from CAMSAP2__Homo_sapiens__NP_001284636
augggcgacgccgcugaucccagagagaugaggaagaccuucaucgugccugcaauuaaaccauuugaccacuacgauuucagccgggccaagauagcgugcaaccuggcuuggcucgucgccaaagcauuugggacagaaaauguuccggaggaacuucaggagcccuucuauacugaccaauacgaucaggaacauaucaagccuccagugguaaaccuguuguuauccgccgagcuguauugucgcgcuggaucucuaauucucaaaucagacgcagccaagccccugcuuggucacgaugcugugauccaggcccuggcgcagaagggcuuguacgucacggaccaagagaaacucgugaccgaacgagaucugcauaagaaaccuauucagaugagugcacaccuggccaugaucgacacacucaugauggcuuauacuguugagauggugagcauagaaaaggucaucgccugcgcacagcaguacuccgccuuuuuccaagcuaccgauuuaccauaugacauugaggaugcggugauguacuggaucaauaaaguaaacgagcaucugaaggacauuauggaacaggagcagaagcugaaagaacaccacacaguugaggcccccgggggacagaagucuccuucgaaaugguuuuggaaguuggugccagcacguuacagaaaagaacaaacccugcuaaagcagcucccguguaucccccuggucgagaaucuucugaaagacggcacugaugguugcgcuuuggccgcucucauacauuucuauuguccugacguggugaggcuggaggauauuugcuuaaaggaaacaaugucacuggccgacagccucuacaaccuucagcugauccaagaguuuugucaggaauauuugaaucagugcugucacuucacccuagaggauaugcuguacgcagccaguuccauuaagucuaacuaucucgucuuuauggcugaacuguucuggugguuugagguugugaaacccagcuucguacagccccgggugguccgcccucaaggggcggagccagugaaggacaugcccuccaucccgguucuuaaugcagccaaaagaaacgugcuggauucaaguagcgacuucccuucuuccggagaaggcgcuacguuuacucagucacaucaccacuugcccagcagguacagucggccacaggcccauucuuccgcaagcggcgggauccgccgaucgucuuccaugucauaugucgauggauucauugguaccuggccuaaggagaaaagaaguagcgugcacggcguauccuuugacauaucuuucgauaaggaagacagcguucagaggucaacacccaaucgggggaucacucguaguauuuccaacgagggacucacccugaauaacagccaugugucuaagcacauccgcaaaaauuuaucauuuaagccaauaaacggcgaagaggaggccgaaaguauugaggaggagcugaacaucgacagccauuccgaucuaaaaucuugcgucccccucaauacaaacgagcuuaauucgaacgaaaauauccacuacaaacuuccuaacggugcuuugcaaaauaggauucugcucgacgaguucgggaaccagaucgaaaccccaagcauugaggaagcccugcagauaauccacgauacggagaaguccccgcauacuccccagccugaccaaauugcaaauggauuuuuccuucacucacaggagaugaguauccugaacucuaauaucaaguugaaccagagcuccccagauaaugugacagacaccaagggcgcgcucucacccauuacugauaacacagaagucgacaccggcauacaugugccuagcgaggauaucccagaaacgauggacgaggauucuucccugagagacuacaccguuaguuuagauagcgacauggacgaugcuucuaaauuucugcaggacuaugauauucggacagggaauacucgagaagcccuaucccccuguccgucaaccgugaguacaaagagccaaccuggaucguccgcaucuagcucaagugguguaaaaaugacuuccuucgccgagcagaaguuucgcaaacucaaccacaccgacggcaagucuagcggguccucaagccagaagacaaccccagagggaagugaacugaacaucccccacgucguggcuugggcccaaauuccugaggaaacuggccuuccccaggguagagauacgacacaguugcuggcaucugagaugguucaucucaggaugaaacuggaagagaagcggcgcgcuaucgaggcccagaaaaagaaaauggaagcggccuucaccaagcaaagacagaaaauggggaggacugcuuuucugaccguggucaagaagaaaggcgacggaauauccccacugcgugaggaagcagccggcgcugaggaugagaagguguacacagaccgggccaaagaaaaggagagccagaaaaccgaugggcagcgaucgaagucacuugcagacaucaaggaaucuauggagaauccucaagcgaaaugguugaagagucccacuacaccaauugauccggaaaaacaguggaaccucgccuccccuagcgaggagacgcugaaugaaggagagauccuagaauauaccaagucuauugagaaacugaacagcucccuccacuuccugcagcaggaaaugcaaagacuuucauugcagcaggagaugcugaugcaaaugagggagcagcagaguuggguaaucagcccaccacagcccucuccucaaaagcagauacgcgacuucaagccauccaaacaggcugguuuaucaagugccauugcacccuuuagcuccgauucuccucggccgacucauccaucgccccagagcucaaauagaaaguccgcuaguuucucugugaaaagccaaaggacaccucgcccaaacgaacucaagaucacccccuuaaaucgaacacuuacuccuccgcgguccguugacucacugccccguuugagaagguuuucuccaagccaggucccuauucagacccgcaguuucgugugcuuuggcgacgauggggagccccagcucaaagaauccaagccaaaggaggaagugaaaaaggaggagcuggaaagcaaaggaacgcuagagcaacggggccacaacccugaagagaaggagaucaaacccuucgaaucuaccgucucagagguucugucccucccagugacagaaacugugugccugaccccgaaugaggaccagcuuaaccagccuacagaacccccacccaagccuguauuuccacccacugccccuaaaaaugucaacuugauagaggugagucugagcgauuuaaagccgccagagaaggcagacguucccguggaaaaauacgauggugagucggacaaggaacaguucgaugacgaucaaaaagucuguugcggguuuuucuuuaaggacgaucagaaagccgagaaugacauggcuaugaagagagcggcccuccuggaaaagaggcuucgacgcgagaaagagacccagcugcggaagcaacagcuagaagcagagauggaacauaaaaaggaggaaacgagaaggaaaacagaggaggaacgucagaagaaggaggacgaacgcgcucggagagaguucaucaggcaggaguauaugcgacggaaacaacucaagcugauggaagauauggacaccgugauuaaaccucgcccccagguugugaagcagaaaaagcagagaccaaagucuauccacagggaucacauugaguccccuaaaacucccaucaagggcccaccuguaagcucauugagucuggccucuuuaaacacaggagacaaugaauccguccauagcggcaaacggaccccgcgaucagagaguguggaaggguuucucagccccuccagauguggaucucgcaacggugagaaggauugggagaacgccagcacuaccuccucaguggcuucuggcacagaauacacggggccaaaacuguauaaggagccuagugcaaagucgaauaaacacauaauucaaaacgcccuugcgcauugcugucuggcuggaaaggucaaugaaggccagaaaaagaaaaucuuggaggaaauggaaaagagcgacgccaacaauuuccucauccuguucagggauuccgguugccaguuucguucucuauacaccuacugucccgagacugaagagauuaacaaacugacagggaucggcccaaagucaauuaccaagaaaaugauagaaggacuuuauaaguacaauagcgaccggaaacaguucucccacaucccugcaaagacacucagugccucuguugaugcuauuacuauccauagccaccuguggcaaaccaaaagacccgugacgccgaagaaguugcugccaacaaaagcauga

SEQ ID NO: 53788 - RNA, 5022 nt, Artificial Sequence
  derived and/or modified sequence opt3 from CAMTA1__Homo_sapiens__XP_011539388
auguggagagccgagggcaaguggcugcccaagaccagcaggaaguccgugucucaaucagucuucugcgggacaaguacuuacuguguucucaacacggugccuccaaucgaagacgaucacggaaauagcaacuccucucauguaaaaauuuuucuuccgaagaaacuguuggagugcuuacccaaguguucgucacugccuaaggaacggcaccgcuggaauaccaacgaggaaauagcugcauaucuaaucacauucgagaaacaugaggaauggcucacuaccagcccaaagacacgaccccaaaaugguaguaugauucuguacaaccguaaaaaggugaaauauagaaaggacggcuacugcuggaagaaaaggaaggaugggaaaaccacucgggaggaccacaugaaacuuaaaguccagggaguggaaugucuguauggcugcuacguucauuccucuaucauuccuacauuucaccgcagauguuauugguugcuccagaauccagauaucgugcugguccacuaccugaacgugcccgccauagaggacugcgguaagccuugugggccaauccucugcagcauuaauaccgauaaaaaggagugggcgaaguggacgaaagaagaguuaaucggacagcugaagccgauguuccauggcauuaaauggacuuguuccaacggcaauucaaguagcggguuuucuguagaacaacuuguucagcagaucuuggacucccaccagaccaagccccaaccuaggacacauaacugccugugcacuggaucacuaggugcuggcgggagcgugcaccacaaauguaauagugccaagcaucggauaauuucuccaaaggucgagccccgcaccggaggcuacgguucccacagcgaagugcagcauaacgaugugucggaggggaaacacgagcauucucacuccaagggaucaagucgagagaagcgaaauggcaaggucgcaaaaccuguucuccugcaccagagcuccacagaggugucuagcaccaaccagguagaagugccagacacgacucaaucaagucccgucuccaucagcucuggccuuaacucagauccggacaugguggauaguccuguugugacaggggucagcggaauggccguggcuuccguaauggguucucugucgcagagcgcaaccguuuucauguccgaggugacuaaugaagccgucuauacaaugucacccaccgcuggcccaaaccaucacuugcucaguccugacgccucucaggggcugguguuagcggucagcuccgacggacauaaguuugcauuccccacgaccggcucaagcgagucucuguccaugcucccaacaaaugugagugaggaacuuguucugagcacuaccuuggauggugggaggaagauucccgagacaacuaugaacuuugacccugauugcuuccuaaauaacccaaaacaaggccagaccuacggaggcgggggacugaaggccgaaauggugucuuccaauauccggcacucaccgcccggugagcguaguuuuagcuucacaaccguacucacuaaagaaaucaagacggaggacacaucguuugagcagcagauggcuaaagaagccuauuccucuagcgcagcugccgucgcggccucaagucugacccuuacugcaggcuccucucuguugccuagcgggggaggccucuccccaucaaccacacuggagcaaauggauuucagcgcuauugacaguaacaaggauuacaccucuuccuucagccagacuggucacucgccccauauacaccagacaccuucacccagcuuuuucuuacaggacgccaguaagccacugccgguggaacaaaauacgcauuccagccuaucugauagcgggggcaccuuuguuaugccuacugugaaaacagaggcuuccucacagaccaguagcuguucuggacacgucgagacacgcaucgaauccacuucaagucuccaucugaugcaguuccaggccaacuuucaagcaaugaccgccgagggcgaagugacgauggagaccagccaggcugcggaaggguccgagguacuuuugaagucuggagagcugcaggcaugcucgagcgaacacuaucuccagccagagacaaauggugugauuagaucagccggcgggguucccauccugccuggaaacgucgugcaaggccuuuaccccguggcucagccaucccuggguaaugccaguaacauggaauugucucucgaccacuucgauauaucuuuuuccaaucaguucucagaccugauuaacgacuuuaucucugucgaagggggcagcaguacuaucuauggacaucaauuaguuuccggcgauagcaccgcacugucucagucagaagacggggccagggcuccuuucacacaggccgagaugugucuacccugcuguuccccacagcaaggaagucuccagcugagcucgucugagggcggugcauccacuauggcguacaugcacguggcugaagugguaagcgccgcaucagcccaggggacccuuggaauguugcagcaaaguggccgggucuuuauggugacggauuacucuccggagugguccuauccugaagguggcguuaaagugcugauuacagggcccuggcaggaggcuagcaacaauuacucaugccucuucgaccagaucagugucccagccagccugauucagcccggaguguuacgauguuauugcccugcacaugauaccggccugguuacucuucaaguggcuuuuaacaaucagauaaucuccaacucuguagucuucgaauacaaggcccgcgcguugccaacacuccccagcucccagcacgacuggcugucacuagaugacaaucaauucagaaugucuauucuggagaggcucgagcagauggaacggcgcauggccgagaugaccgggagucagcagcauaaacaggcuucgggaggcgguagcuccgggggaggcucugguucaggcaacgggggaagccaggcacagugugccuccggcacuggggcucugggaaguugcuuugaaucuagagugguggucguuugcgagaagaugaugagcagggccuguugggcaaaaucaaagcaccuuauccacuccaagaccuuccguggcaugacauugcugcauuuagcggccgcucaggguuaugccacgcucauccaaacccugauuaaauggcggacuaagcacgcagauaguauagaccuugagcuggaaguggauccuuugaauguagaccauuuuagcugcacaccgcucaugugggcuugugcccuggggcaccuagaggcagccgugguccuguacaaaugggauaggagagcuaucucuauuccagacucccucggaagacugccccuuggcaucgcgcgcucacggggucacgugaaguuggccgaaugccuggagcauuuacagagagacgaacaggcacagcucggccaaaacccuaggauucacuguccagcuagcgaggagcccucgaccgaaucuuggauggcccaguggcauagugaggccaucuccagcccugaaauaccgaaagggguuacagugaucgcuucaacuaaucccgagcugcgccgaccacgguccgaaccuucuaacuauuacagcagugagucccacaaggauuaccccgcaccaaagaaacauaaacuuaauccugaguauuuccagacccgucaggaaaaacugcuacccacggcccucagccuggaggaaccaaacauuagaaagcaaucuccgucaaguaaacaguccgucccugagacauugagccccucugaaggagugagggacuuuucgcgcgagcugucaccacccaccccugagacugcggcuuuccaggccagcggcucccaaccaguugggaaguggaauaguaaggauuuauacaucggagugucuaccguccagguaacaggcaaccccaaagguacuagcguggggaaggaagcagccccuucccagguucggccgagagagccaaugucagugcucaugauggcuaauagggaagucgugaacaccgagcugggaaguuaucgagacucugcagagaacgaagagugcggccagcccauggaugacauucaaguaaauaugaugacacuugccgaacacaucauagaggcgacgccugaucgcauuaaacaggaaaacuuugugcccauggagagcuccggccuggagcggaccgacccagcuacuaucucaagcacaaugucuugguuggccuccuaccucgcagaugccgacugucugccuagugcugcccagauuagaagcgcauauaaugaaccccuaaccccaucguccaacacuucucugucaccugucgggagcccgguuagugagaucgcuuucgaaaagcccaaucuuccauccgccgcggauuggucugaguuucucagcgccucaacauccgaaaaaguggagaacgaguucgcacagcugaccuugagugaccacgaacaaagggagcuguacgaagcugcccguuuagugcagacggcuuuucgcaaguauaagggacggccucucagagagcagcaggaagucgcagccgccgugauacaaaggugcuaccgaaaauacaagcaguaugcucuguacaaaaagaugacucaggcggcaauccuuauucaaagcaaauuccggucuuauuacgagcagaagaaauuucagcagucacgcagagccgcuguucugauccaaaaguauuacagguccuauaagaaaugugguaagcggcgacaggccagacgcaccgcaguaauugugcagcagaaauugaggagcucucuccugacaaagaaacaagaucaggccgcucguaagaucaugcgguuccuaagaaggugccgccaucgagucaaggagcugaaaaaggcgaaagaacuugaggacauacagcagcacccccucgccauguga

SEQ ID NO: 53789 - RNA, 3693 nt, Artificial Sequence
  derived and/or modified sequence opt3 from CAND1__Homo_sapiens__NP_060918
auggccagcgcuuccuaccacaucucuaaccugcucgagaagaugaccucaagugacaaagauuucagauuuauggcaacaaaugaccuuaugacugaacugcagaaggauagcauuaaauuggacgaugacuccgagaggaagguggucaaaaugauauuaaagcugcuagaagauaagaacggcgagguucaaaaucucgccgugaaaugccuggggccccuuguaucuaaggugaaagaauaucaggucgagacgaucguggacacccuguguacaaacauguugucggauaaggagcagcuccgggacauuucaagcaucggacugaaaacuguuauuggugaacugccuccagcgaguuccggcucugcucucgccgcaaaugugugcaagaagaucaccgggcgcuuaacaagcgccauagcuaaacaggaggaugucuccgugcaacuggaagcacuugacaucauggccgauauguugucacgacagggaggccugcuaguaaacuuccauccgaguauucucaccugucugcuuccccagcugacuagcccucguuuggcuguuagaaagaggacaaucauugcccucggucaccuggugaugucuugcgggaauaucgucuuuguggacuuaauagagcaucugcucuccgagcuuagcaaaaacgacagcaugaguaccacgcggacuuacauucaguguaucgcggcaauuucucgccaagccggacacagaaucggcgaauaucuggagaagaucauuccauugguggucaaauucugcaauguugaugacgaugaacuaagggaguacuguauacaggcuuuugaauccuucgugcggcgcugccccaaggagguauauccucaugugagcaccaucauuaacaucugucugaaauaccucacauaugacccaaauuacaacuacgaugacgaggaugaagacgagaaugccauggaugcagacggcggggaugacgacgaucagggaucggacgaugaauauucugacgaugacgauauguccuggaaggucagacgagcugccgcgaagugccuggacgccgugguuucaacuaggcacgagaugcuucccgaauuuuacaaaaccgugaguccugcacugauaagccgguucaaggagcgugaggaaaacgucaaagcugauguguuucacgccuauuugucccuccugaagcagacacgcccaguacaaucuugguuaugugacccggaugcuauggagcagggugaaacccccuuaacgaugcuacagagccaaguuccuaauauugugaaagcccuccauaagcagaugaaggagaaaucagucaagacuagacagugcugcuucaacaugcugacagaacuugugaacgucuugccaggcgcacugacccagcacauccccgugcucguuccugggaucauuuuuagucugaaugacaaauccucaucuucaaaccuuaagaucgaugcccugaguuguuuguacgugauucucugcaaucauagcccacaaguauuccacccccacguccaggcucuggugccgccuguuguggcgugugucggagaccccuuuuauaaaauaacuuccgaggcauuacuggugacacagcagcuaguaaaggugaucaggccacucgaccaaccuucuucguucgaugccacccccuacauuaaggaccuguucacgugcaccaucaaacggcuuaaggcugccgauaucgaccaggagguuaaagaacgagcaauuagcuguaugggccagauaaucugcaacuugggugauaaucugggguccgaccucccaaacacacugcagauuuuucuggagcgccugaagaaugaaaucacuagacuuaccacagucaaagccuugacucucauugcuggaucaccccugaagaucgaucuaaggccugugcugggcgagggcgugccaauacucgccaguuuccugcggaagaaccaacgcgcacuuaaauuggggacccugucugcguuagacauccucauuaagaauuauagcgauucccugacagcugccaugaucgacgcaguccuugaugagcugccgcccuugauuucagaaagcgacaugcauguuucucagauggccaucuccuuucucaccacucuggcuaaaguguacccuaguagccuaucuaagauauccggaucaauucugaacgagcucaucggucuggugagaaguccacuuuugcagggcggggcccugagcgcaauguuagauuucuuucaggcucucguagucacgggaacaaauaaccugggcuacauggaccuucugaggaugcuaaccggucccguguauucgcaauccacugcccucacccacaaacagucuuacuauagcauugcgaaguguguugccgcucugacacgugcaugcccuaaagaagggccagccguggucggccaguucauccaagacgugaaaaauucacggaguaccgauuccauacgauugcuggcuuuacucucucugggagagguuggccaucacaucgaccuuagcgggcagcuggaauugaaguccgugauucucgaggccuuuucaagccccagugaggaaguaaagucugcagcguccuacgcccugggaagcaucucggucgguaaccuaccggaguaucugccuuucgugcuucaggaaauuacuucacagccaaagagacaauaccuccuguugcauucucugaaagagaucauaaguuccgcuagcguggucggcuuaaagcccuauguugaaaauauuugggcccuccugcuuaaacacugugagugcgcagaggaagggacaaggaacgugguagcugagugucugggaaaguugacgcucaucgauccugaaacccugcuaccccgccugaagggcuaccuuaucucugguagcuccuacgcccggucaaguguggucacugcagugaaauuuacaauuagcgaccacccacagccuaucgauccccuccugaagaacugcauuggggacuucuugaaaaccuuagaggauccagaccugaauguuagaaggguggcccucgucacauuuaacucugcugcgcauaauaagccgucccugauacgcgaucuucuggacacuguguugccucaccuauauaacgaaaccaaaguucgaaaggagcugauccgggagguggaaaugggccccuucaagcauacggucgaugacggacucgacauucguaaagccgcauuugagugcauguacacccugcuugauucauguuuagacagacuggauaucuucgaguuccucaaucacguagaagacggcuugaaggaucacuaugacauuaaaaugcugacauuucucaugcuggugaggcuuaguacucugugcccaagcgcuguuuugcagcgccuagaucggcugguggagccccucagagccaccuguacaacuaaggucaaagccaacuccgugaagcaggaguucgaaaagcaagacgaauuaaaaaggucugcuaugcgagcaguagccgcgcugcuuaccaucccugaggcugaaaagucgccacugaugagcgaguuucagucacagauauccaguaaucccgagcucgccgcaaucuucgaaucuauucagaaagauagcuccucaacgaacuuggagucuauggacacaagcuga

SEQ ID NO: 53790 - RNA, 3711 nt, Artificial Sequence
  derived and/or modified sequence opt3 from CAND2__Homo_sapiens__NP_001155971
augagcaccgccgcuuuccacaucuccucucugcucgagaagaugacaucaagugacaaagauuuuagauucauggcaacuagcgaccuuauguccgaacugcagaaggauucuauucaauuggacgaggauucggaaaggaaaguggucaagauguuacugcggcuacucgaggacaaaaacggcgaaguucagaaucuggccgugaagugccuugggccccugguagugaaggucaaagaguaccagguggagacgauaguugauaccuuguguacaaacaugcgcucagacaaggaacagcuccgagauaucgcgggaauuggucugaaaacugugcugagcgagcucccuccagcugccaccggcaguggguuagcaacaaaugucugccguaagaucaccggacaacugacuuccgccauugcucagcaggaagacguggcaguacagcuugaggccuuggauauccugucugacaugcuaagcagacucggcguuccgcugggugcuuuucaugccucccuucugcacuguuugcucccccaacugucaaguccuagguuagcggugcggaaacgcgcagucggggcccugggacaucucgcugccgcaugcagcacagaucuuuucguggagcuggcugaccacuugcuagacagacugccaggccccagggugccuaccucuccaacggccauacggacucucauccagugucugggcuccgucgggcgccaggcgggacaucgacuuggugcccaccuggauagauugguuccccucguggaagacuuuugcaaccuggaugacgaugaguuaagggaaucaugucugcaggcauucgaggcuuuucuacggaagugcccuaaggaaaugggcccacacguaccgaaugugaccagccucugucugcaauauauuaaacaugaccccaacuacaauuaugauagugacgaggaugaggaacagauggagacagaagacucugaguucuccgaacaggagagcgaggaugaauacucggacgacgaugacaugucuuggaagguccgucgcgccgcugccaaaugcaucgcagcccuuauuuccucaagaccugauuugcugccagacuuucacuguacucucgcucccgugcugaucaggcgguucaaggagcgagaagagaacguuaaagcggauguguuuaccgcauauauaguccuucugcgccaaacacagccuccaaaggggugguuggaagccauggaggagcccacccagacgggaaguaaucuccauaugcugagaggccaggugccguuaguaguuaaagcucugcaaaggcagcuaaaggaccggagcgugcgcgccagacaggguugcuucucccuccugacugaacuugcaggggucuugccuggaucucuggccgagcacaugcccgugcucgucagcggcauuaucuuuucacuggcugauaggaguuccagcucuacaauucguauggacgccuuagcauuccugcagggccuuuuggggaccgaaccagcggaggcuuuccacccucaucuccccauccugcuaccacccgugauggccugcguugcagauucauuuuacaagaucgccgcugaggcccuggugguacuccaagaacugguccgggcacuuuggccuuugcaccgaccaagaaugcuggacccggagcccuaugugggagaaaugagugcuguuacuuuagccaggcuccgcgcgacagaucuggaccaggaggugaaagaacgggccauuagcuguaugggucaucuugucggccaccugggggauagauugggagacgaccucgagccuacccugcuacugcuccuggauaggcuucgcaacgagauaacgcgauugccagcuaucaaggcacugaccuuaguggccguaucuccccuccagcuggaccuucagccuauucuggcugaagcccuacauauccucgcauccuuccugcggaaaaaucaacgugcguugagacuggccacauuagcugcccucgaugcacuggcucagucgcagggccuuagccugccacccuccgccgugcaggcaguuuuggccgagcucccggcucuggucaacgaaucagacaugcacguggcgcaacuagccguggauuuucuggcaacugucacccaggcucagccugccagucuuguugaggugucugguccagugcucagcgaacuguugaggcuguuacgcucaccccuccugccugccgggguacuugcugcagccgagggcuuccugcaagcguuggucggaacacggcccccaugcguggacuacgcuaagcucauaucccugcuaacugccccuguuuacgagcaggcaguggauggcgggcccggacugcacaaacaggucuuucauagccuugccagauguguggcugcacucucugccgcgugcccacaggaagcugccuccaccgcaaguaggcugguuugugacgcccgaagcccgcacucuuccacaggugugaagguauuggcuuucuuaucacuggccgaggucggccaaguggcagggccuggacaucagcgcgaacucaaggcugugcugcuugaggcccugggcagucccagcgaagauguccgggcggccgcaucguaugcuuuggguagaguuggggccggcucccuaccagacuuucugcccuuccuccuggagcagauugaggcugaaccuaggcgucaguaccuuuuacugcacucucuccgcgaggcauugggagccgcccaaccagauagccugaaacccuaugcugaagacaucugggcgcuccuguuucagcggugcgagggcgcagaggaagggaccagaggagugguagccgaguguaucgguaaacuugugcuggucaauccuucauucuugcuaccgaggcugcgaaagcagcucgcugccggccggccacacacucgcaguacggugauuacagcaguuaaguuuuuaaucuccgaucagccccauccuauugacccacugcuuaaaucuuucauaggggaauuuauggagagccugcaagaccccgaucucaacgugagaagggccaccuuggcuuucuucaauuccgcgguccacaacaagccuucacuggugcgggaccuccuggaugacauccuuccgcuacuguaccaggaaacuaagauucgaagagauuugauccgcgagguugagaugggacccuuuaaacauaccguggacgauggcuuagacgucaggaaggccgcauucgaaugcauguauagccugcucgagaguugucugggucagcuugauaucugcgaauuucugaaccacguagaggacgggcucaaagaucauuacgacauucguauguugacauucauaaugguggcucggcuggccacccuauguccagcaccuguucugcaaagaguggacaggcucaucgaaccccuucgcgccacuugcacagcuaaggucaaagccggcucugugaagcaggaguuugagaagcaggaugaacugaaacgauccgcgaugagagcaguagccgcuuuauugacgauuccagaggugggaaagagcccuaucauggccgacuucucgucacagauucggucuaaucccgaacuggcugcacucuuugagaguauccaaaaagauuccgccagcgcuccaucuaccgacagcauggaacuguccuga

SEQ ID NO: 53791 - RNA, 1206 nt, Artificial Sequence
  derived and/or modified sequence opt3 from CANT1__Homo_sapiens__XP_005257079
augcccgugcagcugagcgagcacccugaauggaacgaguccaugcauucucucagaaucucagucggcgggcuuccaguucuggccaguaugaccaaggcugcagacccgagguuccggccccgcuggaaagugauuuugacauuuuucguaggagccgcgauauuauggcugcuaugcagccaccgaccugcuccaggucgucccccuacucauaaugcccacaacuggagacucggccaagcaccagccaauugguacaacgauacguauccccuguccccuccacagaggaccccggcugggauccgguaccgcauugcagugaucgccgaccuugauacagaaucuagagcucaggaggaaaauacuugguuuucguaucugaagaaaggauacuugacccucucagacagcggcgauaaggucgccguggagugggacaaagaucaugguguucuggagagucaccuggcggaaaaggggaggggaauggagcucuccgacuuaauuguguucaacggcaagcuguauucugucgaugaccggacaggcgugguauaccagaucgaagggagcaaagcaguucccugggugauacuuuccgauggagacgguaccgucgagaagggcuuuaaagccgagugguuggcugugaaggaugaacgccuguaugucgggggacuaggcaaagaguggacuacaaccacgggugacgugguuaaugaaaacccugagugggugaagguagugggguacaagggaucagucgaccacgaaaauugggugaguaacuacaaugcccuccgagcagcugccggcauccaaccacccggcuaucugauucaugagagcgcguguuggucugauacucuucagagaugguucuuucugccuaggcgggccucccaggagcguuacucagaaaaagacgaugagcgcaagggggcaaacuugcuccugagcgcuaguccagacuucggagauaucgccguuucucacgugggugcugucgugcccacccauggcuuuuccagcuucaaauuuauuccgaauacagacgaucagaucauaguagccuuaaagucggaagaggacucugggagaguugcauccuauauuauggccuucacucuggauggaagguuucuccuuccugaaaccaaaaucggcucagugaaguacgaggguauugaguucaucuga

SEQ ID NO: 53792 - RNA, 1941 nt, Artificial Sequence
  derived and/or modified sequence opt3 from CANX__Homo_sapiens__XP_011532966
auguaccagaaggagaacacccaauggcugagaaaucucgccgugacagcucccauccuugaagcauccaacccugucggcgaggggcagggaguuaaauccaggaaggccccagaaucuucaaguaaaugcauuagcuuccacacugguggccuggagauaauggaagggaagugguuguuauguaugcugcuagugcucggaacggcgaucguagaggcucaugacggccacgaugacgaugugauugacaucgaggaugaccuggaugacgucauugaagagguggaagauuccaaaccggacaccacagcacccccuucuucgccaaagguuacuuauaaggcccccgugccuaccggugaggucuacuuugccgauucauucgaccgggggacacuuagcggauggauccugaguaaagcuaagaaagaugacaccgacgaugagauagcaaaguaugacggcaaaugggaaguggaggaaaugaaggaguccaaguugccaggcgauaaagggcucguacugaugucucgcgccaagcaucacgcuaucagcgccaaacugaauaagcccuuucucuucgacacuaaaccuuuaauuguucaguacgaagugaacuuucagaauggaaucgagugcgguggcgcguaugucaagcugcuuuccaaaacaccagaguugaaccuggaucaauuccaugacaagaccccguacacgauuauguuugggcccgauaaguguggagaagacuauaaacuacacuucaucuuucgacacaagaauccuaaaacuggcauauacgaggaaaagcaugcaaaacguccagaugccgaccucaagaccuacuucacagauaagaaaacucaccuguauacccuuauucugaaccccgacaauucauuugagaucuugguggaccagaguguggucaacagcgguaaucuccugaacgauaugacaccuccaguuaaucccucuagagaaauugaggacccggaggauaggaagccugaagacugggaugagcggcccaaaaucccagacccugaagcugugaagcccgaugacugggaugaggacgccccagcaaaaauccccgaugaagaggcuaccaagccugaggggugguuagacgaugaaccagaguacguaccggaccccgacgccgaaaagccugaggauugggacgaggauauggacggagaaugggaggcgccacagauugccaacccccgcugcgaauccgcaccuggcuguggcguguggcagagaccagucauagauaaucccaacuauaaagggaaguggaaaccgccuaugaucgacaacccaucauaccaaggaauuuggaagcccaggaaaaucccuaaucccgauuucuuugaggaccuggaaccauuccggaugacgccuuucagcgcuauaggucucgagcuuuggaguaugacuucugauaucuuuuucgacaacuuuauuaucugcgccgaucgccgaauuguggacgauugggcuaaugacggcugggggcugaagaaggccgcagacggagccgcugagcccggcguugugggucagaugaucgaagcggcagaggaaagaccaugguugugggucguguauauucuaacaguagcccugccgguuuuccucgugauacuguuuuguugcuccgggaaaaagcagaccagcggcauggaguacaaaaagacugaugcuccucagcccgacgucaaagaagaggaggaagagaaggaagaggaaaaagauaagggagacgaggaggaagagggcgaagagaaacuugaggaaaagcaaaagucggaugccgaggaagacgggggaacagugucucaggaggaagaggauaggaaaccaaaggcagaggaagacgagauccugaaccggagcccccguaaucgcaaaccuagaagggaauga

SEQ ID NO: 53793 - RNA, 1428 nt, Artificial Sequence
  derived and/or modified sequence opt3 from CAP1__Homo_sapiens__XP_011538812
auggccgacaugcagaaccugguggagagacucgaaagggcugucggccggcuugaggcaguuagccacaccuccgauaugcaucgcggguacgccgacucucccucaaaggcgggagcugccccuuaugugcaagcauucgauagucuguuggccgguccaguagcugaauacuuaaaaaucagcaaggagauuggcggggacgugcagaaacacgcagaaaugguccauacaggacugaagcuagagcgagcccuccuggugacugcuucccagugccagcaaccggccgagaauaaacuuucugaucuguuggcgcccauaucggaacagaucaaggagguuauuacguuucgugaaaagaacagaggcucaaaacucuucaaucaccugagcgcagugagugaguccauccaggcccuggguugggucgcuauggccccuaagccagggcccuaugugaaagagaugaacgacgcagcuauguuuuacaccaauaggguacucaaggaauauaaagauguugacaagaagcauguggauugggucaaagccuacuuaucuauuuggacagagcugcaggcguauaucaaggaguuccacacuaccggacuugccuggagcaaaacaggcccuguggcaaaggaauuguccggccugccaucagggcccagugcuggaagcuguccuccaccgcccccuccaugucccccuccacccccggugucuaccauauccugcucauacgaaagcgccagucggucuucccuauuugcucaaaucaaccagggugagagcauuacucacgcccucaaacaugucucggacgauaugaagacacacaaaaauccugcacugaaggcccagucuggccccguucgcuccgggccaaagccuuucucagcucccaaaccacagaccagucccagcccuaagagagcgacgaaaaaggagccagcagugcuugaacuggagggaaagaaguggaggguagaaaaccaagagaauguguccaacuuggucaucgaagacacugagcucaaacagguggccuacauuuauaaaugcguuaauaccacacugcagaucaagggcaaaauaaacucuauuacuguggauaauuguaagaaauuaggucuggucuuugacgacgugguagggaucguugagauuaucaacagcaaggaugugaagguccaagugaugggaaaagucccgaccaucucaauuaauaagacagacggcugccaugcuuaccucaguaaaaacucccuugauugugaaauagugagcgccaagucuucagagaugaacguucugauccccaccgaaggcggggacuucaaugaguuuccugugccagaacaguucaaaacguuguggaacggacagaagcuaguaacuacagucaccgagauugcagguuga

SEQ ID NO: 53794 - RNA, 1434 nt, Artificial Sequence
  derived and/or modified sequence opt3 from CAP2__Homo_sapiens__NP_006357
auggccaacaugcagggccugguggagagacucgaaagggcugucagccggcuugagucccugucugcagaaucacaccgacccccugggaauugcggagagguuaacggugugaucgccggcguagcgccaaguguggaggcuuucgacaaguugauggauagcauggucgccgaauuucugaaaaauucccgcauuuuagcaggggacguggagacccaugccgaaaugguucacucugcuuuccaagcacagcgugccuuucuacucauggcuucgcaguaccagcaaccgcaugagaacgauguggccgcgcugcuuaagcccauaucagagaaaauccaggaaauucagacauucagagagaggaaucggggaagcaacauguuuaaucaccugagugcagucuccgaaucuaucccugccuugggcuggauugcugugagcccaaagcccgguccuuauguaaaagagaugaacgacgccgcaacuuucuacacgaaucgcguucucaaggauuauaagcauuccgaccugagacacguggauugggucaaaucauaccugaacaucuggagugaacuccaggcuuauauaaaggagcaccauaccacaggguuaacuuggagcaaaaccggaccaguggccucuacaguguccgcguuuucaguccugagcaguggccccggccuuccuccaccgcccccuccauugcccccuccagggcccccgccucuguucgaaaaugagggaaagaaagaggaaucuucccccagcaggucggcccuauuugcacaacucaaccagggugaggcuaucaccaagggccugcggcacguuacugacgaucagaagacauacaaaaauccaucucuucgcgcccaagggggacagacccaguccccuacgaagucacauacucccaguccaaccagccccaaauccuauccuucucagaagcacgcuccagugcuggaauuggagggcaaaaaguggcgaguagaauaccaagaggacagaaacgaucucgugauuagcgagacagaacugaaacaggucgccuacaucuucaagugugagaagucaacuauucagaucaaagguaaggugaauaguauaauuaucgacaacugcaaaaaguuagggcugguuuuugauaacguggucggaauuguggaaguaaucaauucccaggacauccaaauucagguuaugggcagggugccgaccauaagcaucaacaaaacagagggcugucacauuuaucucucugaagacgcacuugauugcgagaucgucucagccaagaguagcgagaugaauauacugauuccccaggacggggauuaccgggaguucccuaucccagaacaguuuaagaccgcuugggacggauccaaauugaucacggaacccgcggagauuauggcauga

SEQ ID NO: 53795 - RNA, 1002 nt, Artificial Sequence
  derived and/or modified sequence opt3 from CAPG__Homo_sapiens__NP_001243069
auguacaccgccaucccccagagcggcuccccuuucccagggucugugcaagacccgggacugcacgucuggagaguugagaagcucaaacccgugccuguagcucaggaaaaccaggguguguuuuucucaggcgauaguuaucuuguccugcauaaugggccagaggaagugagccacuugcauuuauggauuggacagcaauccucuagggacgagcagggcgcaugcgccguucuggcggugcaccuaaacacacuccugggugaacggcccguccagcaucgcgaggugcaggggaaugagucggaucuuuuuaugucauacuucccucgaggacugaaguaucaagaaggcggcguagagagcgcuuuucacaaaacgaguacuggggccccagcagccauaaagaaauuguaccagguuaagggaaagaaaaacauccgugcuaccgaaagagcacucaauugggacuccuucaacacaggugauuguuuuauucuggaccugggccagaauaucuucgccuggugcgggggaaagucuaacauucucgagaggaauaaagcucgggauuuagcccuggcgauccgcgacagcgagagacagggcaaggcacaagugcuuggucccaaaccugccuugaaggaagggaacccagaggaagaucugacugcugacaaggccaaugcacaggcugccgcgcuauauaaagucuccgaugccaccggacagaugaaccucacaaagguggcagacucaaguccguuugcucuggagcuucugauaagcgaugacuguuucguguuggacaauggccucugcggcaaaaucuacauuuggaaggggaggaaagccaacgaaaaggagcggcaagcugcccugcaggucgcagagggauuuaucucucgcaugcaguaugcccccaauacccagguugaaauuuuaccucaaggucacgaguccccaaucuucaaacaguuuuucaaggauuggaaguga

SEQ ID NO: 53796 - RNA, 2019 nt, Artificial Sequence
  derived and/or modified sequence opt3 from CAPN10__Homo_sapiens__NP_075571
augagagccggcaggggagcuacccccgcacgggagcuguuccgcgacgccgcguuuccugcugccgauagcucccucuucugcgaccuuucuacaccacuggcacaguuucgagaagauaucacuuggcguagaccgcaagagauuugugccacgcccagguuguucccugacgauccacgggaaggacaggugaagcaggguuuacugggcgacugcugguuucuaugugcuugcgcagcccuccagaaaucacgccaucugcuugaucaagucauacccccugggcagccaaguugggcugaccaggaguacagagggagcuucaccuguaggaucuggcaguuuggccgguggguugaagugacaacugaugaccgccugcccugcuuggccggucgacucuguuucuccagaugccaaagggaggauguauuuuggcugccucugcucgagaagguguaugcgaaaguccacgggucuuacgaacacuuaugggcaggacagguggccgacgcucugguugaucuuaccggcggcuuggccgagcgguggaaccugaaggggguggcaggaucggguggccagcaggaccguccagggcgcugggaacauagaacauguaggcaacuacuccaccugaaagaccagugccuuauuucauguugcguccugagcccgcgggcuggagcccgagaguugggcgaguuccaugcguuuaucgugagugaucuccgcgaacugcagggucaagccgggcagugcauuuuacugcucagaauccagaaucccuggggaaggcgguguuggcagggccuuuggcgcgagggcggggaaggauggucccaaguagacgcagcuguugccucugagcuguugagccagcuacaggaaggugaguucuggguggaggaagaggaauuucugagagaguucgaugaacucaccgucggcuauccugugacugaggcugggcaucugcagucccuuuacacagagaggcuguugugccacacccgugcccucccaggagcaugggugaagggccaaucagccggugggugucggaacaauaguggcuuccccagcaacccuaaguuuuggcugcgagucucugaaccauccgagguuuauauagcuguguuacagagaucaaggcugcacgcggcagacugggccggacgcgcucgggcccuaguaggcgauagccacacgaguuggucucccgcauccaucccggggaaacauuaccaggccgugggacuccaccuguggaaggucgagaaaagaagggugaaucuuccucgcguuuugagcaugcccccaguggcugguacugccugccacgcauaugaccgagaaguccaucugcggugugaacucucgccuggcuacuaccuggcggugcccucuaccuuccuuaaggaugcuccaggggaguuucuguugcguguauucuccacaggaagaguuucacucagugccauuagggcaguggccaaaaacacuacccccggcgcugcccugccugcuggugagugggggacaguccaguuacgcggcagcuggcgggugggacaaaccgcaggcggguccagaaauuuugccucuuauccaacgaacccgugcuuccccuuuagcgucccugaaggaccaggucccaggugugugcgaaucacucugcaccagcauugccgcccuucagacacagaguuccacccaauuggcuuucauaucuuccagguucccgaagggggacggagucaggaugcgccgccucuacuccugcaagagccacuuuuguccugugugccccacagauacgcccaggagguaagcaggcugugccuccugccugcuggcaccuauaaggucgugcccucuacuuacuuaccagacacagaaggugcauuuaccguuacgauagccacccguauugaucgcccuucaauccacagucaggagaugcuggggcaauuccuucaggaagugagcgucauggcugugaugaagacauga

SEQ ID NO: 53797 - RNA, 2010 nt, Artificial Sequence
  derived and/or modified sequence opt3 from CAPN13__Homo_sapiens__NP_653176
auggccuacuaucaggagcccagcguggaaaccuccaucauuaaguucaaagaccaagauuuuacaacucugagagaccacugccucucuaugggcaggacguucaaggaugagaccuuuccugcugcagacucaaguauagggcagaaacuucugcaggaaaagcgguugagcaacgucaucuggaaacgcccacaggauuuaccgggaggucccccucauuucauucuggacgauaucucccgauuugacauucaacagggcggggccgcggauuguugguuccuagcugcccucggaucucugacacagaauccacaguaccgucaaaagauccuuaugguucagucguuuucacaccaguaugcaggcauauucagauuuagguucuggcagugcggucaauggguggagguagugaucgacgaucggcugcccguccagggggacaaguguuuguuugugcgcccuagacaucagaaccaagaguucuggccaugccuccuggaaaaagccuacgcuaagcugcucggaagcuauagugauuuacacuacggcuuucuggaggacgcacuuguugacuugacuggcggggugauuaccaauauccaucugcacuccucucccgucgaucuagugaaagccguaaagacagcuaccaaagccggaagccucauuacuugugcgacaccuuccgguccaaccgacacggcacaggccauggaaaacggccugguuucacuucacgcuuauacugugaccggggccgagcagauccaguacaggcggggaugggaagagauaauuagucuguggaauccguggggcuggggugaggcagaauggcgcgggcgauggagcgauggaucucaagagugggaagagacaugcgaccccagaaagucccaguugcauaagaaaagggaagauggcgaguucuggaugucaugucaggacuuccagcaaaaguuuaucgcuauguucauuugcagcgagaucccuaucacucucgaucacggcaacacccugcaugaaggguggagucagauuauguuucggaaacaggucauauuaggaaauacagccgguggcccacguaacgacgcgcaguucaauuuuucugugcaagagcccauggaagggaccaacguggucguuugugugacgguagccgugacuccuuccaaucugaaggcagaggaugcuaaauucccacucgacuuucaggucauccuugccggaagccagcgcuucagagaaaaguuucccccgguguucuuuucgucuuucaggaacacaguucaguccucaaauaacaaauuucggcgaaauuucaccaugacuuaccaccugaguccuggcaacuauguggucguggcucaaacacgcagaaagagcgccgaguucuugcuaaggauuuuucugaagaugcccgauuccgaccggcaccucucuagccauuucaaccugcgcaugaaagguucaccaagugagcacgggucccagcagagcaucuuuaauagauacgcacaacagaggcuugacauagaugccacccagcugcagggcuugcucaaccaagaacuguuaacgggaccucccggcgacauguucucucuggaugagugccguagucuaguagcucucauggaacugaagguuaaugggcggcuugaccaggaggaauuugcgcgauuguggaaaagacuggugcauuaucagcacgucuuccagaaggugcaaaccucaccaggaguccuccugagcuccgaucuuuggaaagcaauugagaacacagacuuucugagggguaucuucaucucucgcgaguugcuccaucuggugacuuuacgguacucggauagcguuggcagaguguccuuucccucacugguauguuuccuaaugaggcucgaagccauggcuaagaccuuucgcaaucugaguaaggacgggaaaggacuuuauuugacagagauggaauggaugucucuggucauguacaacuga

SEQ ID NO: 53798 - RNA, 2055 nt, Artificial Sequence
  derived and/or modified sequence opt3 from CAPN14__Homo_sapiens__NP_001138594
augagccuguggcccccuuucagaugccgcuggaagcucgccccacgguacucccgccgagcuucuccgcagcaaccccagcaggacuuugaggcacuucuggccgaauguuugcguaacggcugcuuauucgaggauaccucauuuccugcgacacugaguagcaucggguccggaucucuacuccagaaacugccacccagacuucaauggaagaggccuccagaacugcacucgaauccccaguucuauuuugcuaaagccaagcgguuggaccucugucaggguauugugggcgauugcugguuccuggcagcccugcaggcucucgcauuacaucaagacauacugucacgcgucguuccucuuaaccagagcuuuacugagaaauacgccgggaucuucagauuuugguucuggcacuauggaaauugggugccaguagugauugaugacagguugccggucaacgaagcuggccagcugguguuuguuaguuccacguacaagaaucuauucuggggugcccuccuggagaaggcguaugcaaaacuuucugggagcuacgaggaucugcaguccggacaagugucagaagccuuggucgacuuuaccggcggcgugacaaugacuaucaaccucgcugaggcccaugggaaucugugggauauuuuaaucgaagcaaccuauaaccggacacugauaggaugucagacccacaguggugagaagauccucgagaauggccuuguagaagggcaugcuuacacucugacaggaauuaggaaaguuaccugcaagcaccgacccgaguacuuggugaaacuaagaaacccuuggggcaaggucgaauggaagggugacuggagcgauucuuccucaaaaugggagcugcucagcccaaaggaaaagauccugcuucugaggaaagacaaugauggggaguucuggaugacguugcaggacuucaaaacucacuuugugcuccuggugauuuguaaguuaacccccggacugcuaagucaagaggccgcgcagaaauggacauauacuaugcgggaaggccguugggagaagcgcucuaccgccggcgggcagagacagcuccugcaagacacauucuggaagaacccucaguuucuuuuguccgucuggaggccagaagagggacggcgaagccugcgccccugcucgguucucgugucucugcuucagaaaccgagacauaggugucggaagcgcaaaccucuguuggcaaucgguuucuaccucuauagaaugaauaaguaccacgaugaccagaggcgucugcccccagaauuuuuccaacggaacaccccuuuaucccagcccgaucgauuucugaaagagaaggagguaucacaggaacuaugccucgagccaggcacguaucugauagugcccuguauucuugaagcucaucagaagagugaguucgucuugagaguguuuagcaggaaacacaucuucuacgaaauuggguccaauucuggaguuguguuuagcaaggagaucgaggaccaaaacgaacgccaggaugaguucuuuacuaaauucuucgaaaagcacccugagaucaacgccguccagcugcagaaucuccugaaccaaaugacauggucaaguuuaggcucccggcagccauuuuucagccuggaggcuugccaggguauucuugccuugcucgaccugaaugcaucugggaccaugucaauacaagaauuuagagaucuauggaaacagcugaagcucagucagaagguguuccauaaacaggacaggggcagcggauaucugaacugggagcaacuucacgccgcuaugcgcgaagcgggcaucauguuguccgaugacguaugccagcugauguuaauucgauacgggggaccgcggcuccagauggauuuuguuucuuucauccaucugaugcuucguguggagaauauggaagacgucuuucagaaccugacucaagacgguaagggcauauacuugcagaaacccgaguggaugaugauggcacucuauucguga

SEQ ID NO: 53799 - RNA, 2145 nt, Artificial Sequence
  derived and/or modified sequence opt3 from CAPN1__Homo_sapiens__XP_011543594
augagcgaggaaaucauuacccccguguacugcacaggcgucuccgcccagguucaaaagcagagagcuagggagcuggggcucggacggcacgaaaacgcaauaaaauaucuuggucaggacuacgagcagcugcgcgugcgauguuugcaaucuggcacuuuauuccgugaugaagccuuuccuccaguaccgcagucacugggguauaaggaccuaggacccaauaguagcaaaacguacggcaucaaguggaaaagaccuaccgagcuccuguccaacccacaguucauuguggauggugcgacaaggacugacaucugccagggggcucuuggagauuguuggcuguuggccgcaauugccucucucacccugaaugacacacugcuccaucgggucgugccccacggccaaucguuucagaacggcuaugcugggaucuuccauuuucaguuauggcaguucggagaguggguugauguggucguggacgaucugcuuccuauaaaggacgguaaguugguauuuguucacucagcagaaggcaaugaguucuggagcgcccugcuagaaaaagcguacgccaaggugaacgggaguuaugaggcgcucuccggaggcucuaccagcgaggguuuugaagauuucacugggggagucacagagugguacgaacugcgcaaagcaccauccgaccuuuaccaaaucauucugaaggccuuggagagaggcucacuccugggcugcaguaucgauauuagcucuguguuagacauggaagcuaucaccuuuaaaaagcuggugaaggggcaugccuauuccgucacgggagcaaaacagguuaauuacaggggucaggugguaucacucauacggaugcgcaaccccuggggcgagguggaguggacuggggcuuggagcgacaguucuuccgaauggaauaacgucgauccuuaugagcgagaccaacuuagagugaagauggaagauggagaguucuggaugagcuuuagggacuucaugcgggaguucacccgucuggagauuuguaauuugacaccagaugcccuaaaaucgcgcacuaucagaaaguggaacaccacacuguacgagggcaccuggaggcgggguucuacggcugggggcugccgaaauuauccggccacuuuuuggguuaacccccaguucaaaauucgccucgacgaaacagaugacccugaugacuacggagauagagaguccggcuguucauuugugcuggcacuuaugcagaagcacaggcggcgcgaaagaagguucgggcgugacauggagaccaucggauuugcugucuaugaagugccacccgagcugguaggucagccugccguucacuugaaacgggacuucuuucucgcuaaugccagucgagcaagaagcgagcaauucaucaaccugagggaaguguccacucgcuuucgguuaccacccggcgaguacgucguggucccgucuacauucgaaccuaacaaggagggggauuuugugcugagauucuuuagcgagaagucagccggaaccguugaacuagacgaucagauucaggcuaaucuccccgacgaacaggugcugagugaagaggaaauagaugagaacuucaaagcgcuuuucaggcaauuggcaggcgaggacauggaaaucuccguaaaggagcugcgcacgauucucaaucgaaucauaagcaaacauaaggaucugcggaccaaagguuuuucucuugaaucaugccguaguauggucaaccugauggacagagaugggaauggcaaguugggacucguggaguucaacauucuguggaauaggauccgcaacuacuuaagcaucuuucggaaguucgaccuggauaaauccggcucuaugucggccuaugaaaugagaauggcuauugagagcgccggguuuaagcuaaauaaaaagcucuacgagcugaucauuacaagguauuccgaaccagaccuugcaguugauuucgacaacuuuguguguugcuugguccgacuggagacuauguuccgcuuuuucaaaacccucgacacagaucuggacggagugguaacuuuugauuuauucaaguggcugcagcuuaccauguuugccuga

SEQ ID NO: 53800 - RNA, 1869 nt, Artificial Sequence
  derived and/or modified sequence opt3 from CAPN2__Homo_sapiens__NP_001139540
auggagaucugcgccgacccccaguucauuauaggcggggcuaccagaacagauaucugucaaggagcacugggugacugcuggcuccuugccgcgauugcuagccugacuuugaacgaagagaucuuagccaggguggucccucugaaucaguccuuucaggaaaacuacgcaggcauuuuccacuuucaguucuggcaauauggggaguggguugaagugguaguggaugaccggcuaccaacgaaggauggagagcuccuguuuguccauucugccgagggcucagaguucuggagugcuuugcuggagaaagcauacgccaagaucaaugguuguuaugaagcucuuagcgggggagccaccacagagggcuuugaggacuucacuggcgggauagcggaaugguacgagcucaaaaagccgcccccuaaccuguuuaaaaucauucagaaggcacugcagaagggaucccucuuagguugcucuaucgauauuaccucggccgcugacucagaagccaucacauuccagaaacuggugaagggccacgcauauagcguuaccggggcugaggaaguggagaguaauggaucccuucaaaaauugauacgcauucgaaacccauggggcgaggucgaauggacuggucguuggaaugauaacugucccucuuggaauacaaucgacccugaggaaagagagaggcugacccggcgccaugaagauggggaguuuuggaugagcuucuccgacuuucuaagacacuacucaaggcucgagauuugcaaccugacgccagauacucuuaccagugacacauauaagaaauggaagcugacuaagauggacggaaauuggcggcgcggcagcaccgccggcgggugucgaaacuaccccaauacauucuggaugaacccucaguacuugaucaaacucgaagaggaagaugaggacgaagaggauggagagucugguugcaccuuccuggugggcuuaauccagaagcauagaaggcggcagcguaaaaugggggaagacaugcacacgauuggauuuggcauauaugagguaccagaagaacuguccggucaaacuaauauccaccucucaaagaacuucuuucuuacaaaccgcgcgagagagaggagcgauaccuucauuaaucugcgggaaguuuugaaccgauuuaaacuaccgcccggggaguacauccuggugccuaguacuuucgaaccaaauaaggacggcgauuuuuguauacgcgucuucucugagaaaaaggccgacuaucaggcaguggaugacgaaauugaggcuaaccucgaggaauuugauaucuccgaggacgacaucgaugacggauucagaaggcuguuugcccagcuugcuggcgaagaugccgagauuagcgcauucgaacugcaaacaaucuugcggcgcgugcucgccaagagacaggacauuaaaucggauggguuuucuauagagaccugcaagaucauggucgacaugcuggauuccgacggaucagguaaauuaggccugaaggaguucuacauucuauggacgaaaauccagaaguaucagaagaucuacagggaaauugauguugaccguagugggaccaugaauagcuaugagaugcggaaagcucucgaagaggcgggauucaagaugcccugucaacugcaucaggugauaguagcacgauuugccgaugaccagcuuaucauugauuucgacaacuuugugagaugcuuggucaggcuggaaacacucuucaaaaucuuuaagcagcuggacccugagaauacuggcaccauugagcuugaucugaucuccugguugugcuucucugugcucuga

SEQ ID NO: 53801 - RNA, 2466 nt, Artificial Sequence
  derived and/or modified sequence opt3 from CAPN3__Homo_sapiens__NP_000061
augcccaccgugaucagcgccuccgucgcuccuagaacagcagccgagccaaggucuccgggccccguuccucacccagcgcagucaaaggcuacugaagccgggggagguaaccccaguggcauuuacagcgcaauaaucucccggaauuucccuauuaucggggugaaggagaagacguuugaacaacugcauaaaaagugccucgagaaaaagguacuuuauguggacccagaauuucccccugaugagaccucucuguuuuacucgcagaaguucccaauucaguuugucuggaaacgcccgcccgagaucugugaaaacccucgauucauaaucgacggagccaaucguacagauauuugccagggcgaguugggugacuguugguuuuuagcugcaaucgccugccugacucuaaaccaacaccuccuguucagagugauuccacaugaucagucauuuaucgaaaauuaugcugggauauuccacuuucaguucuggagguacggagaguggguugacguggucauugaugacugucuucccaccuauaacaaucagcugguguuuacaaagagcaaccaucggaaugaguucuggagugccuugcucgaaaaagcguacgcaaagcugcacggcuccuaugaggcccugaaaggcgggaacaccacugaagcuauggaggauuucacaggagguguagccgaauuuuucgagauccgcgacgcaccuucugauauguacaagauuaugaagaaagcuaucgagagaggcagccucauggggugcuccaucgacgauggaaccaauaugacguacggcacuucaccaagugguuuaaacaugggggaacugauugccaggaugguucggaauauggacaacagccuuuugcaagacucugaucuggacccccgcggauccgaugagcgaccgaccagaacaauaaucccugugcaguaugaaacuaggauggcguguggccuaguccggggccacgccuacucagugaccgggcucgacgaggugcccuuuaagggagaaaaagucaagcugguucgucuucgcaauccauggggucagguggaguggaacggcagcuggagugauagauggaaagacuggucuuucguagauaaggacgagaaagcaaggcugcagcaucaagugacagaagauggggaguuuuggauguccuaugaagacuucauuuaccacuuuaccaaguuggagaucugcaaccucacggcugaugcccugcagagcgacaaguuacagacuuggacagucucggugaaugaaggacgguggguucgaggcuguucugcuggugggugccgcaacuucccugacaccuuuuggacuaauccccaauauagacugaaacuccuugaggaggaugacgauccagacgauuccgaagugauauguucauuccuggucgccuugaugcagaagaacaggcggaaagaccgcaagcuaggcgcaagucuguuuacaauuggauucgccaucuacgaggugcccaaagaaaugcauggcaauaagcagcaccuccagaaggauuucuuccuguauaacgcuagcaaagcgagauccaagaccuacaucaauaugagggagguaucucaacguuuccggcuuccuccaagcgaguacguuauugugccgucaacguaugaaccccaccaggagggggaauuuauccugcgagucuucagugagaaaagaaacuuguccgaagagguggagaauaccauuagcgucgacaggccugugaagaaaaagaagacaaaaccaauaaucuuuguuucugaucgcgcaaacucaaauaaggaacucggaguggaccaggagagugaagaggguaaaggcaagacuagccccgauaaacagaagcaauccccucagccacagcccgggucuucggaccaggaaagcgaggagcaacagcaguuccggaacauuuuuaagcagaucgccggagaugacauggaaaucugcgcugacgagcugaaaaagguauuaaauaccgucgugaacaaacauaaggaucugaaaacacacggcuucacucuagaauccugcagaucaaugauugcccucauggacaccgaugguagugggaagcugaaucuucaagaguuucaucacuuguggaacaaaauaaaggcauggcagaagaucuucaaacauuacgacacagaucagucuggcaccauuaacagcuaugaaaugaggaaugccguuaacgacgcuggauuucaccugaauaaccaacucuacgauaucauuacuaugcgcuaugccgacaagcacaugaauaucgauuucgacuccuuuauauguugcuucgugcgacuggagggcauguuucgggcauuccaugcguucgauaaagacggggauggaaucauuaaacuuaacguccuggagugguugcagcucacgauguacgcuuga

SEQ ID NO: 53802 - RNA, 1923 nt, Artificial Sequence
  derived and/or modified sequence opt3 from CAPN5__Homo_sapiens__NP_004046
auguucagcugcgugaagcccuacgaagaccagaacuauuccgcccugagaagggauugucggcgccgaaaaguccucuuugaagacccucuuuucccagcuaccgaugacucucuguacuauaagggcacaccggggcccgcaguucguuggaaaagaccuaagggaaucugcgaggauccaagguuguuuguggacgguauuucaagucacgauuuacaucaaggccagguagggaauuguugguucguggccgcgugcagcucccuggcuucucgggaaucgcuauggcagaaagucauacccgacuggaaggagcaggaaugggauccugagaagccaaacgccuacgcaggaaucuuucacuuccauuuuuggcgcuucggcgaguggguggacguugugauugaugacagacuccccacugucaauaaccaacugaucuauugucacucaaauagcaggaacgaauuuuggugcgcccuuguggagaaggcuuacgcaaaacuggccgguuguuaucaggcuuuggaugggggaaauacggccgacgcgcucguagacuucaccggcggcguuagugaaccuauugaucugacagagggggacuuugcaaacgaugagacuaaacggaaucagcuguucgaacgcaugcucaaggugcauucccgaggagguuuaaucucugccagcauaaaagcugucaccgccgcagacauggaggcuagacuggccugcggccuugugaaggggcacgcguacgccgugacagaugucaggaagguucgguugggacacggccugcuagcauuuuucaaauccgaaaagcucgacaugauccgucugcgcaacccauggggugagagagaauggaaugggccguggucagauaccagugaggaguggcagaaagugagcaagucugaaagggagaaaaugggaguaacugugcaagacgauggcgaauuuuggaugacauuugaggacgucugucgguacuucaccgauauuaucaagugccgagugauuaacacgucccaucuuucaauccacaaaacuugggaagaggcucgccugcauggcgccuggaccuugcacgaggaccccagacagaauaggggaggggguuguauaaaccacaaggacacauuuuuccagaauccucaguauauuuuugaaguuaagaaaccagaggaugaagugcucaucugcauucaacagcggcccaagcgcagcacuagaagggagggcaaaggggaaaaccuggcuaucggauucgacaucuacaaggucgaggagaaccgucaguaucggaugcauaguuuacaacacaaagccgcaucuuccauuuacauaaauagccgaucgguguuucugagaaccgaucagccugaaggcagguauguaaucauuccaacaaccuucgagcccggucauacgggggaauuucuccuucgcguuuucacugacgugccgucuaacugccgggagcugagauuggaugagccuccccacacauguugguccucacuaugcggcuacccacagcuggucacccaggugcauguccucggagccgcuggccugaaggacaguccuacuggggcgaauagcuaugugaucauaaagugugaaggagauaaaguuagguccgcagugcaaaaggguacaucuacccccgaguacaacguaaaaggcauuuucuaccgcaagaaacuuagccagccaaucacgguccagguguggaaucaccgaguucugaaggacgaguucuuggggcaagugcaccucaaggccgaucccgacaaccugcaggcuuuacauacccugcaccuacgggaucguaauucaagacagccuaguaaccucccaggaacagucgccgugcauauccuguccagcacuucucuuauggcaguauga

SEQ ID NO: 53803 - RNA, 1926 nt, Artificial Sequence
  derived and/or modified sequence opt3 from CAPN6__Homo_sapiens__NP_055104
auggggcccccucugaagcuauucaaaaaucagaaguaccaagagcuuaaacaggaaugcaucaaggacagcagacuguuuugugauccaaccuucuugccggagaaugacuccuuauuuuauaacaggcugcuacccgggaaaguggucuggaagcggccucaggauauuugcgacgauccacaccucauaguuggaaauaucucuaaccaucagcugacacaaggucgccuuggccacaagcccauggugucagccuucaguugucuggcuguacaggaaagccauuggacuaaaacgauuccuaaucacaaggagcaggaaugggacccacagaaaaccgagaaguacgcagggaucuuucauuuccgauuuuggcacuucggagaguggacagaaguggucauugaugacuugcuccccacuaucaacggcgaucugguguuuuccuucucuaccucgaugaaugaguuuuggaacgcccugcucgaaaaagcguaugcuaaguuacuggguugcuacgaggcccuugacggguugacaauaaccgauaucauuguugacuucacuggaacacuggcagagaccguggauaugcaaaagggccguuauacggaacucgucgaggaaaaauacaagcucuuuggcgagcuguauaaaacuuucaccaagggcggacuuaucuguugcucaauugaaagcccuaaucaggaggagcaggaaguggagacagacuggggucuguugaaaggccacacuuacaccaugacagacaucagaaagauaaggcucggggaacggcugguagagguuuucagugccgaaaaaguguacaugguccgcuuaagaaacccacugggaaggcaggagugguccggcccguggucugagauuagcgaagaguggcaacagcucaccgcuuccgaucggaagaaucuuggucuggugaugucagacgauggggaauuuuggaugaguuuggaggacuucugucgcaacuuucauaagcuaaaugugugccgaaacgucaauaaccccaucuucggaagaaaagaacuggagagcguucucggcuguuggacgguggaugacgauccucugaugaacaggucuggcgggugcuauaauaaccgggacacuuuucuucagaauccacaauacauuuucacaguacccgaggauggacacaaggugaucaugucccugcagcagaaagacuugcguaccuaucgcagaauggguaggccugauaacuacaucauuggcuuugaacucuucaaggucgagaugaaucggaaauuucgacugcaucacuuauauauacaggaacgcgcagggacuucaacauacaucgacaccagaacgguguuccugagcaaguaucuaaagaaaggaaacuacguucucgugccaaccauguuucaacacggcaggacaagugaguuccugcuucggaucuuuucugagguccccgugcaguugcgcgaacugacucucgacaugccgaagauguccuguuggaaucuggccagagguuacccuaaaguaguuacccagauuacagugcauagcgcugaggaucuugaaaagaaauaugccaacgagacugucaaucccuaccuggugauaaagugcgggaaggaagaggucaggucgccagugcagaaaaacaccguucacgcgauuuucgacacacaagcaaucuucuaucgucggaccacugauaucccuauuaucgugcagguauggaacucucgaaaguuuugcgaccaguucuugggccaggucacgcucgaugccgaccccuccgauuguagagaccugaaaucauuauaccugaggaagaaaggaggcccaacagcuaaggugaagcaagggcauauuaguuuuaaaguuauaagcuccgaugaccuaaccgagcucuga

SEQ ID NO: 53804 - RNA, 2442 nt, Artificial Sequence
  derived and/or modified sequence opt3 from CAPN7__Homo_sapiens__NP_055111
auggacgccaccgcucuggagagagaugcagugcaguucgccaggcucgcgguccaacgggaccacgaaggccgcuacagcgaggcuguguuuuauuacaaggaagccgcacaggcccuuaucuaugcugagauggcaggguccucucuggaaaacauucaggagaaaauaacagaguacuuggaacgaguucaggccuuacauucagcuguacaaaguaagagcgccgauccccugaaauccaagcaccagcuagaccucgagcgugcgcauuuccuggugacucaggcauuugaugaagacgagaaagagaaugucgaagaugccaucgagcuuuauacggaagcuguggaccugugcuugaagaccucuuacgagacagccgauaagguucuccagaacaaacugaagcaacuggcaagacaggcucucgacagggccgaagcguuaucggagccucugacuaaaccagugggaaagauuucaagcaccagugucaaaccgaagcccccuccagugcgggcccacuucccccuuggugcaaauccauuuuuggagcgcccucaguccuucaucucuccccagagcugugaugcucaaggccagagauauacagccgaagagauugaaguacugaggaccacuuccaagaucaacgggauagaguacguuccuuuuaugaauguggaccuacgggaacgcuucgcuuacccaaugccguuuugcgaucgauggggaaaacucccccugucaccuaagcagaaaacaaccuucaguaagugggucagaccagaggaccuuacgaacaaucccacuaugaucuauaccgugagcucuuuuuccauuaaacaaacaaucgugucagacuguagcuucgucgccagucuggcaauuucugccgcuuacgagaggcgguuuaacaagaaauugaucacuggcauaauuuauccucagaauaaggauggugaaccagaguacaaccccugcgggaaguauaugguuaaacuccaucugaauggagugccgcguaagguaaucauugacgaucaguuaccuguggaccacaaaggcgaacugcucuguuccuacagcaacaauaagucggagcuuugggucucucugaucgaaaaagcguauaugaaggugaugggcggguacgauuuccccggauccaacucaaauaucgacuugcacgcacuaaccgguuggauuccagagcgcauagccaugcauagugauagccagacauucuccaaggacaacucuuuuagaaugcuguaccaaagguuccacaaaggcgauguucucaucaccgcuagcacggggaugaugacugaggccgaaggagagaaguggggccuggugccuacacaugcauaugccguccuugacauucgggaauuuaaaggucugcgauucauccaguugaagaaccccuggucacaccuccgcuggaaagggagauacagugagaaugaugugaagaacuggaccccagagcugcagaaguauuuaaauuuugaccccaggacugcucagaaaauagacaacggaauuuucuggaucuccugggaugaccugugccaauacuaugauguaaucuaccuaagcuggaauccuggccucuuuaaggaaucuacauguauucacucaaccugggacgccaaacagggcccaguuaaggaugcauauagucuggcgaacaauccgcaguacaaacuugaggugcagugcccccaagggggagcugccgucuggguguugcugagccggcauaucacggacaaggaugacuucgcaaacaaucgcgaauuuauuaccauggucguguacaagacagaugguaaaaagguuuauuacccugccgacccacccccuuauauagauggcaucagaauuaacuccccacacuaccucacuaaaaucaagcugaccacacccgggacucauaccuucacacuugugguaucucaguaugagaaacagaauaccauccacuacacugucaggguguauucggcuuguagcuuuacguucuccaagauuccgucaccuuacacacugaguaaacguauaaacggaaaguggucuggccagagcgccggugggugcggcaauuuucaagaaacccauaagaacaauccaaucuaccaguuccacauugagaaaacuggacccuugcucaucgagcugcggggcccucgacaguauuccguuggguucgaaguggucaccgugucaacauuaggagaccccgguccacacggcuuucugagaaagagcucuggggauuacagguguggauucugcuaucuagagcucgaaaacauuccuuccggcaucuuuaacauaauccccaguaccuuccugccaaaacaagaggguccguuuuuccuugacuuuaauagcauuaucccuauuaagaucacucaguugcaguga

SEQ ID NO: 53805 - RNA, 2073 nt, Artificial Sequence
  derived and/or modified sequence opt3 from CAPN9__Homo_sapiens__NP_006606
augcccuaccuguauagagccccuggcccacaggcucacccggugcccaaggacgcaaggaucacccauagcuccgggcaaucuuucgagcagaugcggcaggaaugccuccagcgcggaacacuuuuugaggaugccgacuucccugcgucaaacaguagccuguuuuacuccgaacgaccacaaauucccuucgucuggaaacguccuggugagauaguuaagaauccagaauuuaucuugggcggggcuacuagaacggauauuugucagggagaguuaggcgacugcuggcugcuagccgcaaucgccucucucacccugaaccagaaagcucuugcaagggugauuccccaggaucaaucguucgguccuggguaugccggaaucuuucacuuccaguuuuggcagcauucagaguggcuggacguagugauagaugaccgguugccaacauuccgcgauagacucgucuuucugcacagcgcugaccauaaugaguucuggagugcccugcucgagaaggcguacgcaaaauuaaacggcuccuaugaagcccugaagggcgggucugcuaucgaggccauggaggauuuuacuggagguguggcagaaaccuuccagacaaaggaggcuccggaaaauuucuacgagauucuugaaaaagccuugaagaggggcagccugcuaggguguuuuaucgacacccgguccgcggccgagucagaggcacgcacucccuucggacucauuaaaggccacgcuuauaguguuacagguaucgaucaagugagcuuucgagggcagagaauagaacugauuaggauccggaacccuuggggacaggucgaguggaauggcucuugguccgacucaagcccagaauggcguagugugggccccgccgagcaaaagcgccuuugccacaccgcucuggacgauggggaguucuggauggccuuuaaagacuucaaggcacauuuugauaagguagagauuuguaacuugacgccugacgcccucgaggaagaugcuauccacaaaugggagguuacugugcaucagggaucuugggucagagguuccaccgcgggcgggugcaggaauuuccuggacacauuuuggacuaacccacagaucaaguuaagccugaccgaaaaagaugagggacaggaagaguguucguuccucguggcacuuaugcaaaaggaccggcgaaaacugaagcgcuuuggcgccaauguguugacaauugguuacgcuauauacgagugccccgauaaagacgaacaccuaaacaaggauuucuuuagauaucacgccucuagggcacgguccaagaccuucaucaaucugcgcgaggucucagacagauucaaacucccgccuggggaauacauucugauccccaguacguuugagccacaucaggaggccgacuucugucuuaggauauuuagcgaaaagaaagcuauuacucgugauauggacggcaacguugauaucgaccugccugagcccccaaagcccacaccuccagaucaggaaaccgaggaagaacagcgguuccgagccuuguuugagcaaguggcaggagaagacauggagguaacugcggaagaacucgaauaugugcugaaugcugucuuacagaaaaagaaggauaucaaauucaagaaacugucccuaauuucuugcaagaacaucauuagccucauggacacaucaggcaacgggaaacuggaguuugaugaguucaagguguuuugggacaaacuuaagcaguggauaaauuuguuccugagauuugaugccgacaagaguggaaccauguccacguacgaacucaggaccgcacugaaagccgcugguuuccagcuuagcucucaccuguugcaacucaucguucugcgcuaugccgaugaggaauuacagcuggacuuugacgauuuccuaaacugucucgugcggcuggagaaugcaucaagagucuuccaggcucuuaguacaaagaacaaagaauuuauucauuugaauaucaacgaguucauccaccugacuaugaauauuuga

SEQ ID NO: 53806 - RNA, 807 nt, Artificial Sequence
  derived and/or modified sequence opt3 from CAPNS1__Homo_sapiens__NP_001289561
auguuccuggugaacagcuuucucaagggcgggggagguggcgggggaggcggugggggacuuggcggcgggcugggaaaugucuuggguggcuuaaucuccggggccggaggcggugggggaggcggcgggggagguggcgggggaggcggugggggcggaggcgggaccgcuaugaggauucugggagguguuauaucugcaaucucagaggccgcggcucaguacaaccccgaaccuccaccgcccagaacacacuauaguaauauugaggccaacgaaagcgaggaagugcggcaauuccgccgacuauuugcacagcucgccggcgacgauauggagguauccgcuacugagcugaugaauauccuuaacaaaguggucacgcgucauccugaccugaagaccgauggguucggaauugacacaugcagaucuaugguggcaguuauggauucggacacuaccggcaaauuggguuuugaagaguucaaguaccucuggaauaacaucaaaagguggcaggccauauauaagcaguuugauacagaccggucagggaccaucuguagcagugaacugccaggcgcuuucgaggccgcgggauuucaccugaaugagcaucucuacaacaugauuauccgcagauauuccgaugaaucuggcaauauggacuucgauaacuuuauuagcugcuuagugaggcuggacgcaauguuccgggccuuuaagucccuugauaaagacgggacuggacaaauccaggucaauauacaggagugguugcagcugacaauguacucauga

SEQ ID NO: 53807 - RNA, 2130 nt, Artificial Sequence
  derived and/or modified sequence opt3 from CAPRIN1__Homo_sapiens__NP_005889
augcccagcgccaccucccacucuggcucagggaguaagagcuccggaccuccaccgcccucugguucgucaggcagcgaggcugcagccggggcgggagcugccgccccugcaagucagcauccagcuacaggcacuggugcagugcaaacggaagccaugaaacagauccugggggucauugacaagaaacucagaaaccuugagaagaaaaagggaaagcuggaugacuaccaggaaaggaugaauaaaggcgagcgguugaaccaggaucaauuagacgcuguuuccaaguaucaggaagugaccaauaaccuggaguucgccaaagagcuacagcgcucuuuuauggcgcucagccaggauauacaaaagacaaucaaaaagacugcacgacgugaacagcugaugagagaggaagccgagcagaagaggcuuaaaaccguacuggaguugcaguacgugcucgacaagcugggcgaugacgaaguccggacagaucugaaacaagggcucaauggagugcccauuuuauccgaggaagaacugucacuuuuggacgaguucuauaagcugguugauccugagcgcgacaugagucuaagacucaacgagcaguacgaacacgcuagcauccaucugugggaucuucuggaggguaaagaaaagccagugugcggcaccacuuauaaagucuugaaggagauuguggaaaggguauuucagucuaauuacuucgacuccacacacaaccaucaaaaugggcucugugaggaggaagaggccgcaucagcucccgccguugaagaccaggugccugaggcggaaccagagccggccgaggaauauaccgagcagagcgaagucgagaguacggaguacgugaaccggcaguuuauggcagaaacucaauucaccucuggagagaaggaacagguggaugaguggacagucgaaacuguugaggugguaaauucccugcagcagcaaccccaggcugccagcccuucggugccagagccccacucuuuaaccccugucgcucaggccgacccacuggugcgccgacagagaguucaagaucucauggcacagaugcagggccccuacaacuuuauccaggacuccaugcuugauuucgaaaaucaaacacuggacccggccauagugucagcucagccuaugaaccccacccagaauauggauaugccacaauuggucugcccucccgugcacagugagagcaggcuagcgcagccaaaccagguacccguucagccugaagcaacgcaagugccacuggucuccucuacuagcgaggguuauacagccucacagccgcucuaccagcccagucaugcuaccgaacagcggccucaaaaagagccaaucgaccagauucaggccacuaucucccugaacacagaucagaccacggcaucuagcucacuucccgccgcuagucaaccucagguguuucaggccgggaccagcaagccacugcacuccucuggaauuaaugucaacgcagcgcccuuccaaucgaugcagacaguguuuaauaugaacgcuccgguuccuccagugaaugagcccgaaacuuugaaacagcagaaccaauaucaggccagcuacaaucaguccuucucaagucagccucaucaaguagagcagaccgaacuccagcaggagcaacugcagacagucgugggcacuuaucacggcucucccgaccagagccaccagguuaccgggaaccaucaacagccaccucagcaaaauacaggauuuccccguuccaaccagccauacuauaauucacgcggugugagcagaggcgggucuaggggagcacggggcuuaaugaacgguuaccgagggccggccaauggcuuccgcggaggcuacgauggguauagaccuuccuucaguaacacccccaauagcggauacacucagucucaguuuuccgcuccaagggacuauucagguuaccaacgggacggcuaucagcagaacuucaagcgcgggaguggacagagcggccccagaggugccccuagggggcguggcggaccaccccggccuaaccgaggcaugccgcaaaugaauacgcagcaggucaacuga

SEQ ID NO: 53808 - RNA, 3384 nt, Artificial Sequence
  derived and/or modified sequence opt3 from CAPRIN2__Homo_sapiens__NP_001002259
auggaggugcaggucagccaagccucccugggcuucgaacucaccucuguugagaagucacuuagagaauggaguaggcugagccgggaggugaucgcuugguugugccccuccucuccuaacuuuauuuuaaauuucccaccgcccccuucggcaucaagcguaaguauggugcagcuguuuuccucuccauucggguaccagagccccuccggacacucagaagaggagcgcgaagguaacaugaaaagugccaagccucaggucaaucauagccaacacggcgagucucagcgagcgcuauccccacuccagucaacacugagcagugcugccucucccucccaggcauaugaaacuuacauagagaacgggcuuaucugucugaaacauaagauucguaauaucgagaaaaagaaguugaaacucgaagacuauaaggauagacugaaaagcggagagcaccugaacccugaccaacucgaagccguggagaaguacgaagagguuuuacauaaucuggaguuugcuaaagaacuucagaagacguucucgggcuugucucuggaucuacucaaggcacagaaaaaggcccagaggcgggagcacaugcugaaacuugaagcugagaagaaaaagcugcgcaccauuuugcaagugcaguauguccuccagaaccugacacaagaacacgugcagaaagacuuuaaggguggguuaaauggagccguauaccugccauccaaggagcucgauuaucuuaucaaauucucaaagcugacuugcccggagagaaacgaaaguuugagcguugaggaccagauggaacaguccucucuauacuuuugggaucugcucgagggcagcgaaaaagcgguggucggcaccacauacaagcaucugaaagaccuucugucaaaguugcucaauaguggguauuucgaguccauacccgugccuaagaacgcaaaagagaaggaagugccacuggaggaagagauguuaauccaaagcgagaaaaagacccagcugucuaaaacugaaucagucaaggagagugaaagccuaauggaguuugcccagcccgaaauucagccucaagaguuccucaauaggcgguacaugacagagguugauuauuccaacaagcagggagaggaacagccaugggaagcugacuacgcccgcaaacccaaucugccgaagcgaugggauaugcuuaccgagccugacggucaggagaaaaagcaagaaucuuuuaaaucgugggaggcaagcggcaagcaccaggaaguguccaagcccgcuguaucauuggagcagagaaaacaggauacgaguaagcugaggucuacucucccagaggaacagaaaaagcaagaaaucagcaaauccaagccuucacccagccaguggaaacaagacaccccaaagucuaaggccggguaugugcaggaggagcagaaaaagcaggaaacacccaaacuguggccuguccaacuucagaaggagcaggacccgaaaaagcagacuccaaaguccuggacccccaguaugcaaagcgaacagaacacaaccaaaucuuggacgacuccuaugugugaggagcaggauuccaagcagccagaaacacccaaaucaugggagaacaauguggaaagucaaaagcauagccugaccucgcagucccagauuucuccuaaaagcuggggaguugcgacugccucauugaucccaaacgaccaacuccugccccggaaguuaaauacagagccgaaggaugugccuaaaccaguccaccagcccgugggcaguuccucuacccugccuaaggaccccguacuacguaaagaaaagcuccaggaucugaugacgcagauacaagguaccugcaacuucaugcaggagagcguucuugacuucgauaaaccauccucagcaauuccuacaagccagcccccaagugcuacuccggggucuccuguggccuccaaggagcagaauuugagcucgcaaucagacuuucugcaggaaccccuccaggcuaccucuaguccagucacauguuccagcaacgccugccuggugacuaccgaucaggcaucuagcggauccgagacagaguucaugaccucagaaacucccgaagccgcuaucccuccaggcaagcaacccaguagcuuagcgucuccuaauccgccaauggcaaaaggcuccgagcagggguuucagucacccccugccaguagcuccucugucacgauuaacacagcuccauuccaggccaugcaaaccguguuuaauguuaacgcaccccugccuccgcgcaaggagcaggaaaucaaagagucgcccuacagcccaggauauaaucagucauucacuaccgccuccacacaaaccccuccccagugucagcuuccaaguauccacguggaacagacuguacauucucaagagacagcugccaacuaccacccugacgguacgauucaggucagcaauggcuccuuggcauuuuaccccgcgcagaccaacguguucccaagaccgacucagccuuuuguuaauucaagggggucugugcggggaugcacacgaggcggucgccucauaaccaacagcuauagaagucccgggggcuacaagggauucgauacauauaggggccugccauccaucagcaacgggaauuacucucaacuacaguuucaggcucgggaauauucaggagcccccuacucccagcgcgacaacuuccaacaguguuauaaaagagguggcaccagugggggaccuagggcaaauagccgugccggcuggucggacucuucccaggucagcucaccagagcgggauaacgagacuuuuaauaguggugacucugggcaaggcgauucccgaagcaugacgcccguggacguaccugugaccaacccggcugccacaauucugccaguucaugucuacccccucccucagcagaugagaguggcauucucagcugccaggaccaguaaucuggcgcccggaacucuugaucagccaaucguguucgacuugcuguuaaacaaucucggcgaaacauuugaucugcaacuugggcgcuucaacugcccugucaauggaacuuacguuuuuauauuccacaugcugaaguuggccgugaacgugccccucuauguaaaucugaugaaaaacgaggaaguccuagugagcgcuuacgcaaaugacggugccccagaucaugagaccgcuuccaaccacgccauucugcagcucuuucagggcgaccagaucuggcugcggcuucacagaggggcaaucuauggaucuagcuggaaguacuccacguucucaggcuauuugcuguaccaagauuga

SEQ ID NO: 53809 - RNA, 1428 nt, Artificial Sequence
  derived and/or modified sequence opt3 from CAPS2__Homo_sapiens__NP_001273476
augaucaacaccggcacacagauggaccuggaggugaagggggucgccgcuacuagcagaucccaaauucagcccuucuuuggaaggaaaaagccucuccagcagcgguggacgucugaaucauggaccaaucaaaacaguugcccaccgguugugccccgccuugaucuggguagcuugguagacuccgaugacgaggaucagaauauaaucccugaaaacuuaccagcacccacagacaaauguaagcugaaauaccagcagugcaagacugagauuaaggaaggcuauaaacaauacucucagcgaaaugccgagaacaccaagucgaaugugacacacaaacagucaccucguaacaagaucgaugagaaauguguccaggacgaagaggcgaauaccgaugaccuaacuacacucgauagaaaggcuauucugcaacagggguaugccgacaacagcugcgauaagcagcaaagggcacggaaacuugacgccgaaaucguggcugcagagaagaaaaagcagauaguugccgaacaggugaugaucgaccaucugagucgcgcugucauuuccgauccagagcagaauuuggccaucgagcaaaaagaaucugaccacauucuccccgauagcaagaugaccccucugagauucaggaaacggacgcugcaugagacuaagauccgcacccacuccacacucacugaaaacguguuaucacauaagcugcaguuugacggacgaauaguaaguagaaccaauguucuuccauucauucagaaaagcaucuacucucaccaguguggcaggcggaaggguaaacaauaucguuugggggauuuuuacgugggagcgacacugaccuuccuauccucagaccaccucagccugccggagaguauuaaggagaacacgcuucugaaauugcgcaucacuaauaucgaucagauugcacucgacucucugaagacagccuccauggaacaggaggaugacauaaucauucaggaaaccaacgauagauuagucuuuaaggcuauccaagacgugcugaaagagaagcuccauaaaaggggcgugcggauacuuacuggccuggggaaguauuuccagcaguuggacaaagaaggaaacggucuacuggauaaggccgacuuuaagcaggcacucaaagucuuccaccuggagguuagcgagaaggauuuugaaucggcuuggcuuauucugaaugacaacggcaaugggaaaguggauuacggagaguucaagcgaggcaucaucggugaaaugaacgaguaccgcaaaucuuauguaagaaaggccuuuaugaaguuggacuucaauaaauccgggucagugcccauuaucaacauuaggaagugcuacugugcgaaaaagcauagucaagucauaagcggauga

SEQ ID NO: 53810 - RNA, 828 nt, Artificial Sequence
  derived and/or modified sequence opt3 from CAPS__Homo_sapiens__NP_004049
augcagugccacagagaccuggcccucagccaagcucuuuggggcuggcagcuguccaagcagucugggugggcacaucccucauugccucacaguccauuaccgagcaccgugcauuccuguucuugggcgcccccucaucugcagaggcaccuaccacucgccacagucucgcccggaacuacgcaacugacccaggguccugcuggccggacacuugggcagacucaggccucaugcccagagccccgcccuagcauggaugcaguugacgccaccauggaaaaacugcgagcucaauguuugagucguggagcauccggcauccagggucucgccagauucuuuaggcagcuggaucgggacgggucucgcagccuggaugcugacgaguucagacagggacucgccaaguuaggccuggugcuugaucaagcggaagcagagggcguaugcaggaaaugggaccggaacggguccggaacauuggaucuggaagaguuucuacgcgcccuccgaccaccgaugucacaggcuagagaggccgugauugcagcugccuucgcgaagcuggacaggaguggugauggcgucgugaccguugacgaucuucgugggguguacagcggacgggcccaccccaaaguccgcucuggcgaauggacugaggacgaagugcugagaagguuuuuggacaauuucgauuccucagagaaggacggucagguaacacucgcagaguuucaagauuauuacagcgggguuagugcuucuaugaacaccgacgaagaguucguggccaugaugacguccgcuuggcagcuguga

SEQ ID NO: 53811 - RNA, 627 nt, Artificial Sequence
  derived and/or modified sequence opt3 from CAPSL__Homo_sapiens__NP_001036090
auggccggcaccgcuagacacgacagggagauggcaauccaggccaagaaaaagcugacaacugcgacggaucccauugaacggcuccgccuucaaugccuggcucgagggagcgccggaauaaaagguuugggccguguguucagaaucauggacgaugacaacaauaggaccuuagauuuuaaggaguucaugaaagggcugaacgacuacgcagucguuauggaaaaggaggaaguggaggagcuauuucggcgcuucgauaaggacggaaauggcacaauugauuuuaacgaguuccuccugacucuuagaccuccaauguccagggcccggaaagagguaaucaugcaggcuuuucgcaagcuggacaaaaccggugauggggugauuacaaucgaagacuugcgagaggucuauaaugcaaagcaucacccgaaauaccagaacggagaguggucugaagaacagguguucagaaaguuucucgauaauuucgacucacccuaugacaaggauggccugguuaccccugaagaguuuaugaacuacuaugccggcgugagugcuagcauagacacugaugucuacuucaucauuaugaugaggacagccuggaaacuguga

SEQ ID NO: 53812 - RNA, 861 nt, Artificial Sequence
  derived and/or modified sequence opt3 from CAPZA2__Homo_sapiens__NP_006127
auggccgaccuggaggaacagcucagcgaugaggaaaaggugagaaucgcugcaaaauucauuauacacgcgcccccuggcgaguuuaacgaagucuucaaugacguuaggcuucuguugaacaaugauaacuuacugcgggagggggccgcucaugccuuugcacaauacaaucuagaccaguucaccccagugaagaucgagggauaugaagaucagguacucauuacagagcacggugaccugggcaacgggaaauuucuugauccgaagaaucgcaucugcuucaaauuugaccaucugcgaaaggaagccacugauccccguccuugugagguggagaacgcugucgaauccuggagaacgucuguggagaccgcauugagggccuacguuaaggaacacuauccaaauggagugugcacagucuacggcaaaaagauugacggucagcaaacuaucauagcuuguaucgagucacaucaguuccaggccaaaaacuuuuggaaugggcgguggcgcagugaauggaaguucaccauuacacccagcaccacucaggugguaggaauccucaaaauucaaguucacuauuacgaggauggcaacgugcagcuggucucccacaaggacauccaggauucucugacagugucgaaugaggugcagaccgcgaaggaauuuauaaaaauugucgaggcagccgaaaacgaguaucaaacggcuaucucagaaaauuaccagacuaugagcgacaccacauucaaggcccucagaaggcaguuaccuguuacucggaccaaaauugacuggaacaagauccugaguuacaaaaucggcaaggagaugcaaaacgcauga

SEQ ID NO: 53813 - RNA, 900 nt, Artificial Sequence
  derived and/or modified sequence opt3 from CAPZA3__Homo_sapiens__NP_201585
augacccugagcgugcucuccagaaaggacaaagagagggucauccggcgccuucuguugcaggcucccccuggcgaguucguuaacgccuuugaugacuuaugccugcuaauucgagaugagaagcucaugcaccaucaaggggaaugugcaggacaccagcauugccagaaauacucugugccacuguguauagacgguaauccgguacuucugucacaccauaacgugaugggcgauuaucguuucuuugaccaccagaguaaguugagcuucaaauacgaucuccugcaaaaucagcugaaggacauccagucccacgggauuauccagaacgaggccgaauaucucagagucguguuacugugcgcgcuuaaguuguacguuaaugaucauuaucccaaaggaaacuguaauaugcugaggaagacagugaaaucuaaggaguaccuaauugcuugcaucgaggaccacaacuaugaaacuggcgaguguuggaauggucucuggaaaucgaaguggauauuucaagucaacccuuuccugacccaggugacggggcggaucuuuguacaggcccauuucuuucgcugcguuaaucuucacauugaaaucucaaaggaucugaaagagagcuuggagauugugaaccaggcacaacucgcccugaguuucgcuagauuagucgaagaacaggaaaauaaguuucaggcagccgugcuggaggaacuccaagagcuuuccaacgaggcucugaggaaaaucuugcggcgcgaccuaccagugacacgaacucugauagauuggcacaggauucucucugaccugaaucuugucauguaccccaagcugggauacguuaucuauagcagauccguguuguguaacuggauuaucuga

SEQ ID NO: 53814 - RNA, 3099 nt, Artificial Sequence
  derived and/or modified sequence opt3 from CARD10__Homo_sapiens__NP_055365
augcccggcagagccgaggcuggggaagcagaggaagaggccggagcggguagcggcuccgaagcugaggaggacgcccugugggaaaggaucgagggggugcggcaccgccucgcacgagcccuuaacccugcuaagcugaccccauacuugcgucagugcagagucauugaugaacaagacgaggaggaaguuuuaucuacauauagguucccgugucgggugaaucgcacuggaagacugauggauauacuaaggugccggggcaaacgcgguuacgaggcauuucucgaagcccuggaguucuauuaccccgaacauuuuacgcuucugaccgggcaggagccugcucagcgauguucaaugaucuuggacgaggaaggaccagagggccucacacaguuccugaugacugaaguaagaaggcugcgggaggcccguaagagucaacuccagcgcgaacagcaguuacaagcgagaggcagggugcuggaggaggaacgggcagggcuugagcagcgauugcgcgaucagcagcaagcccaggaaagaugccagaggcugcgggaggacugggaagcuggaagccuagagcuccugcgccuuaaagaugagaacuauaugauugccaugagacuggcacaauuguccgaagagaaaaauucugcuguccucaggucgcgugaccugcaguuagccguggaucagcugaaacucaagguuucacggcuugaagaggagugugcgcuguugagacgagccaggggucccccuccaggcgcagaagagaaggaaaaagagaaggaaaaagagaaggagcccgacaacguggaucuagucagcgaacugcgcgcugagaaucagcggcucaccgccagucugagagaacuucaagaggggcugcagcaggaagcauccaggccuggagccccaggcucugagcgcaucuugcucgacauucuggagcacgauuggcgagaagcacaggacagccggcaagaguuaugccagaaacugcaugccgugcagggugaacuacagugggcugaggaacuccgugaccaauaccugcaggagauggaggaucuuagauugaagcacaggacacugcagaaggacugugaucucuauaaacaucgcauggcgaccguacuggcacagcuugaagagaucgaaaaggagcgggaccaagccauacaguccagagauaggauccagcugcaauacucacagaguuugauugagaaagaccaguaccgaaagcagguucgcgggcucgaagcugagcgggaugaacuguuaacuacacugaccagccuagagggaacgaaagcccuccuggaagugcaacuucagagagcacagggcggcacuugcuugaaggccugugcuucuucccacucacugugcagcaaccucaguucuaccuggucccugagcgaguuuccgucgcccuuagggggaccugaggccacaggugaagcagcggucaugggcgggccagagccccacaauucugaagaggcuacugacuccgaaaaagagaucaacaggcugucaauucuuccuuucccacccagugccggaagcaucuugcgucgccagcgggaggaagauccggcaccucccaagagauccuuuucuagcaugucagacauaaccggcagugugacacucaagccaugguccccuggucugagcuccucaaguagcuccgauucuguguggccccuagggaaaccagagggccugcucgccaggggauguggccuggacuuccuuaaucgaucguuggcuauucgggucagcgggcgcucucccccuggagguccagaaccgcaagacaagggccccgaugggcugucauuuuauggagacagauggaguggcgccguugugaggcggguauuaucugguccugggagcgcacgaauggagccaagagaacagcgcguggaggcugccggccucgagggagcgugccuggaagccgaggcucagcagaggacccuucuguggaaccaaggcuccacguugcccucacucauggauagcaaagcaugccagucuuuccaugaagcccuggaggcuugggccaaggggccuggagcagagccauuuuacauccgugcgaaucuaacucugcccgaacgggccgacccgcacgcucucugugucaaagcccaggagauucugagacuuguggauuccgcauauaagaggcgccaagaaugguucugcacacgaguugacccuuugacccugagagauuuagaccgggguacugugccaaacuaccagagggcucagcagcuccuggagguccaagaaaagugucuucccaguagccgccaucguggcccuagaucuaaucugaaaaagcgggcccuagaucagcucaggcuggugcgccccaaaccaguaggggcuccugccggagacucccccgaucaguugcuguuagagccaugcgcugagccggaacgaucacucagaccuuauagucugguucggccccuucuggugagcgcguugaggccagucgugcuccugcccgagugucuagccccucgccugaucagaaaccuucucgaccugccaucguccagguuggauuuucaggucugccccgcagaaucucugagcggcgaggaauuauguccuucaagugcuccgggugccccaaaggcccaacccgcuacaccugggcucggcucccggauccgugcaauucaggagucugugggaaagaagcacugccugcuugagcugggcgcccgcgggguucgagaauuggugcagaaugagauauacccaaucguaauucacgucgaagugaccgagaagaacguuagagaagugaggggacuccugggccggcccgguuggcgcgacagcgagcuacugagacaguguaggggguccgagcaaguccuuuggggacucccuugcucaugggugcagguaccggcgcaugaauggggccacgcugaggaacuggccaaagugguucggggucgaaucuugcaggagcaggcaagauuagucuggguggaguguggcagcagucgcgggugccccucuuccagcgaagccuga

SEQ ID NO: 53815 - RNA, 3465 nt, Artificial Sequence
  derived and/or modified sequence opt3 from CARD11__Homo_sapiens__NP_115791
augcccggcgggggaccugagauggacgauuacauggaaacccugaaggacgaggaagaugcccucugggagaacguggaaugcaauagacacaugcuuagcagguauaucaacccagcuaaacugacaccguacuugcggcaguguaaggucauugacgagcaagaugaggacgaaguuuuaaaugcacccaugcugccuuccaaaauaaaccgcgccggucgacuacucgauauccugcauacuaagggccagcguggguaugugguauuccuugagucucuggaauuuuacuauccagaguuguacaaacucgugacgggaaaggagcccaccagaagguucucaacaauugucguggaagagggccacgaaggucugacucauuuucugaugaaugagguuaucaagcuccagcagcaaaugaaagcgaaggacuuacagcggugcgaacugcuugcucgcuugagacagcuggaggaugagaaaaagcagaugacccuaacaaggguggaacuccugaccuuccaagagcgguauuacaaaaugaaggaagaacgcgacaguuacaacgaugaacuugucaaggugaaagacgauaauuauaaccuggccaugcgauacgcacaguugagcgaggagaagaauauggccguaaugagauccagggaccuccagcuggaaauugaccaguuaaaacaccggcugaacaagauggaggaagaguguaaacucgaacguaaucaaucucuuaagcugaaaaacgauaucgagaaucgcccuaagaaggagcagguuuuggaacuagagagagaaaacgagaugcugaaaacuaagaaucaggagcuccaaucgauaauccaggcugggaaaaggucacugccagacagcgauaaggcaauucuugacauccuggaacaugaucggaaagaggccuuggaagaccgacaggagcucgugaaccgcauuuauaaccugcaggaagaggcuagacaagccgaggaauuaagggauaaguaccuggaggaaaaggaggaccuagaacucaaaugcaguacacugggaaaggauugugagauguauaaacaccggaugaauaccgucaugcuucaguuggaggaaguggagcgcgaaagagaccaggcguuucacuccagggaugaggcacagacgcaauacucucagugccugaucgaaaaggacaaauaucguaagcagauacgggagcucgaggaaaagaacgacgagaugcgaauugaaauggugagaagggaggccuguaucgucaaucuggagagcaaacuucgccggcuguccaaggauucaaacaauuuggaccagagucuccccagaaaccugccuguuacuauuaucagccaagauuucggcgacgcuucuccaaggaccaauggccaggaagccgaugacuccucaacaagcgaggaaaguccggaggauucuaaauacuuuuuacccuaccauccuccacagcgccgaaugaaccugaaggggauccagcuacaacgggcaaaaucccccauuagccucaagcguacuucggacuuccaggcuaagggacacgaagaggaggguaccgaugccucuccuuccucaugcggcagucugccaauaacaaauagcuuuaccaaaaugcagcccccgagauccaggucuagcaucaugucaauuacggcggaaccucccgggaacgacaguaucgugcgccgguauaaggaggaugccccacauagauccacuguagaagaggacaaugauagcggaggcuucgacgcacuugacuuggaugacgauucucacgaaagguacucauuugguccuaguagcauacacuccucuucgagcucccaucaaucagaggggcuggacgcuuaugaucucgaacaggugaaccugauguuccgaaaauuuaguuuagaacgccccuuccggccaucugucacaagcgugggacacguuagaggccccggcccuuccgugcagcauaccacucugaauggggacucacuuacaagccaguugacccuccugggagguaacgccaggggcucuuucguccacuccgugaagccagggagucuagcugagaaagccggacugcgugaaggccaucaacuccugcuuuuggaggguuguauucgcggggaacggcagagcguaccgcuggauacgugcaccaaggaggaggcacacuggacaauccagagauguucuggccccguuacuuuacacuacaaagugaaucaugaaggauauaggaagcucgucaaggacauggaggauggccugaucaccuccggggacucauuuuacauucgacuuaaccugaacaucaguagccaguuggaugccugcacaaugucgcucaaaugcgacgaugugguccacgugcgggacacuauguaucaagaccgccaugaauggcugugugcuagaguugauccuuucaccgaccacgaucuagacaugggaacaauuccauccuacucuagggcgcagcagcugcuccuggugaaacuucagcgguugaugcaccgagguagcagagaggagguagauggcacccaucacacucugcgcgcauuaaggaauacgcuccaacccgaagaggcccugucaacaagugacccucgugucuccccacggcuuucuagagcuagcuuucuguucgggcagcuacuccaguuuguguccaggucagaaaacaaguacaagcgcaugaauagcaacgagcgaguuagaauaaucaguggaucuccccugggcuccuuggcccggagcucgcuggaugcaaccaaauuacucacugaaaagcaagaggagcuggacccggaaucagagcuugguaagaaucugucuuugauuccuuauagucucgugagggccuucuacugcgaacgccguagaccaguccuguuuacccccacagugcuagcuaaaacccugguacagcggcuucucaacuccgggggcgccauggaguucacuaucuguaagagcgauaucgugacaagggacgaauuucugcgccgacagaaaacggagaccauuauauauucuagagagaagaauccuaacgcauucgaaugcaucgcgcccgcuaauauugaggccguugcagccaaaaacaagcauuguuugcuggaagcuggaaucggcugcacucgggauuuaauuaagagcaauaucuacccaauaguccucuuuaucagggugugugagaaaaacauuaagcgcuucagaaaacugcuuccuaggcccgaaacagaggaggaauuucugcgggugugccguuugaaggagaaagaacucgaggcccugccaugucuauaugcaaccgucgagccggacauguggggguccguugaggagcugcuucgcguggugaaggacaagaucggagaggagcagcgaaaaacaauuuggguagaugaagaccaacucuga

SEQ ID NO: 53816 - RNA, 2223 nt, Artificial Sequence
  derived and/or modified sequence opt3 from CARD14__Homo_sapiens__NP_001244899
augggcgagcugugcagaagggacagcgcccucaccgcucuugaugaagagacacugugggaaaugauggagucccaccggcaucgcaucgugcgauguauuugccccucucguuugacuccuuacuuaagacaggcaaagguccugugucaacuagacgaagaggagguucuccacucaccaaggcugacgaacagugccaugcgggcggggcaucuucuggauuugcucaaaacccgcggaaagaauggugcuauagccuuccuggaaagccugaaauuucacaacccggacguguauacacucguaacuggcuuacagcccgauguggacuucuccaauuuuucugggcugauggagaccucgaaacuuacagaaugcuuggcaggagccaucggcucacugcaggaggagcuaaaccaggaaaagggucaaaaggagguccuccugagaaggugucagcagcuucaggaacaucugggguuggcugagacccgggcagaaggacuccaccaacuggaggccgaucacagccgcaugaagcgagaggugagugcucauuuccacgaaguuuuaagacugaaagacgagaugcucucccuuucucugcauuacagcaaugccuugcaggaaaaggagcuagcggcauccaggugccggucacugcaggaggaacucuaucugcuuaaacaggagcugcaacgugccaacauggugaguagcugugaauuggagcuccaggaacagucucugcgcacugcuuccgaucaagagucaggcgacgaagaguuaaauagacugaaggaggaaaacgagaaacuaaggagccucacauuuagucuggccgaaaaggauauucuugagcagucuuuggacgaggcacggggcucccgacaggaacuggucgagcgcauccacagccucagagaaagggcuguggccgcggagcggcagcgcgaacaauacugggaggagaaggaacagacccugcuucaguuccagaaaucgaagauggccugccaacuguauagagagaaaguaaaugcauugcaggcucagguuugugaacuccagaaggagagggaucaagccuacucugcucgugacuccgcccagcgggaaauuucacagagucugguggagaaagacagcuuacgaagacaggucuuugagcugacggaucaagugugcgaacuaaggacucagcuccgccagcugcaagcagagccuccaggggugcuuaagcaggaagcccggaccagagagcccuguccuagggaaaaacagcgcuugguccgaaugcacgcuaucugcccacgggacgauuccgacugcucucugguuagcucaacagagagucagcuccuguccgauuuaagcgcgacuucuucacgugagcugguggacaguuucagaagcuccucucccgcaccuccaucgcaacagagccuuuauaagaggguagccgaagauuuuggagaggaaccgugguccuucucaaguuguuuggagauacccgagggugacccuggcgcucucccaggggccaaggcaggagauccccaucuggacuacgaacuacuggauaccgccgaccucccucagcuggagucuagccuucagccagugucccccggccgcuuggacgucucagaaagcggugugcugaugcggagaaggccggcucgacgcaucuuaucucaaguuacaaugcucgccuuucagggggaugcacugcuugagcagauuuccgugaucggaggcaaccugaccggcauuuucauccaccgggucacgccugggagugcggcugaccagauggccuugagacccggaacucaaauagugaugguagauuacgaagcaagcgagccacucuuuaaagccguucuggaggacacaacccuagaagaggcugugggucugcucaggcgugucgauggcuucugcugucugucugugaaggucaauacugacggguauaaacgccuuuugcaggaucuggaagccaagguggcaacauccggagacucauucuacauucggguuaacuuagcuauggagggcagagccaaaggugaacuccaggugcauugcaaugagguacugcacgucaccgauacgauguuucaaggguguggcugcuggcaugcgcacagggugaacaguuauaccaugaaggacacagccgcucacggaacuaucccuaauuacagccgauga

SEQ ID NO: 53817 - RNA, 594 nt, Artificial Sequence
  derived and/or modified sequence opt3 from CARD16__Homo_sapiens__NP_001017534
auggccgacaaggugcugaaagagaagagaaaacucuucauccacagcaugggcgaagggaccauuaacggacuucuggaugaguuguuacagacaaggguccugaaucaagaagagauggaaaagguuaaacgggagaacgcuacugugauggacaagacgcgcgcacuaauagauuccguaauccccaagggugcccaggcgugccagauuuguaucaccuacauuugcgaggaagacucuuaucucgcugagacacugggccuuucagccgcacugcaggccgugcaagauaauccugcuaugccaacuuguaguagcccggaagggcgaaucaaauugugcuuucucgaggacgcacagcguauauggaagcagaaacugcagagaugucauguccaaaacaccaucauuaagugguccgagagguacacaucuggaucguucgaaaugcaguggcuguuucuccggaccaauuucaucgagcgcuuuuggagaaacauuuuacugcuucccuugcacaaaggcucacuguauccuaggaucccaggucuagggaaggaacuccagacuggaacacauaagcugagcuga

SEQ ID NO: 53818 - RNA, 3114 nt, Artificial Sequence
  derived and/or modified sequence opt3 from CARD6__Homo_sapiens__NP_115976
auggccaccgagagcacacccuccgaaaucauugagagagaaaggaagaaacugcucgagauacuucagcacgacccugauucuauccuggacacuuugacgucacggcgcuuaauuagugaagaggaguacgaaacccuggagaacgugacagaucuacucaagaaaagccgaaagcugcuuauccugguccagaaaaagggcgaagcuacuugccaacauuucuugaagugucucuuuuccaccuucccacagucugcagccauuugcgggcugcgucacgagguucugaaacaugagaauacagugccgccccagucgaugggagcgucaagcaacagugaagacgcuuuuuccccugguaucaagcaaccagaggcccccgaaauaaccguauucuuuucugagaaagaacaccucgauuuagagacuagcgaguucuuuagagacaagaaaacauccuauagggaaaccgcacugucagcccggaagaaugagaaggaauacgauacgccugaggugacucuuaguuauagcgucgaaaaagugggcugugagguuccagcuaccaucacauacauuaaggacgggcagcgcuaugaggaauuggaugacucucuguaccuaggaaaagaggaauaucucggcuccguggauacucccgaggacgcagaagccaccgucgaggaggaaguguacgaugacccugagcauguagguuacgacggggaagaggauuucgagaacucagaaacaaccgaguuuagcggagaggagccaaguuaugaaggcucugagacgucccugagccuugaggaggaacaggaaaagucgaucgaggaacggaaaaagguuuucaaagacgugcuguugugccucaauauggauaggucucggaagguccugccggacuuugugaagcaguucuccuuagaucgcggcuguaaauggacucccgagucaccuggggaccuggcuuggaacuuucucaugaaggugcaagcccgagaugucacagcgagagacaguauucuuagccacaaaguucuggaugaggacuccaaggaagauuugcuagcaggaguggagaaucuggaaaucagggacauacagaccauuaacccacucgacguacugugcgccacuaugcuuuguucugauagcucacugcagagacaggugaugaguaauauguaccaaugccaguucgcuuugccccuccuguuaccugacgccgagaacaauaaauccauccugaugcuaggugcaaugaaggauauugucaagaaacagagcacacaauucucuggcgggccaaccgaagacacggagaaguuucucacccugaugaaaaugcccgugaucucauucguucgucuuggauauuguaguuuuagcaagucccgcaucuugaacacacugcucucuccggcucagcugaaacuucacaagauuuuccugcaucaggauuugccucuccugguguuacccagacagauaucggacggccuggucgagaucacuuggugcuuuccagauagcgacgauaggaaggaaaauccuuucuuucaaaaacccguggcccuagcgaaccuccgggguaaucuggaguccuucuggacccaguuuggguuccuuauggaaguaucaagugccguuuucuucuuuacagacuguuugggagagaaggagugggaucugcucauguuccugggcgaagcagcuauugagcgaugcuacuucguguuaucuagccaggcccgcgaauccgaggaagcucagaucuuucaaagaauacugaaccuuaaaccagcccaguugcucuuuugggagaggggcgacgcaggggaucggcgcaagaacauggagggacugcaggccgcucuacaggaagucauguuuucaagcugccugagaugugugucugucgaggacauggcggcacucgccagggaacuggguauucaaguggacgaggauuucgaaaauacucagcguauccagguuuccaguggcgagaacauggcugggaccgccgagggagaaggccagcaacggcacagccagcuuaaaucuuccucaaagagucaggcauugaugcccauccaagagccugguacacagugcgaacugagccagaauuuacagaaccucuaugggaccccaguguuucgaccgguacuggaaaauucguggcuuuuccccacuagaauuggcggaaacuuuaaucaugucucccugaaggccucuugggugaugggcaggccuuucgggagcgaacaacgcccaaaaugguuucaccccuugccuuuccagaacgcuggagcccagggucggggcaagucauuugggauccagaguuuccacccacaaauauuuuacuccggagagagauucaugaaauucucuaggguugcacgcggcugucauagcaaugguacguuugggcgacucccccggccgauuugccagcacgugcaggcguguccugagcguccacagaugaugggcacacuggaaagauccagggcugucgccucaaagaucggacauagcuauagucuagacucucaacccgcacgcgccgugggcaaaccuuggccccagcaggcuugcacccggguaacugagcugaccgaagccacagggaagcucauuagaaccucccacaucggaaaaccacauccucagagcuuccaacccgcagcugccacucagaagcugaggccagcgucgcagcaaggugugcagaugaagacacagggcggggccucaaacccggcacuucagaucggaucucacccuauguguaaaaguucccaauuuaagagcgaucagucuaaucccagcacgguuaaacacucccagccaaagcccuuccauucagucccuagucagccaaaaagcucucaaaccaaguccugccagucacagcccagucagacuaagccuagcccguguaaauccacacaaccaaagcccucucagccuuggccaccccagucgaaaccuagccaaccgcgacccccacagccuaagucauccaguaccaaccccucucaggcuaaagcccaccauagcaaggcuggccagaagcgcggugggaaacacuga

SEQ ID NO: 53819 - RNA, 1614 nt, Artificial Sequence
  derived and/or modified sequence opt3 from CARD8__Homo_sapiens__NP_001171829
auggagaagaaagaaugccccgaaaagagcuccucuucagaagaggaacugccuagaagggacaguggcagcucccggaacaucgaugccucuaaacucauucgccuucaggggucgcgaaagcuguugguggacaauucaauacgugaguuacaauacaccaaaacaggaaucuucuuucaggcugaggcaugugucacuaacgauacgguuuauagagaacugccaugcgugagcgagacccuaugugacauuagucacuucuuucaggaagaugacgagacagaggccgaaccgcuccuguucagggcgguacccgagugccagcuuuccgguggcgauaucccuucugugagcgaggagcaagaauccucagaggggcaggacaguggagauauuuguagcgaggaaaaucagaucgucucuuccuacgcuucaaaggugugcuuugagauagaagaggacuauaagaaccggcaguuccugggcccagaagguaauguugauguggaguugaucgacaaaagcacuaaccgcuacagugucugguuucccaccgccgggugguaucucuggucugcaacaggacugggcuuccuggugagagaugagguaaccguuacuauugccuuuggcuccuggagccaacaucucgcuuuagaccugcagcaccaugaacaguggcuugucgggggaccuuuguucgacgugacagcagagccagaagaggccguggcugaaauccaucugccccacuuuauuucgcuacaggccggugagguggaugucucuugguuccucguugcgcacuuuaagaaugagggcauggugcuggaacacccugcaaggguagagccauucuacgccgugcuugaauccccgucauucagucugauggggaucuugcuccggauagcuagcggaacccgccuguccauucccaucacgucuaacacuuuaauuuauuaccauccucacccagaggacaucaaauuucaucuguaccucguccccagcgaugcccuucugaccaaggcaaucgacgaugaggaagaccgauuccacggcgugagauugcaaacaucaccuccaauggagccccuaaauuuugguaguuccuauauuguuagcaacucugcuaaucugaaagugaugccgaaggaacucaagcugucauacaggaguccuggggagauacagcacuucagcaaauuuuaugccggacagaugaaggaacccauccaacuugagauuacugagaaacggcauggcacccuggucugggauacagaagugaagccaguagacuugcagcucguugcggccuccgcaccucccccauucucuggcgcugccuuugugaaagagaaccaccgucagcugcaggcucgcaugggggauuuaaagggaguccuggacgaucuacaagacaaugaagugcucaccgagaacgaaaaagagcuggucgagcaggaaaagacgagacagucgaagaaugaggcccuuuugagcaugguggagaaaaagggugaccuggcacucgauguucuguucagguccaucucagaacgggaccccuaccuugugaguuaucugcgacagcaaaacuuguga

SEQ ID NO: 53820 - RNA, 1611 nt, Artificial Sequence
  derived and/or modified sequence opt3 from CARD9__Homo_sapiens__NP_434700
augagcgacuacgagaacgaugacgaaugcugguccgugcuggagggcuucagagucacccucacaucuguuaucgaucccucaaggauuacuccuuaucuucggcaguguaaggugcugaauccagacgaugaggagcaaguauugagugacccgaacuuagugauacgcaaacgaaaggucggggugcugcuagauauccuccagcguacgggacacaaagguuacguugccuuucuggaaagccuugagcuguauuacccccaguuguauaagaaagugaccggcaaggagccugcuagagucuucuccaugauuaucgacgcaucuggggaaucgggacucacacagcugcugaugacugaggugaugaagcuccaaaagaagguacaggauuuaaccgcccugcuuucaagcaaagacgauuuuauuaaggaauugaggguuaaagacagucugcuacggaagcaucaggagcgcgugcagagacucaaggaggaaugcgaggcgggcuccagggaacugaaacgguguaaggaggaaaauuacgaucuugcuaugcgccuggcccaccaaucugaggagaaaggugcagccuugaugcgaaacagagaccuccagcuggaaaucgaccaguuaaagcauagccugaugaaagcugaggaugacugcaaggucgaaaggaaacacacacucaaacuucggcaugcaauggagcagcguccaucccaagaacuguugugggagcuacagcaggagaaggcccugcuccaagcucgcgugcaggaacuggaggccucagugcaggaagggaaacuugauagaaguagccccuauauacagguccuggaggaagacuggaggcaagcguugcgggaucaccaggagcaggcaaauaccaucuucucucuccgaaaggaccugcgccagggagaggccagaagguuacgguguauggaagagaaagaaauguuugagcugcaaugccuagcucuccgcaaggauuccaaaauguacaaggacagaauugaggccauccugcuucagauggaagagguugcaauugaaagggaucaggcuaucgccacucgugaggaauugcacgcgcagcaugcccggggccugcaagagaaggacgcacuccgaaaacaggugagagagcugggcgaaaaggcugaugagcuucagcugcagguauuccaaugugaagcccaguugcucgcuguggaggggaggcugcgccggcagcaauuagaaacacugguccuaucaagcgaccucgaggacggaaguccuagaaggucucaggagcugucccuuccacaggauuuggaagacacccagcugagcgauaaagguugccucgccggcgggggaucgcccaagcaaccuuuugcagcccugcaccaggaacagguguuacgcaacccacaugacgcuggccugucuuccggugaaccgcccgagaaagaacgacggcgucuuaaggagucauucgagaauuacagaaggaagcgcgcguugcggaaaaugcagaagggguggagacaaggagaagaggauagggaaaacacgacuggcagugacaauaccgauacagagggcagcuga

SEQ ID NO: 53821 - RNA, 2178 nt, Artificial Sequence
  derived and/or modified sequence opt3 from CARF__Homo_sapiens__NP_001098056
auggagcagagcaacgacucccugagagugaaucacaacgauggcgaagagucuaagaccucagcccaagucuucgaacaucucaucugcauggacaguagggauagcuccuuugggcagaaugacucucccacaguucuuccuauuacuacgcgggaggcuaacaauucgcugauaucacagaacaucccaggaccguugacccagacacaaacuuuaagcgcagaacaguuccaccugguggaucagaauggucaggccauucaauacgagcuacagagucucggcgaguccaacgcgcagaugaugaucguagcuucucccaccgaaaauggacaggugcugcgcgucauuccuccaacacaaaccgggauggcccaggugaucauaccccagggccaacuuguugacgugaacagcccucgagaugucccagaggaaaaacccuccaaucguaaccugccuacugugagaguagacacauuggcagauaauaccucaaacuauauccuccauccacagacgaguuuuccgcugcccaagaaaagcguuacugguaugcuggaggagccucucuuagggccacugcagccccuuucuuccaauaccccuauuugggccuguagguugcggucaugcgaaaagaucggagacagcuaccgcggcuauugugugagugagacagaacuggagucuguccuaacuuuccacaaacagcaaacccaguccguguggggcacaagacagagcccaucgcccgcuaagccggcaaccaggcucauguggaagucucaguacgugccuuaugaugggauucccuuugucaacgccggaucccgggcuguugugauggaaugccaauacgguccacgccgaaaaggcuuccagcugaagaaaguaucagagcaggagaguagaagcugucagcuuuauaaggccacgugcccugcgaggaucuacauuaaaaaggugcaaaaguuucccgaauaccgggucccaacugaccccaaaauagauaagaaaaucauucguauggagcaggaaaaggcauucaacaugcugaaaaagaauuugguggacgccgggggaguucuccgcugguaugugcagcugccuacacagcaagcucaucaguaccacgaguuagaaaccccaugucugacucucuccccgucucccuuuccugucagcucacuugaggaggaagagacagccgugagagacgaaaacugcgcacugccaaguagguugcacccccagguagcucauaaaauccaagagcuaguuucccagggcaucgaacagguguaugccguccggaagcagcugcgaaaguucguggagcgcgagcucuuuaaaccugaugaagucccagagagacacaaucugagcuucuuucccaccgugaacgacauuaagaaucauauacacgaaguucaaaaaucucuuaggaacggugauacgguguacaauucagagaucauuccggcgacccugcaguggacaacugacagugggaacaucuugaaggagaccaugacaguaacuuucgccgaaggaaauagcccuggcgaguccauaaccacaaaagucgaaaccaaccagacucggggcucucucucgccagagcccacgcaccuguuaagcucccugucaaguuuccagccuaagauuuuuacacaacuacaggggcuccagcugcagccccgcuauaccucuccagaugaaagcccugcagugguuuccgugaauaaccaacccucaagcucuccauccggacuuuuggacacuaucgguagugcugucaugaauaacaauagccugcuccugggccagucucauucccuucagagagauaccugucugacacaaaacaacucaaccgccaguacuauggggaauuugccggagccugaccagaaccucguggcuauggaugagcugguagaagugggagacguugaggauacaggcaauuuagaagguacgguccacaggauccugcuaggggacgugcagaccauucccauccagauuauagacaaccauagcgcccucaucgaggaaaauccagagucgacuauuuccgugucucaagucaagcaggagcccaaagaaccugcacugagcauggaggccaagaaaacaguugauuacaagaaacuuucagcuaccuga

SEQ ID NO: 53822 - RNA, 1044 nt, Artificial Sequence
  derived and/or modified sequence opt3 from CARKD__Homo_sapiens__NP_001229810
auggugaccagagccggcgcugggacagcagucgccggagcgguugugguagcucugcucagcgccgcacuugcccuguacggucccccuuuggacgcuguguuagagagggcauucucccugcggaaggcccacucuaucaaagauauggaaaacacucuacagcucguccgcaauauuauaccaccgcugucaaguacgaagcauaaaggccaagacgggcgaaucggagugguuggcgguugccaggaguauaccggggcucccuacuuugccgcgauuagcgcacuuaaggugggagccgaucugucccacgucuucugugcuucugccgcagcuccugugaucaaagccuauucgccagaauugauuguacaucccguucucgacucaccuaacgcggugcacgaggucgaaaaguggcugccacgucugcaugcccucguggugggccccggcuuagggagagaugacgcacugcuuaggaauguccagggaaucuuggagguuagcaaggcucgggauauaccugugguaaucgacgccgauggucuguggcuaguggcucagcaaccagcccucauucacggcuaccgcaaagcaguccugacaccgaaccacguggaguuuaguagacuuuaugacgccguucugagggggcccauggauuccgacgauucucauggaagcguguugcggcucucccaggcucugggcaaugucacugugguacagaagggugaacgcgacaucuuaucaaacgggcagcaaguucuggugugcagucaggagggaagcucucgaagauguggcggccagggggaccuccuuuccggaucacugggugucuuggugcacugggcgcuacuggcaggcccucagaaaaccaaugggagcaguccacuccuggucgccgcuuucggagccugcucucuuacaaggcaauguaaccaucaggcauuucagaagcacggccgguccaccacuacaagcgauaugauugccgaagugggugcugccuucucgaaacuguuugagaccuga

SEQ ID NO: 53823 - RNA, 1827 nt, Artificial Sequence
  derived and/or modified sequence opt3 from CARM1__Homo_sapiens__NP_954592
auggccgcugcagccgcggcugugggccccggggccggaggugcaggcagcgccgucccugggggagcuggcccaugcgcaaccguuuccguguucccgggugccagacugcucacaaucggggacgcuaacggagagauucagaggcacgccgaacaacaggcgcuucggcuggagguacgcgcaggccccgauucugccggcauagcuuuguacucacaugaagacgugugugucuuuaagugcagugugagccgagagacugaauguucccguguugggaaacagucuuucaucauuacguuaggaugcaauucggugcugauccaguuugccaccccuaacgauuucuguucauuuuauaauauucuaaagacaugcagaggucacacucucgagaggagcgucuucagugagcggaccgaagaguccucugcagugcaauacuuucaguucuauggcuaccugagccagcagcaaaacaugaugcaggacuauguacgcacagggaccuaccagagagcuauccuucagaaucauacugauuuuaaagacaagauaguucuggaugugggauguggcuccgguaucuugucauucuuugccgcgcaagccggggcaaggaaaauuuaugcugucgaagccaguacaauggcucagcacgccgaggugcucgugaaaagcaacaaucugaccgaccggaucgucguuauuccaggaaagguggaggaaguaucucugcccgaacagguggauaucauaauuuccgagccuaugggcuacauguuauucaacgagcgcaugcucgaaucauaccugcaugcaaagaaguaucuuaaaccaagcggcaauauguuucccacgaucggggacguccacuuggccccuuucacugaugagcaacuguacauggagcaguucaccaaggcuaacuuuugguaucagccaaguuuccacggaguggaccuaucugcgcuccgaggugcagccguugaugaauacuuuagacagccgguggucgacacauucgacauuaggauccugauggcuaaauccgugaaguauacuguaaauuuucuugaggccaaggaaggcgaucugcaucggaucgagauucccuucaaauuucacauguugcauagcgggcucguucacggacuggcauucugguuugacguggccuucauaggcucgaucaugaccgucugguuaucuacagcuccuaccgaaccacugacgcacugguaccaagugcguugccucuuucaguccccucuuuucgccaaggcgggugauacucugucagggacauguuugcuaauugcaaacaaacgccagaguuaugacaucagcauagucgcucagguggaucaaaccggcuccaagucuagcaaucugcucgaccugaaaaaccccuuuuucagauacacuggaacaaccccaucacccccgccuggcagucauuacacgucccccagcgagaauauguggaacaccgggucuacauauaaccuuucaaguggaauggccguugcagguaugccaacugccuacgaucugagcuccgugauugcuucuggcucgagcguagggcacaauaacuugaucccucucgccaauaccggaaucgucaaccauacacacuccaggaugggcucaauuaugaguacugguaucgugcaggggucuagcggcgcacagggauccggcgggggaucaaccagcgcucauuaugccguuaauucucaguucacaauggguggccccgcgauuuccauggccaguccaaugagcauacccaccaacacuaugcacuacgggucuuga

SEQ ID NO: 53824 - RNA, 2496 nt, Artificial Sequence
  derived and/or modified sequence opt3 from CARS__Homo_sapiens__NP_001014437
auggccgacagcuccggccagcaagcucccgauuacagaucuauccugucaauuagugacgaggcagccagggcgcaggcucucaacgaacaccuuagcacccgguccuaugugcagggguacucucugucgcaggccgaugucgacgcauuccgccaauugucagccccuccagcugauccgcaguuauuucauguugcacgaugguuccgucacauagaggcccugcuaggaagccccugcgguaagggccagccuuguagacuccaggcuaguaaagggaggcgggugcaaccacaguggucucccccugccggaacacagccaugccgccugcaucuuuauaauucccugacuagaaacaaggaaguauuuaucccccaggacggcaaaaaggugacgugguacuguugcgguccuaccgucuaugaugcgagccacauggggcaugcaagguccuacauuucauucgacaucuugcggcgcgugcucaaagauuauuuuaaguucgacguguuuuacuguaugaauauuacagauaucgacgauaagauaaucaaacgagccagacaaaaccaccuguucgagcaguacagggaaaagcggccagaggcugcccagcugcucgaggacguucaagcagcuuuaaaaccguuuagugucaagcugaaugaaacuaccgaccccgauaaaaagcagaugcuugagcguauucagcacgccgugcaguuggcgacagaaccucuggagaaggccguacaaagccgccuaaccggagaggaaguuaacucuugcguggagguccuccuggaagaggcaaaagaccuucuguccgauugguuggacucaacucucggcugugaugugacagacaauagcaucuucaguaagcugccaaaauuuugggaaggcgauuuccauagagacauggaggcuuuaaacgugcugcccccugauguccucaccaggguuucugaguaugugccagaaauuguaaauuuugugcagaagaucgucgacaacggguacggauauguguccaaugguagcguuuacuucgauacggccaaauucgcuucgucugagaagcacuccuauggcaaacuugugcccgaagccgucggggaccagaaggcacugcaggagggagaaggcgacuugucaauaagugccgaucggcuaagcgagaagcgauccccgaacgacuuugcucuguggaaagcgucuaagccuggugagcccagcuggccaugcccuugggggaaaggacgccccggcuggcauauugaauguucagcaauggccggcacucuccugggggcuaguauggauauccacggagguggcuucgaccuuagauuuccacaccaugauaaugagcuggcccaauccgaagcauacuucgagaacgacugcugggugagguacuuuuugcacaccgggcaucucacaauugccggauguaagaugagcaaaucucugaagaauuucaucacuaucaaggaugcucugaaaaagcacucagcccggcaguuacgccuagcauuucucaugcauaguuggaaagacacccuggauuauagcuccaacacaauggaaucugcgcuucaguacgagaaguucuugaacgaguuuuuccugaauguaaaagacauucucagagcucccguugauauaaccggccaguuugaaaaguggggugaggaagaggccgagcugaacaagaauuucuaugacaaaaagacggcaauccacaaagcccuuugcgauaacguggacacuaggacagucauggaagagaugcgugcucuggugucgcaaugcaauuuguacauggccgcacggaaggcuguccgaaaaagaccuaaccaggcccuccuggaaaauauugcguuauaucugacccacaugcuaaagaucuuuggggccguggaggaagacagcucccucggcuucccaguuggaggcccggggacuucacugagucuugaggcuacagugaugcccuacuugcagguacugucugaguucagggaaggaguccgcaagauagcacgggagcagaaagugccugaaauucuccaacugagcgaugccuuaagagacaacauccugccagagcuugguguuagguuugaagaucaugagggcuugcccaccguggucaagcucguggaccgcaauacgcugcuaaaagagcgagaagagaagcggcguguagaagaggagaaaagaaagaaaaaggaagaggcugccaggcgcaagcaggaacaggaggcagcgaaacuggccaagaugaaaaucccuccauccgaaauguuccucucagagaccgauaaguauagcaaauuugacgagaacgggcugcccacacacgauauggaaggaaaggagcuuucuaagggccaagcuaaaaaguugaaaaagcuguucgaagcccaggagaaauuauacaaggaauaucuccagauggcacagaaugguuccuuucaauga

SEQ ID NO: 53825 - RNA, 351 nt, Artificial Sequence
  derived and/or modified sequence opt3 from CARTPT__Homo_sapiens__NP_004282
auggagagcuccagagugaggcugcucccccuucugggcgccgcuuuguuacugaugcuaccucuccuggggacccgggcacaggaagacgccgagcuucaaccacgcgcgcuggauaucuacucugcugucgacgaugccucacacgaaaaggaguugauugaagcacuccaggagguucugaaaaagcugaaaaguaagcgagugccgauauaugagaaaaaguacggacagguacccaugugcgacgccggugaacagugugcugugcguaagggcgcaagaaucgggaaacucugcgauuguccuaggggaacaagcugcaacuccuucuuacugaagugucuuuga

SEQ ID NO: 53826 - RNA, 2073 nt, Artificial Sequence
  derived and/or modified sequence opt3 from CASC1__Homo_sapiens__NP_001076441
augagacagaccggcgggggagccacaacugacagcgcuucccccgugcugaacaaugucaucaagucucaaucauacuucacggcaaaaaggguuggucucggcaacaauaguuaucuuggggugggacggccuagcucccagcaguggcugucuuugccaggcccgggugggcagggacccaaggccaaaaagucgggcagcaaaaagaagaaaguaaccaaggcggagcgcuuaaaacugcuacaagaagaggaagaacgacgucucaaggaagaggaggaagcuagacugaaauacgagaaggaagagauggagaggcuugaaauucagcggauagagaaggaaaaauggcaccgccuggaggccaaggauuuggaaagaaggaacgaggagcucgaggagcuguaucugcucgaacggugcuuuccugaggcagaaaaauuaaagcaggagacaaaacugcuuucacaguggaagcauuacauccaaugugacggcaguccagaucccuccguggcccaggagaugaauacuuucauuucuuuguggaaagaaaagaccaacgagacauuugaagaggucaucgaaaagagcaaagugguucugaaucuaauugagaagcucaaauucauccugcuugagaccccuccaugcgaccugcaggauaagaacauaauccaguaucaagaauccauuuugcagcuccaggagcuguuacaccugaaauuugggguggcuacugaaauccuccuuaagcaagcaucaacacuggccgacuuggauaguggaaauauggagaaggucauuaaagacgagaacgugacccuauacguaugggcuaaucugaagaaaaacccccgccaucgaagcguuagauucucugaaacgcagaucgguuuugagauaccuaggauucucgccacuuccgauaucgcggugcggcugcuucacacccauuaugaccacgucucagcacugcacccagugagcacaccgaguaaggaauacacuucugccgugaccgaguuggucaaagaugacguuaagaauguggaaaaggcuauuuccaaagagguagaggaagagagcaagcagcaggaacguggcucgcaucucauccaagaggaagagaucaaaguggaggaggaacagggggauauugaagucaagaugucuuccgccgaggaagagucagaggcaauaaaaugugaacgcgagaugaaggugcugagugaaacaguuagcgcugcccaguuacugcuaguggagaacuccucugagaagcccgacuucuuugaagacaaugucguggaucucugccaguucaccacgcugggaggcguauaccaccuugacaucuuggagcugccuccacaauguaaacccguuaaggguuggaugauuguggaaauccucaaagaggggcugcagaaguauacuuacccuccagaaacaaccgaggaguuugaaacugagaacgcguuucccccgauagaagucacacuugaggugcaugaaaacgucauuuucuucgaggauccugugguugugagaugggacgccgagggaaaacacuggaggaccgauggcaucagcaauguaucauauaagcccaaagaacggcuggucacguucaguuuggacaccuuuggcccagugacacucauccaggaugcacacauuaacaugccuuaccaguccugggagcugcgacccuuagacguuaauaaggugcugcuaacugucaccacaguguucacugaaauccaaauucagauaaaggagaaccucugcaugcugagcucuaucaaacuuaaggauaaaaagcauauuucaaucuuggaagggaccuggaugacaccaauccccuuuauuauagcucugaaagaggccggacucaauaucuucccuacccgccacagucauuuuuauguaauuaucaacaauaaggugccacugguugaggucaaggcuuacagacagauggccuuacugagcuccgcauucgccuuugguuggucuaaauggaaccuuuuguguaauucgacuaaggugguguucaaaugguga

SEQ ID NO: 53827 - RNA, 2112 nt, Artificial Sequence
  derived and/or modified sequence opt3 from CASC3__Homo_sapiens__XP_005257220
auggccgacagaaggcggcagcgcgcuagccaagauaccgaggacgaagaguccggcgcaucugggucagauaguggagguagcccccugcgaggcgggggauccugcucuggcucggccggugggggaggcucaggcagccucccuagucagcgugggggaagaacaggugcgcuucaccugaggcggguggaauccggcggggcuaagucugccgaggaaagcgagugugaguccgaagacggaaucgagggcgaugcagucuugucagacuacgaaagugccgaggauagcgagggugaagagggggaauauucugaggaagagaacuccaaaguugaguuaaagucagaagcuaaugacgcagugaacagcaguacuaaagaggaaaagggagaggaaaaaccagauacgaagucuaccguaacaggcgagcgccaguccggcgacgggcaggagagcacugaaccgguggagaauaaggucggcaaaaagggucccaaacaucuggaugacgaugaagacagaaagaacccugccuacauuccaaggaaaggccuauucuuugagcacgaccuccgggggcaaacccaggaagaggaggugcgccccaagggacgacagagaaagcuguggaaagaugaaggaaggugggagcaugacaaguuccgggaagaugagcaggcuccuaaaucgcgucaagagcuuauagcccuguaugguuacgacauccgcucugcgcacaauccagaugacauuaagcccagaaggauccggaaaccucgauauggguccccaccgcagcgcgaucccaacuggaauggcgaaagauugaacaagucacauaggcaccagggacucggcgggacacugccuccacggaccuuuauuaaucgcaacgcagccggaacugguagaaugagugcucccaggaauuacagccguuccggcggguucaaagagggacgggccggcuuucgaccuguugaagccggugggcagcacggcggaagaucuggcgagacagugaagcaugaaaucagcuauaggucacgccggcuggagcaaaccagugucagagacccaucccccgaggcugaugccccggugcucgggagcccugaaaaggaggaagcggccucugagcccccagcagcugccccugacgcugcacccccacccccugauaggccaauagagaaaaagucauacagucgcgcacgacggacgcguacuaaaguaggagacgccguuaaguuagcugaagaggugccgcccccuccagaaggucugauccccgcgccuccaguccccgagaccacaccgacuccuccaaccaaaacaggcaccugggaagcacccguggacagcuccacgucugggcuugagcaggauguggcccaguugaacauugcugaacaaaauuggucgccuggacagcccagcuuccugcagccaagagagcuaaggggcaugccuaaccacauccauaugggugccgggcccccaccgcaguuuaaucgcauggaggaaaugggcguccaaggaggccgggcaaagagauacuccucacagaggcagcgaccuguucccgagccacccgccccuccagugcacauuaguaucauggaagggcacuauuacgacccccuccaguuccaaggaccuauauauacucauggcgauucuccggcuccacugcccccucaggguaugcuuguacagccagggaugaaccugccccacccuggauugcauccgcaccagacacccgccccacucccuaaccccggccuguacccaccucccgugagcauguccccaggucaaccgccuccccagcaguuacuggcaccaaccuauuuuucagcgcccggcgucaugaauuucgggaacccuagcuacccauaugcucccggagcccucccuccgccacccccuccccaucuuuacccaaauacucaggcaccuucucaaguguacggcgggguuacauauuacaaccccgcccagcagcaagugcagccaaagccuuccccgccccgccggaccccacagccugucacgauuaaacccccaccucccgaggugguaaguagaggaagcucuuga

SEQ ID NO: 53828 - RNA, 1311 nt, Artificial Sequence
  derived and/or modified sequence opt3 from CASC4__Homo_sapiens__NP_612432
auggugggcuucggggccaacagaagggcuggacggcugcccagccucguccuuguugugcuguugguagugaucgucguguuagcauuuaauuacugguccauuucuucacgccacguucugcuacaggaggaaguggccgagcuccaaggucagguccagcgaaccgaaguggcgcguggcagacuggagaagaggaacagugaccuucuguugcucguagauacacauaaaaagcagauagaccaaaaagaagcugauuaugggcggcugagcucccgccugcaggccagagagggacucggcaagaggugcgaggacgauaaaguuaaguuacagaauaacaucucuuaccagauggcagacauucaccaucugaaggaacaacuugccgaguugcggcaggaguuccugcgccaggaggaucagcuacaagacuaucgaaagaauaacacuuaccucgugaaaagacuggaguaugaaucguuucaguguggucagcaaaugaaagagcuuagggcucagcacgaagagaauaucaagaaacuggcagaucaguucuuggaagaacagaagcaagagacgcagaagauucagucaaacgacgggaaagaacucgauaucaauaaccaggucgugccuaagaauauaccaaaaguggccgagaacgucgcugacaagaaugaagaaccgagcaguaaccauaucccccacggaaaagaacaaauuaagcggggcggcgaugccgggaugccuggaaucgaggagaaugaccuggcgaaaguugacgauuuaccacccgcacugcguaagccuccaauuuccgugucucagcacgaaagccaucaggccaucucccaccuccccaccggucagccucuuucaccaaacaugccgcccgacagucauauaaaccacaauggcaacccugggacaagcaagcaaaauccaucuucaccccugcagcgcuugauuccuggauccaaccuagauagcgagccaagaauccagacugacauucugaaacaggcuaccaaggauaggguaagugacuuucacaaacucaagcaaucucgguucuuugaugaaaaugagucccccguggacccgcagcauggcagcaaacuggccgauuacaacggugacgaugggaaugucggagaauaugaggcagacaagcaggcugagcuugccuacaacgaagaggaagacggcgauggcggggaggaggacgugcaagaugacgaggagcgagaacugcagauggauccugcggacuacggaaagcagcacuucaaugauguuuuguga

SEQ ID NO: 53829 - RNA, 6951 nt, Artificial Sequence
  derived and/or modified sequence opt3 from CASC5__Homo_sapiens__NP_653091
auggacggcgugagcuccgaggccaacgaagagaaugauaacaucgaaagacccgucaggcggcgccacucuucaauucugaagccuccacgaaguccgcuccaggaccuucgugggggaaaugagagaguucaagaaagcaacgcucugaggaauaaaaagaacucccggcgcgugucuuucgcagauaccauaaaaguauuucagacugagucgcacaugaagaucgugagaaaaucagagauggaagagacugaaacgggugagaauuuguuacugauucagaacaagaagcuagaggacaauuacugcgaaaucaccggcaugaacacacuccugagcgcccccauucacacucagaugcaacagaaagaguucaguaucauagaacauaccagggagcggaagcacgcgaaugaucagacagucaucuuuuccgacgaaaaccagauggaucuuaccucuagccauacugugaugauuacaaaagggcuguuggacaauccuaucuccgagaagucaaccaaaauugauacgacaaguuuccucgcuaaccugaagcugcacaccgaggacagccgcaugaagaaagaaguuaauuuuucuguggaucaaaacacauccucagagaacaagaucgacuucaaugauuuuauaaaacgacucaagacuggaaaauguagcgccuucccagacguccccgacaaggaaaacuuugagauuccuaucuauaguaaagaaccaaauucugcauccagcacccaccagaugcaugugucguuaaaggaggaugagaacaauucuaacauuacaagacuguucagggaaaaggacgauggcaugaauuuuacccagugccacacggccaacauccagacucuuauccccacauccucagagaccaauagucgggaaagcaaagguaacgacauuacuauauacgggaaugauuucauggacuugacauuuaaccauacccugcaaauccuaccugcuacgggaaauuucuccgagauugaaaaccagacccagaaugcaauggauguaacaacuggcuauggcaccaaggccucugggaacaaaacaguuuucaagagcaaacaaaacacugcuuuucaggaccucucaaucaauagugccgauaagauacacauuacccguucccacaucaugggagcggagacacauaucgugagccagaccuguaaccaggacgcacgcauucuggccaugacuccagagucuaucuacucaaauccgaguauucaagguugcaagacggucuucuauagcuccuguaacgaugcuauggaaaugacaaaaugccuuucuaauaugagagaggaaaagaaccuguugaaacacgacucgaauuacgccaagauguauuguaaccccgacgcaaugagcucccucaccgagaaaacuauauacucaggcgaggaaaauauggauaucaccaagagucauacaguggcuauugacaaccagaucuuuaagcaggaucagucuaaugugcaaaucgccgcggccccuaccccagagaaagaaaugaugcugcagaacuuaaugacuacaagcgaggacgggaagaugaaugucaacugcaauuccguuccccacgugucaaaagaaaggauucagcagagccugucuaacccucucuccauaagucuuacggaucggaagaccgagcuguugagcggagagaacauggaccuaacugaaucucauacauccaaucugggcucacaaguaccacucgcagcuuacaaccuggcccccgagaguaccagcgaaucgcacucccagucuaaaagcucaagugaugagugugaagagaucacaaagucccgaaaugagccguuccagcgcucugacauuaucgcuaagaacagccuuacugauaccuggaauaaagacaaggauugggugcugaaaauuuugccuuaucucgacaaggauucaccccaauccgccgacugcaaccaagaaaucgcaacgagccacaauauagucuacugugguggggugcuggacaaacagaucaccaacagaaauacaguuaguugggagcagucuuuauuuuccacuaccaagccacuguucagcucgggacaauuuucaaugaaaaaccaugauacagccauuucuagucacacugugaaguccguccuaggccagaauagcaagcucgcugaaccucugaggaaaucucuuagcaaccccaccccagacuauugccaugauaagaugaucauuugcuccgaggaagaacagaauauggacuugacgaaaucacacacagugguaaucggcuucgggcccagugagcugcaggaacucggaaagaccaaccuggagcacacuacaggucaacuuaccacuaugaaucggcagauagcgguuaaaguggaaaaguguggcaagagcccuauugagaaaucugggguccugaaguccaacugcaucauggauguguuggaggacgaaucaguccagaaaccaaaguuuccgaaagagaagcagaacgugaagauuuggggacgcaaaaguguuggcggucccaagaucgauaaaaccauaguguucagcgaagacgauaagaaugacauggauaucacaaaauccuacacgauugagaucaaccauagaccucuccuggaaaagagggacugucacuuaguaccacuggcagggaccucugagacuauucuauauacaugccgucaagaugacauggagaucacccggucgcauacaacugcccucgaauguaagaccgucagccccgacgagauaacgacacgaccuauggauaaaaccgugguuuuuguggacaaucacgucgaacuggagaugacugaaucacauaccguguucauugauuaccaggagaaggagagaacagacaggccaaacuuugaacuuucccagcgcaaaaguuugggcacucccaccguaaucugcacaccgacggaggaaucuguguucuucccuggaaauggcgagagcgaucggcugguugcuaacgacucccagcucaccccacuggaagaguggucaaauaacagagggcccgucgagguggccgauaauauggaauuaucuaagagcgcaacuuguaaaaacaucaaggacgugcaaaguccuggauuucugaaugagccccuuuccagcaaaucucagaggcgcaagucauugaagcucaaaaacgauaagacaauugucuucuccgaaaaucacaaaaacgacauggauaucacccagaguugcaugguugagauugacaaugagagcgcccuggaagacaaggaggauuuucaccuagcuggugccucgaaaacuauacuguauucuuguggccaagacgauauggaaaucacacgaucccauaccacggcacucgagugcaagacucugcuuccaaacgaaauugcgauccggccuauggacaagaccguguuguucacagauaauuacagcgaccuggaggugaccgauucacacacuguauuuauugacugucaggcuacagagaaaaucuuagaagagaaccccaaguucgggauaggaaaaggcaagaaccucggugucaguuuuccaaaagauaauucuugcgugcaggaaaucgccgagaagcaggcacuggccguugggaacaagauugugcuucauaccgaacaaaaacagcagcuguucgcugccacaaaucguacuaccaacgagaucauuaaguuucacuccgcagcuauggacgagaaagucaucggcaaggugguugaucaggccugcacguuggaaaaagcgcaaguggagagcugucagcucaauaacagagacaggcgcaauguagauuucacaucaagucaugccaccgcugucugcggaagcuccgacaacuacucuugucugccgaaugugauaagcugcacugacaaccuagaaggcuccgcaaugcugcucugugauaaggacgaggaaaaggccaauuauugcccugugcagaacgaucuggcuuacgccaaugacuuugcaucagaguauuaccuugagucugaagggcagcccuugagugcgccauguccccuguuagagaaagaagaggucauucaaaccucgacaaagggacagcucgauugcguuaucacucugcacaaagaccaggaucuuaucaaggacccucggaaccugcuagccaaucagacccucguguauagccaagaucugggugagaugacgaaauugaacuccaagagaguaucuuucaagcugccaaaagaccagaugaagguguacgucgaugacauuuaugugauaccccagccucacuuuucaacagaucaaccgccauuacccaaaaagggccagagcuccaucaacaaagaagagguuauucucaguaaggcugggaauaaaucucugaacaucauugaaaauagcucagccccuaucugugagaacaagccaaagauacuuaauuccgaagagugguucgcagcugccugcaaaaaggagcugaaagaaaacauccagaccacuaauuacaacacagcauuggacuuccauaguaauagcgacgugaccaagcaggucauucaaacucacgugaacgccggagaggcucccgauccuguuaucacaucuaaugugccguguuuucauuccauuaaacccaaccucaauaaccugaauggcaagaccggugaguuccuagcguuucagacgguccaucugccaccucuucccgagcagcuccuggaauuggggaacaaggcccacaacgacaugcauaucguacaggcaacugagauacacaauauuaacaucaucucaagcaaugcuaaagauucgagggacgaggaaaacaagaaaucucauaauggcgccgagaccacaagucugccaccuaagaccguguucaaagauaagguucgacgcugcuccuuaggaauuuuucucccccggcugccaaacaagagaaauugcagcgugacaggcaucgacgaucuugaacaaauaccggccgacacuaccgauauuaaccaccuggagacgcagccugucucauccaaagacucugggaucggaagcguggcuggcaaguugaaucucagucccucccaguacauuaacgaagagaaucugccaguauaucccgaugagaucaacagcucugacucaauaaauauugaaacagaggaaaaagcacuaaucgagacuuaccagaaggagaucaguccuuaugaaaacaaaauggguaagaccuguaauucccaaaagaggacaugggugcaggaggaagaggacauucauaaagaaaagaaaauccguaagaacgagauuaaauucagcgauaccacucaggaccgcgagauauuugaucaccacaccgaagaggacaucgauaagucugccaacucgguccugauuaaaaaucuuucacggacaccaagcuccugcaguucuagccucgacuccaucaaggcggaugggacgucacuggacuucaguacuuacagaucuagccaaauggaaucccaguuuuugagggauaccaucugugaggaaucauuacgagagaagcugcaggacggacggauuacaauacgcgaguucuuuauccuccugcagguucauauucuuauccaaaaacccagacagagcaaccugccuggcaauuucaccgugaacacuccgccaacacccgaagauuugaugcuaucucaguauguguacaggccuaagauucagaucuaucgggaggacugcgaagcucgaagacagaaaauagaggaacugaagcucuccgccaguaaucaggauaaacugcuugucgacaucaacaagaauuuaugggagaagaugcgccacuguagcgacaaagagcugaaggcauucgguauuuaccucaacaaaaucaagucgugcuuuaccaaaaugacgaagguguucacucaucagggcaagguugccuuguacgggaaacugguacaguccgcucaaaaugaaagggagaagcuccagauuaaaaucgaugaaauggacaagauacugaaaaagauugauaacugucuuacagagauggagaccgaaaccaagaaucuggaggacgaagagaaaaacaaucccguggaagagugggauucugagaugcgugcagccgaaaaggaguuggaacagcuaaaaacugaggaagaggagcugcagcggaaccucuuagaacuggagguccaaaaggaacagacacuugcgcagaucgacuuuaugcaaaaacagagaaauaggaccgaggaacugcucgaucaguugucacugagcgagugggacgugguugaguggagugaugaccaggcuguguucacauuugucuaugauacuauucaacucacgaucaccuucgaagaguccgugguaggauuuccauuccuggacaagcgcuaccgaaaaauagucgacgugaacuuucagucucuucuagaugaagaccaggccccucccagcucacuguugguucacaaguuaaucuuccaguauguggaggagaaggaauccuggaaaaagacaugcacuacccaacaccagcugccaaaaaugcucgaggaauuuagucuggucgugcaucacuguagacuucugggcgaggaaauugaguaccucaagcggugggggccuaacuauaauuugaugaacaucgauauuaauaacaaugagcugaggcuacuguucaguucuucagcagccuuugcuaaauucgaaaucacacucuuccuuuccgccuacuauccgagcguuccccugccaucuaccauacagaaccaugugggaaauacuagccaggacgauauugcaacgaucuuaucgaaggucccuuuggagaacaauuaccugaagaacgugguaaaacaaaucuaccaggaccucuuucaggauugccacuucuaucauuga

SEQ ID NO: 53830 - RNA, 2394 nt, Artificial Sequence
  derived and/or modified sequence opt3 from CASD1__Homo_sapiens__NP_075051
auggccgcucuggcauacaaccucggcaagagagagaucaaucacuauuucagcgugagguccgccaaaguccuugcgcugguugcuguguuguuacuggccgcaugccaucuagccucucggcgcuaccgagggaacgacucaugugaauaucuccugaguagcggacguuuucuuggugagaagguauggcagccccacuccugcaugaugcauaaauacaagauuucugaagcuaaaaauugucugguggauaagcacauagcauucaucggcgacucgagaauuaggcaauuguuuuauucauucgucaagaucauuaacccucaguuuaaagaggaagggaauaagcaugagaacaucccauucgaggauaaaaccgccagcgugaagguugacuuucucuggcacccggaagugaauggaaguaugaaacagugcauaaaggucuggacagaggauuccaucgcuaagccccacgugauuguagccggcgcggcaacuuggucuaucaaaauucauaacgguagcuccgaagcccugucacaguacaagaugaauaucacgaguauagcuccucugcucgagaaauuagccaagaccagcgacguuuauugggugcugcaagauccagucuacgaggaccuuuugucugaaaaccggaaaaugauuacaaaugagaagaucgaugcauacaacgaagcugccguguccauucuaaauucaagcacucgcaacaguaaaucuaaugugaagauguucuccgucagcaagcugaucgcgcaggagaccaucauggaaucgcucgacgggcugcaccuucccgagucuuccagagagacaaccgccaugauucugaugaacguuuauuguaacaaaauauugaagccuguggauggaucaugcugucagccaaggcccccuguaacucucauccagaaacuggcagcuugcuuuuucacauuaaguauuaucggcuaccugauauuuuauauuauccaucggaaugcccaccgcaagaacaaaccauguaccgaccucgaaagcggcgaggaaaagaagaauaucauuaacacgccgguguccucucuugagauccuguugcaaucuuucugcaaacuagggcugauuauggcuuacuuuuauaugugugaucgagccaaucucuucaugaaggaaaacaaauucuacacucacucaaguuucuuuauacccaucauuuauauccugguccuuggaguguuuuacaaugagaacaccaaggagacaaaaguucugaauagagaacagacugacgaguggaaggguuggaugcaguuggugauccucauuuaccauauauccggcgcaagcaccuuccugccugucuauaugcacaucaggguguuaguagccgcuuaccuguuucagacaggguauggacauuucucuuacuuuuggauuaagggcgacuucgguaucuaucggguuugccaagugcuauuucgucucaacuuccuggucgugguccuuugcauugugauggaucgcccauaccaguuuuauuacuucguucccuuggugaccguaugguuuauggucaucuacgugacgcuggcgcucuggccucagauaauccagaaaaaggcaaaugggaacuguuucuggcacuucggacugcuucugaaauugggcuuucuccuguuauucauuugcuuucuggccuauucacaaggcgcuuucgaaaagaucuuuagucuauggccacucagcaaauguuucgagcugaaggggaauguuuacgaauggugguuuagauggaggcuugaccgguauguggucuuccauggaauguuguuugccuucauuuaccuggcacuccagaagcgacagauccuguccgaggguaaaggcgagcccuuauuuucuaacaagauaucgaauuuccugcuuuuuauuagcgugguauccuucuugacuuauucaaucugggccaguucuugcaaaaacaaggcugaauguaacgagcuccacccgagcguguccguuguccaaauucuggccuucauccuaauacgcaauaucccuggguacgcaagaucaguguauagcagcuuuuucgcgugguuuggaaaaauuucccuggaacucuucaucugccaguaccacauuuggcuggcugccgauacaaggggcauccuuguguugauacccgguaacccaaugcugaauauuaucgucaguaccuuuaucuucguuuguguggcacaugagauuagccagaucacuaacgacuuagcccagauuauaaucccuaaggauaauucuucccuccugaaacggcuugcuugcauugccgcauuuuucugugggcuguugauccucucaaguauucaagacaagagcaagcacuga

SEQ ID NO: 53831 - RNA, 2697 nt, Artificial Sequence
  derived and/or modified sequence opt3 from CASK__Homo_sapiens__NP_001119526
auggccgacgaugacgugcuguucgaggaugucuacgaacucugcgagguuaucggcaaggggcccuuuagcgugguaagaagguguauuaaccgggaaaccggacagcaauucgcugugaaaauagucgacguggcaaaguuuacauccucuccuggucuuucaacugaggaucugaaacgcgaagccaguaucugccacauguugaagcauccacacauuguugaguuacuggagacguauagcuccgacggcaugcuauacaugguguucgaauuuauggauggggcggaccucuguuucgagaucgucaaacgagcugaugccggauuuguguauucugaagcaguagccucgcauuacaugcgucagauucuggaggcucuuagauauugccacgacaauaacaucauacauagggauguuaagccgcacugugugcuguuggcaucaaaggagaauagcgcccccgucaaacucggcgguuucgggguggcuauccagcugggagaaaguggccugguggccggcgggcgggucggaaccccucacuuuauggcgccagagguugugaagcgcgaacccuacgguaaaccuguagacguguggggcugcggggucauucucuucaucuuacuguccggaugucuuccauuuuauggcacaaaggagagauuguucgaagguauuaucaaagggaaguacaagaugaaccccaggcaguggucucauauaagcgaguccgcaaaagaucuggugcggcgcaugcuaaugcucgacccugccgagcgaauuacuguuuacgaagcucugaaucacccauggcuuaaggagagagacagguaugccuacaaaauccaucugccggaaaccguggagcaauugcggaaguuuaacgcacgucgcaaacucaagggagcuguccuggccgcggugucaagucacaaauucaauagcuucuauggcgaucccccugaagaguuaccagacuuuucugaggaucccacauccucaggccugcucgccgcagaaagagcuguaagccagguucuugacagucuggaggaaauucacgccuugaccgauugcucugagaaggaccuagauuuccugcauuccguguuucaggaccagcaccuccauacucugcuugaucuguacgacaagaucaacacaaaaagcucgccucaaaucaggaauccacccucugaugcuguccagcgggccaaggaaguguuggaggagauuuccuguuauccggaaaacaaugacgcaaaagagcucaagcgaauacugacccagccucacuucauggccuuacugcagacgcaugacgucguggcucacgaaguuuacucagaugaggcgcuacgcgugacucccccaccuaccagucccuaucucaacggggacagcccagaguccgcaaauggagauauggacauggaaaacguaacaagagucaggcuggugcaauuucagaaaaauacugaugagcccauggguaucacccuuaagaugaacgaauugaaccacugcauuguugcccggaucaugcauggcgggaugauacaccgccagggaacacugcaugugggcgacgagauuagagaaaucaaugguaucucugucgcuaaccaaaccguggagcagcuccagaagaugcugagggagaugcgugggagcauuacguucaaaaucguaccuucauaccggacucagaguuccagcugugaagaucuuccaucuacaacccaaccgaagggccgacagauuuacgugagagcccaguuugaguaugaccccgcaaaagaugaccugauaccuugcaaggaagccggaaucagguuccgcguuggcgauauuauccagaucauuucaaaagacgaucacaauugguggcaagggaaguuggagaacaguaagaauggaacugcuggucucauaccaagccccgaacugcaggaguggcgggucgccugcaucgcaauggagaaaacaaagcaggaacagcaagcguccuguaccugguuuggcaaaaagaaaaagcaguacaaggacaaauauuuagcuaagcacaacgccgaccuggugacguacgaggaaguggucaaacuaccugcauucaagagaaaaacccucguucugcuuggggcccauggagugggcaggcgccacauuaagaauacauugaucacuaaacauccagaucgauuugcuuaucccauuccgcacaccacacggccuccaaagaaggacgaggaaaacgguaaaaauuacuauuucgugucucaugaucagaugaugcaggacaucucgaacaaugaguaccuggaguacgggagccacgaagaugccauguauggcacuaagcucgagaccauacguaaaauccacgaacaaggacugauugcaaucuuagacguagagccccaggcucugaagguccuuagaacagccgaguuugcgccuuucgugguuuucauugccgcucccaccaucacuccaggcuugaacgaagaugagucccuccagaggcugcaaaaagaaucagacauacuacagcgcacguacgcacauuauuuugaucugacaauuaucaauaacgagauugacgaaaccauccggcaccucgaggaggccguggaacuggucugcacugcuccucagugggugcccguuaguuggguguacuga

SEQ ID NO: 53832 - RNA, 1368 nt, Artificial Sequence
  derived and/or modified sequence opt3 from CASP10__Homo_sapiens__NP_001193453
augaaaagccagggccaacacugguacuccucuucagacaagaacugcaaggugaguuucagagagaaacugcucaucauugauagcaaucuugggguccaggacguugaaaaccugaaguuuuuguguauaggauuagugcccaauaaaaagcuggagaaguccucuucggccucagauguauucgaacaucuacucgcugaggaccugcuuagcgaagaggauccauuuuuccuggcagaguugcucuauaucauuaggcagaaaaagcugcugcagcaccucaacugcaccaaagaagagguggaacgguuacugccuacacgccaacgagucagucuuuuucguaauuugcuguacgagcuauccgaggguaucgacucugaaaaccucaaggauaugauuuuccugcuuaaagacagccugccgaagacugagaugacguccuugucauuucucgccuuccuggaaaagcagggcaaaaucgaugaggacaauuuaaccugucuggaagaucucugcaagacagugguucccaaacuucugagaaacauagagaaguauaaaagggagaaggcgauccagauugugacuccuccagucgacaaagaagcugagaguuaccagggggaagaggaauuggugagccaaaccgauguaaagacauuucuagaggcccugccccaggagucuuggcagaauaagcaugcaggauccaacgaaauccucucacacguuuuccaguggcugggcuuuaccgugcauauucacaauaacgucacuaaaguggagauggaaauggugcuucaaaagcagaaauguaauccugcccacgcugacggugacugcuucgucuuuuguauccugacacaugggcgguucggagcaguuuauagcagugaugaggccuugauaccaauucgcgaaaucaugucucacuucaccgcucuccagugccccagacuggccgagaagccuaaauuauuuuucauucaagcgugucagggcgaggaaauccagccauccgugagcaucgaggcagacgcccugaacccggaacaggcucccacgucgcuacaagauucuauuccugccgaggcagacuuucuccugggccuugcuacuguaccaggguacguguccuucaggcaugucgaggaaggaucaugguauauacagaguuugugcaaucaccugaagaagcucgugccccggcacgaggauauccugagcauucuuaccgccguuaacgacgaugugucccgccgagucgacaaacaggguacaaagaaacagaugccucaaccagcguuuacucugagaaagaaauugguguuccccguaccgcucgaugcccugucuuuauga

SEQ ID NO: 53833 - RNA, 729 nt, Artificial Sequence
  derived and/or modified sequence opt3 from CASP14__Homo_sapiens__NP_036246
augagcaaccccagaucccuggaggaagagaaguacgacaugucuggcgccaggcucgcucuuauccugugcgugaccaaagcacgggaagggucagaggaagauuuggacgccuuagagcacauguuccgccagcugcgauuugagaguacaaugaagcgugauccuacugcggaacaauuccaggaggaacuagagaaauuucagcaggcuauugacagcagagaggauccagucuccugugccuucguugugcucauggcacauggaagggaagguuuucugaagggcgaggacggggaaaugguaaaacuugagaaucuguucgaagccuugaacaauaagaacugccaagcucuccgggcaaagccgaaaguguauauaauccaggccugucgcggagagcagagagaucccggcgagacggucgguggggacgaaauugugaugguuaucaaggauucuccucagaccauuccaacauacacugacgcucugcacguguauucgaccgucgagggauacaucgccuauaggcaugaucaaaaaggcucaugcuuuauacagacacugguggacguauucaccaagcggaaaggccacauccucgaauuacugacugagguuacacgccgaauggcggaagcagagcuugugcaggaggggaaggccagaaagaccaaucccgaaauucagagcacguugaggaaacggcuguaccuacaauga

SEQ ID NO: 53834 - RNA, 1152 nt, Artificial Sequence
  derived and/or modified sequence opt3 from CASP1__Homo_sapiens__NP_001244048
auggccgacaaggugcugaaagagaagagaaaacucuucaucaggagcaugggcgaagggaccauuaacggacuucuggaugaguuguuacagacacggguccugaauaaggaagagauggaaaaaguuaagcgcgagaacgcuacugugauggacaagacgcgagcacuaauagauuccguaauccccaaaggugcccaagcgugccagauuuguaucaccuacauuugcgaggaagacucuuaucucgcuggcacacuggggcuuucagccgcaccucaggccgugcaggauaauccagcuaugccgaccaguagcggauccgagggcaacgucaagcuguguucuuuggaagaggcacaacguaucuggaaacagaagucggccgagauauaccccaucauggacaaaucaagcagaacuaggcucgcucugauuaucugcaaugaagaguuugauaguauuccucggcgcacaggugccgaaguggacaucaccgggaugacuaugcugcuccagaacuuaggauauuccguugaugugaagaagaaucugacagcgucugacaugaccacggagcuugaagcauucgcccacagaccagagcauaaaacuagcgauuccaccuuuuuggucuucaugucacacggcauaagggagggcauuugugggaagaaacauagugaacaggugcccgacauccugcaacuaaacgcuauuuuuaauaugcucaacacaaagaauugcccuagccugaaagauaagccaaaaguaaucaucauucaggccugucggggagacucucccgguguugugugguucaaggacuccgucggcgugucagggaaccuuagccugccuacuaccgaggaauuugaggaugacgcaauaaagaaagcucacaucgaaaaggauuucauugccuuuugcaguucuacaccagacaauguguccuggcgccauccgaccaugggaagcgucuucaucggccgauugauagagcacaugcaggaguacgcguguucgugcgauguugaagagauuuuuagaaaagugagguucucuuuugaacagcccgacggucgggcccaaaugccuacgacugagcguguaacacucacccgcuguuucuaucuguucccagggcacuga

SEQ ID NO: 53835 - RNA, 939 nt, Artificial Sequence
  derived and/or modified sequence opt3 from CASP2__Homo_sapiens__NP_001215
augcacccccaucaccaggagacccugaagaaaaacagagugguccucgccaagcaacuucuguugagcgaauuacuggagcaucuacucgaaaaagacaucauuacacuggagaugagggaacuuauacaggcuaagguuggcuccuucucucagaauguggagcuguugaaccuccugccuaaacgggggccacaggcauuugaugccuucugcgaggcgcugcgcgaaacuaagcaaggacaccucgaggacauguuacugacgacccuuucagguuugcagcauguacugccgccccuaaguugugauuacgaccucagccugccuuuuccagugugcgaauccuguccccuuuauaagaaacugcgauugucuacagauacugucgagcacucgcucgacaauaaggauggcccugugugccugcagguuaaaccauguacccccgaguucuaccagacacacuuucaauuagcuuaucgucugcagucaagaccuagggggcucgcccuugugcugagcaacguccauuucaccggagaaaaggaguuggaauuucggaguggcggugacguggaucacuccacucuaguaacacuguucaaacuccugggguacgacguucaugugcuuugcgaucagaccgcacaggagaugcaagaaaagcugcagaauuuugcccaguugccagcucaccgcgucacggacucuuguaucguggcacuccugagccacggaguggagggcgccauuuauggcgucgaugggaaguuacugcaacuacaggagguuuuccagcucuuugacaacgcuaauugcccgucccugcagaacaaacccaagauguucuuuauccaagccuguagaggaggugcgauuggcucacuugggcauuugcuccuguucacugcagccaccgcuagucuggcccuuuga

SEQ ID NO: 53836 - RNA, 834 nt, Artificial Sequence
  derived and/or modified sequence opt3 from CASP3__Homo_sapiens__XP_011530603
auggagaacaccgaaaauagcguggacuccaagucuaucaaaaaccuggagcccaagauuauacacggcucagaaaguauggauagcgggaucucccucgacaauucuuacaaaauggauuauccugagaugggacuuugcauuaucauuaacaauaagaacuuccauaaaucgacagguaugacuucaagaagcggcacggacgucgaugccgcuaaucugagggaaaccuuucggaacuugaaguacgagguucgcaauaagaacgacuuaacacgagaggaaaucguggagcugaugcgugauguaaguaaagaagaccacuccaagagaucuagcuucguguguguccuacucucccauggggaggagggaauaaucuuuggcacuaaugguccaguggaucugaaaaagauuaccaacuucuuuaggggagaccggugccgcucacuuacagggaaaccgaagcuguucaucauucaggcauguagaggcaccgaauuggauugcggcaucgagacugacagugggguugaugacgacauggccugucacaagauacccguggaagcggauuuucucuaugcuuacagcacagccccuggauauuacucuuggaggaacuccaaagacgguucaugguucauucaaagccugugcgcaaugcugaagcaguaugccgauaaacucgaguuuaugcauaucuuaacccgggucaaucgcaagguggcuacggaguucgaaaguuuuucuuucgacgcaacuuuucacgccaaaaagcagauuccauguaucguauccaugcugaccaaagagcuuuacuucuaccacuga

SEQ ID NO: 53837 - RNA, 1134 nt, Artificial Sequence
  derived and/or modified sequence opt3 from CASP4__Homo_sapiens__NP_001216
auggccgagggcaaccacagaaagaaaccccugaaggugcucgaaagccuugggaaagacuuccugaccggagucuuggauaauuuaguugagcagaacgugcugaauuggaaggaagaggaaaagaagaaguacuaugacgcuaaaacagaggauaagguaagggugauggcagacuccaugcaagagaaacagcggauggccggucagaugcuacuccagacuuucuucaacaucgaucaaauuucuccuaauaagaaagcgcauccaaacauggaagcuggcccgcccgagucaggggaaaguacggacgcccugaaacuuugcccucacgaggaguuucugcgcuuguguaaggaacgagcagaggaaauauacccaaucaaagagcguaauaacagaaccaggcucgcccugauuaucugcaauacagaauuugaucaucugcccccucggaacggagcugacuuugauauuacuggcaugaaggagcucuuagagggucuggacuauagcgucgauguggaagagaaucuuaccgcacgcgacauggaauccgccuugagagcuuucgccacaaggccagagcacaaaucuucggauucaaccuuucugguucuaaugagccaugggauccucgaaggaauauguggcacugugcacgacgagaagaaacccgacguccugcuuuacgauacaaucuuccagauuuuuaacaaucggaacugccugaguuugaaggacaaaccuaaggugaucauuguacaggcgugucgcggcgcaaaucgaggggagcucuggguuagagauuccccagccucucuggaaguggcuagcucccagucaagugagaacuuagaagaggacgccgucuauaagacccacguggaaaaagauuucaucgcauuuugcagcucuacgccgcauaacguguccuggagggacucaacuaugggaagcauauucauuacccaacugaucacauguuuucagaaguacaguuggugcugucaccucgaggaggucuuccggaaaguucagcagucuuucgaaacuccccgugcuaaggcccaaaugccuaccauugagcgccuuuccaugacaagauauuuuuaccuguucccagguaauuga

SEQ ID NO: 53838 - RNA, 1131 nt, Artificial Sequence
  derived and/or modified sequence opt3 from CASP5__Homo_sapiens__NP_001129581
auggccgaggacaaccacaagaaaaagaccgugaaaaugcuggaauaccucggcaaggauguccuucaugggguuuucaauuaucuggcuaaacacgacguguugacauuaaaggaggaagagaagaaaaaguacuaugauacuaaaaucgaagacaaggcacugauucuaguagauagccucaggaaaaacagaguggcccaucagauguuuacgcaaacccugcuuaauauggaccagaagauaacauccgucaagccccuguugcagaucgaggcgggaccuccagagucugcugaaucaacuaacauucucaaacugugcccgcgggaggaguuccugcgccucuguaagaaaaaucacgaugaaaucuaccccauuaagaaacgagaggaccguagaagguuagcccugaucauaugcaacaccaaguuugaucaucuuccugcacggaauggugcccacuaugacaucgugggcaugaaacgcuugcugcaggggcuaggauacacaguuguggaugaaaagaaccucaccgcuagagacauggagaguguccugagggcauucgccgcucggccagaacacaagagcuccgauucuacuuuucuugugcugaugucgcauggcauuuuggaggguaucugugggacagcccacaaaaagaaaaagcccgacguacuccuguaugacaccauuuuccaaaucuuuaauaaccgcaauugcuuaucacugaaagauaagccuaagguuauaauugugcaggcgugucgaggagaaaaacauggcgagcucugggucagagacagcccagcaagucuugcccugaucuccucucagagcuccgagaacuuggaagcugauucagugugcaagauucacgaggaaaaagacuucaucgccuuuuguaguagcacgccccacaaugugucuuggagggaucggacucguggcuccaucuucauuaccgagcuaauaacaugcuuucagaaguacucauguugcugucaucugauggaaaucuuccgcaaaguccaaaagagcuuugagguuccucaggcaaaggcucagaugccaacuauugagagagccacccucacaagggacuucuaccuguucccggggaacuga

SEQ ID NO: 53839 - RNA, 882 nt, Artificial Sequence
  derived and/or modified sequence opt3 from CASP6__Homo_sapiens__NP_001217
augagcuccgccucuggccuuagaagggggcaccccgcuggaggugaggaaaacaugaccgagacagacgcauucuacaagcgggaaauguuugauccugccgagaaauauaagauggaccaucgccgacguggcaucgcgcucauuuucaaucacgaaagauuuuucuggcaucuuacucugccagagaggcgggggacgugcgcugaucgcgacaacuugaccagaagguuuucagauuuaggauucgaggugaaauguuuuaaugaccugaaggccgaggaacuacuccugaaaauacacgaagucaguacaguuagccaugcagaugccgacugcuucguguguguauuucuuucccacggcgaggguaaccacaucuacgcuuaugaugcaaagauugagauccagacucugaccggguuguucaagggagacaaaugccauucucucgugggcaagccgaaaauuuuuaucauacaagccugucggggcaaucagcacgauguccccgugaucccucuggacguuguggauaaccagacagaaaagcuggacaccaauauuacugaggucgacgcugccucgguguacacacucccagcgggggcagauuucuuaaugugcuauucaguagccgaaggauacuauagccaucgcgagaccguuaacgguaguugguacauccaggaccugugugaaaugcuuggcaaauacggguccucuuuggaguuuacggagcugcuaacucucgugaaucgaaaggucagccaaagaaggguggauuucugcaaggaccccuccgcuauuggaaagaaacaggugccuuguuucgccucaaugcugaccaaaaagcugcacuuuuucccaaaaaguaacuga

SEQ ID NO: 53840 - RNA, 912 nt, Artificial Sequence
  derived and/or modified sequence opt3 from CASP7__Homo_sapiens__NP_001218
auggccgacgaucagggcugcaucgaggaacaagggguggaggacagcgcuaacgaagauuccgucgacgcaaagcccgauagaucuucauucguuccuagucuguuuagcaaaaagaaaaagaaugugaccaugagguccauuaaaacaacucgggaccgcguaccaacguaccaguauaacaugaauuucgagaagcucggaaaguguauaaucauuaacaauaaaaacuuugauaaggugaccgguaugggcguccgaaaugggacagacaaagaugccgaagcgcuuuucaagugcuuucguucucugggauucgacgugaucguuuacaacgauuguucgugcgcuaaaaugcaggacuuguuaaagaaggccucagaggaggaucacacuaaugcagccuguuuugcuugcauucugcuaagccauggcgaagagaacgugaucuaugguaaagacggggucaccccgauaaaggaccucacagcacacuucagaggagauagguguaaaacccugcuugaaaagcccaaacuguuuuucauccaggccugccggggcacugaguuggacgauggcauucaagcugacagugggccuaucaaugauacagacgccaacccacgcuacaagauucccguggaggcggauuuucucuucgcauauuccaccguaccuggauacuauucuuggagaagcccagguaggggcuccugguuuguucaggcccuguguucaauccuggaggaacaugggaaagaccucgaaauaaugcagauuuuaacgcgggugaaugaucgcgucgcucgacacuucgagagucagagcgacgauccccauuuccacgaaaagaagcaaaucccuugcguggugucuaugcugacuaaagagcuuuacuuuucccaguga

SEQ ID NO: 53841 - RNA, 5949 nt, Artificial Sequence
  derived and/or modified sequence opt3 from CASP8AP2__Homo_sapiens__NP_001131140
auggcagcugacgaugacaacggcgaugggacaagccuguucgacguguuuuccgcaucuccccucaagaauaacgaugagggaucacuugacaucuacgccggucuggauagugcggucagcgacuccgcuucuaaaucgugcguuccuucaagaaauuguuuggauuuauaugaagagauucugacagaagagggcacugccaaggaagcaacguacaacgaccuacagguggaguaugggaaaugccagcuccagaugaaggagcugaugaaaaaguucaaggaaauacagacccagaauuuuagccuuaucaacgagaaucaaagucugaaaaagaacauuuccgccuugaucaaaacagcuaggguagaaauuaaucggaaggaugaggagaucucuaaccuccaccagcgccugagcgaguucccacacuuucgaaauaaccacaaaacugcacguaccuucgacacagugaagaccaaggaucugaaauccagaucaccgcaucucgacgacuguaguaagacugaucacagggccaaaagcgacgucucuaaggaugugcaucacuccacaucauuacccaaucuggagaaagaaggaaagccucacagcgacaaacggaguaccucucaucuuccaacguccguugagaagcacugcacuaacggcguguggagccgcucgcauuaccaggucggugaagggucuuccaaugaggauucaagaaggggacggaaggacauacgccacagucaguuuaaccgaggcaccgagagagugaggaaagauuugagcacaggcuguggggacggagaaccccggauccuggaggcuucccaacgucuacagggucacccugaaaaguauggcaaaggggagccaaagacugaaucuaaaagcucaaaguucaagaguaacuccgauagcgacuacaaaggagagcgcauuaauucuucaugggagaaggaaacccccggcgagagaagucauagcaggguagauucccagucugacaaaaagcucgaacggcagucggagcgaagccaaaacaucaaucgcaaagaaguuaagucccaggacaaggaggagagaaaaguggaucagaagccuaaaucagucgugaaggaccaagaucacuggaggcggagugaacgcgccucucugccacauagcaaaaacgagauuacauuuucccacaauucaagcaaguaucaucuugaagagagaagggguugggaggacugcaagcgugauaaaucugugaacucccacaguuuccaggacgggcgguguccgagcucucuguccaauucacgaacccacaagaacaucgauaguaaagaagucgacgcgaugcaucagugggagaauacgcccuugaaggcagaaagacacaggacugaggauaaacgcaagcgggaacaggagagcaaagaggaaaacagacauauaaggaaugagaagcgcguuccuacagaacaccuccaaaagaccaacaaagagacuaagaaaacaaccacggaccugaagaaacagaaugaaccaaagaccgauaagggagagguguuagacaacggcguaucggagggcgccgauaauaaagaacuggcuaugaaggccgaguccgggcccaacgaaaccaagaacaaggaccucaaacuuucuuuuaugaagaagcugaauuugacucuaagcccugccaaaaagcagccagugucacaggacaaccaacacaaaauuaccgauauccccaagaguuccggagucugcgacucugagagcuccaugcaagugaaaacaguugcuuacgugccgucaauuagcgaacauauccugggugaggccgcggucagugagcacacuaugggcgaaaccaagucuacacuccuggagccuaagguggcccuucuggcaguaaccgaaccccgaaucgggauuuccgagacuaauaaagaggaugaaaacagcuugcucguucggucgguggacaauacgaugcauugugaggaaccaauaugcggaacagagaccucauucccuucucccauggaaauccagcagacugagagucuguuuccauccaccggcaugaagcaaacaauuaacaauggucgugcugccgcucccgucgugauggaugucuuacagaccgacgugagccagaacuucgggcuggagcuagauacuaaaagaaaugacaacucugauuacuguggcaucagcgaaggaauggagaugaagguugcccucuccacaacggugucagaaaccacugagaguauacugcagccuagcauugaagaggcagacauccuuccaaucauguugucugaggauaauaacccgaaauucgaacccuccguaauugucacaccucugguggagucaaagaguugccaccucgaaccaugccugcccaaagagacccuugacagcucccugcaacagacagaauugauggaucauaggauggccacuggcgagaccaauucuguuuaucacgacgacgauaacucggugcucagcaucgaccugaaucacuuacgcccuauuccagaggcuauaucaccccugaacuccccgguccggccuguggcgaagguacuaagaaacgaaaguccaccccaggugccuguuuacaauaacucucauaaggaugucuuucuccccaauagcgcacacuccacgucaaaaucucaaagcgaccugaacaaggagaaucagaaaccaaucuauaagagugauaaauguaccgaagccgacacaugcaagaacuccccucuugaugaguuggaggaaggggagauuaggagcgacucugaaacuucaaagccccaggaguccuucgagaaaaauaguaagcgacgcgugagcgcugaugugcggaaaucgaagaccaucccaagaaggggaaaaucuacagucugucuggacaaggauucccguaagacucauguucgcauccaccagaccaacaauaaauggaacaagcggccggacaaaagcucaagaaguucuaagacggagaaaaaggacaaggugauguccacaagcucacucgagaaaauugugccuauaaucgccguacccaguagcgaacaagagauuaugcauaugcugaggaugauccgaaagcacguccggaaaaauuacaugaaguuuaaagcaaaguucuccuuaauucaguuucaccgcaucauagaaucugccauccugagcuucaccucccuuauuaagcauuugaaccuccacaaaaucucaaagucugugacuacacugcagaaaaaucuaugcgauauuaucgagaguaagcugaaacagguuaagaaaaacgguauaguggacagacucuuugaacaacagcugccagauaugaagaagaaacuuuggaaguucgucgacgaucaguuggacuaucuguuugcuaaauuaaagaaaauucucgugugugauagcaagucguucggcagggacuccgaugaggggaagcuggagaaaaccucuaagcagaaugcccaauacucaaacagccagaaacgguccguugacaacaguaaucgagaacuucugaaggagaaauugucuaagagcgaagaucccgugcauuauaagucacucguaggaugcaaaaaguccgaggaaaacuaccaggaccaaaauaacaguagcaucaauacugucaaacacgauauuaagaaaaacuuuaauaucuguuucgacaacaucaaaaauucucaguccgaggagagaucacuggaagugcacugcccuagcaccccaaagucggagaaaaacgaaggcucuaguauagaggacgcacagacaucccagcaugcgacgcuaaagcccgagcgcagcuuugaaauucugaccgagcaacaggcuucaucccucacuuucaaucuggugucugaugcccagaugggugaaaucuucaaaagccuuuugcaggggagugaccuguuagauuccagcgucaacuguacagagaagucugaaugggagcucaaaaccccugagaagcaacugcuugaaacacugaaaugcgagucaauuccggcauguacuaccgaagaacucguuaguggcguggccuccccaugccccaagaugaucagcgacgauaauuggucucuacugucgucagaaaagggaccuagcuuguccaguggccugucuuuaccaguacaccccgacgugcucgaugagagcugcauguuugaggucuccacgaaccugccucuuucaaaagacaauguguguaguguugaaaagucuaaaccgugcgugagcuccauacuguuggaggaucucgcugucucacugacagugcccagcccacuaaagucugacgggcaucuguccuuccuuaaaccugauaugaguagcucguccacccccgaagagguuauuucugcccacuuuucagaagacgcacuccuggaggaggaagaugcuagcgagcaggacauccauuuggcccuggaaagugacaacuccucuagcaagucauccuguaguagcucuuggacuucaagguccguggcgccaggauuccaguaccacccuaauuuacccaugcacgccgucaucauggaaaagagcaacgaucauuuuauuguaaaaauccgucgggcuaccccaucuacaaguucgggucucaagcaguccaugaugccggacgagcugcuuacuagccugccuagacacggcaaagaagcagaugaggggcccgaaaaggaguauauuucaugccaaaacaccguguucaaaucuguugaagaguuggagaauagcaacaagaauguggacggauccaagaguacacaugaggaacagucaucuaugauacagacgcaggucccagauaucuacgaauuucucaaagacgccagcgauaagaugggccacuccgacgagguggcugaugaauguuucaaacugcaccaaguaugggagaccaaggugcccgagaguauugaggaacuaccuagcauggaagagaucucccauucugucggugaacaucugccaaacacuuauguugaccuuacaaaagaucccgugaccgagacuaagaaucucggggaguuuauugaagugacaguccugcauaucgaccaguugggcugcucaggaggcaacuuaaaucagagcgcccaaauacuggacaacucgcuccaggcagauaccgugggggcguucaucgaccugacgcaggaugccuccagugaggcuaagucugaaggaaaucacccugcccuugcaguugaggaccugggcugugguguaauucagguggaugaggacaacugcaaagaagagaaggcucaagucgccaauaggccguugaaauguaucguggaagagacuuacauugaucuaaccacagaaagcccaucauccugcgagguuaagaaagacgagcugaagucugaacccgggaguaacugugauaauagcgagcucccuggaacccugcauaacucccacaaaaagcgccgaaauaucucagaccuuaaccacccccauaagaaacagagaaaggaaacugauuuaacaaacaaagagaagaccaaaaagccaacacaggacagcugcgaaaauacugaggcacaccagaagaaagccucuaagaaaaaggcuccucccgugaccaaagauccaaguucccugaaggcgacgccuggcauaaaggacagcucagccgcacucgcuacaucuaccuccuugucggccaaaaacgucauuaagaaaaagggugagaucaucauucuguggacucggaaugacgauagggaaauacuccuggagugccaaaaacgcggcccgagcuuuaagaccuucgccuaucuugcugcaaagcuggacaaaaaccccaaucaggugagugaacguuuucagcaguugaugaagcuauucgagaaaucuaaguguagauga

SEQ ID NO: 53842 - RNA, 1617 nt, Artificial Sequence
  derived and/or modified sequence opt3 from CASP8__Homo_sapiens__NP_001073594
auggagggcgggagaagggcccggguggucaucgaaagcaagcgcaacuucuuucugggagcuuuccccaccccuuuuccagcagagcacguugaacucggucgacuuggcgacuccgagacagccauggugccggggaaaggaggcgcggauuacauucuguugcccuucaagaaaauggacuuuucucguaauuuauaugauauaggugaacagcuggacucagaggaucuagcuagucucaaguuccugagccuugacuacaucccucaaagaaaacaggagccaauuaaggaugcccugauguuguuucagaggcuccaggaaaagcggaugcuggaggaauccaaccugucuuuccucaaagaguuacuguuucgcaucaauagacuugacuugcugauuacuuaucuaaacacgaggaaggaggaaauggagcgggaacuccaaacccccgggcgcgcacagaucucggccuaccgaguaaugcuguaucagauaucagaggaagugagcagaagugagcuuagguccuucaaauuucuguugcaggaggaaaucucuaagugcaaacucgaugacgauaugaaucuguuagacauuuucaucgagauggaaaagcgggucauucugggagagggcaagcucgauauccuuaaacgugugugugcucaaauaaacaagagccuguugaaaauuaucaaugacuacgaagaguuuuccaaggagcgcucaaguagccuagaaggcucuccugacgaguucuccaacggggaagaacugugcggaguuaugacaauuucagauagcccaagagaacaggacagugagucucagacucucgauaaaguguaucagaugaaguccaaacccagggguuacugucugaucaucaauaaccauaauuucgcaaaggcccgggagaaggucccuaaacuucacagcauucgagaccgcaacggcacccaucuggaugcuggggccuugacaaccacuuuugaggagcuccacuucgaaauaaagccacaugacgauugcacaguggagcaaaucuacgagauucugaaaaucuaucaguuaauggaccacucgaauauggauuguuuuauaugcuguauucugucucacggagacaagggcaucaucuacgguaccgaugggcaggaagcgccgauuuaugagcuaacgucccaauucacuggacucaaaugccccucacuggcaggcaagccuaagguauuuuucauccaggccugucagggcgacaacuaccagaaagggauuccaguugaaaccgacagugaggaacaacccuaucuugagauggauuugagcuccccucagacaagauacauaccagacgaggcugauuuucugcucggaauggccacugugaauaacugcgucucuuauaggaaccccgcagaagguaccugguacauccagagccugugucagucacuucgggagcgcugcccgagaggcgacgauauucugacaaucuugaccgaagugaauuacgaggugaguaacaaggacgauaaaaagaauauggggaaacaaaugccucagcccacguucacucucaggaagaagcuggucuuuccauccgacuga

SEQ ID NO: 53843 - RNA, 1089 nt, Artificial Sequence
  derived and/or modified sequence opt3 from CASP9__Homo_sapiens__XP_011540572
auggacgaggccgauagaaggcugcuccggcgcugccgacuucgucugguggaagaguugcaggucgaccaauuaugggaugcucugcuaagcagagaacucuucaggccccacaugaucgaggacauucagcgggcaggcuccgggucucgcagagaucaggccaggcagcugauaaucgaccuugaaacccggggaucacaagcgcugccuuuguuuauuaguugucucgaggauacaggucaggacaugcuggcuagcuuccugcgcacuaaccgacaggccgcaaagcucuccaaaccaacguuagagaaucugaccccgguugugcuuagacccgaaaucaggaagccugagguauugcggccagaaacaccccguccuguggauauuggcucugggggauuuggcgacgucggugcccuggagucgcuacgcgggaacgcugaucucgcauacauccugucaauggagccaugcggacauugucuuauaaucaauaacgugaauuucugcagagaaagcggccugaggacucggaccggcaguaacauugacugugagaaauugcgacgcagauuuuccucucuccacuucaugguugaagugaagggggaucugacagccaaaaagauggucuuagcucugcucgagcuugcccagcaagaccauggagcgcuggacugcugugugguaguuaucuugagccacgguugccaggcaucccaucuacaguuucccggcgccguguaugggaccgauggauguccugucucaguggaaaagauugugaauaucuucaacggcacaaguugcccaagccugggugggaaaccgaagcucuuuuucauacaggcuuguggaggcggcugccaagccgaccccgcaccuucucacuccaggcugcggccacccugcugugcugucucacgccacagccagacuccuggggccgauaguggaguuucuaccaaaaagacgacuagauccaaugagccacagaaccuugagaaaaauauggcggugaccgaccaaaggggucccccgcuggaagccggcggguugcgugagaagcagugggauagcuga

SEQ ID NO: 53844 - RNA, 1191 nt, Artificial Sequence
  derived and/or modified sequence opt3 from CASQ1__Homo_sapiens__NP_001222
augagcgccaccgacagaaugggccccagggcugugccugggcugcggcucgcacuucuguuguuacugguccuaggaacaccaaaguccgguguucagggccaagaggggcucgauuucccggaauacgacggaguggaucgcguaaucaacgugaaugccaaaaacuauaagaaugucuuuaaaaaguacgaggugcuggcgcuucuguaucacgaacccccugaggacgauaaagcaucucagcgacaguucgaaauggaggaguugauucucgaacuggccgcacagguucuggaggacaagggcguggguuuugggcucgucgauucagaaaaggacgccgcuguggcuaaaaaguuaggacugacugagguagauaguauguacguuuucaaaggcgacgaggugauagaauaugauggcgaguuuagcgccgacacgaucgucgaauuucuuuuggaugugcuggaggacccaguggaacuaauugagggggagcgugaacuccaggcuuuugagaacaucgaagacgagauuaagcugaucggauacuucaaauccaaggauucugaacauuauaaggccuuugaggacgcggcagaggaguuccaccccuacauaccuuucuucgccaccuuugauucgaaagucgcuaagaaacuuacacugaaguugaaugaaaucgacuucuacgaagccuucauggaggaaccaguuacuauucccgauaaaccuaacucagaggaggaaaucgugaauuuuguagaggaacauagaaggagcacccuccggaagcugaaaccagagaguauguaugagacaugggaagacgauauggacgguauucacaucguggcauucgcugaggaagccgauccggacggcuuugaguucuuagaaacccugaaggcggucgcccaagauaacacugagaaucccgaccucuccauaauuuggaucgacccugaugacuuuccacuucuggugcccuacugggagaagacauucgauauugacuugucugcaccucagaucgggguugugaacgucaccgaugcugacagcguguggauggaaauggaugacgaggaagaucuaccauccgccgaggaacuggaggacuggcucgaggauguacuggaaggagagaucaauacggaagacgaugacgacgaugacgaugacuga

SEQ ID NO: 53845 - RNA, 3267 nt, Artificial Sequence
  derived and/or modified sequence opt3 from CASR__Homo_sapiens__NP_001171536
auggccuucuacagcugcuguugggugcugcucgcucuuaccuggcacacauccgcauauggccccgaccagagagcccaaaagaaaggggauaucauucugggagguuuguuuccuauacauuucggcgucgcggcuaaggaccaggauuuaaaaucuaggccagagucaguugaaugcauccgguacaacuuucgcggguuccgauggcugcaggccaugauuuuugcaaucgaggaaauuaauaguagcccggcccuacuccccaaccugacucuuggauaucguaucuucgacacguguaauaccguguccaaggcucuggaggcaacauugucuuuuguagcccagaacaaaauagauucgcucaaucuggacgaguucugcaacuguucagaacacaucccuagcacuauugcuguggucggcgccaccgguagugggguguccacagcgguugcaaaucugcucggauuauuuuacaucccacaagugucuuaugccagcuccucaagacugcuuaguaacaagaaucaguucaagagcuuuuugaggaccauucccaacgaugagcaucaggcuacugccauggcagacaucauagaauacuuccgguggaauugggucggcacaauugcugccgaugacgauuauggccgcccugggaucgagaaauuuagagaagaggcggaggaaagggacauuugcaucgauuucucugagcugaucucccaguacucagacgaagaggaaauucaacacgugguagagguuauacagaacagcaccgccaaggugaucgucguguucaguucuggaccagaccuagagccccucauuaaagaaaucgugcggcgcaauauaacggguaagauuuggcuggcauccgaggcuugggccagcucgucucuuaucgcuaugccucaguacuuucaugucguuggcgggacuaucggauucgcccugaaagcaggccagauuccagguuuucgagaauuuuugaagaaggugcacccgagaaaauccguacacaacggguucgccaaggaguucugggaagagaccuuuaauugucaucuccaagagggagcuaaaggcccccugccuguggauacauucuuaaggggccacgaagagucaggggaccgguuuaguaacagcuccacugcguuccguccacugugcaccggagaugaaaacaucucuagcgucgagacacccuauauugacuacacccaucuccgcauaucauauaauguguaccuugcaguuuauaguaucgcccacgcucugcaggauauuuacacguguuugccugguagaggccuauuuacuaacggguccugcgccgacaucaagaaaguggaagcauggcagguccugaagcaccucaggcaucugaauuucacaaacaauaugggagagcaagugaccuuugaugaguguggcgaccuuguagguaacuauagcaucauuaauuggcaccugucuccagaagaugggucaauaguuuucaaagaggugggcuacuacaacgucuaugccaagaagggagaacgguuguucaucaaugaggagaaaauucucuggaguggcuuuagccgagaaccccugacuuucguguuauccguccuacaggugccguuuucuaacugcucgcgcgacugccuggcugggacaagaaagggaaucauugagggugaaccuaccuguugcuucgaguguguugaaugccccgauggcgaguacagcgacgagacggacgccuccgcauguaauaaaugcccagaugacuuuuggucaaacgaaaaucauaccaguuguaucgcgaaggagauagaguuccucucuuggacagaaccuuuugggaucgcucugacucuuuucgccguguugggaauuuuucugaccgcauucguacucggcgucuuuaucaaauucaggaacacacccauugugaaggccacuaaucgggaacugagcuaucuucuguuguuuucccuccugugcuguuucucaagcucuuuauucuuuaucggugagccacaggauuggaccugccgccugagacagcccgcuuucgggauauccuuuguucuauguauuaguugcauccucgugaagacaaacaggguccugcuuguguucgaggccaaaauuccuaccagcuuucaccguaagugguggggcuugaaccugcaauuccuccugguauuuuuaugcacuuucaugcagaucgugauauguguuaucuggcuguacacggcaccaccgucuuccuaucggaaucaggaacuugaggacgaaauuaucuuuauuacaugccaugagggaucauugauggcucucggcuuccugaucggguacaccugucuacuggccgcgauaugcuuuuucuucgccuuuaaaagucgaaagcuccccgaaaacuucaaugaggcuaaauuuauuacuuucagcaugcugaucuuuuucaucgucuggauuucguuuaucccugcauaugccuccaccuacggaaaguucgugucugcuguggaggucauugccauacuugcagcgagcuuugguuugcuggccuguaucuucuuuaacaagauuuacaucauuuuauucaaaccaucaagaaauacaaucgaagagguuaggugcaguaccgcugcccacgcauuuaagguggcugcccgcgcaacucuccggagauccaacgugucuaggaaacgcagcuccucacugggcgggagcacaggaaguacgcccucuuccagcauaucgucaaagucuaauagugaagauccuuucccacagcccgagcgacaaaaacagcagcagccgcuugcccugacccaacaggagcagcagcaacagccuuugacucucccacagcaacagcggucccagcagcaaccccguuguaagcagaagguaaucuucggcagcgguacagucaccuuuucucugagcuucgacgaaccucagaaaaacgcuauggcgcacagaaauuccacacaucagaacucacuagaggcccaaaagaguagcgauacucugaccaggcaccagccccuccugccacuucagugcggggaaacggacuuggaucugaccgugcaggagacaggcuuacaaggaccuguuggcggggaccagcgccccgaaguggaggauccagaggaacucucuccggcacuggucguguccucaagucagagcuuuguuauuuccggaggcgguucuacugugaccgagaauguagucaacucguga

SEQ ID NO: 53846 - RNA, 1050 nt, Artificial Sequence
  derived and/or modified sequence opt3 from CASS4__Homo_sapiens__NP_001157587
augaagggcaccgggaucauggacugcgcccccaaagcucugcucgcaagagcccuuuacgauaacuguccugacugcagcgaugagcuggcguucuccaggggagacauuuugacaauauuagaacagcacgugccagagucugaagguugguggaagugucugcuacauggccggcaagggcucgcuccggccaaucgccugcagauccuuacugaggucgcagccgaucgacccugcccuccauuucugcguggauuggaagaggcucccgcaucaagugaggaaacguaucagguuccuacccucccaagacccccuacaccaggcccgguguacgagcagaugaggagcugggccgaagguccccaaccuccaacugcucagguauaugaguuccccgacccuccaaccuccgcccggauuaucugugagaaaacacugucuuuucccaagcaggcgauucugacccucccgcgcccugugagagcaucguuacccacucugccaucacaggucuacgaugugccuacacaacacagggggcccguugugcuuaaagaaccagagaagcagcaguuguaugacauccccgccagcccuaagaaagcuggacugcauccaccggauagucaggccuccaaccccggcccucuaauaccacaacccucuagccagcagaccccugaacggaagccacgccucuccgagcacugccgacuguacuucggcgcacuuuuuaaagcuaucucagccuuccaugggagucugucuagcucccaacccgcggaaauuaucacgcagucaaaguuggucauuauggugggacagaaacucguagacacucuguguauggagacccaggagagagauguuaggaaugaaaucuuacgggguagcagucaccugugcucucuccuuaaggacguggcccuggcaacaaagaacgcugucuugacuuauccguccccugccgcucuaggccaucugcaagccgaggcagaaaaacucgagcagcacacccgucaguuucgcgggacacugggauga

SEQ ID NO: 53847 - RNA, 2253 nt, Artificial Sequence
  derived and/or modified sequence opt3 from CAST__Homo_sapiens__NP_001035905
augagccagcccggccaaaagccugccgcuuccccaagaccgaggcgggcagccgcggcucgccgaacccacgagcaugugucugagaaaacaucagaaagucccagcaagccuggggaaaagaagggauccgacgagaaaaaggccgcaucucuggguucgucacagagcagucguacuuacgccggcgggacggcuuccgcaaccaaggucucugccagcuccggagcuacaucaaaaaguagcucuaugaacccaacugaaaccaaggccguuaaaacagagcccgagaagaaaucccagucaaccaagccuaagagccucccaaaacaggcgagugauacuggcucuaaugacgcacacaacaagaaagccguguccagaagcgcugaacaacagcccucggagaagucuacagaaccuaaaaccaagccacaggauaugaucuccgccgguggggagucaguagcaggaauuacggcuauaaguggcaaaccgggcgacaagaagaaagagaagaaaagccuuacucccgccgugccugucgaauccaagccagauaaacccucuggaaagagcgggauggacgcggcccuggaugacuugaucgauaccuuagguggcccugaggaaacagaggaagagaauacuaccuauacagggccagaggugucagaccccaugaguuccaccuacauugaggaacugggaaagagggaaguuacgaucccgccuaaauaucgggagcuacucgcaaagaaagaaggcauuacuggucccccagcugauagcucuaagccuaucgggcccgacgaugccauagacgcucugucaagugacuucacaugcggaagcccaaccgccgcaggcaaaaagacugagaaggaggaauccacagaggugcuuaaagcccagucugcuggcaccguccgcucggcggcacccccucaagaaaagaaaagaaagguggagaaagauacgaugagcgaccaggcccuggaagccuuguccgccucacucgggaccaggcaggcagagccagagcuggaucugcggaguaucaaggaaguagacgaggccaaggcuaaagaagagaagcucgagaaauguggagaagaugacgagacaauuccgucugaauaccgcuuaaagcccgccacugauaaagacgguaagccucugcuuccagagcccgaagagaaaccuaagccacgaagcgaguccgaauugaucgaugagcugucagaagacuuugauagaagcgagugcaaggaaaaacccucuaagccgaccgagaaaacagaggaauccaaggcagcggcuccugccccaguuagugaggcaguguguaggacuagcaugugcucuauucaguccgcucccccugaacccgcuacccuaaaaggcacagucccagacgacgccguggaggcacucgcugauucacuggggaagaaggaagccgacccugaggauggaaaacccgugauggacaaggucaaagagaaggcgaaagaagaggaucgggaaaaacuuggcgagaaggaggaaaccaucccaccggacuaucgucuggaggaaguuaaagauaaggacgguaaaccuuugcuccccaaggagaguaaagaacaacugccacccaugagcgaggauuucuuacuggacgcccucucggaggauuuuuccgggccucagaacgcuucuagccuuaaguucgaagacgcaaagcuggccgcugccauaucagaggugguaagucagacuccagcauccacgacacaagcgggcgcucccccucgcgauaccucucagagcgacaaagacuuggaugacgcccuagauaagcuguccgacucacucggacagagacagccggauccagacgaaaauaaacccauggaggauaaggugaaagaaaaggccaaagcagagcauagggacaagcugggcgagcgggaugacacuauuccuccagaauaccgacaccuucuggaugacaacgggcaagauaagcccgucaaaccuccgaccaagaaaagcgaggacaguaagaaacccgcugacgaucaggacccaaucgaugccuugucuggagaccucgauuccuguccuagcacaaccgaaacuucgcagaauacagcaaaggacaagugcaaaaaggccgcuucaucuaguaaagcgcccaagaacgguggcaaagccaaggauuccgcaaagacgaccgaggaaacuagcaaaccaaaggacgauuga

SEQ ID NO: 53848 - RNA, 3573 nt, Artificial Sequence
  derived and/or modified sequence opt3 from CASZ1__Homo_sapiens__XP_011539937
augaagguggacuaccugagcgaguucggcuuuagacucuccgauuaugaauuugggaccaaagagaagaggauggaccuuggaacagccgaagguacucggugcacggaucccccugcuggcaaaccagcaauggccccgaagcgcaaagggggacugaaguugaacgcgaucugugcuaaguuaucucgacaggucguuguggagaaacgugccgacgcaggcucacacaccgaagguagucccagccaaccuagagaucaggagagguccgggccagagucuggagccgcucgggcaccccgcucggaagaggacaagagaagggccguaauugaaaaaugggugaauggcgaguacucagaggaaccugcuccaacacccguccugggccggauagcccgcgaggggcuagaacucccuccagagggaguguauaugguucagccgcaggguugcagcgaugaagaggaccacgcggaggaacccaguaaggauggcggggcacuggaggaaaaagacuccgauggagccgcuucuaaggaggacagcggcccuuccacucgacaagccucaggugaagcaaguagccuuagagauuacgcugccucuaccaugacagaguuucuggggauguucggauaugacgaccagaacaccagggaugaguuggcgcggaagaucuccuuugaaaaacuccacgccggcucaacuccagaggcagcuacaagcaguaugcugcccaccucugaagacacgcuguccaagcgugcccgcuucagcaaauacgaggaauauauuagaaagcucaaagcuggcgagcaguuaucguggccugccccaucuacuaagaccgaggaaaggguggggaaagaggucgugggaacacugcccggucuucgguugccguccucaacugcacaucuggaaaccaaggccacaauccuaccucuccccagucacagcuccguacagaugcaaaaucugguugcucgagcgucuaaguacgauuucuucauucagaaacuuaagaccggcgagaaccugcgcccacagaaugggagcacguacaaaaagccuucaaaauaugacuuggagaacgugaaguaccuccaucuguuuaagcccggagaaggcaguccagauauggguggggcaaucgccuucaaaacuggcaaggucggaagacccuccaaauaugacgugaggggcauacagaagccugggccagcuaaagugccgcccacaccuagcuuagccccagcaccccuggccucugucccuucagcuccaagugcccccggaccggguccugagccacccgcaagccucuccuuuaauaccccugaauaccuuaagucuacuuucucgaagacagauagcaucaccacgggcaccguuuccacagugaaaaacgggcugcccacugacaagccagcgguaaccgaggaugugaauauuuaucaaaaauacaucgcucgguuuucaggaagucagcacuguggccacauucauugcgccuaucaguaccgcgaacacuaccauuguuuggacccugagugcaacuaucaaagauucacaucuaagcaggaugucaucaggcacuacaauaugcacaaaaagcgugacaacagccuacagcaugguuucaugcgguuuucaccccuggacgauuguuccguguauuaccacgggugccaucucaauggcaagagcacucacuaucauuguaugcagguuggaugcaacaaaguguacaccucuacauccgacgucaugacccacgagaauuuccacaagaaaaacacucaacugauaaacgauggcuuucagcgauucagagcaacggaagacugugggacagccgauugccaguuuuauggacagaagaccacucauuuccacugcaggcgcccagguuguaccuuuacauucaaaaauaagugcgacauugagaaacauaagaguuaccacaucaaggaugacgcuuacgccaaagauggcuuuaagaaauucuauaaguacgaagaguguaaauaugaagggugcguguacagcaaggcaaccaaccacuuucauuguauucgggcuggaugcggcuucacuuuuacaucuacgucccaaaugaccucacacaagagaaaacaugagaggcgccacauccgaaguagcggugcccuugggcugccgccuucguugcucggcgcgaaggacacugagcaugaagaguccucuaaugaugaccugguagauuucagcgccuuaucaaguaaaaacuccucucugagcgcuucccccacaucacagcagagcagugcaucucuagccgcugccaccgcagcgacagaagccggaccauccgcuacuaagcccccuaauagcaaaaucucgggccuccugccacaggggcuucccggaucaauuccuuuggcccuggcacucucuaacaguggccugccgaccccaacgcccuauuucccuauacuugcuggucggggguccaccagccugccaguuggaacacccucuuugcucggcgccgugagcuccgguucagcagccagugcuacuccugacaccccgacacuggucgcgagcggcgccggggacucugcacccguggcugccgccuccgucccagcuccucccgcaucaaucauggagcguauuagugccagcaagggauuaaucuccccaaugauggcgagacuggcugccgcagcccuaaagccuucugcuacuuuugaucccggcucggggcaacaggugaccccagcaagguucccgccugcccagguuaaacccgaaccaggagagagcacgggcgcgcccgguccucacgaggcuucacaggaccgcucccucgaucugacagugaaggaaccaaguaaugagucuaacgggcacgccguacccgcaaauagcucccuuuugucaucucugaugaacaaaaugagccaaggaaauccuggccucgguagucuguuaaacauaaaggccgaagcugagggcuccccggccgcagagccaagccccuuucuggggaaagcugucaaggcccuugugcaggaaaaguuggcggagccuuggaaaguuuaccuccggagauucggaaccaaggacuuuugugauggccagugcgacuuccugcauaaagcccacuuucauuguguggucgaagagugcggggcacuauucucuacucuggauggagcuauuaagcacgccaauuuucauuucaggacagaaggcggugcugcaaaagggaacaccgaggccgccuuucccgcuucagcggcagagacuaagccaccuauggcccccuccaguccaccugugccgcccguaaccacagcuacggugagcucgcucgaaggaccagccccuucucccgcauccguuccaagcaccccuacucugcuugccuggaaacaauuggcuucaacaaucccccagaugccgcagaucccagcgagugucccucaucugcccgccucuccauuagcaaccacaucccucgagaaugcuaagccccaggugaagccuggcuuccugcaauuucaggaaaaauga

SEQ ID NO: 53849 - RNA, 1584 nt, Artificial Sequence
  derived and/or modified sequence opt3 from CAT__Homo_sapiens__NP_001743
auggccgacagcagagaucccgcuuccgaccagaugcaacacuggaaggagcagagggcagcccagaaagcggaugugcugaccacaggcgcugggaacccugucggagacaagcucaauguuaucacuguggguccacggggcccgcuucugguacaggauguggucuucacggacgaaauggcccauuuugaucgcgagcguauucccgaacgagugguucacgcaaaaggggccggagcuuucggcuacuuugaggugacccaugacauaacaaaguauucuaaagcaaaggucuucgaacacaucgguaagaaaacuccuauugccgugagauuuucaaccguagcuggggagaguggaagcgccgauacaguuagggacccacggggcuucgcggugaaguuuuacaccgaggauggcaacugggacuuggucgggaauaacacucccaucuucuuuauucgcgauccuaucuuauucccauccuuuauacauucucagaaaagaaauccccaaacacaccugaaggacccugacauggugugggauuucuggucgcuaaggccagaaucacuccaccaggugagcuuucuguucagugaccggggaaucccggauggucaucgccacaugaacggcuaugggucccauaccuucaaacuugucaaugcaaacggagaggccguuuacugcaaguuucacuauaagacggaccagggcauuaaaaaucugucuguggaagaugcugcccgauugagccaagaggaccccgauuacgguaucagagaccucuucaacgcaauugcuacugggaaguauccuuccuggaccuuuuacauccagguaaugacauucaaucaggccgagacuuuuccauucaaccccuuugaucugaccaaaguguggccucacaaggacuacccacugauacccgucggaaaacucguguuaaauaggaacccgguuaauuauuucgcggaaguggagcagauugccuuugauccuucaaacaugcccccaggcaucgaagcaaguccugacaagaugcugcaaggccggcuuuucgcuuaccccgacacacaucgucaccgcuuggggccaaacuaucugcauauucccgucaauuguccuuacagagccaggguggcuaacuaucagcgggauggaccaaugugcaugcaggacaaucaagguggcgccccgaacuacuaucccaauagcuuuggggcaccugagcagcagccaucugcccuagaacacuccauccaguacucaggagagguacgacgcuucaacaccgcuaaugaugacaacguuacgcaagugagagcguuuuacgucaaugugcucaacgaggaacagaggaaacggcugugugagaauaucgcaggccaucuuaaggaugcccagauuuucauacagaagaaagcugucaagaacuucacugaagugcaccccgacuaugguagccacauccaagcccuguuggauaaauacaaugcagagaagccuaaaaacgccauucauacauuuguucagagugggucucaccucgcugcccgcgaaaaggcaaaucuguga

SEQ ID NO: 53850 - RNA, 2343 nt, Artificial Sequence
  derived and/or modified sequence opt3 from CATSPER1__Homo_sapiens__NP_444282
auggaccagaacagcgugcccgagaaggcccaaaaugaagcugauaccaacaaugcagacagauucuuuaggucccacucuucaccuccacaucaccggccgggccauagucgcgcccugcaccauuacgagcuccaccaccauggggucccccaccagcgaggagaaagccaucacccuccagaguuccaggauuuucacgaccaggcgcuuuccucucauguucaccaaucgcaucaccauucagaagcucguaaccacgguagagcccacggccccacaggguucggacuggcaccuagccagggcgccgugccaagucauagguccuauggugaggauuaccacgacgaguugcagcgggaugggcgcagacaucacgacggaucucaguauggcggcuuucaccaacagagcgauucccauuaccacagggggucacaucacggacggccccaguauuuaggugaaaaucugagucauuacagcucuggcguaccucaccacggggaggcuucccaucacggaggcucauaucuaccacaugguccgaaccccuacagcgaaaguuuccaccauucugaggcaucccaccucagcgggcugcagcacgacgagucgcaacaucaccaggugccucaucgcggauggccacaccaccaucagguccaccaucacggccgaucuagacaucacgaagcccaccaacauggcaaaaguccccaccauggggagacuaucucaccucacaguagcgugggauccuaccagagggguauuucugauuaucacagcgaauaccaucagggcgaccaccauccaucagaguaucaccauggggaucacccccaccauacgcagcaccauuaccaccaaacccaccggcaucgugacuaucaccagcaucaggaccaccauggagcuuaccacaguuccuaucuucacggcgauuacguucagagcacaucucaacugucaauaccgcauacuucccgcagcuugauccacgacgccccuggucccgcggcauccagaaccgggguguuuccauaccaugucgcccacccuaggggcucugcucauucgaugacacggagcuccucaaccauucgaagucgcgugacucagaugucuaagaaaguacacacacaggauaucagcaccaagcacuccgaagacuggggaaaagaggagggccaguuccaaaagagaaagacggggaggcuccagcggacucgcaaaaagggacauucaaccaaucuguuucaguggcugugggaaaaacucacauucuuaauucaggguuuuagagagaugaucaggaaccugacucaaagccuugccuucgaaaccuuuauauucuucguugugugcuugaauacagucaugcugguggcacagaccuuugcugagguggaaauccguggcgagugguauuucauggcccuagauucuaucuuuuucuguauuuacgucguugaggcgcuccugaagauuaucgcccuugggcuguccuacuuuuucgacuuuuggaacaauuuggauuucuuuauaauggcaauggcugugcucgacuuccuguuaaugcagacgcacaguuuugccauuuaucaucaaagccuguuccggauccucaaaguauuuaagucucuucgagcucugagagccauuaggguguugcgccggcuauccuuccugacuucaguccaggaagugacaggaacccucggccagagucugcccagcaucgcagccauccuuauucugauguucacuugcuuguuucucuucucggcuguucugagagcguuauuuaggaaguccgauccaaaacgcuuccagaacauauuuacaaccaucuucacgcuguuuacccuacucacacuggacgauuggucucuuauuuauauggacagccgagcacaaggugccugguacaucauacccauuuuggugaucuauaucauuauccaguacuucauuuuucugaaucucgucauaacugugcugguagacucauuccagaccgcucuuuuuaaggggcuggagaaagccaagcaggaacgggcagcccguauccaagagaaauugcucgaagauagucugacagaguuaagagcugccgagccuaaggaaguugcauccgagggcacuaugcugaaaaggcuaauugaaaagaaguucggaaccaugacagagaaacagcaggagcuccuguuucacuaccuucaguugguggcgucugucgaacaagagcagcagaaguuccgcagccaagcugccgugaucgacgaaaucgucgauaccacuuucgaggcaggcgaagaggacuuucggaacuga

SEQ ID NO: 53851 - RNA, 1587 nt, Artificial Sequence
  derived and/or modified sequence opt3 from CATSPER2__Homo_sapiens__NP_001269238
auggccgcuuaccagcaagaggaacagaugcagcugcccagagcagacgccaucaggagccggcucauugauaccuucucccuuauagagcaccuacagggcuugucucaagcggugccucgccauacaauccgagaauuacuggacccaucacgucagaagaaacugguccucggggaucagcaccagcugguuagauuuaguauuaagccgcaaaggaucgagcagauuagccaugcucagcggcuucugucccgcuugcacgugagaugcucucagaggcccccucucucgcugugggccggauggguacuggaauguccacucuucaaaaacuuuaucauauucuuaguguuucugaauacuaucauucuuauggucgagaucgaguugcuggaaucaacgaacaccaagcuauggccccucaaacugacacuugagguggcagccugguucauucuguugaucuuuauacucgaaauucuguuaaaguggcugagcaauuucaguguuuucuggaaguccgcuuggaacguguucgacuuugucgugacuaugcucucucuucugccugagguaguuguguuggucggugugaccggccaaagcguguggcuacagcugcuccggaucugccgcguccugcgaucccuuaaacuguuggcacaguucagacaaauucagaucaucauucucguucuggugagggccuuaaagucaaugacauuucugcuaaugcuccugcuuauauucuucuauaucuuugcuguaaccgggguguacgucuucagugaguauacucggagcccacgucaggauuuggaauaccauguguuuuucucugaccugcccaauucccucguuacaguguuuauucuguucacccuugaucacugguaugcccuguugcaggacgucuggaaagugccugagguaucacgcaucuuuagcaguauauacuucauucucuggcuguuacugggaucuaucaucuuuagauccauuaucguugcgaugauggugacgaacuuccaaaauauuaggaaggaacuaaacgaggaaauggcacggcgagagguccagcucaaagccgauauguuuaagcgccagauaauccagagaaggaagaauaugagccacgaggcucugacuucgucucauuccaaaauugaagaccggggcgccucacaacagcgcgagagucuugauuugagcgaaguguccgaggucgaaucuaacuauggugcaaccgaggaggaccugaucacaagcgcuucaaagacugaagagacccucaguaaaaagagagaauaccaguccagcucuugugugucaaguacaagcuccucuuacucgagcuccucagagaguagguucucugaaagcaucgggcgucuggauugggagaccuuaguucacgagaaucugccaggacuuauggaaauggaccaggacgaucggguguggccgcgagacuccuuguuuagauauuucgagcuccuggaaaaacuacaauacaaccuggaggagaggaagaaacuccaggaauuugccguacaggcgcugaugaaucuugaggauaaguga

SEQ ID NO: 53852 - RNA, 444 nt, Artificial Sequence
  derived and/or modified sequence opt3 from CAV1__Homo_sapiens__NP_001166366
auggccgacgagcugagcgaaaaacagguguacgaugcucacaccaaggagaucgaccucgucaacagagaucccaagcaucuuaaugacgauguugugaaaauugacuucgaagauguaauagcagagccugaaggcacacacuccuuugacgggaucuggaaggccucuuucacuacguuuaccgugacaaaauauugguucuacaggcuguugucagcguuauuugguauuccaauggcucugaucuggggaauuuauuucgccauccuaaguuuucuccauauaugggcagucgugccgugcaucaagagcuuccugauugagauccaauguauuucccggguuuacucuaucuaugugcacacugucugcgauccccuuuuugaggccgugggcaagauauucucgaacguacgcauuaaucugcagaaagaaaucuga

SEQ ID NO: 53853 - RNA, 489 nt, Artificial Sequence
  derived and/or modified sequence opt3 from CAV2__Homo_sapiens__NP_001224
augggccuggagaccgaaaaggccgacgugcaguuauucauggaugacgauagcuacucccaccauucugggcuugaguaugcugaccccgaaaaguuugcagauucagaccaagauagagacccucacaggcugaacagucauuugaaguuaggauucgaggaugucaucgccgaaccaguuacaacucacagcuuugacaaaguguggauuugcucccaugcgcuguucgagauaucuaaguacguaauguauaaauuucuaacgguguuccucgcuaucccgcuggccuuuauugcagguauccuuuucgccacccugucguguuugcacauuuggauccucaugcccuuugucaagacaugccugauggugcugccuucaguucagacuauauggaaaagcgugaccgaugucaucauugcuccacucuguacaagugugggccggugcuucuccucuguaagccuccagcugucccaggacuga

SEQ ID NO: 53854 - RNA, 456 nt, Artificial Sequence
  derived and/or modified sequence opt3 from CAV3__Homo_sapiens__NP_001225
augauggccgaggaacacaccgaccuggaggcucagaucgugaaggauauucauugcaaagaaauagaccucgucaacagagaucccaagaauaucaacgaggacauuguuaaaguggauuucgaagacguaaucgcagagccugugggcacauacagcuuugauggggucuggaagguguccuauacuacguucaccguuucuaaauacugguguuauaggcuucugucaacauuguuaggagugccacuggcccuacucugggguuuucuguucgcgugcauuaguuuuugucacaucugggcugucgugccgugcauaaagagcuaccuuaucgagauucaauguaucucccauauuuauucucugugcauccggacuuucuguaaucccuuguuugccgcacucggccagguaugcucgucaauaaagguugugcugcgcaaagaagucuga

SEQ ID NO: 53855 - RNA, 1788 nt, Artificial Sequence
  derived and/or modified sequence opt3 from CBFA2T2__Homo_sapiens__NP_001028171
auggugggcguccccggggccgcugcauuccagcugggaccugagaagagaguuccagccaugccggguagccccguggaaguaaaaauccaauccaggucuucaccuccaaccaugcccccucucccacccauuaacccuggcgggccacggccggugaguuuuacacccacugcgcuuagcaauggaauaaaccacuccccuccaacgcugaauggcgcucccucuccuccacagcgcuucucgaacggucccgccucaagcaccaguuccgcauugacaaaucagcaguuaccggccacuugcggggcucgacaacugucuaagcuaaaacguuuucucaccacacugcagcaguucggaaacgacaucagcccugagauuggcgaaaaggucagaacccuugugcuggcauugguuaauuccacugugacaaucgaggaauuucauuguaaacuccaggaggccaccaacuucccccugaggccauuugucauuccuuuccugaaggcuaaucuccccuuacugcaacgggagcuuuugcacugcgcccgcgcggcaaagcagacgccaucacaguaccuggcccagcaugaacaccuacuccugaacaccaguaucgcuagccccgccgauucuuccgagcuucugauggaagugcauggcaaugggaaaagaccuucaccagagaggcgggaggaaaacagcuuugaccgcgauacuauagcaccggagcccccugcuaagcgaguauguacaaucaguccagcccccagacacucuccugcguugacuguuccacucaugaaucccggaggucaauuccacccgaccccuccaccccugcagcauuauacauuagaagacauugccaccucccaccuguacagggagccuaacaaaaugcucgaacaucgggaggugcgugaucgccaccacagccuuggccugaaugggggauaucaggacgaguuggucgaucauagacuaacggaaagggagugggcagacgaauggaagcaccuggaucaugcucucaacugcaucauggagaugguggagaaaacucggcgaucgauggccgugcugcgcagaugucaagaaucugacagggaggaacuuaacuacuggaagcggcgcuauaaugagaacacagaacugagaaagaccggcacugaguuggucuccaggcagcacucacccgguagugcugauagccucuccaaugacucucagcgugaauuuaacagccggccagggacaggauacguuccuguggaguucuggaaaaagaccgaggaagccguaaauaaagugaagauucaggcaaugucagagguccaaaaagccguggcugaagcggagcagaaggcauuugagguuaucgccacggaacgagcuagaauggagcagaccauagccgaugugaaaaggcaggcagccgaagacgcuuuccuggucauuaacgagcaagaagagaguacagagaauugcuggaacuguggccgcaaggccuccgaaacuugcagcggcuguaauaucgcacgguauugcgggucuuucugucagcauaaggacugggagagacaccacagguuaugcggacagaaccugcauggucagucaccccacggccaagggcgcccacuacucccggugggacgaggcaguagcgcgcgguccgcugauugcucuguaccuucgcccgcccuggacaaaaccagcgcaacaacuucccguucaaguaccccagccucuguuacagcuauugauaccaauggucuuuga

SEQ ID NO: 53856 - RNA, 1962 nt, Artificial Sequence
  derived and/or modified sequence opt3 from CBFA2T3__Homo_sapiens__NP_005178
augcccgccagcagacugagggaccgggcugcauccucugccucaggcaguaccugcgggagcaugucccagacacacccugugcucgagucuggacuucuggcgucggcugguuguucagccccacgcggcccgcgaaaagggggacccgcaccugucgaucguaaagccaaggcuagcgcaaugccagacagucccgccgaaguuaaaacucaaccuagauccacgccacccucuaugccuccaccgcccccugcugccagccagggcgcgaccaggccacccuccuucacaccucauacucaccgggaggaugguccagcaaccuugccccaugggcgcuuucacggaugcuuaaaguggucaauggugugucugcuaaugaacggcaguagccauucuccgacagccaucaauggcgcuccuugcacccccaacggguucuccaauggaccagccacuucaagcacagcaagucucucuacccagcaccuuccucccgcuuguggugccagacagcuuuccaaacugaagagguuuuugacgacucuccaacaguucggcagcgacauuucgccagaaauaggggagcggguacgcacccuggugcugggacucgucaacucuacauuaacuaucgaagaguuucacuccaagcugcaggaggcgaccaauuucccccuucgaccuuuugugauuccauucuugaaagccaaccugccgcuacuccagagagaacugcuucauugcgcaaggcuggcuaagcaaacacccgcccaguacuuggcucagcacgagcagcuccuguuagaugccucagcaaguagcccuaucgacuccucugaacugcuccuugagguuaaugagaacggcaaacggcguaccccagaucgcacgaaggaaaaugguagcgacagagauccccugcauccugagcacuugucaaaaaggccauguacucuaaaccccgcccaacgguauaguccguccaaugggccuccacagcccacaccucccccacacuaccgacuggaagacauugcuauggcgcaucacuuucgcgaugcauauagacauccugaccccagggagcuccgggaacgccacagaccacugguggucccgggaagcaggcaggaggaggugaucgaucauaagcugaccgaacgugagugggccgaagaguggaagcaccugaacaauuugcucaacugcauaauggacaugguagaaaagacucggcgaucucugacaguuuuaagaaggugucaagaggcugaccgcgaggaacugaaucacugggcccggagauacucagaugcagaggacaccaagaaaggcccugcccccgcugccgcaaggccacgcaguagcuccgcgggccccgaagggccucagcuagaugugccacgagaguuccucccccggacgcugaccggauaugucccugaagacaucuggcguaaggcugaggaggccgugaacgaagugaaaagacaggcaaugucugagcuucagaaggccgucucggaugcugaaaggaaagcccaugaguugauuacaacugagcgcgcaaagauggaacgggcucuggccgaggcgaagagacaagccagcgaagacgcucucaccguuaucaaccagcaggaggauuccucagaaaguugcuggaauugugguaggaaagcaucugagacaugcagcggcugcaacgccgcucgauacuguggguccuuuugccagcaccgcgacugggagaagcaucaccacguguguggacaaucacugcagggcccgacugccguaguggcagauccaguccccgguccuccagaagcggcccauagccuugggcccucucugccugugggcgcugccuccccgagugaggcaggaagcgcuggccccucucggccaggguccccuucacccccaggaccuuuggacaccguucccagauga

SEQ ID NO: 53857 - RNA, 549 nt, Artificial Sequence
  derived and/or modified sequence opt3 from CBFB__Homo_sapiens__NP_001746
augcccagaguggucccugaccagaggagcaaguucgagaacgaagaguuuuuccggaaacugucccgcgaaugcgagaucaaguacaccggcuuucgagaucguccacacgaagagagacaagccagguuccagaaugcuugucgggacgggcgcucugagauugcauuuguugccacaggaacuaaccucucacuucaguucuuuccggcgaguuggcagggugaacaaagacagacgcccagcagggaguauguggaucuggaacgggaggcuggcaaaguauacuugaaggccccuaugauauuaaauggggugugcgucaucuggaaaggauggauugaccugcagcgccuagauggcauggguugucucgaguucgacgaggaacgagcacagcaagaagaugcccuggcucagcaggcauuugaggaagccagaaggcggacccgugaguucgaggaccgcgauagaucccauagggaagagauggaagugcggguuucucagcuucuggcugugacagggaagaagacuacccgaccauga

SEQ ID NO: 53858 - RNA, 2949 nt, Artificial Sequence
  derived and/or modified sequence opt3 from CBLB__Homo_sapiens__NP_733762
auggccaacuccaugaauggcagaaaccccgggggaagggguggcaauccucggaaggggcgcauccugggaauuauagacgcuauccaggaugcagugggcccaccgaaacaagccgcggcugaccgacguaccgucgagaagacauggaaacucauggauaagguugugagacuuugccagaaccccaaacugcaguugaagaacuccccuccauacauuuuagacauccugcccgauacuuaucagcaccuaaggcucauucugucuaaguacgacgauaaucaaaaacuugcccagcugucagaaaaugaguauuucaagaucuacauagacaguuugaugaaaaagagcaaacgggcaauccgccucuuuaaggaagguaaggagagaauguaugaagaacagucccaggauaggcggaaccugacgaaacugucucucauuuucucgcauauguuagccgagaucaaggcuauuuuuccuaaugggcaauuccagggagacaacuuucgcaucaccaaagcagaugccgcugaguucuggcgaaaguuuuucggcgacaaaacaauaguaccauggaagguguuuagacagugucugcacgagguccaucagauuucaagcggccuugaagccauggcguugaaaaguacuaucgaucugaccugcaaugacuacauuuccguguucgaguuugacaucuucacaaggcuauuucaacccugggggucuauccuccggaacuggaauuuccuggcaguuacccacccuggauauauggccuuccuuacuuacgaugaggugaaggcucgucugcagaaguacagcacaaaaccagguuccuauauuuuucgcuugucauguaccagacucggccagugggccauaggguacgucacgggagacggcaacauccugcaaacuauuccgcauaauaagcccuuauuccaggcacugaucgaugguaguagggaaggguuuuaucucuacccugacggacggagcuauaacccagaucuuaccggccugugcgagcccacaccucacgaccacauaaaagugacucaggaacaguacgaguuguauugugaaaugggcucuaccuuccaacuaugcaagauuugugcugagaacgauaaagacguaaagaucgagccaugcgggcaucugauguguacauccugccucaccgccuggcaggaaucagauggacaggguugucccuuuugccgaugcgagaucaagggcacggaaccgauuaucguugacccuuucgauccccgcgacgaggggagcagauguugcaguauuauagacccauuuggaaugccuaugcuggaucuugacgaugacgaugacagggaagagucucugaugaugaaucgguuggcgaacgugcgcaaauguacugauagacaaaauucccccgucacaagcccaggcucgucuccccucgcccagaggcguaagccucagccagacccgcugcagaucccccacuuaucccugccuccagugcccccucggcuagaucucauucagaaagguaucgugcgaucaccaugcgggagucccaccggcagcccgaaguccucuccuuguauggucagaaaacaagacaagccacugcccgcaccucccccaccucuuagggaucccccaccgccucccccagagcggcccccuccaauucccccugacaaccgcuugagcagacauauccaccacguugaaucagugccgaguagggauccacccaugccucuggaggcuuggugcccacgcgacguauucggaacuaaucagcucgugggcugucgacugcuuggggaaggaucccccaagccugguauaacagccagcucuaacgucaauggccggcauucacguguggggagugacccgguucugaugagaaaacacaggcgccaugauuugccccucgagggagcuaagguguuuagcaacggccaccuggguuccgaagaguacgacgucccaccucgguuaucucccccaccucccgugaccacgcugcuaccaucgaucaaaugcaccgggccgcucgccaauagccuguccgagaagacaagagauccuguagaagaggacgaugacgaauacaaaauucccucaagucauccaguuucucuuaacagccagcccucccacugucacaaugugaagccuccagucaggucaugcgauaacggccauuguauguugaauggaacucacggccccagcucugagaagaaauccaacaucccugaccugaguauuuaucucaagggggauguguucgacagcgcaucugauccggucccacugcccccugcccgacccccaacccgcgacaauccuaaacauggauccucauuaaaccggacacccagugauuacgaccugcuuaucccaccuuugggugaggacgcuuuugaugcgcucccgcccagccugccaccucccccaccucccgcaagacacucgcuaauagaacacuccaagccgccaggcucuagcucaaggccuaguuccgggcaggaccuguuccuccugcccucugauccauuuguggaccuugccagcggacaaguucccuugccuccggcucgucgccugcccggcgagaacgugaaaacuaaucggaccucccaggauuaugaccaguuaccaucaugcagcgaugguagucaagccccugcaagacccccuaagccaaggccccgacggacagccccugaaauccaucaccgcaaaccacaugggcccgaggcugcccucgaaaacguagacgcaaagauugcgaagcugaugggcgagggauacgcuuucgaggaagucaaaagagcccuugagaucgcacagaauaacguggaaguugccaggucuauucugcgggaguucgcuuuuccgccuccagugagcccccgauugaaucucuga

SEQ ID NO: 53859 - RNA, 2721 nt, Artificial Sequence
  derived and/or modified sequence opt3 from CBL__Homo_sapiens__NP_005179
auggccggcaacgugaagaaaagcuccggggcuggagguggcucugggucaggaggcagugguagcgggggacugaucggccucaugaaggacgcauuccagccccaccaucaccaucaccaucaccuuuccccucacccaccgggcaccgucgauaaaaagaugguugagaaaugcuggaagcugauggacaaggugguaagauugugucaaaaucccaaauuagcccugaagaacucuccuccauacauucuagaucuccugcccgacacauaucagcaucuuaggacuauacugucgcgguacgaagggaaaauggagacguugggagaaaaugaguauuuucgcguguucauggaaaaccucaugaagaaaaccaagcagacaaucucacuguuuaaggaggguaaagagcgaauguacgaagagaauagccagccucguagaaaccugacuaagcucaguuuaauuuucucccacaugcuggcggaacuuaaaggcaucuuuccaucuggguuguuccaaggagauaccuuuaggauuacaaaggcugacgccgcagaguucuggcggaaagccuuuggcgagaagaccaucguccccuggaaaucauuccgccaggcucugcaugaagugcacccuauauccucaggucuagaggcaauggcccucaagaguacuaucgaucugacaugcaaugacuauauuagcguuuuugaguucgauaucuuuaccagacuuuuccagccauggucuucccuguugaggaacuggaauagccucgcugugacgcacccgggguacauggccuuccugacuuaugacgaagucaaggcgcgguuacagaaauuuauucauaagcccggaagcuacaucuuccgccugaguuguacccgacucggccaaugggcaauaggcuacgugacagccgaugggaacauucuucagacuaucccucacaauaaaccacuguuucaggcuuugauugacggauucagagaagguuuuuaucuauuccccgauggcaggaaccagaauccugaccugaccgggcucugcgagccaacaccccaagaccauaucaagguaacccaggagcaguacgaacuguauugugagaugggaucuacguuucaacuuugcaaaaucugugccgaaaacgauaaggacguuaagauugagccgugcggccaccugauguguacuuccugcuugacaagcuggcaggaaucggagggucagggguguccuuucugccggugcgagauaaaaggcaccgaacccaucguggucgauccauuugacccucguggaucuggcucccuccugcgccagggggcagagggagcucccucaccaaauuacgaugacgaugacgaugaaagagccgacgauacuuuauucaugaugaaggagcuggcgggugccaaaguggaaaggcccccuaguccauuuagcauggcaccgcaagcuagccuacccccugugccaccccggcucgaccugcuuccucagcgagucuguguuccaucuagcgccucagcuuugggcacagccaguaaggcagccuccgggagccugcauaaagacaagccccucccggugccuccaacccugcgcgaucuucccccucccccaccucccgacagaccauauucuguaggagcugagucaaggccgcagcggcgcccucugcccugcacgccaggcgauugucccaguagagacaaguugccuccagugcccagcuccaggcucggugauucuuggcugccucguccgauuccaaaaguccccgugucggcgccuagcuccucagacccauggaccgggcgggaguuaacaaaccgacacagucugcccuucucucuaccuagccagauggaaccgagacccgauguuccaaggcucggcuccacuuuuucacuggacaccagcaugucuaugaacuccaguccucuugugggacccgagugcgaucacccaaagaucaaaccuuccucuuccgcaaaugccauauacucauuggcugcccgcccccugccagucccgaagcucccucccggcgaacaaugugagggggaggaagacacagaguauaugacuccaaguagccggccccugagaccuuuagauaccucgcaguccucuagggcaugcgacugugaucagcagauugacagcugcacauacgaagccauguacaacauccaaucacaggcuccaaguaucaccgaguccucuacuuucggagaagguaaucuggccgcagcgcaugcuaacacgggccccgaggagagcgaaaaugaggacgauggguaugacgugccuaaaccgccaguacccgccguucuugcacgccgaacauuguccgauauuucaaacgccagcaguucuuucggauggcucucccuggacggcgauccuaccacuaaugugaccgaagguagccagguccccgagcggccaccuaagcccuuuccacguagaaucaacucggaaaggaaggcugggucaugucagcaaggcucuggaccugccgcaagugcugccacagcguccccgcagcuaagcucugagauugagaaucugaugagccagggcuacuccuaucaagacauacagaaagcccucgugaucgcucagaacaauauugaaauggcaaagaacauccugcgcgaguucgucucaaucaguagccccgcccacguggcuaccuga

SEQ ID NO: 53860 - RNA, 1473 nt, Artificial Sequence
  derived and/or modified sequence opt3 from CBLL1__Homo_sapiens__NP_001271220
auggaccacaccgauaacgagcugcagggcacaaauagcuccgggucucucggaggucuugacgugagaaggcggauccccauuaagcugauaucaaaacaagccaacaaggcuaaaccugcaccacgcacucagcgaacgaucaaucguaugccggccaaggcgcccccuggcgaugaaggguucgacuacaacgaggaagagagauaugauugcaaaggaggcgaauuguuugcuaaucagaggcgguucccaggucauuuauuuugggacuuccagauuaacauccugggggagaaggaugacacccccguccacuuuugugauaagugcggacuaccuauuaaaaucuacggccgcaugauaccauguaagcauguuuucugcuaugacugugccauccuccacgagaaaaagggcgauaaaaugugccccggguguagugacccugugcaaagaauugaacagugcacaaggggaagccuguuuauguguuccaucguacaggguugcaagcggacuuaccuuucucagcgcgaucugcaagcacauauuaaucaccgacacaugagagccggcaagccagugaccagggcuucguuggagaacguccauccgcccaucgcaccuccacccacagaaauaccugagcgguucauuaugccacccgacaaacaccauaugucacacaucccgccuaagcagcacauuaugaugcccccaccuccccuccagcaugugccacacgagcauuauaaucagccccacgaagacauccgugccccuccagcugagcugagcauggccccgcccccuccacgcaguguuucccaagaaaccuuuagaaucucuacuaggaaacauagcaaccugauuacagugcccauacaggaugacuccaauucaggggcgcgggagccuccacccccggccccugccccagcucaccaccaucccgaauaccagggacaaccugucgugagucacccccaucacaucaugccaccucagcagcacuaugcacccccaccgccucccccacccccuauuagccauccaaugccccacccuccgcaggcagcuggcaccccacaucucguauacucucaagcgcccccuccacccaugacguccgccccuccgcccaucacuccaccucccggucacauaauugcccagaugccaccuuacaugaaccaucccccaccggggccucccccaccccagcacggaggcccuccaguuaccgcacccccuccgcaccauuauaauccaaacucauuaccccaguucacagaggaucaaggcacucugagcccucccuuuacccagccagggggaaugaguccugguaucuggcccgcuccacgaggcccuccgcccccaccucgccuucaggggcccccaucucagacaccuuugcccggaccgcaccauccagaccaaaccagauacaggccuuauuaccaguga

SEQ ID NO: 53861 - RNA, 582 nt, Artificial Sequence
  derived and/or modified sequence opt3 from CBLN1__Homo_sapiens__NP_004343
augcugggcgugcucgagcuucuguuguuaggggccgcuuggcuggcaggacccgccagaggucagaacgaaaccgagccuaucguccuagaaggcaagugccucguugugugugacagcaauccaacauccgauccgacugggacggcgcugggaauuucuguaaggucaggcagugcuaaaguggccuucagcgcaauacgguccaccaaccacgagcccucugaaaugucgaaucgcacaaugaucauuuacuuugaccaaguccuugugaacaucgguaauaacuucgauucagagcgaagcacuuuuauugccccucguaaggggaucuauaguuucaauuuucauguugugaaagucuacaacagacagaccauacaggugucccugauguugaauggauggccaguaaucucugcuuucgcaggcgaccaggauguuacaagggaggccgcuagcaacggcgugcucauucaaauggaaaagggggaccgggccuaucugaaacuggagcgcggaaaucucauggguggcuggaaguacuccaccuuuucaggguucuuagucuuuccccuguga

SEQ ID NO: 53862 - RNA, 675 nt, Artificial Sequence
  derived and/or modified sequence opt3 from CBLN2__Homo_sapiens__XP_011524128
augcaggcccccggcagagggccucugggacucaggcuuaugaugccaggucggcgcggcgcucugcgagagcccgggggaugcggcagcuguuuggguguggcauuagcccugcuacuccugcuucugccggcgugcuguccuguccgugcucaaaacgacaccgaaccaaucguuuuggaggggaagugccucgugguaugugauuccucucccucagccgacggagcagugacaaguagccugggcauuuccgucagaucuggcucggccaaaguggcuuucucagcaacuaggagcacgaaucacgaaccuagugagauguccaaccggaccaugacaauauacuuugaucagguucuggugaauaucgggaaccauuucgaccucgccucuagcauuuuugucgcuccacgcaagggaaucuauuccuucucauuucacgugguaaaaguuuacaauagacagacuauucaggugaguuuaaugcaaaacgguuaucccgucaucagcgccuucgcgggcgaucaggacgugaccagggaagcagccucuaauggggugcugcuuuugauggagcgggaggauaagguccaucugaaacuagaacgcggaaaccucaugggcgguuggaaguacuccacauuuucaggguuccugguuuuuccucuuuga

SEQ ID NO: 53863 - RNA, 606 nt, Artificial Sequence
  derived and/or modified sequence opt3 from CBLN4__Homo_sapiens__NP_542184
augggcagcgggagaagggcccuguccgcugugcccgcaguccuccuuguucugaccuugccuggauuaccagugugggcccagaacgacacagagccgaucguacuggaagguaagugccuaguggucugugauucuaaucccgcgacugacucaaaaggcaguagcuccucuccucucgggauuucggugcgggcugccaacucaaagguugcauucagcgccgugcgcaguacgaaucacgagccauccgaaaugucuaacaaaacccgaauaaucuacuuugaucaaauucuggucaaugugggaaacuucuuuacacuugagagcguauucguugcuccccguaagggcaucuauuccuuuucauuccaugugauuaaagucuaccagagucagacuauccaggugaaucugauguugaacgguaagccugugauaagcgcauuugccggggacaaggaugucaccagagaagcugccacaaauggaguucuccuguaucuggacaaagaggauaagguguaccucaaauuagagaagggcaaccugguaggcggguggcaauauucuaccuucuccggauuucuuguguucccauuguga

SEQ ID NO: 53864 - RNA, 834 nt, Artificial Sequence
  derived and/or modified sequence opt3 from CBR1__Homo_sapiens__NP_001748
augagcuccggcauccacguggcccuggucaccgggggaaacaaggguauuggccucgcuauaguuagagaccuuugcaggcuguucucuggggaugugguauugacagcacgggacgugacucgcggacaggccgcgguccaacaguuacaggcugagggccugucaccccgauuucaucagcuagauaucgacgaucuccaaaguauucgugcccugagagacuuccuuaggaaagaauacggugggcuggauguguugguuaauaacgcaggaaucgccuuuaagguggcugacccuacgccauuccacauucaggcagaggucaccaugaaaacaaacuuuuucggcacucgggauguguguaccgaacuccugccgcugaucaagccccagggccgcguaguuaaugugagcuccauaaugucugucagagcccucaaaucgugcucaccugaguuacagcaaaaguuuaggagcgaaacaaucaccgaggaggaacugguggggcuuaugaauaaguucguggaggacacuaaaaagggaguccaucagaaagaagguuggccaaguuccgcuuauggcguuacaaagauuggggugaccguauugucucggauccacgcccgcaaacugagcgagcagcgaaagggagauaagauucuacucaacgcguguugccccggcugggugagaacggacauggcagguccuaaagccacuaaguccccagaggaaggggcugagacccccgucuaccuggcccuucugccuccagaugcagaaggaccgcauggccaguuugugucagagaaaaggguugaacaaugguga

SEQ ID NO: 53865 - RNA, 834 nt, Artificial Sequence
  derived and/or modified sequence opt3 from CBR3__Homo_sapiens__NP_001227
augagcuccugcucuagaguggcccuggucaccggcgcuaacagggggaucggacucgcaauugcccgggagcuuugucgccaguucucaggugacguugugcugacagcgcgagauguagcucguggccaagccgcagugcagcaguugcaggccgaaggguuaagucccagauuucaccaacuggacauagaugaccuacagagcaucagggcucuccgggauuuccugcgcaaggaguacggaggccuuaauguccuggugaacaaugcagccguugcuuuuaaauccgacgauccuaugccauucgacauuaaggccgaaaugacuuugaaaacgaacuuuuucgcgaccagaaauaugugcaacgagcuccugccgaucaugaagccccaugguaggguggucaauauuucuucgcugcagugucuccgggcauuugaaaacugcucagaggauuuacaggagcgcuuccacagcgaaacacugacugagggggaccuuguggauuugaugaaaaaguuuguagaagacaccaagaaugagguucaugagcgagaaggauggccuaacaguccauauggcguguccaaacugggcgucacagugcuaucuagaauccucgccaggcggcuggaugagaagcguaaagcugaccgcauacuugugaaugccuguugccccgggccugucaagaccgacauggauggaaaagacagcaucagaacuguugaagagggugcagaaacaccaguguaccuggcuuugcugcccccugaugccaccgagccacaaggccagcucguacacgacaaggugguccagaacugguga

SEQ ID NO: 53866 - RNA, 714 nt, Artificial Sequence
  derived and/or modified sequence opt3 from CBR4__Homo_sapiens__NP_116172
auggacaaggugugcgccgucuucggcgggagcagaggaaucgguagggcuguugcacagcugauggcccggaaaggcuaccgccucgcggugauugcucgaaaccuugagggggccaaggcagccgcuggagaucugggcggugaccacuuggcauuuuccugugauguagccaaagaacaugacgugcaaaauaccuucgaggaauuagagaagcaccuggggcgugucaacuuucuagugaaugcugccggaauaaacagagauggccuccugguuaggacaaaaacugaagacauggugucucagcuucauacgaaucuguugggcucaaugcugaccugcaaggcggcaaugcggacaaugauccagcagcaagggggaaguauugucaacguggguagcaucguaggccucaagggaaauuccgggcagucuguuuauucggccucaaaaggcggucuggugggguucagccgcgcucucgccaaggaggucgcaaggaaaaagauuagagugaacguggucgcucccggauuuguucacacugauaugaccaaagacuuaaaggaggaacaucugaagaaaaauaucccucuuggccgguucggcgagacaauagaaguggcccacgcgguaguguuuuugcuggagaguccauacaucaccgggcacguccuagugguugauggaggucuccagcugauucuuuga

SEQ ID NO: 53867 - RNA, 1698 nt, Artificial Sequence
  derived and/or modified sequence opt3 from CBS__Homo_sapiens__XP_011528084
augcccagcgagaccccucaggccgaagugggcccaacagggugcccgcacagauccggaccccauucugcuaaggguucacuggagaaaggcaguccugaagacaaggaggcaaaagaaccacucuggaucaggcccgaugccccuagccgguguacuuggcaacuugggcgcccagcguccgagucuccccaccaucacacggcuccugccaagucgccaaaaauucugccggacauauugaagaagaucggagauacccccaugguccgaauuaacaaaaucggcaagaaauucgguuuaaagugcgagcugcuagcaaaaugugaauuuuucaaugccgggggaucaguuaaggaccguauuagccucagaaugaucgaggaugcugaaagggacggcacacugaagccuggcgauacuauaaucgagccaaccagugggaacacaggaauuggucuugcacuggccgcugccgugcggggcuaccgcugcaucauuguaaugcccgagaaaauguccucugaaaagguggacgucuugagagcgcucggggcagagaucgugaggaccccuacuaaugcccgguuugauagcccagaaucccauguuggaguggcuuggcgccugaaaaacgagauacccaauucacacauucuggaccaguaucgaaacgccaguaauccgcucgcacacuacgauacaaccgcugacgaaaucuuacagcagugugauggcaagcuggacaugcuugucgccagcguggguacugggggaacgauuaccggcaucgcgagaaaauugaaggagaaaugcccuggcuguaggaucauugggguagaccccgagggaucuauacuggccgaaccagaggaacuaaaccaaacagagcagacuaccuaugaaguugaggguaucggcuacgauuucauuccuacagugcucgaccggaccgucguggauaagugguuuaaguccaaugacgaggaagcauucacguuugcucguaugcugaucgcccaggaggggcuucugugcggaggcucagcugguagcacuguggccgucgcaguuaaagccgcucaggaauugcaagaggggcagcgcugugugguaauacuccccgauagugugagaaacuauaugacaaaguuccugucugacagguggauguuacagaaaggcuuucugaaggaagaggaucucaccgagaaaaagccauggugguggcaucuucggguccaggaacugggauuguccgcgccccuaacugugcugccuacaauuaccugcggccacacgaucgagauccuccgagaaaagggguucgaccaagcaccaguuguggaugaggccggagucauucuggguauggugacccuuggcaauaugcugagcucguugcucgcugggaaaguacagccgucugaccagguuggaaaggugaucuacaaacaauuuaagcagauucgccugacagauacuuuaggcagacugucccauauacuagagauggaccacuucgcccucgucgugcacgaacagauccagucacaagaccaggcaugggccggugucguugggggccccgcugaucauaguaccggaaaaagcucccagaggcagaugguguuuggcgugguaacagccauugaccugcuuaacuucgucgcagcgcaagagcgggaucagaaguga

SEQ ID NO: 53868 - RNA, 558 nt, Artificial Sequence
  derived and/or modified sequence opt3 from CBX1__Homo_sapiens__NP_006798
augggcaagaaacagaacaagaaaaagguggaggaaguccuggaggaagaggaagaggaguacguuguggaaaaaguacucgacagaaggguggucaaggggaagguggaguaucuucugaaauggaagggauucagcgaugaagacaauaccugggagcccgaggaaaacuuggauugcccugacuuaaucgccgaguuucugcaaucccagaaaacagcucacgaaacugauaagucugaggguggcaaacggaaggcagacucagauagugaagacaagggggaggagagcaaaccaaagaaaaagaaagaagaguccgaaaagccgcgcggauucgcccgaggccuagagcccgaacguauuauaggugcgacggauucuucgggggagcucauguuucugaugaaauggaaaaauucagacgaggcugaucuuguuccugccaaggaagcaaacgugaaguguccacaggucgugaucagcuucuacgaggaaagacugaccuggcauaguuaucccuccgaggacgaugacaagaaagacgauaagaauuga

SEQ ID NO: 53869 - RNA, 1599 nt, Artificial Sequence
  derived and/or modified sequence opt3 from CBX2__Homo_sapiens__NP_005180
auggaggaacugagcuccgugggugagcaggucuucgccgcugaaugcauccucucuaagagacuuaggaaagggaagcuggaguacuugguuaaauggcggggauggucaaguaagcacaacagcugggaacccgaggagaauauuuuagacccucgccugcuacucgcauuucaaaagaaggaacaugagaaggaagugcagaaccgaaaacgugguaagagaccaaggggccggccgcgcaaacugaccgccauguccucuuguucgagaaggucaaaacuuaaagagcccgaugcgccuagcaagaguaaguccucuagcuccucaaguagcucuacauccucaagcaguucuuccgacgaggaagaugacagcgaucuggacgcuaaacgggggccacgcggacgagagacucaccccguaccucagaagaaagcccagauauugguggcaaagccagaacucaaagaucccaucagaaagaaaaggggccggaagccucugccaccggagcaaaaggccacgcgucgccccgucucgcuggcuaaagugcucaagaccgcaagaaaagacuuaggugccccugcuucuaagcugccacccccucuuuccgccccaguugcgggguuggcagcccugaaagcucaugccaaggaagcaugcggaggccccucagcuauggccacaccggagaaucuagcgagucucaugaagggcauggccagcuccccugggaggggagguauuucuuggcagagcucaaucgugcacuauaugaaccggaugacucagagucaggcacaagcugccucccgacuggcucuuaaagcccaggcaaccaauaaguguggccugggguuggaucucaaaguccgcacacagaagggagagcugggcaugucucccccagguucuaaaauuccuaaggcccccucagggggagcuguggaacagaagguaggcaacaccggcgggccaccccauacucacggagcgaguagaguuccugcagguugcccaggcccgcaacccgccccuacacaggaguuaagccuccaggugcuggaccuucaauccgucaaaaaugggaugccaggagugggccuguuggcuaggcacgccaccgcaacgaagggugugcccgccacuaacccugcuccagggaaaggcaccggaucuggccuaaucggggccucgggagcaacaaugcccacugauaccagcaaguccgaaaaacuggcgucacgggcugucgccccgccuacaccagcaaguaagcgcgacuguguuaaggguucugccacccccagcggccaggaguccagaacggcuccuggggaagccaggaaagcagcuacucuccccgagaugucagccggagaggaaagcagcuccagugauagcgacccagacucugcguccccucccucaacaggccagaauccaagugugagcguacagaccucgcaagauuggaagccgacucguucccugauagagcauguguucgucacagacgugaccgccaaccuuaucacgguuaccgugaaagaaucuccuacaagcgucggcuuuuucaaucugcggcacuacuga

SEQ ID NO: 53870 - RNA, 552 nt, Artificial Sequence
  derived and/or modified sequence opt3 from CBX3__Homo_sapiens__NP_009207
auggccagcaacaagaccacacugcagaaaaugggcaagaaacaaaaugggaaguccaaaaagguggaggaagcugagcccgaagaguucgucguugaaaaggugcucgacagaaggguagugaacggaaaagucgaguacuuucuuaaguggaaagguuucacugaugcagacaauacgugggagccugaagagaaccuggauugcccagaauugaucgaggccuuuuuaaauucucagaaggcgggcaaagagaaggacgggaccaagcggaaaucacugagugauagcgaauccgacgauucuaagucgaaaaagaaacgcgacgcugccgauaagccgcgaggauucgcacguggccuagaccccgagagaauuauaggugccacagauucaagcggggaacucauguuucugaugaaauggaaggacagugaugaggcugaccuugugcuggcaaaggaagccaacaugaaauguccucagaucguuauugcuuucuaugaggagagguugacuuggcacuccugcccagaagacgaggcccaguga

SEQ ID NO: 53871 - RNA, 1683 nt, Artificial Sequence
  derived and/or modified sequence opt3 from CBX4__Homo_sapiens__NP_003646
auggagcugcccgccgugggcgaacacgucuucgcuguugagagcaucgaaaagaaaagaauuaggaaggggcggguggaguaccucguaaaauggcgcggaugguccccuaaguauaacaccugggaaccagaggagaauauacuugacccgcgacuguugaucgcauuucagaaccgugaaagacaagagcaguuaauggguuacaggaaacggggccccaagccuaagccacuggugguccaggugcccacauucgcccgcagaucuaauguucuaacugggcuccaggauucaaguacggacaacagggcgaaacuggaucuuggagcucaaggcaagggucaggggcaucaguaugaacugaauagcaaaaagcaccaucaguaccaaccucacuccaaagagcgggccggaaagccacccccuccaggcaagucuggcaaauauuacuaucaguugaacucgaagaaacaucacccguaccagcccgacccuaagauguacgaucuccaguaucaagggggacacaaagaggcaccaucaccuaccugccccgaccugggugccaagagccauccacccgauaaaugggcucagggcgcaggggccaagggauaccugggcgcugugaagccgcucgccggugcggcaggggccccuggaaaaggcagugaaaaggggcccccaaauggcaugaugccugcucccaaagaggccgucacaggaaacgguauuggcgggaagaugaaaaucgugaagaauaagaacaaaaauggacgcauuguaaucguuauguccaaguauauggaaaacggcaugcaggcagugaaaauaaagucuggugaggucgcugaaggggaggcccgaagcccaucccacaaaaagagagcggccgacgagaggcaucccccugcagaucggacuuuuaagaaagcugccggcgcugaagagaagaaaguggaagccccaccgaagcgucgcgaggaagaggugucaggagucagugacccccaaccucaggaugcaggcagcagaaaauuaucuccaaccaaggaggccuucggggaacagccccugcagcuuacaaccaagccugacuugcuggcuugggauccagcgaggaauacucaucccccgucccaccacccucacccacauccccaccaucaccaccaucaccaucaccaccaucaccaugcaguuggacuaaaccucucacacgugcggaaacgaugucugagcgagacacauggugaacgcgagccuugcaagaaaagacuuaccgccaggaguaucucuacgcccacuugucugggcggguccccagcugccgaacggccugcagacuugcccccagccgcugcccucccgcaaccugagguaauucuguuagacagcgaucuggacgagcccaucgaucuccgcugcgugaagaccagaucggaagcaggagagccacccucuucccuucaggucaaaccugaaacaccagcgucagcugccguggcaguugccgcugccgcagcucccacuaccacagccgagaagccuccggcggaggcccaggacgaaccagcugagagucugagcgaauuuaaacccuucuuuggcaauauuaucauaaccgaugugacggcaaacuguuugacugucacauucaaggaguacgugaccguauga

SEQ ID NO: 53872 - RNA, 576 nt, Artificial Sequence
  derived and/or modified sequence opt3 from CBX5__Homo_sapiens__NP_001120793
augggcaagaaaaccaagagaacagccgacagcuccucuucagaggaugaagaggaauacguggucgagaaaguucuggacaggcgggugguaaagggacagguggaauaucuccuuaaauggaagggguucagugaggagcacaacacuugggaacccgagaagaaucuggauugcccugaauugaucagcgaguuuaugaaaaaguacaaaaagaugaaagagggugaaaacaauaagccacgcgagaaguccgaaucuaacaaacgaaagucgaauuucucaaacagcgcugacgauauuaaaaguaagaaaaagcgugagcaauccaaugacauagcaagaggcuuugaaaggggguuagagccggagaaaaucauuggagccacggauucuuguggcgaccugauguuccuaaugaaguggaaggauaccgacgaagcggaucucguccuggcuaaagaggccaacgugaagugcccccagaucguuauugcauuuuaugaggaacggcuuacauggcaugccuacccugaagacgcugagaauaaagagaaggaaacugcaaaaagcuga

SEQ ID NO: 53873 - RNA, 1185 nt, Artificial Sequence
  derived and/or modified sequence opt3 from CBX6__Homo_sapiens__NP_001290423
auggagcugagcgccgugggcgaaagagucuucgcugcagaguccaucauuaagaggcggauacgcaaagggcgaaucgaauaccucguuaaguggaaaggaugggccauuaaguauucuaccugggagcccgaagagaacauccuugacucacgucugauugcggcuuuugagcagaaagaaagagagagggaauuguacgguccuaagaagcggggcccaaaaccgaagacauucuuacugaaacccagugccagcgcauccucuccuaagcuacacucgucagccgcugugcaucgccucaaaaaggauaucagaaggugccaccggaugagccgccgaccacugcccagaccugacccacaagggggaagucccggccuuaggccuccaauauccccguuuucugagacuguacggaucauuaaucguaaggugaaaccccgcgagccuaagagaaacaggaucauucugaauuugaaagucaucgauaagggugcagggggaggcggcgccgggcagggagcuggugcccucgcgcggccaaaagugcccagccgaaaccgcguuauaggcaaguccaaaaaguucucagaaagugugcugagaacgcagauuaggcauaugaaguuuggggcauucgcccuguauaaaccuccacccgcuccgcucgucgccccuagccccggaaaggcagaggcuucugccccaggcccugguuuacugcuugcggcccccgcagcuccauacgacgcccgguccucagggagcaguggaugucccucuccuaccccacaguccagcgauccggacgauacacccccuaaauugcugccagaaacugugucgcccucugcuccuuccuggcgcgagccagaaguacuagaccucucacugcccccggagagugccgcaaccagcaagagagccccuccagagguuacagcugcggcaggccccgccccucccaccgcuccagaaccugccggcgcauccucugagcccgaagccggggauuggaggccagagaugagcccgugcucaaauguggucgugacugacgugacaaguaaccuucugaccgucacgaucaaagaauuuuguaauccugaggauuucgagaagguugcugccggaguggcgggugcagcuggcgggggaggcuccauuggugccagcaaguga

SEQ ID NO: 53874 - RNA, 756 nt, Artificial Sequence
  derived and/or modified sequence opt3 from CBX7__Homo_sapiens__NP_783640
auggagcugagcgccaucggcgaacagguguucgcugucgaguccauuagaaagaaaaggguucggaaggggaaaguggaauaccucguaaaguggaaaggauggcccccuaaguauucuaccugggagccagaggaacacauacuugacccgcgccuggugauggcauacgaggaaaaggaggaacgagaucgugccucagguuauagaaaaaggggccccaagccuaaacgguuguuacugcaacgccuauacaguauggaccucagaagcucccauaaggcgaaagggaaggagaagcugugcuuuucucuuacauguccacugggaucgggcucacccgagggugucgugaaagcuggggccccugaauugguugauaagggaccacucgugcccacucugccuuucccacugaggaaaccgcggaaggcacacaaauaucuccgcuuaagccgaaagaaauuucccccuagaggcccaaaccuggagagucauucccacaggcgggaacuuuucuugcaggagcccccugccccagacguccugcaggcugcaggcgaaugggagcccgccgcucagccgccugaggaagaggccgaugcggaccuagcagaagggcccccaccuuggacgcccgcccucccaucuagcgaggugaccguaacagauaucacugcuaauuccauuaccguuacauuucgugaagcccaagcagcugagggauucuuucgcgacagaucagguaaguucuga

SEQ ID NO: 53875 - RNA, 1170 nt, Artificial Sequence
  derived and/or modified sequence opt3 from CBX8__Homo_sapiens__NP_065700
auggagcugagcgccgugggcgaaagagucuucgcugcagaggcccuccuuaagaggcggauccgcaaagggcgaauggaauaccugguuaaguggaaaggauggucccagaaguauucuaccugggagcccgaagagaacauuuuggacgcgcguuuacuggcugccuuugaggaaagagagagggaaauggagcuauacgguccuaaaaagcggggcccaaagccgaaaacauuccuccugaaggcacaagccaaagcuaaggcaaaaacuuaugaguuucgcucagauagugccagagggauaaggauccccuacccuggacggagcccacaggaccuugcuuccacgucucgcgcccgagaaggccugagaaauauggguuugucgcccccugcgucaagcaccaguacauccucuacuugcagggcagaggccccacgggaucgugaccgcgauagagacagggaucgggaacgagaccgcgagagagaaagggagcgggagcgcgaaagagagagggaacgugagcgggaacgagggaccagcagaguggaugacaagcccuccucaccuggagauaguagcaagaaaaggggcccaaagccgcgcaaagagcuccccgacccuucucagcggccacugggcgagcccuccgcugggcugggagaauaucucaaggguagaaaauuagaugacacaccuucaggcgccgggaaguucccagcaggacacagcguaauucagcuggcuaggcgccaagacagugaucuugugcaguguggcgucaccucucccuccagcgccgaggcgacugguaaauuggccguggacacauuuccggcacgaguuaucaagcaucgggcugccuuccuggaagcuaaggggcagggagcccuagauccuaacggcacccgugugagacacggcucggggcccccaucuuccggagguggccucuacagggacaugggggcacagggaggccgcccuucacugauugcccggauccccgucgcuagaauacuuggugauccagaggaagagaguuggagccccucccugacgaauuuggagaaagugguaguuacugacgugaccucuaacuuucucacagucacuaucaaggaaagcaauaccgaucaaggguucuuuaaagagaagagguga

SEQ ID NO: 53876 - RNA, 510 nt, Artificial Sequence
  derived and/or modified sequence opt3 from CBY1__Homo_sapiens__NP_001002880
auggacaagugccagaaacacgauguggagugugaaaagcccgacgccaacgaggauagccugugcaauuccguccauguucaauggccuggcgaagggucuaccggauucgcuuuuaucagaccaaaaaugccguucuuugguaacacauucucacccaagaaaacuccuccaaggaagagugcaagccucuccaaucuucacucucuggaccggucgacgcgcgagguggaauugggcuuagaguacgggucacccaccaugaaccuggccggacagagccuaaaguuugagaauggccaguggauugcggaaacagguguaagugggggaguggaucgacgugagguccagagacucaggcggcgcaaccaacagcuggaagaggagaauaaccuucugagauugaaaguggacauacuccuggauaugcuguccgaaucuacugcugagagccaucucauggaaaaggaguuagacgaacugaggaucucccggaaacgcaaguga

SEQ ID NO: 53877 - RNA, 2856 nt, Artificial Sequence
  derived and/or modified sequence opt3 from CC2D1A__Homo_sapiens__NP_060191
augcacaagagaaaagggcccccuggcccaccgggaaggggugccgcugcagcccggcagcugggccuccuuguggaccugagccccgauggguugaugaucccugaggacggagcgaacgaugaagaguuagaagcugaguuccuggcccuagucggcggucaaccacccgcacucgaaaagcugaaagggaagggaccucuuccaauggaggccauugagaaaauggcuucccugugcaugcgcgaccccgaugaagacgaggaagagggcaccgaugaggacgauuuggaagcagacgaugaccuccuggccgagcugaaugaaguucucggcgaggaacagaaggcuucugagacaccuccaccgguggcccagcccaagccugaggcgccacaucccggguuagaaacuacgcugcaggagcgacuugcauuguaccaaaccgccauagaaucagcucgucaggccggagauagugcaaaaaugagaagguaugaccggggucugaagacacuagagaaccuccuggcuagcauccgcaaaggcaaugccauugacgaagcggauaucccuccacccguagccauugggaagggaccggcauccacuccuaccuacucucccgcuccaacacagccugcccccagaaucgcuucggccccagagcccagggugacccuugagggcccuucagcaacugccccagcuagcaguccgggucuggcgaaaccccagaugccuccagggcccuguuccccuggaccauuggcacaacuccagucucggcagcgcgacuauaagcuggccgcuuuacacgccaagcagcaaggcgauacaaccgcagccgcucgacauuuuagagucgccaagagcuucgacgcagugcuggaagcgcucuccaggggcgagcccguugaucuuucaugccugccgccuccacccgaccaguugccucccgauccaccuagucccccaagccagccgccuacgcccgcuacugccccaucuaccacagaagugcccccuccaccccggacucuacuggaggcacucgaacaacguauggagcgcuaccaggucgccgcugcccaggcaaaguccaaaggggaccagagaaaggcuaggaugcacgagcggauagugaaacaauaucaggaugccauccgagcgcauaaggccggacgcgcuguagacguugcagaacugccugugccgccagguuuucccccuauucagggccuugaggccaccaaaccaacacagcaaucacuggucgggguguuggaaaccgcuaugaagcucgccaaccaggaugagggacccgaggacgaagaggacgaagugccuaagaaacagaauagcccggucgcacccacggcgcagccaaaggccccucccaguagaacuccacaaucuggcuccgcuccuacagccaaagcacccccaaaggcuaccagcacuagggcccagcagcagcuggcauucuuagagggucggaaaaagcaacugcuacaggccgcucuccgcgcgaagcagaaaaacgauguugaaggggccaagaugcaccugagacaagcaaaaggccuugagccgauguuggaggcuucgaggaauggacugccuguggacaucacaaagguacccccagcccccgugaacaaagaugacuuugcccucguccagcguccuggcccagggcugucucaggaagcugcacggcgauacggagagcuuaccaagcugauuagacagcaacacgaaauguguuugaaucauuccaaccaguucacgcagcucgguaauaucaccgagacaacuaaguuugaaaaacuggccgaggauugcaagaggucaauggacauauuaaaacaggcguucgugcgcggccugcccaccccuacagcucgguuugagcaaagaacuuucaguguuauuaagaucuuuccggaucuaagcuccaacgacaugcuccuguucauugugaaagggaucaaucuuccaacacccccuggauugucucccggcgaucuggacgucuuugugagguucgauuucccauauccuaacguagaagaggcccagaaggacaagaccagcguuaucaaaaauaccgauucacccgaauuuaaggagcaguucaaacucuguauuaaccgcagucaccgagguuuucggcgugcaauacagacuaaggggaucaaauucgaagugguccauaagggcggacuguuuaaaacggacagaguguuaggcacagcccaacugaaacuugacgcuuuggagauugcaugcgaggucagggaaauccucgaggugcuggaugggcgccggccaaccggagguagacuagaaguuauggugaggauacgagagccucugacugcccagcagcucgagaccacaaccgaacgcuggcugguaauugacccgguccccgcggcugugccaacucaaguugccggcccuaaggggaaagcacccccagugccugcccccgcucgggaguccggaaacagaagcgccaggccgcuucacucuuugucaguccuggcauucgaucaggaacguuuagagcgcaagauccucgcucugcggcaggccagaaggccagugccucccgaaguagcgcagcaauaccaggacaucaugcagcgaagucaguggcaacgggcccagcuugagcagggcgguguggggauucgcagagaguacgcagcucagcuggaaaggcaauugcaguuuuauacagaggccgcucggcgacucggcaaugauggaagcagagacgcagccaaagaagcccuguaccgcaggaaccuaguugaguccgaacugcagcgucuccggagauga

SEQ ID NO: 53878 - RNA, 1806 nt, Artificial Sequence
  derived and/or modified sequence opt3 from CC2D1B__Homo_sapiens__XP_011539232
augaugcccggcccuagaccaaggaaggggccgcaggcccggggacaagguguggcugcagccaaacagaugggccuguucauggaguuugggcccgaagacaugcuccuuggaauggaugaggcggaagacgaugaggaccuggaagcugaguuguuagcccugaccggcgaggcacagacaacugguaagaaaccugccccaaaggggcaggcuccccuaccuauggcacacaucgaaaaacucgccgcugauugcaugcgcgacgucgaggaagaggaggaagaggaaggacuggaggaagaugccgagcuucugacggaguugcaagaaguucucggcguggacgaggaaaccgagccacuggauggcgacgaaguagcggaucccgggggaagcgaggaggaaaacggucuggaggacacagaaccuccagugcagacugcaguccucaccgccuccgcuccggccgcacaggcuggcgccucucagggguuacaugcgcugcuugaggaacgaauccacaauuaccgugaggccgcagcuucagccaaggaggcuggagaagccgcaaaggccagaaggugugagcggggcuugaaaacacuggaaagucaacuagcuagcgugcgcagagguaggaagauaaacgaggaugagauucccccuccaguugcgcucgggaaacggccccuggcaccucaggaaccagccaaucgcucccccgagaccgacccgccugcucccccagcccuugaaucugacaacccuucgcagcccgagacuucacugccaggaauuagcgcacagcccgugagugauuuggacccugauccacgagcccuccuguccucuagacaaagggaauauaaggucgcugccuuaagcgcaaaacgggcgggcgagcuggaccgugcucgcgagcucaugagaaucggcaagagguucggggccgugcuugaagcacuggagaagggacagccgguagauuuguccgccaugcccccugcuccagaagaccuaaaaccccagcaagccucacaggcaccuacagcuccaaguguuauucccccggccguggagcggguccagccugugauggcgccagaugugcccgccaccccugucgcucccacggaaagccagacuguucuggacgcacuccaacagcgacugaauaaguaccgcgaggccgguauccaggcuagaucuggcggggaugagaggaaagcccggaugcaugaacgcauagcaaagcaguaucaagacgcgaucagagcccacagggcuggacguaaagugaacuuugccgagcuuccaguaccucccggcuucccaccgauuccuggucuggaauccaccauggggguggaggaagaugcagucgcugccacauuggcagccgcugagaagcucgcgucagccgaggacagcgcacccgcugacaaagaugaagacgagccacccggccaucugcagggagaaccuccagcccaggcccccguggcuaagaagccugcacggccgacuguuccaaguucucagcgauuacccgagccuagagccuccagcucgaaagagucuccaucccccucagugagggaacaacuggcgcuacucgaggcucgcaagcugcaguaccagcgggccgcacuucaggccaaaagaagucaagauuuggaacaggcuaaggcauaucugagggucgccaaauggcucgaggcgcagaucauucaagcucgcagcggccgaccuguggaccuguccaaggggccgugcgaucuuggacggugucugcgucccuga

SEQ ID NO: 53879 - RNA, 4863 nt, Artificial Sequence
  derived and/or modified sequence opt3 from CC2D2A__Homo_sapiens__NP_001073991
augaaccccagagaggaaaaggugaaaaucauuaccgaggaauuuauagagaaugacgaagaugccgacaugggcaggcagaacaagaauagcaaaguccggcgccaaccucgaaagaaacagccaccgacagcuguucccaaggagaugguguccgagaagucucaccuggggaacccucaggaaccaguacaggaggaacccaaaacucgucuccuuucaaugacggugagaaggggaccucggagucugccacccaucccuagcaccucccgcacagguuuugcagaguucucuaugagaggcaggaugcgggagaaguugcaagccgcgcgcucgaaagcugaaucagccuuacugcaggagauuccaacuccgcgacccagaaggcuacggagcccuaguaagaaagaacucgagaccgaauuugggacagagccaggaaaggaggucgaacguacccagcaggagguggauucccaaucuuacagccgcguuaaguuccaugacuccgcaagaaaaaucaagcccaaaccucaggugccacccggcuuuccgucagccgaagaggcuuauaauuucuuuacuuucaacuuugauccugaacccgaggguagugaggaaaagccaaaagcaaggcaccgggccgggacaaaucaggaggaagaggaaggagaggaggaggaaccucccgcucagggcggcgggaaggaaauggacgaggaggaacugcuuaacggagaugacgccgaggauuuccuguugggucucgaccaugucgcggaugacuuuguggcaguacgaccagccgauuacgaaagcauucacgaccgccugcaaauggagagagaaaugcuguucauccccucuaggcagaccguuccuacguauaaaaagcucccagagaaugugcagccgcgguuuuuagaggacgaaggccuguacacugggguccgccccgagguggcuagaaccaaccaaaauauaauggaaaacaggcuuuugaugcaggauccugagcgucggugguucggagacgauggccgaauccuggcccuaccaaaucccauuaagccuuucccauccagacccccggugcucacacaggaacagucaaucaaagcagagcuggagacucuuuauaagaaagcugucaaguacguucauagcagucaacacgugauuaggucuggugacccuccagggaacuuucagcuggauaucgacauauccggauugauuuucacccaccaucccugcuuuagccgcgaacacguacucgccgcgaaacuggcccaguuauaugaucaguaccuggcacggcaucaaagaaauaaggcuaaguuccucacagacaaacuucaggcccugaggaacgcugugcagaccggcuuggauccugagaagccccaccagucgcuagacacgauccaaaagacuauuaacgaauacaagucugagauccgccagacacgaaaauuucgggaugccgaacaggagaaggaccguacccugcucaagacuaucauuaaagucuggaaggagaugaaaucccugagagaguuccagagguuuacaaauaccccacuuaagcugguguugcgcaaagaaaaggcagaccaaaaggccgaugaagaggcuuaugaggcggaaauacaggcagagaucucagaacuccuggaggaacacacggaggaguacgcccagaaaauggaagaguaucggaccaguuuacaacaguggaaggcuuggagaaaaguucagagggccaagaaaaagaaacgaaagcaggcagccgaggaacauccuggcgacgaaauugcugagcccuacccagaggaagaucuggugaagccgagcccucccgagccaacagaccgcgccgucaucgaacaagaggugcgggaaagagcagcgcaguccaggcgucgccccugggagccuacucuaguaccagagcucucucuggcugggagcguuacccccaacgaucaguguccucgggccgaagugucaagaagggaggacgucaaaaagcgaaguguguaucuuaaagucuuguucaauaacaaggaagugucccggacaguuagccgcccgcugggagcagauuuuagagugcacuucggucagauauuuaaucuccaaauuguaaacuggccagagucucugacucuucaggucuacgagaccgugggccauucaagucccacacuguuggccgaaguuuuccucccuaucccagagaccacuguggucacggggagggcucccacagaagagguggaauuuagcuccaaucagcacguaacccuggaccaugagggagugggcucugguguuccuuucucguucgaggccgaugggagcaaccaguuaacucugaugaccuccggcaaagucucacacaguguggcaugggcuaucggagaaaauggcauuccgcuaauucccccacucucucaacagaacaucggguuucggagcgcccugaagaaggcggacgccauauccucaaucggaacaagcggucuuaccgauaugaaaaaguuggcuaaaugggcagccgagucuaagcuggacccuaaugaucccaacaaugcuccacucaugcagcugauuuccguggccacaaguggcgaaagcuaugucccugacuucuuucgauuagagcaacugcagcaggaguucaacuuuguuucugaccaggaacuuaauagauccaaacgcuucagguugcuccaucugcguucacaagaggugcccgaauuucggaacuacaaacaggugccaguauacgauagagagaucauggaaaaggucuuccaggacuaugagaaaaggcuacgcgaucgaaacgugaucgaaacuaaggagcacauugacacgcacagagcaauaguugcgaaauaccugcagcaagugcgggagagugucaucaauagguuucucauugccaagcaguauuuccugcuugcugauaugaucguggaagaggaaguuccgaacauuagcaucuuggggcugucguuauuuaaacucgccgagcagaagcgcccucugcgucccagacggaagggaaggaaaaaggugaccgcacagaaucuuuccgacggcgauauaaaacuguugguaaacaucguccgcgcuuacgacauuccagugcgaaagcccgccgugucuaaauuccaacagccuagcagaucaagucggauguuuuccgagaagcaugcagccucuccaagcacuuauucccccacacacaaugcugauuacccucucggucagguccugguuaggccguucguggaaguaucauuccagcgcaccgugugccacacaacuaccgcggaggggccaaaccccagcuggaaugaggaacuagaacugccuuuuagagcccccaacggcgacuauaguacggcaucucuccaauccgucaaagaugugguuuucaucaauauuuuugacgaggugcugcaugauguccuugaggacgacagggaacggggaagcggcauccacacccguauagagcgccauugguuggggugugugaagaugccauucucgacaauuuacuuucaggcucgaaucgauggaacuuucaagauugacaucccucccguucuguuagguuacucaaaagaaagaaacaugauacucgagaggggcuuugauucugugcggagucuguccgaagggagcuauaucacccuuuucauuacaaucgagccacagcuggucccuggagagucuauucgcgaaaaguuugagagccaagaagacgagaaacuacuccaggccacugaaaaguuccaggccgagugcgcucugaaauuuccgaauagacaguguuugaccacgguaaucgauauauccggcaagacaguguucauuaccagguaccugaagcccuuaaacccaccucaagagcuccugaauguuuaucccaacaaucuucaggcaacugccgaacugguggcgcgguacgucucauugaucccauuccucccugacacagugaguuuuggugggaucugcgaucuguggagcaccucugaccaguuccuagaucugcuugcuggcgacgaggaggaacacgccguacuccuguguaacuauuucuugucccugggcaaaaaggcaugguuacucaugggaaacgccauucccgaggggccgacugcuuacgugcugaccugggaacagggacgauaucuuaucuggaauccaugcucaggccauuucuacggucaauuugauacauucuguccucugaaaaacgucgggugcuugauuggacccgacaauauaugguuuaacauccagagauacgagaguccacuccgcauuaauuucgacguuacgaggcccaagcuguggaaauccuuuuucagccggucucuaccuuauccgggccugucgagcgugcagcccgaggaacuuaucuaccagcguucagauaaggcagccgcggcugaacuccaagacagaauugagaagauccugaaagagaagauaauggauuggaggccacgccacuugacccgguggaaccgauauuguacuuccacauuaagacacuuucugccucuccuggagaaaagucagggugaagacguggaagaugaccauagggccgagcuucugaagcaguugggcgauuaccgcuucucuggguuuccccuacacaugccuuauagcgaagucaaaccacugaucgacgcaguguacuccaccggaguucauaauauugauguacccaacguggaguucgcccucgcugucuauauccacccuuacccaaagaaugugcugucaguuuggauuuacguggccucucuuauccggaacagauga

SEQ ID NO: 53880 - RNA, 3408 nt, Artificial Sequence
  derived and/or modified sequence opt3 from CCAR1__Homo_sapiens__NP_001269889
auggcccaguucggcgggcaaaagaaucccccuugggcuacccaguuuacagcaacugccgugagccagccagcggcucugggaguccagcaaccgucccuccuuggugccucucccacgaucuacacccagcagacagcacuggccgcugcaggcuugacuacccagaccccugccaacuaucaauuaacacagacugcugcccugcagcagcaagcggcagccgcugccgcagcucuacagcagcuccaacagccacagcagacacugcuuacccaacccgccguugcgcugccuacgucauugagucucagcacuccacagcccaccgcccagauuacaguguccuacccuacuccaagaucuucgcagcaacagacccagccgcagaaacaaaggguauucacagggguggucaccaagcugcacgacacguuuggauucguggaugaggacguguuuuuccagcugucagcagugaaaggcaagacuccccaggucggugaucgggugcucguagaagcuacauauaacccuaauaugccauuuaaauggaacgcccagcgcauacaaaccuuacccaaucagaaccagagccaaacucagccucugcuuaagacaccacccgcuguuuugcagccgaucgccccucagaccacguucggggugcaaacccagccccagccacagagucugcuacaagcacagauuuccgccgcuucuaucacaccucuccugcagacucagccccaaccacuucugcagcagccccaacagaaggcgggauugcuccagccuccaguccgaauugugagccagccgcaacccgcacguagacuggacccuccauccagguuuucaggccggaaugaucgcggcgaccaggugcccaacagaaaagaugacaggagucgggagcgcgaacgagagagaaggcggagccgugaacgcucuccucagagaaagaggucccgggagcgaucaccacgcagagagagggaacggagcccccgcagagucaggcguguugugccgcgguacaccguacaguucaguaaauuuucuuuagauugcccuuccugugacaugauggagcugcgaagaagguaucaaaaucucuacaucccaagcgauuucuuugacgcccaguucacauggguggaugcuuucccccuuucgcgcccuuuucagcuggggaacuauugcaauuucuacgucaugcaucgggaaguggagucuuuggagaagaacauggccauacuagaucccccagacgcagaccaccuguacuccgccaaaguuaugcucauggcuucaccuaguauggaagaccuguaucauaagagcugugcccuugcagaggauccccaggaacugagagacggauuucaacacccagcgagguuggugaaguuccucgucgguaugaaaggcaaggaugaggcuauggccaucgggggacauugguccccgucucuggacggcccugaucccgaaaaagacccaagcguguuaauuaagacugcaauccgcugcuguaaagcccugaccgguauugaucuaucaguaugcacacagugguaccgauuugcugagauccgguaucaccgucccgaggaaacccacaaggggagaacuguuccugcccauguggagacggucguucucuucuuuccagacgucuggcacugucugcccacaaggagugaaugggagacccuuucccgcggauacaaacagcaguugguggaaaagcugcaaggcgagcggaaggaggcagauggcgaacaggacgaggaagagaaagacgauggggaagcuaaggagauaagcacuccuacccauuggucuaaacucgacccgaagacaaugaaaguuaaugaucugagaaaggagcuugaaucaagggcccugaguagcaagggauugaaaucccagcucauugcgcgacugaccaagcaauuaaaaguggaggaacagaaggaggagcagaaagaacuggagaagucugaaaaggaggaagacgaggaugacgaucgcaaaucggaggacgauaaggaagaggaggaacggaaaagacaggaagagaucgagaggcaacgucgcgaacggagauauauucuaccagacgagcccgccaucaucguacacccuaacugggcugcaaagagcgguaaauucgauugcuccauuaugucacucaguguccugcuugacuacagguuggaagauaauaaggagcacucuuuugaagugagccuguucgccgagcucuuuaacgagaugcugcagcgagacuucggcguucggauauauaaguccuuacugucacuuccagaaaaagaggacaagaaagaaaaggauaaaaagagcaaaaaggacgagcgcaaggauaaaaaggaggaaagagacgaugagacugacgaacccaaaccuaagaggcggaaaucuggggaugacaaggauaagaaagaggaccgagaugaaagaaagaaagaggacaagcgcaaagaugacuccaaggacgaugacgagacagaagaggauaacaaucaggacgaauacgauccgauggaggcugaagaggccgaggacgaagaggaugacagggaugaagaggaaaugacgaagcgugacgauaaacgggacaucaacagauacuguaaggagaggcccaguaaagacaaggagaaagaaaagacccagaugauuacuaucaaucgcgauuugcucauggcauuuguguauuucgaccaaagccauugcggauaccugcuagagaaggaucuggaagagauacucuauacacugggccuucacuugucucgagcgcaggucaaaaagcuguuaaacaaagugguacucagagaguccuguuucuaccggaagcugaccgacacaucaaaagaugaagagaaucaugaagagagugaaagccuucaggaggacaugcuggguaacagguugcuccugccaacuccuaccgugaagcaggagucgaaagauguugaagagaaugucgggcuaauuguguauaacggcgccaugguggacgucggaucccugcuccaaaagcuggaaaagucugagaaaguucgcgcugaaguggagcagaaacuucaguugcuggaggaaaagacggaugaggacgaaaagaccaucuuaaaucucgagaacagcaauaaaucacugaguggcgaacuucgugaggugaagaaggaucugucccaacuacaggagaaccucaaaaucucugaaaauaugaaccugcaguuugagaaucagaugaacaagacaauuagaaacuugagcacuguaauggacgaaauccacaccguccugaaaaaggauaaugugaaaaacgaggacaaggaccaaaaguccaaagagaauggggccucaguuuga

SEQ ID NO: 53881 - RNA, 2772 nt, Artificial Sequence
  derived and/or modified sequence opt3 from CCAR2__Homo_sapiens__NP_066997
augagccaguucaagagacaaaggaucaacccccugccuggcgggcggaauuuuuccggaaccgccucuacaucacuccuugguccaccgcccggccuguugacuccuccaguggcuacggaguuaagucagaacgcacgccaucugcagggaggagaaaaacagcgagucuucaccggcauuguuacaagccuacacgacuacuuuggugugguagaugaggaaguguucuuucaacucuccgucgugaaggggcgucugccccagcuuggagagaaaguucuggugaaggccgcguauaauccuggccaggcugucccauggaacgccgugaaaguacagacuuugucuaaucaaccccuccugaagucgccugcaccaccgcugcuccacguugccgcuuuaggccagaagcaggggauacugggagcacagccccaacuuaucuuccagccucauagaauaccacccuuguuuccucagaaaccacugucacuauuccaaaccagccacacacuccaucugagucaccuuaacagguuucccgcccgggguccgcacggccgccuggaccaggggagauccgaugacuacgauucuaagaaaaggaagcagcgggcuggaggcgaaccuuggggugccaaaaagccccgccaugacuugccaccuuaucgagugcaccucacccccuacacugucgauagcccaaucugcgacuuccuggaguuacagagaagguaucggucccugcucgugcccucagauuuucuuagugugcaucugagcugguugucugcguucccucuaucccaaccauuuucacugcaccacccgagccguauucaggucaguucugagaaggaagcagcccccgacgcuggggccgagccuaucacagcagauuccgacccagcuuacagcucgaaaguucuccugcuuucuucccccggacuggaagaguuguaucgcuguugcaugcuauucguggaugacauggccgagccuagagaaaccccagagcauccccugaagcagauaaaauucuuacugggcaggaaggaagaggaagcgguacucgugggcggggaguggucaccgagucucgacggacuggauccucaggccgacccacaaguccuugugcggacggcaauccgaugugcucaggcccagacugguauugauuugagcggcugcaccaaaugguggcgcuuugcugaguuccaguaccugcaacccgggccucccagaaggcuccagacaguuguggucuaccugccagacguguggacuaucaugccuacccuugaagagugggaagcccugugucagcagaaggcagccgaggcugcgcccccaacacaagaagcacagggagagaccgagccgacggaacaggccccugaugcuuuggagcaagccgcagacacuucccggcgcaaugccgaaacacccgaggcuaccacucagcaggaaacagauaccgaccucccagaggcacccccuccaccccuggagccugccguaauugcgagaccgggcugcguuaacuuaucucugcacgguaucguggaagauaggcguccaaaagagcggauuagcuuugaagucauggugcuagcugaacucuuccuggagaugcuucagcgagacuuuggguauagagucuacaagauguugcugucacuccccgaaaaggugguuaguccuccagagcccgaaaaagaggaagccgcaaaggaggaggccacgaaagaagaggaagcuauuaaggaggaagugguaaaagagccuaaggaugaggcccaaaaugaaggcccggcaaccgaguccgaagcuccccugaaggaggacggauuacugccaaaaccucuuagcucuggcggggaagaggaggaaaagcccaggggagaggccucagaagacuugugugagauggcgcucgauccagagcugcuacugcuccgcgacgauggugaagaggaguucgccggcgcuaaacuggaggacagugaaguccggagcguggcauccaaccagucugagauggaguuuucgagccuucaggauaugccuaaggaauuggaccccuccgccguucugccauuagauugccuccuggcuuucguguuuuucgacgccaauugguguggguaucuucauagaagggaucuggagcgcaucuugcucacacuggggauucgacuaucagcagaacaggcgaaacaacuggucagucgggugguaacucagaacaucugccaguaccguucucuccaguauagcagacaagagggccuggacggugggcuuccggaagagguguuguuuggcaaucuggauuuacucccucccccaggaaaguccaccaagcccggcgccgcuccuacagagcacaaagcccugguuucacauaacgggagccuuaucaaugucggaucucugcuacagagggcagaacagcaagacuccggucgccucuaccuggagaacaagauucacacuuuggaacugaaauuagaggaaagucacaaccgguucagcgcuaccgaggugacaaauaagacccucgccgcagagaugcaggaacugagagugaggcuugccgaggcugaagagacugcgcgaacggccgagcgccagaaaucucagcugcaacgguugcuccaggaacugagaaggcgucuaacaccacugcagcuugagauacagcgcgucguugaaaaggcagauuccuggguggagaaggaggaacccgcuccuucaaacuga

SEQ ID NO: 53882 - RNA, 1221 nt, Artificial Sequence
  derived and/or modified sequence opt3 from CCBE1__Homo_sapiens__NP_597716
auggugcccccuccaccgagcagaggcggggccgcuaggggacagcugggucggucccucggcccccuucuguuguuacuggcacuagggcacaccuggacauaccgcgaggaaccugaggacggagaucgagaaaucugcucugagucaaagauugccacuacgaaauauccaugucucaagaguagcggcgaacugaccacaugcuaccguaaaaaguguugcaaagguuauaaguucguccuugggcaauguauacccgaggacuacgauguuugcgcggaggcuccuugugaacagcagugcacugacaacuuuggaagagugcuguguaccugcuauccaggcuacagguaugaucgggagcgccauagaaagagggaaaaacccuacuguuuggacaucgaugagugcgccuccucuaauggcacacucugcgcacacauuuguaucaacacccuggggucguaccggugcgagugucgcgaaggauauauucgagaggacgaugguaagacuugcacaagaggcgacaaauacccuaaugauaccgggcaugaaaagucagagaacaugguaaaagccggaacguguugcgcuacuuguaaggaguucuaucagaugaagcaaaccgugcugcagcucaaacagaagaucgcauuacugccaaauaacgccgcugaccuuggcaaauacauaacaggugauaaggucuuggccagcaauacuuaucugccggggcccccuggacuaccaggcggccaggggcccccuggaaguccaggucccaaaggcuccccgggguuuccuggaaugcccggcccaccuggucaacccgggccaaggggcucuaugggacccaugggcccuagcccagaccucucccacaucaagcaggggcggcguggaccggugggucccccuggcgcgccagggcgcgacggaucaaaaggcgaaagaggugcacccgggccuaggggcaguccaggacccccgggcagcuucgauuuucugcuucugauguuggccgacauucggaacgauaucaccgagcuccaggaaaagguuuucgggcaucgaacacacucuuccgcugaggaauuuccucugccacaggaguuccccucauacccugaagccauggacuuaggaagcggugaugaccacccccgcagaaccgagacgagggaucugcgggcaccacgcgacuuuuauccuuga

SEQ ID NO: 53883 - RNA, 1119 nt, Artificial Sequence
  derived and/or modified sequence opt3 from CCBL1__Homo_sapiens__NP_001116144
auggccaagcagcugcaagcuagaaggcucgacggcaucgauuacaaccccuggguggaguucgucaaacuugcaagcgaacacgacguugugaaucuggggcagggauuuccugauuucccaccgcccgacuuugccguagaggcguuccagcaugcuguguccggugauuuuauguugaaccaguauaccaagacauucgucauuauaaucgaaccauuuuucgacugcuacgagccuaugacuaugauggccggcgggcggcccguguuuguuucuuuaaaaccuggaccaauucaaaauggcgaacuggguucaaguagcaacuggcagcuagaucccauggagcucgcagggaaguucacgucccgcaccaaagcccuggugcuuaauacaccuaacaauccacugggaaaggucuuuucucgagaggaauuggagcucguggcuucgcugugucagcagcacgacguaguuugcaucacugaugaaguguaucaauggauggucuacgacggccaucagcacauuucaaucgcaagccugccgggcaugugggagcguacccucacaauagggagugccggaaagaccuucuccgcuacugguuggaaagugggcuggguguuagggcccgaucauaucaugaagcaccugagaacaguccaccagaacucuguuuuucauuguccuacccagagccaagccgcgguggcagaguccuucgaaagggagcagcuuuuguuccggcagccaucaaguuauuuuguacaauucccccaggccaugcagcgcugcagagaccacaugauuaggagccugcagucugugggacuaaaaccuaucauuccacaaggcuccuacuuucucaucacggauauaucagacuucaagcggaaaaugcccgaccugccgggugcugucgaugaaccuuaugaccgccgauuugugaaguggaugauuaagaauaaagggcuuguugccauccccgugagcauuuucuacagugucccacaucagaagcacuuugaucacuacaucagauucuguuuugugaaagacgaggcaacucugcaggcuauggaugaaaaguugaggaaauggaagguagagcucuga

SEQ ID NO: 53884 - RNA, 882 nt, Artificial Sequence
  derived and/or modified sequence opt3 from CCDC101__Homo_sapiens__NP_612423
auggcccuggugagcgcugacuccagaaucgcagagcuccuuaccgaacugcaccaguugauuaagcaaacacaggaggaaaggucucggucagagcauaacuuagucaauauacagaaaacucacgaacgcaugcagacggagaacaagaucagucccuacuaucgaaccaaacugcguggccuauacacaacugccaaggcggaugcugaggccgaaugcaauauucucagaaaagcacuggacaagaucgccgagauuaagagccuucuggaagagaggcggaucgcugcaaaaauagccggguuguauaacgauuccgagccuccacgcaagaccaugagaaggggaguucucaugacacugcugcaacagucugcuaugacccucccguuauggaucgguaaacccggcgacaagccuccaccccuguguggggccauuccugcgucgggagauuacguggcacggccaggcgacaaaguagccgcucgcgugaaggccgucgauggugacgaacaguggauccuugcagaggugguuucauauagccaugcuacuaauaaguacgaaguggaugacauugaugaggaagggaaagagcgacacacauugaguagaaggcgggucaucccccugccucaguggaaggccaacccagagaccgacccggaagcgcuauuccaaaaagagcagcucgugcuggcccuuuauccccagacgacuugcuuuuaccgugcacugauacaugcuccuccacagcgcccccaagaugacuacuccguauuguucgaagacaccucuuaugccgauggauacagcccuccacucaauguugcucagagauauguggucgccuguaaggagcccaaaaagaaauga

SEQ ID NO: 53885 - RNA, 1542 nt, Artificial Sequence
  derived and/or modified sequence opt3 from CCDC102B__Homo_sapiens__NP_001087198
augaaccuggacagcauccacagacucauugaggaaacccagauauuccaaaugcagcaguccucuaucaagucaaggggcgauaugguggcccccgcuaguccuccacgggacacaugcaauacuuguuuuccgcuucacgggcugcagagccacgcagcccauaacuucugcgcgcacuccuacaauacgaacaaaugggauauuugugaggaauugcgcuuacgagagcuggaagaggucaaggcucgugccgcacaaauggagaaaaccaugagaugguggucugacugcacagccaauuggagggaaaaguggucgaaaguucgggcugagcgcaacucagcaagagaagagggaaggcagcuacggaucaagcucgagauggccaugaaggaacugagcacucuuaaaaagaaacagagucugcccccucagaaggaggcuuuggaagccaaugugacccaagaucucaaacugccagguuuuguagaggaauccugugagcauacagaccaguuccagcugucuagccagaugcacgaguccauucgcgaauaucucgugaagcgacaauuuucaaccaaggaggauacuaacaauaaagaacagggcgucgugaucgacaguuuaaagcugagcgaggaaaugaaacccaaccuugaugggguugacuuguucaauaacggaggcucugguaauggggagacaaagaccggacugagacuaaaagcgauaaaccucccucuggagaaugaagugacggagaucuccgcacuucagguccaccuggaugaauuucaaaagauuuuguggaaagagagggaaaugcggacugcccucgagaaggagaucgaacgucuggagucagcuuuaagccuguggaaguggaaauacgaagaacucaaggagaguaaaccaaagaacgugaaagaguucgacauucuucugggccagcauaacgaugagaugcaggaauugucuggcaauaucaaggaggaauccaagagccagaacucgaaagaccgcguaauaugcgagcuaagagccgagcuggaaaggcuccaagcagagaauaccucugaaugggacaagcgggagauucuggaacgagagaaacaggggcuugagcgcgaaaacagaaggcugaagauccagguuaaagagauggaagaguugcucgauaagaagaaucggcuguccgcuaacucacagagucccgacuuuaaaaugagccaaauugauuuacaggaaaagaaucaggagcugcuaaaccuccagcacgccuauuacaaacugaaucgccaauaucaggcgaacaucgccgagcuuacacaugcaaauaacagaguggaccagaaugaagcugaggucaagaaauugaggcugcguguggaggaacucaagcagggacugaaccaaaaggaggaugaacuugacgauucccugaaucagauccggaaauugcagcgaucucucgacgaggaaaaggagagaaacgaaaaccuggagacugaguuaaggcaucugcaaaauugguga

SEQ ID NO: 53886 - RNA, 297 nt, Artificial Sequence
  derived and/or modified sequence opt3 from CCDC103__Homo_sapiens__NP_001245326
auggagagaaacgacaucauuaauuucaaggcccuggaaaaagagcuccaggcugcacuuaccgccgaugaaaaguacaaaagggagaacgcggcuaagcugcgggccguggaacaacgcgucgcaagcuaugaggaguuucgaggcauaguuuuggccucccacuuaaaaccccuggaacguaaggacaagaugggagggaaaagaacagugccuuggaauugccauacuauccaggguaggacguuccaggauguagcuaccgagauuucuccaaacucauggaagaguagcuga

SEQ ID NO: 53887 - RNA, 1500 nt, Artificial Sequence
  derived and/or modified sequence opt3 from CCDC105__Homo_sapiens__NP_775753
augagagugcugguucccccugccgagaggagccaggacacccgggucggcgcuccagcauggcgcgaagccgcgcaagcuauggcccgaacagcacacauccucacugaucguugcgggcaggaggccgugacgauguggcagccgaaggacuccguacuugaucccaacguggcucaucaccuggggagagcagccuacauucagccuuggagguuccgggucgaaaugauaaaagguggcgggaccuuggagaagccacccccuggagaaggcgugacauuauggaaagguaagaugaaaccacccgcuugguaugcccgccugccucuaccacuccauagaaaggcgagggcacugcaaacuaccgagguugugcacgcccaugcucggggagcccgccuuacagcagcucgacugggcagagcccagcaccagaucaauggaaggguccggcaguugcuccgucaacgcgaggugaccgaccacagacugucugaaguaaggaagggccugcucauuaaccagcagucaguuaaauuacggggguaccgaccgaagagugagaaagugcccgauaaggcggacagcaugcugacuugggaaaaagaggagcuuaaguccaugaagcgcaaaauggaaagagauauggagaagucugaagucuugcugaaaacacuagccucguguagggacacccucaauuuuugcuucaaggagcggcugcaggcaguggaucuuaugaaccaaccucuggacaaaguguuggaacaggcucgcagacauucaugggucaaucucagcagggccccaacgccccguacucagggacaaaagaccccuccacccgauccgguugguacauauaacccugcuugugcccuggcauuaaaugaggccaaacggcugcucguggagaguaaggacacucuuguagaaauggcuaagaacgagguggauguccgagaacagcagcugcagaucuccgacagagugugcgcgucuuuggcacaaaaagccagcgagacccuagaacugaaggagaggcucaauaugacacugggccuuaugcgcgggaccauucugcgguguacgaaauacaaccaggaguuguauacuacacacggacucaucaagggcccccuguccaaaguucauuuagaaaccgcugagaagcuggacagaccccuagugaggauguaccagcgccacgucgguacucagcucccugaagccgcacgacuggcccaagggacagauaaacuucagugccacauaaccuauuuggagaagaaucuggacgaacuccuggcuacgcauaagaaccuuucauggggacugaauuguaaaaacaucggccacgagguggauggcaauguaguucgguugcgucucagacagaggcagccccaugugugcuacgagcaagcccagcgccuggucaaggacugggauccacggaccccaccuccaagaaguaaaagcucugcagacccguga

SEQ ID NO: 53888 - RNA, 2355 nt, Artificial Sequence
  derived and/or modified sequence opt3 from CCDC108__Homo_sapiens__NP_001265224
auggagaccgccaucuggagaaggagcuacauuucccugauaucuucagaacggcccgugcacaacuggcgcggcaagaguguccagaaaaagcaagcugagagcaaaucccagaucaagcuccauacacagucugcaccuuucgggcuuugcccaaaagacaugaugcugacucaggccccgucgucaguugugcgaagccguaauaguagaaaccacacgguaaauuccggagguucuuguuugagcgcguccaccguggcuauucccgccaucaacgauucaagugcagccaugagcgcuugcucuacaauuuccgcacaaccugccucaagcauggacacucagaugcauaguccaaagaagcaggaaagggucaauaaacgggugaucuggggcauagagguugcugaagaguuacacuggaaggggugggagcugggaaaagaaaccacacgcaaccuagugcucaagaauagaucucugaaacuucagaagaugaaguauaggcccccuaaaaccaaguuuuucuuuacugucaucccacaacccauuuuccuguccccuggcaucacauugacccucccaauuguguuucggccgcuggaggccaaagaauacauggaucagcugugguucgagaaggcggaggguauguuuuguguagggcuccgcgcaacguuacccugccaucgacugaucuguagaccuccaagccuucaguugcccaugugcgccguuggagacacuaccgaagccuucuuuugucuggauaacgugggcgaccuaccuacauucuuuacuugggaguucucgucuccauuucagaugcuccccgcuaccggccugcuugaaccggggcaagcaucccagauaaaagucacauuccagccucugaccgcugugauuuaugaggugcaagccacgugcugguacggagcggguucaaggcagcggaguagcauccaguugcaggccgucgcaaagugugcucaacuccugguuuccauuaaacacaagugccccgaagaucaggacgccgagggcuuccagaaguuacuguauuuugggucuguggcuguaggauguacuagcgagcgucagauccgccuccacaauccaucagccgugaacgcaccuuucagaaucgaaauuagucccgaugagcuugccgaagaccaggcuuuuuccugcccaacagcgcauggcauaguccugcccggugagaaaaagugcgugagcguuuucuuucacccuaaaaccuuggauacuaggacaguggacuacuguucuaucaugccaucagggugcgcaaguaagacccuacugaaagucgugggauucugucggggcccggccguaagccuccaacauuauugcguuaauuuuuccugggugaaccugggcgaacgaucugagcagccccuuuggauugagaaucagucggauuguacggcucacuuccaauuugccaucgacugccuggaaagcgucuucaccauacgcccugcauuugggacauuggugggaaaggccagaaugacucuccacugugcuuuccagccaacccaucccauuaucugcuuuaggcgggucgccugucugauccaccaucaggacccuuuauuccuggaucuaauggguacaugccacuccgacucaacuaagccagcaauucucaaaccccagcaucugaccugguaccgcacacaccuugcgagaggcuugacccuguacccgccugauauccucgacgcuaugcugaaggagaaaaagcuggcccaagaucagaacggggcacuuaugauuccaauacaggacuuggaagauaugcccgccccucaauaucccuacaucccaccuaugacugaguucuuuuucgacggaacgagugauauuacaaucuuucccccaccgaucucuguggaaccuguugagguggacuucggcgcuugucccgguccagaggcccccaauccuguaccacucugccugaugaaccacaccaaagggaagauuauggucguguggacuaggcguagcgauugccccuuuuggguuaccccugaauccugugacgugccgccauuaaagucaauggcaaugcggcugcauuuccagcccccucacccaaacugccuauauacagucgagcucgaggcuuuugccauauacaaagugugugcgcgaaaugaaagagaggaaugcggcguaagcgccaggucucuguccggacuugugggcuggcaggagguuaccgaagggaguuuccgcuugcauccccugcgggcuagacucagccugggauggacugucacaccuaugucuuuauccccgcccaagcugcuugcauga

SEQ ID NO: 53889 - RNA, 2013 nt, Artificial Sequence
  derived and/or modified sequence opt3 from CCDC114__Homo_sapiens__NP_653178
auggagggcgaaagaagggccuacagcaaggaggugcaccagcggaucaacaaacaacuggaagagauucgccgacucgaagagguccguggggaccuucagguucagauauccgcugcacagaaucaagugaagagacugagggauucucagcgguuggagaacauggaccgcuuacugaaagguagagcccagguacaggcggaaaucgaggaacuacaagagcagaccagggcucucgauaagcagauucaggagugggaaacacggaucuucacucauaguaaaaaugugcgcucacccggauuuauucuggaccaaaaggucaagauccgaagaaggauacggauccuugagaaccagcuggaucgugugacgugccacuucgacaaucaguugguucgcaacgccgcacucagagaagaacuggaucugcucaggauugaccggaaucgauauuuaaacguggaucgcaaacugaagaaagaaauccaucaccuucaucacuuggucagcacccugauucuauccucuacaucggccuacgcugugagagaggaggcaaaggccaaaaugggccuccugagggaacgggcugagaaggaagaggcccaaucagaaauggaggcgcagguacuucagcgccagauccugcacuuggagcaacuccaucacuuucugaagcugaaaaauaacgacagacagccugauccagacguuuuagaaaagagggagaaacaggcaggggaaguggccgagggagucuggaagacuagccaggaacgucucgugcuuuguuaugaggaugcucugaauaaauugagucaacuaaugggcgaguccgacccggaccugcucgugcagaaguaccuggaaauagaggaacggaacuucgccgaguuuaauuucauuaacgagcagaaucuugaacuggagcauguccaggaagagaucaaagaaaugcaagaggcauugguuucugcucgagccagcaaggaugaccagcaccuccugcaggagcagcaacagaagguguuacagcaaagaauggauaaaguacacuccgaagcggagaggcuggaagcccgcuuucaggacgugcggggucagcuagagaagcucaaagcagauauucagcugcuuuucaccaaggcucauugcgacucaaguaugaucgaugacuugcugggggucaaaacaagcaugggagauagagacaugggccucuuucugucucuuaucgaaaagaggcugguggaguugcucaccguucaagccuuccugcacgcucaguccuuuacuucauuagccgaugcagcccugcuagugcucggccagagccuggaggaccuucccaagaaaauggcuccuuugcagccacccgacacacuggaagauccuccaggguucgaggcgagugacgauuaucccaugucucgcgaggagcuccugucccaagucgaaaaguuaguggagcugcaggagcaggcagaagcccagcgacaaaaagaccuugcugccgcagccgcuaaguuggauggaacccucagcguagaccuggccucgacgcagcgggcagguucuuccacuguucuagugccuacccgucauccacacgcgauuccgggcucaauacugagucauaaaacaagcagagauagggggucccucggacacgucacuuuuggcggucugucuagcucaaccgggcaccuucccagucauaucacacacggagacccuaacaccggccaugugacguucggcuccacuagcgcuucuucagggggacacgucacauuccgcccagugagugccagcuccuacuuggguucuaccggcuauguugggucgagccggggaggcgagaacacugaaggugggguggaguccggcggaacagcaucagauaguucuggcgggcugggaagcuccagagaccacguaucaagcaccggucccgccucuuccacgggcccugggaguagcaccucuaaggauuccaggggauga

SEQ ID NO: 53890 - RNA, 543 nt, Artificial Sequence
  derived and/or modified sequence opt3 from CCDC115__Homo_sapiens__NP_115733
auggccgcucuggaccucagagcagagcuugauagccugguguugcaguuacugggcgaccuagaggaacucgaagggaagaggaccguccugaacgcccggguugaggaaggauggcuuucccuggcgaaagcucgcuacgccaugggugcaaagucugugggccccuugcaauaugccucacacauggagccucagguaugccuccaugcuagugaggcacaggaagggcugcagaaauucaaggugguccgagccggagugcacgcuccagaggaaguuggcccgcgugaggccggucugagaaggcggaaagggcccacaaagacuccugagccagaaagcuccgaggcgccccaagauccucucaauugguuuggaaucuuagugccacauucucugcgccaggcacaggccucguucagagacggccuucaguuggcugccgauauugcaucacugcaaaacaggauagacuggggccggagccagcuacgcgggcuccaggaaaagcugaaacagcuugagcccggagcugccuga

SEQ ID NO: 53891 - RNA, 1323 nt, Artificial Sequence
  derived and/or modified sequence opt3 from CCDC121__Homo_sapiens__NP_001136155
augggcagcagagggcagggaucccacucuaagaaaaccaggucaaugcccgugauccugaguccucaacggacagguagcggcgccacugggggaccagcugcacgcgccuacuccgucgcggaggcuguuaagcaguuccgagccggcccggcagguacgggggccggaugcucucuccagggcuguugggcugcaccccguccuuuugaacauagaaccaacaaacuuagggagcugucgacauuggcccacugcucacgggaauuacagacucaagugccagacgcuagcgcccauagucuggcgguaacccuauccgagcuccacucuugucgcgaucugcaggacgaaugccuugauagcagauucgcagagggccccaggcggcuguugccuccauaucauucccucauuaauaacuuugugaagcccgagaaacugacaaaggucgaaacccgccugaaggagaaaauaguggccgaaaugacugaccucaauaagcacaucaaacaggcucagacacaacgaaagcaguuacuggaggagucaagagaacuucacagggagaaauugcugguucaggccgaaaaccgguucuuucuagaguaccucaccaauaagacggaagaguauacugagcagccugaaaagguguggaacaguuaccugcagaaaagcggggagauugaacgucgcagacaagagucugcauccagguaugcugaacagaucucaguccuuaagaccgcccuguugcaaaaagagaauauucagagcagucucaagcggaaacugcaggcgaugcgagauaucgccauauuaaaggagaaacaggaaaaggagauccaaacacugcaggaagagacuaagaaagugcaggcagaaaccgcuucuaagacacgcgagguacaggcccaacuccuucaggagaaaagacuguuggaaaagcagcuauccgagccagacaggcggcugcucggaaaacgcaagagaagggaacugaacaugaaggcucaggcccuuaaacuggcagccaagcguuucauuuuugaguacagcugugguaucaaucgggagaaccaacaguucaaaaaggaauugcuccagcugauugagcaggcucaaaaauuaaccgcgacgcagucgcaucuggaaaaucgaaagcagcaacuacagcaggagcagugguaucucgaaucucugauccaagcaagacagaggcuucagggcucccacaaccagugcuugaaucgccaagauguuccgaagacuacacccucacugccucaggggaccaaaagucggauaaacccaaaguga

SEQ ID NO: 53892 - RNA, 822 nt, Artificial Sequence
  derived and/or modified sequence opt3 from CCDC122__Homo_sapiens__NP_659411
augagcgacaacaaggagagaaaaucccagggcuuccccaaggaagauaaucaagacaccucuucacuggccgaugcuguggagaaagucgcaaagcagcagcagagucaagccagcgaaaucgagaaaaacaagaagguucucuuuaaucuuaaaaacgaacugcacgaguuggagaaggaaauugcggcuauauccgccgagacaaaagaaacugagaggcagaucuaccagcaggacucugcaauugagaauacgaaguuacauugcgauucgcuggaaacccaaaucaaaucacuacacagcgagaacgugaagcucaaguucgacauugaaacagcccaggaggauuuugaagaacauaugaucaaauauaaugcuuacuaugcaaagauaaaagcccacaagaacagucugggggagguagaauccaaauggucuuucaugacugagcuucaugaaaagcgggacuuugugaaaaagcugaagaccaugaaagaggaauugaugcaggaucuccagaauccuggagguaaccgcaucacacaaguccaggaggacauuaccaaucugaaggauaaaaucauuacugugaaggagagcaucauagagaaaacauguuuccuggaggaagagaagaagacccacgaaaaacuccgaaaggagauugagguucagcacaaacguuacgacgcuaucuuaaagagacugcauugccaagugaacaaacuucaguccaauaggcggcaguggcaguggaacauucaacaguuggaaaagacggccgcggagcugcgcaaguguaucggcaugcaggaauga

SEQ ID NO: 53893 - RNA, 3165 nt, Artificial Sequence
  derived and/or modified sequence opt3 from CCDC129__Homo_sapiens__NP_001244896
augagcgugucccugcagaacuacucucccaugauggcccaaaagucacagggcagugacaaucuccaggaggggcaggagaaaagcaagagagagauccuuaaaugcaccaaguccgcuugggcaccucuggaugaaugguugccaccggaccccgaggaagagucucaaucguuaacaauuccuaugcuggaggauucaaaacaggaaagcauacagcaguggcuagacaguggauucuuugucuccgccaacgagaauuuccaacagguuaucgauaggacugugucucucuaugaacaggguaugguacagaugacggugaaggacuacaugcggagccugcaccaauuuuccgagaccccaauucuuucacgcggcacaaguuucaacagcuguuauucuacugcguccgucccccagucaaucccugaguggcuggaauuuugggagauugauccaguggaaaucuugcucgaccugggguucggagcugaugagcccgacauaugcaugcagaucccugcccgauuucugggcugugguagcgcagcccgugggauuaauaucagaguuuuccucgaagcucaaaagcagaggauggauauugagaacccaaauuuauacggacgguuucgccagcuggagauccuugaccaugugaccaacgcauucaguucuuugcuguccgaugucagcauacuaccgaauagagccgaagagaaagcuggcggcgaaucggugcagaggacaucuguauccgccgcgaaggagcaccggcgccgaauggggaaacuccugagaagggcaucaaagcaaaacauucggcgugacugcaaucccgaaguuagugagagcuuuaaagugaaggacgaggucuucgugccuuuuaccaagccaugggauuguggagccgaacuugcugccacuuccaucaaccauaaacagaaucaccugucuuugagcguggagcaucagucacuccaggcaugcgacgaucuguuacccuauccuccacacggucugcucaguaagcaauggcccuguuccagcaugccggcuaaacaggccccucccucuugcgucucagaaggcaguguuaaggggcgcacacagaaagagaaccuuuuccagaccaauaagcugaaauccuugagccaccuagcgggaaagggcccagacucuuucgaaauggaggaggugcaaucguuugaagaggaaacggguaacccucuggauaugacuagcgggaccguaggagccagaguggacagggcaaacuccugucagucagauaguucuggcuuccucgaggagccccuggaaccacuuccccugcagaugccuagcuugccaaauucccagucaccggcugagaacggcgggcggaagccccgagaccaaagccauucucucgucuccagucaggauugccagcuggaaagcgacggaccugauucuaaaucccgcgccucaaugaguuuuagcucgcaagaggcuaaugccuuagaacagagagcauccgugucuguuauggaggaggaguuccugcuagaagccauggaagguccacccgagcucuacauuccugacauggcuugugcgaagacaacuaccaggggcgaaugcccacggaaagacagccaccuguggcagcuuuugcccaugccgcaugcagaguaugaggugacacgcccuaccgccacgucaaaguacgaucacccacugggguuuauggucacucacgugacagaaaugcaggacaguuucguaagacccgagggagcuggcaaaguucaaucccaucacaacgaaucucagaggagcccugguaaugaucauacccaggacaaguuucuccacguggauuccgaggcaccccgugaagaggagucaagcggguucugcccacauacuaaccacagucugcuugucccugaaucuuccagccaguguauccccaagcacucggagaucacaccauacgccaccgaccuggcccaaacgucagaaaaauugauuccgcaucuccacaagcugccuggcgaucccgcucaggugaaaucucggaguggaaccuuaggccagauacugccagggacagaggccgagauggaaaaucuaccccucaacacuggauccagccgaucugucaugacccagaugagcuccucacuggugagugcagcgcaaagagcuguugcccuugguacaggcccuagggggacuagcuuggagugcaccgugugugacccaguaacagcaaccgaaacucgccugggaacgaaggcccggcagcucaaugaugcuucuauccagacauccgcccugucaaacaaaaccuuaacucauggcccccaaccucugaccaagagugucagccuugacuccgguuuuucuucgauuugcccgauggggacaugucacgcaaucccagcucacugcuguauaugcugucaucaccauccccacugccauggcgagagacagagcccuggaccagaacccucaguguguaggcacugcuugugcucccucaccggccaccaggaggcccaguucaugacuacacugaaggcgcuacaagauacgaccguucgcgagcuguguaguugcacugugcaugaaauggaggccaugaaaacaauuugucagucuuuucgagaauaucucgaggaaaucgagcagcaccugauggggcagcaagcucuuuucagccgggacauguccgaggaagaacgugaagaggcagaacaguugcagacccugagagaggccuuaaggcagcaagucgcugagcucgaauuucagcugggagaucgcgcccagcagauccgggaggguauucuucugcaauuggaagugcucacagcagagccuccggagcauuacucaaaucugcaccaguauaacuggaucgaagagucuaauggccagacuagcugcaguaagauucaucccgggauggcgccaagaaccguauucccucccgacgacggacaagaagccccauguuccggcgguacgcagcuagcugccuucaccccucccacacuggagaacagcacuaggaugucuccaucauccagugcaugggcuaaacucgggccgaccccucugagcaauugccccgugggcgaaaaggaugccgacguuuuucuuuga

SEQ ID NO: 53894 - RNA, 1191 nt, Artificial Sequence
  derived and/or modified sequence opt3 from CCDC130__Homo_sapiens__NP_110445
augggcgagagaaagggggugaauaaauacuaucccccugacuucaauccagaaaagcacggaagccugaacagguaccauaauucccacccgcuccgggagcgcgcccgaaaacuuucucaggguauccugauuauacguuuugaaaugcccuauaacaucuggugcgauggcuguaagaaucauauugggaugggagucagauacaacgcugagaaaaagaagguuggcaauuauuacaccacaccuaucuauagguuccggaugaaaugccacuugugugugaacuacauugaaaugcaaacugacccagcaaauugcgauuacguaaucgugucaggugcccagcgcaaggaggagagaugggacauggcggauaacgaacaggucuuaacgaccgagcaugagaaaaagcagaaacuggaaacagacgcuauguuuaggcuagagcacggggaagccgaucggaguacucucaagaaggcacugcccacccuuagccacauacaagaggcccaguccgcuuggaaagacgauuucgcacugaacucuauguugcgccgaagauuuagggaaaagaaaaaggccauccaggaggaagaggagcgggaccaggcucuccaagccaaagcgucgcugacaauuccucuggugccagaaaccgaggaugaccguaagcucgcagccuuacugaaauuccauacucuugauucauaugaagacaagcagaaguugaaacgcacagagaucauuagcagaaguugguuucccuccgcuccuggaucugccagcuccucaaagguuaguggcgugcugaaaaagcuagcacagagcaggcggaccgcucucgccacgucuccaaucacugucggcgaccuggggauagugcgacgcagauccagggauguaccggaaucaccccagcacgcggccgacaccccuaaaagcggagagccacggguucccgaggaagcagcucaagaucgcccuaugaguccaggugacugucccccggagacaacugaaaccccuaaguguucuucccccagaggccaggaggggagcaggcaggauaagccacuuucgccugccggaucuucccaagaagcugccgacacacccgauacccgucauccaugcucacugggcaguagcuugguggcagacuacuccgauucugagagcgaguga

SEQ ID NO: 53895 - RNA, 351 nt, Artificial Sequence
  derived and/or modified sequence opt3 from CCDC134__Homo_sapiens__NP_001291726
auggaccugcuccaguuccuugccuuucuguucguguuguuacugagcggcaugggggcuaccggaacacuaagaacuucccucgaucccucucuggagaucuacaagaaaauguuugaagucaagaggcgggagcaacuucuggcauugaaaaaccucgcccagcugaaugacauucaccagcaguauaagauacuggauguuaugcucaaagguuuauucaaguuuaucccuucaacggacccauuccaaaaggcgcugcgcgaagaggaaaaacgacguaagaaagaggagaagagaaaagaaauuaggaagggcccgcggaucagucgcagccaguccgagcuuuga

SEQ ID NO: 53896 - RNA, 1305 nt, Artificial Sequence
  derived and/or modified sequence opt3 from CCDC136__Homo_sapiens__NP_001188301
auggaggccggcgcuggggcaggagccggugcggcuggcuggagcugccccgggccuggaccaacugugacaacucugggcuccuacgaagccucugaggguugugaaagaaagaaagggcagagguggggaucacucgagcggcgcggcaugcaagcaauggaaggcgagguccuucugccggccuuguaugaggaagaggaagaggaggaagaggaagaggaagagguugaggaagaggaagaacaggugcagaaagggggaaguguagguagcuuauccgugaacaagcaccgaggccugucucuaacggaaaccgagcucgaggaacugcgugcucagguccuucaacugguggcagaguuggaagagacaagagaacucgccgggcagcaugaggacgauucgcuggagcugcagggacucuuagaagacgagaggcuggcuucagcccagcaagcggaaguuuucacuaagcagauccagcagcuucaaggcgaguugcggagccugcgcgaggaaauuagucuacucgagcacgaaaaagaguccgaacugaaggagauagagcaggaacuucaucuggcacaggccgagauccaaucuuugagacaggcugccgaagauagcgcaaccgagcacgaauccgacauugcuucacuccaggaggaucugugcaggaugcagaaugaguuagaagacauggagcggauccgcggugauuacgaaauggagauugccagucugcgagcggaaauggagaugaagaguucugagcccuccgaagaacuccaagaacuuagagagagguaucauuuucugaacgaggaauaccgggccuugcaggagucaaauagcagucuaacagggcagcuggcagaccucgaaucugagcguacccagcgcgcuacugaaagauggcugcaaucccagacacuuagcaugaccucggccgagucucagacguccgagauggauuuccuggaaccugacccagagaugcaguugcucaggcaacagcugcgggaugcugaggagcagaugcacggaaugaaaaacaagugucaggaauuaugcugugagcuggaggaacuacaacaccaucgacaggugucagaggaggagcagcgcagacuccaaagggaacugaaaugcgcccagaaugagguccuucgguuucagacuagccacagcgugacccaguccucucccacaccuaacccacccaucuucagcuugccucugguaggccucguugugauaucagcacugcuuugguguuggugggccgagaccaguuccuga

SEQ ID NO: 53897 - RNA, 492 nt, Artificial Sequence
  derived and/or modified sequence opt3 from CCDC140__Homo_sapiens__NP_694583
augggcgacgagugcagcaaccccgaucugcucgccgaaccuggguccucuccaccgugggaccacggaaaucagagacaagaggcugcaaacgaaucaaauaccagggugccccggguccuuaaggcccaucuggguccugagacagcgcagccaacuaaacgcaguaagcgaaaccguuggagaaggcagagcugucagggccccuccccugcucggucugggcaauucuugggaucggccgauuuaggccugcagcgcgguguucuaaaaucagcagccagaacgugccucagcgaaaucaguaauuccaccagggcuucuccagagagcgcacaguccacagaccccgggcgggccgcucgcccucgaacuagaacccugccaacaccgcacucauuuaagauuggagaggaagccgaggaaaugaaaaagaagaaagagaggaagcggcguaaagagcgcaagaaagaaagaaacuucaagaaguga

SEQ ID NO: 53898 - RNA, 4593 nt, Artificial Sequence
  derived and/or modified sequence opt3 from CCDC141__Homo_sapiens__NP_775919
augagcucccagggcucucccucaguggcccugaguaccacaacugucagcuccguugcugugcaagcaggggacucuaagaucguaauugccgugauaaaaugcggaaaguggguccagcuccagcuugcggagucgcagccuaaccuguuggaaaucgguucaagccaagaugagacgaaaaaguuacugcacgaccaugaacuacuccuggcuaaacuuaaggcccuggaggauagagugugggaauugcuccaggaggcagacaagaccgccgaggaaaauaaagaucagagucagguuuacgacgcuauggcagagacacugggcgaagccugggcugcccugguguccaugcucgagaggcggacugaguuacugcgccuuaccucugaguucuuugaaaacgcguuggaguucgcaauuaagaucgaucaagccgaagacuuucugcagaauacacacgaguucgaaagcgcugagucccuaaaaucacuccugcagcuucaugaacaccauaccaaggagcuguuggaacgaagucucgcccuguuaaacaaaagccagcaacugacugauuuuauugagaaguucaagugugaagggccaaaugucaacccggagcucacacagggagcacacucuuccugccuuaaaguggaccgucuguuggagcuacugcaggauagaaggcggcaacucgacaaguaucugaaacagcaguggcaggaacuuucacaaguacugcagaucugucagugggaucagcaagagaaucagguuaccugcugguuucagaagacgauacgcaacuugcaggaacaaagccucggcaguucucuguccgacaaugaggacagaauccacaaacaggaagaguuaauuaucaaggcuaaagaguggaacagcgccguggaaaagcugaagucggaggcgcuaaggauucuccugucuaaagauuacgucgaaaaggagcaucuucaguugucccaccagaaacugucacaacuccaggaggaguucggucagcugaugguggaacggaauacuuggcuuaagaaagccaacgaauuuuucaauagugcaaacaaggcuuuugacgugcuggggcgcgucgaggccuauuugaagcuccugaaaagcgaaggauuaucccuggcuguucuagccgugcgacaugaggagcuccacagaaagaucaaagauuguaccacagacgcacugcaaaagggccagacucuuauaucucagguagauagcugcucaagucagguguccggcauucacgaaaugaugggguguaucaaaaggcgggucgaccauuugaccgagcaaugcagcgcccacaaggaauacgcucugaagaaacagcagcucacagcgucuguggagggauaucugcguaagguugaaaugucaauucagaaaaucagucccguguuaagcaaugcaauggaugucgguuccacccgcucugagucggagaagauccugaacaaauaccuugaauuggacauucaagccaaggagacgagccaugaacucgaggcugccgcaaagacuaugauggaaaagaacgaguucguguccgaugagaugguaucacugaguucuaaagccagauggcuagcugaggaacugaaucucuuuggccagagcauagacuauaggucccagguucugcagacauacguggccuuccuuaaaucaagcgaagaggucgagaugcaauuccagucuuugaaggaauuuuacgagaccgaaaucccucagaaagagcaagaugacgcaaaggcgaaacacuguuccgacagugcugaaaagcaguggcagcuguucuuaaagaaaucuuuuauuacucaggaucucgggcuggaguuccuuaaccugaucaauauggccaaggagaacgaaauauuggacgugaaaaaugaggucuaucucaugaagaacacaauggaaaaucaaaaagcagagcgggaggaacugagccuacugcgacucgccuggcagcugaaggcuaccgaguccaagccaggaaaacagcagugggccgcauuuaaggaacaacuuaaaaagacgucacauaacuugaaacuguuacaggaggcucucaugcccgugagugcccuggaucuuggcgguagccugcaguucauucuagaccuccgccagaaguggaaugauaugaagccucaauuucagcagcugaacgacgaaguucaguacaucaugaaagagucggaagaguugaccgggagaggagcgccagugaaggagaaaucccaacagcugaaggauuuaauccacuuccaccagaaacaaaaggaaaggauucaggacuaugaggauauccucuacaagguaguccaguuucaucaggugaaagaggaacugggccggcuuauuaagucucgcgagcuggaguucguugaacaacccaaagaauugggcgacgcccacgaugugcagauacaucucagaugcagccaggagaagcaggcuagggucgaccaucugcaccgucuagcacugucacuugggguggauaucauuaguuccguacaacggccucacuguucuaaugugagcgccaaaaaccuccagcagcagcuggaauugcuggaggaggacuccaugaaguggcgagcuaaagccgaagaguauggaagaacauuaucaaggagcguugaauacugcgcaaugcgcgacgagaucaaugaacucaaggauaguuuuaaggacaucaaaaagaaauucaacaaucugaaguuuaacuauacuaaaaagaacgagaagucucggaaucuuaaagcgcugaaguaccaaauucagcaggucgauauguacgccgagaaaaugcaggcuuugaagagaaaaauggaaaagguguccaacaagaccagcgacucguuccucaauuauccaucagauaaagugaacguccugcuagagguuaugaaggaccugcagaaacacguggaugacuucgauaaggugguaacagacuacaaaaagaaucuugaucucacugaacauuuucaggaggucauagaagagugccacuucugguaugaggacgccucugcaaccgugguuaggguggguaaguacaguacagaauguaaaaccaaggaggcugucaaaauccugcaucagcaauuuaacaaguucauugccccguccgugccccagcaggaggaacgcauccaggaggcaacugauuuggcccaacacuuauauggccuggaagaggggcagaaauacauugaaaagaucguuacgaagcacaaagaggugcucgaaagcguaacagagcugugcgagucucuuaccgaacuggaggaaaaguugaaacagggagacguccuaaagaugaauccuaaccuggaggacuuucauuaugauuacauagaccuccugaaagaaccagcuaagaauaaacagacuaucuucaacgaggagcgaaauaagggccaaguccagguggcggaucuuuuagguauuaacgggaccggcgaggaacggcugccccaggaccucaaggugagcacagauaaagaaggaggcguucaggacuugcugcucccugaggauaugcuguccggggaagaguacgagugugugucaccagacgauaucagucuucccccgcugccuggaagccccgaaucuccauuggccccuuccgacauggagguagaggaacccgugucaaguagccuaucccugcacauuucuucguaugguguccaagcaggcaccagcucaccaggggaugcucaggaguccguguuacccccuccaguugccuuugccgacgcuugcaaugacaagcgugaaacuuucaguucucauuuugagagaccguaccuccaguucaaagcagaacccccucugacaagcaggggauuuguggagaaguccacggcccuucaccgcaucucagcggaacauccagagucuaugaugagcgagguccacgaacgggcucugcaacagcacccccaggcccagggcggucucuuggagaccagagagaaaaugcaugcagauaacaauuucacuaagacacaagacaggcugcacgccaguuccgaugcuuuuagcgggcuccgauuccagucuggcaccucacgcggauaucagcggcagauggugccuagagaagaaauaaaguccacaagugcaaaaagcucgguugugucucuggccgaccaagcgccaaacuucuccaggcuucuaagcaacgucacuguaauggagggcucacccgugacccuggagguugaagugacgggguuuccggagccuaccuugacaugguacaagaaaggacagaaguuaagugcugauggucaucugcagguccuccacaaagaaacucgucacucuguguucauuccaaagguauguaaggccgacgcaggccuguauguggcccgcgcucaaaauuccagcggggcccuuucaaguaacgucauccugcauguuaccggaaauugccggcuccccauuacaagagugaacuggaucacuuuguguguggucuacgugagcguuucccugauguauuggcuacugacccaauga

SEQ ID NO: 53899 - RNA, 1338 nt, Artificial Sequence
  derived and/or modified sequence opt3 from CCDC148__Homo_sapiens__NP_001288613
augaagagaacccuggagaugaacguguucgucacacuccagauccuuguugacuuugugaaaaagcaacugaaaacuguauucgaaagguugcgguuagagcagcagcgcauugaaaaugaucugagcgacugguccauaaagauccuagaucacucucucgaggagaaaacgaacccccugucagagcuuccuauugagcuggaaaguuuggagugcccauacccggaccucaagagcuccauccugucugaauuuuauaaguucacccagaaauaccaaaagaaacugcaggauuuuaaucuccaguuagaggacauuuaucgaaacugucagcugucggaggaagaucauuggaucuaccaagccauacuugaccaguaucccggcgauuuguucgggcguagaacacuguaccuagacaugcuccagagguauuuuccucacaagucacggcaugaucugguggagcacgaaaaauacugcgaccaguaccgcuucgcuaucgagcaacagaauauucuuaucagcaacuggaauaagaacaagaaagauuuuauucagaaggcaguccugacuuugaccgaagccugugcgacacaugagauggagaguaugcucgcuaaagacaagaaaaagcaacaggaacugugcgccgacuuaaaagcaaaggugagacaguggagggcccaccaggaggaaguugcucggcuggagauggaaaucuccgcacgccgaagagagaaggaggaagagaaagaaaagcucuggaaaaagaaagagcuucugcaaagggccgaaaagaagaaaaagauaaagaaguauugggcuaaaaagaagcagaaauggcaggagauggagaugcgggauuugcagcgucuagaagaacugaagaaacucauugccgaacaaucucugaaggaccgcgagagagugaaauacaggcaggagcuucuggaacggcgauugauggagaagaaggaagucgcgcuccaggaggcacacgaagauaaagagcgcgccagaaggcuggaggcuuuacggaaacagguggccguaguugcacaauucgacccagugcgcaugaugagcgauaccauggcuuccaaagccagaaugggaaucgaaauugaggaagaguuuauccugcagaagccccuauucacucucaauacauauaacgaacagcagaucauuucagacccuaggcugcguuuugagcuugcguugcgggaggccggucugcaucgaacccucuacgcaaaagaaauacugccaaagaucaguccccaaaaaccuccaagaaaggauauggagagcacggucuucaagauuuga

SEQ ID NO: 53900 - RNA, 1626 nt, Artificial Sequence
  derived and/or modified sequence opt3 from CCDC151__Homo_sapiens__NP_001289382
augcaucccccuguggccccaugcaagaaacugagauguccgcccaccaggagcuucacaccuacucggggccgcuccaaggagggggaccgaaaagcauuuuucgaaucuucacaguggaacaucaagaaaaaucaagagacgauuagucagcuccguaaggaaaccaaggcucuugagcugaaauuguuagaucugcuaaagggagacgaaaaagucguucaggccgugauaagagaguggaagugggagaaaccauaccucaagaacaggacaggucaggcgcuggaacaccuugaucaccggcugcgcgagaagguaaaacaacagaaugcuuugagacaucaggugguccucaggcagcggcgccuggaggaacugcaacuccagcacagcuuacgacugcuugagauggccgaagcacagaacagacauacugagguggccaagaccaugaggaauuuggaaaaccggcuggagaaagcucagaugaaggcacaagaagccgagcacaucacauccguuuaucuacagcucaaggcuuaccugauggacgagucucuuaaucuggaaaaccguuuggauucgauggaggccgaagugguccgcaccaagcacgagcucgaagcgcugcaugugguaaaucaggaggcauuaaacgccagagacauugcuaaaaaucaacugcaguaucucgaggaaacucuuguuagggagcggaagaagcgagaacgcuacaucucagagugcaaaaagagagccgaagagaaaaagcuggagaacgaaaggauggagcggaaaacacaccgcgaacauuugcuacugcagagcgaugacaccauucaggauagucuccacgcaaaggaggaggaacugagacaaaggugguccauguaucagauggaggugaucuuuggcaaggucaaagacgcuacggggacugaugaaacccacucucuugugcgucgguuccuggcccagggagacacauuugcgcaguuggagacucucaagagcgaaaaugagcaaacccuggugcgauuaaaacaggagaagcagcagcugcaaagagaacuagaggaucucaaauacuccggcgaagccacacuggucucacagcagaaacuucaggcagaggcucaagaaagguugaagaaagaggagcgccggcaugccgaagcuaaggaccagcuggagagagcccucagggcaaugcagguugccaaagacagucuggaacaccuugcuagcaagcugauacauaucaccguggaggauggucgcuucgcggggaaagaauuggacccccaagcagauaacuauguaccuaaucuccugggauuaguggaggagaagcugcuaaagcuccaggcccagcugcagggccacgacguccaagaaaugcuuugucauauugcuaaccgagaguuuuuggccucucuggaaggccggcucccagaguacaacacgcguaucgcacugcccuuagccacuuccaaagauaaguucuuugacgaggaaucagaggaagaggauaaugaagugguuacaagagcuagccugaaaauuaggagucagaaacuuaucgagucucacaagaagcaccgccgguccagaaggagcuga

SEQ ID NO: 53901 - RNA, 294 nt, Artificial Sequence
  derived and/or modified sequence opt3 from CCDC167__Homo_sapiens__NP_612502
augaccaagaaaaagagagagaaccugggcguggcccucgaaaucgacgggcuugaggaaaaacugagccagugcaggcgggauuuggaggcugucaauucccgcuuacacucucgagaacugucacccgaggcacguagaagucuagagaaggagaaaaacagccucaugaauaaggccuccaacuacgaaaaggaacugaaauuccuuaggcaagagaaucggaagaacaugcuguugucuguugcgauuuuuauacuccugacacugguguaugcuuacuggacuauguga

SEQ ID NO: 53902 - RNA, 1509 nt, Artificial Sequence
  derived and/or modified sequence opt3 from CCDC169-SOHLH2__Homo_sapiens__NP_001185839
auggagacccugcaggaaagccucaacacacuucugaagcaauuggaggaagagaaaaagacuuuagaaucccaggugaaauacuaugcccugaagcuagagcaggagucuaaggcuuaccagaaaaucaauaacgaaagaaggacguaucucgcagagaugucacaaggcagugggcugcaccaggucagcaagcggcagcagguugaccaacuuccccgcaugcaggaaaaucuggugaaaaccuugcuccugaaggaggagcuggauccucucaaagccaagauugacauauuacugguaggagaugugacagucgguuaccuugcggacacugugcagaaauuguucgcuaacaucgccgaaguuaccauuacaaucuccgauaccaaggaggcagccgcucugcuagacgauugcauuuuuaauauggugcuccugaaggucccaucuucgcuuucagcagaagaacuggaagccaucaaauugauacgauucggcaagaaaaagaacacucauagccucuuuguguucaucauuccggagaauuuuaaaggguguaucaguggacacggcauggacauugcucugacagagcccuuaaccauggaaaagauguccaacguaguuaaauauuggacgacuugcccuucuaauaccgugaagacagagaacgccacugguccagaggagcuggggcucccccuucagcguagcuacuccgaacaucugggauauuucccuaccgauuuguuugcguguucagagagucuaagaaauggcaacggccuggagcucaaugcaagccugucugaguucgaaaagaacaaaaagaucucccuucugcacucaagcaaagaaaaguugaggcgggagcgcauaaaauacugcugugaacaacucagaacacuguuaccauacgucaaggggaggaagaaugacgccgcuagugugcuggaggccaccguggauuaugucaaauacauucgggagaagaucucucccgcaguuauggcucagauuacggaagcccuacaguccaacaugcgcuuuugcaaaaagcaacagacuccuaucgagcucagccugccaggaacagugauggcgcagcgagaaaacucgguaaugucuaccuauuccccggagagaggucuucaguucuugacuaauacauguuggaacggcugcucaacccccgacgccgagaguagccuggaugaagcagugagggucccuuccucuagcgcuucagagaaugccaucggggacccauacaaaacgcauauuaguuccgcugcccucagccugaacucucuucacaccgugcgguauuacucaaagguuacacccaguuaugacgcaacugccgugaccaaucaaaacauaagcauccaucugccuuccgcuaugccacccgucucuaaguugcucccgcgucacuguacaucgggacugggccagacuugcaccacacacccuaauuguuuacagcaguuuugggcguacuga

SEQ ID NO: 53903 - RNA, 2148 nt, Artificial Sequence
  derived and/or modified sequence opt3 from CCDC170__Homo_sapiens__NP_079335
augagccuggacugcaccucccacaucgcccucggcgcugcaucucccgccccugaggaaacauacgaucaucuuucagaggugccagucacuagagaacagcugaaccacuauaggaauguugcgcaaaacgcucggagugaguuggccgcaacguuagugaaguucgaaugugcccagagcgagcugcaggaccuacgcuccaaaaugcucucuaaggagguaucgugccaggaacugaaagcugagauggaaucauacaaggagaauaacgcacgaaaaagcagucuucugaccuccuugcgugauagagugcaagagcucgaagaggaaucugccgcucugagcacauccaagauuaggacugagauaaccgcccaugcggcaaucaaggaaaaucaggagcugaaaaagaaagucguggagcucaacgaaaaguuacagaaauguucaaaggagaaugaagagaacaagaaacagguuaguaagaauugccggaaacacgaagaguuucugacacaacuucgcgacuguuuggauccggacgagagaaacgauaaggccagcgacgaagaucugauucuaaaacucagggaccugcggaaggagaaugaguucgugaaagggcagaucgucauucuugaagaaaccaucaacgugcaugagauggaggcuaaggccucucgcgaaacuauaaugcgacuggcauccgagguaaauagagaacagaagaaagcugccucaugcacagaggagaaggaaaaauugaaccaggaucuccugagcgcgguugaggccaaggaagcauuagagagggaagugaaaaucuuucaagagcggcugcucgcuggacagcaggucugggacgccaguaagcaagaggugucucuucugaagaaauccagcucggaauuggagaagucucuaaaggcuucccaggaugccgugaccacgucacagagucaguauuucagcuuucgugaaaagauugcagcccugcuccgcgguagacuguccaugacuggcucuaccgaggacacaauccuugagaaaauuagggaaauggacagccgggaggaaucacgagaucgcauggucagucaacuggaggcucagaucuccgaauugguugagcagcucgggaaggaaagcggauuccaccagaaggcgcugcaaagagcacagaaagccgagaauauguuagagacucugcagggccagcuaacccaccucgaagcugagcuggugucuggugggguacuuagggacaacuugaacuuugaaaagcaaaaauaccugaaguuccucgaucagcugucacagaaaaugaaacuugaccagauggccgcagagcugggauuugauaugcgguuggacgugguccucgcccgcacagagcaacuggugagauuagaaaguaaugcuguuauagagaacaagaccauugcccauaaucugcagaggaaacuaaagacgcagaaagaacgucucgagagcaaggaacugcacaugucccuuuugcggcagaaaaucgcacaacuggaggaggaaaagcaggcgcgaacugcucucguggucgagagagauaacgcccaucugacaauuaggaauuuacagaaaaagguggaacgccugcaaaaggagcuuaacaccugucgggacuugcacacugaacucaaagcaaagcuggccgauacaaaugagcuaaaaaucaagacccuggagcagacgaaagcuaucgaagaccucaacaagucuagagaucagcuggagaagaugaaagaaaaggccgagaaaaagcugaugucgguaaaaagcgaauuggacaccacagagcacgaggcaaaggaaaauaaggagagggcucgcaacaugauugaaguugugacuuccgagaugaaaacccugaagaaaucauuagaggaagccgagaagcgagaaaaacagcucgcggacuuccgggaggucgugagucaaaugcugggccuuaaugucacaucucuggccuugcccgauuaugaaauaaucaagugccucgagcgucuggugcauagccaccagcaucacuuuguuacuugugcuugccuaaaggacgugaccacaggccaggagagacauccucaggggcaccuucaacuccugcacuga

SEQ ID NO: 53904 - RNA, 3981 nt, Artificial Sequence
  derived and/or modified sequence opt3 from CCDC171__Homo_sapiens__NP_775821
augaaccugaauaccagcuccaacacaggcgacacucagagacucaagaucgccucucuugaugugaaacaaauucugaagaaugagacggaauuggacauaaccgauaacuuaaggaaaaagcugcacugggcuaaaaaggagaagcuagaaaucacaacuaaacauaaugcagagcucgccucauacgaaagucagauugcgaagcugcggagcgaggucgagaaaggggaagcccuucgccagucccuggaguaugacuuggcuguugcacgaaaggaagccggacucggucguagagcugcagaggagaggcuggccgaagcucaccggauccaggagaaacugugcgcccaaaacucugaacuccaggcgaagaccaaugagacagaaaaggcauuccagaccucgcagcaaaaauggaaggaggagugucgcagauuugaacaugauuuagaggaaagggacaacaugauucagaauugcaaccgggaguacgaucugcuuaugaaagaaaagucacgcuuggagaaaacucugcaggaggcccuagaaaagcaccagcgagagaaaaaugaaauggagagccauaucagagaaacagcucucgaggaguucaggcugcaagaggagcagugggaagccgagcggcgugagcuucaguuuauagugcaagaacaggacaccgcaguacagaacaugcacaagaagguggagaaacuggaaacggagcacauggauuguagugacuugcuccgcagacagacuuccgaacuggaguucucuacccaaagggaggaacgguuacgaaaggaguuugaagcuacaacucugcgcgucagaaaacucgaggaaaauaucgaggccgagagggcggcccaucuugaaagcaaguucaacuccgagauuauccagcugcggauucgcgauuuggaaggcgcacuacagguggagaaggcuucacaggccgaagcuguugccgaccuggagaucauaaagaaugaguuuaaggaaguggagagugcauaugaaagagagaaacacaacgcccaagagagcuucgcuaagcucaaccugcuugaaaaagaguacuuuucuaagaauaaaaagcugaacgaagauauugaggaacagaagaaagucaucauugacuuguccaagaggcuccaguauaaugagaaaucaugcagcgagcugcaggaagaguuagugauggcgaagaaacaucaagcauuccugguagaaaccugugagaacaauguuaaggaacuagagaguauccucgacucuuuuacaguguccgggcaguggaccagcggaauccacaaggauaaagacaagcccccuucguucucugucgugcuggagcgucuucggcgaacguugacugauuaccagaacaaacuggaagacgccuccaaugaggaaaaggcuugcaacgagcucgauucaacaaaacagaagauugacagucacaccaaaaauauaaaggaacugcaagauaaacuugccgacgugaacaaagagcugagccauuugcacacuaagugugcagauagagaggcccucaucuccacacugaaagucgaauuacagaauguucugcauugcugggagaaggaaaaagcucaggccgcacaaucugagagcgagcuacagaagcucucacaggcguuucacaaggacgcugaagagaaacugaccuuccuucauacguuguaucagcaccugguggccggcuguguacucauuaagcaaccagaagguaugcuggauaaauucaguugguccgaguuaugcgcagugcugcaggaaaacgucgacgcccuuaucgcugacuugaauagggccaacgagaagauacgccaccucgaguacauuuguaaaaauaagagcgauaccaugcgggaacugcagcagacacaagaggacacuuuuaccaagguggcagaacagaucaaagcucaggagucuugcuggcauagacagaagaaagaacuagagcugcaauacucagaacucuuccuggaaguucagaagagggcccagaaauuucaagagaucgcggaaaagaacauggagaaacuuaaccacauugaaaagagucaugagcaguuggugcuggagaauagccacuucaagaaauuacucucccagacacagcgcgaacaaaugucucugcuugccgcuugcgcacugauggccggggcuuuguauccgcucuacucgcgaagcugugcccuguccacucagcgggauuuucuacaggagcaggucaacaccuucgaacuguuuaagcucgagauccguacacuggcacaagcgcuuucaaccguggaggagaaaaagcaggaagaagccaaaaugaagaagaaaacuuucaagggauugauuagaauauuuaggaaaggcguaaucgcuguucuggccgcaaaucgcuuaaagauucucggccagaguugcgcuucucuguucacguggauggagagcuuuaaagaagggaucggaaugcuuguguguacaggugagccccaggacaagcacaaguucccuaaacaucaaaaggagcagcugcggugccuacaggcccucuccuggcugaccucaagcgauuugcuggcagccaucauuucuuccauggcugaauuacaggacgucauaggcaaagcggauccaaacaguagaaucugugggcaccuccugauuggagccgcaaagaauagcuuugcuaaacuuauggacaagaucucucuggugauggagugcauucccuugcauuccucaaggaguaucacuuaugucgaaaaggauagccucgugcaacgacuggcccacggccuacauaaaguuaacacccuggcccuuaaguacggucuccgcgggcacgugccuauaacaaaaucgaccgcuucccugcagaagcagaucuugggauucacucaacggcugcacgcagccgagguagaaagaaggucuuuacgucucgaggucacagaguucaaacgcagcgugaaugaaaugaagaaggagcuggacaaagcgcagggccuucagaugcagcugaacgaauuuaagcaaucaaaauugauuacgcaugagaaguucgaaagugcuugugaggagcucaauaacgcccugcuacgggaggaacaggcacagaugcugcuuaaugaacaggcccaacagcuccaggagcugaacuauaaauuggaguuacacuccucugaagaggcugauaagaaucagacccugggcgaagcaguuaagagccucuccgaggccaaaauggaacugagaaggaaggaccaaucacuucgacagcugaaccggcauuugacucagcuagagcaagauaaacgcagacuggaggaaaauauccacgacgcggagagcgcucucaggauggccgcaaaggacaaagaaugcguggccaaccauaugcgggcugucgagaacacacugcacaaggugcgagaucagauuagucuuucuugguccgccgcaagcagaaaugacuuuaccuuacagcugccaaaacuccacuuggaaacauucgcuauggaggggcugaagggaggucccgagguaguggccugucaggcgaugaucaagucguuuauggauguuuaccaacucgccucaacucgcauaaugacccuggaaaaagagaugacgucucauaggagucacauugcagcucuuaaguccgaacugcauaccgccugcuugcgugagaacgcuagccuacagucuaucggcagccgggaccacuccaaucugucaauuccuaguagagcaccacucccggccgauacaacugggaucggagacuucuuaccccugaaagccgaacuugauaccacauauacuuuucugaaggagaccuucauaaacacggucccucacgcucucacaagcucucauuccucaccagugaccaugagugcgaaugcaaacaggcccacucagaucggcuuguga

SEQ ID NO: 53905 - RNA, 2382 nt, Artificial Sequence
  derived and/or modified sequence opt3 from CCDC175__Homo_sapiens__NP_001157871
auggcccugagccccuggaccccuggccucggggcuggagagaaacuugugcaggcagccgcggucuccacagguccaucucuggaauugugcacuuuaccgucaacgcugggcaguagcguugcuguggaggcccuagaacaacucuucguaguggagcagucccugcagucugacuacuuuaaauguaacgaagaggcaaagaucuuccuuaaagauauugccgucgcugugaagaaacuggaggaaaugagaaaggcaaccauagacuugcucgagaucgaaucgauggagcugaauaagcuguauuaccucuuagagacacugcccaacucaauuaaaagggaacuugaggaaugcguucgggaugcccgccgauugaaucuguuugagaucaacacuauuaagaugcguaucaccagaacagaaaaugagauagagcuacucaaaaagaaaaucaccgaccugacuaaguauaacgaagcucuuggggagaagcaggaagaacuggccaggaaacacgcgcgguucguguugagccucaaucaaacaauggaaaagaaagcaaccacgacugucuacauuaacgagaccuauacaaagaucaaucugaaacgcgaggauauugccuuacagaagaaauguauccaggaagcugaggaacugauggagaaggaaagagccgaguaccucauaaggaagcaggagcuuacugcacaaauuaacgaauuugagaauacccgggaagugaaacgcauggagacauaucagaagaaaaaggagcuggacaaauugcagaccaagaugaguaagaucaaagaaacgguaacuguuuccgcugccgugcuaucugaucauaaccuggagauugcgcgacuccacgaaagcaucagauacugggagcaggaagucuccgagcugaagaaagaccuugccauccuggaggcaaaguugugcuucuuuacagauaauaaagaaaagcucgacgauauuucaaacgacgagaagaaugaguuccugaacaaaauaaagcaauuaguggagacccugcaugcugccaggauggaauacaaagaucuacgggagaagaugaaaacucucgcucgucaguauaagaucgugcugagugaggaagagaaggccuuucuucagaaacaaaagauucacgacgaaaaccagaaacaguugacauucaucagccagaaggaguacuuucugucucaaaaacgcgucgacauaaagaauauggaagagggacucauuacccugcaggagcuucagcaggcaacgaaaaccguuuaucaacagcagaucaagauccuguccgccaacuuggaaagagagucacagaggugugugauuacacaauggaagauggcuugccuccggaaaaagcaugcgcgauggacugcaaaaaucaaggccgaaauucaggcuauaaccgagaaaauccagaaugccgagguacgcagaauugaacuguuaaacgagacuagcuucaggcagcaagaaaucaguggcuuuguggcacagaucgagaagcugacaaccgaacuaaaggaggaggaaaaagccuucgucaauaaggagaaaaugcucaugaaggaacugucuaaauacgaggaaauuuucgugaaggagacacagauaaacaaggagaaagaagaggaacuuguugaguauuugccucaauuacagguggcugaacaggaguacaaggagaaacggcgcaagcucgaggaacuguccaauaucauuaccgcccagagacaagaagaggauuuacugaacaaucacaucuuucuuuucacuagggacuuuagccguuauauuucgaacauggaggaugucaaacaggaauugcagcagcuccgggaccaagagucuaagaagaauaaagaucacuucgaaacgcugaagaaccuagagaaugguuuuuacaucaacgaccagaaagcagaucugcuccugcuugaaaauaagaaauugaaggaguacauacuguaucugaaaaacaacaucgagaaguaccgagaagggcaggaggcgcucaugcauacauccucagaccugaguagacagcuuauugcucaagaagcccaguauaaggaucugugggcagaguuccagaccacugugaaaaucuugguagacaauggagaagagacccuccaagauauuaacaaucugacagacaagcuaagggagcgcgacgaaaagaugcagcacguuagcaccuggcugcggggcucccucgagggccugagacuuuugguggaacaggagucuccaauggaucuguuaaagaaaaagaagcauaucaggacucgcguccacuuucccguggucaaauguacagaaaagaacacgcucaccaaauga

SEQ ID NO: 53906 - RNA, 1590 nt, Artificial Sequence
  derived and/or modified sequence opt3 from CCDC176__Homo_sapiens__NP_079333
augcccagcaagggcaaagacaagaaaaaggggaaauccaagggaaaggauaccaaaaagcugaucaaaacagacgagucuguggucgauagagccaaggcuaacgcaucacucugggaagccaggcuugagguuacugaacugagucggauuaaauaccgcgacacgagccgaauauuggcgaaguccaaugaggauuuaaagaaaaagcagugcaaaauggaaaaggacaucaugucugugcugucguaucuaaagaagcaagaucaggagaaagacaacaugauugagaagcucaagcagcagcugaaugaaaccaaagagaaggcucaagaagagaaagauaaacuugagcagaaauacacacgucagaucaacgaacuggagggucaguuccaccaaaaggccaaggaaauuggcaugauccauacugaguugaaagcaguaagacaguuucagaagaggaaaauacagguggaacgggagcucgacgaucugaaggagaaucugcgcaacaccgaaagaauccaccaagagacacucaggcgguuagaaucacgcuucuuugaggaaaaacaucgacuggagcaggaggccgaaaagaagauuaucaugcuugcugagagagcacaccaugaagccauuguccaguugaaugacgcugggaggaacguguucaaagagaaugauuaucugcaaaaggcccuagcguaccaccucaaagaaaccgacgcacugcagaagaacagccagaaacuucaggagagucacacucuguugcuccaucaaaaggagaucaaugaccuguuaguuaaggaaaagauaaugcagcuggugcagcagcggucccaaauucagacacuccagaagaaagucgugaaccuugagaccgcccugucuuauaugacgaaggaauuugagagcgagguauugaaacuacagcaacacgcuaugaucgaaaaucaggccggacagguugagauugauaagcugcagcaucuccugcaaaugaaagaccgugaaaugaaccgcgugaagaaacuugcuaaaaauauccuggaugagagaacugaagucgagagguucuuuuuggacgcacuccaccaggugaagcagcaaauccugauuucccggaaacacuacaagcagauagcccaggcggccuucaacuuaaaaaugcgagcagcuuguaccggccgcacagaguauccuaagaucagaacuuuugaugguagggaacauucaaccaacagugugaaucaggaccugcuagaggccgaaaaguggacacacauugaggggaacgucgauaucggagaccucaccugggaacaaaaagagaagguucugcggcuuuuguucgcuaaaaugaauggcugcccaagccgcaaguacaaccagucuuccagaccgcccgugccugauuacguagugucagacagcggcgagacgaaagaauuuggggaugagaguaagcugcaggacaagauauucauuacucagcaaaucgccaucucugacuccagcggagaagucgugcucccaacaauucccaaagagccucaggaaucggauaccgguacuuuuuga

SEQ ID NO: 53907 - RNA, 2604 nt, Artificial Sequence
  derived and/or modified sequence opt3 from CCDC178__Homo_sapiens__NP_001098998
augaccgagaacaagacagugagcuccucuucaacuagagacgaucagacgaauaucggccugaccugccaagaagucaaagcccucagggagaaggcuuggagucggacaaacgaagggaaugcaaugagccagucccuuguucuguacggagccucuaaagagaacucggaagguuuccacgagucaaagaugacuaauaccgagggcgugaacaaagggauuuauuuuagcuaccccugucgccgacauaguugcgcgguagugaauauaccugcuccaugugucaacaagaugaucucccacauucaggacguggaaucuaagauccaggagcauuugaaacguuucgaaaccagcuuugaggagugguccagaacaucaaguacuaaggauuuaaaagaagacuggagcguuacaaccccggugaaggaggucaaacccggagaaaagagggaugagaagugcccugaacugaaacaagagauggagacgcuacucucugaagccauucggcugaucaagucccuugagacugaccgcgcagaugccgaagaggcucugaaacagcagagaucaaggaagaauaugauaaacaugaaaaucgacagcuggaguguguggaaguugcaggaacucccacuggcaguacaaaaagagcacgaggccuaucugucugauguuauugaacuccaguggcauuuagaggacaaggcuaaucagcugcagcacuucgaaaagcaaaagaccgagcuugaagaggccaacgcgaagauccaggcagauauugacuacaugaaugagcacggccccuugcuggauuccaaacagaaccaagaacuacaggaccucaagaaucauuauaaaaagaagauggaggugauggaccugcaccggaaagucaacgaagaacuugaggaagcccuggaggcuugugaaaacgcccgcuugaaggcacagcagaucaaagaggaaauagauaaggacauuuaccaagaugagaaaacaaucgaggcuuauaagcgagaaauuuaccagcucaauagccuguuugaccauuacucgucuuccgugaucaacgugaauacuaacaucgaggaaaaggaggaagaggucaccgaggccauuagagaaacaaaaucaaguaagaaugaguuacacagccuguccaaaaugcucgaagaucuuaggcggguuuaugaccagcugaccuggaagcagaaaucucacgagaaccaauacuuggaagcggugaaugauuucuaugccgcaaagaagacgugggacauagagcuaagcgauguagcuaaagacuuuucagccaucagucuggcuugcacuaagcucacagaggauaacaaaaagcuggaaauugacaucaauaaaauaaccgugaagacuaacgaguccauucguaaaaagagcaaguacgaaucugagaucaaauaucuuacaaucaugaagcugaaaaaugacaagcauuugaaaaacauuuacaaggaggccuaucgcaucgguacccucuuccaccugacgaagcauaaaaccgaugaaauggaggacaagauugcagaagucagaaggaaauuuaaggggcgggaggaguuccugaaaaaguuaacacagggagagguggccgcuggcaugguucuacagaagaaacucuacucaauauacgaggugcaggcgcuggaacgaaaggagcuuaucaaaaaucgcgcaauuugugccaugaguuuggcugaacugcaagagccucuccugcagcuugaagaugaggccgagagaaucaggagccuggacaaggaacacuccgucauguugaacaauaucauugaucagaaagaccucauacggcgcaaggugggcaagguuaaaaagaaacugagaaagaaagggaagaaaacuuuagaugcacugaucgagaccgaaucuaagaggucggccauuuuuaaggaccuagaggcuacaaaaagcaagacuaugaucuucuaugccaaaauuaacgaacucaacgaggagcugaaggcaaaagaagaggaaaagaaguccuuugaucagacccuugagaucuugaaaaauaaguucauaacaaugcguuucaaacgggagcaugcgcaaaccguauuugaccacuacaugcaggaaaagaaagauugcgaggaacgaaucuucgaggaagaccagagauuuagggugcugcucgcuguccgccaaaagacucugcaggauacgcagaagauuaucgccgacucauuagaggagaaccugcggcuugcacaggaauaucaacaguugcagauuacauuccucaaagagaaggacaauuacuuuaacaucuaugauaaacagcugagucuagacaccucuauaagagauaagaaacaacugugucagcuccagaggcgcaugcacacucuguggcaggaacauuucaaacuuguggucuuguuuagccaaaugcgacuggccaauuuccagaccgacucccaggagucaauucaaaagaucuuagcugugcaggaagagagcucuaaccucaugcagcacauucugggauuuuuccagacacuuaccgaugguacuugcgagaaugacggcuga

SEQ ID NO: 53908 - RNA, 5106 nt, Artificial Sequence
  derived and/or modified sequence opt3 from CCDC180__Homo_sapiens__NP_065944
augagaggcggggagaacaggcccccugcccgggugcagagcuccucugaggaacuggaacuccgccaccagucacuugacgcuuucccaggacgacgucugccggguagaggcauccagcccgcagccaagaugaguagcgucgggaaaguuacccaggugccuaauggaaaggcguaccagcaaauuuuucaggcugagguacaguuggugcauuccuuagccgcuacaaggaaacgggccgcugaacgcucuguaacucugaagucgggcagaauaccaaugaugaaaaagguggagacgcccgagggugaaguuaugucaccuaggcagcaaaaguggaugcacagcuugccaaacgauuggaucauggagaaucccgugcuccaucgggaaaaagagcgcgcuaagcgagagaaagccagagaaagugagaacaccauugcugccagggaaguccgggggcugauggacacaaucgugccugagaagauuuccacuucuaccuuccagcgucaggcggaacacaaacgcaagagcuaugaguccgcacuugccucauuucaggaggaaaucgcucaaguaggaaaggagauggaaccacugauaguugauacaggcggcuuguuccucaaaaagcugaccgagagugacgaagagaugaauagacuguuucucaaaguggagaacgauacuaauuuagaagacuacacaauccaggcccugcuugaguugugggauaaggucgcagggaggcugcugcuccggaaacaggaaauuaaggagcuggacgaagcacuucacagccuggaguucucucgaaccgauaaauugaaguccgugcucaagaaauaugccgaggugaucgaaaagacgucauaccugaugcgcccggaggucuauagauuaauuaacgaagaggcgaugguuaugaauuacgcccugcucggaaacaggaaagcacuugcucaacuguuugugaauuugauggagagcacucuacagcaggaacuggacagucggcaccgcuggcagggucucguagauaccuggaaggcccugaaaaaggaggcacuucugcaaucuuucuccgaauuuauggccagcgagucgauccacacacccccugcagugacuaaggaauuggaggucaugcucaaaacccagaacgugcugcagcagagaagguuaaagcaucugugcacaauaugugaccuacucccacccucuuauuccaaaacccaacugacggaguggcacucaagucuuaauagcuugaacaaggaacuggauacuuaccauguugacugcaugaugcguauucggcuccuguacgagaaaacauggcaggaaugucuuaugcacgugcagaauugcaagaagcagcuguuggacuggaaagccuucaccgaggaagaggcugagacucucgucaaccaauuuuucuuucagauggugggcgcgcugcaggggaagguagaagaggauuuagaacugcuagacaaauccuucgagacacucgcagaucagaccgaauggcaaucuagccaccuguucaaguauuuucaggagguugugcagcuuugggaggcccaucaaucagaauugcugguccaggagcucgaacuggagaaacgaauggagcagcacagacagaagcauaguuuagaaucccaagugcaggaggcucaccuggacaggcuuuuggaucagcuccgccagcaaagcgacaaggaaacgcuggccuuccaucuagagaaagucaaggauuaccugaaaaacaugaagucucgguaugaauguuuucacacccuccugacaaaagaggugauggaguacccugcaaucaugcuuaaggaacuaaauucauauaguagcgcccugucccaguacuucuuuguuagagagauuuucgaacagaacuuagcuggagaggugaucuuuaaauucaggcagccagaagcccacgagaagcccucucaaaagcgcgucaagaagcuccggaaaaagcagggcucgaaagaggacaugacuagaagcgaagaguccaucucaagugguaccucuacagcacguagcgucgaagagguggaagaggagaaugaucaggaaauggaguccuuuauuacugaagagguucuggggcaacagaagaagucaccgcuucaugcgaaaauggacgagagcaaggaaggaucuauacagggccuggaggaaaugcaaguggagagagaaggcuccuugaacccuagucucaaugaggagaacgucaaagggcaaggagaaaagaaagaggaaagcgaggaagaggaugagaaggaagaggaagaggaagaggagaagcuggaagaggaaaaagaggagaaggaagcucaggaggaacaggagucucuauccgugggugaagaggaggacaaagaagagggccuggaagagaucuauuacgaagacauggagucauucaccauuaguagcgggaauacauacuuuguauucgugccccucgaggaggaacacugcaggaagucgcauuccaccuuuucugccauguucaucaacgauacuagcucagcaaaauucauagaacagguuacgauuccaagucgccugauccuugagaucaagaagcaauugcgggccggauuuuucgaacaccuggagaaaugguuugaccaguguuccuuaaauacaagagucaccguggcuacuaagauuaacgagcucgauucugaacuggagcuucaucugcaucuacaccagccuagggcccagcaaaucgaaaaagacauucauaaugugcgagcagcugagcuccuguugcaccaggagcagcuggauagccauugcgccggcgucaccgaaacauuaaagaaaaagcgccucauguucugucaguuucaagaggaacagaacguucgguccaaaaauuucagacugaagauauaugacauggagcacaucuuucuuaacgcgaccaggucacagaagcuggugacuuugagcaauacacuccaccaagaacugcuaaguuacguggauguaacgcaggucucucugcguuccuuccgccaguaucuugaggagagccucgguaaacugcgguacucgaacauugaauuuaucaagcauugcagauuguucucagaagggggcaacuuuucucccaaagaaaucaauagucuguguuccagguuagagaaggaagccgcucgaauugagcucguggagagcguuauaaugcugaacauggaaaaacuugagaaugaauaucuggaccaggcaaacgaugugaucaauaaguucgagucuaaguuucacaacuugagcgucgaccucauuuucaucgagaaaauucaacggcugcuaaccaaucuacaggugaagaucaaaugccagguugccaaguccaacucacagacuaauggacuuaacuucagucuccaacagcugcagaauaaaauaaagacaugccaggagagccgcggcgagaagaccacagugacuaccgaagaguuguuaucuuuuguacaaacguggaaagaaaagcugucccagagaauccaguaccucaacuguucacuggauagggucaguaugaccgagcuuguguucacaaauacuauucugaaagaccaagaggaagauagcgacaucuugaccuccucugaggcucuagaagaggaagccaagcuggacguggucacaccagagucguuuacucagcucagccggguugggaaaccccugauugaggauccugcaguggacguaauccgaaaacuuuuacagcugccaaacaccaaguggccgacgcaucacugcgauaaagaccccucacagacaggaagaggugcgugggccuguggcucccgcgggaguucugaagcuggagccggcggugcagugugcagcccuccaguccucuguuccugccccgggccuucaucuccaaagggcuucaaaaggcaucguugucaacccgagaauagcggaaagaaagcugugccgagugccuccgcaaccagcgccggcucuuuuacuccucacccaaagcccaacaagauggaacggaaauauagaguuuugggggauaagccucccccagcugcggaggacuucaaaggaauaauucugacacuccugugggaaucauccgagaaccuucugaccguggccgaggaauuuuacaggaaggagaaacgcccugucacucgacccgauugcaugugugacaccuucgaucagugcgcagaaaauaucaguaagaaaauuuuggaguaccagagccaggcuaacaaguaucacaauucgugucuaaucgaacugagaauacaaauccggagguuugaggagcucuuaccacaggugugcuggcugguuauggaaaacuucaaggagcaucacuggaaaaaguuuuucacaucugugaaagaaauucgcggucaguucgaggagcagcaaaagcgucuugaaaaacgaaaggacaagaaugcccagaaacugcaucucaacuugggccacccgguccacuuucaggagauggaaucccugcaucucagcgaggaggaacggcaggaggaacuggauucaaugaucaggaugaauaaggagaaacuugaagagugcacgcgccgaaacgggcaaguauucauuaccaaucuagccacuuuuacagaaaaguuccuguugcaguuagacgaggugguuaccaucgaugacgugcaggucgcuagaauggagccucccaaacaaaagcugaguaugcucauacggaggaagcuggcaggacuuucucugaaagaagaguccgaaaagccacucauugagcgcggcagcagaaaauggcccgguaucaagccuacagaagugacuauccagaacaaaauuuugcugcagccaaccucaaguaucagcacgacaaagaccacucuagggcaccuggccgcgguagaggcuagggacgccguguaccucaaguaucuugcauccuuugaggaggaacugaaacggauucaggaugacuguaccucucaaauaaaggaagcccagcguuggaaagauagcuggaagcaguccuuacauacaauccagggcuuguacgucuga

SEQ ID NO: 53909 - RNA, 1527 nt, Artificial Sequence
  derived and/or modified sequence opt3 from CCDC181__Homo_sapiens__NP_067002
augaacgagaauaaggacaccgauagcaaaaaguccgaagaguacgaagacgauuucgagaaagaccuggaauggcucaucaacgagaaugagaagucugaugccucaauuauagaaauggcuugcgagaaagaagagaacaucaaucaggaccuuaaggagaacgaaacagugauggagcacacuaagagacauagugaucccgacaaaagccugcaagaugaagucuccccuaggcggaaugacauuaucucuguuccaggcauucagccguuggaucccaucucggacucagauagcgagaacaguuuucaggaauccaaguuagagucucagaaagaccuggaggaagaggaagacgaggaagugcgccgauauauaauggagaagaucguacaagcaaauaaacuacuccagaaccaggagccugugaaugauaagcgugaaagaaagcugaaauucaaggaccagcuugucgaucuggaggugccacccuuggaagacacgaccacauuuaaaaacuacuucgagaaugaaaggaacauguuugggaagcucagccaacuguguauuuccaaugauuucggacaggaggacguucugcucucauuaacuaacgguaguugcgaggaaaacaaagaucggaccauccugguggagcgcgacggcaaguuugaacuuuugaaucugcaggauauugccagccagggguuccuaccuccaaucaacaaugcgaacucuacagagaaugacccccaacagcuccugccuagauccucaaacagcagugucucuggaaccaaaaaggaggauuccacugcuaagauacacgccgugacacauagcucgaccggcgaaccacuugcauauauugcccagccgccccugaauaggaaaacguguccuucuuccgcuguaaacucagaccggaguaaggguaaugggaaaagcaaccaccgcacucaauccgcacauaucucuccaguuaccagcacauacugcuugucaccccgacagaaggagcuccagaaacagcuggaagagaagagagaaaaguuaaaaagggaggaggaacggcguaagauugaggaagagaaagaaaagaaacgcgagaaugacaucguguuuaaggccuggcugcaaaagaaaagagagcagguccucgaaaugaggcggauccagcgagcuaaggagauugaagauaugaacagucgcgagaauagagacccucagcaagccuucaggcuuuggcugaaaaagaaacacgaggaacagaugaaggagcggcagacugaagaguugcgcaagcaggaagagugucuauuuuuccugaaaggaaccgagggcagagaaagggcguuuaagcaauggcuccgucggaaacgaauggagaagauggcagaacagcaggccgugagagagaggacacgccagcugcggcuugaagcuaaaagauccaagcaacugcagcaccauuuguauaugagcgaggccaaaccauucagguucaccgaucacuacaacuga

SEQ ID NO: 53910 - RNA, 1872 nt, Artificial Sequence
  derived and/or modified sequence opt3 from CCDC185__Homo_sapiens__NP_689823
auggccggcuucagccacuuuucccagcccccuuacagagaccugugggagccaccgaggcccgggggagaacgggagucuacccaacgccucgguggccagcgaucaggggcugauaguacagcaugcagccgugccggaacuccuggcgcggaauccgaggcuggugccuguuggcuucauccacacugcucuuucacgcccagaccuaggcggcgcggguguucggacucacugagaggaagcaggaguuuguccgauguggcacggcgcccauuagaacgaucuagaaagcauaggccccggagccgucgccuggaggacgccuggggcgagaccggcacaaaaccuagaccagcuuggcagccgcagacucaacuacccccucagaggccacagcccugcccucacuauccacucgcacagggggauucacccccgccuugucccggaggugccggcaccccacuguccgggacauuucgggucgaaaaggcucaaggaggcgaccagugggccguuccucuuggucgacaucuggggcgcuggagucccagcucugugccauccgagagaucaagcguacccagucagaaauucaagaggcacucugcgugcgugugugcacagaaacgggauuccagcgaccaagucgaaucguuggccucucgcgauucccagccucucgcuucaaguaaggagaugagaagcccacacacccaggugcugaaguccaaacuggaggaaguuguggucucuagccaagaccagcagaucguggcccucguauuaacuaggcugaagaaagcacagcguauucgggagcuucaacagcaggcugccaaggcgugggaagaguugaaacgaucagaucagaagguucaaaugacacuggaaagagagaggcgccuacuccugcggcagagucaggagcaguggcaagaaaaggagcagagaaaaacccuucaguccccggaacagaggggacugcgccgagacagccaacggaagaacgugcccccuggcgagucucguuggaaagaacagccagaggaucaggagucacccagacaagaaaaguuggagaaagccagggcacaggcugaacaucgcaagcagugccagguccggagacucagggagcaagagaaaaugcugcgaaauuuacgcgagcagcacagucugcagcuccagcggagacuuguggaggccuguaggaagcgucaucugcacgcuguggaaggccaaaagaaaguccaggacacgaacuugagcucccuaauaaauuaccaggcccgcaagguucugauggacugccaggcaaaagccgaggaacuccugcggcaacuuucucuggagcagucguuucagagaagccaagagauccaccagggguugaggaaggaacgacagcgggagcuccgcgaaaaagcucagaaggaggaagaacaacugcagcaggcgagauggagggcaggagaguccgaggaacagcggaagaugcgaaaaagaauuuuaguggaacuggccgaugagaagauccgccaagcuaggucacauguacacaaaacuacccgugacaaggugcagcaucuacgggaacucaaccaccugagagagaaaaaucaucacauucuuaaguugaaggccgagaaagaagagaagugucacaucgaagguauaaaagaggcaaucaagaaaaaggaacagaggguccagcauauuagucaaggcaaggauccuaacuuccaggaguuucagaaacugccacaggccucucgccgagaggaaagagcucccccgaauagcucccucgaccaaauggugcuggaggcccagcuucgggcaugccagcaaaacaggggguauuga

SEQ ID NO: 53911 - RNA, 1884 nt, Artificial Sequence
  derived and/or modified sequence opt3 from CCDC22__Homo_sapiens__NP_054727
auggaggaagccgacagaauccugauucacagccucaggcaggcuggcaccgcagugcccccugauguccaaacacuucgggccuucacuacggagcugguuguggaagcgguagugcgcugcuugcgagucauaaacccagcugugggguccggauuaucuccgcugcuaccccucgccaugucagcacguuuuagacuggccaugagucuugcucaggcauguauggaccuggguuacccuuuggagcucggcuaucagaauuuccuguacccaagcgaacccgaucugagggaccucuuacuguuucuugccgagcgguugccuaccgaugcuuccgaggacgccgaucagccagcgggggacucugcaauccugcuacgcgccauuggaucgcaaaucagagaucagcucgcucugcccuggguuccuccacaucuuaggacaccgaagcugcagcacuugcagggcucagcccuccaaaaacccuuccaugcaagccggcugguggucccugaauuaaguucccgcggugagccacgagaauuucaggcuucuccccugcuccuuccugugccaacucagguaccccagccgguugggagaguggccagccuguuggagcaccaugcgcuacaacugugccagcagaccggaagggaccggccuggcgaugaggacuggguccaccguacaucccgccugcccccacaagaagauaccagagcccagaggcagcggcugcagaagcaacuuacugagcaccuccgacagucauggggcuugcucggggcaccuauucaggcucgcgaccugggagaauuacugcaggccuggggugcuggcgccaaaacaggggcacccaagggaaguagauucacccauagcgagaaauuuacguuccaccuagaaccacaagcccaggcuacucaggugucugacgugcccgcgaccuccaggcggccugagcaggucacaugggcagcccaagagcaggaacucgagucacugcgcgaacagcuugagggcguuaacagaagcaucgaagagguggaggcugauaugaagacuuuggguguaaguuuugugcaggccgaaucugaguguaggcauuccaagcugagcaccgcagaacgugagcaagcccuccggcugaaaucgcgagcugucgaacuucugccagacgggacagccaauuuggcaaagcuccagcuggugguugagaacucugcgcagagagugauacacuuagcuggacaaugggagaaacacagggucccgcugcuagccgaauaucgccaucuccggaagcugcaggauugcagagagcuugaauccucaaggcgcuuggcagagauccaggagcugcaccagagugugcgagccgcugccgaagaggcacggcguaaagaagagguauacaagcaacucaugagcgaacuggagaccuuacccagagacguuuccaggcuggcuuauacgcagcgcauucuugagaucgugggcaauauucggaagcagaaagaagagaucacuaagauauugucugauacaaaagaacuccagaaggagauuaacagccugucaggcaaacuagacagaaccuucgccgucacugaugaacugguguuuaaggacgcgaaaaaggaugacgccgucaggaaggcuuacaaauaucucgcagcccugcaugagaauuguagucaacuuauccagacaauugaggauaccgggacgaucaugcgagaagugcgcgacuuggaggaacagaucgagaccgaacugggaaagaaaacauuauccaaccucgagaagauucgggaggacuacagagcucugaggcaggaaaaugccggucuucugggccguguucgcgaggcauga

SEQ ID NO: 53912 - RNA, 825 nt, Artificial Sequence
  derived and/or modified sequence opt3 from CCDC28A__Homo_sapiens__NP_056254
augcccagagccgagccuagggcuacccugggcgaacaggagaaggcagggcucccacuuggagccuggcggcuguacuuguuacgccacuuccgaaaacaaacagaacugcguagaagcgguuccagggacgugacuggcgcgcuacucgucgcugccgcaguugccucugaggcuguggggucacugcggguagcagaaggaggcccgaacacgcuucugcuucaggugcuccgcaguuggcccuggugcaauaaggagcugaaaaccauggaggaaagaaaggucaaaaggcggagcccuaaguccuuuucugcccauuguacacaggugguuaacgcuaagaaaaaugccaucccagugucgaagucaacugguuucagcaaccccgcgagucaguccaccucucaacgcccuaaacugaagcgagucaugaaagagaagacaaagccacaagggggagaaggcaaaggcgcacagagcacccccauucagcacuccuuucucacugaugugucagacguacaggagauggagagaggguuacugagucuuuugaaugauuuccauagcggaaagcugcaggccuuugguaacgaaugcucuauagagcagauggaacacguuaggggcaugcaggagaaacuagcucggcucaaucuggaacuuuauggggagcuggaggaauugccugaggacaagcguaaaacagccuccgauucaaaccucgaccgccuguuaagcgaucuggaggaacucaauaguucuauccaaaaguugcaucuggcagacgcucaggaugugccaaacaccuccgccagcuga

SEQ ID NO: 53913 - RNA, 2826 nt, Artificial Sequence
  derived and/or modified sequence opt3 from CCDC39__Homo_sapiens__NP_852091
augagcuccgaguuccuggccgaacuccacugggaggacggcuuugcuauccccguggcaaacgaagagaauaaacuucuggaagaucaguugucuaaauuaaaggacgagagagccucacugcaagaugagcuaagggaauacgaggaacggauuaacaguaugaccagccauuucaaaaaugugaagcaggagcucuccauaacacagucucugugcaaagcgcgcgagcgagaaacugagucggaggaacacuuuaaggcuaucgcccagcgugaacuugggagaguuaaggacgagauucaaaggcuggagaacgaaauggcaucaaucuuggagaaaaagagcgauaaagaaaauggaauuuucaaggccacgcagaaacucgacggucugaagugucagaugaacugggaucagcaagcucuggaggcauggcucgaagagagugcccauaaggacuccgaugcuuuaacccugcagaaauaugcccagcaggacgauaauaagauccgggcgcuuacauugcaacuggagcgccuaacucucgaaugcaaccagaaaagaaagauacuggacaaugagcuuaccgaaacaaucucugcacagcuggaguuggauaaagccgcucaagacuuuaggaagauucacaacgaacggcaggagcucaucaaacagugggagaauaccauugaacagaugcaaaagcgcgacggcgauaucgacaacugugcccuggaguuagcacgaauaaagcaggaaacuagagagaaagagaaucuggugaaggaaaagauuaaguuccucgagagcgaaaucgggaacaauacagaguuugaaaagaggauuuccguagcugaucggaaacuucugaagugccguaccgccuaccaggaccaugagacgucacgcauccaguugaaaggagagcuagauagucugaaggcgacugugaacagaaccagcucugaccucgaagcccugaggaaaaacaucuccaagauuaaaaaggauauacacgaggaaacagcacggcuucaaaagacuaaaaaucacaacgagaucauucagaccaagcugaaagaaaucacagagaagaccaugucagucgaggaaaaagcuacgaauuuggaggacaugcucaaggaagaggaaaaggaugugaaagagguugacgugcagcugaacuuaauaaagggcguccuguucaaaaaggcccaggagcuacaaacugaaacaaugaaagagaaggcugugcucagcgaaauugaggguacccgaaguucucugaaacaucuuaaucaccaguugcagaagcuggauuuugagacucucaagcagcaagaaaucauguauucccaggacuuccauauccagcaaguagagcgcagaaugagcaggcugaaaggggaaauuaacucggaggaaaagcaggcccuugaggcaaaaaucguugagcugcggaagucuuuggaagagaaaaaguccacauguggacuccuggaaacccagauuaagaaauuacacaaugaccuguacuuuauaaagaaagcccacucaaagaacagugaugagaaacagagccuaaugacgaagaucaaugaacucaaccuguucauugaccgcuccgagaaggagcuugauaaagcuaagggcuuuaaacaagacuugaugaucgaagauaaucugcucaagcuggaggugaaaagaaccagggaaauguuacauucuaaggcggaggaaguccugagccuugagaagcguaaacagcaguuguauacagcaauggaggaacggacugaggaaaucaaggugcacaaaaccaugcucgccucacagauucgauacguggaccaagagagagagaacauaaguacagaguucagggaacgccuguccaagaucgaaaaacuaaagaaucgguaugagauucugacugucguuaugcucccuccagaaggcgaggaggagaaaacccaggcuuacuacgugaucaaggccgcacaggaaaaggaggaacugcagagagaaggggauugccuugacgccaaaauuaacaaggcugagaaagagaucuaugccuuggaaaauacacugcaaguauuaaacagcuguaacaauaacuacaagcagucuuucaaaaaggugaccccgucaagugaugaguaugaacucaagauacagcuggaggaacagaaaagggcagucgacgagaaguaccgcuauaaacaacgacagauccgggagcuucaggaagauauucaaagcauggagaauacucuggacgugaucgaacauuuggcgaacaauguuaaggagaaacucuccgagaagcaggcuuacucuuuucagcugucgaaggaaacggaggaacagaaacccaagcuagagcgugugacaaaacaaugcgccaagcugaccaaagaaauuagacuccugaaggauacuaaggacgagaccauggaggaacaggacaucaaacuuagggagaugaagcaguuccacaaagucauagaugaaauguugguggacauuaucgaggaaaacacagagauucgcaucauacugcagaccuauuuucaacagagcggauuagagcucccuacugcauccacaaaggguucacggcagaguucuagaagcccaucccauacgucacugagcgccaggucuucccgaaguaccagcacuucuacaucccagucaaguaucaaaguacuugaacugaaguuccccgcuagcucgucccuaguuggcucuccuagccgcccaucaagugccuccucuagcuccucaaaugucaagagcaaaaagaguucuaaauga

SEQ ID NO: 53914 - RNA, 438 nt, Artificial Sequence
  derived and/or modified sequence opt3 from CCDC3__Homo_sapiens__NP_001269587
auggacgagaacuacaaucugcucccccacggcgugaacuuccaggaugccaucuuuccugacacccaagaaaauagaaggauguucagcucccuuuuucaguucucuaacugcucacaggggcagcaacuggcuacauuuaguagcgauugggagauucaggaagacucccgguugauguguucuucgguccagaaggcauuauucgaggaagaggaucauguuaaaaagcugcagcaaaaaguggccacucuagagaagcgcaaucgacagcuccgugaaagagugaaaaagguaaagaggucacugcggcaggcgcgcaaaaagggaagacaccuugagcuggcuaaccagaaauugagcgaaaagcucgccgccggugcacugccacauauaaaugcuaggggcccgguccggcccccuuaucugcgcggguga

SEQ ID NO: 53915 - RNA, 3093 nt, Artificial Sequence
  derived and/or modified sequence opt3 from CCDC40__Homo_sapiens__NP_001230271
auggccgagcccggcggggcugcaggaagaagccacccugaagacgguuccgccucugagggcgaaaaggaggggaacaaugaaucacauauggugaguccaccggagaaagaugacggacagaagggcgaggaagcggucgguagcaccgagcaccccgaagagguuacaacucaagcugaggccgcaaucgaagagggggaaguggagacggaaggagaggccgcuguagagggcgaagaggaagcaguguccuacggcgaugccgagucugaagaggaguauuacuauaccgaaacaucgucaccugaggggcagauuagcgcugccgacacuaccuacccauauuucagucccccucaggaacugccaggagaggaagcguacgauuccgucucuggugaggcaggccuccagggguuucaacaggaggccacaggacccccugaaagcagggagcggcgcgugaccuccccagaaccgucacauggcguucuuggucccagugagcagaugggacaggugacuagcgggccugcugucggccgacugacaggcucuaccgaggaaccacaaggacagguguugcccauggggguacagcaccguuucagauuaucccaugguucagacauagagagcagugaucuggaagaguuuguuucucaggaaccugugaucccacccggcgucccggacgcccacccuagggagggggaucuacccguguuccaagaccagauucagcaaccauccacggaggaaggagcaauggcugagcggguggaaagcgagggcucggaugaagaggccgaggacgaagguucucagcucgucguucuggauccugaccacccccuuauggugcgcuuucaggcggcccugaaaaacuauuugaauagacagaucgagaagcucaaacuggaccugcaagaacucguaguggcaacuaagcaguccagggcucagcggcaggaguuaggggucaaccuguacgaagugcaacagcaucuuguucacuugcagaagcugcuagagaaaucacaugaucgccacgccauggcuaguagcgagcgaagacagaaggaagaggaacuccaagccgcaagggcccuguacaccaaaacaugcgcugcggcaaaugaggagcggaagaaacuugccgcucugcagacugaaauggagaacuuggcccuccaccuguucuauaugcagaauauugaccaggauaugcgugacgauauccgcgugaugacccaagucgugaagaaggcagaaacagagagaauaagggccgaaaucgagaaaaagaaacaggacuuauacguagaucagcugaccacgcgggcucaacagcucgaggaagacauugcccuuuuugaggcacaguaucuggcgcaggcugaagauacucgaaucuugcgcaaggccguuuccgaggcauguacagaaauugacgccaucucuguggagaaaagaaggauaaugcaacagugggcuagcagucuagucggcaugaagcaucgggaugaggcccaccgcgcagugcuggaagcucucagaggaugccagcaucaggccaaaucaaccgacggcgagauugaagcguacaagaaguccaucaugaaagaggaagagaagaacgagaaacuggccagcauucuuaauaggacugaaacagaggcuacccuguugcaaaagcucacgacccagugucugacaaaacaggucgcauuacagucucaauucaacacuuaucgucugacccuacaggacacagaagaugcccucucacaggaccaacuggagcagaugauccuuacugaggaauugcaggcuauccggcaggccauucaaggggagcuggaacuccgaagaaagaccgaugcagcgauaagggagaagcugcaggaacacaugacaaguaauaaaaccacuaaguacuuuaaccagcuuauccugcgcuugcagaaagagaagacgaauaugaugacacaucucagcaaaauuaacggagacaucgcccaaaccacucuggauauaacccacacauccucucgguuagacgcucaccagaagacccugguggagcuagaucaggacguuaagaaagugaaugaacucauuacuaacucgcagagcgagaucuccagaaggacaauccugauugaacgcaagcaaggucuuaucaacuucuugaauaaacagcuggagcgaaugguaucagaacucggcggggaggaggucggaccacuggaauuagagauuaagcggcugaguaaacuuauagaugaacaugacggcaaggccgugcaggcacagguuacgugguugcgucuccaacaggagauggugaaggucacccaggaacaagaggagcagcuggcuucucuagaugccagcaaaaaggaacugcacaucauggagcagaaaaagcucagaguggaauccaaaauugagcaggagaagaaagaacaaaaggagaucgaacaucacaugaaggaccuggauaacgaccuuaaaaaguugaauaugcugaugaacaaaaauaggugcucaagcgaggaauuagagcagaacaaucgcguaacugagaacgaauuugugcggucucucaaggcauccgagagagaaacaaucaaaaugcaggacaagcugaaucagcuuagugaggaaaaggccacccuguugaaccaacucguugaggcugagcaccagauuaugcugugggagaaaaagauacagcuagcgaaagaaaugaggagcucugucgauuccgaaaucggucagacagagauucgagccaugaagggggaaauccaucgcaugaaaaaguauugucggacuacccaagacgcacacagacaugugcacgagcagcauggcacgcacgcuggaaccugcacaaagaauacuggcagggcccaggcccgugcucgcaccacacgggaugcaagagggcacgugcaugagcaacacggaacuagggccgguaccuguacgaacaauacaggccgagcgcaggcucgggcccgcaccagagacgcaaggcggcauguccacgaacaucgaacucacacagccagagcuuga

SEQ ID NO: 53916 - RNA, 927 nt, Artificial Sequence
  derived and/or modified sequence opt3 from CCDC42B__Homo_sapiens__NP_001138344
auggccgugcccugggaggaauacuucagacuggcucuccaggagaaacuuagcaccaagcugccugaacaagcagaggaccacgucccaccgguuuugagguuacuggaaaagcggcaggagcuaguggaugccgaccaggcgcuccaggcucaaaaagagguauuucgcacaaagacugccgcacugaaacagcgaugggaacagcuugagcagaaggaacgugagcugaagggcuccuucaucagauuugauaaauucuugcaagacucugaggccaggcggaaccgcgcucucagaagggcagccgaggaacggcaucaggcugggcgccgagaaguggaggcccugagacuguggacgcagcuccaggaauuaaggcgggagcacgcgcgucugcaacgcagacuuaagagguuggagcccugcgcacggcugcuagaacaggcccucgagcugcuuccuggauuucaggaagucccagagcugguggcucgauucgaugguuuggccgaaacccaagcagcucuccgccugagagagagggagcaguuagccgaacuggaggcggcccgggcacgccuccagcagcuuagagacgcuuggcccgaugaaguucuggcccaaggccagaggcgugcucaguugcaggagcggcuagaagccgcacgagagagaacacugcaaugggagucaaaauggauucagauacagaauacugccgcugaaaagacccuccugcuugggaggagucgcauggcggugcugaacuuguuucagcucgucugucaacaucagggacagccuccaacacuggacaucgaggauaccgaaggccaguuagagcacgugaaacuguucaugcaagaccuaagcgcaaugcucgccggucuggggcaggcugagcccgccgccccugcauccuga

SEQ ID NO: 53917 - RNA, 729 nt, Artificial Sequence
  derived and/or modified sequence opt3 from CCDC42__Homo_sapiens__NP_001151733
augagccugggcaucauggaggaagaggaccucgccgaauacuucagacuucaguauggggagaggcuguugcaaauguuacagaagcugcccaacguggaaggagcuuccgagucuccuucaauuuggcuacucgagaaaaagaaagaaaccgagauaaugcaccagacaaugguccagaagaaaaagauguuucaacggcgcauggaaacucugaaucuucgaugggaggagcuggguguuaaggaagcacaguugaaagcccauauccagaagagugagcaguucauucaagaaaacgaucagaaacguaucagagcgaugaagaaagcuaauaaggagagggaacucaagugccagcacaugcaggagcugacgaaacggaagcaagagaugguggcccugcgccucgaacaucagagauuaagcgcaaaacugaaggacuacuauauuuuuaacaaauaccuugagaagguaguggaaaauuccgaggaaucuaggugggcccacauccagaacaccgcugccaaaaagacauugcugcuaggcacuauaaagauggcaacccucaaucuguuccaaaucgucucgaaacaucuuaaggaggugacagagguugcucuggaagauacccacaaacaguuggacaugauucagcaguuuauccaagaucggucagacauuugggccgaggugaagaaaaaggaacagcagcgcguccgaaucuga

SEQ ID NO: 53918 - RNA, 921 nt, Artificial Sequence
  derived and/or modified sequence opt3 from CCDC50__Homo_sapiens__NP_777568
auggccgaggugagcaucgaccaguccaagcugcccggcgucaaagaaguuugcagagauuucgcugugcucgaggaccacacccuugcacauucucugcaagaacaggagauugaacaccauuuggccucaaacguacagaggaaucgguuagugcagcacgaucugcaagucgcgaagcagcuacaggaggaggaccucaaagcucaggcccaacugcagaagcgcuacaaagaucuugaacagcaggacugugagauagcacaagaaauccaggagaagcuggccauugaggcugaacgacguagaauccaggagaagaaagaugaagacauugcaagguugcuccaagagaaggaacugcaggaggagaaaaagcggaaaaagcauuuuccugaguucccagccacacgcgcuuaugccgauaguuacuauuacgaagacgggggaaugaagccgagagugaugaaagaagcgguuagcacucccuccaggauggcacaccgggaucaggagugguaugacgccgaaaucgcucgcaagcugcaggaggaggaacucuuagccacgcaaguggauaugcgagcagcucaggucgcccaggacgaggaaauagcgagacugcuuauggccgaggagaaaaaggcauacaaaaaggcuaaagaaagggagaagucuucguuggacaagcggaaacaggauccugaauggaagccaaaaaccgccaaggcugccaacucaaaaagcaaggagagugacgaaccccaccauuccaagaaugagcguccugcacgcccacccccuccaaucaugacagauggugaggacgccgauuauacucacuuuaccaaccaacagucuagcacaagacauuucuccaaaucagaaaguagccacaagggcuuucacuacaaacauuga

SEQ ID NO: 53919 - RNA, 987 nt, Artificial Sequence
  derived and/or modified sequence opt3 from CCDC54__Homo_sapiens__NP_115989
auguacacccugcacacaaagagagugaaagccgcugcaaggcagauguggacuagcaaccucuccaagguccggcaaucucuuaaaaauguuuaucauaagugcaaaauccgccaccaggacucaacgggcuaccccaccgugacaagugaugacuguaaccaggaugacgauagcuaugacgggaagaugaaucugccuguaguguugcaggaugucaagacugcccaaguggaguuauucucccagaugaccgacauuguucauaugauaccaaaagugcaggaaaagacagaucuguaccagaaacaaauggagguccuagaaacccgaaugaacgugaaugaggacaagcagugcacuacaaccaaagauauccucucuaugaaggaagacauuaaggcgcugaaaaagaaaguaacggagcuugagauccagaacucguguucaacuauucacugccuggaaaucuuggagggagaacgugguaaggagauaaccgagcuccuguauaaacugauccagccggcuacacucaagaauacuuuagccagcaccgauauggaaauuaguuccgcagagcccgaaaaaguuccuucuuacccaaagagcacagaccaucuggagaagaaaaccaucucaccccaaaugaagacgcuuaaaaagagaaaccaccagaaugccuccaggaguuuugaaaaagcuaagccuaacauuuauaucuacccagacuucagcacuuggauaaaguugacauuugugcacggcgggaaauggaccuucuuucugucugcaacuaagcuagaggaguucauucaguggcuccugucccggcccacaauccuuccugaggaaccacaagucauuacccagcgcuacuguccguuuacgggacccauccugucauugaccacaaucugccucagcauuuucaauaacauauauggcuuuaucuguagucugaaagaagaggugacuagauuauga

SEQ ID NO: 53920 - RNA, 1653 nt, Artificial Sequence
  derived and/or modified sequence opt3 from CCDC60__Homo_sapiens__NP_848594
augaccaaggugcccgccacaaagaagcugcagagcuccccuaacucuggcgcugucagaccauucuacgcaucagagaaucucaggcaaguuccggacaaacccaugaagaguaucaaauauauggauaaggaaauuauaaaccuuaagaaagaccugauccggagccgcuuuuugauucaguccgugaagaucgggcgaggauacuucgccauuuuacgugaggaaacugcgaaaaagaaaaagcagcagcaacugcagaagcuaaaagaggaagagagaaauaaguuucagccugcugagaaaaucucugaaauacacuauggugauacgcuccugucgaccuacgacgaugagaaacuuaaaacacugggcgccaggguaacucggcgcccauucacccccauccauucaugcauuaucagcccuaguuugacagaagcacacguggagccacucuuuagacagcugugugcccugcauuggcucuuagaggcucugaccauugaccacacucaucacacaaugaagcccgucauaaccugcuggaacccuaaagauccagggggauccaagucuacgaucaagaaaauuaauaaggacaaaagcaugggccaaaagugggaacacuucaucacugcaccgaaaaccaagaaguuuaaaauucccacaaugagggugacuaaccggaagccuucccgccgagguucaacccuuaguuugagcagagccucugggggauccucaccacagagcaguaugaucucuguuaaucccggcuccgaugagccuccaagcgugaacacacaggucaccucgucuaaagacaucgaagauaaugaguccucaaguacgaagcccgacgaagaaccgcuguauaugaaccuacagaaacuccuggagauggugagggaagaugcucggcguacuguaacaauugagaauggcaugcaacgcaaggccccuagcauacuuuccguucugaagcagaacaaaucuaauagcgcguacaaggaaaugcagaccacuuugaaaucaagugagagauccagcucuacaucagcagaaagucauauccaacccgugcagaagaaaagcaagaacaggaccaauugugacauuaacauccacuauaaguccggggucugcaacacgaugcgggccaaauucuacucuguggcucaggaggccggauuuugucuccaggacaagauggagauacugaugaaacgacaagaggagcgcgguauucagaaguucagagcauuuguguuagucucgaauuuccagaaagauaucgcuaagaugaggcaucacaucagcguugugaaaggcgacgccgaagagauugcggaucacugguacuuugaccugcucuccaaacuuccagaagaucugaagaacuuccggccugccaagaagaucuugguaaaacuacagaaguucggggagaaucuggaccuccgcauuagaccccaugugcugcuuaaaguccugcaagauuugaggauaugggagcucugcucaccagacaucgcaguggcuauugaauuuguucgugagcacaucauccauaugccccaggaagauuauauuaguuggcugcagucucggauaaacaucccuauuggaccauacagcgccuuacgauga

SEQ ID NO: 53921 - RNA, 2055 nt, Artificial Sequence
  derived and/or modified sequence opt3 from CCDC62__Homo_sapiens__NP_958843
augaaucccccugccgcuuuccuggcaggcagacagaacaucgggagcgagguggaaauuuccaccauagagaagcaaaggaaagaacuccagcuucugaucggagaguugaaggaccgggauaaagaauuaaacgacauggucgccguucaccagcagcaacugcuaucuugggaggaggaucgccagaaggugcucacacuggaagaacgaugcucaaaacuugaaggugagcugcauaagcguacugagauuaucagaaguuugacgaagaaaguaaaggcgcucgaaagcaaucagauggagugucagaccgcucugcagaaaacacagcugcagcuccaggaaauggcccaaaaggcaacucacuccucuuuacugucggaggaccuugaagccaggaacgagaccuugucaaauacacugguggagcuaagcgcucaggucggccagcuccaagcacgggaacaggcccugaccacuaugauuaaacuuaaggauaaggacaucauagaggcugugaaccauaucgccgauugcagugggaaauuuaagaugcuggaacacgcguugcgcgacgcaaaaauggccgagacauguauuguuaaggaaaaacaggauuacaagcagaaacucaaggcucugaagaucgaggugaauaaauuaaaggaggaccugaacgagaaaaccacggagaauaacgaacaaagagaggaaauuaucaggcucaagcaggagaaauccugccuucaugaugagcuguuguucacugucgaacgggagaagcgcaaggacgaacuacugaauauagccaaaucuaagcaggagcgaaccaacagcgagcuccacaaucugagacagauuuaugugaaacaacaguccgaucuucaguuucugaacuucaauguagaaaacucacaggaguugauccaaauguacgacaguaagauggaagagagcaaagcacucgacucuuccagggauaugugucugucagacuuagaaaacaaucacccaaagguugauauuaagcgggagaaaaaccaaaagagccuguuuaaagaccagaaguucgaggcuaugcuagugcagcaaaaucguagugauaaaucuuccugcgacgaauguaaggagaagaaacagcagaucgauacagucuuuggagaaaagagcgugaucacucucucgucuauuuucaccaaagaccugguggagaagcauaaccuuccgugguccuugggcgguaaaacacaaauagaacccgagaauaagaucacccugugcaaaauucacacgaagucaccuaagugucaugggacuggaguccagaacgagggcaaacagccaagugaaacacccacccucagcgaugagaagcaguggcacgacguuuccguguaucugggccuuacuaauugcccuucuagcaaacacccagaaaagcuggauguagagugucaagaccagauggaacgcucagagaucaguugcugccagaaaaacgaggccuguuugggggaauccggaaugugcgacagcaaguguugccaucccucuaauuuuauaauugaggcgccuggucacaugucagauguggaauggaugaguaucuucaagccaagcaaaaugcagagaaucgucaggcucaaguccggcuguacaugcucugagucgauuugugggacccaacaugacagcccggccuccgagcugaucgcaauucaggauucacacaguuuaggaucuagcaaauccgcucugcgggaagacgagacggaaucaagcucuaacaagaaaaauucccccaccagucuacucauauacaaggaugccccugcuuuuaacgagaaggccagcaucgugcugccaucucaggacgauuucucccccacaucaaaacuucagcgauugcuggcagaaagucgccaaaugguuacugaccucgagcugagcaccuuacugccuauuucgcaugagaaucuuacaggcuccgccacuaacaagucugaagugccagaggaaagcgcucagaaaaauaccuuugucucauauuga

SEQ ID NO: 53922 - RNA, 1692 nt, Artificial Sequence
  derived and/or modified sequence opt3 from CCDC63__Homo_sapiens__XP_011536303
augagcgugcugaagaaaaacagaaggaaggacuccgauacaccccaggagccuucugaaaaagccaaggagcaacaggcugaagcagagcuccggaaacuucgccagcaguuccgaaagauggucgaaucacguaagaguuuuaaauucagaaaucaacagaagaucgccagccaguacaaagagauuaagacccugaaaacugagcaggacgaaauaacguuguuacugucccuaaugaagucuucgaggaacaugaaucggucagagaagaacuauauggaacuccgccugcuucugcaaaccaaagaggauuacgaggcguugaucaagagccucaaaguucugcuggcugaacucgacgagaagauuuuacagauggaaaagaagaucgccaaucagaaacagauuuuugcaaagaugcaagaggccaacaauccaagaaagcugcagaaacagauccacauacuugaaacaagguugaaccuggugacuguacauuucgauaagaugcuaaccacaaaugcuaaacuccggaaggagaucgaggaccugcgcuuugaaaaagcagccuaugauaacguguaccaacagcuucagcacugccuguugauggagaagaagaccaugaaucucgcuauugaacagaguucccaagccuaugagcagcgagucgaagcgauggcaagaauggccgcuaugaaagacaggcagaagaaagauacuucucaguacaaccuggagauccgggaguuagaacgucuguaugcccaugagagcaagcucaaauccuuccuucuggugaaguugaaugaccgcaacgaauuugaggaacaagcaaagagagaggaggcucuaaaagccaagaaacacguuaagaaaaauaggggcgaaucauucgagaguuacgaaguggcgcaucugcggcuccugaaacuugccgagagcgggaaccugaaccaguugauugaggauuuucucgcaaaggaagagaaaaauuucgcucgauuuacauacgucaccgaacugaacaaugacauggagaugaugcacaagcgcacgcagagaauccaggaugaaauaauuuuacugaggucucaacagaaacuaucccacgacgacaaccauucagugcuccggcagcuggaggauaaacuucgcaagacuaccgaggaagccgacauguaugagagcaaguacggagaaguaaguaaaacauuggaucugcucaaaaauucuguugagaagcuguucaagaagaucaacugugacgcuacuaaaauucuugugcagcugggugaaaccggcaaggucacagauaucaauuugccgcaauauuuugccaucauugagaaaaagaccaacgaccuccuguuacuggagacguacagaaggauacuagaaguggagggggcagaagccgagauucccccuccauucaucaaucccuucuggggaggcuccgcucuccugaagccuccagaacccaucaaagugauaccuccaguccuuggugcggauccguuuagcgaccguuuggaugacguugagcagccccuggaucacucgucucuccggcagcugguguuagacaacuauauucugaaggagaaucgauccaaagaaguaagaggggacucacuuccugagaagguggaugacuucaggagucgcaaaaaggucacuauguga

SEQ ID NO: 53923 - RNA, 1455 nt, Artificial Sequence
  derived and/or modified sequence opt3 from CCDC65__Homo_sapiens__NP_149115
augcccaagaaagagaagauggccaaaaccccucugagcgacgaaaagcagcuccuucuguuccaacagaaauuguuagcugaggaagagauggcaaagaagaaagaaagacugcuaucccaguuucucaaggauaaacuggccaaggaggagcacaacucugcgcuuaaucugaacaaaaucaauacacaguggaggacuguguugcgggaagucaagacgcgcgagcuccauaaggacauugaaauacugucacaaaccuucgagcgaguuguggauugcaaagacaacguaaucaagagucuggcuaaagaucucagcgaggccgaagaacaguacgcacacgccuuacguucccaucugcacaauguggaccagcuuuuggcucugcagagacauaggcuaucucuccuggaagagucguauaacauggaacuugaggcacugacaaaggaguuugaaacugagcggaaaaccauuaucgaucaacacgaaaaggagauucacuacuugcaggacaucuucauggccauggaacagaauuauauagauucagaguacgagagcaaacucgaauuucagaguauguggaacgaccugaagaauaugaacuuagaggaaaagcauuuccugcgccuccaccuugagaauagagucgaagaucuguggaggaaauuucaagacguguugaagaacuauacagaugcuaccgaggaccggaaagccgcguucgagacucuacagguuaaggacgaaaaauccucuaaggagaucgaagugcagaugaagaaaauucaaaagcugcaggaugcaaucacaauuagcaaaggcaagaucaugauacauucccgcgagucagaggacgaaaaucgauacauuagaaacgauaaagagcucguccuggugcagcuuaggaagcugaaggcccagcggacccaagcucgugccgcaagucagaaaaauuugguacgccucacgcuggaaagcaacgcuacuuuaaaggcccugagaaaaaucguugacaagggggagaaaauucuaaagcucgcggaaaucuguaggaaguuugagaccgaggaagagaaagugcugccauucuauucuuccguccuuacaccgaaggaacaggagggaauccagaaaaacaauuuggaggagcugacugaggaacucaccaaggugaugguggauuacauugguauggagaacuuuuggaaacgguacaauaaggucaaacuggaacaacuuucacugcagcaccgacgcgcccaguugcucgacauaaacggcaagcugagagagauguuaaagcaguaucuggaugggaucagcguuagugacgaagugcuaucucaacucaauccccuguucauuguaaacuaccaguccaaucuuuugcagccucugagcaucaggauagcacacccaggagauaaacagcaucccacaaccuga

SEQ ID NO: 53924 - RNA, 2745 nt, Artificial Sequence
  derived and/or modified sequence opt3 from CCDC66__Homo_sapiens__NP_001012524
augggcaacaaggccaaaaucgcuaagugcccccugagaaccaaaacagggcacauucucaagagcacucaggacacguguauaggauccgagaaacuucugcaaaagaagccuguggguucugaaaccucacaggcaaaaggcgagaagaaugggaugacauucaguagcacuaaagauuugugcaagcaguguaucgacaaagauugcuuacauauucagaaggaaaucuccccagccaccccgaacaugcaaaagacaaggaauaccgucaacacuucucugguuggaaaacagaagccccacaaaaagcauauuacagcggagaauaugaaaucgagccuagugugucucacccaggaccagcugcaacagauccuuaugacgguaaaccagggcaaucggucacugaguuugacugaaaacgguaaggaggcuaaaucccaguacucucucuaucugaauagcauauccaaccaaccuaaggaugagaauaucauggggcuguuuaagaaaaccgaaauggugucaagugucccagccgagaacaagagcgugcucaaugaacaccaggagacaucuaaacagugcgagcaaaagauugcaaucgaaaacgaguggaaacccgccgacauuuucuccacuuuaggagaacgcgagugugaucgaucaagccuggaagcuaagaaggcacaguggcguaaagagcuugacgagcagguugccuugaagaaaaaggaaaaagaggugagugaaaaguggaaugauccuuggaagaaaucugaguccgacaagaucauaugggaaaaacaucagauucuggaucaaagcagagagaccguccuacucgagcacccauuuucggcugugaagcaggaacugcagaggaaauggaucgaggaacuuaacaagcagauugaggacgaucggcaacgcaagaucgaagagaaaaucauuuacucuaagggcgaggaacacgacagaugggccaugcauuucgacucccugaaaucauaucccggcagucagagccaguuguuuucccagucuacacacaagcaaccugaguacuucugcguaagcccagauacccaggaacucgcggacguuucaaguguguguacgccgacuacagggucccaggucgagcccagcgaggaagaacauauagcaaaaccuaucaaggauguggugauggccaacucuaaaaagaccaauuuucugaggucaaugacugcuuuacuggacccagcccagauugaggagcgggaucgccgaagacaaaagcagcucgaacaccagaaagcaaucacagcucaagucgaggagaagaggcggaaaaagcagcuugaagaggaacagcguaaaaaggaggaacaggaggaggaacugcgcuuggcccaagagagagaagagaugcagaagcaguaugaagaggacauacuaaaacagaagcaaaaagaggaaauuaugacccugaagacgaacgaacucuuccagaccaugcagagggcgcaggaacuggcccaacggcuuaaacaggagcagcgaauccgcgagcuggcacaaaagggacacgauacaaguagauugaucaagaaucucgguguugacacuauucagauggaauacaacgcuagcaauaucuccaacucuaggcaugauucggacgagauuagcggcaaaaugaauaccuauaugaacuccacaacuucaaagaaagauaccggggugcagacagacgaccugaauauaggaaucuuuaccaacgccgaaagucacugcggcucuuuaauggagcgggauauuacuaauuguagcucccccgaaaucucagcugagcugaucggucaguucagcacgaagaaaaacaagcaagagcuaacacaggacaagggggccucucucgaaaaagagaauaaccgcugcaaugaucagugcaaccaguuuaccagaauugaaaagcaaacuaaacauaugaagaaauacccuaagaggccagacuggaacauaaauaaacccccgaagcguuacaucccugcauccgagaaguaucccaaacagcugcagaagcagcgggaagagaaaaagguacgaagacaaauggagcuuuugcaccugguggagaaaaacaauccaggacaucucagucagaacaggggcauuagcccugagaucuuccacucuucccaccaggaaaccgagucaaagcugcgcuggcaucuugucaagaaagaagaggagccccugaauauucacaguuuuagcaaggaacggucgccauccucucccgugccuguugugaaaaacagaacacagcaaacccagaauacuuugcaucucccacugaagaacagcucauacgagagggaaaauuuaaucaguggcuccaaccagacagagcugucuagcgggauauccgagucaagccacuucaucccguauguccgcacgaaugaaauuuacuaucuagaucccgacgccccucucaguggaccaucuacccaagauccccaguaccagaacucccaggacuguggucaaaaacgacagcuguucgauagcgacugcgugcgggauccucuuuugaauccaaacaugguaaagaaucgugacagacagcaggcuauccugaagggccucucggagcugaggcaaggguuacugcagaaacagaaggaacuugagucaucuuugcucccccuggcggaaaaccaggaggagaguuuuggauccagcuucuga

SEQ ID NO: 53925 - RNA, 1815 nt, Artificial Sequence
  derived and/or modified sequence opt3 from CCDC67__Homo_sapiens__NP_857596
auggagaaccaggcccacaauaccaugggcacaagccccugcgaagcugagcugcaagaacucauggagcagaucgacauuaugguguccaacaagaaaauggauugggaaagaaagaugagggcacuugagacucggcuggacuugcgcgaucaggaguuagccaaugcgcagacgugucuggaccaaaaagggcaggaagucggacuacuccgacagaagcuggauucucuugagaaaugcaaccuggcuaugacccagaauuacgaaggucaauugcagucacucaaggcccaguucaguaagcugacaaacaauuuugagaaacugcgucuccaucagaugaagcaaaacaaaguuccuagaaaggaguuaccacaccugaaagaagagauaccguucgaacuuagcaauuugaaccagaagcuggaggaauuuagggcaaagucccgggagugggacaaacaggagauccuauaucaaacucaucucauuucucuggaugcccagcagaagcuccugucggaaaaauguaaucaguuccaaaagcaggcucagucauaccagacccaauugaacggcaaaaagcagugccucgaggacagcaguuccgaaaucccccgccugauuugugauccugacccaaauugcgagaucaacgaaagagaugaguuuauaaucgagaaauuaaagucugcagugaaugaaauugcccugagcaggaacaagcuccaggacgagaaccagaaacuucugcaagaauugaagauguaucagcggcagugucaggcuauggaggccgggcuauccgaaguaaaaucagagcugcaaagucgcgaugaccuccugcgaaucauugagauggaaagacuucagcugcacagggaguugcucaagaucggagaaugccagaaugcgcaaggcaacaaaacacggcuggagagcucuuacuuacccuccauaaaggagccugaacguaagauuaaagagcuguucucagugaugcaggaccagccaaaucaugaaaaggagcuaaacaaaauccgcagccagcuccaacaggucgaagaguaucacaauagugagcaggaaagaaugaggaacgagauuucugaucugaccgaagaacuucaccagaaggaaaucacuaucgcaacagugaccaaaaaggccgcuuugcuggagaagcaacucaaaauggagcuggaaauuaaggagaaaaugcuugccaagcagaaaguuuccgacaugaaguacaaggcagugcggacggaaaauacucaucugaaagguaugaugggggauuuggaccccggagaguauaugagcauggauuuuaccaaccgagaacagucgcgccacacaucuauaaauaagcuccaguacgagaacgagagacugaggaaugacuuagcuaaacugcaugucaacggcaaguccacuuggaccaaucaaaacacauacgaagagaccggccgguaugccuaccagucacagaucaaaguggaacaaaaugaggagcgccuaagucacgauugugaaccuaacagaagcacgaugccaccgcuucccccuuccacuuuccaggcgaaggagaugacaucuccacugguaagcgacgaugacguuuuuccccuuucaccuccagauaugaguuuccccgccuccuuggcagcucagcacuuucugcucgaagaggagaaaagggccaaggagcuggagaaguuacugaacacccauauugacgaacuucagcgucacacugaguucacauugaauaaauauagcaagcucaaacaaaaccggcauaucuga

SEQ ID NO: 53926 - RNA, 1008 nt, Artificial Sequence
  derived and/or modified sequence opt3 from CCDC68__Homo_sapiens__NP_001137301
augaccacagugacugucacgaccgagauucccccuagagacaagauggaagauaacagcgcccuguacgaguccacaucugcucacaucauagaagagacugaauauguuaaaaagaucaggaccacacuccagaaaauucggacccaaauguucaaggacgagauccgccaugauucaacuaaucacaaacuugacgcaaagcauugcggcaaccugcagcaggggagugauagcgagauggacccauccuguugcucuuuggauuuacugaugaagaaaauuaagggaaaagaccuacagcuccuggaaaugaauaaggagaacgaagugcuuaaaaucaagcugcaagccucgcgagaggcgggugcugccgcauugcguaauguagcccagagacucuuugagaacuaccagacacagucagaagaggugaggaagaaacaagaagauagcaagcagcugcugcaggucaauaaacucgagaaggaacagaaauuaaagcaacacguggagaaccugaaucagguugcugagaaacuugaagagaagcauagucagauaaccgaauuggagaaccuggugcaacggauggaaaaggagaaacgcacgcuacucgagagaaagcugucccuugaaaauaaacuguugcagcucaagucuagcgcaacuuauggcaaauccugucaggaccugcagagggagaucucaauuuuacaagaacagaucagucaucugcaguucgucauucacagccagcaccaaaaccuccggucugugauccaggagauggaagggcuuaagaauaaccugaaggagcaggauaaacgcauagagaauuugcgagaaaagguaaacauucuagaggcccagaacaaagaacugaagacccaaguugcucucuccucagagacaccgagaacuaaagugagcaaggccgucaguaccucugagcugaagacagaaggagugucccccuaccuuaugcugaucagguugcggaaauga

SEQ ID NO: 53927 - RNA, 1425 nt, Artificial Sequence
  derived and/or modified sequence opt3 from CCDC6__Homo_sapiens__NP_005427
auggccgacagcgcuuccgagucugauaccgacggcgcagggggaaacucaaguagcuccgccgcgaugcagucuucgugcucaagcacaagugguggcgggggaggcggugggggaggcggcgggggagguaaguccggcgggaucgugauuucucccuucagacuggaagaacucacuaauaggcuugcuagccugcaacaggaaaacaaagucuugaagauagaguuagaaacguacaaacugaaguguaaagcccuacaggaggagaaucgggaucuccgcaaggcauccguuaccauccaggcccgagcugaacaagaggaagaguuuauuucaaacacacuguucaagaaaauccaggcacuucagaaggagaaagaaacucuggccgugaauuaugagaaggaagaggaauuuuugaccaacgagcucagucguaaacugaugcagcugcaacacgagaaggcugaacucgagcagcauuuagaacaggagcaggaguuccaaguaaauaagcugaugaaaaagauuaaaaaguuggagaacgacacaaucagcaaacagcuuacccuggagcagcuaagaagggaaaagauagaucucgagaauacucuggaacaagagcaggaagcccuugugaaccggcuguggaaacgcauggacaaguuggaggcggagaagagaauccuccaggaaaaacuggaucagccugucucugcaccaccgucccccagggacauuucaauggagaucgauagcccugaaaauaugaugcggcacauucgcuuuuuaaagaacgagguggagcgacugaaaaagcaacucagagccgcucagcuucagcauagugagaaaauggcccaguaccuggaagaagagaggcacaugcgggaagagaauuugcgucuacaacgcaagcugcagagagagauggaaaggcgggaggcacucugccgacagcugucugaauccgagagcucgcuugaaauggacgaugagcgcuauuucaacgagaugucugcucagggacugagaccaaggacaguuuccucacccaucccuuacaccccaagucccagcuccucucggccuauaagcccaggcuugucauaugccagucauacgguggguuuuacuccgcccaccucccucacacgcgcggggaugagcuacuauaauucuccuggacugcacguccaacacaugggcacuucacauggcauuaccagaccaagucccaggcguagcaacuccccugacaaguucaaacggccaacacccccgccuucucccaacacccagacgccagugcagccucccccacccccuccaccgcccccuaugcagccaacuguacccucggccgcaacaagccaaccuaccccaucccagcacucagcucaucccaguucucagccguga

SEQ ID NO: 53928 - RNA, 1317 nt, Artificial Sequence
  derived and/or modified sequence opt3 from CCDC78__Homo_sapiens__NP_001026907
auggagcacgccgcuaccacaggccccagaccugggccaccgagcaggcggguggaaaacgucguucugcgcgcaaaggacuggcuccccggagccccugguggcacugcggugugggcuacgucccuugaggccgaaguaccacccgaucuggcauugaauaaagagcagcaauuacagaucucuaaggaacugguggacauucagauaaccacacaucaccuacaugagcagcacgaggccgaaaucuuccaacucaaaucagagauucugcgacuugaaagucguguccuggaguuggagcucagaggggauggaacuagccagggcugcgcugugccuguugaauccgacccaaggcauccccgggcagccgcucaggagcugcgccacaaggcccaggugccuggucacucugaugaccauagauuucaaguccagccaaagaacaccaugaauccggaaaacgagcagcacaggcuggggucgggacuccagggcgaagugaagugggcguuagagcaucaagaggcacggcagcaggcccugguaacacgcguugcuacccuuggccgacaauugcagggggccagagaagaggcaagggcugccggacagcggcuggcgacucaggccgugguccuauguucaugccaaggucagcuccgucaggcagaagcugagaaugcccgccugcagcuucaacugaagaaauugaaggaugaauacgugcucagacugcagcacugugcuuggcaggccguggagcacgcagacggcgccgggcaggcucccgcgacaaccgcauuaaggacguuccuggaggccacucucgaagauauccgggcugcccaucgaagccgcgagcaacagcuugcaagagccgcuaggaguuaucacaaacggcuggucgacuugucccgcagacaugaggaacuacugguugccuacagggcaccuggaaacccacaggcgauuuuugauaucgcuucucucgaccuggaaccccuuccugugccacugguaaccgauuucagccaccgugaggaccagcauggcggucccggggccuugcucuccucaccgaagaaacggccuggaggcgcaagucaaggcgggacaagcgagccccagggacuggacgccgcuucuugggcccagauacaccaaaaguuacgagauuuuuccagaucaacucagagcuggaaugguaguggccacucuugcugguccgggccaagguggcugaaaagcaacuuccuaucguaucgcucuaccuggacauccaccugggcaggaacgucaacuaaaaguuga

SEQ ID NO: 53929 - RNA, 2853 nt, Artificial Sequence
  derived and/or modified sequence opt3 from CCDC80__Homo_sapiens__NP_955805
augaccuggagaaugggccccagguucacaaugcugcucgccauguggcuugugugcgggagcgagccucacccacaugcuacuauccggggaucccacgguggccgcaaggucccgcugguuucucccgacucaagucgaccugcacguuuucucagacauacggggaggagccggggaauugaacgcuccaccuuagaggaaccaaaccugcagccccuacaaagaaggcggucugugccuguacuccgccuggcccgaccaacagagcccccugcgagaucggauauaaauggcgcugccgugaggccagaacagcggccggcagcccgugguucaccccgcgagaugaucagagacgaggggagcagugcuaggucccggaugcuucgauucccuucuggaagcuccucaccaaacauucuggcaaguuuugccggcaaaaaucgcgucugggugaucagcgcuccccacgccucugaaggcuacuauagauugaugaugucccuccugaaggaugacguuuacugugagcuggcggaaaggcauauucagcagaucguguuguuccaccaagcaggggaggagggagguaaaguccggcgcauaacuucagaaggccagaucuuagagcagccucuggauccaagccuuauucccaaguugaugaguuuucugaaacuagaaaaggggaaguucggaauggugcuccugaaaaagacccuucagguagaggaaagauauccguacccuguuaggcuggaggccauguaugaggugaucgaccaaggccccauucgucggaucgagaaaauacgacagaaggguuuuguccagaaaugcaaggcuucugggguggaaggacagguggucgccgaaggcaacgauggcgggggaggugcaggcagaccauccuuggggagcgagaagaaaaaggaagacccuaggcgcgcucaaguucccccaacacgggagucgagagugaaaguacucaggaagcuggccgcgaccgcccccgcauuaccucagccaccgucuacuccccgcgcuacaacccugccuccagcccccgcuacgacugugacccgauccacaucacgggccgucacuguggcagcccguccuaugaccacaaccgcuuucccaacgacucagagacccuggacaccgaguccuagccacaggccacccaccacuacagagguuauuaccgcgcgccggccuuccgugucugaaaaucucuaucccccaagcagaaaagaucaacauagggagcgaccucagacgacccgccggcccucaaaggcaacaagucuugaauccuuuacuaacgccccaccgaccacaaucagcgagccuucuacuagagcugccggacccggcagguuccgugacaaucgcauggaucggagagaacacggucauagggacccaaacgucgugcccgggccuccaaaacccgcaaaggagaagccuccgaaaaagaaagcccaggauaagauucugucaaaugaguacgaagagaaauacgacuugagucgaccaaccgcuagccagcuagaagacgagcugcaaguaggcaacguuccccucaagaaggccaaagaguccaagaaacacgaaaagcuggagaaaccugaaaaggagaagaaaaagaaaaugaagaaugaaaacgcagauaaacuucugaagucugagaagcagaugaaaaagucggagaaaaagagcaaacaggaaaaggagaaauccaagaagaaaaagggaggcaaaacagaacaggacggguaccaaaagccaaccaauaaacacuuuacucagucacccaagaagaguguggcggauuugcucggaucuuucgaggguaaacggcgccuguuacugaucacggcuccuaaggccgaaaacaauauguauguccagcagagagacgaguaccuagagagcuuuuguaaaauggcaacaaggaagaucuccgugauuaccauauucggcccggucaacaacucaacuaugaaaaucgaucauuuccaacucgacaaugaaaagcccaugcgggugguugaugacgaggaucugguggaccagcgacuuauuagcgaauugagaaaggaguaugggaugaccuacaacgacuuuuucaugguacugacagaugucgaccuccgcgugaaacaguauuacgaaguuccaaucaccaugaagucuguguuugaucugauagacacuuuccaguccaggauuaaagauauggagaagcagaaaaaggagggaaucgucugcaaggaagacaaaaagcaaagucuugagaauuuucugagccguuuccgguggagaaggcgcuugcucgugaucucugccccuaacgaugaagacugggcuuauucccagcaacugucagccuuaaguggccaggcauguaauuuuggucugcgacacauuacaauccuaaaacuccuggggguaggcgaggaggugggaggcguucuugaauuguuccccauuaacgggagcucggucguggagagagaagaugugccagcucaucuggucaaggacauacggaauuacuuucagguuuccccugaguacuucucuaugcuccuggugggaaaagaugguaacguaaagagcugguaucccucaccaauguggaguauggugaucgucuacgacuuaauugauuccaugcagcugaggcgccaagaaauggccauccagcagucucuuggcaugcguugcccggaggacgaguaugcgggguacggauaucacagcuaccaucagggcuaucaagaugguuaccaggacgacuacagacaccacgaauccuaucaucacggguacccuuauuga

SEQ ID NO: 53930 - RNA, 1242 nt, Artificial Sequence
  derived and/or modified sequence opt3 from CCDC83__Homo_sapiens__NP_001273088
auggagaacagcggcaaggccaauaaaaaggacacccacgaugggcccccuaaagaaaucaagcugccaacauccgaggcucuccuugacuaccagugccaaauuaaagaagaugcaguggagcaguucauguuucagauaaagacucugagaaagaaaaaccagaaguaucaugaaaggaacucucgguugaaagaggagcaaaucuggcacauucgccauuuacugaaggaacuaucagaggaaaaagccgagggacucccggucguuacgcgagaggacguggaagaggcgaugaaggaaaaguggaaauucgagcgugaucaggaaaagaaucugagagacaugaggaugcagaucaguaaugcugagaaacuuuuucuggagaaguugagcgaaaaagaguacugggaagaguauaagaacguagguuccgaacggcacgccaaacucauuaccucucugcagaaugauaucaacacagugaaggagaaugcagagaagaugucggaacauuacaaaauaacucuggaggacacccgcaagaaaaucauuaaggaaacacucuuacaacuggaucagaaaaaggagugggccacccagaacgcugucaaacuuaucgacaaaggcucauauuuggaaauuugggagaaugauuggcugaagaaagagguggcaauccacagaaaggaaguugaggaacuaaagaacgccauacacgagcucgaggcugaaaaucuggugcuuauugaccagcugagcaacuguagguuggucgaucucaagaucccccggcgccuguacuuaacucaagccgcggggcuggaggugccuccagaagagaugagucucgaacuucccgagacacauauugaggaaaaguccgagcugcagccuaccgaaguagagucucgagacuugaugagcuccucagacgaaaguacgauccuacaccugagccaugaaaauucuaucgaggaucuccaguauguuaaaauugacaaggaagagaacuccggaacugaguucggcgauaccgacaugaaauaccugcuuuacgaggaugaaaaggacuuuaaagauuaugugaaccuggguccauugggggucaagcucaugucaguggagagcaagaaaaugcccauacacuuccaagagaaggaaaucccugugaaacuguacaaggacgucagaaguccagagucucacauuacauauaaaaugaugaaguccuuuuuauga

SEQ ID NO: 53931 - RNA, 1662 nt, Artificial Sequence
  derived and/or modified sequence opt3 from CCDC85A__Homo_sapiens__NP_001073902
augagcaaggccgcuggcggggcagccgcggcugccgcagccgcugaguccugcucucccgccccugcaggaucaagugcugccccaccggcgcccguggaagaccugagcaaagucuccgaugaggaacuccuucaguggucuaaggaggaacugaucagaucguugaggcgggcagaggccgagaaaguuucagcuauguuagaccacagcaaccugauucgcgaagugaaucgacgucuacaacuccaucugggugagauaagaggccuuaaggauaucaaccagaaacugcaggaagacaaucaggaguugagggaucucuguugcuuccuggacgaugaccggcaaaaggggaagcgcguaaguagagaguggcagaggcugggacgguacaccgccggcgugaugcacaaagaagucgcacucuauuuacagaagcugaaagaucuugaggugaagcaggaagagguugugaaagaaaacauggaguugaaggagcuguguguccuacucgacgaagagaagggugcugggugcgccggaucccgcuguucuauugauagccaagcgucccugugccagcuuacagccucaacugcaccuuacgugcgagacguaggcgauggcaguagcacgucuuccaccgggucaacagacagcccagaccaucacaaacaucacgcuaguucuggaucccccgaacaucugcagaagccuagaagcgaggguucgccagaacacucuaaacacagguccgccucacccgagcauccucagaagccacgggcuuguggcacuccggaucgucccaaagccuugaaggggccuaguccagagcaccacaaaccccucugcaagggaagcccugaacaacagcgccauccacaccccggcuccucuccggagacccugccuaagcauguuuuaagcgguucacccgaacacuuucagaaacauagaaguggguccagcccagagcacgcaaggcacucuggaggcucaccugaacaucugcaaaagcacgcccucggcgggagucuugagcaucugccccgggcucgaggaacaagcccagagcacuugaaacagcacuaugguggcucccccgaccauaagcacgggggaggcucuggugggucgggcggaagcggcgggggaucccgcgaagguacccuaagaaggcaggcgcaggaggauggcucaccucaucaccggaauguguacagugggaugaacgaaucuacucugagcuauguccgccaacucgaggcaagagugaggcagcuggaggaagagaaucguaugcuuccacaggccucccagaaccggcgacaaccgcccacaagaaauucaagcaacauggaaaaaggauggggcucuagggcucgccgggugcugcagugguggcaggguuguagagggaucggaaggugcuugccuacccucccaggcuccuuccgccugaguagcggcgccgacgggucuaauuccucacccaacagugcagccagcuuuucgggacaugcuacgccuucccagcaaccagagcccgucguucacucuuuaaaggugguauggcgaaagcugggugaugccgcaggcagcuguccggggauucggcagcaccuaucaggaaaucaguacaaaggcccuauguga

SEQ ID NO: 53932 - RNA, 1083 nt, Artificial Sequence
  derived and/or modified sequence opt3 from CCDC86__Homo_sapiens__NP_077003
auggacacaccccugagaaggagccggcgccucggcgggcuucgaccugaguccccagaaucucugaccucagugagucguacuagaagggccuuggucgaguucgaaagcaacccggaggaaacgcgggagcccggauccccuccaucuguucagcgcgcugguuuaggcucgcccgagagaccuccaaagaccucacccgggagcccuaggcugcaacagggagcaggccuagaaaguccacagggucagccggagcccggggccgcguccccucaacggcagcaggaucuccaccuggaaucuccacagcgccaacccgaguacagcccugaguccccacgaugccagcccaaaccgucagaagaggcuccuaaguguagucaggaccagggagugcuugccagcgaacuggcacaaaauaaagaggaauugacacccggcgccccacagcaucagcucccucccguaccaggcucucccgagccuuauccagggcaacaggcuccgggacccgagccuucccagccacugcuggaacucacucccagagcaccugguucaccaaggggccagcacgagcccagcaagccgccuccagccggggaaaccgugacaggaggcuuuggugcuaaaaagcggaaggggaguucuucccaagcccccgcgagcaaaaaguuaaacaaagaggaacugccugucauccccaagggaaaaccaaagucgggccguguguggaaggaucgcucuaaaaagagauucucccagaugcuucaggacaaaccuuugaggaccucauggcagcggaagaugaaagagcgacaagagcgcaagcuggcaaaagauuuugccagacaucuagaagaggaaaaggagaggcggcgccaggaaaagaaacagagaagggcugagaaucucaagcgucggcuggagaacgaacgaaaagccgagguugugcaggucauuagaaaucccgcaaaacuuaagagggcuaagaagaaacaacugcgcaguauagaaaagcgggacacuuuggcccuccugcagaaacagccaccgcagcaaccugcggccaagaucuga

SEQ ID NO: 53933 - RNA, 5613 nt, Artificial Sequence
  derived and/or modified sequence opt3 from CCDC88A__Homo_sapiens__NP_001129069
auggagaacgaaaucuucacaccccugcucgagcaguuuaugacaagcccucuugugacuugggucaagacguucggcccacuggccgcugggaauggaaccaacuuggacgaauacguugcauuaguggaugguguauuucugaaucaagugaugcuacaaauuaacccgaaacucgagucccagcgggucaauaagaaagugaacaaugacgccucucugaggaugcacaaccuuucaauacugguucggcagaucaaguucuauuaccaagaaacuuugcagcagcucauuaugaugagucugcccaaugugcugaucauuggcaaaaacccuuuuagcgagcaggggacugaggaagucaagaagcucuuacugcuuuugcugggaugcgcggugcaaugucagaaaaaggaggaguucaucgagcgcauacagggccuagauuuugacaccaaagcugccguagcagcccauauccaggagguuacccacaaucaagaaaacguguucgaucuccaguggauggaggucaccgacaugucccaggaagauauugagccacugcuuaagaauauggcucugcauuugaaacgacucaucgacgaacgugaugagcacucugagacuauuaucgaacugucggaggaaagagacgguuuacauuuucugccccacgcaucaagcagugcccaauccccuugcgggucuccaggaaugaagaggacagagagccggcagcaccucuccguggaacuugcugaugccaaggcgaaaauacgcagacugaggcaggaguuggaggaaaagaccgagcagcuacuggacuguaaacaagaacucgagcagauggaaauugagcugaagcggcuucagcaggagaacaugaaucuguugucagaugcacgcagugcccgaauguauagagacgaacucgacgcucugagggagaaagccgugcgggucgauaaguuagaaagcgagguuucucguuacaaagagcgccugcaugacaucgaguucuauaaggcaagaguggaggaacuaaaggaggauaaccaaguacuccuggaaacgaaaacuaugcuugaggaccaguuggagggcaccagggcucgguccgauaagcugcacgaacucgagaaagaaaaccugcagcuuaaggccaaacugcaugacauggagauggaacgagauauggaccgcaagaagauugaggaguugauggaagagaauaugacacucgaaauggcgcagaaacaaucaauggaugagagccugcacuuaggcugggaacuggagcagaucaguagaacuucugagcuauccgaagcaccccaaaagagccucgggcacgaggugaacgaacugaccucgucuaggcuuuugaaacuggagauggagaaucagucccucacaaagaccgucgaagaacugcggacgacuguggacucaguugaaggaaacgccaguaaaaucuuaaagauggagaaggaaaaucagcgccugagcaaaaagguggagauucuugagaacgaaauaguccaggagaaacaguccuugcaaaauugccagaaccucucuaaggaucugaugaaagaaaaggcucagcuagagaagacaaucgaaacccugagagagaauagcgagaggcagauuaaaauccucgaacaagagaacgaacaucugaaucagacugugucaagucuucgucagcggucccagauaagcgccgaggcucgaguaaaggacauugaaaaagagaacaagaucuugcacgagucuaucaaagaaacaucaaguaagcugagcaaaauugaguuugaaaagagacaaaucaagaaagaguuagagcauuacaaggaaaaaggugagagggccgaagaacucgaaaaugagcugcaccaucuugagaaggaaaacgagcuguugcagaaaaagauuaccaaucucaagauaacgugugagaaaaucgaggcacuggaacaggagaacuccgagcuagaacgcgagaaccggaagcugaaaaagacccucgacucuuucaaaaaucugacauuucagcuugaaucguuggagaaggaaaacagccaacuggaugaggagaauuuagaacucagaaggaacguugagucccugaagugcgccucaaugaaaauggcucagcuucagcuggaaaauaaggagcuagagagugaaaaagagcaacucaagaaaggccuggaauugcugaaggcgucuuucaagaaaacugagcgcuuagaagugagcuaucaggggcucgacauugagaaccagcgacugcagaagacccuugaaaauuccaacaaaaagauccaacagcuggaaucagaguugcaggaucucgaaauggagaaucagacacugcagaaaaaccuagaagaacugaagaucagcucuaaacggcuugagcagcucgaaaaggagaauaagucccuggaacaggagacaagccaguuggaaaaagacaagaaacaacuggagaaggagaacaaacguuuaagacagcaggcagaaauuaaggauaccacacucgaggaaaauaacgucaagauaggaaaucuggagaaagagaacaagacccuuagcaaagaaaucggcauuuacaaggagucuugugugaggcugaaagaauuggagaaggaaaacaaggagcucgucaaacgcgccacuaucgacauuaagacgcuggugacacuacgggaggaucugguuuccgaaaaacuuaagacccagcaaaugaauaacgaccucgagaaacugacucacgaauuggagaagaucgguuuaaauaaggaaagacugcuccacgaugagcagucaaccgacgauagguacaaacugcuugagaguaagcuggaaagcacauugaaaaagucgcuagagauaaaagaagagaagaucgcugcccuggaagcacgacucgaggaguccaccaacuauaaucagcaacugcgccaggaacuuaagacugugaaaaagaacuacgaggccuuaaaacagcggcaggacgaagagagaaugguacaaucuagcccuccaauuucaggggaggauaauaagugggaaagggagagucaggaaacaacgcgugagcugcucaaagucaaggaccgcuugaucgaaguggagcggaacaaugcuacccugcaggccgagaaacaggcacucaagacucaacugaagcagcuugaaacacagaacaauaaccugcaggcgcaaauuuuggcucuacagagacagaccguuucccugcaagagcagaauacaacucuccagacccagaacgccaaauuacaaguggaaaauucuacgcugaacagccaguccaccucacuuaugaaccagaaugcacagcugcucauccaacagagcaguuuggagaacgaaaaugagucugucauaaaggagagggaagaccugaaaucccucuaugauagccugauuaaggaccaugagaaacuugaacuacugcacgagcgacaggccucggaauacgagucauugaucucuaagcauggaacauuaaagagugcucacaaaaaccuggagguggaacaccgggaucucgaggaccgcuauaaucagcugcuuaagcaaaaaggccagcuggaagaucucgagaagauguugaaaguagagcaggaaaagaugcugcuagagaacaagaaucaugaaacuguggccgcagaguacaaaaagcugugcggcgaaaacgacagacucaaucacaccuauucccagcuucugaaagagacagagguuuuacaaacugaucauaagaacuugaaaagccugcucaauaacucuaagcuggaacagaccaggcuugaggcugaguucagcaagcugaaagagcaguaccaacagcucgacauuacguccacaaaguugaauaaccagugugaacuguuaucacagcuaaaagggaaucuggaggaggaaaaccggcaccuccuugaucaaauccagacccugauguugcagaaucgaacucugcucgagcagaacauggaaaguaaggaccuguuucaugucgagcaaagacaguacauagauaaacuuaacgaacuccgcaggcagaaggagaaacuggaggaaaagaucauggaccaguauaaguucuacgauccgagucccccucgucggagaggaaauuggauuacauugaaaaugaggaagcugaucaaaucuaagaaagacauuaaccgcgagcgacaaaaguccuuaacccuaacuccaaccagaucagacaguagcgaagguuuucugcagcucccccaccaggauucccaagacucuucgagcgugggcucaaauucccuugaggaugggcagacacugggaacgaagaaaaguucuaugguggccuugaagcggcugccuuuccucaggaaccgcccaaaagacaaggauaaaaugaaggcgugcuaucguagaagcauguccaugaaugaccugguccagucaaugguucuugccggccaguggaccgguucuacugagaacuuagaagugcccgaugacaucagcacagggaagcggaggaaagagcugggcgcuauggcauuuaguaccacagccauaaauuucuccacugugaacagcucugcuggauuucgcucaaagcaacucguaaauaacaaagauaccacguccuucgaagacauuaguccgcagggcgucagcgaugacucgucuacagggucccgagugcacgccagcagaccugcaucauuggacaguggacggaccucuacuuccaauagcaacaauaacgcgucacugcaugagguuaaggccggugcugugaauaaccagaguaggccccagagccacuccucuggcgaauuuagccuacugcaugaucacgaggccugguccucaucugggaguucgccaauccaauaccucaaacgccagaccagaagcuccccuguccuucagcauaagaucucugagacacuggaaucaaggcaccacaagauuaaaacuggaagccccggcuccgaggugguuaccuugcagcaauuccuggaagagaguaacaagcucacaucugugcagaucaaaagcucaucccaggaaaaucuguuagacgagguaaugaagagucuuagcgucucuuccgauuuucuggguaaagacaagccagugucaugugggcucgcacggagcgugucgggcaaaacgcccggagauuucuaugaccgucgcaccacuaagccugaguuucuacgaccaggcccgagaaagacagaagauaccuacuucauuucuagugcugggaaacccacuccuggaacacaagguaagauaaaacuggucaaggaguccagcuugucaaggcaguccaaagacucuaacccauaugccacccugccccgggcaagcaguguuaucuccacggccgaaggcacuacccgcagaacaagcauucaugauuuccucaccaaggacucuaggcuuccuaucucaguggauaguccacccgcugcggccgacuccaauacuacagcagcuagcaacguagauaaggugcaggagucuagaaauucgaaaucacgaagcagagaacagcaauccaguuga

SEQ ID NO: 53934 - RNA, 6087 nt, Artificial Sequence
  derived and/or modified sequence opt3 from CCDC88C__Homo_sapiens__NP_001073883
auggacgugaccgucagcgagcugcucgaacuuuuccugcaaucccccuugguuacaugggugaagacuuuuggcccuuucgggucuggcucacaagauaacuuaacgauguacauggaccugguagaugguaucuuucugaaucagauuaugcuccagauagacccaagaccgaccaaccagaggaucaauaaacacgugaacaaugaugucaaccugcggauucaaaaucuuacaauccuggugcgcaacauuaagacuuauuaccaggagguuuugcagcagcucaucgugaugaaucugcccaacguccugaugauaggccgagacccucucagugggaaaagcauggaagagaucaagaaaguguuacugcuuguauugggaugcgccguucaaugugaacguaaggaggaguucauugaaagaaucaagcagcuggauauugagacccaggcuggcaucguggcacauauacaggaagucacacacaaucaagagaacguguuugaccuacaguggcucgagcugccagauguggcccccgaagaacuugaagcgcuguccaggucuauggucuugcaucuccggcgccugauugaccagagagaugagugcaccgaauuaaucguugaccugacucaagagagggauuaucuccaggcucagcacccuccaucgcccauuaaaucaagcagugccgacuccacaccuucuccaaccagcucccuuucaagugaggacaagcagcaucuggcaguggaauuggccgauacgaaagcucggcuacgccgaguaagacaagagcuggaagacaagacugagcagcucguggauaccaggcacgaagucgaccagcuggugcuugagcugcagaaaguuaagcaagagaauauccaguuggcagccgaugcucggagcgcccgugcguaccgcgacgaacucgauucucugagagagaaggcaaacaggguggaacgguuagagcuggaacuaacacgauguaaagagaagcuccacgacgucgauuucuauaaagcccgcauggaggaacugagagaggacaauaucauucuuauagaaacuaaggcuauguuggaggagcagcugaccgccgcaagggcucggggugauaaagugcaugaacucgagaaggaaaaccugcagcuuaaauccaagcugcacgacuuggagcucgaccgcgauacagacaagaaaagaaucgaagaacuguuagaggaaaacaugguacuggagauugcccaaaagcagucaaugaaugaaagcgcgcaucuagggugggagcucgaacagcugaguaaaaacgccgaucuuucugacgcauccaggaaaucauuuguuuucgaguugaaugagugcgcuucgucucguauccugaaacucgaaaaggagaaccagucccugcaaucaaccauacagggauuacgggaugccagucuggugcuugaagagagcggcuugaaguguggcgaacucgagaaagagaaucaccagcuguccaagaaaauugaaaagcuacaaacgcagcuggagcgagaaaaacagucuaaccaggaccucgagacucugagcgaggaacuuaucagagagaaggaacaauugcagucagauauggagacacugaaggcugacaaagccaggcagaucaaggauuuagaacaggagaaagaccaccucaaucgcgcaauguggagucugcgggagagaucccaagucagcucugaagccaggaugaaggauguggagaaagaaaacaaggcacuucaucagaccgucacugaggcgaaugggaagcugucacaguuggaauuugagaaacgccagcuccaccgagaccuggagcaagcaaaggaaaaaggagagcgggccgaaaagcuagagcgugaacugcagagacuccaggaggagaacgguaggcuggcucgcaaagugacaagucuugaaaccgccacggagaagguugaagcauuggagcaugagagccaaggccugcaguuagaaaaucggacccucagaaaaucccuggauacacuucagaacgugucucugcagcuagaggggcucgaaagggacaauaagcaacuggacgccgagaacuuggaacugcgacgcuuaguagagacuaugcgguucaccucgacaaagcucgcucagauggagagagaaaaucagcagcuggagagggaaaaagaggaacuucguaagaacgucgaucuguugaaagcccucggaaagaaaagcgagcgccuggagcuauccuaccaaucagugagugcagaaaaccugcggcuucagcagucucucgagagcuccucacacaagacucagacccuggaaagcgaguugggcgaacuggaggcggagagacaggcuuuaaggcgagaccucgaagcccugcggcuugcaaaugcccagcuggagggugcugaaaaggaucgcaaagccuuggagcaggagguugcacagcucgaaaaggacaaaaagcugcuagagaaagaagcuaagagacuguggcaacagguggagcuuaaggaugccguccucgacgauucuacagcgaaacuguccgccguggaaaaggagaguagggcuuuggacaaagaguuagcacggugccgagaugccgcugggaagcugaaagaacucgagaaggacaacagagaucugaccaagcagguaacugugcaugcccgcacgcuuacaacccugagggaagacuugguucuagagaaacuaaagagccaacagcucucuuccgaacuggauaaacuuucacaggaguuagagaaggucggacugaaucgugaacucuugcugcaggaggacgacaguggcagcgauacuaaauauaagauucucgaaggccggaacgagucggcacugaaaaccacacuugcgaugaaggaagagaagaucgugcuguuggaggcccaaauggaagagaaggcuucccuaaauagacagcuggaaucugagcuccagauguuaaagaaagagugugaaacccugaggcagaaccaaggggagggacagcaccuucagaauagcuuuaagcacccggccgguaaaacugcagcuucacaucagggcaaggaagccugggggcccggacacaaggaggcaacaauggaacugcuccgcgugaaagaccgagccauugaguuggagagaaacaaugcugcgcugcaagccgaaaagcagcuccugaaagagcagcuucaacaucuagaaacgcagaacgucaccuucaguucccagauacugacuuugcagaagcaaucugcauuuuuacaggagcacaauacaacccugcagacacagacugcuaaacuccaaguugaaaacagcacccuguccucacagagcgccgcccuuacggcucaguacacccugcuccagaaucaccauacagcaaaggagacugagaacgaaaguuugcaacggcagcaggagcagcugaccgccgcguacgaagcucuacugcaagaucacgagcaucucggcacacuucacgaaaggcagucugccgaguaugaggcacugauccgccagcauuccugcuuaaagacuuugcaccguaaucuggaacucgagcacaaagaacugggugagagacauggggacaugcuuaagcggaaagccgagcuggaagagagggaaaaggugcucaccacggagcgcgaggcuuugcaacaggagcagcgaacaaacgcacuggccaugggcgagaaccagagauuacggggagaacuagauagggugaauuuccugcaccaucaacucaaaggcgaguacgaggaacuucacgcgcauaccaaggaacugaagacuagcuugaacaaugcucagcuggagcucaaccgcuggcaggccagauucgacgagcugaaagaacagcaccaaacaauggauauuucgcuuaccaagcucgacaaucacugugagcuguugucaaggcugaaagggaacuuagaagaggaaaaucaucaccuacugucucagauccagcuccuuagucagcaaaaccagaugcuguuggagcagaauauggagaacaaggaacaauaucaugaggaacagaaacaguacaucgauaagcugaaugcacuccggcgucacaaggagaaacuggaggaaaagauuauggaccaguauaaauuuuacgauccuccacccaagaaaaagaaccacuggauaggagccaaagcucuuguaaaguuaaucaagccuaaaaaggaggguucccgcgaacgacugaaaagcacugucgacucuccacccuggcaacucgagagcuccgacccggccagcccugcugcuagucagcccuugagaagccaggccgaaaauccagauaccccugcgcugggcucuaacugcgccgaggagagggacgcacauaauggguccgugggaaagggccccggugaucuaaaaccaaagcgggggucaccccaccgcggcagucuggacagaacagaugcuagcacggaccucgccaugagguccuggccuucugaacuuggaucgcggaccuguagcacuucagcuacaaccacagcaccauccaacaguacuccgauugcccgacaucccggcagaaccaagggguauaacucugaugacaaucugugcgagccuagcuuggaguucgagguuccaaaccaccgccaguacguguccaggcccucaucucuggaaagcagucggaauacguccagcaacucuucaccucucaaucugaaaggauccagugagcaauuacauggucguagcgagucguuuucuuccgaagaucuuaucccaagcagagaccuggccacacuccccagggaggcuucaaccccgggccgcaacgcgcuagggcggcacgaauacccucugccacgaaauggacccuugccucaggagggcgcacagaagagagguacugcacccccauaugucggggugaggccuugcagugcuucucccuccagcgaaaugguuacccuggaggaguuccucgaagagucaaaccgcaguagcccaacacacgauacuccguccugucgggacgaucuucugucugacuacuuuagaaaagccagcgacccucccgcaauuggcggacagccaggacccccugccaagaaagaaggggcuaagaugccaaccaauuucguggcgcccacaguaaagauggccgcaccuacguccgagggacguccguugaaaccaggccaauaugucaagcccaacuuuaggcugaccgaggcugaagccccuccaucaguggcaccccggcaggcccagccuccgcaaucucucaguuuaggucgcccccgacaggcuccagugccucccgccucgcaugcgccagcaagcagauccgccucucugucaagggcuuucagccuugccuccgcugaucugcuacgggcaagugggccugaggccugcaaacaggaaucuccccagaagcucggagcuccagaggcccugggcggucgcgaaacuggcagccacacauugcaaucaccggcaccucccuccagucauagccuggcgagagagaggaccccacucgucgggaaagccggaucuuccugucagggccccgggccucgaucacggccacuugacacucguagauuuagccuggcucccccuaaggaggaacgcuuagccccgcugcaccagucggcaacagcuccagccaucgcaaccgccggagcuggcgcggccgcagcugguucugggaguaauucccaguugcuccacuucagccccgccgccgccccugcugccaggacgaagcccaaagcgccaccucggucaggagagguugcuacuauaacccccgugagagccggccugucccuaucugaaggugauggcguaccagggcaaggaugcagcgagggccuuccugcaaagaguccggggcgcucccccgaccuggccccacaucucggaagggcucuggaagauuguagccgaggcucugugucaaaaaguuccccugcaagccccgagccagguggggacccucagacagucugguacgaguauggaugcguguga

SEQ ID NO: 53935 - RNA, 1617 nt, Artificial Sequence
  derived and/or modified sequence opt3 from CCDC8__Homo_sapiens__NP_114429
augcugcagaucggcgaggacguggauuaccuccuuauucccagagaagucaggcuggccgggggaguuuggcgggugauaagcaagccugcuaccaaagaggcagaguuccgcgagcgauugacacaauuuuuagaagaggagggucguacucuggaagacguagccagaaucauggagaaguccacgccacacccgccccagccucccaaaaagccaaaagaaccuagggugcggcgcagaguccagcagauggugaccccacccccuaggcuaguugugggcacauaugauucuucaaacgcgagugacagcgaguucuccgauuuugagacuucucgggacaagucgcgccaagggccacgaagaggaaagaaagucaggaagaugccggugucauaccucggcagcaaauuccuggguagugaucuugaauccgaggacgaugaagaacugguagaagcauuuuugcggcgucaggagaagcagcccucugccccuccagcacgcagaaggguuaaucuccccgugccuauguucgaggacaaccuggggccacagcugagcaaagccgaucgguggcgagaauaugucucccaagugucauggggaaagcucaagcgcagagugaaaggcugggcucccagggcaggcccgggggucggagaggcccgguuagcuaguaccgccguugaaagcgcgggugugucuuccgcaccugagggcacaucacccggggaccgccugggaaaugccggcgauguaugcgugccacaggcuagcccuagaagguggcgucccaagauuaacugggccaguuuucggcgaagaaggaaagaacagaccgcaccaacuggucagggggcugacaucgaggccgaccaaggaggcgaggcggccgauucucagcgcgaagaggcaauugcugaccagcgggaaggcgccgcugggaaucaaagagccggagcacccgccgaucagggugcugaggcggcagacaaccagagggaagaggccgcugauaaucagcgcgccggcgcuccugccgaggaaggggcugaggccgcagacaaccaacgagaagaggcggcugauaaucagcgggccgaggcaccagccgaccagcguucccagggaacagauaaccauagagaagaggcugccgacaaucaaagggcagaagcuccggccgaucagggcagcgaggucaccgacaaccagcgcgaagaggcggugcacgaccagcgggagagagcccccgcuguucaaggugcagauaaucagagggcccaggcucgagccgggcagcgcgcagaagcggcccauaaccaacgggcuggcgccccuggaauccaggaggcagaagugucggcugcccagggcacgacugggaccgcaccaggagccagagcuaggaagcaagucaaaacagugcguuuccagacucccggucgcuuuucuugguucuguaagcggagaagggcguuuuggcacaccccucgacuuccaacauugcccaaacggguaccgcgcgccggcgaggcaagaaaucugaggguucuacgggcugaagcccgagccgaggcugagcagggggaacaggaggaccaacucuga

SEQ ID NO: 53936 - RNA, 1326 nt, Artificial Sequence
  derived and/or modified sequence opt3 from CCDC91__Homo_sapiens__NP_060788
auggacgaugacgauuucggcggguuugaggccgcugaaaccuucgacggagguagcggcgagacacagacuacgucccccgcaaucccuugggccgcguuuccagcugugucugggguccaccugucaccgaguagccccgaaauuguucucgauagagaccauuccucuucgauaggaugccuuucaagcgaugccaucauuaguuccccugagaacacccacgcagccaauucuaucgugagccaaacaauuccaaaggcucagauccagcaguccacucauacccaccuggacauaucauuguuccccuuaggccugacagaugagaaaaguaacgguaccaucgcccuaguagacgauagcgaggacccuggggcaaaugugucuaacauucaacuccagcagaagaucuccucacuggagauuaaacuuaaggucagcgaagaggaaaaacagaggaucaagcaagauguggagagucugauggagaagcauaauguuuuggaaaaaggauuucucaaggagaaagaacaggaggcuauaucuuuccaggaccgguacaaggaacugcaggagaaacacaagcaagagcuggaagacaugcgcaaggccggccacgaggcgcucuccauuaucguggaugaauauaaagcauuacugcagagcucggucaagcagcaaguggaggccauugaaaaacaguacaucucugcuaucgagaagcaggcccauaaaugugaggaacuuuugaacgcacagcaccaacgacugcuagagaugcucgacacugaaaaggagcugcuuaaagaaaagauuaaggaggcucugauacagcagucccaggagcaaaaagaaaucuuggagaagugccucgaagaggagcgucagagaaauaaagaagcccugguaucagcggccaaguuagagaaagaagcaguuaaggaugcugugcugaaggucguggaggaagagaggaaaaaccucgagaaggcccaugcugaagaacgggaacuuuggaaaacagagcacgccaaggaccaggaaaaagugagucaggagauucaaaaggcaauccaggagcagcgcaagauaagccaggaaaccgucaaagccgcuauuaucgaggaacaaaagagauccgagaaagcgguugaagaggcagugaagaggacgcgggaugagcugaucgaauauauuaaagagcagaagcgcuuggaccagguaauccgacaaagaucucuaagcucacuggaacucuuucugaguugugcccagaagcagcuuuccgcucugauugccacugagccaguggauauagaguga

SEQ ID NO: 53937 - RNA, 972 nt, Artificial Sequence
  derived and/or modified sequence opt3 from CCDC94__Homo_sapiens__NP_060544
augagcgagagaaaggugcugaacaaauacuaucccccugacuucgauccauccaagaucccgaaacucaaacuucccaaggacaggcaguacgucguucggcugauggccccuuuuaauaugcgcugcaagaccuguggcgaauauauuuacaaggggaaaaaguucaacgcucgaaaagagacagugcaaaaugaaguauauuugggauuaccaauauuucguuucuacaucaagugcacuagaugucuggcagagauuacguuuaaaaccgaucccgaaaacacagacuauacuauggagcacggugccaccaggaauuuccaggcggagaagcuacucgaagaggaagagaagcgggugcagaaagagcgcgaagaugaggaacugaacaauccuaugaagguccuugagaacagaacaaaagacucuaagcuggaaauggagguguuggagaaucuccaggaacugaaagaucugaaccaaaggcaggcucauguugacuuugaggccaugcuccggcagcaccgcuuaucagaagaggaacgaagaaggcagcaacaggaggaggaugaacaggagaccgcagcccugcuugaagaggcucggaagcgucgcuugcuggaagacagugauagcgaggacgaggcagccccaucuccccuacagccugcucucagaccaaauccgacugccauccuggaugaagcgcccaaaccuaagaggaagguggaggucugggaacaauccgugggcucgcuugggucacggccaccccugagccgauugguaguugugaaaaaggcaaaagccgacccugacugcaguaacggacagccacaggcugcccccacaccgggcgcaccucaaaaucgcaaggaggcuaaccccaccccacucacgccuggugccuccucucugagccaguuaggggcguaccuggauuccgacgauucaaauggaaguaacuga

SEQ ID NO: 53938 - RNA, 1032 nt, Artificial Sequence
  derived and/or modified sequence opt3 from CCDC97__Homo_sapiens__NP_443080
auggaggccguggcuaccgcaacagccgcgaaggaacccgacaaaggcugcaucgagccugggccaggacacuggggugaacugagcagaacuccgguccccuccaagccucaggauaaaguugaggcugccgaagcaacgccaguggcccucgacucugauaccucaggcgcugagaacgcagccguaagugcuaugcuucaugccguggcggcaagcaggcugcccgucuguucccaacagcagggggagccugacuugacagaacacgagaagguggccauuuuagcucagcuguaccaugaaaaaccccuaguuuuccucgagcgguuucgcacuggacugcgagaggaacaccuugccugcuucggccaugugcguggugaucacagagcagacuuuuauugugcugaggucgccaggcaagggaccgcgcggccacgcacacugagaaccagguugcggaaucgccgauacgccgcacucagagaacugauacagggaggcgaguauuucucugaugaacagaugagguuucgggcuccucugcucuacgagcaguauaucggccaauacuuaacucaggaggaacugucggcccguacaccaacccaccagccgcccaagccugggucaccaggacgccccgcuugcccucuuagcaacuugcugcuacagaguuaugaggaaagagagcuccaacagaggcugcuucagcaacaggaagaggaggaagccugucuggaggaagaggaagaggaggaagacuccgaugaggaagaccagcggucugguaaggauagcgaggcaugggugccagacuccgaggaacgauugauucuccgcgaggaguucacgucaagaaugcaucagagguuucuggauggcaaagacggggacuucgauuacaguacuguagacgauaaucccgacuuugauaacuuagacaucguugcccgggaugaggaagaacgcuacuucgacgaggaggaaccggaagaugcuccuagccccgagcuggacggagauuga

SEQ ID NO: 53939 - RNA, 2508 nt, Artificial Sequence
  derived and/or modified sequence opt3 from CCHCR1__Homo_sapiens__NP_001099033
auguggccccacagcgccggcgcuagaccuugggcauccacccugacagggaaggacccaagggugauggccugcuggugucucgauggacuuccgucuggucuggcggagcccuggcgggaauuguggcgcuggcgaucacguccuuuacauugcgucccacccuucaguccucuggcuagaagcuccagggaccaccggaaccuacgcagaaggggcaauaucgauggguggcggcagaaccucgagccaucuaauaacguugaaauguuucccccuucgggacaucaagacgugucagagcgccgacuggauacucagagaccacagguaacgaugugggaaagggacgugagcagugaucggcaggagccgggccgucgcgguagauccugggggcuugagggaucucaagcccugagccagcaggcagaagucauugugaggcaguugcaagagcuccggcgacuggaagaggagguucgccugcucagagaaaccuccuuacagcagaaaaugaggcuggaggcccaggcuauggaacuugaggcauuggcccgggcugaaaaggccggccgcgcggaggcagagggccugagagccgcucuagccggggcagaaguggucaggaaaaaucucgaggaaggaucacaacgugagcuggaagaggugcagcggcuucaccaggagcaacugaguagcuugacacaggcucaugaagaggcccucucuucccugacuucaaaggcggaagguuuagagaaaagccugaguucucucgaaacccgacgagccggcgaggcaaaggagcuugcugaagcccagagggaggcugaacuguugcgcaagcagcuauccaaaacacaagaggaccuggaggcccagguaacccucguugaaaaccugcggaaguacgugggggagcagguccccagcgaagugcacucgcagacuugggagcuugaaagacaaaaacuguuggagacaaugcagcaccuccaggaggauagggacucucugcaugcaaccgccgaauuacuacaggugcgcguccaaucccugacgcacauacucgcucugcaggaggaagaacuuacucgaaagguucagccuucagauaguuuggaaccagaguucacccggaaaugucagagccugcucaaucguuggagagagaagguguuugcgcugaugguacaacuuaaggcacaggaacuggagcauuccgacucugugaaacaguugaagggacaagucgccagccuccaggaaaaagugacaucacagagucaggagcaagcuauccugcagagguccuuacaggauaaggccgcagaaguugagguggagcgcaugggcgccaaaggucugcagcuagaacucagccgggcucaagaggccagaaggcgauggcagcagcagacugcaucugcggaggagcaacugcgccuugucgugaacgcuguaucaaguagccagauuugguuggagaccacaauggccaagguugaaggggcagccgcucagcugcccucccucaauaaccggcugucuuaugccgugagaaaaguccacaccaucaggggauuaauugcacguaagcuggcucuugcccaauugcgccaggagucgugcccucucccacccccggugacggacgucagccuggaacuacagcagcugcgggaggaaagaaauaggcucgacgcggagcugcaacuuuccgcccgauugauccagcaggaggugggccgggcucgcgaacagggcgaggcagaaagacaacagcugucaaagguugcccagcaguuagagcaagaacuccagcagacucaggagagucuggcuucucuugggcugcaauuggagguggccaggcagggacagcaagaaagcacagaggaagcagcgucccuccggcaggagcugacccagcagcaagaacuauacggucaggcccugcaggagaaaguagcugaggucgaaacucgacucagagagcagcugucagauacagaacgcaggcuuaacgaggcccgucgggagcacgcaaaggcugugguuagcuugagacaaauacagaggcgcgccgcacaggaaaaagagcgaucucaggaacugagacgguuacaagaggaagccaggaaggaggagggccagcgccucgcucguagacugcaggaacuugagcgggacaaaaaucugaugcuagcgacccuccaacaggaagggcuguuguccagguauaagcagcagcgccuguuaacggugcucccuagucugcuugauaagaaaaagagcgucgugucuucccccagaccaccugaguguucagccagugcacccguagcugccgccgugccaaccagagaaagcaucaaaggaucgcuguccguuuugcucgacgaucugcaagaccuaucugaggcuauuagcaaggaggaagcagucugccagggcgauaaccuggaccgguguucaaguuccaauccccagaugucuagcuga

SEQ ID NO: 53940 - RNA, 1287 nt, Artificial Sequence
  derived and/or modified sequence opt3 from CCKAR__Homo_sapiens__NP_000721
auggacguggucgauagccugcucguuaacggcuccaauaucacacccccuugcgagcuugggcuggaaaacgagaccuuguucuguuuagaccagccaagaccgucuaaggaauggcaacccgccgugcagauucugcuauacucacucauauuucugcuuaguguacugggaaauacuuuggugaucacgguccucauuaggaacaaacggaugcgcaccgugacaaauaucuuccugcugagccucgcuguuuccgauuuaaugcugugcuuguuuuguaugccuuucaaccuuauuccaaaucugcuaaaggacuuuaucuucgguucugcagugugcaaaacuaccacauauuuuaugggcaccucggucucagugagcacuuucaaccucguagccauaagucuggagcgauacggggcgaucuguaagccccuucagucccguguuuggcagacaaaaucucacgcucugaaggugauugccgcaaccuggugcuugagcuuuacgaucaugacuccuuauccaauuuacuccaaucucguccccuucaccaagaacaauaaccaaacagccaauauguguagauuucuguuaccuaacgaugugaugcagcagucauggcauacuuuccugcuccuuauccuguuuuugauaccaggaauugugaugauggucgcuuauggccuaaucagucuggaacucuaccaggguauuaaauucgaggcaagccaaaagaaaucugccaaggagaggaaaccguccaccacaucaagcgggaaguaugaagacagugauggaugcuaccugcagaagacccggcccccucgcaaacuugagcugagacaguugucuacgggcuccagcucgagggcuaaucggauccgcucuaacuccucagccgcgaaccucauggcaaagaaacgaguuaucagaaugcugauugugauaguaguguuauucuuucuguguuggaugccaaucuucagugccaaugcuuggagggccuacgacacugcaagcgcugaacggcgucuauccggcacacccauuucuuuuauccuccugcuuagcuauaccucaaguugcgucaacccuauaauuuacuguuucaugaauaagcgcuuuagauugggguucauggccacuuuuccaugcugccccaacccgggaccucccggugcgaggggcgaggugggggaggaagaggaaggaggcacaaccggugccucccugagccgguucucuuauucacacaugagugcaagcguuccaccucaguga

SEQ ID NO: 53941 - RNA, 1344 nt, Artificial Sequence
  derived and/or modified sequence opt3 from CCKBR__Homo_sapiens__NP_795344
auggagcugcucaaacuuaacagaagcgugcagggcaccgggcccggaccuggugccucccugugcaggccaggcgcuccguuguuaaauucuucaagugucgggaaccugagcugugaacccccucggauccgcggagcaggcacacgagagcuagaacucgccauucguauaacucuguacgcgguuaucuuccuuauguccgugggugggaauaugcugauuaucguaguguugggacucucuagaaggcugcggacggucaccaacgcuuuucugcucucguuagccgugucagaccugcuuuuggcaguugccugcaugccauucacacugcuacccaaucucaugggcacuuuuauuuucggcaccgugaucuguaaggcugucagcuaucugaugggggugaguguauccguuucuacacuuagccugguggcaauagccuuggagcgcuacuccgcuaucugcagaccucuccaagccagggucuggcagacccggucacacgcggcacgcgugauuguggccacuuggcuguuaaguggacugcucauggucccauaucccguuuacacagugguacagccuguggguccacgaguccuucagugugugcauagauggccgagcgcuaggguucggcaaaccuggucugugcuguugcuacugcuccuguuuuucauccccggcgucgugauggccguagcauaugggcuuauuucccgugaacuguacuugggacuccgcuuugauggcgacucagauagcgacagucagucuagaguuaggaaccagggugggcugccuggagcugugcaccagaauggccggugccgaccagagacgggcgccgucggggaggauuccgacggauguuaugugcaauuaccccgcagcagaccugcgcuggaacuaacugcccucaccgcaccaggucccggcucggggucuaggccgacacaggcuaagcugcuugccaaaaagcgggucgugcgcauguugcugguuaucgugguacucuucuuucugugcuggcuuccugucuacuccgcuaacacuuggagagccuucgauggacccggcgcacauagggcccugucaggugcuccaauaaguuuuauucacuugcucagcuacgcguccgcaugugugaauccucugguuuauugcuucaugcaucgucgguuucgacaggccuguuuagagaccugcgcuagaugcugucccaggccaccccgcgcccggccuagagcacugccagacgaagauccgcccacaccuucuaucgccagccuaucaaggcucaguuacaccacgauuuccacucuggggccaggcuga

SEQ ID NO: 53942 - RNA, 348 nt, Artificial Sequence
  derived and/or modified sequence opt3 from CCK__Homo_sapiens__NP_000720
augaacagcggcgugugccuguguguccucauggccguucuugcugcaggggcccugacccagcccgugccuccagcggacccggcuggauccgguuugcaaagagccgaggaagcacccaggcggcaguuacgcguaucucagcgaacagauggcgagucacgugcccaccugggggcucuacucgcaagauacauccagcaagccaggaaggcuccuaguggacggaugagcauugugaaaaaucugcagaaccuugacccaucccaucgcauaucugauagagacuauaugggcuggauggauuucgguaggcggucggccgaagaguacgaauaucccucauga

SEQ ID NO: 53943 - RNA, 294 nt, Artificial Sequence
  derived and/or modified sequence opt3 from CCL11__Homo_sapiens__NP_002977
augaaggugagcgccgcucugcucuggcuucuguugaucgcagccgcguucaguccccagggcuuagcugggccugccucugucccaaccacaugcuguuuuaaccuggcaaauagaaaaauuccgcuacaaaggcucgagucauaccggcgcauaacuuccggaaagugcccccagaaagccguuaucuucaagacgaaacuggcuaaggacauuugugcagauccuaagaaaaagugggugcaggacagcaugaaauaucuugaucagaaguccccaacccccaaaccuuga

SEQ ID NO: 53944 - RNA, 297 nt, Artificial Sequence
  derived and/or modified sequence opt3 from CCL13__Homo_sapiens__NP_005399
augaaggugagcgccguccugcucugccuucuguugaugaccgcugcauucaacccccagggcuuagcccaaccugacgcgcugaauguuccauccacauguugcuuuacuuucucuaguaaaaagaucucacuacagagacucaaaagcuacgugauuacgaccuccagguguccgcagaaggcuguaauauuucggacaaaacuggggaaggagaucugcgccgaucccaaggaaaaaugggugcagaacuauaugaagcaccuuggacgcaaagcacauacucugaagaccuga

SEQ ID NO: 53945 - RNA, 330 nt, Artificial Sequence
  derived and/or modified sequence opt3 from CCL14__Homo_sapiens__NP_116738
augaagaucagcguggccgcuauucccuucuuucugcucauaaccaucgcacuuggcacaaaaacugaguccucuucacagaccgggggaaagccuaaagucguuaagauucaacugaaauugguggguggcccauaccacccgagugaaugcuguuucacguauacaacuuacaagauccccagacagaggauuauggacuauuacgagaccaacagccagugcuccaagccugggaucguauuuauaacaaaacggggacauucuguguguaccaauccaucggauaaguggguccaggacuauaucaaagauaugaaggaaaacuga

SEQ ID NO: 53946 - RNA, 342 nt, Artificial Sequence
  derived and/or modified sequence opt3 from CCL15__Homo_sapiens__NP_116741
augaaggugagcgucgccgcucuguccugccucaugcuuguugcagugcugggcucucaggcccaauucaccaacgacgcggagacagaauugaugaugucaaaauuaccccuggagaauccuguagugcuaaacaguuuucacuucgcugccgauuguugcacuagcuacaucucccagucuauuccauguucgcucaugaagucauauuuugaaacgagcagugagugcuccaaaccgggggucauauuccugaccaagaaaggaagacaggugugugcaaagcccucugguccuggcguucaggacugcaugaagaaacuuaagccauacagcaucuga

SEQ ID NO: 53947 - RNA, 363 nt, Artificial Sequence
  derived and/or modified sequence opt3 from CCL16__Homo_sapiens__XP_005258077
augaaggugagcgaggccgcucugucccuccuuguccugaucuugauuauaaccucugcaucaagaagucagcccaaaguuccugaaugggugaacacaccaagcacuugcuguuuaaaguacuaugagaaaguacugccgaggcggcuaguggucggcuaccgcaaggcccucaauugccaccuucccgcgaucauuuucgugacgaaacgaaaccgugaaguuuguaccaauccuaacgacgauugggugcaagaguauaucaaggacccaaaucugccccuguugccuacaagaaaccucuccacugucaagauuaucaccgcuaaaaaugggcagccacagcugcugaacucucaguga

SEQ ID NO: 53948 - RNA, 285 nt, Artificial Sequence
  derived and/or modified sequence opt3 from CCL17__Homo_sapiens__NP_002978
auggcuccccugaagaugcucgcccuugugacccuguuguuaggcgcaagccugcagcacauccaugccgcgagagggacaaacgucggaagggagugcugucuagaauacuucaaaggugcuauuccucuccggaagcugaaaacuugguaucaaacguccgaggacugcucucgcgaugccauaguuuuugugaccguacagggccgagcaaucuguucagacccaaauaacaagcgugugaaaaaugccgucaaguaccuucagagucuggaaagaagcuga

SEQ ID NO: 53949 - RNA, 270 nt, Artificial Sequence
  derived and/or modified sequence opt3 from CCL18__Homo_sapiens__NP_002979
augaagggccuggccgcugcacuccuugugcuggucugcaccauggccuuguguagcugcgcgcagguugggacaaacaaagaguuauguugccugguguacacuuccuggcaaaucccccagaaguucauuguagacuauucugaaacgucaccucaguguccaaaaccgggagugauacuacucaccaagagagguaggcagaucugcgcugaucccaauaaaaaguggguccaaaaguacauuagugaccugaaacuuaacgccuga

SEQ ID NO: 53950 - RNA, 297 nt, Artificial Sequence
  derived and/or modified sequence opt3 from CCL19__Homo_sapiens__NP_006265
auggcccugcuccuugcucugagcuuguuagugcuguggacuucccccgcaccuacacuaucuggcacuaacgacgccgaggauugcugucucucagucacgcagaagccaaucccgggguacauuguuagaaauuuccacuaucugcuuauaaaagacggaugcagggugcccgcgguaguguuuaccacacugcggggucgccaauugugugcuccuccagaucagcccugggucgaacgaaucauucagcgucuccagagaaccagugccaagaugaaaaggcggagcuccuga

SEQ ID NO: 53951 - RNA, 291 nt, Artificial Sequence
  derived and/or modified sequence opt3 from CCL1__Homo_sapiens__NP_002972
augcagaucauuaccacagcccuggugugccuccuucuggcuggcauguggcccgaggacgucgauagcaaguccaugcaaguuccuuucucuagauguugcuuuucauucgcagaacaggagauaccauugagggccaucuuauguuaccggaacacgaguagcauuugcuccaaugaagggcugaucuuuaaacuaaagcgcggaaaagaggcgugugcucucgacacuguggguuggguacagcgacaccguaagaugcugagacauugcccgucuaaaaggaaguga

SEQ ID NO: 53952 - RNA, 288 nt, Artificial Sequence
  derived and/or modified sequence opt3 from CCL20__Homo_sapiens__NP_001123518
augugcuguaccaagagccugcuccuugccgcucugauguccguguuguuacugcaccuaugcggcgagucugaagcaucaaacuucgacuguugccucggguacacagauagaauccugcaucccaaauuuauugucggauucacuaggcagcuugccaaugaggguugugacauaaacgcgaucauuuuucacacgaagaaaaagcugaguguuugcgcuaauccuaaacaaaccugggugaaguauaucguacgguugcucagcaagaaagugaagaacauguga

SEQ ID NO: 53953 - RNA, 405 nt, Artificial Sequence
  derived and/or modified sequence opt3 from CCL21__Homo_sapiens__NP_002980
auggcccagagccuggcucucucccuucugaucuugguguuagcauucggcauucccagaacccaagggucugacggaggugcccaggauugcugucugaaguacucacagaggaaaauaccugcgaaggucguucggaguuaucgcaaacaggagccaagccuaggcugcuccaucccggcuauucucuuucugccccgaaagcguucucaagccgaacuuugugcagacccuaaagagcugugggugcagcaguugaugcagcaccucgauaagacaccaucgccccaaaagccugcccaggggugcagaaaagacaggggagcuucaaagacuggcaaaaaggguaaagggagcaagggauguaagcggacggaacgcagucagaccccaaaaggccccuga

SEQ ID NO: 53954 - RNA, 282 nt, Artificial Sequence
  derived and/or modified sequence opt3 from CCL22__Homo_sapiens__NP_002981
auggacagacugcagaccgcccuccuugugguccugguuuuguuagcuguggcacugcaagccacagaggcgggccccuacggggcuaacauggaagauagcguaugcuguagggacuaugugcgguaccgccuaccucuccgagucgugaagcacuucuauuggacuuccgauucuugcccacguccgggaguugugcugcuuacguuuagagacaaagagaucugugccgaucccagggucccuugggugaagaugauucugaauaaauugucacaguga

SEQ ID NO: 53955 - RNA, 414 nt, Artificial Sequence
  derived and/or modified sequence opt3 from CCL23__Homo_sapiens__NP_005055
augaaggugagcgucgccgcucuguccugccucaugcuuguuaccgcacugggcucucaggccagagugacaaaagacgcggagacugaguucaugaugucaaaguugcccuuagaaaacccuguacugcuagauaugcucuggaggcggaaaaucgggccacaaaugacgcugagucacgcugccggauuucaugcaaccagcgccgacuguugcauuuccuacacaccgcgcucuauacccuguucgcuucuggaaucauauuucgagacuaauagcgaaugcaguaagccuggugugaucuuuuugaccaaaaagggccgacguuucugugcuaacccauccgauaagcagguccaggugugcaugagaaugcucaaacuggacacaaggauuaagacccggaaaaauuga

SEQ ID NO: 53956 - RNA, 360 nt, Artificial Sequence
  derived and/or modified sequence opt3 from CCL24__Homo_sapiens__XP_011514762
auggccggccugaugaccaucgugacaagccuccuuuuccugggggucugcgcucaccauauuauacccacuggauccguugugaucccuucuccauguugcauguuuuucguaucaaagaggauuccggagaacagaguggucaguuaccaguugagcucccggucuacguguuuaaaagccggugugaucuuuaccacaaagaaaggccaacaguucugcggggaccccaagcaggaauggguucagcgcuauaugaaaaaucuggaugcaaagcaaaagaaagcgucgccucgagcucgugccguggcagucaagggaccagugcagagauaccccggcaaccagacuaccuguuga

SEQ ID NO: 53957 - RNA, 450 nt, Artificial Sequence
  derived and/or modified sequence opt3 from CCL25__Homo_sapiens__NP_001188288
augaaccuguggcuccuugccugccugguggcuggcuucuugggggcaugggcccccgcgguccacacccagggaguuuuugaggacuguugcuuagcuuaccauuauccuaucgguugggccgugcugagaagggcauggacauaccggauucaagaaguaagcggcuccuguaaucuaccagccgcuauauucuaucucccgaagcgccaccgaaaagugugcgggaaccccaagucucgugagguccagagagcaaugaaacugcuugaugccaggaauaagguguuugcuaaacugcaucacaacacucagacguuccagggaccucaugccguuaagaaguugucaaguggcaauagcaaacucuccucuucgaaguuuucaaacccaaucagcaguuccaaacggaaugugucucugcugauuagcgcgaacuccggucucuga

SEQ ID NO: 53958 - RNA, 285 nt, Artificial Sequence
  derived and/or modified sequence opt3 from CCL26__Homo_sapiens__NP_006063
augaugggccugagccucgccuccgcugugcuucuggcaucuuuguuaucacugcaccuagggaccgccacaagaggaagugacaucagcaagacuugcuguuuccaguacucccauaaaccccucccuuggacgugggucaggucuuaugaguuuaccucgaacucaugcagccaacgggcgguuauuuucacaacuaagcgcgguaaaaagguguguacccacccacgaaagaaauggguacagaaguacauaagucugcuuaaaacaccgaagcagcuguga

SEQ ID NO: 53959 - RNA, 339 nt, Artificial Sequence
  derived and/or modified sequence opt3 from CCL27__Homo_sapiens__NP_006655
augaaggggcccccuaccuucugcagccugcuccuucuguccuuguuacugucuccagacccgacagccgcuuuucuacugcccccuucaacugcauguugcacgcagcuguacagaaaaccacuuagugauaagcuguugaggaaagugauccaagucgagcuccaggaagccgacggcgauugucaccuccaggcguucguucugcaucucgcucagcggagcauuugcauacacccccaaaacccuuccuuaucucagugguuugagcaucaggaacgcaagcugcacggaacccuuccaaaauugaauuucgguaugcugcgaaagaugggcuga

SEQ ID NO: 53960 - RNA, 384 nt, Artificial Sequence
  derived and/or modified sequence opt3 from CCL28__Homo_sapiens__NP_001288802
augcagcaaagaggccuggccaucguggcucucgcagucugcgccgcgcuucacgcuagcgaggccauucugcccauagcauccucuuguugcaccgaaguuucacaucacaucaguaggcgguuguuagagcgcgugaacaugugucguauucagcgagccgacggggauugcgaccuggcugcaguaauccuacaugugaagagaaggcggauuugugucagcccucacaaucauacagugaaacaguggaugaagguucaggccgcuaaaaagaacggaaaagguaaugugugccaccgcaagaagcaccauggcaaaagaaacuccaauagggcccaccaagggaagcaugaaacuuacggacacaaaacgccauauuga

SEQ ID NO: 53961 - RNA, 300 nt, Artificial Sequence
  derived and/or modified sequence opt3 from CCL2__Homo_sapiens__NP_002973
augaaggugagcgccgcucugcucugccuucuguugaucgcagccaccuucauuccccagggcuuagcgcaaccugacgcuauaaacgccccagucacauguugcuacaauuuuacuaacagaaaaaucuccguucagaggcuggcaucuuaucggcgcauuacgucaaguaaguguccgaaagaggccgugaucuucaagaccauuguagcuaaagaaaucugcgcagaucccaagcagaagugggugcaggacagcauggaucaccuagacaaacaaacacagacuccuaagaccuga

SEQ ID NO: 53962 - RNA, 279 nt, Artificial Sequence
  derived and/or modified sequence opt3 from CCL3__Homo_sapiens__NP_002974
augcaagugagcaccgccgcucuggcaguccuccuuugcacaauggcccuguguaaccaguucuccgcgucuuuggcugccgacacucccacggcaugcuguuuuucauacaccaguagacagaucccucagaauuucauugccgauuauuuugagacaagcucccagugcucuaagccaggcguuauauucuuaacuaaaaggucgcggcaagugugugcugacccgucagaagaguggguacagaaguacgugagcgaucuggaacuaagugcauga

SEQ ID NO: 53963 - RNA, 282 nt, Artificial Sequence
  derived and/or modified sequence opt3 from CCL3L3__Homo_sapiens__NP_001001437
augcaagugagcaccgccgcucuggcaguccuccuuugcacaauggcccuguguaaccagguuuuguccgcgcccuuagcugccgacacuccuacggcaugcuguuucucuuacaccucaagacagaucccacagaauuuuauugccgauuauuucgagacaaguagccagugcuccaagccgucugugauauuucugacuaaaaggggccggcaaguaugugcugaccccucggaagagugggugcagaaguacgucucagaucuagaacucagcgcauga

SEQ ID NO: 53964 - RNA, 279 nt, Artificial Sequence
  derived and/or modified sequence opt3 from CCL4__Homo_sapiens__NP_002975
augaagcugugcgugaccguccucagccuucugauguugguugccgcuuucuguucccccgcauuaucugccccuaugggcucagacccaccgacagcgugcuguuuuaguuacacugcuagaaaacugcccaggaacuucgugguagauuauuacgagacgagcucccuaugcucucagccugccguggucuuucaaaccaagcggucgaaacaggugugugcagacccaucagaaagcuggguucaggaguauguguacgaucucgaacugaauuga

SEQ ID NO: 53965 - RNA, 279 nt, Artificial Sequence
  derived and/or modified sequence opt3 from CCL4L1__Homo_sapiens__NP_996890
augaagcugugcgugaccguccucagccuucugguuuugguggccgcuuucuguuccuuagcacugucugcccccaugggcucagacccuccaacagcgugcuguuuuaguuacacugcuagaaaacuaccgaggaacuucguaguggauuauuacgagacgagcucccucugcucucagcccgccgucguguuucaaaccaagcgggggaaacagguuugugcagacccuucggaaucaugggugcaggaguaugucuacgaucuggaacuuaauuga

SEQ ID NO: 53966 - RNA, 264 nt, Artificial Sequence
  derived and/or modified sequence opt3 from CCL4L2__Homo_sapiens__NP_001278397
augaagcugugcgugaccguccucagccuucugguuuugguggccgcuuucuguuccuuagcacugucugcccccaugggcucagacccuccaacagcgugcuguuuuaguuacacugcuagaaaacuaccgaggaacuucguaguggauuauuacgagacgagcucccucugcucucagcccgccgucguggggaagcaaguuugugcagacccuucggaaucaugggugcaggaguaugucuacgaucuggaacuuaauuga

SEQ ID NO: 53967 - RNA, 465 nt, Artificial Sequence
  derived and/or modified sequence opt3 from CCL5__Homo_sapiens__NP_001265665
augaaggugagcgccgcugcacuggccgucauccucauugcgaccgcucuuugcgcccccgcauccgccucuccuuacucaagugacacaacuccauguugcuucgcuuauauagcaagaccgcugcccagggcccacaucaaagaguacuuuuauacgagcggcaaguguuccaacccugcuguugugcaucggucucgcaugccaaaacgagaagggcagcaaguauggcaggauuucuuguacgacucgcguuuaaauaagggaaaacugugccaccccaaggagccuccaucagugugucagcccagagaagagauggguagcggcguccaucagcuauuuggggaugaacucggauggagggugcuggagccugagcuuacccaaauuugccuguucuugcucgcccugguucuggcgugggaagcaaguccacacuauccgacacccccugccccauga

SEQ ID NO: 53968 - RNA, 300 nt, Artificial Sequence
  derived and/or modified sequence opt3 from CCL7__Homo_sapiens__NP_006264
augaaggccagcgcugcacugcucugccuucuguugaccgccgcggcuuucucuccccagggcuuagcccaaccuguggggaucaacacauccacuacguguugcuacagauuuauuaauaaaaagauaccaaaacagaggcuggagucauaucggcgcaccacaaguagccacuguccgcgagaagcagucaucuucaagacuaaacuagacaaggagauuugcgccgaucccacccagaaguggguucaggacuuuaugaaacaucucgauaagaaaacacaaaccccuaagcuguga

SEQ ID NO: 53969 - RNA, 300 nt, Artificial Sequence
  derived and/or modified sequence opt3 from CCL8__Homo_sapiens__NP_005614
augaaggugagcgccgcucugcucugccuucuguugauggcagccaccuucucuccccagggcuuagcgcaaccugacuccgucucaaucccaauuacauguugcuuuaacguuauaaauagaaaaaucccgauucagaggcuggagaguuacacucggaucacgaacauucagugucccaaggaagcugugaucuucaaaaccaagcgcgggaaagagguaugcgccgauccuaaggaacgaugggugcgugacagcaugaagcaccuagaucagauauuucaaaaucucaaaccauga

SEQ ID NO: 53970 - RNA, 1398 nt, Artificial Sequence
  derived and/or modified sequence opt3 from CCM2__Homo_sapiens__NP_001025006
augcacagcuccugcagacagaggcggaaccaaaaucugucuaaggagaucccccagaccgaauuucauacaggcuacucaauggagaacgaaccugggauugugaguccauuuaaacgcgucuuccucaagggagagaaaagccgagacaagaaagcccacgaaaagguuacugagcguagaccgcuucauacggugguacuguccuugcccgagaggguggaaccugaucgguuacugucugacuauauagagaaggaagucaaauaccuaggucagcucaccucgaucccaggcuaucugaaucccucaagccgcacagagauucuucacuuuaucgauaacgcuaagagagcacaucagcugccugggcacuugacucaagagcacgacgccgugcucagucuguccgcguacaauguuaaacuggcuuggagggauggagaagacauuauccuccgggugccaauacaugauaucgccgcagucucuuaugugcgcgacgaugccgcucacuuaguaguucugaagaccgcacaggaccccggcauuagcccuucccagucacuuugugccgagaguagccgagguuugucugcugggucccugucagaaagcgccgugggaccagucgaggcgugcugucuagugauccucgcagccgaaaguaaaguggcugccgaggagcugugcugucuucugggccaggucuuccaaguuguguacacagaaucuaccauugauuucuuggacagagcaaucuucgauggcgcuuccacuccgacacaucaccucagccugcacucggacgacucuuccaccaagguagauauaaaggagacguaugaaguggaggccucaacuuuuugcuuccccgaaagugucgacguugggggagcgagcccucauuccaaaaccauuucugagagcgaguuaucagccagugcaacagaacugcuccaggauuacaugcuuacucugaggaccaaguuguccagccaggagauccagcaauuugcugcccuacugcacgaauaccggaacggugcuucuauucaugaguucuguaucaaucuccgucagcuguauggcgacucacgcaaauuucuucuguuggggcucagaccauucauccccgaaaaggauagucagcacuuugagaacuuccuggagacaauuggagugaaagacggcagggguauaaucaccgauagcuucgggcggcaucgacgcgccuuauccacgacuucuucgagcacaaccaauggaaacagagcaacuggcuccucagacgauaggagugccccuucugaaggcgacgagugggaucggaugauuagcgacaucuccucagacauagaagcucuggggugcagcauggaucaagacucugcguga

SEQ ID NO: 53971 - RNA, 1395 nt, Artificial Sequence
  derived and/or modified sequence opt3 from CCNA1__Homo_sapiens__NP_001104515
auggagaccggcuuccccgccaucauguacccugggagcuuuauuggagguuggggcgaagaguaucuguccugggaagggccaggacucccggacuucguguuucagcaacccgucgagucugaagcuaugcacugcucaaacccuaagaguggcguugugcuugcaacaguagccagagguccagaugcgugucagauacugacuagggcucccuuggggcaggacccuccacagcggacgguguuaggacugcuaaccgccaauggccaauaccgccgaacaugcggccaggggaucacucguauuagauguuauagcggauccgagaacgcauuucccccugccgguaaaaaggcucucccagauugcggcguccaggagccgcccaaacagggguuugacaucuacauggaugaacuggagcaaggagacagggauucuuguucggugcgggaaggcauggcauucgaggacguuuaugagguggauaccgguacacuuaagucagaccugcauuucuugcucgauuucaauaccgucagcccuaugcugguggacaguucccugcucucucagagcgaagauauuuccucauuagggacugacguaaucaacguuacagaguacgccgaagagauauaucaguaccugcgcgaagcugagaucagacacaggccaaaagcccauuacaugaagaagcagcccgacauuaccgagggaaugcggacgauccuuguggauugguuggucgaagugggcgaggaauauaaacugcgcgcggagacucuauaccucgcagugaauuuucuggaccgauuccuuaguugcaugagcguccugagaggcaaguugcaacucguugggaccgccgcuaugcuguuagccucuaaauaugaagagauuuacccuccagagguggaugaauuuguauauaucacagacgauacuuacaccaagaggcagcugcucaaaauggagcaccuucuguugaaggugcuagcauucgaccugacaguccccaccacgaaccaguuucuccugcaauaucuucggcgucagggaguguguguucgcacugaaaaucuggcuaaguacguggccgaguugucccuccuggaagcggauccguucuuaaaauaccugccuucacuaauagccgcagcugccuucugccucgcuaacuauacagucaauaagcauuuuuggcccgagacccuggccgcauucacugguuacagccuuagugagauugugccauguuugucugaacugcacaaagccuaucucgacaucccucacagaccccagcaggcuauuagggagaaguacaaagcguccaaguaucugugcguaagccuuauggaaccacccgcaguucuguugcuccaauga

SEQ ID NO: 53972 - RNA, 1299 nt, Artificial Sequence
  derived and/or modified sequence opt3 from CCNA2__Homo_sapiens__NP_001228
augcugggcaacagcgcccccgggccugcuaccagagaggcaggauccgcccuccuugcgcugcagcaaacagcuuugcaggaagaccaggagaauaucaacccagaaaaggccgcaccggugcagcaacccaggacucgggccgcuuuagcaguccugaaaucugguaauccucgcggccuagcccagcagcagcgaccaaagacgcguagaguugcuccccucaaagaucugccugugaacgacgagcacguaaccgugccacccuggaaggccaauucaaaacaaccugcguucacaauucaugucgaugaagcagagaaggaggcccagaagaaaccagcugaaagucagaagauagagagggaagacgcccuugcauuuaacagcgcuaucucccugccggggccccggaaaccuuuggugccacucgauuaccccauggacggaucuuucgagucgccucacacuauggauaugucaauuguucuggaggacgaaaagccagugagcgucaaugaggugcccgauuaucaugaagacauccacaccuaccugcgcgagauggaaguaaaaugcaagccgaagguuggcuauaugaaaaagcagccugauauuacaaacaguaugagagccauccucguggacugguuagucgaggugggugaggaauacaaacugcaaaaugagacccuucauuuggcggugaacuauauagauagguuucuguccucuaugagcguccuacgggggaagcuccagcugguuggaacugccgcaaugcuucuggcuuccaaauucgaagagaucuaucccccagaaguggccgaguuuguauacauuacagacgacaccuacacgaagaaacagguguugcgcauggagcaccucguccugaagguguuaacuuucgaucuggcugccccuaccguuaaucaauuucucacacaguacuuccuucaccagcagcccgcaaacuguaagguggaaucacuggccauguuuuugggcgagcuaagucugaucgacgcugauccauaucucaaauaccugcccagcgucauugcgggcgcagccuuccaucuugcucuguauacugugaccgggcaaucuuggccugaauccuugauccgaaagacaggauacacccucgagucacugaaaccaugcuuaauggaccugcaccagacguaucuaaaggccccgcagcaugcacagcaaagcauaagagaaaaauacaagaauaguaaguaucacgguguaucucuccugaaucccccugagacucuuaacuuguga

SEQ ID NO: 53973 - RNA, 1302 nt, Artificial Sequence
  derived and/or modified sequence opt3 from CCNB1__Homo_sapiens__NP_114172
auggcccugagagugaccaggaacagcaagaucaaugcugagaacaaagcaaagauuaauauggccggcgcgaaacggguccccacagcuccugccgcaacuuccaagccagggcuccgcccgcgaacggcccuuggagacauagguaacaaaguuucugaacagcugcaagcuaagaugcccaugaagaaagaggcaaagccuucagccaccggcaaagugaucgauaagaaauugccaaagcccuuagaaaagguaccuaugcuggugccaguccccgugagugagccuguuccagaaccggagcccgagccugaaccagagcccgugaaagaagagaagcuaagcccugagccaauucucgucgacacagcuucccccucuccgauggaaacuucggggugcgccccugcggaggaagaucugugucaggcauucucagacgugauccuugccguaaaugauguugacgcugaggauggagccgaccccaaccugugcagcgaauacgugaaagauauuuaugcauacuugcgucagcucgaggaggaacaggcugucagaccaaaguaucugcugggcagggaggugaccgguaauaugcgggccauccucauagacugguuagugcaaguccagaugaaauuucgccugcuucaggaaacaauguacaugaccguuaguaucauugauagauucaugcagaacaauugugugccuaagaaaauguugcaacugguaggggugacugcgauguuuaucgccuccaaguaugaggaaauguaucccccagagauuggagacuucgcauuugucacagauaacaccuacacgaagcaccagaucaggcagauggagaugaaaauacuacgggcucucaauuucggccugggccgcccccuuccucugcacuuuuugagacgagccucuaagauuggggaaguggacguugagcagcauacucucgcuaaauaccugauggaauuaaccaugcuggacuacgauauggugcauuucccaccgagccaaaucgccgcaggagccuuuugccucgcucuuaagauucuggacaacggugaguggacacccacuuugcagcacuaucuauccuacaccgaagagucacugcucccugucaugcagcaucuggcgaaaaaugugguaaugguuaaccaaggccuuacaaagcacaugaccgugaagaauaaauaugcaacgaguaagcacgccaaaaucagcacucugccacaguugaacucugcucucguccaggaucuggccaaggcaguggccaaagucuga

SEQ ID NO: 53974 - RNA, 1197 nt, Artificial Sequence
  derived and/or modified sequence opt3 from CCNB2__Homo_sapiens__NP_004692
auggcccugcucagaaggcccaccgugagcuccgaccuugagaacaucgauacaggcgucaauucuaagguuaaaucacacgugacuauucggcgcacgguacuggaagagauagggaaccgagugaccacacgugcugcacaggucgccaagaaagcgcaaaauacuaaggugccuguucagccaaccaaaacaaccaacgugaauaagcaguugaagccgacugcuagugucaaacccgugcagauggaaaaguuagccccuaaaggaccaagccccacaccugaggacguauccaugaaggaagagaaccugugccaagcauucucugaugcccuacucuguaaaaucgaggacauugauaaugaagacugggagaacccacagcugugcucggauuacguuaaggacaucuaucaguaccuuagacagcuggaaguguugcaaucaauuaauccccauuuucucgaugguagggacaucaacggccggaugcgcgcuauacuggucgauuggcugguccaggugcacagcaaguucagacucuuacaggagacccuguauauguguguggggaucauggacagguuucuucagguucaaccugugagucggaaaaaguugcagcugguaggaauuacggcacuacuccuggccuccaaauacgaggaaauguucucuccaaauaucgaggauuuuguguauauuacugacaacgcuuacaccagcucccagauccgcgaaauggagacacuuauacugaaggaauugaaauucgagcucggccgaccgcugcccuuacauuuucugagaagggccucaaaggcgggugaggucgacguggaacaacacacucucgcaaaauaucuuauggagcugaccuugauugauuacgacaugguucauuaccacccuaguaagguggccgcugccgcaagcugccuaucucagaagguccuggggcagggaaaauggaaucucaagcagcaauauuacacaggcuauaccgaaaacgaggugcuggaaguaaugcagcacauggcuaaaaauguugugaaggucaacgagaaccuuacgaaauucaucgccauuaagaauaaguacgcguccucaaaacuguugaagaucagcaugaucccacagcucaacaguaaagccgugaaggaucuggcaucucccuuaauuggccgguccuga

SEQ ID NO: 53975 - RNA, 876 nt, Artificial Sequence
  derived and/or modified sequence opt3 from CCNB3__Homo_sapiens__NP_391990
augcugcucccccuuccuccacagagcuccaagccggugcccaaaaagucucaaucaaguaaaaucgucccuagccaccaugacccauccgagaagaccggcgaaaacugccagacaaaaauuucucccucgucacugcaggagagcccuaguuccuugcagggggccuuaaagaagagaucugcuuucgaagaucugacuaauguuagcuuugagaugacgcacgaaacccuauaccucgcagugaaacugguagaccuuuaucugaugaaggccguguguaaaaaggauaaauugcaacuccugggagcgacagcuuucaugauagccgcaaaguuugaggagcauaacuccccaagggucgacgauuucguguacaucugcgacgauaauuaucagcggucagaaguucugaguauggagauuaacauccucaauguguuaaagugugacauuaacauccccauagccuaccacuuucugcgccgauaugcucguugcauccauacuaauaugaaaacccuuacauugagcagauacauuugugaaaugacccugcaggaguaucacuacguccaggagaaggcaucuaaacuagccgcugccucccuccugcuugcgcuguacaugaagaaauuggguuauugggugccuuuccucgaacacuacucaggcuauagcaucagugagcugcauccauuaguaaggcaacugaacaagcuccuuacuuuuucuuccuacgauagccugaaagcaguuuauuacaaguauucgcacccgguguucuuugaagucgccaagauucccgcuuuggacaugcuaaaacuggaggaaauccucaauugcgauugugaggcccaggggcuggugcuuuga

SEQ ID NO: 53976 - RNA, 597 nt, Artificial Sequence
  derived and/or modified sequence opt3 from CCNC__Homo_sapiens__NP_001013417
auggccccuaccugcguguuccuggcuagcaaggucgaggaauuuggcguuguguccaacacaagacucaucgcagccgcgacuucuguacuuaaaacgagguucucauacgcuuuucccaaggaguucccauaucggaugaaucacauucuggaaugugaguuuuacuuguuagaacugauggacugcugucuaauaguguaucauccguaccgcccccuccugcaguauguccaagauauggggcaggaggacaugcuucugccuuuggccuggcgaaucgugaacgauaccuaccguacagaccucugccugcuguauccacccuucaugauugcacucgccuguuuacacguugcuugcgugguccagcagaaagaugcaagacaaugguuugccgagcugaguguggacauggaaaagauccuugagauuaucaggguaauauugaaacuguacgaacaguggaagaauuucgaugagcggaaggagauggcuacuauccuaagcaaaaugccuaagccaaaacccccuccaaacuccgaaggagagcaggguccgaauggcucucagaacucgucauacagccaaaguuga

SEQ ID NO: 53977 - RNA, 888 nt, Artificial Sequence
  derived and/or modified sequence opt3 from CCND1__Homo_sapiens__NP_444284
auggagcaccagcugcucugcugugaaguggagaccaucagaagggccuaccccgacgcuaaccuucugaaugaucgggucuugcgcgcaauguuaaaggccgaagagacaugcgcgccuagcguuuccuauuucaaaugugugcaaaaggaaguacugccaucuaugcgaaaaauuguggcuacuuggaugcuagaggucugcgaggaacagaagugugaggaagagguguuuccgcucgccaugaacuaccuggaccguuuccuuucacuggagcccguuaaaaagaguagauugcagcuccugggcgcaacgugcauguuuguggccagcaagaugaaagaaaccauaccucugacagcugagaagcucuguaucuauacugauaauuccauuaggccagaagaguuacugcagauggaacuuuugcuggucaacaaacuaaaguggaaucucgcagccaugacaccccaugacuucaucgagcacuuucugucuaaaaugccugaggcugaagagaacaagcaaauuauccggaagcaugcccagaccuucguggcgcuuugcgcaaccgauguaaaauuuauaucgaauccacccucaaugguugccgcugggagcguggucgccgcagugcagggacugaacuugcgcaguccuaauaacuuccucuccuacuauagacugacuagguuuuuaucucgggugaucaagugugacccagauugccugcgcgcuugucaggaacaaauugaggcccuccuugaaagcucccugcgacaggcgcagcagaauauggacccgaaagccgcagaggaggaagaggaagaggaagaggaggucgauuuggcuugcacacccaccgacguuagagauguggacaucuga

SEQ ID NO: 53978 - RNA, 870 nt, Artificial Sequence
  derived and/or modified sequence opt3 from CCND2__Homo_sapiens__NP_001750
auggagcugcucugccacgaaguggaccccgucagaagggccguucgggaucgcaaccuucugcgagacgaucguguguugcagaauuuacugaccaucgaggaaagauaccuaccucaauguagcuauuucaagugcguacagaaagacauucagccauacaugaggcggaugguggcuacauggaugcucgaggucugugaggaacagaagugcgaggaagagguguuuccgcuggcaaugaacuaucuugaucgcuuccuggccggcguucccacuccuaaaucccauuugcaacuccugggggcgguguguauguuucuggcuucuaagcucaaagaaacgucaccauuaaccgccgagaagcugugcauauacacagacaauaguaucaagccccaggagcuuuuggaaugggagcuggucgugcuaggaaaacucaaguggaaccuggcagccguaacuccucacgauuucauugaacauauccuuagaaaacugccacagcagagggagaaguugagccucauucggaaacacgcucaaaccuuuaucgcacugugugccacagacuucaaguuugcuauguaucccccuuccaugauagccaccgguucuguuggcgcggcaaucugcggguuacagcaggaugaagaggugucgucacugacuugugacgcccucacagagcuucuggcuaagauuaccaauacggaugucgacugcuugaaagccugucaggaacaaaucgaggcagugcuacugaacagccuccagcaguaccgccaagaucagcgagacggaaguaaguccgaagacgagcuggaucaggcuucuacuccaaccgacgugagagauauugaccuuuga

SEQ ID NO: 53979 - RNA, 636 nt, Artificial Sequence
  derived and/or modified sequence opt3 from CCND3__Homo_sapiens__NP_001129489
augaacuaccuggacagauaccucagcugcgugcccaccaggaaggcccagcuucaacuguugggcgcugucuguauguuacuggcauccaaacuacgggagacaacuccucucacgaucgaaaagcugugcauuuacaccgaucacgccguuucuccacgccagcuucgagacugggaggugcugguauuggggaaacucaagugggaucuggcggcugugauagcccaugacuuccuggcauuuauccuccaccguuuaucacugccgagagauaggcaggcccuugucaaaaagcaugcucagacauucuuggcacugugugccacugacuauaccuuugcuauguaucccccuaguaugauugccacaggaagcaucggugcggcagugcaaggccuaggggccugcuccaugucuggagaugaacucaccgagcugcuugcuggcauuacugguacagaaguugacugucugcgggccugccaggagcagaucgaggcagcuuugcgcgaaucgcucagagaggccucacagaccagcaguuccccagcgcccaaggccccuagggggucuagcucccaaggaccaucacagacgaguacucccaccgaugugacagcaauacaccuguga

SEQ ID NO: 53980 - RNA, 1083 nt, Artificial Sequence
  derived and/or modified sequence opt3 from CCNDBP1__Homo_sapiens__NP_036274
auggccagcgcuaccgcacccgccgcggcugugccuacacuggccuccccacucgagcagcuuagacaccuggcagaagaguugagguuacugcuaccgcggguccgcguuggagaagcccaagagacuacggaagaguucaaccgagagauguuuuggcguagacucaaugaagcugcagugaccguaucuagggaggccacaacucugaccaucguguucucacagcuuccccugccuaguccacaggaaacacagaaguuuugcgagcaaguccaugcugccauuaaagcguucauagcaguguacuauuugcuccccaaggaccaggggaucacccugcggaaacugguucgcggagccacucucgauauuguggacgguauggcucaguuaauggagguccugagcgugacaccuacccaguccccagaaaacaaugaucuuaucucuuacaacucgguauggguugccugucaacagaugccccagauuccuagagacaauaaggcagcugccuugcugaugcuaacgaaaaacguggauuuugucaaggacgcgcacgaggaaauggagcaggccguggaagagugcgauccauauucaggccuccugaaugacacugaggaaaacaauagcgauaaccauaaucacgaggacgaugugcuuggguucccgaguaaccaagaccuguacugguccgaagaugaccaggaguugaucauacccugucucgcacuggucagggcuucuaaggccugccugaaaaagauccggauguuaguugcugaaaauggcaaaaaggaccagguggcccaacucgaugacauuguagauaucagcgacgagauuuccccuucaguggaugaccuugcacugaguaucuauccacccaugugucauuugaccguccgcauaaacagcgccaagcuagugucuguucugaaaaaggcucucgagauuacaaaagcgucccacgugacuccucagccagaagauucauggaucccccugcuuauuaaugcaaucgaccacugcaugaaccgaaucaaggagcugacccagagcgaauuggagcucuga

SEQ ID NO: 53981 - RNA, 1233 nt, Artificial Sequence
  derived and/or modified sequence opt3 from CCNE1__Homo_sapiens__NP_001229
augcccagagagaggcgggaacgcgacgccaaggagcgagauaccaugaaagaagacggcggggcugaguucagcgcacguuccagaaagaggaaagccaacgugacagucuuucugcaggauccugacgaagagauggcgaagaucgaucggacugcucgcgaccaaugcggaucucagccaugggauaauaacgccguuugugcagacccgugcucacucauucccacgccugauaaagaggacgaugacagaguguacccaaauaguaccuguaagcccaggauaaucgccccuagccgggguuccccacuucccguacugucuugggcuaaccgcgaagagguguggaagauuauguugaauaaagaaaagacauauuuacgagaucagcacuuccuggagcagcauccucuacuccaaccaaaaaugagagcaauccugcuugacuggcugauggaggucugcgaaguguacaaguugcacagggagacuuuuuaucucgcccaggacuucuuugaucgguacauggcuacccaggaaaacguugugaaaacacugcugcagcucauuggcaucucgucauuauucauagccgcgaagcuggaggaaaucuauccgcccaaacuucaucaauuugcauacgucaccgacggggccuguagcggagaugagauuuugacuauggagcugaugaucaugaaggcucuaaaguggcgucucaguccucugacaauuguguccuggcuuaauguauauaugcagguugccuaccugaacgacuugcacgaagugcuccugccacaguacccccagcaaaucuucauacagauugcagaguuacuggaucucugcguccuugacguggauugucuggaauuuccuuauggcaucuuggcugccucugcgcuauaccauuucagcuccucagagcugaugcagaaagugagugguuaucaauggugcgacauugaaaauugugucaaguggaugguuccauuugccauggugauccgcgagaccgggagcucuaaacucaagcacuucagaggaguagcagaugaggacgcucacaacauccagacgcauagggauucccuggaccuucuggacaaagcccgggcuaagaaggccauguugucagaacagaaucgagcaagcccccucccgaguggccuguuaacuccuccccagucuggcaaaaagcaauccagcgggccagagauggccuga

SEQ ID NO: 53982 - RNA, 1215 nt, Artificial Sequence
  derived and/or modified sequence opt3 from CCNE2__Homo_sapiens__NP_477097
augagcagaagguccucucggcugcaggccaagcaacagccccagccuucacagaccgagaguccacaagaagcucagaucauucaggcaaagaagcgcaaaacaacucaggacgugaagaaacgacgugaggaagucacgaagaagcaccaauacgagauaagaaacugcuggccgcccguucucagcggcgggaucuccccuuguauuaucauugaaaccccacauaaagagaucggaacaucugauuucucgagguuuacuaauuaucgguucaagaaccuuuuuauaaaucccucaccucugccagacuugagcugggguugcaguaaagaggugugguuaaacaugcugaagaaagaaucccgcuacguacacgauaagcauuucgaggugcuacacucugaccucgaaccccagaugagaagcauccugcuugauuggcuguuggaggucugugagguguauacccuccauagggaaacauuuuaccuggcccaggacuucuuugaucgguucaugcugacccagaaggacauuaauaaaaacaugcuccaauuaaucggcauuacuucccuguuuaucgcgucaaaacuugaggaaauauaugcuccuaaauugcaggaguucgccuacguuacagauggggcaugcagugaagaggacauucugcgcauggagcuaaucauucucaaggcccugaaaugggaacuuuguccagugaccaucaucagcuggcugaauuuguuucuccaggucgaugcucugaaggacgcaccgaaaguguuacugccccaauauucucaggagacguucauucagauagcccagcuccuugaucugugcaucuuggcuauugacucccuagaauuucaauaccgaauccugacugccgcggcacucugucacuucaccucaauagagguaguuaagaaggccagcggacuggaaugggacaguauuucugagugcguggauuggauggucccuuucgugaacguggucaaauccacaagcccaguuaaacuuaagacuuuuaagaaaauccccauggaggacagacacaauauccagacccauacaaacuaccuggcuauguuggaagaggugaauuauauuaacaccuucaggaagggcggucagcucucgccuguauguaaugggggaaucaugacgccacccaagucuacugaaaaaccgccuggcaagcacuga

SEQ ID NO: 53983 - RNA, 2361 nt, Artificial Sequence
  derived and/or modified sequence opt3 from CCNF__Homo_sapiens__NP_001752
augggcagcgggggagugguccacugcagaugugccaagugcuucuguuaccccaccaaaaggcggauccgccgacguccuagaaaccugacaauucucucccuuccagaggacguucuguuucauauauugaagugguuaucuguggaagauauccuggcuguaagggcagugcacucacagcuaaaagaccucgucgauaaucaugccagugugugggcgugcgcuagcuuccaagagcuguggccgucccccgguaaccuuaagcuguuugaacgggccgcagagaaaggcaauuucgaagccgcuguuaaguuggggauugcauaucucuacaacgagggacugucugugucggacgaggcccgcgcugaagucaauggccugaaggccucaagauuuuucagccucgcggagagguuaaacgugggugcagccccuuuuaucuggcuguucauucggccacccuggaguguauccgggucuuguugcaaagcuguugugcacgaaagccuucgcgccgagugucaguugcagcgaacucauaaggcauccauccugcacugccuaggaagaguccucucacuguuugaggaugaagagaaacagcaacaggcucacgaccuuuucgaagaggccgcgcaucagggcugucugacgaguagcuauuugcucugggaaucugauaggcggaccgacguguccgauccuggccguugccugcacucauuucgcaaguuaagagacuacgccgcaaaaggguguugggaggcucagcugagccucgccaaggcuugcgccaaugcaaaccaacuuggacuggaggugagggccaguucugaaauagucugccaguuguuccaggcuucccaggcgguuagcaagcaacagguguuuucgguacagaaaggucuaaaugauacaaugcgguauauccugauugacuggcucguggaggucgcaacuaugaaggauuucaccucucugugucuucaucugacaguggaaugcguugaccgauacuugcgcagaaggcucgugccacgguaucgccugcaauuacugggcaucgccuguauggucauuugcaccagauucaucuccaaagagauacuaacuauuagggaagcuguguggcucacagacaacaccuacaaguacgaggaucugguacguaugaugggggagaucguuucagcccuugaaggaaaaauucgggugcccacggucguggacuauaaggaggucuugcugacucucgugccuguugaacugcgaacccagcaccuuuguaguuuucugugcgaguugagccuccugcacacauccuuaucugcauacgccccagcuagacuggccgcagcggcucuacuccuggccaggcuuacucauggccagacccagccguggacaacccaauugugggaucugacggguuucagcuaugaagaccucauccccugugugcugucauuacacaaaaagugcuuucaugaugacgcaccuaaggauuaccgccagguaagucugacugccgucaaacagcgguucgaggacaagagauauggggagaucucccaggaagaggugcuuagcuacucucaauugugugcugcccucggaguuacacaggauucaccagaucccccuaccuuucugaguacuggcgaaauucacgcauuccuaagcuccccaucuggcaggcgcacaaaacgaaagcgggaaaauucgcugcaggaggaccgugggagcuuugugaccacgcccaccgcugagcucuccucacaggaggaaacacugcuuggaaguuucuuggacuggucucuggacugcuguagcgguuaugagggcgaucaagaauccgagggggagaaagaaggagacgucacugccccgucaggcauauuagaugugaccguaguguaccucaacccugagcagcauugcugccaggaaagcucugacgaggaagcgugucccgaggauaaggguccacaggacccucaagcccuggcucuugauacacagauccccgcaacuccagggcccaagccucugguuagaaccuccagggagccaggcaaagacgucacaaccaguggauacagcucuguguccacugccucaccgacgaguagcguggauggcggguugggagcucucccccagccuacaucgguccugucccuagacucugauagccacacccaaccaugccaccaucaggcccgcaagucaugucugcagugccggcccccuaguccacccgaauccucuguuccgcagcaacaggugaaaagaauuaaucucuguauccacagcgaggaagaggacaugaaccugggucuugugagguuguga

SEQ ID NO: 53984 - RNA, 888 nt, Artificial Sequence
  derived and/or modified sequence opt3 from CCNG1__Homo_sapiens__NP_954854
augaucgaggugcugaccacaacugacagccagaagcuccuucaccaacugaacgccuuguuagaacaggaguccagaugccagcccaaagucuguggccugaggcuaauugaaucugcucaugauaaugggcuccggaugacggcacgccugcgagacuucgagguuaaggaucuucugucauugacccaguuuuucggauuugacacagaaacuuucagucucgccgugaaccugcuggaucguuuucucagcaaaaugaagguacaaccuaaacacuuagguugcgugggccuguccuguuucuaccuugcggucaagucuauagaggaggaaagaaaugugccauuggcuaccgaccugaucaggauuucgcaguaucgguuuacaguuucagaucuaaugcgcauggagaagaucgugcucgaaaaagucugcuggaaggugaaagccaccacugcauuccaguuucugcagcuuuacuauagccuguugcaagagaaccucccgcuggagagaaggaauaguauuaacuucgaacgguuagaggcccagcugaaggcuugucauugccgcaucauauuuuccaaagcaaagcccucuguacucgcccuuagcaucauugcucuggaaauccaggcccagaaguguguugaguugacagaagggauugagugccuacaaaaacacuccaagaucaauggacgagaccugaccuucuggcaggagcucgugucaaaaugucugacggaauacaguagcaacaagugcucuaaaccuaauguccagaaacuuaaguggauaguguccggcagaacugcgaggcaacugaagcauucauauuaccggauuacccacuugccaacaauccccgagauggugccuuga

SEQ ID NO: 53985 - RNA, 1035 nt, Artificial Sequence
  derived and/or modified sequence opt3 from CCNG2__Homo_sapiens__XP_011530701
augaaggaccugggcgccgagcaccucgcugggcaugaaggagugcagcuucuggguuuguuaaacgucuaccuggagcaagaagagagauuccagcccagggaaaaaggccuaagccucaucgaggcaaccccugagaaugauaacacacugugcccagggcuucggaaugccaagguugaagaccugcgcuccuuggcgaacuuuuucggaucuuguacugagacguuugugcucgcuguaaauauucuggaucgauuccuggcccucaugaaagugaagccgaaacacuuaucaugcauaggcgucuguaguuuucugcuugcagcccguaucguggaagaggacugcaacauucccagcacccaugauguuaucagaauuucccaguguaagugcacagcuucugacaucaagaggauggagaaaauaaucucggaaaaguugcacuaugagcuggaagcaacuaccgcccuaaauuuccuccaucuguaccacacaauuauccuuugucacaccucagagcggaaagaaauucugagcuuggauaagcucgaggcucagcugaaagccugcaacugucgcuuaaucuuuaguaaggcgaagccuuccgugcuggcacucugccuucugaauuuggaggucgaaacucuaaaaucuguggagcugcucgaaauacugcuucugguaaagaaacauagcaagauuaacgacacagaguucuuuuauuggagagaauugguuuccaaaugucucgccgaguacucaaguccagagugcugcaagcccgaucugaaaaaguuaguguggaucgucagcaggcggaccgcucaaaaucugcacaacucuuauuacuccgugccugaacuaccaacgauucccgaggguggguguuucgacgaaucagagagcgaagauaguugcgaggacaugucuuguggagaggaaucccucagcucgucuccuccauccgaucaggagugcaccuuuuucuuuaauuucaagguggcccagacucuguguuucccgucauga

SEQ ID NO: 53986 - RNA, 813 nt, Artificial Sequence
  derived and/or modified sequence opt3 from CCNH__Homo_sapiens__NP_001186118
augacccugugcaaguacuaugagaaaagacuccuugaguucuguagcguguuuaagcccgccaugccuagguccgucguuggcacagcuugcauguacuucaaacgguuuuaucugaacaauucugugauggaauaccacccacgcaucauuauguugacuugugcauucuuagccugcaagguagacgaauuuaacgugucaaguccgcaguucgucgggaaucugcgagagagcccccuaggacaagaaaaagcgcucgagcagauacuggaguaugaacuucuguugauccagcagcucaacuuucaucugauugugcacaauccuuaccguccauucgaggguuuucugaucgaucucaagacgagauaucccauuuuagaaaacccugagauccugaggaagaccgcugacgauuuccuuaaucggauagccuugacagacgcauaccugcuauacacuccaucccaaaucgcccucaccgcuauucugucuucggcaucacgcgccggcaucacaauggagagcuaucuuagugaaucccugauguugaaagagaacagaaccugucucucucagcuguuagauauuaugaaaagcaugaggaaucugguuaagaaguacgaacccccucgguccgaggaaguggcuguccucaaacagaaacuugagcgcugccauucagccgagcuggcguugaacgugaucacuaagaagcgaaagggguaugaagacgaugacuacguaaguaaaaagagcaaacacgaggaagaggaauggacagaugacgaucuaguugagucucuguga

SEQ ID NO: 53987 - RNA, 1134 nt, Artificial Sequence
  derived and/or modified sequence opt3 from CCNI__Homo_sapiens__NP_006826
augaaguuccccggcccucuggagaaccagagacucagcuuucuucuggaaaaagccaucaccagggaggcucaaauguggaaggugaauguccggaaaaugccauccaaccagaauguuucuccgucacagcgcgacgaagugauucagugguuggcaaaguuaaaauaccaauucaaccuguaucccgagacauuugcccuagcgaguagccuccuggaucgauuccuugcuacuguaaaggcccacccuaaguaccuguccugcauagcaaucucuugcuuuuucuuggccgcuaaaacgguggaagaggacgagcguauuccaguccucaaggugcuggcaagagauucguuuuguggguguucaagcagugaaauccugaggauggagcggauuauccucgacaaauuaaauugggaucugcauaccgccacaccccuugacuucuugcacauauuucaugcuaucgccguuuccacucgcccucagcugcuauucucucucccaaagcugagccccucccagcaccuugcggugcugaccaaacaguugcuccauugcauggcauguaaccaacuguuacaguuuagaggaucaaugcuggcccucgcuauggucagucuugaaauggagaagcugauuccugauugguugagccuaacaaucgagcugcuccagaaggcccagauggacucuucccaacugauucacugcagggaacuuguggcacaccaucugucaaccuugcagagcagucucccauuaaauucuguauauguuuaccggccgcugaaacacacucuggugacaugugauaagggugucuuccgccuacaucccuccagcgugccuggcccagacuuuucgaaagauaacucuaagcccgaggugccuguccgagggaccgcugccuucuaucaccaccucccagcggccuccggaugcaaacagacgucaacuaagagaaaaguugaagagauggaaguggacgauuucuacgacggcaucaagaggcuguauaaugaggacaacguaagugagaauguggguagcgucugugggaccgaucuuucccggcaagaaggacaugcaucucccugcccgccuuugcagcccgugagcguuauguga

SEQ ID NO: 53988 - RNA, 1152 nt, Artificial Sequence
  derived and/or modified sequence opt3 from CCNJ__Homo_sapiens__NP_001127847
auggagcuggaaggccagugguggagagggcaacucgccgcugacauccaccaggcacuuagguacaaggagcugaaauugcccagcuauaagggacaguccccucaguuaucucugcggcgcuacuucgccgaucuaauugcgauagugucaaaccgauuuacccucugcccaagugcucgucaucuggccgucuaucuucuggacuuguucauggauagauacgacaucagcauucaacagcuccaccugguugcacuguccugucucuuacuggccucuaaauuugaagagaaggaagauucggugccgaaacuugagcaguugaacucacuggguugcaugacaaauaugaaucuaguacucacuaagcagaaccugcuucauauggagcuguugcuccuggaaacguuccaauggaauuuaugucugcccaccgcugcacacuuuaucgaguauuaccucagcgaagccgugcaugagacagaccuucacgauggcuggccuaugauuugccuggagaagacuaaauuguauauggcuaaguacgccgacuacuuccuagaagucagucugcaggauuaugcguuucucaacuacgcaccaucccugguggccgcugccuguguugcaucuagcaggaucauacuucggcugucccccaccuggccuacacgcuugcacagacucaccgcuuauucaugggacuuccuggugcagugcaucgagagguuacugauugcccaugauaaugacgucaaagaagcgaacaagcagcgggggcaagccggaccacagagugcacagcuaagcguguuucaaacugcuucucagcccucccgcccuguacacuuccagcagccacaauaccuccaucagacacaccagaccucacugcaguaucgacacccgacgagcgagcaacccaguugucagcagaucguuucuacuacccauacauccagcuacacucuucagaccugcccugccggcuuucaaacaucggugcaggguuuggggcacaugcagaccggagucggcaugucucuggcuauuccaguggaagugaaacccugucucuccgucucauauaauagaaguuaccagaucaacgagcauuacccuugcauaacgccauguuucgagagguga

SEQ ID NO: 53989 - RNA, 1308 nt, Artificial Sequence
  derived and/or modified sequence opt3 from CCNJL__Homo_sapiens__NP_078841
augauggacgagcccuggugggaaggcagaguggccagcgauguccacugcacccugagggagaaggaacucaaacuuccuacauuccgggcucauuccccacuguugaagucucgccgauuuuucguugacaucuuaacucugcuaucaagucacugucagcucugcccggcagcccgucaucuggcgguguaccuucuggaucacuuuauggacagauauaacguaacgaccagcaaacaauuguacacaguggcugucuccugucuccugcuggccaauggggugucucucuuaucgcccaggcugaagugcucaggaaugauuagcgcacauuguaaccuucacuugccugguaguuccaauucuccagccagcgcuccccacccuccacccacuccuccacagguugcagagaccacaggcaaauucgaagaucgggaggaccaugugccgaagcuggagcagauaaacuccacccgcauccuaucaagucagaauuuuacucucacaaagaaagaacugcuuagcaccgagcuguugcuccuggaagccuucucuuggaacuuaugccugcccacgccugcucacuuucucgauuauuaccuucuggccuccgucucacaaaaggaccaucacugucacacuuggccaaccacaugccccagaaaaacuaaggaguguuugaaagaguaugcgcauuacuuccuagaagugacccugcaggaucacaucuuuuauaaguuccagccuagcguaguugcagccgcuugcgugggggccaguaggauuugucuccagcugucuccauacuggacacgggaccuucaacgcauuuccagcuacucgcuggagcauuugucuaccugcaucgaaauacuccuggucguguaugauaauguguuaaaggacgcagucgcuguuaaaucccaggcccuggcgauggugcccggaacgccgccuacucccacacagguacuauuucagccuccagccuaccccgcacucggccaaccagcuaccacucuggcccaguuccagacacccgugcaagaucuuugcuuggcuuaucgagacucacugcaggcccacagaagugguagccuccuguccgggucuaccggaagcucacuucauacgccuuaccagccacugcagccguuggacaugugucccgucccugugccagcaagucucuccaugcacauggccaucgcugcggagcccaggcacugccuggcaaccacauauggcagcucuuacuuuucaggcagucauauguucccuacuggguguuucgaucgguga

SEQ ID NO: 53990 - RNA, 1743 nt, Artificial Sequence
  derived and/or modified sequence opt3 from CCNK__Homo_sapiens__XP_011535577
augaaggagaacaaagaaaauagcucccccucugugaccucagccaaccuggaccacacaaagccuugcugguacugggauaaaaaggaccucgcucauacuccaagucagcuugagggccuggauccggcaacggaagccagauauaggcgggagggggcgcgcuucaucuuugacgucggaacccgauuggguuuacacuacgauacacuggcuacuggcauuauauauuuccaucguuuuuacauguuccacagcuuuaaacaauuccccagauauguuaccggggccuguugccuauuucucgcaggaaagguggaagagacaccuaagaaauguaaggacaucauuaaaaccgccaggucccugcuuaaugauguacaguucggccaguuuggugacgauccaaaggaggaagugaugguccuggagcggaucuugcuccagacuauuaaauucgaccugcaaguggaacaucccuaccaguuucugcucaaguaugcuaagcaguuaaaaggggauaagaacaaaauccagaagcugguucaaauggcauggacauucgugaaugacucucuuugcaccacguugucgcugcagugggagccugagauaaucgccgucgcugugauguaccuagccggacgccucuguaaauuugaaauucaggaguggacuucaaagccaauguacagaagguggugggaacaguucguacaagauguucccguggacguccuggaggacaucugccaccagauucuugaucuguauagccagggcaaacaacagaugccucaccauaccccacaccaguugcagcaaccgcccagucuccagccuacaccacaggugccccaggugcaacagucccagccuucucagagcuccgaaccaucacaaccccagcagaaggacccgcagcaaccugcgcagcagcaacagcccgcacagcagccaaagaaaccuaguccccaaccaagcucuccccggcaggucaagcgcgccguugugguauccccuaaagaggagaacaaggcugccgaaccaccgcccccuaaaaucccaaagauagagacuacccaucccccucugccacccgcacacccgccuccagaucgaaagcccccuuuagcugccgcgcugggcgaagccgagcccccagggccuguggacgcaacagaucuccccaaaguccagauuccaccgccugcucaccccgccccagugcaucagcccccuccacuuccccacagaccuccgccacccccuccaucaagcuacaugaccggaaugaguacgacuucuuccuauaugagcggugaaggcuaccaaucgcugcagucuaugaugaagacagaggggcccuccuauggagcuuugccuccggccuacggucccccagcacaucuaccuuaucacccccauguuuacccaccuaaucccccaccgccucccgugccacccccuccagccucauucccucccccggcuaucccacccccuacccccggcuacccaccucccccaccuacuuauaacccgaauuuucccccaccucccccaaggcugccucccacacacgcggucccgccacacccucccccagggcucggacugcccccugcaaguuacccgcccccagccgugccucccggcggccagccuccaguacccccuccaauucccccgccugggaugccacccguuggaggucuuggccgggcugccuggaugcguuga

SEQ ID NO: 53991 - RNA, 1581 nt, Artificial Sequence
  derived and/or modified sequence opt3 from CCNL1__Homo_sapiens__NP_064703
auggccagcggcccccacuccaccgcuacagcagccgcggcugccucuucagcagccccuagugcugggggaagcuccucugguacuacgaccacaacuaccacaaccacuggcgggauccugauuggagacagacucuacucggaggugucacuuacaauagaucauagccugaucccagaagagagguugaguccgacccccuccaugcaggacggcuuagaucugccuucugaaacggaccuacggauucucgguugcgagcugauccaagcagccgggauucuucugcgcuugccacaggucgcuauggccacuggacagguucucuuccaccgauuuuucuauagcaaguccuuugugaaacauucauucgaaaucguagcgauggcauguauaaaccuggccaguaagaucgaggaggcuccccguagaauuagggaugugaucaaugucuuucaccaucugcggcagcuccgcggcaaaagaaccccuagcccauuaauucuggaccaaaacuacaucaauacaaagaaccaggugauaaaagccgaaaggcggguucuuaaggaguugggcuucugcgugcacgucaagcacccccauaaaauuaucgugauguaucugcagguacuagaaugugagcgcaaucagacucucguucaaaccgcauggaacuacaugaaugauucucugcgaacaaacguguuugucagauuccagccugagaccauugcuugcgccuguaucuaucuugcggccagggcacugcagaucccauugccgacgcggccccacugguuucuccuguucgggacuacagaagaggaaauucaggagauaugcaucgaaaccuuacgucuguacacucgcaagaaaccuaauuaugagcuccuugagaaggaaguggagaaaagaaagguggcucugcaagaagccaaguugaaagcuaagggacuaaacccagacgguacacccgcccuguccacccucggcggguuuagcccugcaucaaaaccaaguucucccagggaggucaaggccgaagagaaauccccgauuagcaucaauguuaagacggugaaaaaggagccugaagaucggcagcaggcuucgaagucucccuacaacggaguacgaaaagacuccaagcgcucaagaaauaguaggagcgcgucccggucucgcagcagaaccaggucacguagucggucccauacaccacgaagacacuacaacaauaggcgcagccggucuggcacuuauucaaguagaagcaggucccgcucucgaucgcacagcgaguccccucggcgucaucacaaccaugguucaccccaccugaaagcaaagcauaccagagaugaccuuaaaaguucuaacaggcacgggcacaagcgcaagaaaagccgguccagaucacaaagcaagucuagggaucauuccgacgccgcuaaaaagcaccgacaugaacgcggacaccaccgggacagaagggagcguagucgcagcuucgaacggucucauaaauccaagcaccauggcggcucaagaagugggcacggaaggcaucgacgguga

SEQ ID NO: 53992 - RNA, 1170 nt, Artificial Sequence
  derived and/or modified sequence opt3 from CCNL2__Homo_sapiens__XP_011540521
augggccagcuggccgcugcacucaugagccccagaagggggcuuccucugggagccgaguccccaucugcgcggugcucacacgcuaguaacuugcauccgcgcgguuucagcuuauuucaaguggacuccuucaaggaagccgcagcccgaucugcugagaaaggccccgcagccucggcucuggaagaggaagaggaggaaccuaagcguauggccugucuaccagcggcaacccccgcccucugcucagcuagcaguuuugagaauuacaugaacgauucccugagaacagacgucuucguuagguuucagccugaaucuaucgccugugcaugcauuuaucuugcugcccggacucuggagauaccauugcccaaucgcccucacugguuccuccuguuuggggcgacggaggaagagauccaggaaauuugucugaaaauccuccaguuauacgccagaaagaaaguggaucugacccaucuugagggagaaguagagaagaggaagcacgcaauugaggaagcuaaagcccaagcucggggcuugcugccaggugggacacaggugcuagacggaacuagcggcuucuccccggcccccaagcucgucgagucaccuaaagaaggcaaggggaguaaaccaagcccccugucugugaagaacaccaagcgccgacuugagggagccaaaaaggcaaaagcugauuccccuguuaauggucugccaaagggcagagaaucaaggagccggagucguucucgcgagcaguccuauagcagaucgcccucuagguccgcgucaccgaaacggcgaaagagugacagcggguccacaucuggaggcagcaaaucacagagucgcuccagaagcaggucugauucaccuccccggcaagcaccacgcagugccccuuacaaggguagcgagaucagaggguccaggaagucuaaagacugcaaguauccccagaaaccacauaagucgcguagccgguccucaagucgaucuagaagcaggucccgcgaacgggcugauaaccccggaaaauacaagaagaaaucacacuauuacagagaccagaggcgcgagcgaagccggucuuacgaacguaccggcagaagguaugagcgcgaucacccuggccauucccggcacagaagguga

SEQ ID NO: 53993 - RNA, 1053 nt, Artificial Sequence
  derived and/or modified sequence opt3 from CCNO__Homo_sapiens__NP_066970
auggugacccccugcccuacaagcccauccucuccggccgcuagagcaggcaggcgggacaacgaucagaaucugcgcgcccccgucaagaaaucacgacguccuagacucaggcggaagcaaccacuucacccccugaacccuuguccauugcccggggacaguggaaucugcgauuuauucgagagcccuuccucugguucggacggcgcggaaucaccaagcgcugcccgcgggggaaguccgcugcccggcccugcacagccaguugcccagcuagaucuccagacuuuuagagacuacggucaauccuguuaugcuuucaggaaagcacaggagucucauuuucacccccgggaagcccuggcucgccagccucaggugacggccgagagccgaugcaagcuccuguccugguugauuccaguacauagacaauucgggcucucauuugaaagucugugucugaccgugaauacacucgauagguucuuaacuaccacacccgucgcggcagacugcuuucagcugcuuggagugaccagcuugcugauagccuguaaacagguugaggugcacccgccucgggucaagcagcuacucgcucugugcuguggcgccuucucucgucaacagcuuugcaaccuggaguguaucguguugcauaagcuccacuuuacucugggcgcacccacaauuuccuucuuuuuagaacacuucacccaugcucgcguagaggccgggcaggcggaagccucagaggcacuggaggcucaagcccucgcuagaggaguugccgaacuuagccuggcagauuacgccuuuacgaguuauucuccauccuugcuagcuaucugcugccuggcgcucgcagacaggaugcugcgggugagccgaccugucgaucuucgccugggugaccaccccgaggccgcuuuggaagauuguaugggcaaacuccagcuguuaguggccauuaauucgacuucucugacccauaugcuaccagugcagaucugcgagaaguguucccuucccccuucaaguaaauga

SEQ ID NO: 53994 - RNA, 2181 nt, Artificial Sequence
  derived and/or modified sequence opt3 from CCNT1__Homo_sapiens__NP_001231
auggagggcgaaagaaagaacaauaacaaaaggugguacuucacccgggagcagcuggaaaauagccccucccgccgauuugggguggacccugauaaggagcucucuuaucgucaacaggccgcuaaccuucugcaggacaugggacagagauugaaugucucacaauuaacaaucaacacugcaauuguuuacaugcacagguucuauaugauacagaguuuuacgcaguucccagguaauagcguggccccggcggcucuguuucuagccgcaaaaguagaagaacagcccaagaaacucgagcaugugaucaaggucgcccauaccugccugcacccucaagaaucccuuccagauacacggucugaggcuuaccugcaacaggugcaggacuugguuauucucgaaucgaucauucugcagacucugggcuucgagcucaccaucgaucacccccauacacacguggucaaguguacccaguuagugcgcgcaucaaaagaccuggcccagacuagcuauuuuauggcuacaaacagucuucacuugaccacguucucccugcaauacacuccuccaguaguugccugcguguguauacaucuagcgugcaaguggucuaauugggagauccccgucagcaccgaugggaaacacuggugggaauauguggacgcaacagugacucucgagcugcuugaugaacugacccaugaguuuuugcagauucucgaaaagacaccuaacagacugaaaaggaucuggaauuggcgggccugugaggcugccaagaagaccaaagcagacgaucgcggaacggacgagaagacuuccgaacagacaauuuuaaacaugaucucacagaguagcucugauaccacuauagcuggccugauguccaugucaacaagcaccacgagugccgucccaucucucccgguuuccgaggaaagcucgucuaaucuuaccuccguggagaugcugcccgguaaacgaugguugucaagucaaccuagcuucaagcuagaaccaacacaggggcacagaacuuccgagaaccuggcgcucaccggaguagaccacucucugccccaggacggcagcaaugccuuuauuucacagaaacaaaacaguaaguccgugccuagcgcaaaagucucucuuaaggaguacagggcuaagcaugccgaggagcuggcugcccagaaacggcaguuggaaaacauggaggcaaaugugaagucacaguacgccuaugcugcgcaaaaccuccugagucaccaugauagccacuccucuguuaucuuaaaaaugccaauugaaggcucggagaaucccgagcguccguuccuggaaaaggcagacaaaacagcccuaaagaugcgcaucccuguggcugggggagauaaggccgcaagcuccaaacccgaggaaaucaagaugagaauuaaaguccaugccgcugccgacaagcacaacucaguggaggauaguguaacuaaaucuagggagcacaaggaaaagcauaaaacccacccaagcaaucaucaccaccaucacaaccaucacucccauaagcacucacacagccagcucccuguugguacaggcaauaaacggcccggggacccaaagcauucuucccagaccaguaaccuggcacacaaaacuuacagccuuucuuccucauuuaguagcucguccucuacgcgaaagcgcggacccagcgaggaaacaggcggugcgguguucgaucauccugcuaagauagccaaaucaaccaagaguuccucuuugaauuucagcuuuccaucccugccgacuauggggcagaugcccggacacucaagcgacaccaguggccucucuuucucccaaccuagcugcaaaacaagagucccacauucgaagcuggauaaaggccccaccggggcaaacggacacaauacuacacagacgaucgacuaucaggauaccgugaacaugcuucacucacuguugucugcccaagguguccagccuacucagccaacagcuuuugaguucgugaggcccuacagugacuaucucaauccgcgguccggcgggauuagcucucgcagcggaaacaccgacaagccuagaccacccccucugcccuccgaaccaccucccccauuaccgccucugcccaaauga

SEQ ID NO: 53995 - RNA, 951 nt, Artificial Sequence
  derived and/or modified sequence opt3 from CCNY__Homo_sapiens__NP_001269781
augggcaacaccacaagcugcuguguguccucuucacccaagcugagaaggaaugcccacagucggcucgagagcuaccgcccugacacugaucuuucccgagaagacacggggugcaaccugcagcauaucucugaucgugagaauauugacgucagagagaaaaggaagucguuguucauaaaccaccauccaccgggacaaaucgcucggaaauauucaagcuguaguaccaucuuuuuagaugacuccacaguuucucagcccaaucugaaguacacuauuaaaugcguggcacuagccauuuauuaccacaucaagaaccgcgauccugacgguagaaugcuccuggauauauucgacgaaaaucuucauccacugagcaaguccgaaguacccccugauuaugacaaacacaacccagagcagaagcagaucuacagguuugugcggaccuuguucucagcggcucaacucacagccgagugugcaauugucacccugguguaucuggaacgccucuuaacuuacgccgagaucgauauuugccccgcuaauuggaaacgaaucguucugggcgcaauacuuuuggccaguaaggugugggacgaccaggcugucuggaacguggauuacugucagauucugaaagacaucacaguagaagauaugaaugagcuagagagacaguuucucgaacugcuucaauucaacauuaauguuccuagcucuguguaugccaaguacuauuuugaccugagguccuuggcggaggcaaacaaucucucauucccacuggaaccguuaagccgggagcgugcccacaagcuggaagcuaucagucgccucugcgaggauaaauacaaggaccuuagaaggucugcccggaaacgauccgcaagcgcugauaaccugaccuugccccgcuggucgccugccaucauuucuuga

SEQ ID NO: 53996 - RNA, 2976 nt, Artificial Sequence
  derived and/or modified sequence opt3 from CCP110__Homo_sapiens__NP_055526
auggaggaauacgagaaguucugcgaaaaaucgcuggccagaauccaggaggcuucccucucuaccgaaucauuucuucccgcacaaagugagagcauuucccugauaagguuccacggcguggccaucuugucuccuuuacugaacauugagaagcggaaagaaaugcagcaggagaagcagaaagcgcuagacgucgaagcucgcaagcaaguuaaucgaaagaaagcccuccugacacgugugcaggagauccuugauaacguacaggugagaaaggcaccaaaugccucggacuuugaucagugggagauggaaacugucuauucaaacagcgaggugaggaaucugaacguuccggcuacguuccccaauaguuuuccuucccauaccgaacacucuacagcagccaaauuggacaagauugcugggauccucccacuggauaacgaggaccaauguaaaacugauggaauagaccuggcccgggauagcgaagguuucaauucccccaagcagugcgacucaaguaacaucagccauguggagaaugaggcguuuccuaagaccucuuccgcaacaccacaggaaacccucauuucagauggccccuucagcgucaacgagcagcaagacuuaccucugcuugccgaagugaucccagauccguacguaaugaguuugcagaaucugaugaaaaagucuaaagaguauauugaacgcgagcaguccagaaggagccuacgggggucgaugaaccgcaucguuaaugagucucaccucgacaaggaacaugacgcuguggaggucgccgauugugugaaagaaaagggacaacugacuggcaaacacugcguguccgucauacccgacaagccuucacuuaacaagaguaacguucuguugcagggugcaagcacacaggcuuccucuaugagcaugccagugcucgccucauuuaguaaaguagauauucccauccgaaccgggcacccuacggugcuggaguccaauagcgacuucaaggucauuccaacuuuugugaccgaaaacaauguuaucaaaucuuuaacaggaucauacgcgaagcugcccaguccggagccuagcaugucccccaaaaugcauagaaggcggucucguacuucgagcgccugucacauccucauuaacaauccaauaaacgcaugcgagcuuuccccuaagggcaaggaacaggcuauggaucugaucauucaagacaccgaugagaauacaaacgugcccgaaaucaugccaaaauugcccaccgaccuagccggcgucuguucaaguaagguguauguagggaaaaauacgucugagguuaaggaggaugugguccugggaaaaagcaaccaggugugccaguccucagguaaucaucucgaaaacaaggucacucacggccuggugacaguugaggggcagcuuaccagcgacgaacgcggagcucacauaaugaacucuacuugugccgcaaugccuaagcugcaugagccauacgccuccagucaaugcauugcuagcccgaauuucggcacagugucugguuugaaacccgcguccaugcucgaaaagaauuguucacugcagaccgaguuaaacaaaaguuaugauguaaagaacccuagcccacugcuaaugcagaaucagaacacgagacaacagauggacacccccauggucucgugcgggaaugagcaguuucucgacaacuccuucgaaaaagugaagaggcggcuggaucuugacaucgauggauugcagaaggagaauugcccuuacguuaucacaucuggcauuacugaacaagagcgacagcaucugccagaaaaacgcuaccccaagggcagcggguucgugaacaaaaauaagaugcucggaaccucaaguaaagaguccgaggaacugcuuaagucuaaaaugcuggcauuugaggaaaugagaaagagguuggaggaacagcacgcccaacagcucagccuguuaaucgcugagcaggagcgggaacaggagcgccugcaaaaggaaauugaggagcaggaaaagaugcuaaaagagaaaaaggccaugacagcagaagccuccgagcucgacauaaacaaugcugucgaacuggaguggagaaaaaucucagauagcagucuuuuggagacuaugcugucucaggccgacucccuccacaccagcaacagcaauucaucugguuucacaaacagugcaaugcaguauuccuuugugagcgcgaaugaagcuccguucuaccuguggggcucuagcaccuccggguuaacuaagcugucaguaacgaggccuuuuggacgugccaagacacgguggagucaaguguucagccuugagauucaggcaaaauuuaacaagaucaccgccguugcuaaaggcuucuugacucgaagacucaugcagaccgauaagcugaaacagcuaaggcaaacagucaaggacaccauggaauuuauccgcucuuuccaguccgaggccccacugaagcgggguauugugucagcacaggaugcuagucuccaagaaagagugcuggcccagcuuagggcggccuuguaugggauacaugacaucuuuuucgucauggaugcugcagagcgcaugagcauucugcaccacgaccgagagguucggaaagaaaagauguuacgucagauggauaaaaugaagucccccagaguggcccucucugcugccacucagaaaucgcuggacaggaagaaguacaugaaagcagcggagaugggcaugccuaauaagaaauuucuugugaagcaaaaccccagcgaaacacgcguacugcagccaaaccagggacagaaugccccuguccaucgguugcucucaagacaaggcuccaucuguaggaaaaaccccaagaaagcugccaagugcugugacaaucugcgacgccagcacagucuaggguga

SEQ ID NO: 53997 - RNA, 1089 nt, Artificial Sequence
  derived and/or modified sequence opt3 from CCR10__Homo_sapiens__NP_057686
augggcaccgaggccacagaacaggugagcugggggcacuacuccggagacgaggaagaugcuuauucugcagagccccugccugaacucugcuacaaggccgacguccaagcguucucaagagcuuuucagccaaguguuagccuuacuguggccgcacuggguuuggccggcaacggguuaguacuggcuacgcaucuagcagccaggcgggcugcccgcuccccgaccucugcgcaccuccugcagcuugcacuggccgauuugcuccuggcucugacacuccccuucgccgcagcuggagccuuacagggcuggucgcuggguucagcgacuugucgaaccaucagcgggcuuuauagugccuccuuucaugcaggauucuuguuucuggcuugcauuucugccgaccguuacguggcuauagccagagcacuaccugccggcccaaggcccagcacaccuggccgggcucaccucgucuccgugaucguuuggcugcuuucacuguugcucgcgcugccagcauuacuguucagucaagaugggcagcgcgagggacagagaaggugucggcucauuuuucccgagggucuuacccagacugugaaaggcgccagcgcugucgcccaaguggcacugggguucgccuugccucuaggaguaaugguugcuugcuaugcccugcucggccgcacacugcuugcagcgcgagguccagaaagaaggcgggcucugcguguggucguggccuugguggcagccuuugucguucuccagcugccguacucuuuagcucugcuacucgacaccgccgaucugcuugcagcucgcgagagauccugucccgccucaaagaggaaagacguggcguugcugguaacgagcgggcucgcccuggcucggugcggacuuaauccugugcuguaugcauucuugggccuccgauuucgccaggaucugagaagguuacugcggggcgggaguuguccaucuggaccccagccucgcagagguugcccaaggcguccccggcuauccagcuguucggccccgacugaaacccauucucucuccugggacaacuga

SEQ ID NO: 53998 - RNA, 1068 nt, Artificial Sequence
  derived and/or modified sequence opt3 from CCR1__Homo_sapiens__NP_001286
auggagacccccaacacaacugaagacuacgauacgaccacagaguucgacuauggcgaugccacuccuugccagaaggugaaugaaagagcuuuuggggcacaacugcucccaccgcuuuacagccuggucuucguuaucggauugguggguaacauuuuaguagugcugguccuagugcaguauaaaaggcucaagaauaugaccuccauauaccugcuuaaccuggccaucucugacuugcucuuucuguucacacugcccuuuuggauugauuauaaacucaaggacgauuggguuuucggcgacgcgauguguaaaaucuuaucaggguuuuacuauaccggacuguacagugagauuuucuuuaucauacuuuugacuaucgaucgguaccuggcuauugugcacgccgucuucgcacuacgcgcccgaacagugaccuuuggcguaaucacgagcauuaucauaugggcucucgcaauucuggccuccaugccuggucuuuauuucucuaagacucagugggaauuuacccaucacacaugcucgcugcauuucccacacgagucauugcgugaguggaaacucuuccaggcucugaaguuaaaucuguuugggcucguucuuccccuguuggugaugaucauuuguuacacuggaaucaucaagauucuacugagaaggccuaacgagaaaaagagcaaagccguccggcucauauucgugaucaugauuaucuuuuuccuguuuuggaccccauauaaucuuacaauacugauuaguguguuccaagacuuuuuguucacccaugaaugcgaacagucccgccaccucgaucuggcgguccagguuacggaggugaucgcauacacucacuguugcguaaaccccgugaucuaugccuuugucggcgagagauucaggaaguacuuacggcagcuguuucaucgccgaguggcuguucaccuagugaaguggcucccuuuccugucugucgacagacuugaaagggugagcuccacaucaccaaguaccggcgagcaugaauugagcgccggguuuuga

SEQ ID NO: 53999 - RNA, 1125 nt, Artificial Sequence
  derived and/or modified sequence opt3 from CCR2__Homo_sapiens__NP_001116513
augcugagcaccuccagaucuagguucauccggaacacaaaugagucaggcgaagaggugacuacguuuuucgacuacgauuauggggcccccugccacaaguuugacgucaaacagauuggagcucaacuccuuccuccacuguacaguuugguuuucauauuugguuucgugggcaacauguuaguagugcugauccuaauuaauuguaagaaacucaagugccugaccgauaucuaucuucugaacuuggcaauuagcgaccuccuguuucugaucacacucccguuaugggcccauuccgcggcuaaugaaugggucuucgggaacgccauguguaaacuguuuacuggacuuuaccacauaggcuauuucggugggaucuuuuucauuaucuugcugaccauugaucgcuaccuagcaaucgugcaugccguuuuugcucucaaggcacgaacagugaccuucggagucgugacuucuguaauaacauggcugguugccguguucgcuucgguccccggcauuaucuuuaccaagugccagaaagaggacucaguguauguguguggcccuuacuucccacguggguggaauaacuuucacacgauuaugagaaauauccuuggacuggucuugccccuccugaucaugguuauuugcuacagcgguauauuaaagacucugcucaggugucggaacgaaaagaaacgccauagagccgugaggguaaucuucaccauuaugaucguguauuuucuuuucuggacaccuuacaauauagucauucuguugaacacuuuucaggaguucuuuggccuaaguaauugcgaguccaccucucagcuggaucaagcgacacaggugaccgaaacgcucgggaugacucacuguugcaucaacccaaucauuuaugcauucguuggagagaaauuucggagccuguuccacaucgcccuuggcugucgcauugcuccccugcagaagccugugugcggugggccaggaguccgaccgggcaagaaugugaaaguaacaacccagggcuugcucgacgggagaggaaaggguaaauccauaggcagggcccccgaagcaucacugcaagauaaggagggggcuuga

SEQ ID NO: 54000 - RNA, 1122 nt, Artificial Sequence
  derived and/or modified sequence opt3 from CCR3__Homo_sapiens__NP_001158152
augcccuucggcaucagaaugcugcucagggcccacaagccugggcggagcgagaugaccacaucccuugacacuguggaaacguuuggaaccacaucuuacuaugaugacgucggucuguugugcgagaaagcugauacucgcgcauuaauggcccaguucguuccaccgcuguacagucuaguguuuaccguaggccuccuggggaacguggucgugguuaugauucuuauaaaguaucgacgucugagaaucaugacaaauauuuacuugcucaaccuggcgaucagugaccugcucuuuuuagugacccugcccuuuuggauucauuaugucaggggacacaauuggguguucggccaugguauguguaaacuuuugagcggguuuuaccacacuggacuguauuccgaaaucuucuuuauaauccuacucacaauugaucgguaccuggcuaucguacaugccguuuucgcacuucgcgccagaaccgugacguuuggcgucauuacuucuaucgugaccuggggccuggcuguguuggcagcccucccugaguucauauuuuacgaaacagaggagcuguucgaagagacuuuaugcucggcucuguauccagaagacaccgucuacucauggaggcacuuccacacacuccggaugaccauuuucugucuuguucugcccuugcuagugauggccaucugcuauacggggauuaucaagacucugcuccgcuguccuagcaaaaagaaguacaaagcgauccgacugauuuucguaauaauggcaguguuuuucaucuuuuggacaccauauaacgucgccauucuucugaguuccuaccaaucuaucuuguucggaaaugauugcgagagaagcaagcaucucgaccuggugauguuaguuaccgaggugauagcuuauucccacuguugcaugaaccccgucauuuacgccuuugugggugaaagguuccggaaauaccugcgucacuuuuuccaucgccaccuacucaugcaucugggcagauauaucccuuuucuuccaucagagaaguuggaaaggacuucaagcguaucuccguccacagcagagcccgaacugucaaucguuuucuga

SEQ ID NO: 54001 - RNA, 1083 nt, Artificial Sequence
  derived and/or modified sequence opt3 from CCR4__Homo_sapiens__NP_005499
augaaccccaccgacaucgccgauacaacucuggacgagagcauuuacuccaauuauuaccucuaugaaucuauaccuaagccaugcacgaaagagggcaucaaggcuuucggggaacuuuuucugccgcccuuguacucauuaguguucgucuuuggacugcuagguaacaguguugugguacucgugcuguucaaauauaagagacuuaggagcaugaccgaugucuaccuguugaaucucgcaauuuccgaccugcuguuuguguucucucucccuuuuuggggcuauuacgccgcggaucaguggguuuucggguuaggacuguguaaaaugaucucguggauguaccuugugggcuuuuauucagguauuuucuuugucauguugaugagcaucgaccgguaccuggcuauagugcacgccguauucagucuacgcgcacgaacacucacuuaugggguuaucaccucccuggccacauggucuguggcugucuuugcaagccuuccaggauuccuguucucaaccugcuacacugagcguaaccauacauauuguaagaccaaguacuccuugaauaguacgacuuggaaagugcucagcucucuggaaauuaacaucuuaggccuggugauuccccucggcaucaugcuguuuugcuauuccaugauaauuagaacccuucaacacuguaagaaugagaaaaagaacaaagccgucaagaugaucuucgcuguugugguauuguuucuaggguucuggacaccuuacaauauugugcuguuucucgagacucuggucgaacuugaggugcugcaggauugcaccuucgaaagguacuuggacuaugccauccaggcgacagagacccucgcauuuguucauuguugccugaacccaaucauuuacuucuuuuuaggagagaaguuccggaaauauauacugcagcuauuuaagacgugucgcggucucuucgugcugugccaauacuguggccuuuugcagaucuauucagccgauacucccagcaguucuuacacacaguccaccauggaccacgaucugcaugacgcucucuga

SEQ ID NO: 54002 - RNA, 1059 nt, Artificial Sequence
  derived and/or modified sequence opt3 from CCR5__Homo_sapiens__NP_000570
auggacuaccaggugagcucccccaucuaugauauuaacuacuauaccucugagccuugccaaaagauaaaugucaaacagaucgccgcuagacugcucccaccgcuuuacucacugguuuucauuuuuggcuucguggggaacauguugguaaucuuaauucugaucaauuguaagaggcuaaaaaguaugacagacauauaucuccugaaccuugcaaucagcgaucuguuuuucuugcucacugugcccuuuugggcccacuacgcggcugcccagugggacuucggaaauacgaugugccagcugcugaccggucucuauuuuauuggcuucuuuuccgggaucuucuuuauuaucuuacugacaauagaucgguaccuugcagucgugcaugccguuuucgcuuugaaggcacgcacugugaccuuuggagucgugacaucuguaauuaccuggguuguggccgucuucgcuucgcugccuggcaucauuuucacucgaucacaaaaagaaggucuacacuacacauguagcagucauuuuccauauucccaguaccaguucuggaagaacuuucagacccucaagaucgugauccuggggcuugugcugcccuugcucgucaugguuauuugcuauucuggaauacugaaaacguuacugcguuguagaaaugagaagaaaaggcaccgggccgugcgccucaucuucacuauuaugaucguauacuuucuuuucugggcgccuuauaacauagugcuguugcuaaauaccuuucaagaguucuuuggccugaacaauugcagcuccucaaacagacucgaccaggcaaugcaggucacagaaacucugggcaugacccauuguugcauuaauccaaucaucuacgccuucgugggggaaaaguuuaggaacuaucuucugguuuucuuucagaaacacauugcuaagcgguucuguaagugcuguaguaucuuccaacaggaggcccccgagcgcgcaagcucuguguacacacgauccaccggagaacaggagauuucagucgguuuguga

SEQ ID NO: 54003 - RNA, 1125 nt, Artificial Sequence
  derived and/or modified sequence opt3 from CCR6__Homo_sapiens__NP_004358
augagcggcgaguccaugaacuucucugacguguuugauucaagugaagacuacuucgucagcguuaauaccuccuauuacucuguggauucggagaugcugcucugcucacuucaggaaguaagacaauuuagcaggcuguucgugcccaucgccuauaguuugauuugugucuuuggguuacugggaaacauccuagugguuauaacauucgcuuuuuacaagaaagcacgguccaugacugacguguaucuccugaauauggccauugcggauauccuuuucguccugacguugccuuuuugggcugugucucacgccaccggugcauggguauucagcaacgccacaugcaagcuccugaaaggcauuuacgcuaucaauuuuaacugugggaugcugcucuuaacuugcauauccauggaccgcuauaucgcaauuguucaggccaccaagucauuccgacugcguaguagaacacuuccaaggagcaaaaucauuuguuugguggucuggggacugucugugaucauauccucaagcaccuuuguguucaaucagaaguacaacacucagggcagugaugucugcgagccgaaguaccaaacaguuucugaacccauucgguggaaacuacucaugcugggucuugagcuguuguucggguuuuucaucccucucauguuuaugauuuucuguuauaccuuuaucgugaagacgcugguacaggcucaaaauuccaaacgccauaaggccaucagagugauuauagcggucguguuaguuuuccuggcaugccagaucccacacaacauggugcuccuugucacugccgcuaaucugggaaaaaugaacaggagcugucagucggagaaguugauuggcuacaccaagacagugacugaaguacuagccuuucugcauugcugucucaaucccguucuguaugcauucaucggccagaaauuucggaacuacuuccuuaagauacugaaagacuuguggugcgugcgccgaaaguauaaaucuuccggguuuucaugcgcuggaagauacagugagaauauuagcaggcagaccuccgaaacagccgauaacgacaacgcgucuagcuucaccauguga

SEQ ID NO: 54004 - RNA, 1137 nt, Artificial Sequence
  derived and/or modified sequence opt3 from CCR7__Homo_sapiens__NP_001829
auggaccugggcaagcccaugaaaagcgugcucgucguugcccuucuggugaucuuccagguaugcuugugucaagaugaggugaccgacgauuacauuggggacaacacaacugucgauuauacguuauuugaaucccugugcucuaagaaagacgugagaaauuucaaggcuugguuucuaccuauaauguacucaaucauuuguuucguuggacuccuggguaacggccuugugguccugaccuauaucuacuuuaaaagguugaagacaaugacugauaccuaucuccugaaucuggcaguggccgacauucucuucuuacugacacuuccauuuugggcguacagugcugccaagagcuggguauucgggguucacuuuugcaaauugaucuucgcaauauauaagauguccuuuuucucuggaaugcugcuacuccuguguaucucgauugaucgguacguggccaucguccaggcugugucagcacaucgccaccgagcccgugugcuucugauuagcaaauugaguugcgucggcaucuggauacucgcuaccguucuguccauuccggaguuacuguacucugaccuccagagaagcuccucagaacaggccaugagguguagucuuaucacugagcauguggaagcguuuauuacaauccaaguagcacagauggugaucgguuuccugguccccuugcuagccaugagcuucugcuaucuggugauuauacggacccuccugcaggcucgcaacuuugagagaaauaaggccaucaaaguuauuaucgcaguggucgugguauucauaguuuuucagcuuccuuacaacggggugguccuggcucaaacgguggccaauuucaacauuacuucuuccaccugugaguugucaaagcagcucaauaucgcguaugaugucacauacagccuggccugcgugagguguugcguuaacccauuuuuauaugcauucaucggagugaaguuucggaaugaccuguucaaacuauuuaaggaucucggcugccugagucaggaacagcuucgccaauggucuuccugucgacacauuagaaggagcucgaugucuguagaggcugaaacuaccacaaccuucucccccuga

SEQ ID NO: 54005 - RNA, 1068 nt, Artificial Sequence
  derived and/or modified sequence opt3 from CCR8__Homo_sapiens__NP_005192
auggacuacacccuggaucucagcgugacaacugucacggacuauuacuaucccgauaucuucuccucuccuugcgacgccgagcuuauucagaccaacggcaagcuguuguuagcuguuuucuacugucugcuauuuguguuuucacuccuggggaauagucuuguaauacugguguuggucgugugcaaaaagcucagaagcaucacagauguuuaucugcugaaccucgcauuauccgaccugcuuuucguguuuucuuucccauuucaaacuuacuauuugcuggaucagugggucuucggaaccgugauguguaaaguaguuucggguuuuuacuacauuggcuucuauucaagcauguuuuucaucacacuaaugaguguggacagguaccucgccgucgugcacgcgguguaugcucugaagguccggaccauucgcauggggacuacacuuugccuggccguuugguugaccgcaaucauggccacgauaccgcuccugguguuuuaccagguagcuuccgaagauggaguguuacaguguuauucuuucuacaaucaacagacucugaaauggaagaucuucaccaacuuuaagaugaauauucucggccuucugauccccuucacaauuuuuauguucugcuauaucaaaauauugcaucagcuaaagcgaugucagaaccacaauaaaacuaaggcaauucgucugguccucaucgugguuauugccagccugcuuuucugggugccuuuuaacgucgugcuguuuuugaccucccuccauucaaugcacauccuggacgguugcaguaucagccaacaguuaacauacgcuacccauguaacggagauuauaucuuucacucacuguugcguuaauccagugaucuacgccuuugucggggaaaaauucaagaagcaccuguccgagauuuuucagaaaucauguagccagaucuucaacuaucuaggaagacaaaugcccagggaaaguugcgagaagucuuccagcugccagcagcauucgucucgguccucaaguguggauuacauacucuga

SEQ ID NO: 54006 - RNA, 1074 nt, Artificial Sequence
  derived and/or modified sequence opt3 from CCR9__Homo_sapiens__NP_001243298
auggccgacgauuacggcagcgaguccaccucuucaauggaagacuaugugaacuucaauuuuacagauuucuacugcgagaagaacaaugucagacaguuugcuagucacuuccugcccccucucuauuggcuuguuuuuaucgugggggcacugggaaacagcuugguaauuuuaguguacugguauuguacuagggucaaaacgaugaccgacauguuccugcuaaaucucgccauagcggaucugcuuuuucuggugacauugccauucugggcuaucgccgcagccgaccaauggaaguuucagacuuucaugugcaaaguugugaacuccauguacaagaugaauuuuuauucuuguguccuccugauuaugugcaucucgguggaucgguacauugcuaucgcacaggccaugcgcgcucauaccuggcgagaaaaacgucugcucuacucaaagaugguauguuucacaauauggguuuuagccgcggcacugugcaucccggagauucuuuauagccagaucaaggaagagagugguauugccaucuguaccaugguguaccccuccgacgagucuacuaaauugaaaagcgcuguccugacacuaaaggugauacucggcuuuuuccugccuuucguggucauggccugcuguuauaccauuaucauucacacgcuuauccaagcaaagaaauccucaaagcauaaggcucugaaaguuacuaucaccguguugacaguauuugugcucagucaguucccauacaacugcauucuguuaguccagacuauagaugccuaugcgauguuuaucagcaauugugccgugucuaccaacauugacaucugcuuccagguuacacaaaccauagcauuuuuccacuccugccugaaucccgugcucuacgucuuugugggggaaagauucaggcgggaucuuguaaagacgcugaaaaacuugggauguauuucacaggcucaguggguuagcuuuacucgcagagagggcagucuaaagcugucuuccaugcuccuggaaacaaccagcggugcccuuucgcuguga

SEQ ID NO: 54007 - RNA, 1071 nt, Artificial Sequence
  derived and/or modified sequence opt3 from CCRL2__Homo_sapiens__NP_001124382
augaucuacaccagauuccugaagggcagccucaaaauggccaacuauacacuugcucccgaggacgaauacgaugugcugauugagggggaauuggaguccgacgaagcagagcagugcgauaaguaugacgcccaagcguuaucugcucagcuggucccuucacuauguagugccguuuuugugauaggaguacucgauaaucugcuugugguccugaucuuggugaaauacaagggucucaaaaggguugagaacauuuaucugcugaaucucgcagugagcaacuuaugcuuccugcuuacuuugccauuuugggcccacgcuggcggggacccgauguguaagauccugauuggacuauacuucgucggccucuauuccgaaacguuuuucaauugccugcuuaccgugcagcgguaccugguauuuuugcauaaggguaacuucuuuucugcacgccgacguguucccugugggaucauaacaucggugcucgccugggucacugcuauccuggccaccuuaccugaguucgugguguacaaaccacagauggaagaucaaaaguauaaaugcgcguuuucaagaacacccuuccugccugcagacgagaccuuuuggaagcacuuccucacucuuaaaaugaauauuagcguccugguuuugccacuauucaucuuuacauuccuguacgugcagaugaggaagacccuccgguuucgcgagcagagauauagucuguucaaacuuguauuugccauuaugguggucuuccuguugaugugggcucccuacaacaucgccuuuuuccucuccacguuuaaggaacauuucucucugagcgauuguaaguccucauauaauuuagacaaaagugugcacauaacuaagcugauugcaaccacacauugcuguaucaacccucuacucuacgcuuuucuggauggaacuuucagcaaauaucuuuguaggugcuuucacuugcggucuaauaccccacugcagccgcgcggccaauccgcccagggcacaucacgagaggaacccgaccacagcaccgagguuuga

SEQ ID NO: 54008 - RNA, 1296 nt, Artificial Sequence
  derived and/or modified sequence opt3 from CCRN4L__Homo_sapiens__NP_036250
auguuccacagccccagaaggcugugcuccgcccuccuucagcgggacgcuccuggccugcgccgauugccagcaccgggguuacguagaccccugucuccuccagccgcggugcccaggccugcuucaccacggcuacucgccgcagccagugcugcaagcggagccgcucgcuccuguucuagaaccgucugcucgauggguacaggcacuucaaggcuguacagcgcccuugcgaagacgcugaacaguuccgcagccucucaacaucccgaguauuugguuagcccugauccagaacaccucgagccgaucgaccccaaagaacugcuggaggaaugucgggcugugcuccauacccgcccuccacgauuucagagagauuucguagacuuaaggacagauugccccuccacucacccuccaauucgggugaugcaguggaauauacuggcccaggcacuuggggagggaaaggacaacuuuguccaaugucccguggaggcuuugaaaugggaagaacguaagugccugauccuagaagagauucucgccuaccagccggauauccugugucuucaggagguugaccauuauuucgauaccuuucagccucuguugucacgccucggcuaccaagguacauucuuucccaaaccauggaguccuugccuggacguggaacacaauaacgggcccgauggaugugcguuauucuuucugcagaauagauucaagcucgucaacagcgccaauauuaggcuuaccgcaaugacucugaagacaaaccagguggcuaucgcccagaccuuggagugcaaagaaucuggccggcaauuuuguauagcuguaacgcaccuaaaggcccgaacuggcugggagcgcuucagauccgcacaggggugcgaccugcuccagaaucugcaaaacaucacccagggagccaaaauuccacuuaucguuugcggugauuuuaaugcugaacccacagaggagguguauaagcauuucgcgucaagcagucugaaccucaauucugcauacaaauugcuguccgccgacggccagagcgaaccuccauauacuaccuggaagauuaggacaucgggggagugucggcacaccuuagacuacaucugguacucuaagcaugcucugaacguccgcuccgcccuagaucuccugacggaggagcagauaggaccgaauagacuucccucauucaacuauccuagugaccacuugagccuggugugcgauuuuuccuucacugaagagucugacggccucagcuga

SEQ ID NO: 54009 - RNA, 2703 nt, Artificial Sequence
  derived and/or modified sequence opt3 from CCSER1__Homo_sapiens__NP_001138537
augggcgacagcggguccagaaggucuacccuggugucacggcuccccaucuuccgccgaaguauuaaccguagacacgauagccuuccuuccucuccaucgucaagcaauacagucggaguucauaguuccucuccgagcuccacuaacucaaguagcgguucuacgggcaagaggcgguccauauuucgcacccccucaaucagcuuccaccauaaaaaggggagugagccuaaacaggaaccaacaaaucaaaaccugucuauuuccaauggagcccagcccggccacagcaacaugcagaaguugucguuagaggaacauaucaaaacuagagguaggcacucugugggguuuuccucaagucggaauaagaagauuacccgcagccugacagaggacuucgaacgagagaaagagcacuccaccaacaagaauguauuuaucaacugccuaucuagcggaaaaucagaaggcgaugacaguggcuucacugaggaucagacaagaagguccgugaagcaaagcacccggaaacuccugccuaagucuuuuucaagucauuacaaguucagcaaaccaguccuucagucccagucuauaucgcuggugcagcaaagcgaauuuuccuuggagguuacgcaguaucaggagcgugaacccgugcucguccgcgcuucaccuaguuguucuguggacguaacugagagagcagggagcucccugcagucaccacugcucagcgccgauuuaaccacagcgcaaacuccgucugaguuccuggcucuuaccgaggacuccguuagugaaauggaugccuuuagcaagucuggauccauggcaucacacugcgacaauuucggucauaacgauaguacaagccagaugucguugaauagcgccgcugugaccaaaacgacuacagagcugaccggcacuguccccugugcaaucaugucuccugggaaguacaggcuagagggacagugcagcacagaaucaaacagucucccagagaccuccgccgcuaaucaaaaagaagugcugcuucagauugccgagcugcccgcgacgucugugagccacuccgaaucaaacuugccugcagacagcgagcgggaggaaaacaucggccuccagaauggugagaccaugcuggggacaaacaguccacgaaaguuaggauuuuaugaacagcacaaagccauugcugagcaugucaagggcauccaccccauaucugauuccaagauuaucccgacuagcggcgaccaucacauuuucaauaaaaccucgcauggguacgaagccaacccugcaaagguucuggcuucaucucucagucccuuccgcgagggaagauuuaucgagaggcggcuucgcuccagcucugaagguacagccggcagcuccagaaugauccugaaaccaaaggacgggaauauugaggaagugaacucauugaggaaacaacgugcgggaaguuccucuuccaagaugaacucacuagauguacugaauaaucucggcaguugugagcuggacgaggaugaccuuaugcuggauuuggaguuccucgaagaacagagccugcacccuuccgugugccgggaggacucuuaucacucggucgugagcugugccgcaguuguguuaacucccauggaaccaaugauagagaugaagaaacgagaggaacccgaguuuccugaaccaucaaagcagaaccugucccuaaaacucaccaaggaugucgaccaggaggcuagaugcagucauaucucuaggaugccgaauagccccuccgccgauuggccucugcaagguguggaagagaacgggggcauugacucacuuccauuccgcuugaugcugcaggauuguacagcuguaaaaacccuccugcuuaagaugaagcggguucugcaggagucugccgacaugagccccgcaaguuccacuacgagcuugccugugucuccacucacagaagaacccgucccguuuaaagacaucaugaaggaugaaugcucaaugcugaaauuacagcugaaggagaaagacgaacuaauaucccaacuccaggaggagcugggaaaggugagacaccuucagaaggccuucgcuaguagggucgauaaaagcacccagacugaauugcuguguuacgacggccucaaucugaagcgcuuagagaccgugcaagggggacgagaagcgacauaucggaaccguauuguuucgcagaaucugucuaccagagauaggaaagcaauccauacuccuacagaggaccgcuuucgguacuccgccgcugaucagacgagcccauacaagaacaaaaccugccaacuucccucauugugccucaguaacuuccugaaggacaaagagcuagccgaagugaucaagcacucuagagguacuuaugagacacugaccuccgauguaacacagaaucucagggcaacugucggccagagcucacugaagccuaccgccaaaacggaagggcuuaguaccuuuuuggagaagcccaaagaccagguggcuacagcccgacaacacagcacuuucaccggacgcuuuggccagccaccucggggucccauuucccugcauauguacucuagaaagaacguuuucuuacaccauaaucuccacagcacagaacugcagacucuugggcagcaagauggcuga

SEQ ID NO: 54010 - RNA, 825 nt, Artificial Sequence
  derived and/or modified sequence opt3 from CCS__Homo_sapiens__NP_005116
auggccagcgacuccggcaaccaggggacccugugcacacucgaguucgcugugcaaaugacuugucagucuugcgucgaugcaguuagaaagucacuucagggaguggccgguguacaggacguggaaguccaccuggaggaucaaaugguguugguucauacgaccuuacccagucaggaagugcaggcgcugcuagagggcacagggaggcaggcuguccucaaaggaaugggcagcggucaacugcagaaucuuggggccgcaguggccauccugggaggcccuggcacuguacaggggguugugcgguuuuugcagcucaccccagaacgcugucugauugagggaacaauagacggucuggagccgggccuccacggguuacauguccaccaauacggagaucugaccaacaauugcaacuccuguggcaaucauuucaaccccgacggugcuucucacgggggaccucaggauucggaccgacaccguggcgaucuuggcaaugugagagcagacgccgaugggagggcuaucuuucggauggaagacgagcaguugaaggugugggaugucauuggacgcucacugaucauugacgaaggugaggacgaucuaggcagagggggacauccacucagcaaaaucacuggcaacaguggugagaggcuggccugcgggauaaucgcgcgguccgcaggccuuuuccaaaaucccaagcagauuuguucuugcgacggacugacaaucugggaggaacgcggccgaccuauugccgggaaaggaagaaaggaaagcgcucagccacccgcccacuuguga

SEQ ID NO: 54011 - RNA, 1608 nt, Artificial Sequence
  derived and/or modified sequence opt3 from CCT2__Homo_sapiens__NP_006422
auggccagccugucccucgcucccgugaacaucuucaaggcaggcgccgacgaggaaagagcggagaccgcuaggcuuacaucuuuuauuggggccauagcaaucggagaucuggucaaaucaacuuuggguccuaagggcauggacaaaauuuuacugaguagcgggcgggaugccucccuaaugguuacgaaugacggagcuaccauccucaagaacauuggcguggauaauccagcagccaaaguacugguggacaugucucgcguccaggaugacgaagugggugaugggacaacuucgguuaccgugcuugcugccgagcuguugcgagaagcggagucacucaucgcaaagaagauacacccgcaaacaaucauugccggauggcgugaggcuaccaaagccgcaagagaagcucugcugagcagugccgucgaccauggcuccgaugaggugaaguucaggcaggaccucaugaacaucgcgggcacuacauuaucuagcaaacugcuuacccaccauaaggaucacuuuacgaaauuggccguagaagcaguucugcggcuaaagggguccggaaaucucgaggcuauucauaucauaaagaaacuggguggcucacuugccgacaguuaccuggacgagggguucuugcucgauaagaaaauuggagugaaccagcccaagcgcaucgaaaaugcuaaaauucugaucgccaacacuggcauggacaccgauaagaucaaaauuuuugguagcagagucaggguggacucuacagcaaagguggccgagauagaacacgcugagaaggagaaaaugaaggaaaaagucgagcggaucuuaaagcacgggauuaauugcuucaucaaccgccagcugauauauaauuacccugaacaacucuuuggagcggcaggcguuauggccauugagcaugcugauuucgccggcguggaacgacuugcacugguaacugggggagagaucgccuccaccuuugaccacccagaauuggugaaacuagguucauguaagcugaucgaggaggucaugauuggcgaagauaagcucauccauuucagcgggguggcucugggagaggccugcacaauuguucuuagaggcgcaacccagcagauacuggacgaagcggagaggaguuugcacgaugcucucugugugcuggcccagacggucaaagacucucggacuguguauggugggggcugcuccgaaauguuaauggcacacgccguaacacaacuggcuaaccguacccccggaaaggaggccguugcaauggagagcuacgcuaaagcccuacgcaugcucccuacuaucauugcggauaaugccggcuaugacucggcugaccugguggcacagcuuagagccgcucauucugaagggaacacaaccgccggauuggauaugagggaggguacgaucggcgacauggcaauccuggggauuaccgaauccuuucaggucaagcgacaggugcuccugucagcggccgaggcugccgaggucauacuucggguggauaauaucauuaaagcagcuccacgcaagagaguucccgaccaccauccuuguuga

SEQ ID NO: 54012 - RNA, 1524 nt, Artificial Sequence
  derived and/or modified sequence opt3 from CCT3__Homo_sapiens__NP_001008800
augaugggccacagacccgugcugguccucagccagaacaccaagagggaguccgggcggaaaguucaaucuggaaauaucaacgccgcuaagauucaggugcagcauccugcagccaaaucaaugauagaaaucagucgcacacaggacgaggaaguaggugauggcacuacgagcgugauuauccuugcgggggagaugcuguccgucgcugaacacuucuuggagcaacagaugcauccaaccgugguuauuucugccuaccgaaaggcauuagacgauaugaucucgacacugaaaaagauaucaaucccgguggacauuagcgauagugacaugaugcuaaauaucauuaacuccucuaucacuaccaaggccauaagccguugguccucacucgcuugcaauauugcacuggaugccgucaaaauggugcaguuugaggaaaacggaagaaaggagaucgacauuaaaaaguaugcuaggguagagaaaauccccggcgguaucauugaggauaguuguguucuucgaggggugaugauaaauaaggacgucacacacccucgcaugagaagguacaucaagaacccacggauugugcuguuggauagcucucucgaguauaaaaagggagaaucccagaccgacaucgagauaacucgcgaagaggauuucacacggauucugcaaauggaagaggaguacauccagcagcugugcgaagacaucauucagcucaaacccgacguggucaucaccgagaagggcauuucagauuuagcccaacauuaucugaugagagcgaauauaacggcaaucaggcggguucguaaaacugacaacaaucgcauugccagagcuuguggcgccaggaucgugagccggccugaagaacuucgagaagaugacguagggaccggagcagguuugcuggagaucaagaaaauuggcgaugaguacuuuacauucauaacugacugcaaggauccaaaggcuuguaccauccuacuccgcggggccaguaaagaaauucugucugagguggaaagaaaccuucaggacgcgaugcaggucugcaggaaugugcuguuggauccccaacucguuccuggaggcggugccuccgagauggcaguggcucacgcccugacagaaaagagcaaagcuaugaccggggucgagcaguggccauaucgggccguggcacaggccuuagagguaaucccgcgcacgcugauucagaacuguggagcuucgacuaucagacuccuuacaucucugagggcgaagcacacccaagaaaauugcgagacuuggggcguuaacggcgaaacagggaccuugguggacaugaaagagcuaggaauaugggagccccuggcagucaagcuccagacguacaagaccgccguggaaacagcuguccugcuucugcguaucgaugacauuguguccggucauaaaaagaaaggcgacgaucagucacggcaagggggagccccugacgcaggccaggaguga

SEQ ID NO: 54013 - RNA, 1530 nt, Artificial Sequence
  derived and/or modified sequence opt3 from CCT4__Homo_sapiens__NP_001243650
augcccgagaacguggccccuagaagcggcgcuaccgcaggggccgcgggagguaggggcaagggggcuuaccaggaccgggauaaaccagcccaaauccgcuucuccaauauuucugcagccaaggcugucgcagacgccauacgaacaucacugggaccgaaaggcauggauaagaugcucguugaacuuaguaaagcucaggacaucgaggccggugaugggacuacgagcgugguaauuaucgcgggaucccuguuggacucuugcaccaaguuacugcagaagggcauucaccccacaaucauaucggaaucauuucagaaagcacuagagaagggcaucgaaauucucacugauaugagccguccuguggagcugagugacagagagacccuucugaacuccgccacaaccucuuugaauagcaaagucgugucccaauauucaagucuccugagcccaaugucuguuaacgcugugaugaaggucaucgaucccgccacugcaacauccguggaccugagggauauuaaaaucguaaagaagcucgggggaaccauagacgauugugaauuaguugagggucuggugcuuacgcagaaagucucaaauagcggcauuacucggguggaaaaggcuaaaaucggguugauucaguucugccugagugccccuaagaccgacauggacaaccagaucguggucucugauuacgcgcaaauggaccgcguucuaagagaggagagggccuauauccucaaucuggugaaacagauuaagaaaacaggauguaacguacuucugauacagaaguccaucuugcgggaugcacucagcgaccuggcuuuacauuuucugaauaagaugaaaauuauggugaucaaggauauagaacgcgaggacauugaguucaucugcaaaacuaucggcaccaagccagucgcccacauugaucaguuuacagcugacaugcucgguucggccgaacuugcagaagaggugaaccugaaugggucuggaaaauugcuaaagaucaccggcugugccucccccggcaagacgguuacuauugugguccgagggucaaacaaacuggugauagaggaagcugagagaaguauccaugaugcgcucugcguaauuaggugucugguuaagaaacgggcacuuaucgccggagguggcgcuccugaaaucgagcuggccuugcgucucacagaauacagccgcacccuguccgggauggagucuuauugcgugagagcauucgccgacgcuauggaggucauuccaagcacuuuagccgaaaaugcaggacugaacccgauaucaacagugaccgagcuaaggaaucggcacgcgcaaggcgaaaagacggcugguaucaacguccgaaaagggggcauuaguaacauccucgaggaacuggugguucagccccuuuugguguccguaagcgcccugacccucgcaacagagacuguccgcucuauucugaagaucgaugacgugguuaauaccagauga

SEQ ID NO: 54014 - RNA, 1626 nt, Artificial Sequence
  derived and/or modified sequence opt3 from CCT5__Homo_sapiens__NP_036205
auggccagcaugggcacccuggcuuucgacgaguacgggagacccuuucucaucauuaaggaucaggacaggaaaucccggcuuaugggacuggaagcauugaagucucacauaauggccgcgaaagcuguggccaacacaaugcgcacuucauuagguccuaauggccuggauaagaugauggucgacaaagauggggacguuacggugaccaacgauggagcaacaauccuaaguaugauggacguagaucaucaaauugccaagcucaugguggagcugagcaagucccaggacgaugaaaucggcgacgguacuaccggggucgugguucuugcuggagcacuguuggaggaagccgagcagcuccuggaucgaggcauucacccaauccguauagcugacggcuaugagcaggccgcgagaguggcaaucgaacaucuggacaaaauuucugauucgguccucguggacaucaaggauacagagccguuaauucaaaccgccaaaacuacacuggggucaaagguaguuaauagcugccacaggcagauggcugaaaucgccgugaacgcaguccuuaccguggcugacauggagcggcgcgauguggacuucgaguugauaaaagucgaaggaaagguugguggcagacuggaggauacgaagcuaauuaaaggggugaucguagacaaggauuuuagucauccccagaugccuaaaaagguggaagacgccaaaauugcgauccucacuuguccauucgagcccccuaagccaaaaaccaagcacaagcuggaugucacauccguggaagacuacaaagcccuucagaaguaugagaaagagaaguuugaagagaugauccaacagauuaaagaaacuggagcaaaucuggcuauaugccaguggggcuucgacgaugaggccaaccacuugcuccugcagaauaacuuacccgcuguuaggugggugggugggccugaaaucgagcugauugccaucgcaaccggaggccggauagucccacgcuuuucugagcucacagccgaaaaacuuggcuucgcugggcuggugcaagagauuagcuuuggaaccacgaaggacaagauguugguaaucgaacaguguaaaaauucccgagcgguuacuaucuucauuagagguggcaacaagaugaucauugaggaagcaaagaggucacuacaugaugcccugugcgugauacggaaucucauccgugacaaccgcgucguguacgggggaggcgcugccgagauuaguugugcacuggccgucagccaggaggcugauaaaugcccgacacuugaacaauaugccaugagagcauuugcggacgcucuggaggugauccccauggccuugucugaaaauuccgguaugaacccuauccagaccaugacugagguuagggcacgacaggugaaggagaugaauccagcccucgggauugauugucugcacaagggcacaaacgacaugaaacagcaacauguaauagaaaccuuaaucggaaagaaacagcagauuucacuggcuacgcagaugguccggaugauccuaaagauugaugacauccgcaaacccggcgagagcgaagaguga

SEQ ID NO: 54015 - RNA, 1461 nt, Artificial Sequence
  derived and/or modified sequence opt3 from CCT6A__Homo_sapiens__NP_001009186
auggccgcugugaagacccugaaccccaaagcagaggucgccagagcgcaggcugcccucgcaguuaauaucagcgccgcuaggggccuucaagacgugcugcggacaaacuuggggccuaagggaacuaugaaaauguuaguauccggugcaggcgauauuaagcugacgaaagacgggaaugugcuacuccacgaaaugggacugcauccacgcauaaucaccgagggcuucgaagccgcuaaggagaaggcccuucaguuucuggaagaggucaaagugucucgagagauggaucgugaaacauugauugacguugcgagaacuucacucaggaccaaggugcacgcagagcuggccgauguccugacagaagcugugguagacaguauccucgccauuaaaaagcaggaugagccgaucgacuuauucaugauagagaucauggaaaugaaacauaagagcgagaccgauacuucccugauucggggucuuguuuuggaccacggggcacgccaucccgauaugaagaaaagaguggaagacgcuuacauccugacaugcaacgucucucuagaguaugaaaagaccgaggucaauucgggauuuuucuacaaaucagccgaggaaagggagaagcucgugaaagcggaacggaaguuuauugaggaucgcgugaaaaagaucauagaacugaagcgaaaaguuuguggcgacagcgacaagggcuucgugguaauuaaccagaaagggaucgauccuuuuagucuugacgcccuguccaaggagggaauuguggcauugagaagggcuaaacggcguaauauggagcgccucacgcuggccugcgguggcgucgcuuuaaacucuuucgaugaccugagcccagauugucucgggcacgccggacuuguguaugaauacacucugggcgaggaaaaguuuaccuucaucgagaagugcaauaaccccagauccguuacauugcuaaucaaagguccuaauaagcacacucugacccaaauuaaagacgcagugagggaugggcuccgggccgucaagaacgcuauagacgauggaugugugguaccaggcgcgggcgcaguugaaguggccauggcugaggcccugaucaaacauaagcccucagucaaggggcgagcacagcuuggagugcaggccuuugcugacgcccuguugauuaucccuaaaguccucgcacagaauagugguuucgaucugcaagagacauuagugaagauacaggcggaacacagcgagucuggccagcugguugggguggaccuaaacaccggagaaccaaugguagcugccgaggucggcgugugggacaauuauugcguuaaaaagcagcuccugcauuccuguacggugauugcaacuaacauccuuuuggucgaugagaucaugcgcgccgguaugucaagccugaaaggguga

SEQ ID NO: 54016 - RNA, 1482 nt, Artificial Sequence
  derived and/or modified sequence opt3 from CCT6B__Homo_sapiens__NP_001180458
auggccgcuaucaaggcagugaacagcaaagccgaggucgcgagagcuagggccgcacuggccguuaauauuugcgcugcacggggccuccaggacgugcuucgcaccaaccuggggcccaagggaacaaugaaaauguugguauccggugccggcgauauaaaguuaacuaaagacgggaaugugcugcuagaugaaaugcaaauccagcacccuacggcuucucucauugccaaggucgcgaccgcacaggacgaugugacaggagacggcacuaccucaaacguucugaucauuggugagcuucugaagcaggccgauuuguacaucagugaagggcuccauccacgaauaaucgcugagggauucgaagccgcaaaaauuaaggcucuggaggugcuggaggaagucaaagugacaaaggagaugaaacguaagauccucuuagacguagccagaaccagccugcaaacuaagguucacgcggaacuugccgauguguugacagaggucgugguggacuccguccuggcaguuaggcggccgggcuaucccauugaucuauuuaugguggagaucauggaaaugaaacauaagcucggcaccgacacgaaagagguaaauucuggguucuuuuacaagacugcugaagagaaagaaaagcuggugaaagccgagcgcaaguucauagaggauagaguccagaagauuaucgaccuuaaagacaaggugugugcucagucgaacaaaggauuuguugugauuaaucagaaggguaucgauccuuucucacuggacagcuuggccaaacacggcaucgucgcacucaggcgggccaagcgccgaaacauggaaagacugaguuuagcuugcgggggaauggcgguaaauuccuuugaggaucugaccguggacugucucggccaugcaggucuuguuuaugaauacacacugggggaggaaaaguucacuuuuauugaggagugcgugaacccauguucugucaccuugcuagugaaaggacccaauaagcacacacugacccaagucaaagaugccauaagggacggccuccgggcuaucaagaacgccauugaagauggcugcauggugccuggggcaggagccaucgagguugcuauggccgaagcacuggugacguauaaaaauagcauaaagggucgugcgcgccuuggcguacaggcuuucgccgacgcacuguugauuaucccaaagguccucgcccagaacgcuggguacgauccccaggagacucuggugaaaguucaagccgaacacguggaguccaagcaguuagucggaguggaccugaauacaggcgagccuaugguagcagcugaugccggugugugggacaacuauuguguuaaaaagcagcuacuccauucaugcaccgucaucgcgacuaacauucugcuuguggacgaaaucaugagagccgggaugaguagcuugaaauga

SEQ ID NO: 54017 - RNA, 1020 nt, Artificial Sequence
  derived and/or modified sequence opt3 from CCT7__Homo_sapiens__NP_001009570
augauggacagccagcugguggccggcgucgcuuucaagaaaaccuuuuccuacgcaggguucgagaugcaacccaagaaauaucacaacccuaagaucgcccuccuuaauguugaacuggaguugaaagcggaaaaggauaacgcugagauuagagugcauacaguagaagacuaccaggccauaguggaugcagaguggaauaucuuauaugacaagcuggagaaaauucaccauucuggagccaaggucgugcuaucaaaacucccaaucggugauguugcuacucaguacuuugcagacagggauauguucugcgccggccgggugccggaagaggaccugaagcgcacgaugauggcuugugggggaaguauucagaccagcgucaacgcccuuuccgcggaugugcugggccgaugccaaguauuugaagagacacagaucgguggggagcguuauaauuucuuuacuggaugucccaaagcaaagaccugcacauucauauugagaggcggcgccgaacaguuuauggaggaaaccgagaggucucuccacgacgcuaucaugauuguucggcgcgccaucaagaacgauucgguggucgcagggggaggugcuauugaaauggagcugucaaaauaccugagagacuauagcaggacuaucccuggcaagcagcaacucuuaauaggggccuacgcgaaagcccuggagauuaucccacggcagcuuugugauaaugcaggauucgacgcuacaaacauuuugaauaagcugcgcgcccgacaugcucagggcgguaccugguacgggguggacaucaacaaugaagauaucgccgacaacuuugaggcauucgugugggaacccgccauggucagaauuaaugcucuaacggcggcaagugaggccgcuugccucauaguuuccguggaugaaacuaucaaaaacccuaggucuaccguagacgccccaacagcagccggacggggccguggccgcgggagaccccacuga

SEQ ID NO: 54018 - RNA, 4287 nt, Artificial Sequence
  derived and/or modified sequence opt3 from CD109__Homo_sapiens__NP_001153059
augcagggacccccucugcucaccgccgcucaccuucugugcguguguacagcagccuuggcggucgcuccagggccgagauucuuaguuacugcccccggaaucauuaggccugguggcaacgugacgauagggguagagcugcuagaacauugcccaagccaagugaccgucaaggcagagcuccugaaaacagccuccaaucuuacugugucuguucuggaagcugagggaguguuugaaaagggcucauucaaaaccuugacacuccccagucugccucugaacagcgcagacgagaucuacgagcuccgggucaccggucgcacucaggaugaaauuuuauuuuccaauucuacacgacugucguucgagaccaagcguaucucaguguuuauucagacggacaaagcccuuuauaagccaaagcaggaaguaaaauucagaaucguuacuuuguuuagcgauuucaagcccuacaaaaccagucugaacauacuaaucaaggacccuaaauccaaucucauucaacaguggcugucucagcagagcgaucuuggggugaucuccaagacauuucaacugucaagucacccaauuuugggagacuggagcauccagguccaggugaacgaucagacuuauuaccaaucuuuccagguguccgaguauguccucccgaaguuugagguuacccugcagacacccuuauacuguucaaugaauagcaaacaucugaacggcaccauaacggcuaaguauacuuacggcaaaccugugaagggggacguaacacucaccuuccuuccacugaguuuuuggggcaaaaagaaaaauauuacuaagacauucaagaucaacgguucugccaauuucuccuuuaacgaugaagagaugaaaaaugugauggacagcucgaacggcuugucugaauaccuagaucuguccucacccgggccugucgagauucucaccacggugaccgaaaguguuacaggaaucagcaggaauguguccacuaacgucuucuuuaagcaacacgacuauaucauugaguucuuugauuacaccacagugcugaaaccaucucuuaacuucacugcgaccguaaagguuacacgggcagacggcaaucagcugaccuuggaggaacgcagaaacaauguggucauaacugugacgcagaggaacuauacagaguacuggagcgguucaaauagugggaaccagaaaauggaagccguccaaaagaucaauuauaccgugccccaguccggaacuuuuaagauugaguucccgauccucgaagacagcucugagcugcaguuaaaggcuuacuuucugggcucaaaaaguagcauggccguucauucccuauucaaaucuccuucgaagaccuauauacagcucaaaacacgggaugagaacauuaaggugggcagccccuuugaacugguagucuccgggaauaagcgccuuaaagaguugucauacauggugguuagucgaggacaacugguggcagucgguaagcagaacucuaccauguucagccucacuccagaaaauuccuggacaccuaaggcuugcgugaucguauacuauaucgaggacgauggcgaaauuaucucagacgugcugaaaauucccguucagcuugucuuuaaaaacaagauaaagcuguacuggagcaaagugaaggccgagccaucugagaaaguguccuugagaaucagugucacgcagcccgauagcauuguugggaucguggcgguggacaagucuguaaaucucaugaacgccuccaaugauaucaccauggaaaacgucgugcacgagcuggaauuauauaacacuggauacuaucugggcauguucaugaacucauucgcaguuuuucaagaguguggucuaugggugcucacagacgcuaaucugaccaaagauuacauugacggggucuaugauaaugccgaguacgcugaaagguucauggaggaaaacgagggccacauaguggacauccaugacuuuagucuuggaagcucgccucacguucggaagcauuucccagaaacauggauuugguuggauacuaauaugggcuaccguaucuaucaggaguuugaggugaccguaccggacuccauuacgucuugggucgccaccggguucgugaucagcgaagaucugggacucggucugacaacuacccccguggaguuacaggcauuucagccuuucuuuauauuccugaaccuuccauacucagucauccgcggcgaagaguuugccuuggaaauuacaaucuucaauuaucucaaagacgcuacugagguuaaggugauuaucgagaagagugauaaauuugacauacugaugaccuccaacgaaauuaaugcgacggggcaccaacagacacuacugguacccucugaggauggagcaaccgugcucuuuccuaucagaccaacucaccugggcgaaauucccaucacagucaccgcccuuagcccgacugcuuccgacgccgugacccagaugauauugguuaaggcagaggguaucgaaaaaucauacagccaaaguauucuguuagaucucacagacaacaggcugcagucuacgcuuaagacccuguccuucagcuuuccuccaaauacugugacagggucggagcggguccagaucaccgccauuggcgauguguugggacccucaaucaacggccucgcuucucugauacgaaugccuuaugggugcggagagcagaauaugauuaacuucgcccccaauaucuacauccuagacuaucugacuaaaaagaagcaacucacagauaaccugaaagaaaaggcacuuaguuuuaugcgccaggguuaccagagagaguugcuguaccagagggaagacggcuccuucagcgcguuugggaacuaugacccaucuggaagcaccugguuauccgcuuucguucuccgguguuuucuggaggccgauccuuacauugacaucgaucaaaaugugcuucaucgcacguauacauggcugaaaggccaccagaagucaaacggugaguucugggaccccgggagagucauucauagugaacuacagggcggaaauaaaagcccaguaacccucacugcauacauagugaccucucuguugggcuauaggaaguaccagccgaacaucgauguucaagaguccauucacuuucuggaaucagaguucagucgugggaucagcgacaauuauacauuagcccucauuacuuacgcucuguccucugugggaucgccuaaggccaaagaagcacuuaacaugcugaccuggcgggcugagcaggagggcgguaugcaguuuugggucagcucagaauccaaguugagugauucuuggcaaccccgaagccucgacaucgagguggccgcguacgcccugcuaucccauuuccugcaguuccagacaucagaagggauaccaaucaugagauggcuuucuaggcagcgcaauagccucggaggcuuugcuaguacgcaagauaccacuguagcacugaaagccuuguccgaguucgcugcccugaugaacacagaacggaccaauauucaggugacugucacaggucccagcucuccuucaccauuagcaguugugcagcccaccgcggugaacaucuccgccaauggcuuuggguucgcuauuugccagcucaacgucguguauaauguuaaggccaguggaagcucgagaaggcgccgaucuauccaaaaccaggaggcauuugaccuggauguagcugugaaagagaauaaggacgaucuuaaccacgucgaccugaacguguguacguccuucagcggcccugggcggucaggaauggccuugauggaaguuaaucuccugaguggcuuuauggugccgucugaggcaauaucccuaagcgaaacugucaagaaaguggaguacgaccacgguaagcugaaccuuuaucucgauucaguaaaugaaacccaguucugcgucaacauuccagccgugcguaauuuuaaaguuaguaacacacaggacgcuagcguguccaucgucgauuacuaugagcccagaaggcaagcggugcgcucuuacaauagcgagguuaagcuguccucaugugacuugugcucugaugugcaggggugccggccuugugaagacggagccaguggcucgcaucaccauagcuccgucaucuucauuuucugcuucaaauuacuguauuuuauggagcucuggcuguga

SEQ ID NO: 54019 - RNA, 1128 nt, Artificial Sequence
  derived and/or modified sequence opt3 from CD14__Homo_sapiens__NP_001167576
auggagagagccagcugccugcuccuucuguuguuaccccuggugcacgucuccgcuaccacaccugaaccaugugagcuagacgaugaagacuucaggugcguuuguaacuuuucugagccgcagcccgauuggucagaagcauuccaaugcgugagugccguagagguggagauccaugcgggcgggcucaaucuggaaccuuuucuuaagcgggucgacgcugaugccgacccacgccaguacgcagauacugugaaagcccugcgaguucguagauugacggugggagcugcacagguccccgcccagcuccuggugggugcucugaggguacucgccuauagccgguuaaaggagcugacccuugaagacuugaaaauuacaggcacuaugccuccacugccccuagaggcgaccgggcucgcacuguccucucuucgccugagaaacguuucgugggccacaggaaggucaugguuggcugagcuccaacaguggcugaagccuggcuuaaaagugcugagcauagcccaggcacacaguccagcuuucuccugugaacagguccgggccuuuccggcgcucaccucucuugaucugagcgacaaucccgguuugggggagcgcggacuaauggccgcacugugcccucauaaguucccagcuauccaaaaccucgcccugcgaaauacuggcauggaaacacccaccggcgugugugcugcccuugcagccgcuggggugcagccucacucccuggauuugucacauaacagucucagagcgacggucaauccaagcgcacccaggugcauguggucuuccgcccugaacucauuaaaucugagcuuugcuggacuagagcagguuccgaagggucucccugccaaacugcgggugcuugacuugaguuguaaccgucugaaucgcgcaccccagccagaugaacucccugagguagacaaccugacucuugacggcaaucccuuccuggugccagggaccgccuugccccacgagggaucuaugaacuccggcgucgugccugcuugcgccagaagcacacucucgguuggugugucugggacucuggucuuacugcaaggagcaaggggcuuugcguga

SEQ ID NO: 54020 - RNA, 762 nt, Artificial Sequence
  derived and/or modified sequence opt3 from CD151__Homo_sapiens__NP_001034579
augggcgaguucaacgaaaagaaaaccacaugcgggacugugugucugaaguaccuccuuuuuacguauaauugcuguuucuggcuggccggauuggcugucauggcaguugguaucuggaccuuagcccugaaaagcgacuacauuucccuacucgcgucuggcacauaucuggcuacugccuacauacuugugguagcagggaccguggucauggugacaggaguucugggcugcugugccaccuuuaaggagagaaggaacuugcuccggcuguauuucauccugcucuuaauuaucuuucugcuugaaauuaucgcugguauauuggcauacgccuauuaccagcaacugaauacugagcuaaaagaaaaccucaaggauacaaugaccaagcgcuaccaccagcccgggcaugaggcugugacgucagccgucgaccagcugcagcaagaguuccacugcuguggaaguaauaacagccaggauuggcgagacuccgaauggauccguucucaggaggcgggcggcagagugguaccugauucgugcuguaaaacuguuguggcacuuugcgggcagagggaccaugccucaaauauuuauaaggucgaaggagguuguaucaccaaacuggagacauuuauucaagagcacuugcgggugaucggcgcuguggggauaggaauugccugcguccagguuuucggcaugaucuuuacuugcugucucuaccgcagccugaaguuagaacauuauuga

SEQ ID NO: 54021 - RNA, 3471 nt, Artificial Sequence
  derived and/or modified sequence opt3 from CD163__Homo_sapiens__NP_004235
augagcaagcugagaauggugcuccuugaggacuccggcucugccgauuucaggcggcacuuugucaaccugucacccuucaccaucacaguuguguuguuacugagugcuugcuuuguaacuagcucccuagggggaacggacaaagaacuccgccugguggauggugagaauaaguguucuggccgagucgaagugaaaguucaggaggaaugggggaccgugugcaacaauggauggucgauggaggcagucucagugauuuguaaccaacuuggcugcccuacagccauaaaggcgccagguugggcuaauagcagugccggguccggacguaucuggauggaccauguaucuuguagaggcaacgagagcgcacugugggauugcaaacacgacggcugggggaagcauuccaauuguacucaccagcaggaugccggaguuaccugcucagacgguaguaacuuggaaaugaggcucacacggggcgggaauauguguagcggacgcauugagaucaaguuccagggcagaugggguaccgugugcgaugacaacuuuaauauugaucaugcuucugucaucuguaggcaacuggaaugcggguccgcagugucauucagcggaaguucuaacuuuggcgagggcuccgggccgauaugguucgacgaucugaucugcaauggaaacgagagcgcccucuggaauuguaaacaccaggguuggggcaagcacaacugcgaccaugcugaagacgccggggugauuuguucgaaaggagcggauuuaucucugcggcuugucgacggcguuacugagugcuccggucgcuuggaagugcgauuucagggggaguggggcacaaucugugaugacggaugggauucauacgacgcagccguagcuugcaagcagcugggcugucccaccgccgugacggcaauugggagagucaacgcuaguaaaggauucggucacaucuggcuagauagcguguccugccaaggccaugaaccugccauauggcaguguaagcaccacgagugggggaagcauuauugcaaucacaacgaggacgcgggaguuacuuguucugauggcagcgaccucgaacugaggcuucggggugggggcucacguugcgccggaaccguggaggucgaaauucagcgccuguugggcaaagugugcgauagaggguggggacucaaggaggcagacguaguuuguaggcagcuggguugcggcagugcuuuaaaaacauccuaccaaguguauagcaagauccaggccacuaauaccuggcuguuucucucuucauguaacgggaaugaaacaagucuuugggacugcaaaaacuggcaguggggaggccugaccugugaucauuacgaggaggcuaagauuacgugcagcgcccaccgggaaccacgauuggucgguggggacauccccuguuccggccgcguggaggucaaacauggagauacuuggggcucuaucugcgacucggauuucagccuagaagcagccuccgugcuguguagagagcuccaaugcgggacaguugugucaauucugggaggcgcucacuuuggugaagggaauggacagauaugggcggaggaguuccagugugaaggccacgagagucaucuuucucugugcccuguagcaccaaggcccgaagguaccugcagccacucccgggacgucggcgugguuuguucacgcuauacugagaucagauuggugaacgggaagacaccuugcgagggaagggucgaacucaagacccugggcgccugggggagcuuauguaauucucauugggauauugaggacgcucacgugcugugccagcaacuaaaauguggaguagcccucuccacgccaggcggugcacguuucgggaagggaaacggccagaucuggcggcacauguuucauugcaccgguacagaacagcacaugggcgauuguccggugacugcccugggggcuagucuuugccccagcgagcagguugccucugucauauguuccggaaaucaaucacagaccuugaguagcugcaacucguccucucugggcccuacacgaccaacuauucccgaagagagcgcaguggcguguaucgagucagggcagcucagacuggugaauggaggcgguaggugcgcugggcgcgucgaaaucuaccaugagggaaguuggggcaccauuugcgacgauuccugggaccuuucugaugcccacguugugugucggcagcuggguugcggcgaagcaaucaacgccacagggagcgcucauuucggagagggcaccgggccuauuugguuggacgaaaugaaauguaauggaaaggaguccagaauauggcaaugccacucacacggcuggggucagcagaacuguaggcauaaagaggacgccggggugaucugcagcgaauuuaugagucuccgccugacuucugaggcaucccgagaggcuugugccggacgguuagaaguauucuauaacggcgcguggggcacggucggaaagagcucgaugucagaaacaaccguggggguugugugccgucagcuggguugugccgauaagggcaaaauuaauccagcuucucuagacaaggcaaugaguauccccaugugggucgauaacgugcaaugcccgaaagggccugacacucucuggcagugucccuccagcccaugggagaagagacuggccucuccuagcgaggaaaccuggaucacaugcgauaauaaaauuaggcuucaggagggacccaccuccugcucaggccgcguugaaauauggcacggugggaguuggggaacugugugugacgauagcugggacuuggaugacgcucaaguagucugccagcagcugggcuguggcccagcccucaaggcauuuaaggaggcggaguucgggcagggaacaggucccaucuggcugaacgaagugaaaugcaagggcaaugagucuuccuuaugggauuguccugcccggagaugggggcauucagaaugcggacacaaagaggacgcugccgugaacuguacggauauuaguguccaaaagaccccacagaaagcaacuacaggcaggagcucccgacagucuucguuuaucgcuguugguauucugggggugguacuuuuggccaucuucguggcacucuuuuuccugaccaagaagcgccggcagagacaaaggcuagccgucagcucacguggagaaaaucuggugcaucagauacaguaccgcgagaugaacuccugccucaaugcugacgaccuggaucuuaugaacaguucugagaauagccacgaauccgcggacuuuucagccgcagaguugaucucuguuagcaaauuccugccgauuaguggcauggaaaaggaggcuaucuuaucccacacagaaaaagagaacggcaaucucuga

SEQ ID NO: 54022 - RNA, 4362 nt, Artificial Sequence
  derived and/or modified sequence opt3 from CD163L1__Homo_sapiens__NP_777601
augaugcugccccagaacagcuggcacaucgacuucggcagaugcuguugccaucaaaaucucuuuuccgccguggucaccuguauucuucuguugaacucuugcuucuuaauaucaaguuuuaaugggacagaucuggagcuaaggcucguuaacggagacgguccuuguagcggcacuguggaaguaaaguuccaggggcaguggggaacggugugcgaugacggcuggaauaccacagcuuccacugucguguguaaacagcuggguugcccauuuucuuucgcaauguuucgguucgggcaagccguuacccgccacggaaagaucuggcuugaugacgugucguguuacggcaacgagucagcgcugugggaaugccagcaucgagaguggggcagccacaauuguuaucauggggaagaugucggagugaacugcuacggugaggcuaauuugggccuccgucugguagacgggaacaauaguugcuccggaagaguugaggugaaauuucaggaaagguggggcacaauuugugaugacgguuggaaccugaauaccgccgcagucgugugccggcagcucggguguccgucuagcuucaucuccucaggaguggucaacagucccgccguuuuacgcccuauuuggcuggaugacauccuuugccaaggcaaugaguuggcucuguggaacuguagacacaggggcugggggaaccacgauugcagccauaaugaagacgugacucuaacauguuaugacucuuccgaucucgagcugcggcuuguaggagguaccaaccgcugcaugggccgaguggagcugaagauacaggggagauggggaacggucugucaccauaaauggaauaacgcagccgcugacgugguuugcaagcaguugggcugugguacugcccuccacuuugcggggcugccacacuuacagucaggcagcgauguggucuggcuggacggagugaguugcucuggcaaugaauccuuccucugggauugcaggcauagcgggaccguaaacuuugacugucuucaccaaaaugauguuucggugaucugcucugacggagcagaucuggaguugcggcuagccgacgguuccaacaauuguucaggccgugucgaagugcgcauucaugagcagugguggacaaucugcgaucagaacuggaagaaugaacaagcucuggucguguguaaacagcucgggugccccuucaguguuuucggaagcagaagggccaagccuuccaacgaggcacgggacauuuggaucaauucuauaagcuguacuggcaacgagucagcucugugggacugcaccuacgaugguaaagccaagcgaacauguuuucgcagaagugacgcgggggugauuugcuccgauaaagccgaccuugaucugagguugguaggcgcacacagcccauguuauggacggcucgaagucaaguaccagggcgagugggggaccgugugccaugaccgcuggucuacgagaaaugcugccguugugugcaagcagcugggaugugguaaacccaugcacgucuucggcaugacuuauuuuaaggaggcuucagggccuaucugguuagaugacgugaguugcauuggaaacgaaagcaacaucugggauugugaacacuccggcugggguaaacauaauugcguacacagggaggacgugaucguuacauguucuggggaugccaccuggggccugcgucuagucggaggcucgaaccggugcagcgggcgacucgagguguacuuccaaggaagauggggcacugugugugacgaugguuggaacuccaaggcagccgcugucguuugcucacagcuggacuguccaaguucuauuauagggaugggacuuggcaaugcgagcacagguuacggcaaaaucugguuggacgauguguccugcgacggggaugaaucagaccuguggagcuguagaaauucuggauggggcaacaaugauugcucccauagugaggacguggggguaauuugcagcgaugcaucugacauggaacuccgccuggucggaggcuccucacggugugccgguaagguggagguuaacgugcagggggcugucggaauccuuugcgccaauggcugggguaugaacauagcagaagugguuuguagacagcuggagugcggcagugccauuagggugagccgcgagccgcacuuuaccgaacgaacguugcacauccucauguccaauucgggguguaccggaggcgaggcuucucugugggauugcauccggugggaauggaaacaaacagccugucauuuaaacauggaggcaagccugauuugcucagcgcaccgucagcccaggcuaguaggggcugacaugccuuguaguggaagggucgaggugaagcaugccgauacuuggcgcuccgugugcgacucugauuucagccuccacgcagccaauguccugugucgggaacuuaacugcggcgacgcuaucuccuugucaguuggugaccauuuugggaagggaaauggccugaccugggccgagaaauuccagugcgaagguagcgagacacaccucgcacuguguccaauugugcagcaccccgaagauacuugcauacauaguagagagguaggcguggucuguucuagguauaccgacgugcgauuaguuaacgggaagucccaaugcgauggacagguggagaucaacguccugggccacugggggagccuuugugacacacauugggauccugaagacgcucgcguguugugccggcagcucucguguggaaccgcccugucaacuacgggcgguaaauacauuggggagagaucuguuaggguguggggacaccguuuucauugccuaggcaaugaaagucugcucgauaacugucagaugacaguccugggcgcgccacccugcauccacgggaauaccguauccgugaucuguacuggaagccuuacccaaccguuguucccuugccuggccaacguuucugaccccuauuuaagcgcugugccagaggguuccgcacucauuugccuggaagauaagcgccuucggcuggucgacggcgauucaagaugugccgggaggguggagauauaccacgacggauuuuggggcacaaucugcgacgaugguugggacuugagugaugcucauguagugugucagaaacucgggugcggagucgccuucaaugcaaccguuagcgcgcacuuuggcgagggcucugggccuauuuggcuggacgaucuaaacuguacuggaauggaaucccaucuguggcagugccccucacgagguuggggccaacacgacugucggcacaaggaggaugccggggugaucugcagugaguucacagcucuccgccuguauagcgaaacggaaaccgaguccugugccggaagacuugagguguucuacaauggcacuugggguucugucgggaggcggaacauuacaaccgcaaucgcuggaauagugugccgacaguugggcuguggcgaaaaugggguuguaucgcuggccccauuaagcaagacaggaucagguuuuauguggguggacgauauccagugccccaaaacucauauuuccaucuggcagugucucagugcaccuugggagagacgcauuucuagcccagccgaagagaccuggaucacgugcgaggacaggauacguguccggggcggggauaccgaaugcuccggaagaguggagauuuggcacgcuggcucaugggguacaguuugugacgauucuugggaccuggcggaagccgagguggucugccaacagcuuggguguggaagcgcacuggcugcccuaagggacgccaguuucggccagggcacugggaccaucuggcucgaugacaugcgcugcaagggaaacgaauccuuucugugggauugucaugcuaaaccguggggucagagcgacugcggccacaaggaggaugcaggggugcgauguucuggacaaucauugaaaucccugaaugccaguagcggccauuuagcgcucauucugucgucuaucuucggucuucuguugcucguacuguuuauacuauuccugacauggugcagaguccagaagcagaagcaccuuccccuccggguguccacuaggcgccgugggagccuggaggaaaacuuguuucacgagauggaaaccugucugaaaagagaggacccucauggaacgcggacaucagaugacaccccaaaucacggcugcgaagaugcuagugacacuucuuuacucggcguucugcccgccuccgaggcaacaaaguga

SEQ ID NO: 54023 - RNA, 555 nt, Artificial Sequence
  derived and/or modified sequence opt3 from CD164__Homo_sapiens__NP_001135873
augagcagacuguccaggucucuccuuugggccgcuaccugccugggcguguugugugucuuaucagcagacaagaacacaacucagcaccccaauguuacgacccuggccccuauuaguaacgugacaagcgcgccaguaacuucccuaccgcucgugaccacacccgcuccugagaccugcgaagggcggaauaguugugucucgugcuucaacgugucaguugugaauacuacauguuuuuggauugagugcaaagaugaaagcuacuguagucauaacuccaccgucucugacugccaagugggaaauacgacugauuucuguagcgccaagccaaccguacagcccuccccuucaacaacuucuaaaaccguuacaaccagcgguacgacuaacaauacagugaccccaacuucucagcccguccgcaaguccacauuugacgcagccucauucauaggcgggaucgugcuggugcuuggaguccaggcuguuaucuuuuuccuguauaaauuuugcaagagcaaggagcgaaacuaccacaccuuguga

SEQ ID NO: 54024 - RNA, 1314 nt, Artificial Sequence
  derived and/or modified sequence opt3 from CD177__Homo_sapiens__NP_065139
augagcgccgugcugcuccuugcucuguugggguucaucuuaccccugccugggguccaggcacuacucugccaauuuggaaccguucagcacguguggaagguauccgaccugccaagacaguggacaccgaaaaacacuucuugugauucaggucuuggcugccaggacacgcugauguugauugagagugggccccaagugagccucguccuguccaagggauguaccgaagccaaagaucaggagccuagggugacagaacaucggaugggcccaggucugucucucauaucguacacuuucguuugccgccaggaggacuuuuguaauaacuuagucaauucacugccccuuugggcgccucagccacccgcugauccugggagcuugcgaugcccagugugucugaguauggaaggaugccuagagggcaccacagaggaaaucuguccgaagggcaccacucacugcuaugacgggcuccugcgucuuagaggagguggcauuuucuccaaccugagggugcaaggguguaugccccagccuguaugcaauuugcucaacggaacacaggagaucggcccaguugguaugaccgaaaauugcgauaugaaagacuuucugacgugucaucgggggacuaccauuaugacacacggaaacuuagcccaggagcccacugauuggaccacaucuaauaccgagaugugcgaagugggccaagucugucaggagacgcugcuccuucuggacgugggcuugacuagcacauuaguggggaccaagggaugcuccacugucggugcacagaacucacaaaagacaaccauccauagugccccuccaggcguucugguggcuagcuacacgcacuucuguucuuccgaucucugcaauucagcaagcaguucuuccguacugcuuaacagccugcccccgcaggccgcuccugugcccggggaccgccaguguccaaccugcguccagccuuugggaacauguucgucuggcucccccagaaugacuugcccaaggggugccacccacuguuaugauggguacauacaucucucaggcggaggccugaguacaaaaaugagcauccaagggugcguggcgcagcccuccucuuuucuacugaaucacacucggcagauuggaaucuucagcgcacgcgaaaagcgagacguucagccuccagccucacaacaugaggguggcggggcugaaggacuagagagucucaccuggggcgugggucuggcccuugcaccggcuuugugguggggcgucgugugccccuccuguuga

SEQ ID NO: 54025 - RNA, 1986 nt, Artificial Sequence
  derived and/or modified sequence opt3 from CD180__Homo_sapiens__NP_005573
auggccuucgacgugagcugcuuuuucugggucguucuguuuuccgcuggcuguaaggugaucaccucuugggaucagaugugcauugagaaagaagcaaacaagacauacaauugugagaaccucgggcuuucagaaauacccgacacucugccuaauacgaccgaguucuuggaauuuaguuucaacuuuuuaccaacaauccacaauagaacuuucagcaggcugaugaaccuaaccuuucucgaucugacacggugccaaauuaauuggauccaugaggacaccuuccagucccaccaucagcuuucuacucugguauugacaggaaacccgcucauuuuuauggccgagaccucgcugaauggucccaaaucacugaagcaccucuucuuaauccagacgggcauaagcaaccuggaauuuaucccugugcauaaucuugagaacuuggaaagucuguaucuaggguccaaucacauuucuagcaucaaauucccaaaggauuuccccgcgcgcaaccucaagguccuggacuuucaaaauaacgcuauucacuacaucucccgagaggauaugcguucacuugagcaggccauaaaccugaguuugaauuucaacggaaauaacgugaaaggcauugaacucggugcauuugacagcacuaucuuccagucucugaauuuugggggaaccccuaacuuauccguuauuuucaauggccugcagaacucaacaacucaaagccucuggcuuggcaccuuugaggauaucgacgaugaagacaucaguucugccaugcugaagggguugugugagauguccguggaaagccuaaaucugcaggagcauagauucucggauauuucuuccacaaccuuucagugcuucacgcagcuccaagagcuggaccuuacugcuacacaccugaaaggauugccaucagguaugaagggccucaaccugcugaaaaagcugguccuaagugugaaucauuuugaccagcucugucagauaagcgcagccaacuuccccucccugacccaccuuuauaucagggggaauguaaagaaauugcaccugggaguuggcugccucgaaaagcuggguaaccuucaaacucuggauuugucucauaaugacauugaggcuagcgauuguugcucacuccagcugaaaaacuuaagucacuuacagacacuaaaccucucccauaaugaaccucuggggcuucagagccaagccuuuaaggaguguccacaguuggaacugcucgaccuggcguucacccgguuacacaucaacgcaccgcagucucccuuccagaaucugcauuuucuucaaguguugaaccucacguacugcuuccuggauaccucaaaucagcaccuacuggccggacucccuguccugcgccaccuuaacuugaaaggcaaucauuuucaggacggcacaauaacuaagaccaaccuguuacagacaguggggagucucgaggugcugauucuuagcuccugcggacuguugucuaucgaucaacaggcuuuccacucgcucgguaaaaugagccaugucgaccugucccacaauucacuaacuugugauaguaucgacucucugagccaccucaagggcauuuaucugaaccuugccgcaaauuccaucaacauuauaucaccaagauugcugcccaucuuaagccagcagucuaccauuaaucucucccauaacccucuggauugcacauguaguaauauccacuuucuuaccugguacaaggagaaccugcauaaacuagaagggagcgaggaaacuacgugcgcuaacccacccucucucaggggaguuaagcuguccgacgugaaauugucauguggcaucacagccauugguauauucuuucugaucguauucuuacuccugcuugcgauucuguuguuuuucgccgugaaguaucuccugcgguggaaauaccaacacaucuga

SEQ ID NO: 54026 - RNA, 1674 nt, Artificial Sequence
  derived and/or modified sequence opt3 from CD19__Homo_sapiens__NP_001171569
augcccccuccaagacuccucuucuuucuucuguucuugaccccgauggaggugaggcccgaggaaccuuuagucguuaagguggaagagggcgacaacgccguacugcagugccuaaaagggacaagcgauggaccaacucaacagcucacguggucccgggaaucuccccugaagccuuuucuuaaacugucauugggucucccaggccuggggauccacaugcgcccccuggcuauuuggcuguucauauuuaaugugagucagcagaugggaggcuucuacuuaugucaaccugguccaccgagcgagaaggcauggcagcccggguggaccgucaacguggagggauccggcgaacuguuucgauggaauguuucugaccuuggcggguugggaugcggucugaaaaaccguucgucagagggcccuagcaguccauccgggaagcuaaugucucccaagcucuaugugugggccaaagauagaccugaaaucugggagggagagccacccugucugccgccuagggacagccuuaaucagucccugucacaggauuugacaauggcgcccggcaguacucucuggcugagcugcggugucccaccugacucugugucccgggggcccuuaucauggacccauguacacccaaagggacccaaaagccugcucagucuugaacugaaggaugaccgcccugcuagagauauguggguuauggagacaggcuugcuacugccaagggccaccgcacaagacgccggcaaauacuauugucaucgggggaaccucacuaugucuuuccaccuggaaauuacagcucgcccggugcuuuggcauuggcuguugcgaaccggagguuggaaggucuccgcagugacgcucgccuaccugaucuuuugcuuauguagccuggugggcauucuacaccuccagagagcucugguccuuaggcggaagcguaaacgcaugacugaucccaccagaagguucuuuaagguuacaccuccacccgggucgggaccucagaaucaguauggcaacguguugucucugccaacucccaccuccggucucgggcgggcccaacgaugggcggcaggccugggaggcacagccccgucauacgggaauccuaguagcgacguacaggcugauggagcccuugguucccgcucuccacccggcguggggccugaggaagaggagggagaaggcuaugaggaacccgacagcgaggaagacucagaguucuacgagaacgauaguaaucugggucaggaccaauugucccaggaugggagcggcuacgaaaacccagaggacgaaccucucggacccgaggaugaagacucuuuuucaaaugcagagaguuaugagaacgaagaugaggaacugacccagccagucgcuagaacgauggacuucuuaagcccgcacggcuccgccugggauccuucuagggaggcgacuucgcuggccgggagccaguccuacgaggacaugcggggaauccuauaugcagcuccccaacuccgcucaauaagaggucagccaggccccaaucaugaagaggaugccgacaguuacgaaaacauggacaacccugaugggccagaccccgcuuggggaggcggugggaggaugggcacauggucuacccguuga

SEQ ID NO: 54027 - RNA, 984 nt, Artificial Sequence
  derived and/or modified sequence opt3 from CD1A__Homo_sapiens__NP_001754
augcuguuccuccuucugcccuuguuagccgugcugccuggcgacgggaacgcugauggacuaaaggagccacucagcuuucacgucaccuggaucgcauccuucuacaaucauucuuggaaacagaaccugguuucagguuggcuuagugaccugcaaacacacacuugggauagcaauuccucuacgauuguguuuuugugcccguggucgagaggcaacuucucaaaugaagaguggaaggaacucgagacccuguuuaggauacggacaauccgcagcuucgaagggauucgacguuaugcccaugagcugcaguuugaguaccccuucgaaauccagguaacuggaggcugugagcuccacagugguaaaguguccgggagcuuuuuacagcuggcguaucaaggaucugacuucgucuccuuucagaacaauucauggcuuccuuacccaguggcuggcaacauggccaagcauuucugcaaaguuuugaaucagaaccagcacgaaaaugauauuacccacaaccugcuaagugacacaugucccagauuuauccucggccugcuugaugcagggaaggcccaucugcaaaggcaagugaagccugaggcuugguugagccacggaccaucucccgguccuggccaucuccagcuggucugccacguguccggguucuauccaaaaccgguauggguuauguggaugcggggagagcaggaacagcagggcacccagcgcggugacauauuacccucagcagaugggacuugguaccugagagccacacucgagguggcugccggagaagcggcagaccuuagcuguagggucaagcacaguucucuggagggccaagauaucguguuguauugggaacaucacuccagcgugggcuucauuauccuagccgucauuguuccucugcuccugcuuaucgggcuggcuuugugguuucggaaacgcugcuucuguuga

SEQ ID NO: 54028 - RNA, 1002 nt, Artificial Sequence
  derived and/or modified sequence opt3 from CD1B__Homo_sapiens__NP_001755
augcugcuccuucccuuccagcuguuggccguguuauuuccuggcgggaacagcgagcacgcuuuccaaggaccaaccuccuuucaugucauccagacaucuucauucacuaauaguacgugggcacagacccaggguagcggcuggcuggacgaucuacaaauucacgggugggacuccgauucuggaacagccauauuucucaagccguggucgaaaggcaacuucucagacaaggaaguugcggagcuggaagagaucuuuagaguguacauuuucgguuuugcuagggaaguacaggauuucgccggggacuuucagaugaaauaucccuucgagauccagggaauugcaggcugcgagcuucauagcggcggggccaucgugaguuuucugcggggagcuuuggguggccucgauuuccuguccgucaagaaugcaucuugugugccuagcccagaagggggaucccgcgcccaaaaauucugcgcucugauaauccaguaccagggcauuauggagacuguucgaauccucuuauaugaaaccuguccccguuaccugcuugguguguugaacgccgggaaggcggaccugcagagacaagucaagccugaggcauggcuaucaaguggaccaagccccggcccuggcaggcuccagcuggugugccacguaucuggguuuuauccaaaaccgguuugggugauguggaugcggggagagcaggaacaacaggguacacagcuuggcgauauucugcccaaugccaacuggaccugguacuugcgcgcuacucucgacgucgccgauggggaggcagcuggacuguccuguagagugaagcauagcucauuagaaggccaggacaucauacuguauuggaggaauccuacaaguauugguucuaucgugcucgccauuaucgucccaucccuucuguugcuacugugccucgcgcugugguacaugcggcgccgaagcuaccaaaacauccccuga

SEQ ID NO: 54029 - RNA, 1002 nt, Artificial Sequence
  derived and/or modified sequence opt3 from CD1C__Homo_sapiens__NP_001756
augcuguuccuccaguuucuucuguuggccuuacugcuacccggcggggacaacgcugaugcaagccaagagcacguguccuuccaugucauccagauauuuucuuucguuaaucagucaugggccagaggacaggguaguggcuggcucgacgaacugcaaacccacgggugggauagcgaguccggaacaauuaucuuucuucauaacuggucuaagggcaauuucucgaacgaggaacugucagacuuggaacuccuguuuagguucuaccuguuuggucucacucgggagauucaggaucacgcgagccaggacuauaguaaauacccuuucgaggugcagguaaaggcugggugcgaauuacauuccggaaaaucuccagagggcuuuuuccaaguggccuuuaauggccuggaucuuuugagcuuccagaacacgaccugggucccgucccccggguguggaucacuggcacagagugugugccaccuacucaaucaccaguaugaagguguuacagagacuguguacaaccugauccgcagcaccuguccucgauuccuucugggcuugcucgacgccgggaagauguauguccaucgucaagugagaccagaggcuuggcugucuuccaggcccucauuaggaagcggccagcugcuccuuguaugccacgcaagugguuuuuacccuaaaccaguuugggugacauggaugcggaaugaacaggagcaacuggggaccaagcauggagauauuuugcccaacgccgacggcacuugguaucuacaggucauccuggaaguggcuucugaggaaccugccggccucuccugucgcgugagacacagcucgcuugggggacaggauauaauccuguacuggggucaccauuucucuaugaauuggauugcgcuggucguuaucgugccauugguaauucucaucgugcuggucuuaugguuuaagaaacacugcuccuaccaggacauacuguga

SEQ ID NO: 54030 - RNA, 1008 nt, Artificial Sequence
  derived and/or modified sequence opt3 from CD1D__Homo_sapiens__NP_001757
augggcugccuccuguuccuucuguugugggccuuacugcaggcuugggggagcgcagaggugccccaaagacuauuuccucucaggugucugcagaucuccucuuucgccaacucaaguuggacccggacagacggacuugcguggcugggugaauugcagacucacagcugguccaaugauucugacacgguccgcucgcucaagccauggucacagggcaccuuuagcgaucaacagugggagacacugcagcauauuuuccgaguuuaccguaguuccuuuacuagagacgugaaagaguucgcuaagaugcugaggcucucuuauccguuagaacugcagguaagcgccgggugcgaagugcaccccggaaacgcauccaauaacuuuuuccaugucgccuuucaaggcaaagauauacuuucauuccaggguaccaguugggagccuacacaggaggcuccauugugggugaaucuggcaauccagguucuaaaccaagacaaguggacccgggaaacugugcaguggcuccugaaugggacauguccccaguuugucagcggacuucuggagucuggcaaauccgaauugaagaagcaagugaaaccuaaggccuggcucucacgcggcccaagccccgggccuggaagacuguuacugguaugccacguuagugguuucuacccaaaaccggugugggucaaguggaugaggggcgagcaggagcagcaggggacccaacccggagauauucucccuaacgcugacgaaacgugguaucuucgggccacucuggaugugguggcgggcgaggcagccgguuugucuugucgcgucaaacauuccagccuagaagggcaggacaucguucuguacuggggaggcucguauaccucuaugggccucauugcucuggccgugcuugcaugccuguuguuucuccugaucguaggguucacaucccgauucaagagacagacuucauaccagggaguguuauga

SEQ ID NO: 54031 - RNA, 1131 nt, Artificial Sequence
  derived and/or modified sequence opt3 from CD1E__Homo_sapiens__NP_001036048
augcugcuccuuuuccuguuguuugagggcuuaugcugucccggggaaaacaccgccgcuccucaggcacugcaaagcuaccaccuagccgcggaggaacagcucuccuucagaaugcugcagacaucuucauuugcuaaucauaguugggcccacagcgagggauccgguuggcuuggcgaccugcagacucaugggugggauacgguguugggaaccaucagguuccucaagccauggucucacggcaacuuuucgaaacaagaacugaagaaucugcagucacucuuccaguuauauuuucauagcuucauucagauaguccaagcaagugccggucaguuucagcuggaguacccguucgagauccagauucuugcugggugccggaugaacgcaccccaaaucuuuuugaauauggccuaucagggauccgacuuccugucuuuucagggcauuagcugggaaccuuccccaggcgcugggauccgcgcccaaaacauauguaaaguucuaaaucgauaccucgauaucaaggagauucugcagucacuucugggacacacaugcccccguuucuuggcgggucucauggaagcaggcgagagugagcugaaaagaaaggugaagccugaagccugguuaagcugugggccaucucccggaccuggcaggcugcagcucguaugccacguguccgguuucuauccaaaaccggucugggugauguggaugcgcggggagcaggaacaacggggaacucagagaggcgacguucuucccaacgcugaugagaccugguaccugagggccacauuggacguggcagcuggcgaagccgcggggcuaucaugucgggucaagcauagcagucugggaggucacgaucucaucauucauuggggcggguauucuaucuuucugauacuuauuugccugaccgugaucguaacuuugguuauucucguggucguggacucccgccugaaaaagcagagcccuguguucuuaaugggagccaauacacaggauaccaaaaacucgcgacaccaauuuugucuggcacaggucucuuggaucaagaauagaguucuaaagaaauggaagacgaggcucaaccagcugugguga

SEQ ID NO: 54032 - RNA, 885 nt, Artificial Sequence
  derived and/or modified sequence opt3 from CD200__Homo_sapiens__NP_001004196
auggagagacugacccucacaaggacuaucggcgggccccuucugacggccaccuuguuaggaaagacaacuauuaacgacuaccaggugauacggaugccuuucagccaccuguccaccuauucucuagucuggguuauggcugcagugguacucugcacagcccaagugcaggucgugacccaggaugaacgcgagcagcuguacacuccagcgucacuuaaauguagucugcaaaaugcucaggaagccuugaucguuacauggcagaagaaaaaggcagugagcccggagaacauggucaccuuuuccgaaaaucauggugugguaauucagcccgccuauaaagacaagaucaacauuacgcaacucggccugcaaaauucuacuaucaccuucuggaacauaacacuggaggaugaggggugcuacaugugucucuuuaauacuuucggauuuggcaagaucucggguaccgcuugcuuaacaguuuaugugcagccuauugucucacugcacuacaaauucagcgaagaccaucuuaacaucaccuguagugcaacggcccgaccagcucccaugguguuuuggaaggugccucguuccgggauugaaaauucuacugucacauugagccacccaaacggaaccacuuccguuacaucaauccugcauauaaaagaucccaagaaucaggugggcaaagagguaauuugccaggugcuacaccucggcaccgucacggacuucaagcagaccgugaacaagggguauugguuuaguguuccucugcuucugagcaucgugucuuuggucauucuccugguguuaaucuccauccugcucuacuggaaaagacacaggaaucaggaucgggagccauga

SEQ ID NO: 54033 - RNA, 1047 nt, Artificial Sequence
  derived and/or modified sequence opt3 from CD200R1__Homo_sapiens__NP_620161
augcugugccccuggagaaccgccaaccucggccuucuguugaucuuaacaauuuuccugguggcugaggcagaaggggccgcgcagccuaauaacagccuaaugcuccaaacuuccaaggagaaucacgcucuggccucuucaagucuuuguauggacgaaaaacagauaacgcagaacuacagcaagguccuggcagagguuaauaccuccuggccagugaaaauggccacaaacgcuguauugugcuguccgcccaucgcacucaggaaucugauuaucauuacuugggaaaucauacugcggggacagccuucuugcaccaaggccuauaaaaaggagacaaacgagaccaaggaaacuaauuguacagaugagcgcaucaccugggugucgcgaccagaccaaaacucagaucuccagauucguacggucgcuaucacucaugacgguuacuauagaugcauuauggugacccccgauggcaauuuucacaggggguaccauuuacagguucuggugacaccugaagucacucuuuuccagaaccggaaucgcaccgccguguguaaagcgguagcaggaaagccagccgcucacaucagcuggauacccgagggcgacugcgccacaaaacaagaguauuggaguaacgguaccguuacggugaaguccacuugucauugggaaguccacaaugugucuacagugaccugccacgucagccauuugacugggaacaaaucccuguacauugagcuacucccuguuccaggagcaaagaagucagcuaaacuguauaucccguacauuauccuuacaaucauuauacugaccaucgugggcuuuauuugguugcucaagguaaacggcuguagaaaauacaagcugaauaaaacggaaaguacccccguggucgaggaagaugagaugcagccuuaugccagcuacacagagaagaacaauccauuauaugacacuaccaacaaagugaaggcgucugaagcccugcaguccgagguugauacagaccuccacacucuuuga

SEQ ID NO: 54034 - RNA, 987 nt, Artificial Sequence
  derived and/or modified sequence opt3 from CD207__Homo_sapiens__NP_056532
augaccguggagaaggaagcccccgacgcucacuucacagucgauaaacagaacaucagccuguggccuagagagccaccgcccaaguccggcccuucucucguuccagggaaaacucccacggugagggcagcccuuauuugccugaccuugguauuaguggcgucaguccugcuacaagcugugcucuacccucgguuuaugggaacaauaagugacguuaagacuaaugugcagcugcuuaaaggucgcgucgauaacaucagcacccuggacuccgaaauuaagaagaauagugauggcauggaggccgcaggggugcagauccagaugguaaacgaaucguugggauauguucgaucacaauuccucaaacugaagacaagcguggagaaagccaaugcucagauucagauccugacccguaguugggaggaagucuccacucucaacgcacagauaccagaguuaaagucugaccuggaaaaagccagcgcucuuaauacaaagaucagagccuugcaaggcucccuggagaacaugucaaagcuacucaaaaggcagaaugauauucuucagguggugagucaggguuggaaguacuuuaaagggaacuucuauuacuuuagccugauccccaagaccugguauucugcggagcaauucugugucucccgcaauucacaucugacgagcguuacuucugaaucugagcaggaauuuuuguacaaaaccgcaggaggccucauuuauuggaucggccugacaaaggccgggauggagggagacugguccuggguggaugacacuccuuucaacaaaguacagagcgugcgguuuuggauaccaggugaaccgaauaacgcuggcaauaacgagcacugcgggaacauuaaggcccccucguuacaagcauggaaugaugcuccuugugacaagaccuuccuguuuaucugcaaaagaccauacguccccucugagccuuga

SEQ ID NO: 54035 - RNA, 807 nt, Artificial Sequence
  derived and/or modified sequence opt3 from CD209__Homo_sapiens__NP_001138365
augagcgacuccaaggagcccagacugcagcaacucggccuucuggugucuaaagucccuucaaguaucagccaggaacaguccaggcaggaugccauuuaccaaaacuugacccaguuaaaggcugcaguuggggagcugucugaaaaaucgaagcuacaggagauauaucaggaacucacacaacugaaagccgcggugggagagcuuccagagaagucaaagcugcaggaaaucuaccaggaguugacucggcucaaagcugccguaggugaacugccggaaaagagcaaacugcaggagauuuaucaagaacucacgugguuaaaggcagccguggagcgccugugccaccccuguccuugggaauggaccuucuuucagggcaauugcuacuucaugaguaacucccagcgaaauuggcaugacucuaucacagcuuguaaagaggucggggcacaacuugugguuauuaagagcgccgaggagcagaacuuuuugcagcugcaguccucacguaguaauagauucacuuggaugggacuaagcgaucucaaccaagagggcaccuggcaguggguggacgguucuccacugcuucccuccuuuaagcaguauuggaauaggggagaaccuaacaaugucggggaggaagauugcgcugaguucucaggcaacggcuggaaugacgauaaauguaaccuggccaaguuuuggaucugcaaaaagagcgcggcaaguuguucucgggacgaggaacaguucuuguccccagcccccgcuacaccuaauccaccgcccgccuga

SEQ ID NO: 54036 - RNA, 1011 nt, Artificial Sequence
  derived and/or modified sequence opt3 from CD226__Homo_sapiens__NP_001290547
auggacuaccccacccugcuccuugcccuguugcacguguauagagcuuuaugcgaggaaguccuguggcauacaagcguuccuuucgcagagaacaugucccuagaauguguguacccaucuaugggcauccucacucagguagagugguuuaagauugggacgcaacaggauucaauagccaucuucaguccgacccacggaauggugauuaggaaacccuaugcggaacgggucuacuuucugaauagcacaauggcuuccaacaauaugacucuuuucuuucgcaacgccucugaggacgauguggguuauuacucgugcucacuguauaccuacccucagggcacauggcagaagguuauccaagugguccagagcgacaguuucgaggcagccgugccauccaauucucauauuguaagcgaacccgggaaaaacguuaccuugacuugucagccucagaugacauggccagugcaagcuguccgaugggagaagauccagccccgucagauagaucuccugaccuacugcaaucuggugcacggaagaaacuuuacguccaaauucccuaggcagaucgugucaaauuguagucauggccgguggagcgucauuguuaucccagacgugacuguaucugauuccggucucuaucgcugcuacuuacaagcaucagccggggaaaacgagaccuuugugaugagacugacagucgcugagggaaagacugacaaucaguauacccuuuucguggccggcggcacaguuuugcugcuacucuuugugauuagcaucaccacgauaauugucaucuuccugaacaggcggcgccgaagagaaaggcgggaucuuuuuacugagaguugggacacacagaaggcgccgaauaacuaccguucucccauuuccaccagccaaccuacuaaucagucgauggaugacacacgcgaagauaucuaugugaacuacccaaccuucucuagaaggcccaaaacgcggguauga

SEQ ID NO: 54037 - RNA, 2280 nt, Artificial Sequence
  derived and/or modified sequence opt3 from CD22__Homo_sapiens__NP_001172028
augcaccuucucggccccuggcuucuguuguuagugcuggaguaccuagccuucagcgacuccucuaagugggucuuugaacauccugagacccucuaugcuugggaaggggcaugcguuuggaucccauguacauacagagcccuggauggagaccuugagucauucauucuguuucacaacccggaauauaauaaaaacacgaguaaguucgaugguacuagguuguacgagagcaccaaagacggcaaggugcccuccgagcagaaacggguacaauuucucggggauaagaauaagaacugcacacugucuauacauccugugcaccugaaugacucgggacagcucggcuuacgcauggaaucaaaaacugagaaguggauggaacgaauccaucugaacgucagcgagcguccauuucccccucacauucagcuuccacccgagauccaggaaagucaagaggugaccuugacaugucugcuaaauuucuccugcuaugguuacccuauucagcuccaguggcugcuugaagggguuccaaugagacaggcggcugugaccucuacuagccugacaaucaaauccgucuucaccaggucagaguugaaguuuaguccgcaauggagccaccauggaaaaauagugacgugucagcuccaggaugccgacggcaaguuccugucuaacgauacuguacaguuaaauguuaagcacacccccaaacuggaaaucaaggugacaccuuccgacgcaauuguccgggagggcgauucagugacuaugaccugcgaggugagcaguucuaacccagaauauacaaccgucuccuggcucaaagacgggacgagccuuaagaaacaaaauacuuuuacacugaacuugcgcgagguuaccaaggaucagucgggaaaauacuguugccaggugucuaaugacguaggucccggcagauccgaagagguguuccuacaaguccaguacccuccaaagaaggugacuacaguuauccagaaccccaugccgauuagggaaggggacaccgugacgcugucauguaauuauaacaguagcaacccuuccgucacccgguacgaguggaaaccccauggagccugggaggaaccaucucucggcgugcugaagauccagaauguagguugggauaacacaacuauagcuugcgcagccuguaauagcuggugcucaugggcuaguccuguugcccuuaacgugcaauaugcgccccgcgacguccgagugagaaaaauuaagccacuguccgagauccacagcgggaacucugucucauugcagugcgauuuuaguagcucccaccccaaagaagugcaguucuucugggagaagaacggaaggcuccugggcaaggaaucucaguuaaauuuugacucgauuagcccugaggaugcaggcuccuacucauguuggguuaacaauaguaucgggcaaaccgccucuaaggcuuggacacuggaggugcuauaugccccacggcgucuccgcguaagcauguccccgggagaccaggucauggaagguaaaucagcaacucugaccugcgagagcgaugcuaaucccccugugucucauuacacaugguucgacuggaauaaccagucccuuccauaucacagucagaaauugagacuggaacccguuaaggugcaacauagcggcgccuacuggugucaggggaccaauucugucggaaaaggcagguccccucucucaacucugacgguguacuauaguccagagacaaucggucggcgaguagcgguggggcuuggcagcugccuggccauuuugauacucgcaaucuguggacugaaguuacagcgcagauggaagaggacccagucgcaacagggccugcaggagaacuccucugggcagagcuuuuucguucggaauaaaaagguccgcagagcuccccuaucagaaggaccgcacagucucgguugcuacaacccuaugauggaggauggcauuuccuauacuacccugagguuuccagaaaugaacaucccccguacaggggacgccgagucuagcgaaaugcaacggccucccccagauugugacgacaccgugacuuacuccgcucugcauaaacgacaggugggagauuaugagaaugucauaccugacuuccccgaggaugaaggcauucacuacucagaguugauccaguuugguguuggggaaagaccacaagcccaggagaacguggacuaugugauccugaagcacuga

SEQ ID NO: 54038 - RNA, 1113 nt, Artificial Sequence
  derived and/or modified sequence opt3 from CD244__Homo_sapiens__NP_001160135
augcugggccagguggucacccucauccuucuguuguuacugaagguuuaccaagggaaaggaugccaggguagcgccgaccacgugguauccauuucuggcgugccccuacagcuccagccuaacucaauacaaacaaaggucgauaguaucgcuuggaaaaagcugcuuccaagccagaauggguuccaucacauucugaaaugggagaacggauccuugccgucuaauacuucgaacgacagauuuucauucaucgugaagaaucucagccugcugauuaaggcagcccagcagcaagauaguggccucuauuguuuagaaguuacguccaucucugguaaagugcagaccgcgacauuucaggucuucguguuugagagccugcuucccgacaagguagaaaaaccuagguugcaggggcaaggaaagauacuggaucggggccgcugccagguugcucuauccugucucgugucacgagacggcaacgucaguuacgccugguaucgugggagcaaacugauccagacugcaggaaaucuuaccuaccuggaugaggaaguggacauuaacgguacacauaccuauacuugcaaugugucuaacccagucuccugggagucacacacauugaaucucacccaagauugucagaacgcccaucaggaguucagauuuuggcccuuccugguuaucauugugaucuuaagcgcucuguuucucggcacgcuugcaugcuucuguguauggaggcggaagcgcaaggaaaaacagagugagacuucuccuaaggaauuucugaccauauacgaggacgugaaagauuugaagacaagaaggaaucacgagcaagaacagacuuucccagggggaggcuccaccauuuauagcaugauccagucgcagucuuccgcccccacaucacaagagccugcuuacacccuauacagucugauucagccaagccggaaauccgguucucgcaagcgaaaccacagcccgucauuuaauaguacgaucuaugaagucaucgggaaaucccagcccaaggcccagaacccugcgagacucagcaggaaggagcuggaaaacuucgacguguacucuuga

SEQ ID NO: 54039 - RNA, 492 nt, Artificial Sequence
  derived and/or modified sequence opt3 from CD247__Homo_sapiens__NP_000725
augaaguggaaagcccuguucaccgcugcaauccuccaggcccaacuucccauuacagaggcgcagagcuuuggccuguuggacccuaaguuaugcuaccugcuagaugggauacucuucaucuauggagugauucugacugcucuuuuucugagagucaaauucuccaggucugccgacgcaccagccuaccagcagggucaaaaccaguuguauaaugaacucaaccugggccggcgcgaggaauacgauguucuggacaagcgacgugggagagauccggagaugggaggcaaacccaggcggaagaauccucaggaaggucucuauaacgaguuacagaaggacaaaauggcugaggcauacucagaaaucgggaugaagggagagcgcagaaggggcaaaggccacgaugggcuguaucaaggacuuaguacggccaccaaggacacauacgaugcuuugcauaugcaggcccugccaccccgguga

SEQ ID NO: 54040 - RNA, 2274 nt, Artificial Sequence
  derived and/or modified sequence opt3 from CD248__Homo_sapiens__NP_065137
augcugcucagacuucuguuggccugggcugcagccggccccaccuuagggcaggacccuugggcggcugagccaagggccgcaugcggaccgagcuccuguuacgcccuguucccccggcgccgaacauuucuagaggcuuggcgugcaugcagagaacucgguggcgaucuggccacuccuaggacgccagaagaggcucaacggguggacucucuugucggggccggacccgcgucacgccuguuguggaucggccuccagagacaggcaaggcagugucaacugcagcggccucugcgcgguuucaccuggacaacuggggaucaggacaccgccuuuacaaacugggcucagccagccaguggaggccccugcccugcacaacgauguguugcucucgaagccagcggcgagcacagaugguuagagggguccugcacccuggcgguggauggauaucuuugucaguucgguuuugaaggcgccugcccagcauugcaggacgaggcugggcaggccggaccggcuguauacacuacacccuuccaucuggugucuaccgaauuugaguggcuaccuuucggcucggucgccgcagugcaaugucaggccggucguggggcuucacuccugugcguuaagcagccagagggaggcgugggcuggagcagggcggggccccuuugucugggaacggguugcaguccugauaauggcgggugcgaacacgagugugucgaagagguggacggacauguauccugccgguguacugaaggcuuucgcuuggcagccgaugguagaucuugcgaggacccaugugcucaagcccccugcgagcagcagugugaaccugggggcccgcagggauauagcugccacuguaggcucggcuuccggcccgcagaggaugacccacaucgaugcguugauaccgacgaaugucaaauugccggggugugccagcagaugugcgucaacuacgugggagguuuugaguguuauugcuccgaaggccacgagcuggaggcugacgggauaucauguaguccugccggagcaaugggcgcgcaggcuagccaagauuuaggugacgaacugcucgaugacggggaggaugaagaggacgaagaugaggccuggaaagcauucaauggcggauggacagagaugcccggcauccuuuggauggaaccaacucagcccccugacuuugcccuggcuuaccgcccaucuuucccggaggauagagaaccccagauuccuuauccagagcccaccuggccuccacccuuguccgccccgagggugccuuaccacucaagcguccuaaguguuacacggccagugguagugucugcaacccaucccacgcugccuuccgcucaccagcccccagucaucccugccacucaucccgcgcucagccgcgaccaccaaauuccagugaucgccgcuaacuacccggaucugccuucggcauaucagcccgggauacuuucuguuucccacucagcccagccacccgcucaucagccuccaaugaucaguacaaaguaccccgagcuguucccugcccaccaaagcccgauguuuccagacaccagaguggcaggaacucagacaaccacgcauuugcccgguauuccuccaaaucacgcgccccucgucaccacacugggcgcccaguuaccuccgcaagcucccgacgcccuggugcuaaggacucaggcaacccagcucccaaucauuccuacagcucagcccucccugacuaccacaucucguagcccaguaucgccugcccaucaaaucaguguucccgcagccacccagccagcugcgcuuccgacuuugcugccuucccagagccccacgaaccagacaucuccaauaucacccacccacccucacaguaaagccccacaaauuccccgggaagaugggccuagcccgaagcucgcacuguggcuuccaucccccgcuccuacugccgcccccaccgcucugggagaggcaggcuuggccgaacauucucagcgagacgauagauggcuccugguggcguuacuggucccaacaugcguguuccuagucgugcuccuggcucuugguaucguuuauuguaccaggugcgggccucacgcccccaauaaacgcauuacugacuguuaccggugggugauccaugcaggcucaaagagcccaacagagccuaugccgcccagaggauccuugacgggcguacagaccugcaggacuucagucuga

SEQ ID NO: 54041 - RNA, 411 nt, Artificial Sequence
  derived and/or modified sequence opt3 from CD24__Homo_sapiens__XP_011533677
augagaaccagggacgcccccgugagcucccugcggcucgcugauacacgccgaucucagaacaaggcacgugccucaggcagagcgaggccucgggggcgcgcuagaaggagucuucggacucgcacgccaccggcccgaagcgcagaccaacccggaagagucagggcccggcgucgcccugguccaguuggccaggggcuggcuggaucccccagaucuccuccaugcuugaggcccccuggcgcaucggguucaccaagcacccagcacccggcccggcgagcugcccaucgcagaagggggcacggacagaguaauggcggccaagcgcgggcaggggccgcugccgcaggaacagcucccacucaugccgugcgcugugcgccugagccauccucuaucuuauga

SEQ ID NO: 54042 - RNA, 531 nt, Artificial Sequence
  derived and/or modified sequence opt3 from CD274__Homo_sapiens__NP_001254635
augagaaucuucgccguguuuauuuucaugaccuacuggcaucugcucaacgcucccuauaauaagauaaaccagaggauccuugucguugacccugugacaagcgagcacgaacugacuugccaagcagagggcuacccaaaagccgaaguaauuuggacguccucugaucaccagguguugucagggaagaccacaacuaccaauaguaaacgggaggaaaaguuauuuaacgucacaagcacccugcgcaucaauacuacaaccaacgagauuuucuauuguacguuucgacgucuagacccggaggaaaaucauacugcggagcucgugauccccgaacugccucuugcucacccacccaacgagagaacccaucugguuauauugggagccauccuccugugccuggguguggcacucacauucauuuuuagguuacggaaaggccgcaugauggaugucaagaagugugggauccaggacacuaauuccaaaaagcagucugauacccaccuggaggaaacauga

SEQ ID NO: 54043 - RNA, 951 nt, Artificial Sequence
  derived and/or modified sequence opt3 from CD276__Homo_sapiens__NP_079516
augcugagaaggcggggcagccccgggaugggagugcacgucggugccgcucucggcgcacuuugguucugccugaccggggccuuggagguucaggugccugaagacccaguaguggcguuagucggaacagaugcuacucuguguugcuccuuuucuccggagcccggcuucucacuagcccaacucaaccugaucuggcagcuuacggacaccaagcagcuggugcauaguuuugcagaaggucaggaucaagggagcgccuacgcuaaucgcacagcauuguucccugaccuccuggcccagggaaacgcuucccugcgacuccagcguguuagaguggccgaugagggcucuuuuacuuguuucgucucgauuagggacuuuggcucagcggcagugagcuuacagguagccgcuccauauaguaaacccuccaugacccuggaaccuaauaaggaucuucggccaggggacacaguuaccauaacuugcucuagcuaccgcggauaucccgaggccgagguguucuggcaagauggucagggcgucccuuugacagggaacgugaccacgucccagauggcaaaugaacagggacuguuugacgugcacucaguccuaagaguugugcucggcgcuaacgguacuuacaguugucugguaaggaauccagugcuucaacaggaugcccaugggagcgucaccaucacaggacagccgaugacuuuucccccugaggcgcugugggugaccguuggcuugucugugugccucauugcccuguuagucgcacuggcuuucguguguuggcggaaaaucaagcaauccugcgaagaggagaacgccggcgcugaagaccaggauggggagggagaagguucaaaaacagcccuccagccacuuaagcacagcgacaguaaggaggacgauggccaggaaauugcauga

SEQ ID NO: 54044 - RNA, 783 nt, Artificial Sequence
  derived and/or modified sequence opt3 from CD27__Homo_sapiens__NP_001233
auggccagaccccacccuugguggcugugcgugcucggcacccuugucgggcugagcgcuacaccagcaccgaaguccugucccgagaggcauuacugggcccagggaaaauugugcugucaaaugugcgaaccugguacuuucuuaguuaaggacugugaucagcaccggaaagcggcucagugcgacccauguauccccggcgugucuuuuucaccugaucaucacacgcgcccacauugcgagaguugucgacacugcaacagcgggcugcuaguacguaauuguaccauuacagccaacgcagaaugcgccugcagaaauggauggcaguguagggacaaggagugcacugaaugugauccccucccuaacccaucccugaccgcucggucuucgcaagcacuuucaccgcacccccagccuacacaucugccauaugugagcgagauguuggaggcccgcaccgcuggccacaugcagacucucgccgacuucagacagcugcccgcgaggacacugaguacccauuggccuccacaacggucccucugcucuagcgauuuuauacgcaucuuagucauuuucuccgguauguuucugguguucacgcuugcaggggccuuguuucugcaccagcgaagaaaauacaggucaaauaagggagaaagucccguugagccggcugaaccuugucgguauagcugcccccgugaggaggaaggcucuacuaucccaauucaggaggacuaccgcaagccugaacccgccuguuccccauga

SEQ ID NO: 54045 - RNA, 306 nt, Artificial Sequence
  derived and/or modified sequence opt3 from CD28__Homo_sapiens__NP_001230007
augcugagacuccuucuggccuugaacuuauuccccagcauccaggugaccggcaagcaccugugcccuuccccacuauuuccggggcccucuaaaccuuucuggguccucguugugguaggaggugugcuggcuuguuacucacuucuggucacaguggcauuuauuauauucuggguuaggaguaagcggagccgcuugcuccauuccgacuauaugaauaugacuccacgacgucccggcccuacgagaaaacacuaccaaccauaugcgcccccuagggauuuugccgcuuaccggucuuga

SEQ ID NO: 54046 - RNA, 1920 nt, Artificial Sequence
  derived and/or modified sequence opt3 from CD2AP__Homo_sapiens__NP_036252
augguggacuacaucgucgaguaugauuacgacgccguucacgaugacgaacugaccauuagagugggcgagauaaucaggaacguaaagaaacuccaggaagagggguggcuugaaggagagcugaauggucggcgcggcauguuccccgauaacuuugugaaggagauuaaacgagaaacagaguucaaggacgauagcuugccuaucaaacgugaaagacaugggaaugucgcuuccuuagugcaaaggauuucuacuuauggacugccagcaggcgguauccagccgcacccccagacgaagaacauaaagaaaaagaccaaaaagcggcagugcaaaguucuauuugaguacaucccucaaaaugaggacgaacucgagcugaaggugggggauauuaucgacauuaacgaagaggucgaagagggaugguggucaggcacacuuaauaacaagcugggcuuguucccaaguaauuuugugaaagagcucgaaguaacugaugacggggagacccaugaagcccaggaugacagcgagacaguucuggcgggacccaccuccccuaucccaucucuggguaacgugucggaaacugcuucaggcagcgucacacagcccaagaaaauacgcgggauuggauucggcgacaucuuuaaggaggguagugugaaacucagaaccaggacguccucuagcgagacugaagagaagaaaccugaaaagccauuaauucugcagucccuugggccgaagacccaaucaguggagaucacaaaaacugauaccgaaggaaagaucaaagccaaggaguauugucggacauuguucgcauacgagggcaccaaugaagacgagcugacguuuaaagaaggcgagauuauacaccuaaucaguaaggagacuggggaagccggaugguggcgcggugagcucaacggcaaggaaggggucuuccccgauaauuuugcuguucagauuaacgagcuggacaaagauuucccuaagccaaagaagcccccuccacccgcaaaagccccggcuccuaagcccgaacuuaucgccgcggagaagaaauauuuuagccugaagccagaggaaaaagacgagaagucuacauuggaacagaaaccuuccaagcccgcagccccacaggugcccccuaagaaaccaaccccgcccacuaaggcuucaaaucuccugcgaagcaguggaacaguauacccuaaaagaccagagaagcccgugccuccacccccgccuauagccaaaauuaacggcgaagucucuuccaucagcucgaaguucgagaccgagccagugucuaaauuaaagcuggauuccgaacaacucccccuuaggccuaagucaguugacuucgauagucugacggugcggaccagcaaagagacagacgucgugaacuuugaugacaucgcauccucugaaaauuugcuacaucugacugcuaaccgucccaagaugccaggucgcagacucccugggagguucaauggcggacacagccccacccacucaccagagaaaauucugaaacuuccgaaagaagaggacagugccaaccugaagccuuccgaguugaagaaagauacaugcuacagccccaagccaucuguauaucucucaacucccaguagcgcguccaaagccaauaccacagcauuucugaccccuuuagaaaucaaggcuaaaguugagacugacgaugugaagaagaacucucuggacgaacuacgggcccagauuauagagcuccuguguaucgucgaggcucuuaaaaaggaucauggcaaagaauuggagaagcugcgaaaagaccucgaagaggaaaagacgaugcgcucgaaucuggagauggagauugaaaaacuuaagaaggccgugcugagcuccuga

SEQ ID NO: 54047 - RNA, 561 nt, Artificial Sequence
  derived and/or modified sequence opt3 from CD300A__Homo_sapiens__NP_001243770
auguggcugcccugggcccuccuucuguugugggugccugcuagcaccuccaugacaccagcaucuaucacugccgcgaagacgucaaccauuacaacugcuuucccgcccgucaguagcaccacauuauuugccguuggcgcaacccacuccgccucuauacaggaggaaacugaggaagugguaaacucgcaacugccucuacuccugucacuucuggcuuugcuccugcugcucuuagugggggcaagccugcuugccuggagaauguuccagaaauggaucaaggcuggagaccauagugaguugucccagaauccaaaacaggccgcgacacaaucugaacugcacuacgcaaaccuagagcuccugauguggccccuucaggagaagccugccccacccagggaagucgagguggaauauagcaccguugcuuccccucgggaggagcugcauuacgccucaguggucuuugauaguaauacgaaccgcauugcagcucagcgaccacgugaagaggaaccggacagcgauuauucugugaucagaaaaacuuga

SEQ ID NO: 54048 - RNA, 675 nt, Artificial Sequence
  derived and/or modified sequence opt3 from CD300C__Homo_sapiens__NP_006669
augaccgccagagcuugggcaagcuggagguccucugcccugcuccuucuguuggugcccggcuacuucccuuuaucacacccaaugacagucgcggggccgguuggagguagucugagcgugcagugccgguaugagaaggaacaucgcacucuaaacaaauuuuggugucgacccccucaaauccuccguugcgacaagauuguagagacgaaaggcuccgcugggaagagaaauggaagggugucuauacgggauucgccagccaaccugucauucaccgucacacuugaaaaucugacugaggaagacgcaggcaccuacuggugugguguggauacacccugguugcgcgacuuucacgauccuaucguugagguggaggucagcguguucccagccgggaccacuacagcuaguucuccccaguccagcaugggaaccuccggcccuccaacgaaacucccgguacauacuuggcccucaguuaccagaaaggacaguccugaaccaagcccccacccuggcucucuguuuuccaacgugagguuccugcucuuaguccugcuugaguugccacugcuacucucaaugcugggggcagugcuuugggugaaucggccccagcgcagcagucgaucuagacagaacuggccgaagggagaaaaucaauga

SEQ ID NO: 54049 - RNA, 585 nt, Artificial Sequence
  derived and/or modified sequence opt3 from CD300LF__Homo_sapiens__NP_001276011
auguggcugccccagcucgaccuuaugagagugaucagcgccaagucccaaggcuacucuauugucacccagauaacagggccuacuacgguuaacggacuggagagggguucauugaccgugcagugcguauaucggaguggcugggaaacauacuuaaaaugguggugucgcggggcuaucuggcgagauugcaagauucuggugaaaacuagcggauccgagcaggaagucaagcgugacagagugucuaucaaagauaaucaaaagaacaggaccuucacaguuaccauggaggaccuaaugaagacugaugcagacacauauugguguggcauugagaaaaccgguaaugaucucggggugacgguccaggugacuaucgacccagccccgguaacccaggaagagacaucgucaagccccacucugaccggacaccaucuugauaacaguucccgggacguuccucgcgcgggcacagcugccccaggcgggagaccccuguugugcaggccugauccagcagccggacggaaucuccccgcuaaggguuaccacgaagcauuucuguguccuggcuga

SEQ ID NO: 54050 - RNA, 525 nt, Artificial Sequence
  derived and/or modified sequence opt3 from CD302__Homo_sapiens__NP_001185692
augcugagagccgcucuccccgcacuucuguugccuuuacugggccuagccgcggcugccguggcagacugcccaagcuccaccuggauccaguuccaagauucuuguuacauuuuucuccaggaggccauaaaggucgaaucaaucgaggacguuaggaaccagugcacagaucacggggcugacaugauuaguauccauaaugaagaggaaaacgcauucauucuggauacucuuaaaaagcaguggaaaggaccggacgauauccuguuggguauguuuuaugacacggaugugcccuacaagcggaaauaucucagcgacaaucacauacugaucuccgcccugguaauugcuucuaccgugauccucacagucuuaggcgccauuaucugguuccuguacaagaagcauucggauucacgcuuuacuaccguguucagcacagcgccucaaaguccauauaacgaggacuguguucuuguggucggggaggaaaaugaguaccccgugcaguuugauuga

SEQ ID NO: 54051 - RNA, 723 nt, Artificial Sequence
  derived and/or modified sequence opt3 from CD320__Homo_sapiens__NP_001159367
augagcggcggguggauggcccaggugggagcuuggagaaccggugcacugggccucgcccuucuguuguuacuggggcuaggacucggccuggaggcggcugccucuccccuuuccacaccuacuucagcacaagccgcugguaucgaaccaugcacgcagaaggggcaguguccgcccccuccaggacugcccugcccuuguaccggcgucagugacugcagcggcgggacagauaaaaaguugaggaacuguucccggcucgcaugccuggccggagagcugcgcuguacucucucugacgauugcauuccauuaaccuggcgaugugacggucaccccgauugcccugacucgucagaugaacugggcugugggacaaaugagauacuuccagaaggagacgcuaccacuaugggcccgcccguuacauuggagagcgugaccagucugcguaacgccacgacuauggguccuccaguaacccuagaguccgugcccucugucgggaaugcgacaagcuccucagcaggagaucagaguggcagcccuacugccuacggcgugaucgcugccgcagcuguucucucugccucccuggugaccgcgacacuucuguugcucucauggcugagagcccaagaaagguuacggccacuggggcuccuugucgcaaugaaagagagccuguugcuaagugaacagaagaccucucugcccuga

SEQ ID NO: 54052 - RNA, 714 nt, Artificial Sequence
  derived and/or modified sequence opt3 from CD33__Homo_sapiens__NP_001076087
augccccugcuccuucuguugccuuuacugugggccgaccuaacccacagaccaaagauccucauuccgggcacacuggagcccgggcauagcaaaaaccuuacuugcuccgugucuugggcuugugaacagggaacgccuccaauauucucauggcugagugcagcccccaccagcuuggguccuaggacaacucacuccucuguccucaucauuaccccacggccccaagaucauggcacaaaucugaccugccagguuaaguuugcgggggcuggagugacuacagagcgcaccauccagcugaacguaacguacgugccucagaauccaacuaccggcauuuucccgggugacgggucgggaaaacaagaaacacgagccggcgucgugcacggcgcaaucgggggagccgguguuacugcucucuuagcacugugucuuugcuugauauuuuucaucgugaagacccaucguagaaaagccgcuaggacagccgucggccggaacgauacccaccccacgacugggucagcgagcccuaagcaccagaagaaaaguaagcugcauggaccaacagagaccuccucuuguagcggcgcagcccccacuguggaaauggacgaggagcuacacuaugcuucccucaauuuucaugguaugaacccuucaaaagauacaaguaccgaauacagcgagguacgcacgcaguga

SEQ ID NO: 54053 - RNA, 1158 nt, Artificial Sequence
  derived and/or modified sequence opt3 from CD34__Homo_sapiens__NP_001020280
augcuggugagaaggggcgcccgggcugggccccgcaugccucgaggauggaccgcacucugccuucugagcuuguuaccauccgguuucaugucucuggacaacaauggcacagccacuccggagcuacccacgcaggggaccuuuucaaacgucaguacaaauguuagcuaccaagaaacuaccacaccuuccacccucggaucuacuucgcugcacccagugucacagcauggcaacgaggcgacaaccaauaucacggaaacuaccguaaaguucacaagcaccagugugauuacuuccgucuaugguaacacaaauucuagcgugcagucccagaccucaguuauaaguacgguguuuacuacacccgcuaacgucagcaccccugagacuacacuuaaaccaucucugucccccgggaaugugucagauuugagcaccacgaguaccucucucgccacauccccuacuaagccauacaccagcucgucuccgauccuguccgacauuaaagcagaaaucaaguguucaggcauucgugagguaaaacugacacaaggaaucugccucgagcagaacaagaccaguagcugugccgaguucaagaaagauagaggcgagggguuagcuaggguucugugcggagaagaacaggcagacgccgaugcuggugcccagguguguucccuuuugcuggcgcaaucugagguccggccccagugccuacuccuggugcuugcaaaucgcacugaaauaagcucaaagcugcaguugaugaaaaagcaccagagugaccucaaaaagcugggcaucuuagauuuuacagagcaagacguggccucccaucagagcuauucucagaagacccugauugcucucgucacuucaggggcccuucuggcaguuuugggaaucacgggcuacuuccuaaugaacagaaggaguuggagcccuacaggugaacggcugggggaggauccauauuacaccgaaaauggaggcggccaaggguauuccucuggacccgguacuucgccugaggcucagggcaaagccagcgugaaccgcggggcgcaggagaauggaaccggccaggccacaucccgaaacggucacucagcaagacaacauguaguggcugacaccgaacucuga

SEQ ID NO: 54054 - RNA, 1419 nt, Artificial Sequence
  derived and/or modified sequence opt3 from CD36__Homo_sapiens__NP_001001547
augggcugcgacagaaacugugggcugaucgccggagcugugauuggugcaguccucgccguuuucggcgggauacuuaugcccgugggagaucuguugauccagaagaccauuaaaaagcaaguaguguuagaggaaggcacaaucgcguuuaaaaauugggucaagacugguacggagguguacaggcaguucuggauuuuugacguucagaacccucaggaagugaugaugaauagcuccaacauccaagucaaacagcgggggccauauaccuaccgcgugcgauuccuggcuaaggagaauguaacacaggaugccgaagacaacacuguuucuuuucuacagccgaauggagcaauauucgagcccucacucagugugggcaccgaggccgauaacuuuacaguccugaaucuugcuguggcagccgcuagccacaucuaucaaaaccaguucgugcagaugauucugaauaguuugaucaacaagucuaaaucgucaauguuucagguccguacccucagagaacugcuguggggcuacagggacccuuuccucagcuuaguuccauaucccgugacuacaaccguagggcuguuuuacccuuauaauaacacggccgauggaguguacaaggucuucaaugguaaagacaacauuaguaagguggcgaucauagauacuuacaaaggcaagcggaaccuuuccuauugggagucucauugcgacaugauuaaugggaccgaugcagccagcuuuccacccuucguugaaaagucccaaguguugcaguucuuuucaagugacaucugucgcagcauuuacgcugucuucgagucugaugugaaccugaaaggaaucccuguauauagauuuguucuaccauccaaggccuucgcaucaccgguggagaaucccgacaacuacugcuuuuguacagagaaaaucauuagcaagaauugcacuuccuauggcguccucgacauaucuaaauguaaggaggguaggccuguguacaucucccugccacacuuccuuuaugcuagccccgaugucucggaaccuauugacgggcugaacccaaaugaggaagaacaucggaccuacuuggauaucgagcccauaacaggauuuacccuccaguucgccaaacgccugcaagugaacuuacugguuaagccgucugaaaagauucaggugcucaaaaaucuuaagcgaaacuacaucguaccuauccugugguugaaugagacgggcacuauuggcgacgaaaaagcgaacauguuuagaucccaggucacagggaagaucaaucuacugggacucauugagaugauacugcuuucaguggguguugugauguucgucgccuuuaugaucaguuauugcgcauguaggagcaaaaccauuaaguga

SEQ ID NO: 54055 - RNA, 846 nt, Artificial Sequence
  derived and/or modified sequence opt3 from CD37__Homo_sapiens__NP_001765
augagcgcccaggaguccugccugucucucaucaaguacuuccuuuuuguguucaaccuguuuuucuuugucuugggcucauuaauuuucuguuuugggauauggauccugauugacaaaaccaguuucguuagcuuugugggacuagcuuucguaccccuccaaaucugguccaaggugcuggcaauuucugguaucuuuacaaugggcauagcccuucuggggugcgucggagcguugaaagaacucagaugucugcugggccucuauuucgguauguuacugcuuuuguuugcuacucagaucacgcuggggauucuaaucucgacccagagggcccagcucgagcggucacugcgcgaugugguugaaaagacaauucaaaaauacggaacuaauccugaggaaaccgcagccgaggagagcugggacuaugugcaguuccagcuucgaugcuguggcuggcacuacccacaggauugguuccaaguccugaucuugcguggcaacgggagugaagcucauagagugccgugcuccuguuauaaucucucugcaacaaacgacagcaccauacuggauaagguaauuuuaccccagcuguccaggcucggacaccuugcccggucacgccauagugcugacaucugcgccguuccugcggagagccacauuuacagagaagguugugcacagggccugcagaagugguugcauaauaaccuaaucucuaucguggggauuugccugggagucggccuccuggagcuugguuuuaugacucuguccauauucuuguguaggaaucucgaucacguguauaaccggcuggcccgcuaccgauga

SEQ ID NO: 54056 - RNA, 903 nt, Artificial Sequence
  derived and/or modified sequence opt3 from CD38__Homo_sapiens__NP_001766
auggccaacugcgaguucagccccguguccggcgacaagccuuguugcagacugucuaggcgggcucagcucugucuuggggucucaauccugguuuugauuuuagugguagugcuggcagucgugguuccacgcuggcgacaacaguggaguggaccggguaccacaaaacguuuucccgaaacugugcuagccagaugcgucaaguacacggagauacacccugaaaugaggcauguggauugucagagcguaugggacgcguucaaaggcgcuuuuaucuccaagcacccaugcaauauuaccgaggaagauuaucagccccucaugaaacuggggacacaaacuguuccuuguaacaagauccuucuguggucucggauuaaggacuuggcccaucaguucacccaggugcagcgcgauauguuuacacucgaggacacccugcugggauaccucgcagaugacuuaacuuggugcggcgaguucaauacaucgaaaaucaacuaucaaucauguccagauuggagaaaggacugcagcaauaaccccgucaguguguuuuggaaaaccguguccaggcgguucgccgaagcugcaugugaugucguucacgugaugcugaaugguucucgcagcaagauauuugacaaaaacuccacguucgggucaguagaggugcauaaucuucagccugaaaagguccagacuuuggaggccugggugauccacggaggccgagaggauaguagagaccugugccaggacccaaccauuaaggaacuagagagcaucauuucuaaaaggaacauccaauuuuccugcaagaauauauaccggccggauaaauuccuccaguguguuaagaaccccgaagacucaagcugcacaagugagauuuga

SEQ ID NO: 54057 - RNA, 516 nt, Artificial Sequence
  derived and/or modified sequence opt3 from CD3D__Homo_sapiens__NP_000723
auggagcacagcaccuuccuguccggccucgugcuugccacacuguugucucaggucucacccuuuaagaucccuauugaagaguuagaagacagaguuuucgugaacugcaauacgaguauaacuuggguagaggggaccgugggaacacugcuaagcgauaucacuaggcucgaccuggguaaacggauucuugauccacgcggcaucuaccgauguaacgggaccgacauuuauaaggauaaagaauccacaguccaagugcauuaccguaugugccagucuuguguugagcuggacccggcuaccguggcaggaaucauagucacugaugugaucgccacauugcuccuggcgcugggcguauuuugcuucgcuggucacgagaccgggagacucucgggagccgcagacacgcaggccuuacugaggaaugaucagguuuaucaaccccuucgggaccgcgaugacgcucaguacucacauuugggcggcaacugggcaagaaauaaguga

SEQ ID NO: 54058 - RNA, 1533 nt, Artificial Sequence
  derived and/or modified sequence opt3 from CD3EAP__Homo_sapiens__NP_036231
auggaggaaccccaggccggcgacgcugcaagauucagcugcccuccaaacuuuaccgccaagccgcccgcguccgagucuccuagguucucacuggaagcucugacagggccagauacugagcuuuggcugauccaagcccccgcagacuuugccccugaauguuucaauggacggcacgugccauugagugguagccagauugucaaaggcaaguuagcugggaaacgccaucgauaccguguucuguccucuugcccccaggcaggagaggccacgcuacucgcuccuucgaccgaggccggcggugggcugacaugugcgucagcaccacagggaacucuuagaauacuggaaggcccgcaacagagcuugaguggcuccccacuccagccuaucccagccucucccccuccacagauucccccggggcugaggccucgguuuugcgcuuucggagguaaucccccagugaccggcccucgcagcgcccuggcacccaaccucuuaacauccgggaagaaaaagaaggagaugcaaguaaccgaagcuccagugacucaggaggccgucaacggacacggcgcgcuggagguggauauggcccuugguucacccgaaauggacguuaggaaaaagaaaaagaaaaagaaucagcaguugaaggagccugaagcagcugggccagugggaacagagccgaccgucgaaacgcuggagccccuaggcgugcucuuuccuaguacuaccaaaaagcggaaaaagccaaaaggcaaggagacauucgaacccgaggauaaaacuguaaagcaagaacagaucaacaccgagccucuggaagacacaguucuuagcccaaccaagaaaagaaagcgccagaaagggacggagggaauggagcccgaagagggugugacugucgaaucucaaccucaggugaagguggagccgcuggaagaggccauuccauugcccccuaccaaaaagcgaaagaaagagaagggccagauggcuaugauggaacccgggacagaggccauggaaccagucgagccugagaugaaaccccucgaauccccaggaggcacuauggcaccgcagcaaccugagggugccaagccccaggcucaggcggcacuggccgcucccaaaaagaagaccaaaaaggaaaaacagcaagaugccacaguugagcccgaaacggaggugguagggccugaguuaccagacgaucuggaaccccaggcagccccuaccucaacaaagaaaaagaagaaaaagaaagagagaggccauacugugaccgaaccgauccagccacucgagcccgaacuuccuggagagggccagccagaggcuagggccacacccgggagcacuaagaaacggaagaaacaaagucaggaaucucguaugccugagaccgucccgcaggaagagaugcccggaccaccucucaauuccgaaagcggugaggaggcacccacaggccgcgacaagaagagaaaacagcaacagcagcaaccaguguga

SEQ ID NO: 54059 - RNA, 624 nt, Artificial Sequence
  derived and/or modified sequence opt3 from CD3E__Homo_sapiens__NP_000724
augcagagcggcacccacuggagagugcuggggcucugccuucuguccgucggaguuuggggucaagacggcaacgaggaaaugggagggaucacacagacucccuacaaggugucuauuucaggcacgaccguaauauugacauguccucaguauccagguagugagaucuuauggcagcauaaugauaaaaacauugggggagacgaagaugacaagaauaucggcagcgaugaggaccaccugucccuaaaagaguucucugaacucgagcaaucgggcuacuaugugugcuacccgagggggucaaagcccgaagaugccaacuuuuaucuguaccuucgggcucgcgucugugagaauugcauggaaauggacgugaugagcguugcaacuauugugaucgucgauauauguaucaccggaggucuguugcuccugguguauuacuggaguaaaaaccgaaaggccaaggcgaaaccuguaacacguggcgcuggggccggaggcagacagaggggucagaauaaggagcggccacccccuguuccaaaccccgacuacgagccuauucgcaaagggcagagagaucuguauuccggacucaaucaaaggcggaucuga

SEQ ID NO: 54060 - RNA, 549 nt, Artificial Sequence
  derived and/or modified sequence opt3 from CD3G__Homo_sapiens__NP_000064
auggagcagggcaaggggcuggccgugcucauccuugcuauuauacuguugcaaggaaccuuagcacagagcaucaaagguaaccaccuggucaagguuuacgacuaucaggaagauggcuccgugcuacucacaugcgacgccgaggcgaaaaauauuacuugguucaaggaugggaaaaugaucggauuucugacggaagacaagaagaaauggaaccuuggcucuaaugcuaaggaucccagagguauguaccaguguaaagggucacaaaacaagaguaaaccucugcagguauauuacaggaugugccagaauuguauugaguugaacgccgcaaccaucagcggauuccucuuugccgaaauaguguccaucuucguccuggcugugggcguuuauuuuauugcaggccaggacggggugcggcaaucucgcgccucggauaagcagacacugcucccaaaugaccaguuauaccagccgcugaaggaucgagaggacgaucaauauucacaucuucagggaaaccaguugcguagaaauuga

SEQ ID NO: 54061 - RNA, 834 nt, Artificial Sequence
  derived and/or modified sequence opt3 from CD40__Homo_sapiens__NP_001241
auggugagacugccccuccagugcguccuuuggggcugucuguugaccgccguucacccugagccaccgacagcuugcagggaaaagcaauacuuaaucaacagccaguguugcucccugugucagcccgggcagaagcuagugucugacugcacugaguucacggaaaccgagugucucccuugcggagaaucagaguuucuggauacauggaaucgggagacucauugucaccaacauaaauauugcgacccaaaccuuggucugcgcguacagcagaaaggcaccagugaaacagauaccauuuguacuugcgaggaaggguggcacugcacaagcgaggcaugugaguccugcguguugcaucgaucuuguucgcccggauucggcgucaagcagauagccaccggugugucagacacgaucugcgaaccuuguccaguuggguuuuucagcaaugugaguuccgcguuugagaaaugccaccccuggacuucuugugaaaccaaggaucucgucgugcaacaggcuggaacaaacaagacugacguaguuugcggcccucaggaucgucugagagcccugguggucauuccaaucauuuucggcauccucuuugcaauauuacuggugcuuguguucaucaaaaaggucgccaaaaagccgaccaauaaagcuccccacccuaagcaggagccacaagaaauuaacuuucccgacgauuugccugggagcaauacagcagccccaguucaggagacccugcauggaugucagcccgugacgcaagaggacgguaaggaauccaggaucucaguacaggagcggcaguga

SEQ ID NO: 54062 - RNA, 786 nt, Artificial Sequence
  derived and/or modified sequence opt3 from CD40LG__Homo_sapiens__NP_000065
augaucgagaccuacaaccagacaagccccagauccgccgcuacuggccugccuauuucuaugaagauauucauguaucuccuuacgguguuucugaucacccaaaugauugggucagcauuguucgccgucuacuuacacaggcggcuggacaaaaucgaagaugagcgcaaucuacaugaagacuuuguuuucaugaagacaauucagcgaugcaacacuggagagcguagucucagccugcuuaauugugaagagaucaaaucccaguuugaggguuucgugaaggauauaaugcugaacaaagaagagaccaagaaggaaaauucuuuugagaugcagaaaggcgaccaaaacccacagaucgcggcucacguaauuucggaggccucaagcaagacaaccaguguguugcagugggcagaaaaaggguauuacacuauguccaauaaccucgucacacuggagaauggaaagcagcugaccgugaaaagacaaggccucuauuacaucuaugcccagguuacguucugcucuaacagggaagcuagcucccaggcaccguuuauugccucauuaugucugaagagucccggucgguucgagcgcauccuuuugagagcugccaauacucauagcucugcgaagccuugcgggcagcaauccauacaccugggaggcguguuugaacuacagccaggcgcaucagucuucgugaacguaaccgaucccagccagguuagucaugggacaggauuuacuucuuucggucuccugaaacuuuga

SEQ ID NO: 54063 - RNA, 2229 nt, Artificial Sequence
  derived and/or modified sequence opt3 from CD44__Homo_sapiens__NP_000601
auggacaaguucugguggcacgccgcuuggggccugugccucgugccccuuagccuggcacagaucgauuugaacauuaccuguagauuugccggggucuuccauguugagaaaaauggaagguacuccauaucucggacagaagcggcugacuuaugcaaggccuuuaacucaacucugccuacgauggcacaaauggagaaagcccuaaguaucgguuucgaaaccugucgcuauggcuuuauugaggggcacgugguaaucccacguauucauccgaauagcaucugcgcugcaaacaauacaggaguguacauacucacuuccaacaccucucaguaugauacauacuguuucaaugccucggcucccccugaagaggacugcaccucagucacugaucugccaaacgccuuugacggccccaucacaauuaccaucgugaaucgagaugguacgagauauguucagaagggggaguacaggacuaacccugaagacauuuauccaagcaaucccaccgaugacgaugugaguuccggaucuagcuccgagcggucaaguacaagcggcggcuacaucuucuacacuuuuucuaccguccacccuauaccagacgaagauuccccguggauuacagacucaaccgaccgcauccccgcgacgacucuuaugagcacaagugcaaccgccacugagacagcuaccaaaagacaggagacgugggauugguucucuuggcuguuuuugccuuccgaaagcaagaaccaucuccacaccacaacucaaauggccgggaccucgucuaauacaauuuccgcaggaugggagccaaacgaagagaaugaagacgagagggaucggcaccugucauucagugguagcggcaucgacgaugacgaggauuuuaucuccucuacuauuagcaccacaccccgcgcuuucgaccauaccaagcagaaccaggauuggacucaguggaacccuucacacaguaauccagaagugcugcuccaaacgacaacccgaaugacugacguagauagaaacgggaccacagccuaugagggaaauuggaaccccgaagcgcauccgccuuuaauacaccacgagcaucacgaagaggaggaaacuccccauuccacuagcacaauccaggccacgccaucuucaaccacugaggaaacagcaacccagaaagagcagugguucggcaauagguggcacgaagguuaccggcaaacaccuaaggaggacagucauagcacuaccgggacggcugccgcuuccgcccacaccucucaccccaugcagggacguacaacuccaucgcccgaggacagcuccuggaccgacuuuuucaacccuauuucacauccaaugggccgcggccaccaggcagggagaaggauggauauggauaguucucauagcaucacacugcaaccgacugccaaucccaacaccggacuuguugaagacuuggaucggacggguccucuguccaugacaacccagcagucaaauagccagucuuuuuccaccagucacgagggccuagaagaggacaaagaucacccaacaaccagcacucucaccucuuccaaccgaaaugacgugacagggggacgcagagaucccaaccauucagagggcaguacgacccugcuugaagguuauacuagccacuacccucauacaaaggagucgaggaccuucauaccagucacauccgcuaaaacugggucuuuuggcgugaccgcggugacggucggagacagcaauucaaacguuaaucggagucuguccggcgaucaagacacauuccaccccucugggggaagccauaccacucacgguuccgaaucagauggccacagccaugggagucaggagggaggcgcaaacaccacaucugguccgauucgcacuccucagaucccagaaugguugaucauucucgccucccuguuagcucuggcccucauccuugcaguguguauugccguaaacagcagaaggcguugcgggcagaagaagaaacuggugauaaauucgggcaacggagcugucgaggaccggaagcccucaggcuugaauggggaggccucuaaaagucaagaaauggugcaccuaguuaacaaggaguccagcgaaaccccugaccaguuuaugacagcagaugagacgcgaaaucugcagaacguggacaugaaaaucggagucuga

SEQ ID NO: 54064 - RNA, 1179 nt, Artificial Sequence
  derived and/or modified sequence opt3 from CD46__Homo_sapiens__NP_002380
auggagcccccuggcagaagggaaugcccauucccgagcuggcgguuucccgggcugcuccuugccgcuauggugcuguuguuauacuccuucucugacgcaugugaggaaccuccaaccuuugaggccauggaacugaucggaaagcccaaaccuuauuacgagauuggugagcgcgucgauuauaagugcaaaaagggcuacuucuauauaccaccccuagcgacacacacuaucugugaccgaaaccauacguggcucccuguuucagaugacgcuugcuaccgugaaaccuguccauauauuagagauccgcugaaugggcaggccgugcccgcaaacggaacauacgaguuuggcuaccaaaugcacuucaucugcaaugaagguuauuaccuuauuggggaggagauccuguauugugaauugaaaggaaguguagccauauggagcggcaagccuccaaucugcgagaaggugcucuguacucccccuccaaaaauuaagaacggcaaacauaccuuuuccgaagucgagguguucgaauaccuggacgcuguuacauauucuugcgaucccgcaccggggccugaccccuuuucgcugaucggagagucaaccauuuacuguggugauaauagcguguggaguagggccgcuccagagugcaaggucgugaaaugccgguucccuguaguugaaaacggcaagcagaucuccggguuuggaaagaaauucuauuacaaggccacugugauguuugagugugacaaaggcuucuaccucgaugguucugacacaauagucugcgauagcaauuccaccugggaucccccagugcccaaguguuuaaaagugcugccuccaucaaguacgaagccgcccgcgcuuagccacucugucuccacuucaagcaccacaaaaaguccugcaucuuccgccagcgggccacgccccacuuauaagccuccaguuucgaacuaccccggauauccgaagccugaagagggcauuuuggacucucuggacguguggguaaucgcugugauugucaucgccaucgugguuggcguggcagucauuugcgugguaccauacagauaucuacagaggcggaaaaagaaagggaccuaccucacagacgaaacccaucgcgagguuaaguucacgucccuguga

SEQ ID NO: 54065 - RNA, 972 nt, Artificial Sequence
  derived and/or modified sequence opt3 from CD47__Homo_sapiens__NP_001768
auguggccccugguggccgcucuccuucugggcagcgcaugcuguggguccgcccaguuguuauucaacaagaccaaaucugucgaguuuacauucugcaaugacacuguugugaucccuuguuuuguaacgaacauggaagcgcaaaauaccacagagguguacgucaaguggaaauucaagggaagagauauuuauacuuuugacggugcucugaacaaaucaaccgugccaacagauuucaguagcgccaagauagaaguuucccagcuacucaagggcgacgcaucucugaaaauggauaagucggacgccgugucacacaccgggaauuacacuugcgaggucacagaacuuaccagggagggagagacgaucauugaacugaaauaucgggugguaagcugguuuaguccgaacgagaauaucuugauuguuaucuuccccauauuugcuauccuccuguucuggggccaguuugguauuaagacucugaaauaccgcuccgggggaauggaugaaaagaccaucgcacucuuaguggccggccuggucauuacagugaucgugauagucggcgcuauucuuuucguuccuggggaguauucuuugaagaacgccacuggacugggucuaaucgugaccagcacaggcauucucauccugcuucauuacuauguauuuuccaccgcgaucgggcugacgucauucgugauugcaauauuggucauccaggugauugccuacauccucgcuguugugggacugaguuuauguauagccgcaugcauuccaaugcacggcccccugcucaucagcggucuuucuauccuggcuuuggcccaacuacuggggcucgucuacaugaaauucguggcguccaaucagaagacuauucagccuccacgaaaagccguagaggaaccccugaacgcauuuaaggagucaaaaggaaugaugaaugacgaauga

SEQ ID NO: 54066 - RNA, 732 nt, Artificial Sequence
  derived and/or modified sequence opt3 from CD48__Homo_sapiens__NP_001769
augugcagcagaggcugggacuccugucuggcccucgagcuucuguuguuaccccugucucuacucgugaccucaauccaggggcaccugguccauaugacaguugugaguggaagcaacguaacucuuaauauuuccgaaucucugccugagaacuacaagcaauugacgugguucuauaccuuugaucagaaaauaguggaaugggacucgaggaagucaaaauacuucgagagcaaguuuaaaggucggguccgccucgauccacagaguggcgcucuguauaucuccaaggugcagaaggaagacaauucuacauacauuaugcgaguucugaaaaagacugggaacgagcaagaguggaaaaucaagcuccagguguuagauccgguccccaaaccugugauuaagaucgaaaagauagaggacauggaugacaauugcuaucugaaacuuagcuguguaaucccaggagaauccguuaacuacaccugguauggcgauaagcgucccuucccuaaagaguugcagaauagcgugcuggagacaacccuaaugccacacaacuacaguagaugcuacacuugucaggucagcaauucuguguccucaaagaacgguacagugugccucucacccccuuguacccuggcaaggaguuuuggggucgaauggauugccucuuggcuuguugugacgguaccaacuauccugggauugcuccugaccuga

SEQ ID NO: 54067 - RNA, 1377 nt, Artificial Sequence
  derived and/or modified sequence opt3 from CD4__Homo_sapiens__NP_000607
augaacagaggcgugcccuucaggcaucugcuccuuguccugcaguuggccuuacugccugcugcaacccaagggaagaaaguugugcuaggaaagaaaggugacacaguagagcucacuugcacggccagccagaagaaauccauccaguuucacuggaaaaauucuaaccagauuaagauacugggcaaucaagggucauuccuuaccaaaggaccaaguaagcugaacgaucgggcggacagccgccgauccuugugggaucagggcaauuuuccgcucaucauuaaaaaccugaagaucgaagacucugauacauacauuugugagguggaagaccagaaagaggaaguccagcugcucguguucgguuuaacugcuaauucggauacccaucugcuucaagggcagucauugacacugacccuagagagucccccuggaagcuccccaucuguucagugccguagccccagaggcaagaacauccagggcgggaagacucucuccgugucacaacuggagcuucaggacaguggaacauggaccuguacgguccugcagaaucaaaagaagguggaauuuaaaauagauaucguaguuuuggccuuccagaaggcaagcucuauuguguauaaaaaggagggugaacaggucgaguuuuccuucccucucgccuuuacuguggagaaacugaccggcucaggggaauuaugguggcaggcugagagggcaagcaguucuaaguccuggaucacauucgaccugaagaacaaagaagugagcgucaagcggguuacucaagauccaaaacuccagaugggaaagaaacuuccccugcacuugacccuaccucaggcccugccacaguacgcuggcucggguaaucucacacuggcccuugaggcgaagaccgggaagcugcaccaagaagugaacuugguagugaugcgcgcaacgcagcuccagaaaaaucugacuugcgaggucuggggaccgacaucucccaaguuaaugcugucccuaaaacucgagaacaaggaagccaaagugucaaagagagagaaggcuguuugggugcugaauccugaagccggcauguggcagugucuuuugagugacagcggccaaguccugcucgaguccaacauuaaagugcugccaaccuggucuacucccguacagccuauggcacuuaucguucugggagggguggcugguuugcuccuguuuauaggcuuagggauuuucuuuugcgucaggugucggcaucgccgaagacaggccgaaaggaugagccagaucaagcggcugcuaucagagaaaaagacaugccaauguccacaccguuuccagaaaaccugcagucccauuuga

SEQ ID NO: 54068 - RNA, 1146 nt, Artificial Sequence
  derived and/or modified sequence opt3 from CD55__Homo_sapiens__NP_000565
augaccguggccagacccagcgucccugcugcacugccacuccuuggcgagcugccgagguuguuacugcuaguucuccugugccuucccgccguguggggagacugugggcugccuccagauguacccaacgcgcagccugcuuuggaaggucggacauccuucccagaggacacugugaucacguacaagugcgaagagucuuuugucaaaauucccggcgaaaaggauucagugauaugucucaaagggagucaauggagcgacaucgaggaguucugcaaucgcuccugugaaguuccuacccgacugaacucugccucgcugaagcagccauauauuacacagaauuacuuuccggugggaacugucguggaguaugaaugccgucccggcuacagaagggagccuucacucagcccaaaauuaaccugucugcagaaccuuaaguggaguacagcaguagaguucugcaagaaaaaguccugucccaauccuggugaaauccggaacgggcaaauugauguuccaggaggcaucuuguuuggcgccaccauaucuuucagcugcaauacuggguauaaacuguuuggauccacaucaaguuucugucuaaucagcgguucuuccgugcaguggucagacccccucccggagugccgcgaaauuuacugcccugcucccccacagaucgauaacggcauuauccagggggagagagaccacuauggauacaggcaaagcgucaccuacgcauguaauaagggcuuuacgaugauaggugaacauaguauuuauugcacugugaacaaugaugagggggaguggucuggaccucccccagaaugucggggcaaaucccugaccagcaaggugcccccuacaguccagaagccaacuaccguuaacgugccgacaaccgagguaucgcccacgucucagaaaacuacaaccaagacuacaaccccuaaugcccaggcuacgcgcuccaccccagugucacgaacaacuaaacacuuccaugaaaccacacccaacaagggcagugggacuaccagcggaacaaccagacuucuguccggucacacuugcuuuacguugacaggccuccuggggaccuuagucacuaugggacugcucaccuga

SEQ ID NO: 54069 - RNA, 387 nt, Artificial Sequence
  derived and/or modified sequence opt3 from CD59__Homo_sapiens__NP_001120695
augggcauccaagggggaagcgugcuguucggucuccuucuggucuuggccguguuuugccacuccggccauucuuuacaguguuacaacugccccaauccuaccgcugacuguaagacagcaguuaacugcucaagugauuucgacgccugucugauuacuaaagcggggcuacagguauauaauaagugcuggaaauuugagcacuguaacuucaaugaugugacgaccagacucagggaaaacgagcugacauacuauugcuguaagaaagaccuuugcaauuuuaacgaacagcuggagaauggaggcacuagcuuguccgaaaagaccguccuccugcuggugacaccauuccucgcugccgcauggucuuuacauccguga

SEQ ID NO: 54070 - RNA, 1488 nt, Artificial Sequence
  derived and/or modified sequence opt3 from CD5__Homo_sapiens__NP_055022
augcccaugggcagccugcagccucucgccacccuuuaccuguuggggauguuaguggcuuccugccugggaagacuaucuugguaugacccagauuuccaagcaaggcucacacggucaaacaguaagugucagggucagcuggaggucuaccuuaaagacggcuggcacaugguuugcagccaguccugggggcgaucuucgaagcaaugggaagauccgucacaggccagcaaagugugucagcgccugaauugcggaguacccuugagucucggcccuuuucuggugacuuauacgccacaguccucuaucauuuguuacggucaacuggggagcuucuccaacugcucacauagucguaaugacaugugucacagccucggauuaaccugccuggagccccagaagacaacuccuccaaccacaagacccccuccaaccacuacaccggaacccaccgcgccuccaaggcuucaguuggucgcucagucuggcggccaacauugugccggggugguugaguuuuauuccggaucacuggguggcacgauaagcuacgaagcacaggauaaaacucaggaccuagagaacuuccucugcaauaaccugcaaugugggaguuuucuuaagcaucugcccgagaccgaagccggacgggcucaggauccuggcgagccacgcgaacaccagcccuugccgauccaguggaagauucaaaauucuuccugcacaagccucgagcacugcuucagaaaaaucaagccucagaaaucggguagggugcuggcauuacuguguucuggguuucagcccaagguccagucccggcucgugggaggcucaaguauuugcgagggcacuguagaaguucgccaaggggcccagugggcugcccuuugugacagcuccucugcgcgaagcucacugagaugggaggaagugugcagggagcagcaguguggaagugucaacuccuaucggguguuggaugcuggugacccaaccagccguggccuauucugcccucaccaaaaacugucucagugucaugaacucugggagcgcaauucauacugcaagaagguguuugucacaugucaggaucccaacccagccgggcuggcugccggaaccguugcaaguaucauacuugcucugguguugcucguagugcuguuagucgugugcggcccccuggccuacaaaaagcuaguuaaaaaguucagacagaaaaagcaaaggcaguggaucgguccuacggggaugaaucagaacaugagcuuucaccggaaucauacugcgacagugcgaucccacgccgagaacccaaccgcaucucacgucgacaaugaauauucgcaaccgccccgcaacagccaucucuccgcuuacccugcccuggagggcgcacuucacagaucaaguaugcagccagauaacucuagcgacuccgacuaugauuugcauggagcccagaggcuguga

SEQ ID NO: 54071 - RNA, 1044 nt, Artificial Sequence
  derived and/or modified sequence opt3 from CD5L__Homo_sapiens__NP_005885
auggcccuccuguucagccuuauccuggcuauuugcaccagacccggcuuuuuggcauccccuucuggggugagguuagucggaggucugcaccggugugagggccgcguugaaguggagcagaaggggcaauggggaacaguaugcgacgauggcugggacauaaaagauguggccguccuaugucgagaacucgguugcggggcggcuucaggaacuccaaguggcauccuguacgagccgcccgccgaaaaggagcagaaagugcuuauucagagcguuuccuguacgggcaccgaggacacacuggcacagugcgaacaagaggaaguguaugauuguucucaugacgaggaugccggggcuucgugcgagaacccugaaagcucauucaguccaguccccgagggagugcguuuggcagacgguccuggccacuguaaggggagaguagaaguuaaacaucagaaucagugguacacugugugccagaccggauggucccucagggccgcuaaggucgugugucggcaacugggcugcggucgcgccgugcugacacagaagagaugcaacaaacacgcguaugggaggaagccaaucuggcucucucagaugagcuguuccggacgggaggcaaccuuacaggauugccccucaggcccuuggggcaaaaauacuuguaaccaugacgaagauacaugggucgagugcgaggacccauuugaucugcgccuuguugggggagacaauuuguguaguggucgacuggaagugcuacacaagggcguaugggggagcgugugcgacgauaacuggggagagaaagaagaccaagucguguguaagcagcucggcugcgguaagucucuguccccgucauucagagauaggaaauguuacgggcccggcguuggacggauuuggcuugacaaugugcguugcagcggcgaggaacagagucuggagcaaugucagcaccgcuuuuggggguuccaugauugcacccaccaggaggacgucgccgugaucugcucuggauga

SEQ ID NO: 54072 - RNA, 648 nt, Artificial Sequence
  derived and/or modified sequence opt3 from CD63__Homo_sapiens__NP_001244321
auggccguggagggcgggaugaagugcgucaaauuccugcucuacguucuucuguuggcuuuuuguggagcaacccccgguagcuuacugccugugguaaucauugccgugggcgucuuccuauuucucguggcguucguugggugcuguggagcuugcaaggaaaacuauugucugaugauaacauuugccaucuuccuuucccugauuauguugguggaggucgcagccgcuaucgcaggcuacguguuuagagacaaaguaaugucugaguucaauaacaauuuuaggcagcaaauggaaaacuauccaaagaauaaccacacugccucaauucucgaucggaugcaggcugacuucaaaugcuguggugccgcgaauuacacggauugggaaaagaucccgaguaugagcaagaaccgcguucccgacuccugcuguauaaaugugaccgucgggugcggaaucaacuuuaaugagaaagcaauucauaaggagggcuguguggagaaaaucggcggguggcugcgaaagaacgugcuggucguugccgcugccgcacucggaauugcuuucguggaaguauuagguaucguguuugccugcugccuggucaaaucuauacguucgggcuaugaagugauguga

SEQ ID NO: 54073 - RNA, 984 nt, Artificial Sequence
  derived and/or modified sequence opt3 from CD68__Homo_sapiens__NP_001035148
augagacuggccgugcuguucagcggcgcccuucugggguuguuagcagaguccaccggaacaacuucucacaggacgaccaagucacauaaaacaacuacccaccggacaaccacuacagguaccacgagucauggccccacuaccgccacacacaacccuacuaccacaagccaugggaaugucaccguucacccaacguccaacucuacugcgacaucgcagggaccgucaaccgcuacucacagccccgccacaaccagucauggcaaugcaacggugcacccuaccuccaacucuacagccacuagcccagguuuuaccuccucagcucaucccgaaccuccacccccuaguccaagcccgucucccacauccaaggagacuaucggggacuacaccuggacaaauggaucacaaccuugcguacaccuccaggcacagauucagauacgcgugauguauaccacucaaggcggcggggaagccuggggaaucagcguccuaaacccaaauaaaacgaaggugcaggguaguugugagggcgcucacccccaucuccugcuuucuuucccuuacgggcaccuguccuuuggauucaugcaggauuugcagcaaaaaguuguguaucucagcuacauggccgucgaauauaacgugucguuuccacaugcggcacaguggacauucucugcccagaaugcuucccugcgagaccugcaggcuccccucggccaaucauuuaguugcagcaacuccucuauuaucuuaagcccggcaguacaccuggaucuuuugucacugcgucuacaggcugcccagcucccucauaccgguguuuucgggcaaaguuuuuccugucccagcgacagaucuauucugcuuccacugaucauaggauugauccuccugggcuuacuggcgcucgugcuuauugccuucugcaucauuaggcggcgcccuucagcauaccaggcucuguga

SEQ ID NO: 54074 - RNA, 600 nt, Artificial Sequence
  derived and/or modified sequence opt3 from CD69__Homo_sapiens__NP_001772
augagcuccgagaacugcuucguggccgaaaauucuucacugcaccccgagaguggccaggaaaacgacgcuaccagcccucauuuuuccacaagacacgaggggucuuuccaagucccaguucucugugcagugaugaauguaguguuuaucacuauucuuauaaucgcccugauugcguugucggucggacaguacaacugcccgggucaguauacguucucaaugcccagcgauagucauguguccucuuguagcgaagacuggguuggcuaccagaggaagugcuauuuuaucuccaccgugaaacggucauggacaagugcucaaaaugccuguagcgagcacggggcaacuuuagccgucauugauucugagaaggacaugaacuuccugaaacgcuacgcuggacgagaggaacauugggugggccuaaagaaagaaccuggucacccauggaagugguccaaugggaaggaguuuaacaauugguucaacguaaccggaucagauaaaugcguuuuucucaagaauacagaggugagcaguauggaaugugagaaaaaccuguauuggaucugcaauaagcccuacaaauga

SEQ ID NO: 54075 - RNA, 1806 nt, Artificial Sequence
  derived and/or modified sequence opt3 from CD6__Homo_sapiens__NP_001241679
auguggcuguucuuuggcaucaccgggcuccuuacagccgcucugagcggacaccccuccccugcaccaccggaccaguugaacacuucuucagccgagagugaauuaugggagcccggugaaagacugccugugaggcuaacgaauggcagcuccucuugcucggggaccgucgagguucggcucgaagcgucaugggagccagcuuguggagcccugugggauagccgcgcagccgaggcugugugccgagcacuuggcugugguggggccgaagcugccagucaacuggcgcccccuacaccagaguugcccccuccaccggcagccggaaacacuuccguagcugccaaugcaacccucgcuggcgcccccgcgcugcugugcucuggcgccgaauggcgucucugugagguggucgagcaugcaugcagaagcgacgggaggcgggcucgcgugacaugugccgaaaacagagcuuuaaggcugguugauggagguggcgccugcgcagggcggguggagaugcuugaacacggagaguggggcuccgucugugacgauaccugggacuuggaagaugcccaugugguaugccgccagcuggguugugggugggcuguucaggcgcuaccuggacuccacuucacuccaggccgaggccccauucauagagaccaggugaauugcucaggggcagaggccuaccugugggauugcccuggacuuccaggucaacacuauuguggccacaaggaggacgcuggggccgucugcagugaacaucagagcuggaggcugacaggaggcgcagaucggugugagggucagguggaagugcacuuucguggggucuggaacaccguuugcgacucugagugguaccccuccgaagccaaaguguugugucagucacucggcugcggaacggcuguagagcgcccgaagggccugccucauagcuuaagugggagaauguauuacucuuguaauggagaggaacugacucucuccaacugcagcuggagguucaauaacucgaaucuuuguucucaaucccuggccgcacggguguugugcucagcgagucgaagccuacacaaccuguccacccccgaggucccagcuucugugcagacaguuacuauagaaagcucagugaccgucaaaaucgagaauaaggaaagucgcgagcucaugcugcuuauuccuuccaucgugcuggguauuuugcuccugggcagcuuaaucuuuauagccuucauccugcuaagaauuaaagggaaguauguauuuaugcuccccauccagguucaggcaccacccccugaggauucugacucaggaagugacagcgauuacgaacacuaugacuucuccgcccaaccaccgguggcucugacaaccuuuuacaacucucagaggcaucgggucacggaugaggaagugcagcaaucgcgcuuccagaugcccccucuugaggagggcuuggaggaacugcacgccagccauauuccaacugcaaaucccggucacuguaucacagacccuccaucccucgggccccaguaccauccgagaucaaacagugaaucuagcaccuccucaggcgaggauuauugcaacagcccuaagucuaaacugccacccuggaauccucaggucuuuuccagugaaaggagcucuuuccuugagcaacccccaaaccuggaguuggcuggaacucagccugccuuuuccggcucacccaguccacagccggacagcacagauaaugacgauuacgacgauauaucggcggccuga

SEQ ID NO: 54076 - RNA, 1080 nt, Artificial Sequence
  derived and/or modified sequence opt3 from CD72__Homo_sapiens__NP_001773
auggccgaggcuaucaccuacgcagaccugagauucgugaaggcccccuugaaaaagagcauuuccucuaggcuuggccaggauccuggggcggacgaugacggagaaauaacauaugagaacguccaaguuccagcugugcuggguguaccgucaaguuuggccagcuccguguuaggcgauaaagcagccgucaagucugaacagcccacugcuucguggcgggcagugacgagcccugccguugggcgcauccugccaugccgaaccacaugucuacguuaccuccugcuuggacuguugcucacuugccugcugcucggcgugaccgcuauuuguuuaggugucagauaucugcaagugucacagcagcuucagcagacaaauaggguauuggagguuaccaacaguucccugcggcagcaacuacgccucaaaaucacucagcuggggcagucugccgaagaccuucagggaagcagaagggagcuggcgcaaucccaggaggcacuccagguggaacaacgggcccaccaggcugccgagggccagcuccaggcaugccaagcugaucgccagaagacaaaggaaacccugcagucagaggagcagcaaagacgagccuuagaacagaaacugaguaauauggagaacaggcucaagcccuuuuucacguguggcagcgcggacacuugcuguccuucuggguggauuaugcaucagaaauccugcuuuuacaucucacuuaccagcaagaauuggcaggaaagucaaaaacagugugagacacugucuuccaaguuggccacuuucagcgaaauauauccacagucgcacucuuacuauuuucuaaacucccugcuccccaauggagguucaggcaacaguuacuggaccgggcugagcuccaauaaggauuggaaacuuacagacgauacccagcggacgcguacuuacgcacaaucuagcaagugcaacaaaguccauaagacauggucaugguggacccuggagagugaguccugucgcagcucuuugccuuauaucugcgaaaugacugcuuucagauuuccagacuga

SEQ ID NO: 54077 - RNA, 483 nt, Artificial Sequence
  derived and/or modified sequence opt3 from CD74__Homo_sapiens__NP_001020329
augcacagaaggcggagccgcuccugccgagaggaccagaagcccgugauggaugaccaacgugaucugaucucuaacaaugaacagcucccuaugcuuggcagaaggccaggggccccggagucaaaauguagucggggagcucuguacaccgguuucagcauuuuggucacauuacugcuagcaggccaggccacuacggcguauuuucucuaccagcaacaggggcgccuggacaaacuuaccguuacaucccagaaccugcaguuggaaaaucucagaaugaagcugcccaagccuccaaaacccgugucuaagaugaggauggcuacuccucugcucaugcaagccuuaccaaugggagcacugccccagggcccuaugcagaacgccaccaaguaugguaauaugacagaggaucauguaaugcaccuuuugcagucgcauuggaacuggcggacccgccugcuaggguggguguga

SEQ ID NO: 54078 - RNA, 681 nt, Artificial Sequence
  derived and/or modified sequence opt3 from CD79A__Homo_sapiens__NP_001774
augcccggcgggccuggagugcugcaggcccucccagcuaccaucuuccuucuguuuuuguuaagcgcagucuaccuggguccgggcugccaagcccuauggaugcacaagguucccgcgucccucauggugucucugggggaggacgcucauuuccaguguccucacaacucaaguaauaacgccaauguaacaugguggagagugcuucauggaaacuauacuuggccacccgaauuucugggcccuggugaggauccaaaugggacguugauuauacagaacgucaauaaaagccacggaggcaucuacgugugcaggguucaggaaggcaacgaguccuaucaacagucuugugggaccuaccuccgggugcgccagcccccuccacgaccguuccuggacaugggagaagguacaaagaaucguauuaucacugcagagggcauuauccugcucuuuugcgccgucgugcccgggaccuuacugcuuuucagaaaaagguggcagaacgagaaguugggacuggaugcuggcgacgaauaugaggaugaaaaucuauacgagggucucaaccuggacgauuguucgauguaugaggacauaucacgggggcuucaaggaacauaccaggauguaggcagccugaauaucggcgacguucaguuggaaaaaccuuga

SEQ ID NO: 54079 - RNA, 690 nt, Artificial Sequence
  derived and/or modified sequence opt3 from CD79B__Homo_sapiens__NP_000617
auggccagacuggcucucagccccgugccuucccacuggauggucgcacuucuguuguuacugucugccgagccaguuccggcggcuaggucagaagaccgguaccgcaaccccaagggcagugccugcagccgaaucuggcaguccccucguuucauugcaagaaaaaggggguuuaccgugaagaugcauuguuauaugaacucugccucgggaaauguaucauggcuauggaaacaagagauggaugaaaauccacagcagcucaagcuggagaaaggucggauggaagagagccagaacgagagucuugcuacacugacuauacaaggcauccgcuucgaagacaaugggauuuacuuuugccagcagaaguguaacaauacguccgagguguaucagggaugcggcaccgaauugagagucauggguuucucuacacucgcacaacugaagcagaggaacacucugaaagaugggaucauuaugauccagacccucuuaauaauccuguuuauuaucgugcccauuuuccuuuugcuggacaaggaugacagcaaagccggaauggaggaggaucacacauacgaaggccuagacaucgaucagaccgcuacuuaugaggacauaguuacacuccggaccggcgaagugaagugguccgucggggagcauccuggacaagaauga

SEQ ID NO: 54080 - RNA, 723 nt, Artificial Sequence
  derived and/or modified sequence opt3 from CD7__Homo_sapiens__NP_006128
auggccgggcccccuagacugcuccuucugccauuguuacuggcucuagcaaggggccucccgggagcccuggcggcucaggaggugcaacagagcccccacugcaccacagucccuguuggugccuccgugaacaucacuuguucuacgucaggcgggcuucggggaauuuaccugcgccaguugggcccacagccccaagacauaaucuauuacgaagaugguguagugccuaccacagaccgacguuucagagggaggauugauuuuaguggaagccaggacaaucucacuaucaccaugcaucggcugcagcuguccgauacaggcaccuauacuugccaggcaauuacagaggucaacguguacggcucugggacccucguuuuagugacggaggaacaaucgcagggauggcaccgcuguucagacgccccacccagagcuagcgcacugccugccccaccgacugguagugcccuucccgauccucagaccgcuuccgcguugccagaucccccugcagccucugcucugccagccgcacuagcugucaucagcuuccuccugggccuugggcugggaguggccugcguauuggcgaggacacagauaaagaagcucuguuccuggcgggacaaaaauucagccgcaugcguuguguaugaagacaugagucauagccgcuguaacacucugucuucccccaaucaauaccaguga

SEQ ID NO: 54081 - RNA, 867 nt, Artificial Sequence
  derived and/or modified sequence opt3 from CD80__Homo_sapiens__NP_005182
augggccacaccagaaggcaggggacaagccccuccaagugcccuuaccugaacuucuuucaacuccuugugcuggccggauugucucauuucuguucaggugucauccacguuacuaaagaggugaaggaaguagcuacguuaaguugcggccauaaugugagcgucgaggaacuggcacagacccggauuuauuggcagaaagagaagaaaauggugcuaacaaugauguccggggacaugaacauauggccagaauacaagaaucgcacuaucuuugauauuaccaacaaucucucuaucguuauucuggcccuucgaccgucggacgagggaacauaugagugugugguccugaaguacgaaaaagaugcguucaagcgugagcacuuggcugaagugacccucucaguaaaagccgacuuucccacuccuagcaucagugauuucgagauaccaacauccaacaucagaaggauuaucugcucuaccagcggcgguuuucccgagccucaucuguccuggcuggaaaauggggaggaacucaacgcaauuaauacgacuguuucacaggacccagagaccgaauuauaugccgugaguagcaagcuggauuucaacaugacaacuaaucacucuuuuaugugucuuaucaaauacggacacuugcgggucaaccaaaccuucaauuggaacacaaccaagcaggagcauuuucccgacaaucugcuaccuuccugggcuauaacgcucauuucagugaacggcaucuucgugauuugcugucugacuuauugcuuugcaccacgcuguagagagaggcggcgcaacgaacgacuuagaagggagagcguccggccgguuuga

SEQ ID NO: 54082 - RNA, 711 nt, Artificial Sequence
  derived and/or modified sequence opt3 from CD81__Homo_sapiens__NP_004347
augggcguggaggggugcaccaaguguaucaaauaccugcucuuugucuuuaacuucguuuucuggcuugccggaggugugauucugggcguagcuuugugguuaagacacgacccccagacaacuaaucugcuauaucucgaacugggggauaagccugcaccaaacacguucuacgugggaauauauauccuuauugccgucggcgcggugaugauguuuguugguuuccuggggugcuacggagcuauccaagagagccaguguuugcucggcaccuuuuucacaugccuggugauucuguuugccugugaagucgcagccggcaucuggggguucgugaauaaagaccagauagcuaaggauguaaaacaguuuuaugaccaagcacuccagcaggccguuguggaugacgaugcuaacaaugccaaggcggucgugaagacuuuccaugagaccuuagacugcuguggauccucuacacugaccgcacuuacuacaucaguguugaaaaacaaucugugcccgagugguagcaacaucauuuccaaucuauuuaaggaagauugucaccagaaaaucgacgaucucuucucuggcaagcuguaccuuauugggaucgccgcuauagucguugccgugauuaugaucuucgagaugauucugucgaugguauugugcuguggaaucaggaacucaagcguguauuga

SEQ ID NO: 54083 - RNA, 729 nt, Artificial Sequence
  derived and/or modified sequence opt3 from CD82__Homo_sapiens__NP_001020015
augggcagcgccugcaucaaggugaccaaauacuuccuguuucucuucaaccuuauauuuuucauucugggggcugucaucuugggauuugguguuuggauuuuagcagacaaguccucuuucaucucagugcugcagacaaguagcuccucucuaagaaugggcgccuauguauuuauuggggugggagcggucacuaugcucaugggcuuccuggguuguaucggggcugugaaugagguuaggugccuucugggauugcucaaacaagaaaugggcggcauagugacggagcugauccgggauuacaacucgucacgcgaagacagccugcaggaugccugggacuauguccaggcacaggugaaguguugcggguggguaaguuuuuacaauuggaccgauaacgccgagcucaugaaucgacccgaaguuacauauccuuguuccugcgaggugaaaggagaggaagacaacucuuuaagcguccguaaggguuucugugaggcuccaggcaauagaacucaauccgggaaccacccggaagauuggcccguguaccaggagggaugcauggagaaggugcaggcauggcugcaggaaaaucuuggcauuaucuugggugucgggguuggaguggccauuaucgagcugcuaggcaugguacucucaauaugucugugcaggcaugugcacagugaagacuauagcaaagucccuaaguacuga

SEQ ID NO: 54084 - RNA, 618 nt, Artificial Sequence
  derived and/or modified sequence opt3 from CD83__Homo_sapiens__NP_004224
augagcagaggccugcagcuccuucuguuguccugcgccuacucuuuagcucccgcaaccccugaggugaaggucgccuguucagaagacguugaucugccaugcacagcgccgugggacccccaagugccuuauacuguaaguugggugaaacuacucgaagggggagaggagaggauggaaacgccacaggaggaucaucugcggggucagcacuaccaccagaagggccaaaacgggagcuucgacgcucccaaugagcgcccuuauucccuuaaaauccgaaacaccacaucuuguaauucgggaacuuaccguugcacccugcaggauccagacggccagagaaacuugucagguaaggucauucucagggugacagggugucccgcccagcggaaagaagagaccuuuaagaaguaucgcgcagaaauaguucugcugcucgccuuagugaucuucuaccugacucuuauuaucuuuacaugcaaauucgcuagauugcaaagcauuuuuccugauuucaguaaggcaggaauggagagggccuuucugccagucaccuccccgaauaaacaucuaggccucgugacgccccacaagacugagcugguauga

SEQ ID NO: 54085 - RNA, 1038 nt, Artificial Sequence
  derived and/or modified sequence opt3 from CD84__Homo_sapiens__NP_001171808
auggcccagcaccaucuguggauccuccuucugugcuugcaaaccuggcccgaggcugcaggcaaggacagcgaaauuuucacagugaacgggauauuaggagaguccgucacuuuuccuguuaauauccaggaaccaagacaggugaaaauuaucgccuggacgucuaagaccucaguagcguacgugacaccgggugauagugagacugcucccgucgugaccguuacacacaggaacuauuacgaacggauucaugcccugggcccuaauuauaaccuagugaucagcgaccuccgcauggaggaugcaggggacuacaaagccgauauaaauacccaggcugacccauauacuacaaccaagcgauacaaccugcaaaucuaucguagacuuggaaaacccaagauuacgcagucccugauggcaucugucaauucgacuuguaacgugaccuugacaugcucaguagagaaggaagagaaaaauguuacuuacaacuggagcccucucggcgaagaggguaaugugcugcagaucuuccagaccccagaggaucaagaacugacauacaccuguacggcccagaaccccgucaguaauaacuccgacucuauuagcgcuaggcagcucugcgccgauaucgcgaugggguuucggacucaccauacaggauuacuguccgugcuugcaauguucuuuuugcuggugcuaauacucucaagugucuuccuguuucgccuuuucaagagaaggcagggccggauuuuuccugagggcagcugucugaauaccuucacuaaaaacccauaugccgcuucuaagaaaacaaucuacaccuauauuauggccucccgcaacacgcaaccggcagaaucacgaaucuacgacgagaucuugcagagcaagguucuccccaguaaggaggaaccugugaauaccguauauucugaggugcaguuugcugauaaaauggggaaggccuccacacaagacagcaaaccacccggaacuucgucuuacgaaauugucauauga

SEQ ID NO: 54086 - RNA, 654 nt, Artificial Sequence
  derived and/or modified sequence opt3 from CD86__Homo_sapiens__NP_001193853
auggacccccagugcaccaugggccugagcaacauccucuucgugauggccuuucuucuguccgcuaauuucucucaaccugagauugucccaauaucaaacaucacagaaaauguuuacauuaacuugacuuguaguagcauccacggguauccggagcccaagaaaauguccguguuacugagaacgaaaaauucuaccauugaauacgauggaaucaugcagaagucgcaggacaacguaacagagcuauaugaugugucaauaagccucagugucuccuuuccugacgugacuucuaauaugaccaucuucugcauucuggaaacagauaagaccaggcuucugagcuccccauuuucaaucgaguuggaggacccccagccuccacccgaucauauuccuuggaucacugcaguucucccaacagugauaauuugugucaugguguucugccugauccuguggaaauggaagaagaaaaagcggccgcgcaacaguuacaaaugugguaccaauacgauggaacgagaggaaagcgagcaaacuaagaaacgugagaagauucacauccccgaaagaucugacgaggcccagaggguauuuaaguccucaaaaaccagcaguugcgauaagucugacacauguuucuga

SEQ ID NO: 54087 - RNA, 708 nt, Artificial Sequence
  derived and/or modified sequence opt3 from CD8A__Homo_sapiens__NP_001759
auggcccugcccgugaccgcucuccuucugccuuuggcauuacugcuacacgccgcgagaccaagccaguucagggucuccccgcucgaccggacauggaaccugggcgagacuguugaacuuaagugccaagugcuguugucuaaucccacgucaggguguaguuggcucuuucagccucgcggagcugccgcaagcccaaccuuccugcuguaccucucccagaacaaacccaaggccgcugaggguuuagauacacagcgauuuucuggcaaacgucugggggacacuuucguacuuaccuugucggauuuuagaagggaaaaugagggauauuacuucugcucagcacugagcaacaguaucauguauuuuucccauuucgugccugucuuucuaccagccaagcccacaaccacuccugcuccacggccgcccaccccugccccaacaauugcgucucaaccccucagccugcgcccugaagcauguagaccagccgcuggcggugccgugcacacgagggggcuugacuucgcaugcgauauauacaucugggcuccccuggccggaacuuguggcguuuugcuccuguccuuagugauuacccuguauugcaaucaucggaaccgccgaagagucuguaaaugcccgaggccugugguaaagucaggcgacaagcccagucucagcgcgcgguacguuuga

SEQ ID NO: 54088 - RNA, 597 nt, Artificial Sequence
  derived and/or modified sequence opt3 from CD8B__Homo_sapiens__NP_001171571
augagacccaggcuguggcuccuucuggccgcucaguugaccguguuacacggcaacagcguccugcaacagacuccugcauacaucaagguucagacaaauaaaauggugaugcuauccugcgaggccaagauuucucucucaaacaugcggauauauuggcugcgccagcgacaagcgccaaguagcgacucccaucacgaguuccuugcucugugggauucugccaaagggacgauccauggagaagaaguagagcaggaaaagauugcaguguuucgugacgccucgagauucaucuugaaucucaccucagucaaaccggaggauagcgguauuuacuuuuguaugaucgugggcagucccgagcugacauucgggaagggaacucagcuguccguuguggacuuucucccuaccacagcucagccaaccaagaaaucuacuuuaaagaaaagggucugccggcugccccgcccugaaacacaaaagggccuuaaagguaagguguaucaggagccauugagccccaacgcauguauggauaccacggccauacugcagccucacagauccugccuaacucaugggucauga

SEQ ID NO: 54089 - RNA, 1959 nt, Artificial Sequence
  derived and/or modified sequence opt3 from CD93__Homo_sapiens__NP_036204
auggccaccagcaugggccugcuccuucuguuguuacugcuacucacacagcccggggcuggaacuggugcagacacggaggccguggucugcguuggcaccgcguguuacacagcucacuccgggaagcugucugccgcagaagcccaaaaccauugcaaucagaacggaggcaaucuugcuacugugaaaucaaaggaggaagcacagcacguacagagagugcuggcccaauugcucaggcgggaggcugcccugaccgcgcgcaugaguaaauucuggaucggucugcagcgagaaaaggggaaaugucucgauccuagcuuaccacugaagggauuuuccugggucggcggcggggaggacacaccguauucuaacuggcauaaggagcuucguaauucgugcauuucaaaaagaugugugagcuugcugcuagaucucagucagccccugcuuccuuccaggcugccaaaguggucugaaggacccugcgguagcccuggcuccccagggucaaacauagagggauucguuuguaaauuuaguuucaagggcaugugccggcccuuggcacucggugggccuggacaggugaccuacacuacaccauuucaaaccacgucuagcucccuggaagccgucccguucgcuucagccgcaaauguggcuuguggcgagggcgacaaagaugagacucagagccacuacuuuuuaugcaaggaaaaggcccccgacguauucgauugggggaguucuggaccucuguguguuuccccaaaauaugguugcaacuuuaauaacggcgggugccaucaggacuguuucgagggaggcgaugguagcuuucucugcgggugucgccccggcuucagacuucuggacgauuuggugaccugcgcgucgaggaauccuuguucuuccucaccaugccggggaggcgccacauguguccuagggccccacggaaagaacuauacuugccgcuguccgcaggguuaccaacuggacaguagccagcucgauugcguggacguggacgaaugucaggauuccccuugcgcacaagagugcgucaauacccccggcggguuucgaugugaaugcuggguuggauaugagccaggcgguccuggggagggcgcuugucaggacguggaugaaugcgcccugggaagaucucccugugcucagggcugcacaaacaccgacgggagcuuccacuguucaugcgaggaaggauacguacuugccggugaggauggcacgcagugucaagacguggaugaaugcgucgggccaggaggcccccugugugacaguuugugcuucaauacucaggguuccuuucauugcgggugucucccuggcugggugcuggcaccaaacggaguuagcugcacaaugggcccggugucuuuagggcccccuucaggaccacccgaugaggaggacaaaggcgaaaaggaggguaguaccgucccuagggccgcuacugcgagcccaacacgggggcccgaaggaaccccgaaagcaacgccuaccacaucccguccaucucugucgagcgaugcccccaucacuuccgcuccucuaaagaugcucgcccccucaggcaguccagguguguggcgcgagccuucuauucaccaugcaaccgccgcuagcggcccccaggaaccagccgggggagacuccucaguagcaacacagaacaaugacggcacugaugggcaaaaacugcuuuuguucuacauccugggaaccguuguggcgauucuccugcuucuggcuuuggcccucggccuguuagucuauagaaagaggcgggcaaagcgagaggagaaaaaggagaaaaagccgcagaacgccgcugacagcuacucuugggugccugaacgcgccgaauccagagcaauggagaaucaguauagucccacaccagguaccgauuguuga

SEQ ID NO: 54090 - RNA, 1710 nt, Artificial Sequence
  derived and/or modified sequence opt3 from CD96__Homo_sapiens__NP_005807
auggagaagaaauggaaguacugcgccguguauuacaucauucagauacacuucgucaaaggcguuugggaaaagaccgugaacacagaggaaaauguauaugcuacucuggggagcgacgugaaccucacgugucaaacccagacagucggauuuuucgugcagaugcagugguccaaaguuacuaauaagaucgaucuuauugcaguguaccauccccaauaugguuuuuacugcgccuauggcagaccuugugagucucuggucaccuucacagaaaccccagagaacgggucaaaguggacuuugcacuuaaggaauaugaguugcagcguguccggacgguacgaguguaugcugguacuauacccggaaggcauccagacaaaaauuuauaaccuccugauccagacccauguuacggcggacgaguggaacucuaaucacacuauagaaaucgagauuaaucagacccuugagauccccugcuuucaaaacucgucaagcaagauuaguuccgaguucacauacgcuuggucuguggaagauaaugguacucaggaaacccugaucagccagaaccauuugauauccaauucaacacuccugaaagaccgcgucaagcuggggaccgauuaucgacuccacuuaaguccugugcagauuuuugacgauggacguaaauucagcugucacaucagagugggcccaaacaagauucugaggucuuccacgacugucaagguuuuugccaaacccgagaucccugugaucguagaaaauaacucaacagacgugcuugucgagcggcgcuuuaccugcuugcugaagaacguguucccaaaagcaaauauuacuugguucauagauggcagcuuucuacaugacgagaaggaagggaucuacauuacaaacgaggaaagaaaaggaaaggaugguuuccucgagcugaaaaguguucuuaccagggugcacucuaauaagcccgcccaauccgacaaccugacgaucugguguauggcuuugagcccugucccaggcaauaagguguggaacauaucgucugagaaaauuaccuuccuccugggguccgaaaucucaaguacagauccgcccuuaagcguaacugaguccacccuggacacacagccuucuccagcaagcucaguuagucccgcccgguauccugcuacuuccagcgugacccucgucgacgugucugcccuucgcccaaauacaacuccccagccgucaaacaguagcaugaccacgcgaggauuuaauuacccuuggacauccucuggcaccgauacuaagaaaucggucagcagaauccccuccgaaaccuauucaaguucuccaagcggugcgggguccacacugcaugacaacguguucaccucaacugcaagggccuuuagcgagguuccuacaacggcuaauggaucuaccaagacuaaccacgugcacauuacaggcaucguagucaauaaacccaaggauggcauguccuggccagugauuguugccgcauugcuauucugcuguaugauacuguuugggcucggagugcggaaguggugccaauaccagaaagaaaucauggagcgucccccuccauucaagccgcccccuccacccauuaaauauaccugcauccaggaaccuaacgagagugaccugccauaccaugagauggaaacacuuuga

SEQ ID NO: 54091 - RNA, 510 nt, Artificial Sequence
  derived and/or modified sequence opt3 from CD99__Homo_sapiens__NP_001116370
auggccagaggcgcugcacuggcccuccuucuguucggguuguuaggagugcuggucgcggcucccgacgguggcuuugaucuaagcgacgcccucccuggggaugacuucgaucugggagacgcaguuguggauggcgagaacgacgauccaaggccgcccaauccuccaaagcccaugccuaacccaaaucccaaccacccuuccucuucagguaguuuuagcgacgccgaucuugcugacgggguauccggaggcgaaggcaaagggggaucugaugguggcgggucgcaucggaaggagggagaagaggcagacgccccaggcgugaucccggguauugucggggcugugguuguggccgucgcgggagcaauaagcucauucaucgccuaccagaaaaagaaacugugcuuuaaggaaaaugcugagcaaggcgagguggacauggaaagucaccgcaacgccaaugcagagcccgcuguacagcgaaccuugcucgaaaaguga

SEQ ID NO: 54092 - RNA, 687 nt, Artificial Sequence
  derived and/or modified sequence opt3 from CD9__Homo_sapiens__NP_001760
augcccgugaagggcgggaccaaaugcaucaaguaccugcucuuuggauuuaacuucauuuucuggcuugccgguauagcuguccuggcaaucggcuugugguuaagauucgacagccagacaaaauccauuuuugagcaagaaacuaauaacaauaacucuucauucuauacggggguuuacauccugauuggagccggcgcgcuaaugaugcucguggguuuucugggguguugcggagcuguacaggagagucaguguaugcuuggccuguucuuuggcuucuugcucgugaucuuugccauagaaaucgcagccgcuauuuggggguauagccacaaggaugaggucaucaaagaagugcaggaguucuacaaggacaccuauaauaagcugaaaacaaaggaugagccucaaagggaaacucugaaagcaauucauuacgcccucaacugcuguggauuagcugguggcguugagcaguuuaucuccgacauaugcccaaagaaagaugugcuggaaaccuucacagucaagucuuguccggacgccauuaaggagguguucgauaauaaauuucacaucauuggggcgguaggaaucggcaucgcaguugugaugauuuucgguaugauauuuucgaugauccuuugcugugccauucggcgcaaccgagagauggucuga

SEQ ID NO: 54093 - RNA, 1476 nt, Artificial Sequence
  derived and/or modified sequence opt3 from CDADC1__Homo_sapiens__NP_001180407
augaaggaggccggccagaugcaaaaccuggaaagcgcuagagcagggagguccgugucuacccagacaggaucaaugacuggucagaucccccggcucaguaaagucaaucuuuucacgcuguugagcuuauggauggagcuguuuccugccgaagcgcagcgccaaaagucccagaaaaacgaggaaggcaagcacgggccacuaggagacaaugaggagcgaacccguguuucuacagauaaaagacaggugaagaggacuggccucguaguggucaagaacaugaaaauugugggucugcauugcucgucagaagaccuucacgcugggcagauagcccugaucaagcauggaagccgguugaaaaauugugaucucuacuucagucgcaagccgugcuccgcaugucugaaaaugauuguuaacgccggcgugaauagaaucucuuauuggcccgcugacccugagauuagccugcucaccgaagcauccucaagugaggaugccaaguuagacgcuaaggccgucgagaggcugaaaagcaacucucgggcgcacgugugcguacuuuugcaaccacugguuuguuacauggugcaguuugucgaagagacauccuauaagugcgauuucauccagaaaauaaccaagacucuacccgacgcaaauacagauuuuuacuaugaauguaaacaggagcgcaucaaggaauacgagaugcuguuccucgugucaaacgaggaaaugcauaaacaaauucuuaugaccaucggccuggagaauuugugcgaaaacccuuauuuuagcaaucuccgacagaacaugaaggaccugauuuuacugcucgccacgguggcuaguucugucccaaauuucaagcacuuuggguucuacagauccaaccccgagcagaucaacgaaauacacaaucaaagccuuccucaggagauugccaggcauuguaugguucaggcacggcuguuggcuuaccguacugaggaucacaaaaccggagugggugccguaaucugggcggaaggcaagucgcgcucuugcgacgggacaggagccauguauuuugugggcugugguuacaacgcauucccagucggguccgaguaugcugauuuuccgcauauggacgacaaacagaaggauagagaaauuaggaaauuccgguacaucauccacgccgagcaaaaugcucuaacuuuccgaugccaggaaauuaagcccgaggagcgcucaaugauauuugugaccaagugcccuugugacgaaugcguuccacugaucaaaggagccggcauuaagcagaucuaugcaggcgauguggacgucgggaaaaagaaagccgauauaaguuacaugagauucggagagcucgaaggugugagcaaguuuacauggcagcugaaccccuccggcgcuuaugggcuugagcaaaaugagccugaaaggcgggagucuuga

SEQ ID NO: 54094 - RNA, 3684 nt, Artificial Sequence
  derived and/or modified sequence opt3 from CDAN1__Homo_sapiens__NP_612486
auggccgcugugcuggagagccuccuuagagaagaggucuccguugcagccgugguaagguggaucgcgcggucuacccagggcucagaagacaacgcuggggaggccgcagcccugaguagcuugcgcgcuuuacgaaaggaguucgugcccuuucugcuaaauuuccuccgugaacaauccucuagaguccugccucagggaccaccgacacccgcaaaaacuccuggugccucggcugcccuuccaggcaggcccgggggaccuccacggggcucacgcggugcgagaagccagcuguuucccccuacggaggcacagaguaccgccgcugaagccccauuggcaaggcggggagggcgccgaagaggcccgggccccgcuagggagcggggagggcguggucucgaagagggcguguccggggagucucugccuggagccggcggucgcagacugagggggagcggauccccaucacggcccagucucacauuaagcgauccuccaaaccugucuaaucuugaagaguuucccccgguuggcuccgugccucccggcccaacugggaccaagccuucacgacgcauuaaccccacaccagucagcgaagagagaaguuugucuaaacccaagaccugcuuuacuuccccuccaauaagcugugugccgucgucucaacccuccgcgcuggacacaucaccuuggggacuaggucucccacccggcugcaggagucugcaggaggaacgggagaugcuucgcaaagaaagaagcaagcagcugcagcaauccccuaccccaacgugucccacuccggaguuggggucuccucucccaagcaggaccggaucacugacagaugaacccgccgacccugcacguguaaguucccggcagcgauuagagcugguugcucucguguacagcucuugcaucgccgaaaaucuuguccccaaccuguucuuggagcuauuuuucguguuucagcugcucacugcuagaaggauggugaccgccaaggauucagacccagagcugaguccugcaguccuugauagccuggaaucccccuuguuccagucuauucacgacuguguuuucuucgccgugcaaguacucgagugccauuuucaggugcugucgaauuuagauaaaggcacacugaagcuacucgcugaaaacgagcgccugcuuuguuucagcccagcguugcagggucggcugagagcagccuaugaaggguccgucgcuaaagugucacucguuaugccgccuaguacccaagccgugucuuuccagcccgagacggacaauagggcaaacuuuagcuccgaucgcgccuuccacacuuuuaagaaacagcgagacgucuucuacgaggugcugcgggaaugggaggaucaucacgaggaaccaggcugggacuuugagaagggacuuggcucacguaucagagcuaugauggggcagcugagcgccgcaugcucucauucccacuucguaagguuguuucaaaagcagcuccugcagaugugucagagucccggaggugcgggcgggacaguuuuaggagaagcuccugacgugcugagcaugcuaggcgccgauaaacucggucgccuguggcggcuucaagagagauugauggcaccacagucuuccgggggccccugcccuccgccaaccuuccccggaugucagggcuuuuucagggacuuuauucugucagccaguagcuuccaguuuaaucaacaccucauggauucgcuguccuuaaagauccaggaacugaacgggcuugcuuugccucagcaugagccaaaugacgaagauggagagucugacgucgauuggcagggugagcgaaaacaauucgccgugguccuccugagccuacgccugcucgcaaaguuccugggcuuuguggcuuuccuucccuaucgggggccugaaccgcccccaacuggagaguugcaggacucaauacuggccuuaagaagucagguuccucccgugcucgauguaaggacacugcuucaacguggccugcaggcgcgccgggccgucuugaccgugccauggcucguugaauuucuguccuucgcugaccacguggucccucuacuggaguacuauagagauaucuuuacgcuccugcuuagguugcaucgaucucugguguuaagccaggaauccgaggguaaaaugugcuuccucaacaagcugcuucugcuagcaguacucggguggcuguuucagauucccaccgugccagaggacuuguucuuucuggaagagggcccgucauacgccuucgaaguugacacagucgcuccugagcacggauuagauaaugcccccgugguggaccaacagcuccuguauacuugcuguccauacaucggcgaacuucggaaacuguuggcaagcugggucagugggucuuccggacgcagcggcgguuuuaugagaaagauuacccccacaacuaccacaucgcucggggcgcagccuucacagaccucucaaggacugcaggcccagcuagcucaggccuucuuucacaaccaaccacccagucugaggcggacuguugaguucguggcagagcgaaucggcuccaacugcgugaagcauauaaaagcuacgcuuguagccgaucucgucagacaggcagaaagccuguugcaggagcaacuggugacacagggugaagagggcggggacccugcccaguuacucgagauucuguguucucagcuuugcccgcacggagcucaagcgcuggccuugggccgcgaguucugucagcguaagagcccaggggcaguuagggcucuccugcccgaagaaaccccugccgccgugcuauccucagcugagaauaucgcagucggacuggccacugaaaaagcgugcgcuuggcuuagugccaacauuaccgcacucauccggagagaggugaaggccgcuguuagcaggacacugcgcgcacagggccccgagccagccgcgcgaggugaaagacggggguguucuagggcuugcgagcaucacgccccuuugcccucccauuuaaucucagaaauuaaagaugugcugagucucgcaguaggaccacgcgacccugaugagggcgucagcccggaacaccuggagcagcuucugggucaauugggccagacccuacguuguagacaguuucugugucccccagccgagcagcaccucgcuaagugcuccguggaacuggccucucuuuuaguggcagaccaaauaccuauccuggggcccccagcucaguaccggcucgagaggggacaggcccgccgauugcugcauaugcuccugucgcuuuggaaggaagauuuccagggcccugucccccugcaauugcuacugagcccgagaaauguugggcucuuagcggacacucggccaagggagugggaucugcuucuguuucucuugcgcgaacugguggagaaaggacucaugggcagaauggagauugaagccugccuggguucacuucaccaggcacaguggccuggggacuucgcugaggaacuagccacacuguccaacuuguuuuuagcugagccccaucugccagagccccaacucagggcaugcgaacugguacagccuaaucggggaacggugcuugcccagaguuga

SEQ ID NO: 54095 - RNA, 1011 nt, Artificial Sequence
  derived and/or modified sequence opt3 from CDC123__Homo_sapiens__NP_006014
augaagaaagagcacgugcugcauugccaguucagcgccugguaccccuuuuucagaggcgucaccaucaaguccguuauucucccucuuccacaaaacgugaaagacuaucuguuggaugacgggacauuaguagugucuggaagggaugacccgcccacucacucacagccugauagugacgaugaagcugaggaaauacaguggagcgacgaugagaauacggcaacccugacagccccagaauuucccgaguucgcgacuaagguccaggaggcuaucaacucccuagguggcucuguguuuccuaaacucaauuggucggccccacgggacgcauacuggauugccaugaacucaagccugaaguguaagacccuuagugauaucuuccuguuguuuaaauccucugacuucauuacacgcgauuuuacccaacccuucauccauugcacugacgacagcccugauccauguauagaauaugagcucguucugcgaaaguggugcgaacugaucccgggggcugaguuucguuguuucgugaaagagaauaagcucauuggaaucucccagagagacuacacacaguauuacgaucacauuucaaaacagaaggaagagaucaggcggugcauacaagacuuuuucaagaaacauauucaguauaaguucuuagaugaagacuuugucuucgauaucuaccgcgacaguagaggcaaaguguggcugauugauuuuaaccccuucggugagguaaccgacagccuuuuguuuacgugggaggaacugaucucugagaauaaccuaaauggggauuucuccgaaguugacgcacaggagcaggacagcccugccuuuagguguacuaacucagaagugaccguccaaccaagucccuaccucucuuaucggcugccuaaggauuucguggaccuuuccacaggagaggaugcucacaaacugaucgacuuuuugaagcucaaacgcaaucagcaggaagaugacuga

SEQ ID NO: 54096 - RNA, 1836 nt, Artificial Sequence
  derived and/or modified sequence opt3 from CDC14A__Homo_sapiens__XP_011540643
auggacuucccccugggccagugcagacucguguguagcucccuuuacauguggcuggccaagagggaggauggggcugcaaucuugaacaugccuucuccaucauuuuaugccgacuucggaccguuaaaucuggcgauggucuaccgguauugcuguaaacuaaacaagaaacucaagaguuacagccugucccgcaaaaagauuguucacuauaccugcuuugaucaacgaaagcgugcuaaugccgcauuccuuauaggugccuacgcugugaucuaucugaaaaagacacccgaagaggcauacagagccuugcucucuggcucgaacccuccauaccugcccuuuagggacgcuucauucgggaauuguacuuauaaccugacgauucucgauugcuuacagggaauccggaaaggccugcagcauggguuuuucgacuuugaaaccuucgauguagacgaguacgaacacuaugagcgcguggagaauggugauuuuaacuggauugucccuggaaaguuccuugccuuuagcggcccacaucccaaaaguaagaucgaaaauggcuacccuuugcacgcgccagaggcauauuucccguacuucaagaaacauaacgugacagccguugugagacugaauaagaaaauauaugaagcuaagagguuuacugacgccggguucgagcacuacgaucuauuuuucaucgacggauccacccccucugauaacauuguccggcgcuuucucaauaucugugagaacacagaaggugcaauugcugugcacugcaaagccggccuggggcgaaccggaacucuuaucgcguguuacguaaugaagcauuauagauucacacacgccgagauaauugcauggaucaggauuugccggccuggcagcaucaucgguccacagcaacauuuucuggaagagaaacaggcuuccuuguggguucagggggacauuuuccguucaaagcucaagaaucgccccaguagcgaaggaucuauaaacaaaauccuguccggcuuagacgauaugucaauuggcgggaaccugagcaagacccagaauauggagagauuuggagaggacaaccucgaagaugacgauguggagaugaaaaaugguaucacgcaaggcgacaaacuuagggcccugaagagucagcggcagccucgaacuucuccauccugugcuuuccgcagcgaugacaccaaggggcaccccagagccgucucgcagccguuuagguugucuuccucacuacaaggaagugcagugacacugaagacuagcaaaauggcccucuccccuucugcuaccgcgaagcggauaaaccgcacaagccugucaaguggcgcaaccgugagauccuucagcauuaauucuaggcuugccucaagucuggguaacuugaaugcugccacggaugaccccgaaaacaaaaagacuagcuccucuucgaaagcaggguuuacagccagcccauucaccaaucuccugaacggcuccucacagccuacuacacguaauuaccccgaguuaaacaauaaccaguauaaucggaguucuaacagcaacggaggcaaucugaacuccccacccgggccucacucagcuaagaccgaggaacauacgaccauccuacgaccaagcuacacaggacucucuuccaguagcgccagauuccugucuagguccaucccggucucagcacaaacucccccuccagguccccagaauccugagugcaacuuuugcgcgcuuccaagucagccccgcuugccgccuaagaaauucaauagcgcuaaggaagccuuuuga

SEQ ID NO: 54097 - RNA, 1386 nt, Artificial Sequence
  derived and/or modified sequence opt3 from CDC14B__Homo_sapiens__NP_001070649
augagcagagagggcgccggggcugcacugguggccgaagucaucaaggacaggcucugcuucgcgauucuuuacucccggcccaaaucugcuucaaacguucacuauuuuaguauagauaaugagcuggaauacgagaacuucuaugccgacuuuggaccuuugaauuuagcaaugguguaccgcuauuguugcaagaucaacaaaaagcugaaaagcauuaccaugcuacgaaagaagaucguacauuucacagguuccgaucagcguaaacaagccaaugcugcauuucucgugggcuguuacauggucauuuaucuggggagaacuccagaagaggccuacaggauccuuauauucggagagacgucuuacaucccguuucgggacgcugccuauggcucgugcaacuucuacauuacccuguuggauuguuuucacgcggugaagaaagcaaugcaguaugguuuccucaauuuuaacucauucaaucuggacgaauacgagcauuaugaaaaggccgagaacggggaucugaauuggaucauucccgaccgcuuuaucgcuuucugcggaccucacagcagagccaggcucgagaguggcuaccaucagcacuccccagaaacauauauacaguacuucaaaaaccacaauguuacuaccauuauccgguuaaacaagcgcauguacgaugcaaagcgauuuacagacgcuggcuucgaucaucacgaccuguuuuucgccgaugggucuacccccacugacgcgauugugaaagaguuucuugacaucugugaaaaugccgagggagcaaucgcuguccauugcaaggccgguuugggcagaacagggacccugauugcuuguuauauaaugaaacacuacaggaugacggccgcagaaacuaucgccugggugcggauuugccguccuggaagcguaaucggcccacaacagcaguuccuaguuaugaagcagaccaaccucuggcuggagggugauuauuuucgccaaaaacuuaaggggcaggagaacggacagcacagagcugcguucuccaaacuguugucaggcguggacgauauaaguauuaauggcgucgaaaaccaggaccaacaggagcccgaaccuuacagcgaugacgaugagaucaauggggugacacagggagacaggcuccgggcacugaagucucgacgccaauccaagacuaacgccaucccauuaaccgugauucugcagucaagcguccagaguuguaaaacaucugaaccgaauaucuccgguagcgcuggcauuaccaagagaacgacuaggucggccucucggaaauccucaguuaagagucucagcauaucccgcacaaaaaccgugcuuagauga

SEQ ID NO: 54098 - RNA, 1863 nt, Artificial Sequence
  derived and/or modified sequence opt3 from CDC16__Homo_sapiens__NP_003894
augaaccuggagagacucaggaagcgggugcgccaguaccuugaccaacagcaguaucagagcgcccuguucugggcugauaaagucgcauccuugucucgagaagaaccccaagacaucuacugguuagcccagugccuguaucuaaccgcgcaguaccaccgugcugcccaugcacucagaucaaggaagcuggauaaacuuuaugaagccugucgguaccuggcugcacgcugccacuaugccgcuaaggagcaucagcaagccuuggacguucucgauauggaagaaccuauuaauaaaagacuguuugagaaguaccugaaggacgaaaguggcuucaaagauccaagcuccgacugggagaugucucagucgucaauaaagagcaguaucugucucuuaagggggaaaauuuacgaugcgcuggacaaccggacacuugcaacuuauuccuacaaggaagccuugaaacuggauguguauugcuuugaggcuuucgaccuacucacgucucaccauaugcugaccgcccaggaggaaaaggagcuucuggagagcuugccgcucuccaagcuguguaaugaggaacaggaguuacugcgcuuucucuucgagaacaaacuuaagaaauacaauaagcccucagaaacaguaaucccugagaguguggauggacugcaagaaaacuuggacgucgugguuagccuagcagagcgacacuauuacaauugcgacuuuaaaauguguuauaagcugacuucuguggucauggaaaaagauccauuccacgcuuccugccuccccgugcauauugguacccugguagagcuuaacaaggccaaugagcuguuuuacuugucacacaagcucguugaccuguacccuagcaacccagugaguugguucgcggucggcuguuauuacuuaaugguggggcauaaaaaugaacacgccagaagguaucugucuaaggcaacaacccuagagaaaacuuacggacccgcuuggaucgccuauggccacuccuuugcuguggaaagcgagcaugaucaggccauggcagccuacuucacagcugcgcagcucaugaaggguugccacuuaccuaugcuuuauauaggguuggaauacggacugaccaacaauucgaaacucgcagagcgguuuuucucucaagcccuguccaucgcuccagaggacccguucgucaugcaugaaguuggcgugguagccuuucagaacggcgaguggaagacggcagaaaagugguuccuugaugcccuggagaaaauuaaggcuaucgggaaugaggugacugucgacaaaugggaacccuugcucaacaaccugggacacgugugucguaagcugaaaaaguacgccgaggcacuggauuaucaucgccaggcgcuaguucucauuccucagaaugcuucaaccuacagugccaucgguuauauacacagccugaugggcaacuuugaaaaugcaguggacuacuuccacacagcccuuggguugagaagggaugacacuuuuuccgucaccaugcugggacauugcauugagauguauaucggcgauucugaggcuuacauuggugccgacaucaaggacaaacucaagugcuaugauuucgacgugcacacaaugaaaacccugaagaacaucauuagcccacccugggauuuucgggaguucgagguagaaaaacaaacggcagaggaaacuggguuaacaccucuggagaccucacgaaagacuccagacagucgccccucccuugaagagacauuugagauagaaaugaaugagagcgauaugauguuggaaaccucuaugucagaccauaguacguga

SEQ ID NO: 54099 - RNA, 1434 nt, Artificial Sequence
  derived and/or modified sequence opt3 from CDC20B__Homo_sapiens__NP_001139206
auggaguggaagcuggaaagaaccgcccccaggcgggugcgcacagaggaagagaugcucugggaaagcaucaugcgaguccuuuccaaagaccugaagcagaaacguucucaagauucagcuaacguuuuggacagugugaaugcaacuuacagcgauuucaaguccaacuuugccaaaagauuaucugcggagguaccuguggcuucgucaccaauuacgaccagguggcagcagagccagacacgggcccugaguuccgacucuuucggcgaggaacaaagcacuaccuaucuaccggaggcauccgggucaguccucaagacacccccugaaaaggagacccugacucuuggaagucgcaaagagcagcugaagacaccaagcaaagguauaucugaaaccuccaauucagccuugcacuuuugcaaggcuccccaugcaauggauagagacuggaaagagagcguggccaguaagggccagaagugucucaaacagcuguucguuacgcaaaacgugguccagcaggcuaaugggaagaugcagcugugcgaacaaucugaguguguguggaaaggaugcaaggauggcguaagggacgaauccuuucaccucaaaagcucgggugauaucaacgacucuauuuuacagccugagguuaagauccauauuacugggcugcggaaugauuacuaucuuaacaucuuggacugguccuuccagaaucugguggccauagcgcuaggaucagcagucuacaucuggaacggcgagaaucacaacggcauugaaaauaucgaucucagucugaccuguaacuauauuagcuccgugucuuggaucaaagaggggacaugccuugccgugggaacuagcgaaggugagguccaacugugggacguugugaccaagaagcgcuugcgaaauaugcucggccaucugucaguagugggggcuuuaaguuggaaccacuuuauacuguccagcggaucuagacucggcagggucuaccaccaugacgugcggguugcccagcaccauguggguacacuucgucacaaacaggcagucugugcucugaaguggucaccagaugggcgcuugcuaaguagcggaugcuccgacggccugcucaccauuuggccccacgauccuggcgccucugcgcaggggcaaccacugaaagugaucacgcagucgacugccguaaagauuuguagccuuaucuggcugccgaaaacaaaggaaaucgcaaccggacaggguacucccaagaacgacguuacaguguggaccugcccuacggucuccagaucaggcggguucuuuggacauaggggccggguguugcaccucagucugucuccagaucagacccgagucuucagcgcugccgcugacgguacagccuccguguggaauuguuauuga

SEQ ID NO: 54100 - RNA, 1794 nt, Artificial Sequence
  derived and/or modified sequence opt3 from CDC23__Homo_sapiens__NP_004652
auggccgcuagcaccuccauggugcccgucgcaguuacagccgcgguggcuccuguacugucuaucaacucagacuucagugaucucagagagauuaagaaacagcuucuguugauagccggcuuaacuagggaacgggggcugcuacacagcuccaaguggucugcagagcucgccuuuucgcugccagcacuuccgcuggcugaauugcaacccccuccacccaucacggaggaagacgcccaggauauggacgcuuacacccucgccaaagcguauuucgaugugaaggaguacgaccgcgcagcccauuuucugcacggaugcaauucaaagaaggcuuauuuccuguacauguauagccgauaccucaguggugagaagaaaaaggaugacgaaacagucgauuccuuaggcccucuggagaaaggacaggugaagaacgaagcccuucgugaguugagaguugagcugucuaaaaagcaucaggcaagggaacuagacggguuuggccucuaucuguacggugugguccuucggaagcuggauuuggugaaagaggcuauugacguauucguugaagccacucacgugcucccacugcauuggggagcgugguuagagcuguguaaucucaucaccgauaaggaaaugcuuaaauuucugagcuugcccgacacauggaugaaggaguucuuucuagcccacauuuacaccgagcugcaacucaucgaagaggcacugcagaaauaucagaaccuuauagacgucggguucuccaagucaaguuacaucgugagccagauugcuguggccuaucacaauauccgcgauauugacaaagcucugucuaucuuuaacgaauugagaaagcaagauccuuacaggauagagaauauggacacuuucuccaaccuccuguauguccggucaaugaaaagcgaauuaaguuaccuggcccauaaucuaugcgagauugauaaauaucgcguugagacauguugcgugaucggcaacuacuacucucuccgaucccagcacgaaaaggcagcccuguauuuucagagagcucuuaaauugaauccaagguaccugggcgcguggacccucauggggcaugaguauauggaaaugaagaacacgagcgcagccauucaggcuuaccggcacgccaucgagguaaauaaacgugacuaucgcgcaugguacggacugggucaaacuuaugaaauccuuaagaugccguucuacugucuguacuauuacagaagggcccaccaguugcggcccaacgauucgcgaaugcucguggcucugggcgagugcuaugagaaguuaaaucagcuggucgaagccaaaaaguguuacuggcgcgcauaugcggugggggacguugagaaaauggcucuagugaagcucgccaaacugcaugaacaacuuaccgagucugagcaggcagcccagugcuacauuaaguauauacaggauaucuacuccuguggagaaauugucgagcacuuggaagagucaacagcuuucagauaccuggcccaauauuacuuuaagugcaaacucugggacgaagcaaguacuugugcucagaagugcugcgccuucaacgauaccagggaggagggcaaagcgcuguuacggcagauccugcagcuucgcaaccaaggugaaacaccuaccacggaggugccagcccccuuuuucuugccugcuagccucuccgcaaauaacacuccaacaagaaggguaucuccccugaaucuaagcucaguuaccccguga

SEQ ID NO: 54101 - RNA, 1575 nt, Artificial Sequence
  derived and/or modified sequence opt3 from CDC25A__Homo_sapiens__NP_001780
auggagcugggccccgaaccuccacacagaaggcggcuccuuuucgccugcagcccgcccccugcuucccagccaguggucaaggcacuguuuggggccucugcggcuggagguuugucacccguuaccaacuuaacagugacuauggaccaacugcagggccuagggagugauuacgagcagccucucgaaguaaagaauaacagcaaucugcagcgcaugggauccucugagucgacggacucaggcuucugucuugauagcccagguccccuggacaguaaggaaaacuuggagaauccuaugcgacguauccauucccucccacaaaaacugcuggggugcucuccggcccucaagagaagccacuccgauucauuagaccaugauauuuuucagcugauagaccccgaugagaacaaagaaaaugaggcauucgaauuuaagaagccugugaggccagucagucggggaugucuucacagccauggcuugcaggagggcaaagaccuguucacccagcgccaaaacucugcccccgcuagaaugcuauccucaaaugagagggauagcagugaaccugggaacuuuaucccacucuucacaccccagucuccggugacugcaacccuguccgacgaggaugacggauuuguugaccuucuggauggugaaaauuugaagaacgaggaagagacaccuagcugcauggccucgcucuggaccgcuccccuggugaugcggacuacaaauuuagacaaccgcuguaaacuguucgauucuccaucccucugcucaaguagcacccgauccguccuuaagagaccugagaggucucaggaagagucacccccaggcagcacgaaacggcguaagaguauguccggggccagccccaaggaaucuacuaauccugagaaagcgcacgaaacccugcaccagucauugagucuagcaagcuccccaaagggaacaauugagaacauccuggacaacgauccgcgcgaccucauuggcgauuuuucuaaagguuaucuguuccauacuguggccgggaagcaccaagaccuuaaauacaucucgcccgagauaauggcuagcguacugaauggaaaguuugccaacuugaucaaagaguucguuauuaucgauuguagauauccuuacgaauaugaaggcggccauauuaagggggcagugaaucuccacauggaggaagaggucgaggacuuccuguuaaagaaaccaaucgugcccaccgauggaaagagggugauagucguuuuucacugcgaguucuccucagaacgggguccucgaaugugucgcuacgugagagaaagggaccggcugggcaacgaguauccaaaacuacauuaccccgagcucuacguacugaaagggggauauaaagaauuuuucaugaagugccagaguuacugugagccgccuucuuaucgcccaaugcaccaugaagacuuuaaggaggaucuuaaaaaguucagaacaaaaagcaggaccugggcuggcgaaaaguccaaacgugagauguacucacgguugaagaagcuguga

SEQ ID NO: 54102 - RNA, 1551 nt, Artificial Sequence
  derived and/or modified sequence opt3 from CDC25B__Homo_sapiens__NP_001274445
augcacagcgagacccccaagucccaggugggcacacuccuguucagaucuaggucacggcuuacucaucugaguuugagccgccgagccuccgaaucuucguuaucaagcgagaguuccgaaucuagcgacgcugggcugugcauggauuccccuucaccaauggacccgcacauggcagagcaaacguuugaacaggccauccaggcggcuagucguauuauaagaaacgagcaguucgccaucaggcgguuucaaagcaugcccguccgccuacucggacauucuccuguucugagaaauauuaccaacucccaggcaccagaugguaggcggaaaucagaggccggcagcggggcugcaaguucuuccggagaagacaaggagaaugauggcuucguguuuaaaaugcccuggaagccuacacacccaagcucgacucaugcccuugcugaaugggccucucgccgagaggcguucgcacagagacccuccucagccccugaccugauguguuugaguccagauaggaaaauggagguagaggaacucagcccgcuggcucugggucgguuuucccucacccccgccgaaggggacacagaggaagaugacggauucguggauaucuuagagucugaccugaaggaugacgacgcagucccuccaggcauggagagccuuauuucagcucccuuggugaagacccuggaaaaagaggaagagaaggaucuaguuauguacaguaaaugccagcgucucuuucgcuccccuagcaugccauguucugugaucagacccauacugaagaggcuugaacggccgcaagaccgagauacuccuguccagaacaaacgcagaaggucagugacacccccagaggagcagcaggaagccgaggaaccuaaggcgcggguacugcgcaguaagagcuugugccacgacgagaucgaaaaucuccuggauuccgaccacagagaguuaauuggcgauuauucuaaagccuuccugcuccaaaccguugacgggaagcaucaggaucuuaaauacaucucgcccgagacgaugguggcacuguugacuggaaaguuuagcaacauugucgacaaauucgugaucguggauuguagguauccauacgaauaugaggguggccacauaaagaccgcugucaaucuaccccuggaacgugacgccgaguccuuucuccugaaaucaccuauugcuccaugcagucuugacaagcggguuauccugauuuuccauugugaguucucuagcgaacgagggccgagaaugugcagguuuauccgcgagcgggauagagccgugaacgacuaccccuccuuguauuacccugaaauguacauccucaagggaggcuauaaagaguucuuuccacagcaccccaauuucugugaaccucaagauuacaggccaaugaaccacgaggcauuuaaggacgagcugaaaacauuccgcuuaaagacucgaucaugggccggugaacggagccguagagagcugugcucuaggcuacaggaucaguga

SEQ ID NO: 54103 - RNA, 1422 nt, Artificial Sequence
  derived and/or modified sequence opt3 from CDC25C__Homo_sapiens__NP_001274511
augagcaccgagcuguucuccucuacaagagaagagggcucaagugggagcggacccuccuuuaggucuaaccagcggaagaugcucaaucuucuguuggaacgcgacacuucguucacggugugcccugaugucccacgaaccccgguugguaaauuuuuaggcgacucagccaaccugagcauccuaagugggggaacacccaagcguugucucgaucuguccaaucuuucuagcggcgagauuacugcuacccaacugacaaccuccgcagacuuggaugaaacuggucaccucgacucaagugggcugcaggaggugcaucuggccggaaugaaccacgaucagcaucucaugaaaugcagcccugcgcaguuacuguguucuacaccaaauggccuugacagaggccacaggaagcgggaugcuaugugcuccucaagcgccaacaaagagaaugacaacgggaauuugguagauagugaaaugaaguaccugggaucucccauaaccacggugccuaagcuagacaaaaacccaaaucucggugaggaucaagcagaagagaucuccgacgagcugauggaauuuagccuuaaggaccaggaggccaaagucucgcgcucuggccuguauagaucccccucaaugccugaaaacuugaauaggccacggcucaaacagguggagaaguuuaaggauaacacuauuccggacaagguuaaaaagaaauacuucagugggcagggaaagcugcgcaaaggcuuaugucugaagaaaaccgugagccucugcgauaucacaauuacucaaaugcuugaagaggacuccaaucagggucaucugaucggggauuuuucuaaggucugugcuuugcccaccgugagcggaaagcaccaggaccuaaaauauguaaacccugagacaguugcagcccugcucucaggcaaguuccagggccugauagaaaaauuuuacgugaucgauugccgauauccauacgaguaucuugggggacacauucaaggugcucugaacuuguacagucaggaagaacucuucaauuucuuccugaagaaacccaucgucccuuuagacacccagaagagaauuaucauaguguuucauugugaguucuccagcgagaggggcccacggaugugccguugucugcgcgaggaagauagaucucuaaaccaauaccccgcccucuauuacccggagcuguauauucuuaaagggggauacagggacuucuuuccugaauauauggaguugugcgaaccccagucauacugcccaaugcaccaucaggaucacaagacggagcugcuccggugucgaagucagagcaaggugcaagagggcgaacgccagcugagagagcagaucgcgcuucuggucaaagacauguccccuuga

SEQ ID NO: 54104 - RNA, 2493 nt, Artificial Sequence
  derived and/or modified sequence opt3 from CDC27__Homo_sapiens__NP_001107563
augaccgugcugcaggagcccguccaagccgcuaucuggcaggcacucaaccacuacgccuauagagacgcgguuuuccuugcugaaaggcuguacgccgaggugcauagcgaagaggcauuguuuuuacuggccacaugcuauuaccgguccggcaaggcuuauaaagcauaccgccuacucaaggggcacucuuguacuacgccucagugcaaauaucugcuugccaaguguugcguagaucugucaaaauuggcugaaggagagcagauucucagugguggcguguucaauaagcaaaagagccaugacgauauagucaccgaguuuggggacuccgccuguuucacacugucucugcucggacacguguacugcaaaacugaucgauuagcgaagggcucggaauguuaccagaaaucacugagccuuaacccauuuuuguggaguccguucgagucccugugcgaaaucggugagaagcccgacccugaucagaccuuuaaauucacaucucuacagaauuuuagcaacugucucccaaauuccugcaccacucaaguucccaaccauucacugagucaccgucagccugagacagugcuuaccgaaacgccacaggacacuauugagcugaauagauugaaccucgaaagcucuaauuccaaguauucacugaacaccgauagcagugucucuuacaucgacuccgcagugauuagccccgauacaguaccuuuagggacuggaaccucgauccugucuaagcagguucaaaauaaaccaaagacaggcaggucccuccuuggcgggccggccgcucugucacccuugaccccuaguuucggaauacuaccacuggagacgcccagcccuggugacggcuccuaucuccagaacuacacuaauacaccacccgugaucgaugucccgucuaccggggccccuagcaaaaagacuuuucgggugcugcagucaguggcacgcauuggacaaacaggcaccaaaagugucuucucccagagcgguaacucuagagaaguuacgcccauccuugcucagacccagucaagugggccacaaacaagcacuaccccucaggugcugucccccacaauuacuucuccacccaaugccuugccuaggcggucgagccgccucuuuaccuccgacucaaguacaaccaaggagaacucuaaaaagcugaagaugaaauucccaccgaagauccccaaccgaaaaacuaagagcaaaacgaauaagggaggcauaacacagccuaacauuaaugacuccuuagagaucaccaagcuggauucaagcauuaucucugaaggcaaaaucuccacuauuaccccacagauacaagcguucaaccuacagaaggccgcagcugaggggcucaugagucugcuuagagaaaugggaaaagguuauuuggcccuguguagcuacaauugcaaggaggcuaucaacauucucucucaucugcccucccaccacuauaauacaggcuggguacuuugccagaucgggagggccuacuuugaacugucagaguacaugcaggcagagcggauauucagugaagugcgucgcauugagaacuauagagucgaaggaauggagaucuacagcaccacuuuguggcaucuccaaaaagacguggcccugucgguuuuauccaaggaucugacagacauggauaaaaauucuccugaggcuuggugugcggcaggcaacugcuuuagccuacagagggagcacgacaucgccauuaaauucuuucagcgggcuauccagguggauccaaauuaugccuacgcauauacgcuccugggucacgaguucguccuuaccgaagaguuggacaaggcccuggcuuguuuucgaaacgccauucgcgugaaucccagacauuacaacgcaugguaugggcucggcaugauauacuacaaacaagaaaaguucucacuggcggagaugcacuuucagaaggcuuuagauaucaauccgcagaguuccguacugcuuugccauauuggaguugugcaacacgccuugaagaagucugagaaagcacucgacacucugaacaaggccaucgucaucgauccuaaaaacccacuauguaaguuccauagggcuagcgugcuguuugccaaugaaaaauauaaguccgcacuccaggagcuggaagaacuuaaacagauuguccccaaggaaucauugguguacuuccugauaggcaagguuuauaaaaaguuagggcagacacaccucgcucugaugaacuuuagcugggccauggaccuugacccuaaaggagcgaauaaccaaaucaaggaggccauugauaaacgguaccugcccgacgaugaggaaccaaucacccaggaggaacagauuauggguacagacgagagucaggaaucuuccaugacugaugcugacgauacccaauugcacgcagccgagagcgacgaguucuga

SEQ ID NO: 54105 - RNA, 711 nt, Artificial Sequence
  derived and/or modified sequence opt3 from CDC34__Homo_sapiens__NP_004350
auggccagaccccuggugccuagcucccagaaggcucuccuucuggaguugaaaggcuuacaagaggaaccagucgaaggguucaggguuacccugguggacgagggagaucuauacaacugggaaguagcaaucuuugguccgcccaauacauauuacgagggcggguauuucaaggcccggcucaaauuuccuauugacuacccauauucucccccugcguuccgcuuucugacuaagauguggcacccaaacauauacgagacgggagaugugugcaucucaauucuucaucccccugucgacgauccacagaguggcgaacugccgagcgagcgauggaaucccacccagaacgugcguacaaucuugcucuccguuauuucucugcugaaugaaccuaacacuuucucgccagcuaauguggacgccucagucauguauagaaaauggaaggagagcaaggguaaagauagggaguacaccgacaucauacggaaacaggugcucgggacaaagguagaugcagaacgcgacggaguuaaggugcccaccacuuuagccgaguacugugucaaaacaaaggcuccugcaccagaugaaggcagugaccuguuuuaugaugacuacuaugaggacggcgaaguggaggaggaagccgauuccugcuucggggacgaugaggacgauucuggaaccgaagagagcuga

SEQ ID NO: 54106 - RNA, 1137 nt, Artificial Sequence
  derived and/or modified sequence opt3 from CDC37__Homo_sapiens__NP_008996
augguggacuacagcgucugggaucacaucgagguuuccgacgaugaagacgagacccaucccaacauugauacagccucucuguucagauggaggcaccaggcucggguggaacgcauggagcaauuucagaaggaaaaagaggagcucgaccgaggcugccgugaauguaagagaaaaguagcagagugccagaggaaacuuaaggaacuggagguggccgagggaggaaaggcggaauuggagcgguuacaggcugaagcccaacagcugcgcaaggaggaaagaucaugggagcagaaacuagaggaaaugaggaagaaagagaagaguaugccuuggaaugucgauacucucagcaaagacgguuucuccaagucuauggugaacacgaagccagagaaaaccgaggaagauucggaggagguucgggaacagaagcauaaaacauuuguggagaaguaugaaaaacaaauaaagcacuucggcaugcugcgccgaugggacgauucacagaaauaccuuagcgacaauguccaucuggugugugaggaaacugcaaacuauuugguaaucuggugcauugaucucgagguugaggaaaagugugcccugauggaacagguggcucaccagaccaucgucaugcaauuuauucuggaacucgcaaagaguuuaaaaguggacccgagagccugcuucaggcaguuuuucacaaagaucaaaaccgcugaccggcaguacauggagggguuuaaugaugagcuggaagccuucaaggagcgugugcgcgggagagcgaaacuuaggauagaaaaggcaaugaaggaguaugaagaggaggaacggaaaaagcgauugggccccggugggcuggacccugucgagguuuacgaaucccuaccagaggaacuccaaaaauguuuugaugugaaggacguacagaugcugcaggaugccaucucuaaaauggaccccacugaugcuaaguaucacaugcagcgcugcauugacagcggacuuugggugccuaacuccaaggccucagaggcaaaagagggcgaagaggcuggcccaggggauccccuguuggaagccgucccuaagacaggagacgagaaagaugugaguguuuga

SEQ ID NO: 54107 - RNA, 1014 nt, Artificial Sequence
  derived and/or modified sequence opt3 from CDC37L1__Homo_sapiens__NP_060383
auggagcagcccuggccuccaccgggccccuggagccugccuagagccgaaggggaggcugaagaggaauccgacuucgauguguuuccaucuucacccaggugcccucaacugccaggagguggcgcacagauguacagucacgggaucgagcuugccugucagaagcagaaagaguucgucaagagcuccguugcgugcaaauggaaccuggcugaagcccaacagaaguugggaucuuuagcacugcauaauucggagucacuagaccaggaacacgccaaagcucagaccgcagugagcgagcuccggcaacgcgaggaagaguggcgacagaaggaagaggcccugguacagcgugaaaagaugugucuuuggaguacagaugcuauuuccaaagacguguuuaacaagucuuucauaaaucaggauaaaagaaaggacacugaggaugaggacaaaagcgaauccuuuaugcaaaaguaugagcagaagaucaggcauuucggcaugcugucacggugggaugacagucagcgcuuuuugagcgaucaccccuaccucgucugcgaagagacggccaaauaucugauucugugguguuuccaucucgaagcggagaagaaaggugcauuaauggagcaaaucgcccaccaggcugugguuaugcaguuuauuauggaaauggccaagaacugcaauguggacccuagaggguguuucaggcuguuuuuccagaaagcaaaggcugaggaagagggauacuuugaagccuucaaaaacgagcuugaggcguucaagucucggguccgcuuguauucccaaucacagagcuuucagccaaugaccgugcagaaucacguaccgcauaguggcguuggcucuaucgggcugcuagaaucccucccccaaaacccugauuaccugcaguauagcauaucgacagcccuuugcucucucaauuccgugguccacaaggaggacgacgaaccaaaaaugauggauacuguguga

SEQ ID NO: 54108 - RNA, 5160 nt, Artificial Sequence
  derived and/or modified sequence opt3 from CDC42BPA__Homo_sapiens__NP_003598
augagcggcgaggugaggcugaggcagcuagaacaauucauccuugacgggcccgcacagaccaacggacagugcuuuuccgucgagacccuguuggauauuuuaauaugucuguacgacgaaugcaauaacucuccucuacggcgcgagaagaauauccucgaauaucuggagugggcuaagccauucacuucaaagguuaaacagaugcgacuucaccgugaggauuuugaaauucugaaggugaucgguagaggcgcauucggggagguagcaguggucaaauugaagaacgcggacaagguguuugcuaugaaaauucucaauaagugggaaaugcugaaaagggccgagacggcauguuuccgggaggaacgcgauguucuggugaacggagacaauaaguggaucaccacacuccauuacgccuuucaagaugacaacaauuuauaucuggucauggauuacuaugugggcggugaccuuuugacucugcuaaguaaauucgaggauagacucccggaagacauggcuagguuuuaccuggcagagaugguaauagccaucgauagcguucaccagcuucauuaugugcaccgggacauuaagcccgacaacauccugauggauaugaaugggcauauucgcuuggcugacuucggauccugccucaagcugauggaagauggcaccguccagucuucgguggccgugggcacaccugacuacaucucaccagagauauuacaggcgauggaggaugggaaaggacgauacggucccgaaugugacugguggagccugggcgucugcauguaugagaugcucuacggggaaaccccuuuuuaugcagagagucuuguugaaacuuacggaaagauuaugaaccacaaagagagauuccaauuuccagcccaggugacagauguauccgagaaugcuaaggaccugaucaggcgguugauuuguucucgugaacaccgccuaggccagaacgguaucgaggauuucaaaaagcaucccuucuuuagcgggaucgacugggauaauauuagaaacugcgaagccccuuauauaccagagguguccucaccgaccgacacgaguaacuucgacgucgaugacgauugucugaaaaauagcgaaacuaugcccccuccaacccacacagcauuuucuggacaucaccuccccuucgugggcuuuacuuacaccuccucaugcguucugagcgacaggaguugucuucgggugacagcuggcccuaccucucuggauuuggacgucaacgugcagcgaacgcucgauaauaaccuggccacugaggcguaugagcgcagaaucaagagguuagaacaagagaagcuggaacuaucccggaaacuccaggagagcacacagaccguacaagcccugcaguacucgacuguugacgggccacuuacagcaucuaaggauuuggagauuaaaaaucugaaggaagagaucgaaaaacuccgcaaacaggugaccgaguccucacaccuggaacagcaacuugaggaggcuaacgccgucagacaggaacuggacgaugcuuucaggcagauaaaggccuacgagaaacagauuaagacguugcaacaggaacgugaggaccucaauaaagaacuggugcaggcaagugagcgguuaaagaaccagagcaaagagcugaaggaugcccauugccaacgaaagcuagcuaugcaggaauuuauggagaucaaugaaagacucaccgagcugcacacacagaaacagaaacuugcgaggcauguccgcgacaaagaagaggagguggacuugguuaugcaaaagguggaaucccugcggcaggagcucagaaggacugaacgcgccaagaaggagcuggagguacacaccgaagccuuagcugccgaggcaucuaaggaucgaaaacugcgggaacagagcgagcauuauucaaagcaacuugaaaacgaguuggagggacucaaacagaagcagaucaguuacucccccggugucugcagcauugaacaccagcaagagaucacaaaacugaagacugaccuagagaagaagucuauuuucuaugaggaggaacugucaaagcgugagggcauacacgccaaugaaaucaaaaaccucaagaaagagcugcaugauagugaagggcagcagcuugcuuugaauaaggagauuaugauccugaaagacaaguuagaaaagaccagaagggagagccaguccgagcgcgaagaguuugaaucugaguucaaacaacaguacgagcgggaaaaggugcuccugacagaggaaaacaagaaacuuaccucggagcuggauaaauugacuacgcucuaugaaaaucugagcauccacaaccagcagcuagaggaggaaguuaaagaccuggccgauaagaaagaguccguggcacauugggaagcgcaaauuacagagauaauccagugggucucagacgaaaaggaugcuagaggauaccuccaggcccuggcaaguaaaaugaccgaggagcuugaagccuugaggaacucuagccugggcacucgagcuaccgacaugccguggaagaugcgccgguuugccaaauuagauauguccgcaagacucgagcugcaaucagcucuugacgccgaaauuagggcgaagcaggccauccaggaggaacugaauaaggugaaagcuagcaacauuaucacagaguguaagcuaaaagauucugagaagaaaaaucucgaacuguuguccgagauagaacagcugaucaaggacaccgaggaguuacguagugaaaaagguauugagcaccaagacagccagcacucuuuccucgcauuucugaacacuccuacagaugcccuugaccaguucgaaacgguagauuccacaccccugucagugcauacuccaacauugcgcaagaaggggugcccuggcaguaccggauuucccccaaaacggaagacacaccaguuuuucguuaagagcuucacuacccccacgaagugucaucaaugcaccucgcucauggucggccugaucagacagggguguuccugcgagguguguggauucucuugccacauuacaugugugaauaaagcuccuacuaccugcccagucccgcccgaacagacaaaggguccucuaggcaucgacccacagaaggggauaggaacugccuaugagggccauguuaggauucccaaaccugccggugugaagaaaggguggcaacgagcgcuggccaucgugugugauuuuaaacuuuuccucuacgacauugcugagggcaaagccagccagccaucaguagucaucagucaggugauagauaugcgggacgaagaguuuuccguuucuagcgugcuggcauccgaugucauccacgcuucacgcaaggacauucccugcaucuucagagugaccgccagccaguugagugcaucuaacaauaagugcuccauucugauguuagccgauacggaaaacgagaaaaauaaguggguuggagugcucagcgaacugcacaaaauccuuaagaaaaacaaguuuagggaccggucgguauacgucccgaaggaggcuuaugacucaacacugccuuugauaaaaaccacucaagcggccgcaauuaucgaucaugagcgaaucgcucucggcaaugaagaggggcuguucguggugcacgucacaaaggacgaaauuaucagaguuggagauaacaaaaagauucaucagauagagcuaaucccaaaugaccagcugguggccguaauuucuggucgcaacaggcacgugcgucuuuuucccaugagugcccucgauggccgggaaaccgacuucuacaaacuguccgagacuaaggggugucaaaccgucacaagcggaaaggugagacauggcgcuuugacgugcuuauguguugcaaugaaaagacaggugcugugcuaugagcucuuucagucuaagacccgccaccgaaaauucaaggaaauccaggucccuuacaaugugcaauggauggccauuuucagcgagcagcuguguguugguuuucaguccggguuccuuagauauccccugaacggcgaaggaaacccauacucaauguugcacaguaaugaucauacucucagcuuuaucgcgcaccagccuauggacgcuauaugcgccguggagaucucuuccaaagaguaucugcucuguuucaacucaauuggcaucuacacagauugccaagggcggaggagucgccagcaggaacugauguggcccgcaaauccaagcuccuguugcuacaacgccccguaucuuucugucuacucggagaaugcuguagacauuuuugaugugaacagcauggaauggauccagaccuuaccucugaagaaaguucguccccucaauaacgagggaucauugaaucugcucggccuggaaacaauaagacuuauuuauuucaagaacaagauggcagagggugacgagcugguggucccagaaacuuccgauaauagucggaaacaaauggugaggaacaucaauaacaagcgccgauacucuuuuagaguacccgaggaagaacggaugcagcagaggcgcgaaauguugagagacccugagaugaggaauaaacuaaucagcaacccaaccaacuucaaucauauugcccacauggggcccggagacggcauacaaauccugaaggaucucccuaugaacccgcggccacaggagucccguacgguguuuucagguucugucagcauucccaguaucacaaaaucccgcccugaaccaggccgaagcaugucugcgucauccggguuaagugcuagaagcucggcccagaauggaucugcacugaagagggaguucuccggcgggagcuauucagccaagcggcagcccaugccuaguccgucugaaggaucccuuagcucaggcgguauggaccaagggagugaugcucccgcccgcgacuuugauggagaggacagcgauuccccaagacacucuaccgcaagcaacuccucaaaucugucuaguccucccucgccagcuagcccuaggaaaacuaagucccucucuuuggaaucaaccgaccggggcagcugggaucccuga

SEQ ID NO: 54109 - RNA, 5136 nt, Artificial Sequence
  derived and/or modified sequence opt3 from CDC42BPB__Homo_sapiens__NP_006026
augagcgccaaggugagacugaaaaagcucgagcagcuucuguuggacggccccuggaggaacgaauccgcuuuaucugucgagacccugcuagauguucucgugugccuguacacagaauguucacacagugcacuucggcgcgacaaauauguagccgaguuccuggaaugggcgaagccuuuuacucaauuggugaaagagaugcagcuccaucgagaggauuucgaaaucauuaaggucauagggcguggagcuuuuggugagguggccguugugaagaugaaaaauacggaaagaaucuacgcaaugaagauucugaacaaaugggagaugcugaagagggccgagaccgcuugcuuccgggaagagcgcgacguccucgugaauggcgauugucaguggaucacagcauuacacuaugccuuucaggacgaaaaccaucuguaccuuguaauggauuauuacguugggggagacuugcugacucuacucagcaaauucgaggauaagcugccagaagacauggcuagauuuuauauuggcgagauggugcuugccaucgauuccauacaccaacugcauuacguccacagggacaucaagccggauaauguguugcucgacgugaacggucacauucggcuggcggacuucgggucuugcuuaaaaaugaaugaugacggaaccguccagucgucaguugcagugggcacacccgauuacaucagcccugagauucugcaggccauggaagacggcauggggaaguauggaccagagugugauugguggagucucgguguaugcauguacgaaaugcuuuauggcgagacccccuuuuacgcugaaucccugguggagacuuaugggaaaaucaugaaccaugaggaacgcuuccaguuuccuucucacgucacagacgugagcgaggaagccaaggauuugauacaacgacuaauuuguuccagagagaggcggcugggacagaauggcaucgaagacuucaaaaagcaugcauuuuucgagggucucaacugggagaauauucguaaccuggaagcuccauacauccccgauguuucaaguccuagcgacaccucuaauuucgauguggacgacgauguccuucgcaacacggagauccugccaccggggucccacacuggauuuucaggcuugcaccuccccuucauuggcuuuaccuucacaacugaaagcugcuuuagugacagagggucucugaaauccauaaugcagagcaauaccuuaacaaaggaugaggacgugcagagggaucuggagcauucgcuacaaauggaagccuaugagcggcgaauccgcagacucgaacaggagaagcuggaacuuucuaggaaauugcaggaguccacccaaacgguacagucacugcacggaaguagccgggcgcucuccaacucuaaccgcgacaaggagauuaaaaagcugaaugaagagaucgaaagacuuaaaaacaagauagccgauagcaauaggcuggagcgucaguuggaagacacuguugcacuccggcaggagcgagaggauucaacacaaagacugagggguuuagaaaagcagcaucgcgugguccggcaggagaaagaagagcugcacaagcagcuaguggaagcuagugagagacucaaaucccaagccaaggagcugaaagacgcucaucagcagaggaagcuugccuugcaggaauucagcgagcugaacgaacgcauggcagagcuccgagcccaaaagcagaaagucucucggcagcugcgugauaaggaggaagagauggaaguggcuacccagaaaguugacgcgaugagacaagagaugaggcgcgcagaaaaguuacggaaagagcuggaggcccagcuugaugacgcuguggccgaagcaucaaaggagagaaaguugagggaacacagugagaauuuuuguaaacagauggaaagcgagcucgaggcccugaagguaaaacaaggcgggcgaggagcuggcgccacucuagaacaccagcaggagauuuccaagaucaaaucugaacuggagaagaaaguccucuucuacgaagaggagcuggugcgccgggaagcaucgcauguucuugaggugaagaacgucaagaaagaagugcacgacagcgagucccaucaguuggcgcugcaaaaggagaucuuaaugcucaaagauaagcuggaaaaaucaaagagagagaggcacaaugaaauggaggaagcuguagguacaauuaaggacaaauacgagcgugagcgcgccaugcuuuuugaugaaaacaagaaacugaccgcagagaaugaaaaguugugcaguuucguggacaaacucacggcccagaaccggcagcuggaggaugaacuacaggaccuggcugccaagaaggagucuguugcacacugggaggcucaaaucgccgaaauuauacagugggucagcgaugagaaagacgcgagaggguaucuccaggcccuggcuuccaagaugaccgaagagcuugaagcauugaggucaagcucucugggcucccgaacauuagauccucucuggaaagugcggcgcagucagaagcuggacaugagcgccagacuugagcugcaaucugcucuagaggccgaaaucagggcaaaacagcucgugcaggaggaacugcggaaggucaaggaugcgaauuugacucuggaguccaaauuaaaggacucagaggccaaaaaccgagaacuccuggaggaaauggagauucuuaagaaaaagauggaagagaaauuuagagcugauaccggacugaaguugccagacuuccaagacaguaucuuugaguacuucaauacagccccccucgcacaugaucugacuuuccgcaccagcucggcuuccgaacaggagacacaggccccuaagccagaagcaucucccagcaugucaguugccgcuagugagcagcaagaagacauggcgaggccgccucagcgucccuccgccgugccacuaccuaccacucaggcacuggcucuugccggccccaaaccaaaggcccaccaguuuucuaucaaaagcuucuccucacccacgcaauguagccauugcacaagucucaugguggggcugauucggcagggauaugcuugcgagguauguucuuuugcaugccacgucuccuguaaggauggugccccucaggugugcccaauaccgcccgagcagagcaaaagaccuuugggcguugacgugcaaagggggaucggaaccgcguacaagggccaugucaaggugccaaaacccacugguguuaagaaaggguggcagcgcgcuuaugccgugguaugugauugcaagcuguucuuauacgaccucccugaaggcaaaucgacccagccaggagucauugcaucacaggugcuggaucuucgagacgaugaguuuucugugaguuccguccuggccagcgacguuauccacgcuacaagacgggauauucccuguaucuucagggugaccgcaucuuugcucggcgccccgagcaagacuuccucacugcuaauacugacagaaaacgagaaugaaaagcgcaaauggguagggauccuugagggacuccaaaguauucugcacaagaaccguuugagaaaccaggugguccaugugccuuuagaggcguaugacagcucucugccacucaucaaagcuauucugacggccgcaaucguugacgccgaucggauagcugugggucuugaagagggccuguacgucauugaagugaccagggacguuaucgugcgcgccgcagauugcaagaaaguccaccagauugaguuggcuccccgagagaagaucguaauacuacugugugggagaaaucaucacgugcaucucuacccuugguccucacuggacggagccgaaggcaguuuugauaucaagcuucccgagacuaaagguugccaauuaauggcgacagccacccugaagcggaacagcgggacaugucucuucguugcagugaaaagguugauucugugcuaugaaauccagcgcacuaagccauuucacagaaaauucaaugagauugucgcuccuggcuccgugcagugccucgccguacugagggaccggcuuugugugggauaccccucuggcuuuugccuguugucgauccagggggauggacaaccacuaaaccuggucaauccgaacgacccuagccucgcuuucuuaucacagcaguccuuugaugcacugugugccguugaacuugagagugaggaauaucugcucugcuucucucacaugggcuuguacguggacccccagggucgucgcgcccgagcucaagagcugauguggccagcggcacccguggccuguagcugcuccccuacccaugucacgguguauucagaauacgggguugauguauucgacgugagaaccauggaguggguccagacaauaggacucaggcggauucgcccacugaauucugaaggcacucuuaaccuacugaauugugagcccccuagauugaucuauuuuaagagcaaguucaguggugcuguguuaaacguuccggauaccuccgacaauagcaaaaagcagaugcugaggacacggucuaaacgaagauuuguguucaaggucccagaggaagagcgccuccagcaaaggcgggaaaugcugcgugaccccgagcuuagaucaaaaaugaucuccaacccuacuaauuuuaaccacguggcccauaugggcccaggggauggaaugcagguacugauggaccuccccuugagugcagucccuccgagccaggaagagaggcccggcccagccccuaccaaucuggcucgccaacccccaucgcggaacaagccuuacauuucuuggcccuccagcgggggaucagagccaagugugacgguuccgcuacgaucuauguccgauccugaccaggauuucgacaaagaacccgauagcgacucaacaaagcacaguaccccaagcaacuccucuaaucccagcggcccuccaucccccaacucaccucacagaucucagcugccgcucgagggucuugaacagccagcgugcgauacuuga

SEQ ID NO: 54110 - RNA, 4656 nt, Artificial Sequence
  derived and/or modified sequence opt3 from CDC42BPG__Homo_sapiens__NP_059995
auggagagaaggcugcgggcccucgaacagcuugcucgcggcgaggcagggggaugccccggucuggacggcuuguuagaucugcuacucgcccugcaccaugaacuuagcuccgggccucugcgacgugagagaucuguggcgcaguucuugucaugggcuaguccauuugucagcaagguuaaagaacucaggcugcagcgggacgauuucgagauccugaaggugauuggacgcggcgccuuuggugagguaaccguggucagacagagggacacagggcagauauucgcaaugaaaaugcuccacaagugggaaauguuaaaacgggccgagacugcuuguuuucgcgaagagagggaugugcugguuaagggagacuccagaugggugacgacccuucauuacgcauuccaagaugaggaauauuuguaccuggucauggacuauuacgccggcggcgaucuacucacacugcuuucuagguuugaggaccggcugccgcccgaauuggcucaguucuaucucgccgagauggugcuggcgauccacucguuacaucagcugggguacguacaccgugauguuaagccugacaacgugcuccuugaugucaauggacacauucgccuggcagacuuugguucaugcuugagacuaaacacuaauggcaugguggacagcaguguggccgucgggaccccagauuauaucucccccgaaauucugcaggcuauggaggagggaaaaggccauuacgguccucaaugugacugguggucucucgggguuugcgccuacgaacugcuuuucggagagacaccauuuuaugcagaaagccugguggagaccuacggcaagaucaugaaccacgaagaucauuugcaguuucccccugacguaccagaugugccggcuuccgcccaggaccucauaaggcagcuguuaugucggcaagaggagcgacugggccgcgggggacuagaugacuucagaaaucaccccuucuucgaaggugucgauugggagaggcucgcgucaaguacugccccuuauaucccagaacugcggggccccauggacacaagcaacuuugauguggacgacgauacccuuaaucacccugggacguugccacccccgucucauggagcauucuccggccaccaucugccuuuuguugguuucacuuacaccucagggagccacagucccgagucuuccagcgaggcuugggccgcucucgagcgcaaacugcagugccuugagcaggaaaagguggagcugucgagaaaacaucaagaagccuugcacgcaccaacagaccacagggagcucgagcagcugcguaaggaaguccagacuuuacgggaucgacugccugagaugcuaagagacaaggccucucucucccagaccgauggacccccagcuggcucacccggccaagacagugaucugaggcaggaacuugaccgcuugcaucgggagcuggcggaagggagagcaggacuccaggcccaggagcaagagcuguguagggcucagggucagcaggaagaguuacugcaacgccuucaggaagcccaggagcgagaagcagccacagcuagccagacccgggccuuguccucucaacucgaggaggcacgugcggcucagagagaacuggaggcccaggugagcucacuaaguaggcaaguaacgcagcugcagggccagugggaacaacgccucgaggaauccagccaggcaaaaacuauucacacagccucugagaccaacgggaugggaccuccagagggcgguccgcaggaagcucagcugcggaaggagguugccgcacuuagagaacaauuggagcaggcucauucacacaggcccagugggaaagaggaagcccugugccaguuacaggaggaaaaucgacgccucagccgggagcaagaaagacuggaggcggagcuugcccaggaacaggaguccaagcaaaggcuggaaggcgagcgucgcgaaacugagucuaacugggaggcucaguuggcagauauccucucgugggugaaugacgaaaaagucagccggggauaucugcaggcccuagcuacaaagauggccgaggaacuggagucccucagaaacgugggcacccagacgcugccugcaaggccacuugaucaccaauggaaagcgcgacgguugcagaagauggaagccucagcucgccuggaguuacagagugcccucgaggcagaaauuagagcuaagcaggggcugcaagagaggcuuacccagguccaggaagcccagcugcaagcagagcggcgacuacaggaggccgaaaaacagucucaggcucuccaacaggagcuggcgauguugagagaagaacugcgcgccaggggacccguggacacaaagccuagcaauuccuuaaucccauuucucucauuccguagcucugaaaaagauuccgcaaaggaccccgguauaaguggcgaggcuacucggcaugggggagagccggaccugagaccugaaggcaggcgcagccuucgaaugggugccguuuuuccaagagcccccaccgcuaacacagcaucuacugaggggcugccugccaaacccggcucccacaccuugcggccaaggucauucccuagucccacaaagugucuccgcugcaccagccugaugcuaggacugggccgucaggggcuuggaugugaugcgugcggcuacuuuugccauacuacgugugcuccacaagccccgccuugccccgugccacccgaccuccugagaacagcauuggguguacacccugaaaccgggacuggaaccgccuaugagggcuuccugucggucccacggcccuccggugugaggcgcggcuggcagcgaguuuuugcugcauuaucugauagcagacuccugcuuuucgacgccccugaucugcgguugucaccgccaaguggggcgcuccuacaggugcuggaccugagggauccccaguuuuccgcuacaccuguccuugccucugacgugauucaugcacaaagccgcgaucucccaagaaucuucaggguaaccacuucccagcuggccgugcccccuacaacguguaccguuuuguuacuggcugaaucagagggagagcgggaacguuggcuccagguccugggcgagcuucagcgccuguugcuagacgcccgaccgagacccaggccaguguacacucugaaggaagcauacgauaaugggcucccucugcuuccccacacauuaugcgcugccauucuggaccaagaucggcucgcguugggaaccgaggaaggccuguucgugauccaccuccgcagcaacgacaucuuucaggucggugaguguagaaggguucagcagcugacacuuaguccaucugccgggcuguugguggugcuaugcggacggggcccuuccguacgacuguucgcacucgcugaguuagaaaacauugaggucgccggugcuaaaauacccgaaagcagaggcugucaagugcuggcagccgggucgauccuucaggcccgcacuccaguucugugcguggcugucaagcgacaggugcucuguuaucaauugggaccgggcccugggcccuggcagcggcguauuagagagcugcaggcgccagcaaccguucagucacucggacugcuuggcgacaggcuaugcgugggugccgcugggggauuugcccuguaccccuuguuaaaugaggcagccccucuggcucucggcgcgggucugguaccagaagaacuucccccuucucgcggcgggcugggagaagcccucggcgcagucgaguugagucuguccgaguuccuacugcucuuuacgaccgcugggaucuauguggauggagccggccggaaaagccgaggucaugagcuucuguggccggcagccccaaugggguggggauacgcugcccccuauuuaacaguguucucugagaacagcauagacgucuuugauguuagaagggcggaaugggugcaaacuguaccuuugaagaaagugcgcccccugaauccagagggcucccucuuccuguacggcaccgaaaagguccggcuuacauaucugagaaaccagcucgcagagaaggacgaauuugauauuccugacuugacugauaauucacguaggcagcuguuccggaccaaaaguaagcgccgauuuuucuuuagagugagcgaggagcagcaaaaacagcagaggcgggaaauguuaaaggaccccuucguucgcucuaaacuaaucuccccaccuacgaacuucaaucaccuggugcaugucgggccggccaacggaagacccggugcuagggauaagucaccagccccugaggaaaagggccgaguggcucgggggaguggaccccagcguccacacagcuuuuccgaggcacucagacgcccugccucuaugggcucggaaggucuugggggagacgcugaucccaugaaaaggaagccguggacaagccugucauccgagaguguuucuuguccacaaggcagcuuguccccugccaccucacugaugcaagugucugagcggcccagaagccucccacugagucccgaacuugaguccagcccuuga

SEQ ID NO: 54111 - RNA, 1176 nt, Artificial Sequence
  derived and/or modified sequence opt3 from CDC42EP1__Homo_sapiens__NP_689449
augcccggcccucaagggggaagaggugccgcuaccaugagccugggcaagcucuccccaguggggugggucucuucaagucagggaaaaaggcggcuuacagcagacaugaucagccacccgcugggcgauuuccgccauacuaugcacguuggucgagggggagacguguuuggcgauacguccuucuugucuaaccauggcgggucgucaggaagcacccaccguagucccagauccuuuuuagccaagaaacugcagcuaguaaggcgggugggugcgccuccacgcagaauggcuucucccccugccccaagccccgcaccuccagccauuuccccgauaaucaagaaugcuauuucacucccccagcugaaccaggcagccuacgacagucuugucgugggcaaacugagcuucgauucuuccccuacaucaagcacugacgggcauaguucuuauggauuggauuccggcuuuugcaccaucagcaggcucccacggucggagaagccccacgaccgcgaucgagacgguucuuucccuuccgaaccagggcugagaaggucagauagucugcucagcuuucgguuagaccuggaucuuggacccuccuugcugucugagcuacucggcguuaugagccugccggaagcuccugccgcggagacacccgcaccagccgcuaauccucccgccccaaccgcaaaccccacuggcccugcugccaauccaccggcgacaaccgccaaucccccugcaccagcugccaaccccucagcuccugccgcaacgccaacugggcccgccgcuaacccgccugcgccagcagccaguuccacaccccacggacauuguccuaauggugugaccgcuggccuugggcccgucgccgaaguaaagagcucuccagugggaggcgguccucgugggcccgcaggcccagcccugggacgccacuggggcgcugggugggacggaggucaucacuacccggagauggacgccagacaagagaggguugaaguguugccucaggcacgggcgucaugggagagucucgaugaagaguggcgagcuccccaggccggcagccgcacuccaguccccuccaccgugcaggcaaacacauucgaguuugccgacgcugaagaggaugacgaagugaaagucuga

SEQ ID NO: 54112 - RNA, 765 nt, Artificial Sequence
  derived and/or modified sequence opt3 from CDC42EP3__Homo_sapiens__NP_006440
augcccgccaagaccccuaucuaccugaaagcugcaaacaauaagaaaggcaagaaauucaagcucagagacauucuuagcccagauaugauauccccgccccugggggacuuuaggcacacaauccauauuggaaaggagggucagcacgauguguucggcgacaucagcuuuuugcaagggaacuaugaauuacugccuggaaaucaggagaaagcccaucuaggccaguucccaggucacaacgaauuuuuccgggcgaauaguacuucagauagcgucuuuacggagacccccuccccuguucucaagaacgcuauuucucugccaacaaucgggggaucgcaggcccuuaugcugcccuugcucucaccugugacuuucaauagcaaacaagaaaguuuuggcccagcaaagcugccgcgccuguccugcgagcccguaauggaggaaaaagcccaggagaagucuagccucuuagaaaacggcaccgugcaucagggggacacauccuggggaucaagugguagcgcuucucaguccucacaaggccgagauagccacaguucuucccugagcgagcaguacccugacuggccagcagaggauauguucgaccaccccaccccuugugaacuuauaaaggggaaaacuaagucggaggaaucuuuguccgaucugacaggaucacuacucagucugcagcuugaccugggcccaucuuugcucgaugagguccugaaugugauggacaaaaacaaguga

SEQ ID NO: 54113 - RNA, 255 nt, Artificial Sequence
  derived and/or modified sequence opt3 from CDC42SE2__Homo_sapiens__NP_001033791
augagcgaguucuggcugugcuuuaacuguugcaucgccgaacagccccaaccuaagagaaggcggcgcauugaccgauccaugauaggcgagccaaccaauuucgugcacacagcucaugucgggucuggagaucucuuuucagguaugaacaguguuagcuccauccagaaucagaugcagucuaaaggcggguacggaggcgguaugccggcaaacgugcaaaugcagcuuguagacacuaaggccggguga

SEQ ID NO: 54114 - RNA, 1797 nt, Artificial Sequence
  derived and/or modified sequence opt3 from CDC45__Homo_sapiens__XP_005261342
auguucgugagcgacuuuagaaaggaguucuacgaagucguucagucccaaagggugcugcucuuuguagccucugauguggacgcucuuugcgcauguaaaauacugcaggccuuguuccagugcgaucacguccaguauaccuuagugcccguuucaggcuggcaagagcuggaaacagcguuucuagagcauaaggaacaguuccacuacuuuauucucauaaacuguggggcuaauguggaccugcuugauauccugcagccugacgaggauacuauuuucuuugucugcgacacgcaucggccagugaacguaguuaauguguauaacgauacccagaucaaauugcucauuaagcaagacgaugaccuggaggucccggccuacgaagauaucuuccgcgacgaggaagaggacgaggaacacaguggaaaugauagcgacgguuccgagcccucugaaaaacgaacacgucuggaggaagagauaguggagcagacuaugagaaggcggcagcgcagagaaugggaggcaaggucgggcucagggagcgaaccuguggccgcugcacucgagaagaguucccgguuauuugccggaccaaugucugaucgcaccgcuccccgaagcccuagaagggacauccuguucgauuaugaacaguacgaguaucauggcacauccucagccauggucauguuugagcuugcguggauguugaguaaggaccugaacgauaugcuauggugggcaauuguuggucucaccgaccaaugggugcaggauaaaaucacucagaugaaguacguaacagacguggggguccugcaacggcacgugagccgucacaaucaucgcaacgaagaugaggaaaauacccuuucuguugacuguacgagaauuuccuucgaguacgaccugagguuggugcucuaucagcacuggucacugcaugauagcuuaugcaacacaaguuacaccgccgcucgguucaaacuguggucuguccacggacagaagcgacuccaggaauuucuugccgacaugggccugccauugaaacaagugaagcagaaguuccaggcaauggauaucucccuaaaagagaaucugcgcgagaugauagaagagagcgcuaacaaguuuggcaugaaagacaugagaguacagacauucucgauucacuuuggguucaagcauaaauuucucgccucugauguuguguucgcgacuaugucccugauggaaucacccgagaaggacggaagugguaccgaucacuuuauccaagcccuugacagccuguccaggucuaauuuggauaaacucuaucauggccuggaguuagcaaagaagcagcugcgggcuacacagcagaccauugccagcugucuaugcacgaaccucgucaucucacaagggccuuuccuguacuguagucuuauggaaggaacuccagacgugauguuguuuucccgcccggcuagccugucucuccugucaaaacaccuucugaagaguuucgucugcagcacuaaaaauagaagguguaaguugcucccccuggugauggccgcaccuuuauccauggagcauggcaccguuacugugguagguaucccacccgaaacagauucuucggaccguaaaaacuuuuucgggcgggccuucgagaaggcugcggaaagcaccuccucacgaaugcugcacaaccacuuugaucuaagugucauugagcucaaggcagaggacagaucuaaauuccuggacgcccuuaucagcuugcuguccuga

SEQ ID NO: 54115 - RNA, 2409 nt, Artificial Sequence
  derived and/or modified sequence opt3 from CDC5L__Homo_sapiens__NP_001244
augcccagaaucaugauuaagggcgggguguggaggaacaccgaggacgaaauacugaaagccgcugucaugaaguacgguaaaaaucaguggagccggaucgcaucccuccuucaccgcaagucugccaaacaaugcaaggcgcgaugguaugaguggcuggauccuucaauuaagaaaacagaauggagucgugaggaagaggagaaguuguuacaucuggcuaaacuaaugccaacucaguggagaacgaucgccccgauuaucggaaggaccgcagcccagugucucgaacacuacgaguuccugcuugacaaggcugcacagcgggauaacgaagaggagacaacugacgauccccgcaaacugaagccuggcgaaauagacccaaaucccgagaccaagccugccagaccagaucccaucgacauggaugaagacgaguuggaaaugcucagcgaggcuagggcccggcuggcgaacacacaagggaaaaaggcaaaacgcaaggcccgagagaaacagcuggaagaggcuagaaggcucgccgcauuacagaagcggcgugaacugcgcgcugccggaauugagauccagaaaaagagaaagaggaaacggggcguugauuauaaugcggaaauuccuuuugagaagaaaccagcccuugguuucuacgacaccuccgaggaaaacuaucaagcauuggaugcugacuuucgaaagcugcgccagcaggaccuagauggggagcucagaucugaaaaagagggaagggaccggaagaaggauaaacagcaucugaagcgcaaaaaggaaucggaccuuccgucagccauccugcaaacuagcggcgugagugaguucacgaaaaagagauccaaguugguacuccccgcuccucagauaucugaugccgagcugcaggaaguggucaaagugggccaagcaagcgagauugccaggcagaccgcugaagaguccgggaucacaaauucagcgaguagcacuuuacugucugaguacaacguuaccaauaacuccguggcacuccguacaccacggacucccgccucacaggaccgaauacuucaggaagcucaaaaucugauggccuugaccaacgucgauacaccucuaaagggaggucugaauaccccacuccacgagagcgacuuuaguggcgugacgccccagagacagguaguucagacuccgaacacagugcugucuaccccuuucaggacucccuccaauggggcagaaggacuuacaccacgcagcggcaccacgccuaaacccgucaucaacucgaccccaggucggacaccccugagagauaaguugaacaucaauccugaggacgggauggccgauuauucugacccauccuacgugaaacaaauggaaagggagucacgcgagcaucuccgacugggauuacugggccuaccggcucccaagaacgacuuugaaauugugcucccugagaaugccgaaaaggagcuggaagaacgggagauagaugacacuuacaucgaagaugcagcggacgucgaugcucguaaacaggccauuagagacgcagagaggguuaaggaaaugaaacgcaugcacaaggccgugcagaaagaucuuccacggcccagugagguaaacgaaaccaucuugagaccucugaauguggagccaccccucacagaccugcaaaagagcgaggaacuuauuaaaaaggagaugauuacuaugcugcacuaugauuugcuccaucacccguacgaaccuuccggcaacaagaaagggaagaccgucggauucgguacaaauaacucugagcauaucaccuaucuggagcacaauccauacgaaaaauuuagcaaggaggaacugaaaaaggcucaggacguguuaguucaggagauggaaguggucaagcagggcaugucacacggggagcuaaguuccgaggccuauaaccaggugugggaagagugcuacagccaaguacucuaucugcccggacagucuagguacacucgagcaaaucuugcuaguaaaaaggaucgcaucgaaucauuggagaaacggcuggaaauuaacagaggccauaugacgacagaggccaagagggcggccaaaauggagaagaagaugaaaauccuccuggguggguaccagagccgugcuaugggcuuaaugaagcaacugaaugaccuuugggaucagauugaacaggcacacuuggagcuccgcaccuucgaggagcugaaaaagcaugaagacuccgccauaccucggagacuagagugucugaaagaggacguucagaggcaacaggaacgagagaaggaacuccagcaccgguaugcugaucugcuuuuggagaaggagacucugaaaucuaaguuuuga

SEQ ID NO: 54116 - RNA, 1683 nt, Artificial Sequence
  derived and/or modified sequence opt3 from CDC6__Homo_sapiens__NP_001245
augccccagaccagaagccaagcccaggcuacaaucuccuucccuaagaggaaacugucucgggcacucaacaaggccaaaaauucaagugacgcgaaacuugagccaacuaacgugcagacgguuaccugcagcccgcgcgucaaggcucugcccuuguccccucgaaagcguuuaggcgaugacaaucuguguaacacaccacaccuacccccuugcucuccacccaagcaggggaaaaaggaaaauggaccuccacauucgcacacucucaaagguagaaggcugguguuugauaaccaacuuaccauuaagucaccgagcaaacgggagcuggccaagguacaucagaauaagauauugaguuccgugcgcaaaucucaggaaaucacaaccaacagcgagcagagauguccccucaagaaagaauccgcaugcgucaggcuguucaagcaagagggcacuuguuaccagcaggccaaacuggugcucaauacagcuguuccugaccgguuaccagcacgcgagcgagaaauggaugugauuagaaacuuucugagggagcacaucugcgggaagaaagccggaucacuuuauuugaguggcgcucccgguaccgggaagacggccugucugagccggauucuacaggaccucaagaaagaacugaagggauucaaaacuaucaugcuuaauugcaugucucugcguaccgcgcaagcagucuuuccugccauagcucaggagaucugucaggaggaagugucccgcccagccggcaaggauaugaugagaaaauuggagaagcauaugacagcagaaaagggccccaugauuguacucguucuggacgagauggaucaauuagacucaaaagggcaggaugugcuguacacucucuucgaauggccguggcuuagcaacagucaccuggucuugaucggaauugcuaauacccuagaccugacagauaggauccucccucggcugcaggcccgagagaagugcaaaccccagcuucugaacuuuccaccuuauacccgcaaucaaauagugacgauuuugcaggacagacucaaccaggugucuagggaccagguccuggauaacgcggccguucaauucugugcacggaagguguccgcuguaagcggugacgugcgcaaagccuuagaugucugcagaagggcuaucgagauuguggaaucggacguuaagucucagacuauccugaagccccuauccgagugcaaaucaccaagugaaccccucaucccuaagcgugugggccugauucacauaagccaggucaucuccgagguggaugggaaucggaugacacuuucucaggaaggagcccaagacagcuuuccauugcagcagaaaauucugguauguucacucaugcugcuuauccgacagcugaagauaaaagagguuaccuugggcaagcucuacgaggcauauaguaaggugugcagaaaacaacaggucgccgcuguggaucaguccgaaugucugagcuuaucuggucugcuagaggcgagggggauucucggacugaagcgcaacaaagaaacucggcuuacaaaggucuucuuuaaaaucgaggaaaaggagaucgagcaugcauugaaagacaaggcccugauuggcaauauccucgcuaccggccugccguga

SEQ ID NO: 54117 - RNA, 1596 nt, Artificial Sequence
  derived and/or modified sequence opt3 from CDC73__Homo_sapiens__NP_078805
auggccgacgugcugagcguccucagacaguacaacauccaaaagaaagagauuguugugaagggcgaugaaguaauauucggggaguuuuccuggcccaaaaaugugaagaccaacuaugucguguggggaacagguaaagaaggccagccuagggaguacuauacucuugacucuauccuguucuuguuaaauaacguucaccugucacauccaguguacguccggcgcgcugcaacggaaaauauuccggugguacgacgucccgauagaaaggaccuacucggguaucugaacggagaggccaguaccagcgcguccaucgauaggucugcuccucuugagauuggccugcagcggucgacacagguuaagcgcgccgcagacgaaguguuggccgaggcuaaaaagccaagaaucgaagaugaggagugcgucaggcucgacaaagaacggcuggcagcccgccuggagggucacaaggaagggauagugcaaacugagcagauccgaucacucagcgaagcuaugaguguggagaaaauugccgcgaucaaggcaaagauuauggccaaaaagagauccaccaucaaaacagauuuagacgaugacauaaccgcucugaagcagaggucuuuugucgaugccgagguugacgugacucgggacauuguaagccgugaacgcguguggagaacaaggaccacgauccuucaguccacuggcaaaaauuucucaaagaacauuuuugcaaucuugcaaagugucaaagcucgggaggaaggacgagcccccgagcagcgcccugcgccaaaugccgcacccguggauccuacccugagaacaaagcagccaaucccggcugccuacaacagguaugaccaggaacgguucaagggcaaagaggagacugaaggguuuaagauugauaccaugggaacauaccaugguaugacccuaaaaagcguuacggagggcgcuucugcccgcaagacucaaacacccgcagcccagccugugccaagacccgucucccaggcuaggccuccacccaaucagaaaaaggggucacguaccccgauaaucauuaucccugcggcaacuacaagccucauaaccaugcugaacgccaaggaccuucugcaagauuugaaauucgugcccagugacgaaaagaaaaagcagggaugucagcgggagaaugaaacgcucauucaacgaagaaaagaucagaugcagccaggcgguaccgcuaucucuguaacaguuccuuacaggguggucgaccagccccugaaguuaaugccacaagauugggaccgcguggucgccguguuuguucaggggcccgcauggcaguucaagggauggccuuggcugcucccagauggcuccccgguggacaucuuugccaaaauuaaggcuuuccaccuuaaauaugacgagguacggcuggaucccaacguccagaagugggacgugacuguuuuggagcuaagcuaccauaaaagacaccuggauaggccuguguuucuccgcuucugggaaacccuggaccgauauauggucaagcacaagucgcaucuucgguucuga

SEQ ID NO: 54118 - RNA, 1725 nt, Artificial Sequence
  derived and/or modified sequence opt3 from CDC7__Homo_sapiens__XP_011540528
auggaggccagccugggcauccagauggacgaacccauggcuuucuccccucaaagagauagguuucaggcagaggggucucucaagaaaaacgaacagaauuucaaacuugccggagugaaaaaggacauugagaaacuguacgaagcggucccacaguugucaaacguuuuuaagauagaggauaagaucggugagggcaccuucaguagcguguauuuagcuacagcccaacugcagguagggccggaagagaaaauugcacuaaagcaccucauccccacuucccauccuauucggaucgccgcugaacugcagugccuuacgguggcaggaggccaggacaaugucaugggugugaaauacuguuuucgcaagaacgaucacguugugauagccaugccauaucuggagcaugagucuuucuuggacauccucaauucgcugucauuucaagaaguccgagaguacaugcugaaccucuucaaggcuuuaaagcguauucaccaguuugggaucgugcauagagauguaaagcccagcaauuuccuguauaacaggcggcuuaaaaaguacgccuugguugacuuuggacuggcgcagggcacccacgauacaaaaauugaacuacucaaguucgugcagagugaggcacaacaggaacgcugcucccagaauaaaucucacaucauaacuggcaacaagauuccucugagcgggccaguccccaaagagcuugaccaacaguccaccacaaaggccucagugaagagaccuuauaccaaugcucagauccagauuaaacaaggaaaggaugguaaagagggcaguguggggcugagcguccagaggucuguuuuuggagaacggaacuucaauauccauuccucaaucagccacgagaguccagccgugaaguugaugaaacagucuaagacuguagacgugcucucccgcaagcuggcaacuaaaaagaaagcuauuagcaccaaggucaugaacucggccgugaugcgaaaaacggcgucuuccuguccggccucauuaacuugcgauuguuacgcaaccgacaagguuugcaguauaugucugagcagaaggcagcaaguggcuccccgggccggcacaccugguuuccgugcuccagaaguccucacuaagugccccaaucagaccacagccaucgacaugugguccgcaggggugauuuuucuuucucuguugagcggacgcuacccuuucuauaaagccucagaugaccuaaccgcucuggcgcagaucaugacgauaagaggcaguagggagacuauucaggcagccaagacauuuggcaaauccauccucuguagcaaggaaguaccagcucaagaucugcggaaacuuugcgagcgacugcgcgggauggacucuucaacccccaaguugacaagugauauccagggacaugccagccaccagccggcaauuuccgagaagacagaccacaaagccucuugucucguucagaccccucccggucaauacucgggcaacagcuucaagaaaggggauuccaacucaugcgaacauugcuuugacgaguauaauacgaaccuggaaggauggaaugaggugccagaugaggcuuacgacuuacuggauaagcuacucgaccugaacccugccaguagaaucaccgcagaagaggcgcuuuugcaccccuucuuuaaagacaugucucuguga

SEQ ID NO: 54119 - RNA, 3072 nt, Artificial Sequence
  derived and/or modified sequence opt3 from CDCA2__Homo_sapiens__NP_689775
auggacgccaacagcaaggauaaacccccugagaccaaggaauccgcuaugaauaacgcaggcaaugccucuuucauccuggggacaggaaaaauugugacuccacagaagcacgcggagcucccgcccaacccuugcacgccagacaccuuuaaaucaccccuuaauuucaguacagucacuguugaacaacuggguauaaccccugagagcuuugugagaaacuccgcuggcaagucuucgucauacuugaagaaauguaggcggcgcagcgccguaggggcacgaggaaguccagaaacaaaucauuuaauccguuucauugccagacagcagaacaucaagaaugcuaggaaaagcccccuggcacaggauucuccuagccaaggcuccccagcccuauaucggaacgugaauacccuccgcgagagaauuucagcuuuucagagugccuuccacagcaucaaggagaacgagaaaaugacugguugccuggaauuuucugaagcggggaaggaguccgagaugacagaccuuaccaggaaggaaggacugucagcaugucagcagagcggcuucccggccgucuugaguucuaaacggcgccgaauauccuaccaaagagauagcgacgagaaucucacggaugcugaaggcaaggugaucgggcugcagauuuuuaacaucgacacugauagggccugcgcaguugagaccucgguggaccugucugaaauuuccucaaaacucggaaguacacagagcgguuucuuagucgaggagucccugccccuuucugaauugacugagaccagcaaugcucugaagguggccgauuguguaguuggcaaagggucaagugacgcgguguccccugauacauuuaccgccgaagucagcucugacgcagugccagacgugcggucacccgcuacgccugccugccgucgcgaucuaccaacucccaagacauucguccucagaaguguucugaaaaagccgagcgugaagaugugucuugagucccugcaggaacauugcaacaacuuguaugacgaugacggaacccacccuucucucaucucgaaucugcccaacuguugcaaagagaaggaggcugaagaugaggaaaauuuugaggccccagcauucuuaaacaugaggaaacggaagcgaguaacuuucggcgaagaccugagcccugagguguuugaugagucccuccccgccaauacaccacuucgcaaaggugggacccccgucuguaagaaggacuucucaggacugaguucuuugcuacuggaacaaagcccugugccagagccgcucccccagccugauuuugacgauaaaggcgaaaaccuggagaauauagagccacuucagguuuccuucgcugugcugucaagccccaacaagucuuccauuagugaaacguugagcggcaccgacacauuuucuuccucaaauaaccaugagaaaaucaguagcccuaaggucgggagaauuacuaggaccucgaaucggcgcaaccaacucguguccguaguugaagagucugugugcaaucuguuaaacacagaaguccagccaugcaaagagaagaagaucaauagaaggaaaagccaggagacuaaguguaccaaacgugcgcugcccaagaaaucacaggugcuaaagaguugccggaagaaaaagggaaaagguaagaaauccguccaaaagucucucuacggcgaacgagacaucgcaagcaaaaagccgcugcuuuccccuauuccagaguugcccgaagugccugagaugacacccucaauaccaagcaucagaaggcuggggaguggauauuucucuuccaacggcaagcucgaagagguuaaaaccccuaagaaccccgugaaacgcaaggaucugcuucggcacgacccagaucugcacaugcaucaggguuacgacaaauaugauguaagcgaguuuuguucguacauuaagucaucuaguuccuuggggaaugccacuagcgacgaagauccgaacacgaauaucaugaacauaaaugagaacaagaauauuccuaaagcuaagaacaaaucugaaagcgagaaugaacccaaggccggcacagacuccccagucucaugcgcaagugugaccgaggagagaguugccagcgauucucccaaaccugcucucacucugcagcagggacaagaguucuccgccggcgggcagaacgcagaaaauuuaugucaguuuuucaagaucucaccagaccugaacaucaagugcgaaaggaaagaugacuuucuaggagcggcugaggguaagcuccaguguaaucgccugaugcccaacagucaaaaagauugccacugucuuggcgacguguugauugagaauaccaaggaaagcaaaucccagucugaggaccuggggcgaaagccuauggaaucgagcucagucguguccugccgggaucguaaggacagaaggcgcaguauguguuacucugauggacggagccuccaucuggagaaaaacggcaaccacacaccguccucaucuguagguagcaguguggaaaucuccuuagagaauagcgagcuguucaaggaccuuucugaugccauugaacagaccuuucagagaaggaacucagagacuaaaguucgacgcuccacacgguugcaaaaggaccucgaaaaugaggggcuggucuggauaagucuaccacugcccagcacgucgcagaaagcaaagagaaggaccaucugcacuuucgauucuuccggcuucgaaagcaugucaccuauuaaagagacagugaguucucgucagaagccacaaauggcucccccuguguccgacccggagaacagccagggacccgccgccggcucaagugaugaaccagggaagcgccggaaauccuuuugcaucuccacccucgcaaauacaaaggcuacuucucaguucaaaggauauagaaggcgaagcucccugaacgguaagggcgagucaucucuuaccgccuuggaacggaucgagcacaauggggaacgcaaacaguga

SEQ ID NO: 54120 - RNA, 807 nt, Artificial Sequence
  derived and/or modified sequence opt3 from CDCA3__Homo_sapiens__NP_112589
augggcagcgccaaguccgugcccgucaccccugcuagaccaccgccccacaacaaacaucuggcaaggguugccgacccucggucuccaucagcggggauccuccgcacacccauucagguggagaguagcccucaaccaggacuucccgcuggugaacagcuggagggcuugaagcacgcccaggauuccgacccucgaucuccaacuuuagggauagcacguacgccgaugaaaaccucgucaggagaucccccuagcccacugguaaagcagcuaagugaaguguucgagacagaagacuccaaaucuaaucucccucccgagccaguccugcccccggaggccccucuuagcuccgaacuggauuugccccucggcacucaacugucaguggaggaacagaugccaccuuggaaccagaccgaguuucccaguaagcagguuuucagcaaggaggaagcuagacaaccaacagagacccccguggcaucucaguccucagacaaaccuagcagggauccagaaacuccgcggaguucugguuccaugcgcaauagauggaagcccaacagcucgaaaguccuggggaggucuccucucacaaucuuacaggacgauaauuccccaggaacccugacgcuucggcagggcaagcgccccucaccuuugagugagaacgugagcgaacugaaagagggcgccauucuagggacuggacgacuccugaagaccgguggcagagcuugggagcaagggcaggaccaugauaaggaaaaucagcacuuuccacuuguagaguccuga

SEQ ID NO: 54121 - RNA, 759 nt, Artificial Sequence
  derived and/or modified sequence opt3 from CDCA5__Homo_sapiens__NP_542399
augagcggcagaaggacccgguccgggggagccgcucagcgcucugguccccgagcaccuucaccaacaaagccgcugcguagaagucaaaggaaaagcggcuccgagcuccccucuauccuuccugaaauuuggccaaagacucccucggccgcggcugugcggaaaccuauaguccugaagcgcaucguugcccacgcaguggagguaccagccgugcagucacccagaaggagcccucggauuaguuucuuuuuggaaaaagagaacgaaccaccggggcgcgaguuaacgaaggaggaccuguucaagacccauuccguccccgcuacaccuacuucuaccccagugcccaauccugaagcagagagcuccucaaaagaaggagagcuagaugcccgagaccucgagaugaguaagaaaguuagaaggagcuacucucggcuggaaacacuuggcuccgcuucaaccagcacuccaggucgucgcaguugcuuuggguucgagggacuguugggcgccgaagaucucucuggcgugucccccgucguguguagcaagcugacagagguaccgagaguuugcgcgaaaccuugggcacccgacaugacccugccagggaucucgccucccccagaaaagcagaagaggaaaaagaaaaagaugcccgagauucucaaaacggaguuagaugaaugggccgcugccaugaacgcagaguuugaagcugccgagcaguucgaccugcuuguggaauga

SEQ ID NO: 54122 - RNA, 1353 nt, Artificial Sequence
  derived and/or modified sequence opt3 from CDCA7__Homo_sapiens__NP_114148
auggacgccagaagggugccccagaaggaucugcgggucaaaaagaaccucaaaaaguuccgcuacguuaaacuuaucagcauggagaccuccucuucaagugacgauagcugcgacuccuuugcuucugauaauuucgcaaacacaaagccuaaguuucgaucggacauuucagaagaacuggccaauguguucuaugaagauagcgacaacgagaguuuuuguggcuucuccgaaucugagguacaagauguguuggaccacugcggguuuuuacagaaaccacguccggaugucacuaaugagcuggcgggaauauuccaugcugacagcgaugacgaauccuuuugugguuucucagagagugaaauccaggacggcaugagacuacagagcgugagggaggggugccggacgcgcucucaauguagacacuccggaccccucaggguugccaugaaguuuccugcacggucaacccgcggcgccacaaacaaaaaggcugagagccgacagccaagugaaaauucugugacugauuccaacagcgacucggaggaugaaucugguaugaauuuccuggagaaaagagcacuuaacauuaagcagaauaaggccaugcuggcuaaauugauguccgaacucgagucauuucccgggaguuucaggggacggcauccucugccaggcagcgacucccagucucgucgccccagaaggcggaccuucccuggcgucgccagccgacgcaacccagagagaagggcgcggccgcugacacgcucaagaaguaggauccucggguccuuagaugcacugcccauggaagaggaagaggaagaggacaaguacaugcuugugcguaaacggaagaccguagauggauauaugaaugaggacgauuugccucgaagcagaaggucucgcucaaguguuacucugccacacauuauccggcccguggaagagauaacagaagaggaacuagagaacgucugcagcaauuccagagagaaaaucuacaacaggucucucgguucgaccugucaucaaugccgccagaagacgauugacacuaaaaccaacugucgaaauccugauugcuggggcgugcgggggcaguuuuguggaccaugccugcguaacagauauggcgaagaggugagggacgcccuucuggaccccaauuggcacugcccgccuugucgcgguaucugcaacuguagcuucugccggcagagagaugggaggugugcuacaggagucuugguuuaccucgccaaguaucacggcuuuggcaaugugcaugcauaccugaaguccuuaaaacaagaguucgagaugcaggcuuga

SEQ ID NO: 54123 - RNA, 1263 nt, Artificial Sequence
  derived and/or modified sequence opt3 from CDCA7L__Homo_sapiens__NP_001120842
auggagacccugagcuccgaagagucuugcgacucauucgauagucucgaaagcggcaagcagcaagacgugagauuucacuccaaauacuucacagaggaacuuaggcggaucuuuauugaggauacugacucugagacggaagauuucgccggguuuacccagucggaccugaacggaaagacaaaucccgaggucaugguuguggaaucagauuugagcgacgaugguaaagcuaguuuaguauccgaggaggaagaggacgaagaggaagauaaggcaacuccucgccgaucucguagcagaagguccucaauaggccugcggguggccuuccaguuuccaaccaaaaagcuagcgaacaagccggacaaaaauaguagcucugagcaacucuucuccucagcucgccugcagaacgagaagaaaacaauccuugaaagaaagaaagauuguaggcaggucauucagcgggaggacagcaccagugaaucugaggacgauucccgcgacgaaagccaggagucgucugaugcccuguugaagcgaacuaugaauaucaaggagaacaaagcaaugcucgcccaacugcuggcugaacucaauuccaugcccgacuuuuucccugugagaacaccaaccucagcaaguaggaagaaaacgguucggcgugccuuuagcgaggggcagauuacucgcagaaugaaccccaccagguccgcucggccuccagaaaaguucgccuuagagaauuuuacagugucugcggcaaaauucgccgaagaguucuauagcuuucgacgcagaaagacuaucggaggcaaaugcagggaguaccggcgcagacauaggauaucaaguuuccgucccgucgaagauaucaccgaggaagaccuggagaacguggcuauuacaguacgggauaagaucuaugacaagguucuugguaauaccugucaccagugccgacagaaaacgauugauacuaagacaguguguagaaaccaagggugcuguggagucaggggccaguuuugcggcccuuguuugcgcaaucgguacggggaggacgugagauccgcccugcuagauccagacugggugugcccgcccuguaggggaaucugcaacugcagcuauugucgcaaacgagacggucggugcgcaaccggcauacucauucaucuggcuaaguucuacggguaugauaaugucaaagaauaccuugagucucugcagaaggaauugguugaggacaacuga

SEQ ID NO: 54124 - RNA, 2511 nt, Artificial Sequence
  derived and/or modified sequence opt3 from CDCP1__Homo_sapiens__NP_073753
auggccggccugaacugcggggugagcaucgcucuccuuggaguccuguuguuaggugcagccagacugcccaggggcgcggaggcuuucgaaauugcccuaccucgggaguccaauauaaccguucucaucaagcuggggacaccaacucuucuggcaaaaccguguuacauugugaucucuaagcgccacauuacgauguugucaaucaaaaguggagaacgaauaguauuuaccuucagcugccagucccccgagaaccauuuugugaucgaaauucaaaagaauaucgacuguaugucuggcccuugcccauucggugagguccagcuccagcccucgacaucacugcugccuacucucaaccguaccuuuauuugggaugugaaagcccacaagagcaucggguuagagcugcaguucaguauaccaagacuuaggcaaauuggacccggcgaauccuguccugacggcguuacacauucuaucagcgggcggauugaugcuaccgugguccgcaucggaacuuuuugcuccaaugguacagugucaagaaucaagaugcaggagggcguaaaaauggcauugcaucugccaugguuccacccgaggaacguuaguggguuuagcauugccaaucggucuuccauaaagcgccuauguaucauugaaucaguguucgagggagagggcagcgcuacccucaugagugccaacuaucccgaagguuuuccugaggacgaacugaugacguggcaguucgucgugccagcgcaccuucgagcaucuguguccuuucugaauuucaacuugagcaauugcgagagaaaagaagagagggucgaguacuauauccccgggucgacuaccaacccugaaguuuucaagcucgaggauaaacagccaggaaauauggccggcaacuuuaaucugucuuuacaaggcugugaccaggaugcucagucccccgggauacugcggcuccaguuccaagugcuuguacagcacccgcagaacgaaucaaacaagauuuacguggucgaccugaguaaugagcgugccaugagcuugacaaucgaaccucgccccgugaagcaauccagaaaauuuguuccaggaugcuucgugugucuagagucuaggacuugcagcucaaaccugacccucacaagugguuccaagcauaaaaucagcuuucugugcgaugaccuuacccggcuguggaugaaugucgagaagacgauuucuuguacugaucaccgauauugccagcgcaaaucauacagucuccaggugccuagcgacaucuugcaucugcccguagaauuacacgauuucuccuggaagcugcuaguuccaaaagacagacucucucuggugcuuguccccgcacagaaguugcaacagcacacacaugagaagccuuguaacaccucguuuagcuaucugguggcuuccgccauuccaucacaggaccucuacuucggcaguuuuugccccgggggaucuauaaaacagauccaagucaagcagaauauuagcgugacucugaggacauucgcgcccuccuuucagcaggaagccucacggcaaggccuuaccguuagcuucaucccuuacuuuaaagaggaagguguguucacgguaaccccagauacaaagucuaaagucuaucugcgcacucccaacugggacagaggguugccuucccucaccagugugagcuggaauaucucuguuccaagggaucagguggcaugucugacauucuuuaaggagcguuccggcgucgugugccagacuggacgggcuuucaugauuauacaggagcaacgaaccagagccgaagagaucuuuucauuagacgaagauguacugcccaagccgaguuuccaccaucacagcuuuugggugaacauuucgaauuguuccccuacaucuggcaaacagcuagaccuccuguucagcguuacccuuacuccaaggacggucgauuugacagugauccugauugcugccgucgggggaggugugcuccuguuaucagcacugggccuuaucauaugcuguguuaagaaaaagaaaaagaagaccaacaaagggcccgccgugggaaucuacaaugacaacauuaauacugagaugccucgccagcccaagaaauuucaaaagggccggaaagauaacgacagucauguguaugcuguaaucgaggauaccauggucuacggucacuugcuccaggacuccucugggagcuuccugcagccagaaguggacacauauagaccuuuucagggcaccaugggaguuugcccgccauccccgccuacuauuuguucaagggcgcccacagcaaagcuagccacggaggaaccacccccucgcagcccacccgagagugaaucugagccuuacaccuucucccacccgaauaacggcgaugugagcucgaaggacacugauaucccacugcucaacacacaagagcccauggaaccugcugaguga

SEQ ID NO: 54125 - RNA, 2367 nt, Artificial Sequence
  derived and/or modified sequence opt3 from CDH10__Homo_sapiens__NP_006718
augaccauccaccaguuccugcuccuuuuucuguucugggugugcuugccccauuuuuguagcccugagauuauguucagaaggacaccagucccgcaacagcggauauuauccucucgcguuccccgaucagacggcaagauccugcaccgucagaaaagaggguggauguggaaccaguuuuuccuacucgaagaguacacuggaagugauuaucaauacguggguaagcugcauagcgaccaggauaaaggcgacgggucccuuaaguauauucugucuggagauggcgccgguacguuguuuaucauugacgagaaaaccggggauauccacgcuacaaggcggauagaccgcgaagaaaaggcauucuacacucucagagcccaggcgaucaauaggcggacccugcgcccuguagagccagagucggaauuugugauuaagauccaugauauuaacgacaaugagcccacauucccugaagagaucuauaccgcuucagucccagagaugagcgugguuggaacaagugugguccaggugacugccaccgaugcagacgaucccuccuacggcaacucugcccgaguaauauauagcauucugcaaggccagccuuacuuuuccguugaaccagagacggggaucauuagaacugcucucccgaauaugaacagggaaaaucgggagcaguaccagguggucauccaagcaaaagacaugggaggucagaugggcggguuaucaggaaccacaacugugaacaucacccugacagacgugaaugauaaucccccucguuucccacagaacaccauucaccuucgcgucuuggaaaguagccccguuggcacggccauagguucugugaaggcuacugacgccgauacagggaaaaacgcggagguagaguauagaaucauugacggagauggcaccgacauguuugauaucgugacugaaaaggacacacaagagggcauaauuaccgucaaaaagccucuggauuacgaauccaggcggcuauauacgcucaagguggaggcagaaaauacccacguugacccacgauucuacuaucuggggcccuucaaagauacaacuaucgugaagaucucaauugaggacgucgacgagccgccuguguuuagccgcaguucuuaccuuuucgaaguacaugaggauaucgaaguuggaaccauuauagguacagugauggccagagaccccgauuccaucagcucgccaauuagguuuucucuggaccggcacacugauuuggaccgcaucuucaacauccauuccggcaaugggucacucuauaccaguaaaccucuggauagagaguuaagccaguggcacaaccugacagucauugcugccgaaauaaacaaucccaaggagaccacuaggguggcagucuuugugcguauccucgacguuaacgauaaugcuccacaguucgccguguuuuacgacacguucguaugcgagaacgcgcggcccggacagcuuauucaaacaaucuccgccgucgauaaagacgauccucugggcggucagaaguuuuucuuuucuuuggcagcugugaauccaaacuucaccguucaggacaaugaagacaacacugcccgaauccuaaccaggaaaaauggguuuaacagacacgagauuagcacauaccugcucccgguggucauaucagauaaugacuaucccauccagaguuccaccggcacucugacaauucgcgugugugcuugcgauagccaaggaaacaugcagucuuguucagccgaagcacuucuguugccugccggccucaguacgggggcucugaucgcgauuuuacugugcaucauaauucuacucguaaucgugguucuguucgcagcccuuaagcggcagagaaagaaagagccauugauucugagcaaggaggacaucagggauaauauagucuccuacaacgacgaaggagguggcgaggaagauacccaggcuuucgacaucgggacucuccgcaaucccgccgcaauugaggagaaaaagcugcgacgggauaucauuccugaaacacuuuuuaucccacguagaacccccacagccccggacaacacugaugugagggacuucauaaacgagcgccugaaagaacaugauuuggacccuaccgcuccacccuaugacucucucgccacguacgcauaugagggaaaugauucgauugcggaaagccuguccucauuagagaguggcaccacagaaggugaccaaaacuacgauuaucugcgggagugggggccuagauuuaauaagcuagcugagauguacggcggaggcgaaucugacaaggauagcuga

SEQ ID NO: 54126 - RNA, 2391 nt, Artificial Sequence
  derived and/or modified sequence opt3 from CDH11__Homo_sapiens__NP_001788
augaaggagaacuacugccugcaggccgcucucgugugucuuggcaugcugugccacagccaugcauucgcccccgaaagaagggggcacuugcggccuuccuuucauggacaccaugagaaagguaaggaaggccaagucuuacagcgcucuaaacgaggguggguuuggaaucaguucuuugugaucgaggaauauaccggaccagacccgguacuggugggccgucuacacucagauauugacaguggugaugggaacauaaaguacauccucagcggagagggcgcgggcacaauuuucgucaucgacgauaaauccgggaauauucacgcuacuaagacgcuggacagagaggaaagggcccaguauacccuuauggcacaagccguggaucgggacacaaaccgcccccuggagccuccaucugaauuuaucguuaaggugcaggauauaaaugacaaucccccugaguucuugcaugagacuuaccacgcuaacgucccagaaagaucgaacgugggaaccucaguaauccagguuacagcaagcgaugccgacgaucccaccuaugguaauagugcuaaacucguguacuccauucuggagggccagccuuauuuuucugucgaagcccaaacugggaucauuaggacagcgcugccaaacauggaccgggaggcaaaggaagaguaccauguggugauccaggccaaagacaugggaggccacaugggugggcucagcggaaccacgaaggucacuauaaccuuaacagauguuaaugacaacccgcccaaauucccucaguccguguaccagaugucaguaagugaggcugccgugccaggcgaagaggucggccgcgugaaggcaaaggaucccgacauuggggaaaauggacugguuacuuauaacaucguggauggugacggcauggagagcuuugaaauuaccacagauuacgagacccaagagggggucaucaaacuuaagaaaccuguggacuucgaaacgaagcgagcuuauucuuugaaaguagaggccgcgaauguucacaucgauccaaaguuuauuuccaacggacccuucaaagacacugugacagucaagauaucaguggaagaugccgacgagccgccuauguuucuggcacccagcuacauccaugaaguccaggagaacgcugccgcuggcaccgugguugguagagugcacgccaaggacccagaugcagccaauaguccuauuagguauucuaucgaccggcauacugaucuagaccguuucuucacaauaaaccccgaggauggguuuauuaaaaccacgaagccacucgaccgcgaagagaccgcuuggcugaauaucacaguauucgcggcagaaauccacaacagacaucaggaggccaaaguccccguggcuauuaggguucuugaugugaaugacaacgccccuaaguuugcagccccauacgagggcuucaucugugaauccgaucaaacuaaaccgcugagcaaucagcccauugucaccauaucggcugacgauaaggacgauacagccaacggaccucgguuuaucuucucuuugccacccgagauuauccacaauccuaacuuuacugugcgagacaaucgcgacaacaccgcaggcguauaugcgagaaggggaggguucucccggcagaagcaggaucucuaccuguuaccaaucgugauuucagacgguggcauacccccgaugaguagcacaaauacccugacuaucaaaguuugcgggugugaugucaacggagcucuccuuuccugcaaugccgaagcauacauucugaacgccggcuugucuacgggugcucuaaucgccauucuggcauguaucgugauacuccuggugaucgucguucuuuuugugacacugcgcagacaaaagaaagagccuuugauuguguucgaagaggaggacguaagggaaaacaucauuaccuaugaugacgaagggggcggagaagaggauacugaggcuuuugacaucgccacccuccagaauccagauggcauaaacggguucauuccccguaaggacaucaaaccugaguaccaguauaugccccggccaggacugcgaccugcgcccaauagcgucgauguggacgauuuuauuaacacaagaauccaggaggccgacaaugacccaaccgcuccgccuuacgauucaauacaaaucuaugguuacgaaggcagggggaguguugcaggauccuuaagcucucuggagucagccacuacagacagugaucuagacuaugauuaccuccagaacuggggcccccgcuucaagaagcuggcugaccuuuacgguagcaaagauacguucgacgaugacuccuga

SEQ ID NO: 54127 - RNA, 2283 nt, Artificial Sequence
  derived and/or modified sequence opt3 from CDH13__Homo_sapiens__NP_001207417
augaagacacccccuggcgccagcuccagaaccaaaugcucuagggagcugcggucauucugugcuuuuaguugcccacgcgcaaagcagccgacuuguacggccugguucccccaacaggaacacccuagcgagaacgggccacagaugcccggacgagacccuccagcggcuuccaccaugcaagugcuccuucugacaucugccgaagauuuggacugcacucccgguuuucagcagaaagucuuccauaucaaucagccugcagaguuuauugaagaucagucgauauuaaaccugaccuucucagacuguaagggcaaugauaaacuacguuacgagguuagcaguccauauuuuaaggugaacuccgacgggggacucguagcccugagaaauaucacagcugugggcaagacccuuuucguccacgcaaggacuccgcaugccgaggauauggcugaacuggugauuguuggugggaaagacauccaaggaucuuugcaggauauuuuuaaguucgcccggacaagccccgugccucgccagaaaagauccaucgucgugucaccaauacucauccccgagaaccagaggcaaccuuuuccacgggacguaggcaagguuguggauagugaccgccccgaacgaagcaaauucagacugaccggcaagggggucgaucaggagccgaagggaauuuuuaggaucaaugagaacacggguucuguguccgugacucggacccuggaccgugaagucauugcgguuuaccaacucuucguggagacaacugacguaaauggcaaaaccuuagaagggccugugccccuggaggucaucgugauagaucagaacgacaaucgcccaauuuucagagaaggaccuuauaucggccacguuauggaggguucacccacagggaccacggugaugaggaugacugcauuugaugccgacgauccagcuacagacaacgcccuuuugcgguacaauauucgacagcagacccccgauaagccuagcccaaacauguucuauaucgacccggagaaaggagauaucgucacugugguaagucccgcacugcuagaccgcgaaacacucgagaauccuaaguacgaacugauuauagaggcucaggauauggccggccuugacguuggccugaccgggacggcgaccgccacaaucaugauugacgauaaaaacgaccauucuccaaaguuuacuaaaaaggaguuccaagcaaccguggaagagggagcugucggugugaucgucaacuugacaguggaagauaaggacgaucccacuaccggcgccuggagagcugccuauacaauaauuaaugggaacccuggacaguccuuugagauccacaccaauccacagacuaacgaaggcaugcucagcguugugaaaccccuggacuacgagaucucggcauuccacacguuacugauuaagguagaaaaugaggauccgcucgucccugacgugucuuacgguccauccucaacagccaccguucauaucacugugcuugaugucaacgaggggcccguguuuuauccugaccccaugaugguaaccaggcaggaagaucugagugugggcagcguuuugcuaacagucaaugcuaccgacccagauucccugcaacaccagacuauucgguacucuguguauaaagacccugcgggauggcucaacauaaaucccaucaacggcacaguggacacgaccgcaguccuggaucgcgagagcccauucguugacaauucaguguacacugcccuuuuucuggcuauugauagugggaacccgccugccacaggaaccgguacauugcucaucacucuggaagacgugaaugauaacgcacccuucaucuauccaaccguagccgaggucugcgacgaugcuaagaauuuauccgugguuauucugggcgccagcgacaaagaucuacaucccaacacggacccuuuuaaguucgagauacacaagcaggcagugccagauaaagucuggaagaucucuaaaauuaacaauacccacgcgcucgugucacugcuucagaacuugaauaaggcuaacuacaaucugcccaucaugguuacagacagugggaaaccuccgaugacuaacauuaccgaucucagagugcaaguauguagcugccguaauuccaaggucgacuguaacgccgcaggagcccugagguuuucucuuccaucggugcuguugcucagccuguucuccuuagcuugccuguga

SEQ ID NO: 54128 - RNA, 2445 nt, Artificial Sequence
  derived and/or modified sequence opt3 from CDH15__Homo_sapiens__NP_004924
auggacgccgcuuuccugcucgugcuuggccuguuggcacagagcuuaugccugucccuagggguccccggauggagaaggccuaccacacucuacccauggcggcgcgccccggcgcugucucgaguucguagagcuugggugauucccccuaucucaguaagugagaaccacaagaggcuuccauauccccuggugcaaauaaaaagcgauaagcagcaguuggguuccgucaucuacucuauucagggcccugggguggacgaagaaccacggggaguguuuucgaucgauaaauucacuggcaagguuuuucucaaugccaugcuggaccgcgagaaaacggauagauucaggcugcgggcauuugcccucgacuuaggugggucaacccuggaggaucccacagaccuugaaauugucgugguagaucaaaacgacaaucgcccugcuuucuugcaggaggcauuuacuggacgaguucuggagggcgccgugccaggcaccuaugucacaagagcugaagccaccgaugcggacgauccggagacugacaacgcagcccuaagguucagcauccuccagcaggggagucccgaacuguuuuccauagacgagcuuacaggagagauccggaccgugcaagugggucuggaucgugaagucguugcuguguacaauuugacgcuccagguagccgacaugucuggcgaugggcugacugcaaccgcuagcgccauuaucacauuagacgauauuaacgacaaugcgccugaguucacucgcgaugaauuuuucauggaggccaucgaagcaguguccggagucgacgugggcagacuggagguugaggauagggaccucccagguucacccaacuggguggcucgguuuaccauacuugaaggggauccugacggacaguucacaauucgaaccgacccaaagacgaaugagggcguccugaguaucgugaaggccuuggauuaugaaagcugugagcauuacgaacuaaaaguaucuguucagaacgaggcuccccugcaagccgcagcccuccgcgcugagagaggccaggcgaaggugaggguccacgugcaggacacuaaugaaccgccugucuuccaagagaacccccugcggacaucccuugcagaaggggccccaccuggaacccugguggcuacuuuuucagcccgcgaucccgacacagagcaguugcagagacucagcuauaguaaagauuacgacccagaagauuggcugcagguugacgcagccaccgguaggauucaaacgcagcauguguuaucucccgcuuccccuuuccugaagggcgggugguaccgugccaucguacuagcacaggaugacgcgagccagccacggaccgcuacaggaacucucucgaucgagauucuggaggucaaugaucacgccccggugcuugcacccccuccacccggcucuuugugcuccgaaccucaucaagguccagggcugcuccugggcgccaccgacgaggaucuucccccgcacggagcuccuuuucacuuccagcugucaccacgauugcccgaacucggcagaaacuggagucugagccagguuaaugugucccaugccagguuacgcccucggcaccagguccccgaggggcugcauagacuaucucuccugcuuagggacagcggacaaccaccucagcagcgcgagcagcccuugaacgugacaguaugucgaugcgguaaagacggcgugugucugccaggggcagcugcccuccuggcgggaggcacugguuuaucacugggggcccuuguuauagucuuggcuagugcacuccugcuacuggugcucgugcugcuugucgccuugcgggcucguuuuuggaagcaauccagaggcaagggacuguuacacggcccgcaggaugaccucagggauaacguucugaauuaugacgaacaagggggaggugaggaagaucaggacgccuacgauaucagccagcuucgccacccuaccgcacugucuuugccccucggcccacccccucugcggagagacgcgccacaggggaggcuacauccccagccuccgcgagugcugccaacaucaccccucgauauugccgacuucaucaacgauggacuggaggcugccgacagugauccuagcgugccacccuaugacaccgcacuuauauacgacuaugaaggcgaugguuccguagcugggacuuugucuucgauucugagcucccaaggcgacgaggaucaggacuacgauuauuuacgcgacuggggaccucgguuugccagacucgcagauauguacggccacccgugcgggcuggaguacggagccaggugggaccaucaggcucgugaaggccuuucacccggugcgcugcuaccacgccaccgggggagaacggccuga

SEQ ID NO: 54129 - RNA, 2424 nt, Artificial Sequence
  derived and/or modified sequence opt3 from CDH16__Homo_sapiens__NP_001191673
auggugcccgccuggcuguggcuccuuugcgucagcguuccucaggcucugccaaaggcacaaccggccgaguuguccguggaaguacccgagaacuacggcgggaauuucccuuuauaucugaccaaacuaccacuccccagagaaggagcggagggucagaucgugcugucuggcgacucagggaaggcuacagaaggaccuuuugccauggauccagacaguggcuuccuucuggucacuagggcauuggaucgggaggagcaggccgaauaccagcuccaagugacgcuggagaugcaggacggucacguucugugggggccccagccugugcucguccaugugaaagaugaaaacgaccagguaccacacuuuagccaagcuauuuaucgcgcacgauuaucccguggaaccagaccgggcauacccuuccuguuucuugaggccucugauagggacgagccuggcacagcuaauucggauuugcgguuccauauccugucacaggccccagcgcagcccagcccugacauguuucagcuagaaccacgccucggggcacuggcccuuagucccaagggauccacuucucuggaucacgcuuuggagagaaccuaccaacuccugguucaggugaaagacaugggugaucaggccagcggccaucaagcaacagcuaccgucgaaguguccauuaucgagucaacuugggugaguuuagaaccgauucaccuggccgagaaccucaagguccuuuauccucaccauauggcgcagguucacuggagcgggggagacgugcauuaccaccuggagucucaucccccaggcccuuucgaaguaaaugccgaggguaacuuguaugugacaagggaacuagaccgggaggcacaggcugaauaccugcuccagguccgcgcccaaaauucccacggggaggauuacgcugcaccccuggagcuucacgugcugguuauggacgaaaacgauaaugugccaaucugucccccucgagacccaaccgucucaauaccggaguugagucccccuggaacggaagugacuagacucagcgccgaggaugccgacgcuccaggcucucccaacucccauguaguuuaucagcuguuaagcccugaaccagaggauggcguggaggggagggcguuucaggucgaccccaccucgggaucugugacacuggguguccuaccgcuccgggcaggccagaauauccugcuuuuggugcuggccauggaucucgcuggggccgaaggaggcuucuccucaacuugcgagguugaaguggcaguaaccgacauuaacgaucacgccccugaguuuaucacaagucaaauugguccaaucagccugcccgaggacgucgaaccugggacccuuguggcuaugcugacggccauagacgcagauuuggagcccgcguuccgucucauggacuuugcuauugaacgcggcgauacugagggaacauucggccuggacugggaaccagauuccgggcauguuagauuaaggcuguguaagaaucuaucuuacgaggccgcaccuagccacgagguggucgugguagugcagucaguugccaaacucgucggacccgguccaggcccgggggcuaccgccacugugacagugcuggucgaacggguuaugccucccccaaaacuugaccaggagaguuaugaagcauccgugcccaucagcgcuccugccggaucuuucuugcugaccauucagccaucagaucccaucagucgaacgcuccgcuuuagccuggugaacgacuccgagggcugguuaugcaucgaaaaauucucuggugagguacacaccgcgcaaucgcugcagggggcccagccuggcgauacauacacuguccuuguggaggcucaggacaccgcauugacacucgccccgguuccaagccaauaucuguguacucccagacaggaucauggacuaauuguguccggcccuucaaaggacccagaucuggcuagugggcacggacccuacucuuuuacccucgguccuaauccgacaguccagagggacuggcggcugcaaacccuuaacggcagccaugccuauuugacucuggcauuacacuggguggaaccccgcgagcacauaaucccaguugugguaucccauaacgcgcagauguggcagcuccuggucagagugauuguguguaggugcaaugucgaagggcagugcaugcguaaaguuggacggaugaagggcaugccuacgaaacuuucagccguggguauccugguagggacauugguggcuauaggcauuuuccucauccugaucuuuacccacuggacuaugagccgaaagaaggaccccgaucaaccagccgacucugucccucuaaaggcaaccguguga

SEQ ID NO: 54130 - RNA, 2499 nt, Artificial Sequence
  derived and/or modified sequence opt3 from CDH17__Homo_sapiens__NP_001138135
augauacugcaggcccaccuccauagccuuugccuguugauguuauaccuggcuaccggcuaugggcaagagggaaaguucuccgguccccuaaaaccuaugacauuuucuauuuacgaaggccaggagccaucacagauaaucuuccaguuuaaggcaaacccgcccgccgugacuuucgaacucacgggggagaccgacaauauuuuugucaucgaaagagagggacugcuuuauuacaacagggcgcuggaucgggagacacgcaguacucacaauuugcaaguugcugcccucgacgcaaacggcauuaucguggaagguccuguaccaauaaccaucaaagugaaggauauuaaugacaaccgacccacauuccugcagagcaaauaugagggguccguccgucagaacucuagaccuggaaagccauuucuguacgugaacgccaccgaucucgacgaucccgcuacuccuaauggccaguuauauuaccaaaucguuauucagcugccaaugaucaacaaugugauguacuuccagauaaacaauaagacaggcgcaauuucgcuuaccagggaagggucacaggaguugaacccggccaaaaaucccagcuauaaccuggucaucagugugaaggacaugggaggucaauccgagaacucuuuuagcgauacgacuuccguagacauuaucguuaccgaaaauaucuggaaagcuccuaagccaguggagauggucgaaaacucaacagauccccauccuauuaaaauaacucaggugcgguggaaugacccaggcgcccaguacagucuaguggauaaggagaagcucccccgcuucccguuuagcaucgaccaagaaggggacauuuaugucacccagccucuggauagagaggagaaagacgcguacguuuucuaugcaguggccaaggaugaauacggaaaaccccuuucuuauccacuggagauccacguaaaggugaaagacauaaacgauaauccucccacauguccaucccccgucaccguguuugaaguucaggagaacgaaagguugggcaauucaauugguacgcucacugcucaugaccgggaugaggagaacacagccaauagcuuccugaacuaccgcaucguggaacagaccccuaaguuaccaauggacgggcuguuccucauccaaacuuacgcaggaaugcuucagcuggcuaaacagaguuugaagaagcaggauacaccgcaauauaaucuaaccauugaggucucugacaaagauuuuaagacgcugugcuucgugcagaucaacguaauugacauaaaugaccagauccccauuuuugaaaaauccgauuacggcaaccucacccuggccgaggacacaaauaucggcagcacuauccuuaccauucaggcgacagaugccgacgaaccuuucacugggucgucuaagauacuguaucacaucauuaaaggagauuccgagggucgauugggcguugacaccgauccacacacaaacaccggguacgugaucauuaagaagccccucgacuuugagacugcagcugucucaaacaucguguucaaagccgaaaauccugagccacuggucuuuggagugaaguauaacgcuaguagcuucgccaaauuuacguuaauaguuacagaugugaaugaagcaccccaauucucccagcauguauuucaggccaaggucucugaggacguggcuaucggcaccaaaguugguaacgugacugcgaaggauccggaggggcuggacauuagcuacucacuaagaggcgauaccaggggauggcucaagaucgaccacgucacaggcgaaauuuucaguguggcaccucuggaccgggaggccggguccccauaucguguacaggugguugcuaccgaagucggagguagcucucuuucaagugugagcgaguuucauuugauccugauggaugugaaugacaaucccccucgccucgccaaagauuacacuggccuguucuucugucacccccuuuccgcaccagggucucugauauuugaagccacagacgaugaccaacacuuguucagaggaccucauuuuacguucucgcucggcagcgguucccugcagaaugauugggaggucucaaagauuaacgggacccacgcuagguuaaguacucggcauacagaguuugaggaacgagaauacguugugcugauccgcauuaaugacggcggaagacccccacuagagggcaucgugucucucccgguaaccuucugcagcugugucgaaggguccugcuuuaggccugccggacaccagacagguauacccacugugggcauggcaguugggauccugcuuaccacguugcuggugauuggaaucauucucgcggucguguucauccggaucaaaaaggauaaaggcaaggacaacguugagucagcucaagccagcgaggugaagccacugcgcucuuga

SEQ ID NO: 54131 - RNA, 1725 nt, Artificial Sequence
  derived and/or modified sequence opt3 from CDH18__Homo_sapiens__NP_001161139
augaagaucaccagcacauccugcauuugucccgugcuggucugccucuguuucguucagagaugcuacggcacugcccaccauucuucaauaaaagugaugaggaaccaaacgaagcacaucgagggggaaaccgagguacaucaccggccuaaacgcggauggguguggaaucaguuuuucguccuugaggaacauauggguccagacccgcaguaugugggcaagcugcacaguaacagcgauaaaggggacggauccguuaaguacauuuugacaggcgaaggugcugggacuaucuuuauuaucgaugacaccacaggagauauacacucuaccaagucguuagaccgagagcagaaaacucauuaugugcugcacgcacaagccaucgaucguagaacaaauaagccccuagagccugaaucagaguucauuaucaaaguccaggacauuaacgauaaugcgccaaaguuuaccgacggccccuacaucgugacgguaccugaaaugagcgauaugggcaccaguguucuccaggugacugcuacagacgccgaugacccaacuuaugggaacuccgcaagggucguguacucuauacugcagggacaacccuauuucagcguggacccuaaaaccggugucauucggacagcccuucauaauauggaucgcgaggcuagagagcacuacuccguugugauccaggcaaaggacauggccggccagguagggggacugucaggcaguaccacggugaacauuacuuugacagaugucaaugacaacccaccgagguuuccccagaagcacuaccaacucuaugugccugaaagcgcucagguugguucugccguggggaaaaucaaggcgaaugaugcagacaccggauccaacgccgauaugacuuacucaaucauuaauggcgacggcauggggauauucagcaucaguacagauaaagagacccgggaagguauucugucucugaagaaaccacucaacuaugagaagaaaaaguccuacacguuaaauaucgaaggagcuaacacccaucuggacuuucgcuucagccaccuuggccccuuuaaggaugccacaauguugaaaauaauugucggggacguggacgagccuccacuguucucgaugcccucuuaucuaauggagguauacgaaaacgcaaagaucggaacuguugugggcaccguccucgcucaggauccggacuccacaaauucacuggugcgauauuuuaucaacuacaaugucgaggaugacagauucuucaacauugaugccaauacugguaccaucaggacaaccaaagugcuugaccgggaagagacuccuugguacaacauuacgguuacagcgagugaaauagauaaucccgaccuguugagccaugugaccguagggauccguguccucgaugugaacgacaauccaccugagcuggcccgcgaguaugauauuaucguuugugaaaacuccaagcccggccaagugauccacacuauuucugcaaccgacaaagaugacuuugcuaauggaccaagauucaacuuuuucuuagacgagaggcugcccgucaauccuaacuuuacacucaaggauaaugaagccgcugccccaagcccgucaggcuucgugcaugcacgggagauggggguaugcggacccgccaugcagaagccuaguuguccacgacuuguguga

SEQ ID NO: 54132 - RNA, 1473 nt, Artificial Sequence
  derived and/or modified sequence opt3 from CDH19__Homo_sapiens__NP_001257957
augaacugcuaccugcuccuuagauucaugcugggcauccccuuguuauggccuugucugggggccaccgagaauagccagacaaagaaagugaagcaaccagucaggucccaccuacggguuaaacgcggauggguguggaaccaguuuuucguaccggaagagaugaauacuacgucucaucacauuggucagcuccgaucagaccuggauaacggcaauaacaguuuucaguauaaacuucugggggcuggagcaggcagcaccuucauaaucgacgaacguacaggugauauuuacgccauccaaaaguuggacagagaggaaaggucccucuauauucugcgggcucaggugaucgauauagcgacugggcgcgccgucgagcccgagucugaauuugugaucaagguuucggacauuaaugauaacgagccuaaguuccuggacgaaccauacgaggcaaucgugcccgagaugucaccugaaggaacccucgucauucaggugacagccagcgaugcugacgauccaaguuccggcaauaacgcaagauuacuguauucucuuuugcagggccaacccuacuuuagcguagagccuaccacugggguuaucaggauauccucaaaaauggaccgggaacugcaggaugaguauugggugauuauccaggccaaggacaugauuggacagccaggugcucuaaguggcacaaccagcguccucaucaaacugucugacgugaaugauaacaagccgaucuucaaagaaucccuuuaccgccugacggugucagagagcgcccccacugggaccaguauuggaacaauaauggcguacgacaaugauaucggcgagaacgcagaaauggacuauucuauugaggaagaugacucccaaacuuuugauaucauaaccaaucaugagacacaggaagguauugucaucuugaagaagaaaguugacuucgagcaccagaaccauuacgggauccgagccaaggugaaaaaccaccacguaccugagcaacucaugaaguaucauaccgaagcuagcacgacuuuuauuaaaauccagguggaggaugucgacgaaccaccccuguucuuacugccuuacuauguguuugagguuuucgaagagacaccacagggaucguucgugggcgucgugucugccaccgaucccgacaauagaaaguccccgauuagguacucaauaacucggaguaaaguauuuaacaucaaugacaacggcacaauuaccacgagcaauucccucgaucgugagaucucugcaugguauaaccuuagcaucaccgcuacagaaaaguacaauauugagcagauaucaaguaucccucuguacguucaaguguugaacauuaaugaccacgcccccgaguucucccaguauuacgaaacuuaugucugcgagaacgcggggagcggacagggucuauuuuucuga

SEQ ID NO: 54133 - RNA, 2649 nt, Artificial Sequence
  derived and/or modified sequence opt3 from CDH1__Homo_sapiens__NP_004351
augggccccuggagcagaucccugucugcccuccuucuguuguuacaggugucaaguuggcugugccaagagccugaaccaugucacccgggguucgacgcugagagcuacaccuuuacaguccccaggcggcaucuagaacgcggacgaguucucggucgugugaacuucgaggauugcacuggcagacagaggacggcauauuuuucccuggacacccgguucaagguagggacagauggagugaucacugucaaacgcccucuuagauuucacaauccacagauucauuuccugguguacgccugggacucuaccuauaggaaguuuucgacaaaaguuaccuugaacacugugggccaccaucaccggcccccuccacaccaggcgucagucagcgguauacaagcugaacuccugacauuccccaauaguuccccugggcugcgccgacagaagagagauugggugaucccaccgauuucuugucccgagaacgagaaaggaccuuuuccaaagaaucucguacagaucaagagcaacaaagacaaggaaggcaaaguuuucuacuccauuaccggccagggggccgauacgcccccugugggagucuuuaucauagagagggaaacugguugguuaaaggugaccgagccacuggaccgggagcguaucgcaacauauacucuuuucucacaugccgugaguagcaauggcaacgcugucgaagaucccauggagauuuugaucaccguuacagaccaaaaugauaacaaaccggaauuuacccaggagguguucaaggggucuguaauggaaggagcacugccuggcacguccgugauggaggucacugccacagacgcugaugacgacgugaauaccuacaacgccgcgauugcauauacuauccuaucacaggaucccgagcucccagacaagaauauguucacaauaaaccgcaauaccgguguuauuagcguggucacgaccgggcuggauagagaaaguuuuccuacauacacucuugugguacaggccgcugaccugcaaggagagggcuugucuaccacagccacugcaguuaucaccgugacagauaccaacgacaaucccccaauuuucaaucccacuacguacaaaggccaggucccugaaaacgaggcuaauguggucaucacaacccucaaggugacugaugccgacgcgccaaacaccccggccugggaagcaguuuauacaauccugaaugaugacgggggacaguuugugguaaccacuaaccccgucaauaacgaugguauuuuaaaaacagcuaagggccuggacuucgaggccaaacaacaguacauacuccacguggcuguuacgaauguggucccuuuugaggugucccuuaccacuagcacagccaccguaacaguggacguucuggaugucaacgaagcaccaaucuucgugcccccugagaagaggguggaagucucggaggacuuugggguuggacaggaaauuacuucuuauaccgcccaggagccagauacguucauggagcaaaagaucaccuaccggauauggcgagacacagcuaauugguuggaaauuaaccccgauacuggcgcgaucuccacccgcgcagagcuagacagagaagauuuugagcaugugaaaaauucaacauauacugcccugaucauugcuaccgacaacgguaguccgguggccacggggacaggcacccuccugcuuauccugagcgauguaaaugacaacgcaccuauuccagagcccaggacuauauucuuuugcgaacggaacccuaagccccaggucaucaauauuaucgaugccgacuugccaccuaacacaucccccuucaccgcugagcucacucacggagccucugcaaauuggaccauccaguacaacgauccaacacaggaaagcauuauacugaaaccgaagauggcguuagaggugggcgacuauaaaaucaaucugaagcuaauggacaaccaaaauaaagaucagguuacgacccucgaagugucagucugugacugcgagggggcugccggagugugucgcaaggcacagccuguugaggccggucugcagauucccgcuauccuuggcauucucgggggaauccuggcccuccugauacuuauccuguugcuccuguuauuucugagaaggcgugcagugguaaaggaaccacuauugcccccugaggaugacacucgggauaacgucuacuacuaugacgaagagggcgguggggaagaggaucaagacuucgaucugagucagcuucaccgaggcuuggacgcuagaccagaggugacaaggaaugauguggcccccacccugauguccgucccucgcuaccucccgcggccagcgaaccccgacgaaauuggaaauuucaucgaugagaaccugaaagccgcugacacagacccuacugcaccacccuaugauagcuuacugguuuuugacuacgaaggcucugggucagaggccgcuagucuuagcuccuugaacucuucggaaagcgauaaggaccaggauuaugacuaccucaacgaguggggaaauagauucaaaaagcuggccgauauguaugguggcggggaggacgauuga

SEQ ID NO: 54134 - RNA, 2406 nt, Artificial Sequence
  derived and/or modified sequence opt3 from CDH20__Homo_sapiens__XP_005266739
auguggaccagcggcagaauguccaacgccaagaauuggcuggggcucggaaugucucuuuacuucuggggucugauggacuugacaacuacgguguuaucagauacccccacaccucagggcgagcuggaagcucuacucagugacaaaccacaaagccaccagaggacuaagcgguccugggucuggaaccaguuuuucguucuggaggaauauaccgggacagauccgcuuuacgugggaaaacugcauucugacauggaucgcggcgacgguucgaucaaguauauuuugucaggggagggagcaggcauaguauuuaccaucgaugacacuacaggcgauauucacgccauccagcgacucgaccgugaagagagagcgcaauacacccugagggcucaggcccuggaucggcgcacggggagacccauggagccugaaagcgaguucauuaucaaaauacaggacaucaaugauaacgaaccaaaguuucucgacggacccuauguggcaacugucccugagaugaguccaguggguaccuccguuauucaggugacagccacugacgcugaugaccccaccuacggcaauucugcaagggucguguauagcaucuuacaagggcagccuuacuucuccguagauucaaagacaggaguuauucggaccgcccugaugaacauggaccgcgaggcuaaagaauacuaugaggugaucauacaggccaaggauaugggcggucagcuugggggauuggcgggcacgacuacagucaauauuacccugagugacgugaacgauaauccaccgcgauuuccccaaaaacauuaccagaugagcgugcuagaaucugcaccuaucuccucaacugucggcagaguuuucgccaaggaccucgaugaggggauuaacgcugaaaugaaauauacaaucguggacggagauggugccgacgcauuugacaucagcaccgauccaaauuuccagguaggcauuauaacggugaagaagccccugaguuuugagucuaaaaaguccuacacccuuaaagucgagggggcuaacccucaccuggaaaugagguucuugaaucucggaccauuucaagacacaacuaccgugcauaucagcguugaggauguggacgaacccccggucuucgagccuggcuucuauuuuguggaaguacccgaggauguugccauugguacaacuauccagauaauuucggcgaaggacccagaugugaccaacaauucuauccgguacuccaucgaccguucaagugauccugggcgcuucuuuuaugucgacauuacaaccggcgcccugaugacugcaagacccuuagauagggaggaguucagcuggcacaacaucacggugcuggcuauggaaaugaacaauccaucccaggucggaucugugcccguuacaauuaaagugcucgacguaaacgauaaugccccugaauuuccacgguucuacgaggcuuuugucugcgaaaacgccaaggcaggccagcuuauacaaaccgugagcgccguugaccaggacgauccgcgaaaugggcagcacuucuacuauucacuggcucccgaggcggcaaacaauccuaacuuuacuauccgcgacaaucaggauaacaccgccagaauuuugacaaggcggaguggauuccgccaacaggagcaguccguguuucaucuaccaauccugaucgcugacagcggucagcccguccucucuucaaccggcacucugacaauucaaguguguaguugcgaugacgaugggcacguaaugagcuguuccccugaagccuacaugcuuccagugucucugucgagaggagcauugauagccauccucgcuugcauuuucguucuguuaguccuggugcuacucauccugagcaugaggcgucaucggaaacagcccuauauuaucgacgaugaggaaaauauacacgagaacaucgugcgauacgacgaugagggcgguggggaagaggacacggaagccuuugauauugcagcgauguggaauccgagagaggcucaggccggcgcagccccuaagaccaggcaggacaugcuuccagaaaucgaguccuugucacgcuaugucccccaaacuugugcuguuaacaguacagugcacucuuacgugcuggccaagcucuaugaggcagacauggaucugugggcuccucccuucgacagccuucagaccuacauguucgaaggagauggcuccguagccgggucacugagcucuuugcaguccgcgacaagugacagcgagcaaucuuuugauuuccucacugacuggggaccacgguuuagaaaacuggccgaauuauacggugcuuccgagggcccugcaccccugugguga

SEQ ID NO: 54135 - RNA, 2487 nt, Artificial Sequence
  derived and/or modified sequence opt3 from CDH22__Homo_sapiens__XP_011527296
augagacccaggccugagggccgggggcugcgcgccggaguggcucucagcccagcacuucuguuguuacugcuacucccgcccccuccaacccugcuuggucgacugugggccgcgggcacacccuccccuucugcuccaggggcccgucaggacggagcauugggcgccgguagagucaagaggggguggguuuggaaccaauucuuugugguagaagaguacacuggaacggaaccccucuaugugggcaaaauccacucagauagugacgagggcgauggggcuauuaaguacaccauaagcggagaaggugcaggcacaaucuuccugauugacgagcugacuggggauauccaugccauggagcggcucgaccgcgaacagaaaaccuuuuauacauuaagagcucaggccagggaucgggcgaccaaucgccugcuugagccugaauccgaguucauuaucaagguccaggacauaaacgauucugagccacgauuuuugcacggaccguacaucggcucgguggcagaacugucacccacugguacaagcguuaugcaagugauggccagugacgcugaugacccuaccuauggguccucugccaggcuagucuacagcgugcucgauggagagcaucacuucacgguagacccaaaaacuggcguuauuagaaccgcagugcccgaccuggaucgggaaucccaggagcguuaugaagucgugauccaggcuacagacauggccggccagcuugggggacugucagguaguacuaccgugacaauugucguuaccgaugugaaugacaacccuccacgcuuuccccaaaagauguaccaguucagcauccaggagucugcgccgauaggcacggccguagggagagugaaggcagaggauuccgacgucggagaaaauacugauaugacauaccauuugaaagacgagucaagcaguggcggugauguguuuaagguuaccacugacucugauacacaggaagcuauuaucgugguccagaaaaggcucgacuucgagucccaaccugugcacaccguaauucuggaagccuuaaacaaguuuguugacccccgguucgcugaucuggggacguuucgagaccaggccaucgugcgcgucgcagugaccgaugucgacgagccaccugaguucagacccccaagcggccuccuugaagugcaagaggaugcccagguuggaucgcuggugggcguagucacagcuagggaccccgaugcggcaaaucggccugugcgcuaugccaucgacagagaaucugauuuggaccagauuuucgauauagacgcugauacuggggccaucguuaccggaaaaggucuagacagggagacagcaggcuggcacaacauuacugugcuggccauggaagcugacaaucaugcccagcucucccgugcaucacugcggauccgaauacuugaugucaacgacaauccaccggagcuggcgacccccuacgaggcugccgugugcgaagaugcaaagccugggcaauugauucagacaaucaguguaguggacagagaugagccacagggaggccacagguuuuauuuccgccucguucccgaagccccuagcaacccacauuuuucccuguuagacauccaggauaauaccgcugccguccacacucaacacguggguuucaaccggcaggagcaggacguguuuuuccugcccauucuagucguugauucugggccgccuacgcucagcucaacaggcacccugacuaucagaauuuguggaugcgacaguuccggcaccauacagagcuguaauacaaccgcauuugugauggcugccucucuuucaccaggggcguugaucgcccugcucgugugcguacugauucuugucgugcugguuuugcucauccugacuuuaaggcgccaucacaagagucaucugagcuccgaugaggacgaagauaugcgagacaacgugaucaaauacaacgacgagggagguggcgaacaagauacagaggcuuaugacaugucugcacuacggucgcucuacgauuucggggaacugaagggaggcgacggugggggcagcgccggaggcggggcuggaggcgguuccgggggaggcgccgguucacccccucaggcacaccuucccagugagcgucauucuuugccacagggcccucccagcccagagccggauuuuuccgucuucagagacuuuauuucaaggaaaguggcgcuggccgauggggaccucagcguuccucccuaugaugcuuuccagacguacgccuuugaaggagcagacucuccagcugccucccugaguagcuuacacucuggcuccucagggagugagcaagauuucgcauaccugagcucguggggaccccgcuuccggccucuugccgcuuuguaugcgggccacagaggugacgacgaagcccaggcauccuga

SEQ ID NO: 54136 - RNA, 4146 nt, Artificial Sequence
  derived and/or modified sequence opt3 from CDH23__Homo_sapiens__NP_001165401
augggcagacacguggccaccagcugccaugucgcuuggcugcucguucuuaucuccggguguuggggacaggugaacaggcugcccuucuuuacaaaucacuucuuugacacuuacuuguuaauuucugaggauacgccuguagguucaagugugacccaacugcuagcacaggacauggauaacgacccacucgucuucggcgugagcggggaagaggccucccgguuuuucgcgguugaaccggauacaggaguggucuggcugcgccagccccuugaccgagagacuaagucugaauuuaccguggaguucucgguaucagaucaucagggcguuauaacacguaaagugaauauccaagucggugacgugaacgauaaugcuccuaccuuucacaaccagccauauagcgugcggauucccgagaauacuccugucgggacaccaaucuucauuguuaacgccaccgaccccgaucugggagcaggcggcaguguguuguacuccuuucagccuccaucucaguucuuugccaucgacagcgcuagggggauaguaacggugauccgggaacucgauuaugagacuacccaagcauaccagcugacagucaaugccacugaccaggacaagacccgcccgcuguccacacucgcuaacuuagccauuaucauuaccgaugugcaggacauggaucccaucuucauaaaucugccuuauucaacgaacauuuacgaacauaguccacccggaacuacaguuagaaucauuaccgcgaucgaccaagauaaagguaggccucggggcaucggguauacuauugugagcggaaauacaaacucuauauucgcacuugacuacaucuccggcgucuugacccugaauggucuacucgaucgcgagaacccacuguacucacacggguuuauucuuacggugaagggaaccgagcugaacgacgaucgaacacccagcgacgccacuguaaccacaacuuucaauaucuugguuauagauauuaacgacaaugcuccggaauuuaacaguucugaguauuccguggccaucaccgaacucgcacaggucggcuucgcucugccuuuauuuauccagguggucgacaaagaugagaaucugggccucaacagcauguucgaaguguaccuuguugggaauaacucgcaccauuuuauuaucucucccacauccgugcaaggaaaggccgacauuagaauaaggguagcgaucccacuggauuaugagaccgucgaccgguacgauuucgacuuguuugccaaugagucagugccugaucacguugguuaugcaaaggugaaaauuacucuaaucaacgaaaaugacaaccgucccaucuucagucagccacuguacaauauuagccucuaugagaacgucacggugggcacauccguacugaccgugcuugcuacugauaaugacgccgggaccuuuggagaaguuucuuacuucuuuagcgaugaccccgaucgcuucucacuggacaaggacacaggcuugauaaugcucaucgcuagacuggauuacgaguuaauucagagguucacccugacuaucauugcccgggacggugggggcgaagagacaacgggacgaguccgcaucaacgugcuagaugugaacgacaaugucccuaccuuucagaaagaugcauauguuggcgcccucagagagaacgaaccaagugugacucaacuggugaggcuucgggcuacagacgaggauuccccgcccaauaaccagauaaccuacagcaucguaucugcgucagcauucgggaguuauuuugacauuagcuuguacgaaggauauggugucaucuccgugucucgcccucuggauuacgagcagauuucgaauggccucaucuaucugacaguuauggccauggacgcugggaacccaccccuuaauagcacugugccugucaccauagaaguguucgaugagaacgacaauccacccacguuuuccaagccggccuacuucguuucagugguagagaacauuauggcaggagccaccguccuguuuuugaaugcuacagaucucgacagaaguagggaauacggccaggagucuaucauuuauagccuggaagguuccacucaauuccguaucaacgcccggucaggggagauaaccacaacuagcuuacuggaccgagagaccaaaucugaauacauccuaauugugagagcaguggauggcggagucggccauaaucagaagacggggaucgcgacaguuaacauuacccuccuggacaucaaugauaaccacccuacuuggaaggacgcuccauauuacauaaaccuuguggagaugacacccccugauuccgacguaaccacuguggucgccguggaucccgacuugggagaaaaugguacccugguuuauaguauucagccaccuaacaaauuuuacagccucaauucuacaacgggcaagaucaggaccacucacgcaaugcuggaucgcgagaaccccgacccacaugaagccgaguuaaugcggaaaaucguggucuccgugacagauugcgggagaccgccucugaaggcuaccucaagugccacaguuuucgugaaucuuuuggaccucaacgacaaugaucccacuuuucagaaccugccauucgucgcagagguacuagaaggcauucccgcuggagugagcaucuaucaaguuguggccauugaccuggaugagggucucaaugggcuggucucguacaggaugccugugggcaugccacgcauggacuuucuuauaaacuccucuagcggaguaguggucaccacgacagaauuggaucgagagcggaucgcggaauaccagcugcguguuguggccucagacgcuggcacccccacuaaaaguuccaccucuacauuaacuauucacgugcucgaugucaaugacgagaccccuacauucuucccggcaguguauaacguuagcguauccgaggaugugccaagagaauuuagggucguguggcugaauuguacggacaacgauguugggcuuaaugccgagcugucauacuucaucaccggaggcaacguggacgguaaguuuagcgucggguaucgcgaugcugugguacggacugucgugggauuggacagagaaacaaccgccgcauacaugcucauucuggaggcgaucgacaacggccccguugguaaaaggcauacuggcacagccaccguguucgucacggugcuagauguuaaugacaaccgaccuauauuucugcagaguucuuaugaagcuagugugccagaggauauccccgaggggcacagcauucuccagcugaaggccacugacgcagaugaaggagaguucggccgcgucugguaccggauccuucaugggaaucacggaaacaauuuuaggauucacgugucgaacggcuugcugaugagagguccucguccguuagaccgcgaaagaaauucaucucauguacucaucguggaggcuuauaaccacgaucuggggcccaugagaaguuccguuagggucauaguguacguggaggacauuaaugaugaagccccagucuucacccaacagcaguacagccgacuuggacugcgggagacagcaggcaucgguaccucuguaaucgugguucaagccacugaccgcgauagcggcgacgggggccuagugaacuauaggauucucuccggagcugaagggaaguuugagauagaugaaucaacaggacugaucauuaccgucaauuacuuggacuaugagacaaaaacuuccuacaugaugaacgugagcgcgaccgaccaggccccucccuucaaucagggcuuuugcucuguuuauaucacgcuguuaaacgagcucgaugaagcagugcaguucuccaaugcuucauacgaggccgccauucuggaaaaccuugcucuggguacagagaucgucagagugcaagcauauaguauagacaauuugaaccagaucaccuaccgguucaacgccuacacuagcacccaggcgaaggcucucuuuaaaauugaugccaucacaguacgaggguggggacagggcgcaccauuccugccuauuuga

SEQ ID NO: 54137 - RNA, 498 nt, Artificial Sequence
  derived and/or modified sequence opt3 from CDH26__Homo_sapiens__NP_068582
augaagccccugaucuggaccuggagcgacguggagggccagagaccugcccuccuuauuugcacagcugcagccgggccaacucaaggagucaaagaucuggaagagguuccgcccuccgcggcuucucagucagcccaggcaaggugugccuuggguaguuggggcuacgggaagccuuucgaaccacggagcgugaaaaacauacacuccacgcccgcuuauccugacgcaaccaugcaucgccaguuacuggccccaguagagggacgaauggcugaaacacuaaaucaaaagcuccacguggccaacguccuggaggaugaccccggcuaccuuccucauguguauucugaggaaggugagugcgggggagcgccaucgcugagcucauuggcaagucucgaacaggagcugcagccggaucugcucgacuccuuaggcucuaaagccacucccuuugaggaaaucuacagcgaguccggcguuccuucauga

SEQ ID NO: 54138 - RNA, 2721 nt, Artificial Sequence
  derived and/or modified sequence opt3 from CDH2__Homo_sapiens__NP_001783
augugcagaaucgccggcgcucugaggacccuccuuccccuguuggcagccuuacugcaggcgagcguggaggcuuccggggaaauugcccuauguaagacaggauucccugaggacgucuacucugcaguucucucaaaagaugugcacgaaggucaaccacugcuuaacguaaaguuuaguaauugcaacggcaaacggaaggugcaguaugagagcuccgaaccggccgacuucaaagucgaugaggacgggaugguguacgcuguucgcucuuuuccccugucgucagagcaugcaaaguucuugauauaugcccaggauaaggaaacucaggagaaauggcaaguggcugucaagcucagccugaaaccuacgcugaccgaagagagugugaaggaguccgccgaaguagaggaaaucguuuuuccacgacaguucucuaaacacagcggacaucuccagcgucagaagagagacugggugauucccccuaucaauuuaccagagaacuccaggggccccuuuccucaagaacugguccggauucgcucagauagagacaagaaucuuaguuugagguacagcgugacagguccaggggcggaucagccgcccacuggaaucuucauaaucaacccuauuucuggccagcuguccgugaccaaaccacuagaccgggagcagaucgcacgcuuucaccuccgagcccaugcugucgauauuaauggcaaccaaguugagaaucccaucgacauagugauuaacguaaucgauaugaaugacaacagaccugaguuccugcaccagguguggaaugggacagucccagaaggaucaaagcccgguaccuaugugaugacuguuacagccauugacgcagaugacccgaacgcucuuaauggcaugcugagguaccggaucgugagccaggccccuaguacccccucuccaaacauguuuacgaucaacaaugaaacuggggauauuauaaccgucgcggccggauuggaccgugagaaagugcaacaguauacacucaucauucaggcaacugauauggaaggcaacccuaccuacggucuguccaauacagcuaccgccguaaucacgguuacugacgugaacgauaaucccccagaguucacagcuaugaccuuuuacggggagguccccgaaaaccgcguggacauaauugucgccaauuuaacugugacagauaaggaccagccucacaccccagcauggaacgccguuuauagaaucagcggaggcgauccgacgggcagguucgcuauccaaaccgaccccaauucgaacgacgggcuggugacaguagucaaaccuauugauuucgagacuaaucggauguuugugcucaccguugcggcagaaaaccaggugccacuugccaagggaauccagcaucccccucagucuacagcuacugucuccgugaccguaauugacgugaaugagaacccauacuucgcccccaauccgaaaauaauccgacaagaagagggucugcacgcaggcacaauguugaccacuuuuacggcccaggauccugaccgcuauaugcagcagaacauuagauacacaaagcuaucagauccagcuaacuggcugaagaucgaccccguuaaugggcaaaucaccacuauugccguccucgauagggagaguccuaacgugaaaaauaacauauauaaugcaaccuuccuggcgagcgacaacggaaucccgccaauguccggcacagguacccuucagauuuaccuguuggauaucaaugacaacgcuccucaggugcucccccaggaagccgagacuugugaaacaccagaucccaauucuauuaacaucacggcacuggacuaugauauagacccuaaugccgggcccuuugcuuucgacuuaccacugagccccgucaccaucaagcggaacuggacuauuacacgccuaaauggcgauuuugcccaacucaaccugaaaaucaaguuccuugaggcaggaauuuacgagguuccuaucauaauuaccgacucaggcaauccacccaaaaguaacaucuccauuuugagagugaaggugugccagugugauagcaacggggacugcacagauguagacaggaucgucggagcuggucugggcacuggggccauaaucgcgauucuccuguguaucauuauccuucugauauuggugcucauguuuguuguguggaugaagcgucgggauaaagaacgacaggccaagcaacuguuaauugacccugaggaugacgucagagauaauauccugaaauacgacgaagagggaggcggugaagaggaucaggacuaugaccuaucucagcuccagcaaccggauaccguggagccagacgcuaucaagcccguugggauuaggcgcauggaugaacggccuauccaugcagagccacaguaccccgugagaucagccgcuccucacccgggcgacauuggagauuucauaaacgaaggccugaaagccgcagacaaugaucccacggcgccaccuuaugacagucuuuugguauuugauuacgaggggagcggauccaccgccgguucucugucgagccucaacuccucaaguucuggcggggaacaggacuaugauuaccugaaugacuggggacccagguucaagaaguuagcugacauguauggcgguggggaugacuga

SEQ ID NO: 54139 - RNA, 2490 nt, Artificial Sequence
  derived and/or modified sequence opt3 from CDH3__Homo_sapiens__NP_001784
augggccugcccagagggccucucgccagccuucuguuguuacaggugugcuggcugcaaugugcugcauccgagccaugcagggccgucuuccgggaagcggagguuacccuagaagcuggaggugccgagcaggaaccgggccaggcacucgggaagguguuuaugggaugucccggccaggagccugcccuguucucuacagacaacgaugacuuuacuguacgcaauggugagacggugcaagaacgacguucacuuaaagagagaaacccacugaagaucuuccccaguaaaaggauuuugcggcgccacaagagagauugggucguggcuccuauaagcguuccagaaaaugggaaaggacccuuuccucagaggcucaaccagcugaaguccaauaaggaccgggauaccaaaaucuucuacucuauuacaggcccaggcgcagacucgccgcccgaggggguguuugccgucgagaaggaaacuggauggcugcucuuaaacaaaccucuggaucgcgaggaaaucgcuaaguaugagcuuuucggucaugccgugucagaaaauggcgcgagcguagaggacccaaugaacauuaguaucauaguuaccgaucagaaugaccacaaacccaaguuuacacaagauaccuuccgaggguccguguuggagggaguccugccuggcacuucugugaugcaagugacagcaaccgacgaagaugacgccaucuacacguauaacggugucguugcuuacagcauucauucccaggagccaaaggacccccacgaucuaauguuuacuauccauagaucaaccgggacaauuagugugaucagcucuggacucgacagggaaaaaguaccggaguauacucugaccauacaggccacagauauggacggcgauggcuccaccacgacugcaguggcugucguggaaauucuugacgccaaugauaacgcgccuauguucgacccccagaaguacgaggcccacguuccagagaaugcaguggggcacgaaguccagcggcugacagugaccgauuuggacgcuccuaacucacccgccuggcgugcuacuuaucucaucaugggaggugaugacggcgaccauuuuacaauuaccacgcacccagagagcaaucaggggauccugaccacacgcaaaggauuagauuucgaagccaagaaccaacauacucuguacguagagguuaccaacgaagcacccuucgugcucaaacuuccuacaaguacugccaccaucgucgugcacgucgaggacgugaaugaggcuccaguuuuugugccgcccucuaagguagucgaagugcaggagggcauuccuacaggugaaccaguuugcguguacaccgcggaggaucccgacaaagagaaccagaagauauccuauagaauccugagggauccugcagggugguuggccauggacccagauagcggccaggucacugcugugggaacgcuagaccgggaagaugagcaauucguacgaaauaacauuuacgaagugaugguucuggccauggacaauggcucgcccccgacaaccgggacuggaacccuccugcuuacacugaucgaugucaacgaccacgguccugugccagagccccgccagauaaccauuuguaaucagucuccugugagacaggucuugaacaucacugauaaggaccucucaccccauacauccccauuucaagcacagcugacggacgauagugacaucuauuggaccgccgaaguuaaugaggagggcgauacugugguguuaagccugaaaaaguuccuaaaacaggacacauacgauguacaccucucccugucugaccaugggaacaaggaacagcuuaccgucauuagggcuacagugugcgauugucacggacauguugagacuugcccuggccccuggaaagguggguuuaucuugccagugcugggcgccguccucgcacugcuuuuccuguugcucgugcuguuacugcuaguucggaagaagcgcaaaauuaaggaaccgcuccugcuuccugaggacgauaccagagacaauguguuuuauuacggagaagagggcgggggagaggaagaucaagacuaugauauaacgcaguugcacaggggucuggaggcgcgucccgaaguaguccuccggaacgacguggcuccaaccaucauucccacaccuauguaccgaccaagacccgccaauccugacgagaucggcaacuucaucauugaaaaucugaaagcagccaacacugauccgaccgcuccacccuacgacacauuacugguguuugauuaugaggggagcggaucagacgccgcaagucuuuccagcuugacuucuucagcuagugaucaggaccaggauuacgacuaucucaacgaguggggcagcagguucaagaaacuggccgauauguacggugggggcgaagacgauuga

SEQ ID NO: 54140 - RNA, 2640 nt, Artificial Sequence
  derived and/or modified sequence opt3 from CDH4__Homo_sapiens__NP_001239267
augaacggcagcugcgacuucauccuguccgccucuuuucuccccuguuucaaggaggugaaauuuucaaguugcgucgggaccaagggaacacaguacgaaacuaauagcauggauuucaaaguuggugcugacggcacgguguuugcaaccagagagcuucaaguaccuuccgaacagguggccuucacagucacugcgugggauucucagaccgcugagaagugggacgccgugguuaggcuguugguggcacagacaucgucaccacacagcgggcauaaaccgcaaaagggaaagaaagucguggccuuagaucccaguccuccacccaaggacacccugcuaccuuggccacagcaccagaacgcuaauggccuccggcgccgaaaacgugauuggguaauucccccuauaaacguuccagaaaauuccagagguccguuuccccagcaacuggugaggauccggucugacaaggauaacgacauuccuauccgcuauagcauuacuggggucggagcagaucagccacccauggagguguucuccaucgacucaaugaguggcagaauguacgugacaaggccuauggaucgggaggaacaugccagcuaucaccuucgcgcucaugccgucgacaugaauggcaacaaaguugagaauccaauagaccuguacaucuaugugauugauaugaacgacaaucgacccgaauuuaucaaccagguauacaaugggucuguggaugagggauccaagccggguaccuaugucaugacggugacugcgaacgacgcagaugacucaaccacagccaauggcaugguuagauacaggauugugacucagaccccucaaagccccagucagaacauguucacaaucaacucugagaccggggauauagucacgguggcugccggauuggaccgggaaaagguacagcaauacacuguuauugugcaggcaacagauauggagggcaaucucaacuauggucuguccaauaccgcuacugccaucauuacagucaccgacgugaacgauaauccaccugaauuuacggcgagcaccuucgccggggagguccccgaaaaccguguggagacaguuguggcaaaucugacuguaauggaccgcgaccagccacacucgcccaacuggaaugcugucuacagaaucaucucuggagauccuuccggccacuuuucagugaggaccgacccaguuacaaacgagggcauggugacugucgugaaagccguagauuaugaacucaaucgggcuuucauguuaaccgugaugguuaguaaccaggccccgcuggcaagcgggauucaaauguccuuccagucuacagccggagucaccauaagcaucauggacauuaaugaggcucccuacuuuccuucaaaccauaaacuuauccgauuggaagagggugugccacccggcacugugcugacgacauucagugcggucgauccugaccgcuuuaugcagcaggcaguuagauauuccaagcuaagcgauccagccucuuggcuccacauaaaugcuaccaacgggcaaauuacuaccgccgcagugcuggacagggaaucacuuuacacaaagaacaauguguaugaggccaccuuccuggcugccgauaacggaaucccgcccgcaaguggcacugguacauugcagaucuaccucauugacaucaaugauaacgcgccugagcuguuaccaaaagaagcucagauuugugagaagcccaaucugaacgccauaaauaucacggcagccgacgcugauguagacccuaacauugggcccuacgucuuugaacucccauucgugccugccgcaguucggaaaaauuggaccaucacucgccuuaacggcgacuaugcucagcugagcuugagaauccuauaccuggaggccggaauguaugaugugcccauuauagucacagacuccggcaauccaccgcucucuaacaccucgaucauuaaggugaagguuugcccuugugaugacaauggggauugcacaacuaucggagcgguggccgcugcaggucugggcaccggggccauuguagcuauccuuauauguauccugauuuugcucacgaugguccuguuauuugugauguggaugaaaaggcgugaaaaggagcggcauaccaaacaacugcuaaucgaccccgaggaugacgugcgagauaacauucucaaguacgacgaagagggaggcggugaagaggaucaggacuaugaucugagccagcuucagcaaccagaggccauggggcacguccccuccaaagcaccuggcguuagaaggguggacgaacgcccaguaggagcggagccccaguacccuauccggccgauggugccacaccccggcgacauaggggauuucauuaaugaaggauugagagccgcugacaacgauccuacagccccacccuaugacucacugcucgucuuugauuacgaggguaguggcucuacugcagggagcguguccucacugaacucuagcuccaguggagaccaggauuacgacuaucuuaaugauuggggcccuagguucaagaagcuggcugacauguacggugggggcgaagaggauuga

SEQ ID NO: 54141 - RNA, 2355 nt, Artificial Sequence
  derived and/or modified sequence opt3 from CDH5__Homo_sapiens__NP_001786
augcagagacugaugaugcuccuugccaccagcggcgcuugccugggguuguuagcaguggccgcggucgcugccgcaggagccaaccccgcucaaagggacacacacucccugcuaccuacucaucggcgccagaagcgagauuggaucuggaaucagaugcacauugacgaggagaaaaacacgucucucccacaucacguugguaagauaaaaucaagugugagccguaagaaugcaaaauaccugcuuaagggcgaguauguagggaagguguucagagucgaugccgaaaccggagacguguuugcuaucgagaggcuggaucgggaaaacauuuccgaguaccauuugacagccguuaucguggacaaagauacuggcgagaaucucgaaaccccgucuucguucacaauuaagguccacgacgugaacgauaauuggcccguauuuacccaccgccuguucaacgcgucaguuccugagagcagugcaguggguacuuccgucaucucugugacagccguggacgcugaugacccaaccgucggggaucaugccagcguuauguaucagauacugaaaggaaaggaauacuuugcaaucgacaauuccggcagaauuaucacgauuacuaaaucacucgacagggagaagcaagcucgguaugagaucgugguagaagcccgcgaugcgcagggcuuacgaggggacaguggaaccgccacagugcuggucacucuucaggauauaaacgacaauuuccccuuuuucacccagacaaaguacaccuuugugguuccugaggauacgagaguggguacuagcgucggcucuuuguucguggaagacccagaugagccccaaaacaggaugacaaaauauuccauucugcguggggacuaccaggaugcauuuaccaucgaaacuaauccugcucacaacgagggaauuaucaagccaaugaaaccgcuagacuacgaguauauccagcaguacucauucauuguagaagccacagaucccaccauagaccuccgguauaugagcccuccagcuggcaaucgcgcccaaguuaucauuaacaucacggacguggaugagcccccuauauuucagcagccauucuaccauuuccaacugaaggaaaaccagaaaaagccccuuauugguaccguccuggcaauggacccggaugccgcuagacacaguaucggguauucuaucaggcggacauccgacaaaggacaguuuuuccgagugacuaagaagggcgauauuuacaaugagaaagaauuggaccgcgaggucuauccuugguacaaccucaccguggaggcgaaggaacuggauagcacaggcacucccaccgggaaagagucgaucguucaggugcacauugaaguauuagacgagaaugauaacgcaccagaauuugccaagccuuaccaacccaaagucugugagaaugcugugcauggacagcugguucuccagauaucugccaucgacaaggauauuacaccaagaaacgugaaguucaaauuuauccuuaauaccgagaacaauuucacucugacggacaaccacgauaauacagcaaacaucaccgucaaguauggucaguuugacagggaacauacuaaagugcacuucuugcccguagugauuuccgacaauggcaugccuucacggaccgggacaaguacccuaacuguugccgucugcaaguguaacgagcaaggagaauuuacauucugcgaggauauggcugcccaggugggcgugagcauacaggcagucguugcgauccugcucuguauucugacgaucaccgugauuacucuucugaucuuuuugcgcagaaggcuccguaaacaggcucgggcccaugguaaguccgugccagagauacacgaacaacugguaacauacgacgaggaagggggcggagagauggauaccacaucuuaugacgucagcguguuaaauucaguucgaagaggcggggcaaagccgcccaggccugcccuggaugcucgcccaagucuauacgcccaggugcagaaacccccucggcacgcaccaggagcucaugguggccccggggaaauggccgcgaugaucgaggucaagaaagacgaggccgaucacgacggagauggcccgccuuaugacacucuccauauuuacgguuaugaaggguccgagagcaucgcugaaucucugucaagucuuggcaccgauagcuccgacucugauguggacuacgacuucuugaacgauuggggaccaagauuuaagaugcuggcagagcucuacggcucggaccccagggaagaacugcuuuauuga

SEQ ID NO: 54142 - RNA, 2373 nt, Artificial Sequence
  derived and/or modified sequence opt3 from CDH6__Homo_sapiens__XP_011512223
augagaaccuacagguauuuccugcuccuguuuugggugggccagcccuacccuacacuuagcacuccauuguccaagcggacgucuggguucccggccaaaaagcgcgcuuuagagcugucaggaaacaguaaaaaugaacuaaaccgaagcaagcguuccuggauguggaaucaauuuuuccuccuggaggaauauaccgguucugacuaccaguaugucggcaaacuucacucggaucaggacagaggggauggaucacugaaguacaucuugagcggcgacggugcaggggaucucuuuauuauaaacgagaauacaggagacauccaggccacuaagaggcuggaucgggaagagaaacccguuuauauucugcgcgcgcaagcuaucaacagaaggaccggccggccuguggagccagaaagugaguucauuaucaagauacaugacaucaaugauaacgaacccauuuuuacaaaagagguauacaccgccacugugccugagauguccgacgucggcacauucgugguucaggugaccgcaacggaugccgacgauccaacuuacggaaauucugcuaaggucguguauagcauccuccaggggcagcccuacuuuuccguagaaucagagaccgguauuaucaaaacagcauuacugaacauggaccgcgaaaaucgagagcaauaucagguugugauacaggccaaggacaugggcgggcagaugggaggccuuagugguacuaccacagucaacauuaccuugacggaugugaaugacaacccuccaagauucccgcaaagcacuuaccaguuuaagacacccgaaucuuccccuccagggacccccaucggaaggauuaaagccucagaugcugacgugggcgagaaugcggagaucgaauauagcaucacugauggcgaggggcuggacauguucgaugucauuacagaccaggaaacccaagagggaauaaucacgguuaagaaacuacucgauuuugaaaagaaaaagguguacacccugaaaguagaggcaaguaacccuuauguggagccacgguuccuuuaccugggucccuucaaggacucugccacaguccguauugugguugaagauguggacgagccgccugucuuuuccaaguuggcuuacauccuccagauacgcgaagacgcccagauuaacacuaccaucggcagcgugacagcacaggaucccgacgcugccagaaauccaguaaaauauucgguugauaggcacacugacauggaucggaucuucaacauugacucugggaauggauccaucuuuaccucaaagcuguuagaucgagagacacugcucuggcauaacauuaccgugauagcgacugaaaucaauaacccuaaacaaaguagccgcgucccccuuuacauuaaggugcuggacgucaaugauaacgccccagaguucgcagaguuuuaugaaacguucgugugcgagaaagcuaaggccgaccaguugauccagacacuacacgcuguugauaaggacgaucccuacuccggccaucaguuuucuuucagccuggccccugaagcagccucagguaguaauuuuaccauccaagacaacaaagacaauacugcugggauucucaccagaaagaacggcuauaauaggcacgagauguccacauaccugcuuccagugguaauaagcgauaacgacuauccgguccagucuucaaccggaacugugacaguucgggugugugcgugcgaucaccauggcaauaugcagaguugucacgcagaggcccugauccaucccacgggguugagcaccggagcucucgucgccauucuguuaugcaucgugauucugcuaguaacugugguucucuucgcagcccugcgcagacagaggaaaaaggaaccucuuaucauauccaaagaggacauccgugauaacauugucucuuacaacgacgaagguggcggggaggaagauacacaggcuuuugacaucggaaccuugcggaauccagaggccauugaggauaacaagcugcgaagagacaucgugcccgaagcacucuuccugccuaggcgcacaccaacugcgcgggauaauaccgacgugagagauuuuauaaaccaaaggcuuaaggagaaugacacggaccccaccgcuccgccuuacgauucgcuggccacauaugcauacgaaggcacugguagcgucgccgacuccuugucaagucucgagucuguuaccacagaugcugaccaggauuaugacuaccugagcgauugggggccacgcuucaaaaaguuagccgacauguauggcggaguggauuccgacaaagauucauga

SEQ ID NO: 54143 - RNA, 2358 nt, Artificial Sequence
  derived and/or modified sequence opt3 from CDH7__Homo_sapiens__NP_387450
augaagcugggcaaaguggaguucugccacuuucuccagcuuaucgcccuguucuuguguuuuagcgggaugucccaagcugaauuaucuagaucaaggaguaagcccuacuuccagagcggacggucccgcaccaaacgaucuugggucuggaaccaguuuuucguucuggaggaauauauggguucggacccucuauacgugggcaagcuccauucagauguagacaaaggggauggaagcauuaaguauauacugaguggcgagggugcauccucuaucuuuauuaucgacgaaaauacaggggauauucacgccacuaagcgucuugacagagaggagcaggcguacuauacgcugagggcucaagccuuggaucggcucaccaacaaaccaguggaaccggagagcgaauuugucaucaagauacaggacaucaaugauaacgagcccaaauuucuggacggaccuuacacagcaggcgugccagagaugucccccguuggcacuucagugguccaggugaccgccacagaugcugacgauccuaccuaugggaauagugcacgcguaguuuacagcauucugcagggacaaccauacuucucuguggaacccaagacuggugucaucaaaacagcccucccuaacauggacagagaggcuaaggaccaguauuuacuggugauucaggccaaggauauggugggccagaaugggggacuuuccggcaccacgucagucacuguuaccuugacagacgugaacgauaauccaccgagguuuccccggcgcagcuaccaauauaacguaccugaaagucugccaguggcgucugucguggcacgaaucaaagccgcugacgccgauauaggugcaaaugcugagauggaauacaagauuguugacggggauggacuaggcaucuucaaaauuuccguggacaaggagacucaggagggcaucaucaccauucagaaagaacucgauuuugaggccaagacaagcuauacccugagaauagaagcggccaacaaagacgcagaucccagguuccuuucgcuggggccuuucucugacacgacuacagucaagaucauuguggaggacguagaugaaccacccguuuucuccucaccguuguacccuauggaggugagugaggcuacccaagucggaaauaucauagguacuguggccgcucaugaccccgauagcuccaacucuccaguccgguauagcauugaccguaauacagaucucgaacgcuacuucaacaucgacgccaacucaggcgugaucaccacggcaaagagucuggauagagagaccaaugccauucacaacaucacaguuuuagcuauggaaucccagaauccuagccagguggggaggggauacguagcgauuacuauacuggacaucaacgauaaugcacccgaguuugccauggacuaugaaaccacagucugcgagaacgcucagccaggccaagugauucagaaaaucucugccguugauaaggacgagcccucaaauggucaucaguucuacuuuagucucacuaccgaugcaacaaacaaucacaacuucagccuuaaagacaauaaggacaacaccgccuccauccugacucggcgaaauggguuucgcagacaggaacaaucuguguauuacuugccuauuuucauagucgauucgggcagcccaucccuaucaaguacgaacacacugaccaucagggugugugacugcgaugcugacggaguagcccagacuuguaaugcagaggcguaugugcucccggcuggccugucuaccggggcccuuauugcaauccuggccugcguuuugacacuccuggucuuaauucugcuaaucgugaccaugcggcgcaggaaaaaggaaccccucauauuugaugaggagagagacauccgugaaaacauugugcgguacgaugacgagggagguggcgaagaggauacugaggcuuucgacauggccgcacugcgaaaccuuaaugucaucagagauacaaagacgaggcgcgacguuaccccugaaauucaguuuuugagccggccagcuuucaaauccauccccgauaacgugauauuuagagaguucauuugggaaaggcugaaggaggccgacguggacccuggggcgccacccuaugauucacuccagacuuacgccuucgaaggaaauggcagcguagcugagucucuguccagucuugacagcaucucuuccaacucagaucaaaauuacgacuaucugagugauugggguccgcgcuuuaaacgauuggcagacauguacgggacaggccaggaaagccucuauucguga

SEQ ID NO: 54144 - RNA, 2400 nt, Artificial Sequence
  derived and/or modified sequence opt3 from CDH8__Homo_sapiens__NP_001787
augcccgagagacuggccgaaaugcuccuugaccuguggaccccuuugaucauuuuauggauaacacugccaccgugcaucuacauggcucccaugaaccagagccaagugcuaauguccggcucuccucucgagcuaaauucacuuggggaagaacagaggauucugaaccggaguaagcgcggaugggucuggaaucagauguucguuuuggaagaguuuagcgguccagagcccauccucgugggccgacugcacacugaucuggacccuggguccaaaaagauuaaauauauccucucuggagauggcgcagguacgauauuccagaucaacgacguaaccggggauauucaugccaucaagcguuuagacagagaagagaaagcggaauacacacugacugcucaagccguggauugggagaccucgaagccacuugagcccccuucagaauuuauuaucaagguccaggacauaaaugauaacgcaccagaguucuugaauggaccguaucacgccacagugcccgaaaugagcauucugggcaccaguguuacuaacgugacagcuaccgacgcagaugacccugucuacggcaauuccgccaaacugguguauucuauccucgaggggcagccauacuuuagcauugaacccgagacggcuaucaucaagacugcccugccuaacauggauagggaggcgaaagaagaguaucuuguaguuauucaggcaaaggacaugggaggucauuccggcgggcugucaggaaccacaacuuugaccgugacacucaccgacgucaaugauaacccacccaaauucgcccaaagucuguaccacuuuagcgugccggaagacguggucuuaggcacggcuauaggucggguuaaggccaaugaucaggacaucggggagaacgcacagucuuccuacgauauuaucgacggagauggcacugcucuguucgaaauaacaucagacgcccaggcgcaagauggcauuauccgccucagaaagccucuugacuuugagaccaaaaagagcuauacucugaaaguggaggccgcaaauguacauaucgaucccagguucagugggcggggaccauuuaaggacacagcuaccgugaaaauugucguggaagacgccgaugagccucccguuuucucuuccccaacguacuugcuagaagugcacgagaacgcugcccugaacagcgucaucggucaggugaccgcacgcgaccccgauauuacaucgucuccuauacgauuuuccaucgacagacacacugaucucgaaaggcaguucaauauuaacgccgacgauggcaagaucacccuggcuacaccacuugaccgggagcugucaguauggcauaauaucacuauuauagcgaccgagauccguaaccacagucaaauuagccgcguuccgguggcaaucaaagucuuggaugugaaugacaacgcccccgaguucgcuuccgaguaugaagccuuucucugugagaaugggaagccuggacaggucauucagacagugucugcaauggauaaggacgaucccaaaaacggccauuacuuccuguauagcuuacugcccgagaugguuaauaacccuaauuuuaccaucaagaaaaacgaagacaauucacuaaguauacucgccaagcacaacgguuucaauagacagaaacaagagguguaccugcuuccaaucauuaucuccgacagcgggaacccaccguugucuucaacgaguacucugacaauuaggguaugcggcuguagcaacgauggagucgugcaguccugcaauguugaggcuuaugugcucccuaucggccugucuaugggggcccuuauagcaauucuggcguguaucauuuugcuccuggucaucgugguauuauuugugacccugcggcgacacaagaacgaaccacuaauaaucaaggacgaugaagacguucgcgagaauauuaucagauacgaugacgagggagguggcgaagaggauacugaggcuuucgacauugccacccuccagaaccccgaugggaucaauggauuucugccuaggaaagacauaaagcccgaucuucaguucaugccacggcaaggcuuggcaccuguccccaacgguguggacguggaugaauuuauuaauguccgccugcaugaagccgacaacgacccaacagcuccgccuuacgauucgauccagaucuauggguacgagggcagaggaagcguugccggcucccucucaagucuggagucuaccacuagcgacuccgaucagaauuucgacuauuuaucagauugggggcccagguuuaaacgucugggagaacuuuacagcgugggugagucugacaaggaaacauga

SEQ ID NO: 54145 - RNA, 2370 nt, Artificial Sequence
  derived and/or modified sequence opt3 from CDH9__Homo_sapiens__XP_011512224
augagaaccuaccacuauaucccccuguucauuuggacauacauguuucauacuguggacacgauacuccuucaggagaagccuaacagcuaucuguccucuaaaaagaucgccggcuugaccaaagaugacgggaagauguuaaggcggacaaaacgcggauggauguggaaucaauucuuucugcuagaagaguacacugguaccgauacacaguaugucggcaagcuccacaccgaccaggauaagggggacggaaaccugaaauacauucuuacuggcgauggugcugggucacuguucguuaucgacgaaaauacaggagauauucaugcagccaagaaauuggaccgagaggaaaagagucucuauauccugcgugcgaaagcuauagauagaaagaccggcaggcaaguggagccagagagcgaauuuaucauuaagauccacgacauuaacgauaaugagccgaaauucacgaaggaccuguacacugccuccguacccgaaaugucuggcguggggaccucggucauccaggugacagcaacugacgccgaugacgcuaacuacggaaauucagcaaaaguuguguauagcauacuccagggucagccuuacuuuagugucgauccagaguccggcauuaucaagaccgccuuacccgacaugucucgggagaaccgcgaacaguaucaagugguaauucaggcuaaagauaugggagggcagaugggcggucugagcgggacaaccacgguuaauaucacucuuacagacgugaacaauaacccuccaagauucccccaguccaccuaccaauuuaauucaccugagagugucccauugggaacucaucugggcaggaucaaggccaacgauccggacgugggcgaaaaugcggagauggaauauagcauugcagagggggauggagccgacauguucgaugugauaacagacaaagacacccaggaggguaucauuacggucaagcagaaccuagauuuugaaaaccaaaugcucuacacccugcggguugacgcuucuaauacacaccccgauccucgcuuccuucaccugggcccauuuaaggacacugccgugguaaaaaucuccguggaggauauagacgaacccccugucuucaccaaggugucauauuugauugagguugaugaagacgugaaagaggggagcaucaucggacaggucacagcauacgauccagacgcucgaaacaaucucauuaaguacaguguggauagacauacugacauggauaggaucuucggcauucacucugagaacgguuccauauuuacccugaaagccuuagaccgggaaagcucgcccuggcauaauaucacaguaaccgcgacugagauuaacaauccgaagcagucuucccacaucccuguuuucauccguauucuggacauaaacgaucacgcccccgaauuugcaauguauuacgagacguucgugugcgaaaaugcuaagccagggcagcucauccaaacagucucagugauggacaaagaugacccuccccgcggccauaaguuuuucuuugagccaguccccgaguucacccuuaacccuaauuuuacuauuguggauaacaaagacaauaccgccggaaucaugacaagaaaggauggcuauaguaggaacaaaaugagcaccuaccuguugccaauucuaaucuucgacaaugauuauccgauacaguccucuacugggacacugacgauccggguuugugcuugcgacaaccagggaaacaugcagagcuguaccgccgaagcacucauucugucagccggucuuaguacuggcgcucugguggcgaucuugcucugcguacugauuuuacugauccuagucgugcucuuugcagcccugaagcgacaacgcaagaaagagccccuuauaauuuccaaggaugacguuagagauaauaucgugacauacaacgacgaagggggaggcgaggaggacacccaggcuuucgauauugguacauugaggaauccugaagcccgggaggacagcaaacugcgcagagaugucaugccagaaacuaucuuucagauaaggcguaccgugccccucugggagaacaucgacguacaggauuucauucaccggcgacugaaggaaaaugacgcagauccuucugccccacccuaugacucacuugcuacguacgccuacgaggggaacgauaguaucgcagacagccuguccucuuuggagucgcucaccgcggauuguaaucaagacuaugacuaccugagcgauuggggcccgagauucaaaaaguuagcugacauguauggaggcgaugacuccgauagggacuga

SEQ ID NO: 54146 - RNA, 2238 nt, Artificial Sequence
  derived and/or modified sequence opt3 from CDHR1__Homo_sapiens__NP_001165442
augagaaggugccggugggccgcucuggcacucggccuucugcgcuuguguuuagcccaggcgaacuucgcuccccacuuuuucgacaauggggugggaagcaccaacgguaauauggcccuguuuucccuaccugaggauacaccagucggcucucauguuuacacucucaacgggacggacccggaaggagaucccaucucauaucacauuaguuucgacccuagcacccgauccguguuuucuguagauccaacauucggcaauauaacucugguggaggaacuugaccgugagagagaagaugagaucgaggcaauuaucucgauuucagacggucugaacuuggucgccgaaaaggugguuauccucgugaccgaugcuaaugacgaggcacccagguuuauacaagaaccuuacgucgcccuggugccagaggauauccccgcugggagcauuaucuucaaaguacaugccguugaccgggauacaggaaguggcggcuccgugaccuauuuucugcagaaccuccacucuccuuucgcggucgaccgccauagcgggguguuaagacugcaggcaggagccacucuugacuacgagaggucccggacacacuauauuaccguggucgcuaaggaugguggcgggcgcuugcacggagccgacguuguguuuucagcaacgacuaccguaacagugaaugucgaagaugugcaggacauggcuccaguuuucgugggcacuccguacuaugguuacgucuacgaggauacccugcccgggagugaagugcuaaaaguaguugccauggacggagaucgaggcaagccuaacagaauccucuauagccuggugaauggcaacgacggggcguuugagauaaaugaaacaucuggagccauuuccaucacccaaucaccagcacagcuucagagggaggucuacgagcugcaugugcaggucacggaaaugagccccgcugguaguccugccgcucaagccacugugccaguuacaauucggaucguggauuugaacaaucacccgcccaccuucuauggcgagucugggccucagaaccguuucgaacucuccaugaacgagcaucccccacagggagaaauccugcgcggcuuaaaaauuacuguaaaugacagcgaucagggugcaaacgccaaguuuaaucugcaacucgucgggccuagaggcauauucagggugguuccccagacagugcuuaacgaggcucaggucaccaucauuguggaaaauucggcggcaaucgacuuugagaagucuaaaguacugacguucaaguugcuagccguggagguuaacaccccagaaaaauuuuccucaacagcugacgucgugauacaacugcucgauacuaaugacaacgugcccaaguucgauagucuguacuaugucgcccggauuccugagaaugcaccaggaggcagcuccguuguggccgugaccgcuguagacccggauacagggcccuggggagaagucaaauacucuacuuaugguaccggcgccgaccuuuuucugauccacccuagcacaggguugaucuacacccagccaugggcaucacucgaugcggaggcuacugcccgauacaacuucuaugugaaggcagaggacauggaaggaaaguacaguguugccgagguguuuauuacgcuguuagaugucaaugaccaucccccucaguucggcaaauccgugcagaagaaaacaaugguucuggguaccccagugaagaucgaagcuauugaugaggacgccgaggaacccaacaaucuaguagauuauagcauaacucacgcagagccggcuaacgucuuugacaucaauucucacaccggggaaauuuggcucaaaaacucaauccgcagucuggacgcccuucauaacaucacaccuggcagagauugcuuguggagccuggaggugcaagcgaaggacaggggauccccaucuuucucgaccacugcccuccugaaaauugauauaacagacgcugaagugcggcgccuuagauacaugaagaauagcaacuuucccggcacgaccaaguccgucaggaaaccuaaguucaaacccaagaaaccacacucaagucaggggcuguucuugcauccucacugugagaucgcacucuuuaaucugucuaacguuaauuuauauagccguguguuccagggagccgcucaggccuccuga

SEQ ID NO: 54147 - RNA, 3933 nt, Artificial Sequence
  derived and/or modified sequence opt3 from CDHR2__Homo_sapiens__NP_001165447
auggcccagcuguggcucagcugcuuccuucugcccgcuuugguggucuccguugcagccaacguggcgccuaaguuuuuagcuaauaugaccucuguaauccugccagaggaccuaccggugggcgcccaagcauucuggcucgucgccgaagaucaggacaacgauccccugacauacgggaugucaggaccuaaugcuuauuucuucgcagugacuccaaaaacgggugagguuaaacuugccagugcucuggacuacgaaaccuuguauacauuuaaggugacuauuagcgucuccgaucccuacauacaggugcagagagagaugcucguaaucguugaagacaggaacgauaaugccccuguguuccaaaacaccgcguuuucuacaucgauuaaugagacccugccagucggcucagugguguucagcguccuggcaguugacaaggauauggggagugccggaauggugguauauuccaucgagaaagugauucccucuacuggcgacagcgaacaccucuuucggaucuuagcuaacgguuccauaguccugaaugggucacuuaguuacaacaauaagagcgccuucuaucaguuggagcugaaggcaugugaucuaggaggcauguaccauaacacauuuaccauccagugcucucucccuguguuccuguccauuucaguuguggaccagccagaucuugacccgcaauuuguccgcgaauuuuacagcgcuaguguggccgaggacgcggccaaaggcacgucuguacugacuguugaggcaguggauggggacaagggaaucaaugaucccgucauuuauuccaucagcuacucgacccgaccugguugguucgacauaggcgcugauggggugauucgugucaacggaucuuuggacagagaacagcuccuggaggccgaugaagaggugcaguuacagguuacagcuacugaaacccaccugaauaucuauggccaagaggccaaaguguccauuuggguaacagucagggugauggacguuaacgaucauaagccagaguuuuacaacuguucacuccccgcaugcaccuucacgccugaagaggcccaggugaauuuuacugguuaugucgacgaacacgcuaguccacggauccccaucgaugaccuuacaauggugguauacgacccggauaaagggagcaacggaaccuuccuguugucccuaggcggcccugacgcggaggcauuuucugugagccccgaacgcgccguugggucagcuaguguccaggugcuggugagagucuccgcccucguugauuaugagaggcaaacugcaauggccguacaggugguggcuacagacagcgucucucagaauuucucaguggccaugguuaccauucaucugcgggauauaaacgaccaccgcccaacguuuccucagagucuuuacgugcugaccguccccgagcacagcgcaacaggauccgugguuacugauucuauccaugcgaccgacccagauacaggugcuuggggccaaauuacuuacucguugcuccccgggaauggagccgaccuguuccagguggauccuguaagcggcaccgucacagugcgaaacggugaauuacuggacagagagucccaggcaguguauuaccuaacccuccaggccacugaugggggcaaucugucaaguucuacgacacuucaaauccacuugcuggacauaaacgacaaugcuccagucguuagcggauccuauaacauuuuugugcaggaagaggaaggcaauguaucagugaccauccaggcccaugauaacgacgagccggggacuaauaacagcaggcuccuguucaaucuucugcccggaccuuacucucacaacuuuuccuuggauccagacaccggucuccugcggaacuuaggcccccuggaucgugaggcaaucgacccugcucuagaagggcgcauuguccucacagugcugguuagugauuguggagagccagugcuuggcaccaaggucaaugugacuaucacaguugaagacauuaacgauaauuugcccauauucaaccagagcucuuauaauuuuacggugaaggaggaggacccggguguccugguaggggugguuaaagccugggaugcggaccaaaccgaagccaacaauagaaucuccuucucacucaguggcagcggagcuaacuacuucaugauuaggggccugguguuaggggcaggaugggccgaggguuaucugcggcuuccuccagaugucucguuggacuacgaaacucagcccguguuuaaucucacaguauccgcugagaacccugacccccagggcggggaaaccaucguggaugucugcguuaaugugaaggacgugaacgauaauccaccuacacuggacgucgccucucuacgaggaauccgcguggcagagaacggcagccagcacggucaaguugcgguaguggucgccucagauguggacacuagcgcucagcuggagauucagcucguuaauauacuguguaccaaagccgggguggaugucggcucccuuugcuggggaugguucucuguggcagcuaacggcagcguauacaucaaccaauccaaggccauugacuaugaagcaugugauuuggucacgcuggugguuagagccugcgacuuagcuaccgaucccggguuucaggcguacucaaauaacggaagccuccugaucacaauugaggacgugaaugacaacgccccauauuuccuuccggaaaauaaaacuuuugucaucauaccugagcugguguugcccaacagggaaguugcaagugugcgggcucgcgaugacgauucuggcaauaacggugucauccucuucuccauucugagaguggacuuuaucagcaaggauggggccaccauuccauuccagggaguauuuucgaucuucacaucaucugaggccgacguguuugcuggcaguauacagcccguuacuucccuagauagcacccugcaagguacguaccaggucacagugcaggcaagggaccguccuucucucggcccauuccuggaggccaccacuacacuuaauuuguuuaccguggaucagagcuaucggucccgacugcaauucucaacucccaaagaagaggucggggcgaacagacaggcuauuaaugccgcauuaacccaggccacaaggacgaccguauacaucguggacauucaggauaucgacagugcugcacgcgcccggccucauagcuaucucgaugcguacuucguuuuuccgaacggaucugcucugacucuugacgaacuguccgugaugauaagaaaugaccaagauucacuaacacagcuccugcaguugggccuggucguguuagggagucaagagagccaggaauccgaccucucuaagcagcugaucucgguuauuaucggacuuggcguggcccuguugcucguccuggugauuaugaccauggcauucguaugugugaggaagaguuacaaccgcaaacuacaggccaugaaggcugccaaagaggcacgaaagacagcugccgguguuaugccaucagcgcccgccaucccugggacuaauauguauaacaccgagcgggcaaacccaaugcugaaucuucccaacaaagaucucggacuggaauacuuguccccuaguaaugaccuggauucugucagcgugaacuccuuagacgauaauucaguggacgucgauaagaacucucaagagauaaaggaacaccguccgccccauacgccaccugagcccgacccagagccucucagcguugugcugcuuggcagacaggcuggugccaguggccagcuggaagggcccuccuauacaaaugcuggauuggauaccacugaccucuga

SEQ ID NO: 54148 - RNA, 2658 nt, Artificial Sequence
  derived and/or modified sequence opt3 from CDHR3__Homo_sapiens__NP_689963
augcaggaggccaucauucugcucgcucugcugggcgcaaugagcgggggagaagccuugcacuuaauacugcuacccgcgaccgguaacguggcugaaaauuccccuccaggcacaucuguccauaaguucucaguuaaacucagugccagccuguccccggugauccccggguuuccucaaauuguaaacucuaauccacuuacugaagcauucagagugaacuggcugucgggaacguacuuugaggucgugaccacaggcauggaacaguuggacuucgagacuggucccaauaucuuugaucuccagauuuauguuaaggacgaggugggggucaccgaucuucaggugcugacaguacaaguuaccgacgugaacgaaccuccacaguuccagggaaaucucgccgagggcuuacaccuguacaucgucgaaagggcuaaccccggcuuuauauaucagguggaggcauucgauccugaggacacuucacggaauaucccacuuagcuacuuuuugauuaguccgcccaaauccuuccgcaugucugccaacgggacacuguuuagcaccacggaacuagauuucgaggcuggacaucgauccuuucaccucaucguggaaguccgugacucagguggccugaaggccaguacugagcuucaaguuaauauugugaaccugaaugaugaaguaccuagauucaccagcccaacaaggguguauacugucuuggaggagcucucucccgggaccaucguggcgaacauaacagcagaagacccugaugacgagggauucccaucccaucuguuauacucaauuaccacgguuagcaaauauuuuaugaucaaucagcugacuggcacaauucagguggcccagcggaucgaucgcgacgcuggugaacucagacaaaaccccaccaucagucuugagguccuggugaaggacaggccguacgggggacaggaaaaccggauucagauaacuuucaucguagaggauguuaaugacaacccugccacaugccaaaaguuuaccuucucuauuauggugcccgagcgcacggcaaaaggcaccuugcuacuggaucucaauaaguuuuguuucgacgaugacuccgaagcuccaaacaaucgauuuaacuucacaaugccuagcggcgucgggucgggaucuagauuucugcaggaucccgccgguuccggcaaaaucgugcuuauaggggaccuggauuacgagaauccaucaaacuuggcggccggaaauaaguauacugucauuauccaggugcaggacguugcacccccuuacuauaaaaacaauguguacguauauauccucaccaguccagaaaacgaguucccgcugauuuuugauaggcccagcuacgucuucgacguguccgaacggcguccugcucgcacaagaguuggccaagugagggccacugacaaggauuuaccacagucuagccugcuauauucaaucaguaccgguggggcuucccuccaguaccccaaugucuuuuggauuaacccuaagacaggcgagcugcagcuugugaccaaaguagacugcgagacuacgccaauauacaucuugcggauucaagccacaaauaacgaagauaccagcucugugacuguuaccgucaacauccuggaggaaaaugacgagaagcccaucuguacaccgaacucauauuuccucgcacugccuguggaucuuaaagugggaaccaauauucagaacuucaagcugacuugcacagacuuggauaguagcccacgauccuuucgcuacucuauaggccccgggaaugucaacaaucacuucacguuuucgccuaacgccggaagcaauguuaccagacuccuguuaacuuccagguucgacuaugcugguggcuuugauaaaaucugggacuacaagcugcuaguguaugugacagaugacaaccucaugucagaucggaaaaaggcggaggcacugguagaaaccgggacagucacucuuaguauuaaggugaucccccacccaaccacgauuaucaccacaacuccucgccccagaguuaccuaccagguguugaggaaaaaugucuauucuccaagcgccugguacgugccguucguuauaacacugggauccauccuccuguuaggccugcuuguguacuugguaguccuccuggcuaaggccauucaucgucacuguccuugcaaaacugguaagaacaaagagccccuaaccaagaagggggaaacgaaaacagcagagcgggacgugguggucgaaaccauccagaugaauacuauuuuugacggcgaggccaucgauccaguuacaggagagaccuaugaguucaacucaaagacuggcgcucgaaaauggaaggacccccugacccaaaugccuaaauggaaggagagcucucaucagggggccgcaccaagaagggugacagcgggagaagguaugggcucccuccgcagugcuaauugggaggaagaugagcugagcgggaaggccugggcagaggacgccggacuuggcucucggaacgaaggugggaaauugggcaaccccaagaauagaaacccugcuuuuaugaauagggccuacccgaaaccacaccccggaaaguga

SEQ ID NO: 54149 - RNA, 2520 nt, Artificial Sequence
  derived and/or modified sequence opt3 from CDHR5__Homo_sapiens__NP_001165439
augggcagcugggcccugcucuggcccccucuucuguucaccggguuguuagugagaccaccgggaacaauggcucaagcacaauacugcuccgucaacaaggacaucuuugagguugaagagaauacuaacgugacggaaccccugguagauauucacgugccugagggucaggaagucacccuaggcgcccucucuacaccauucgcguuuaggauacaggggaaucagcuguuccuuaacgugacucccgacuaugaggagaaaucacuguuggaagcucaacuccugugucagaguggaggcacccugguuacacagcuccggguguuugucagcguguuagauguaaaugacaacgccccugaguucccauuuaagaccaaagaaauccgcguugaggaggauacuaaggucaauuccacagugauucccgaaacccagcugcaagcagaggaccgagauaaagacgauauccuuuucuacacguugcaggaaaugacugccggugcuucugacuauuuuucgcuggugucagugaaccguccugcacuaagacucgauaggccacuggacuucuacgagcggccgaauaugaccuuuuggcuucugguccgcgauacacccggggaaaacguugagccuagccauacugccaccgcuacauuggugcucaauguagugccagccgaccugagacccccuugguucuuaccaugcaccuuuagugacggauaugucuguauucaggcgcaguaccacggcgcagugcccacgggccauauccugccguccccucucguucuuaggcccgggccaauauaugccgaggauggagaccgggguaucaaccaaccuauuaucuacucuauuuuccgcggcaaugugaacgggacuuucaucauacaccccgauagcggaaaucugacagucgcucgauccgugccaucacccaugaccuuuuugcuacugguaaagggccagcaggccgaccucgcaagauacaguguuacucaagugacagucgaagcuguggccgcggccgguagcccuccaagguucccgcagcggcuguaucgugggaccgucgcacgcggagcuggcgccggcgugguugugaaggaugcugccgcacccucucagccucuuaggauucaggcccaagacccagaguuuuccgaucugaacucagcuaucacguacagaauuaccaaccauagccacuuccggauggaaggggagguagucuugacaacuaccacacucgcgcaggcaggagccuuuuaugcugaaguggaggcccacaauacuguuaccagugguacagcaaccacugugaucgagauccaggucucugaacaggagcccccuuccacggaagccggcgggacaaccggaccauggacuagcaccacaucggaggugccccgaccgccugaaccaucucaaggccccuccaccacuucaaguggugggggcacaggaccucaucccccaagcggcacgacccugcgcccucccacuuccucuacaccagggggaccgccuggugcugagaacagcaccucacaccagcccgccacaccaggcggggacacugcacagacccccaaaccuggaacgagucagccaaugcccccuggcguagguaccuccacaagccaucaaccggcgacuccaucugggggcaccgcucagacacccgagccuggaacuucacagccaaugcccccuaguaugggcaccagcacgucccaccagccggccacacccgggggagguaccgcacaaacuccagaagccggcacaucucagccuaugcccccagggaugggaaccucgacuagccaccagccuaccacacccggcggugggacggcucaaaccccagagccgggcacuucccagccuaugcccuuaucaaagaguacaccaucuagcggaggcgggcccuccgaagauaaaagauucucagugguugacauggccgcacugggaggcguccuaggugcucuccugcuuuuggcccugcucgggcuggcggugcuugugcauaagcacuacggaccuaggcugaaaugcuguagcggcaaggccccagagccccagccucaggguuuugauaaucaggcuuucuugccggaccauaaggcaaacugggccccaguccccucuccuacccacgaccccaaaccagcugaggccccuaugcccgcagaaccagcgccuccgggccccgccuccccagggggagcuccugagcccccagccgcagcucgggccggcgggaguccuacagcaguucgcagcauucucacuaaggaaagaaggcccgagggaggcuauaaagccgugugguuuggugaagauauagggaccgaggcugacgugguaguccugaaugcgccgacguuagauguggacggagccucugauuccggcucaggugacgagggcgaaggggcaggacguggcgggggaccauacgaugcuccuggcggugacgauaguuauaucuga

SEQ ID NO: 54150 - RNA, 642 nt, Artificial Sequence
  derived and/or modified sequence opt3 from CDIPT__Homo_sapiens__NP_006310
augcccgacgagaacaucuuccuguuugugccuaaucucauuggcuacgccagaauagucuucgcuaucauuagcuuuuauuucaugccaugcuguccgcuuaccgcauccucuuuuuaccuguugucaggguuacuggaugccuucgacggacacgcggcuagggcccuaaaccaggguacacgguuuggcgcaaugcucgauaugcugacugaccgcugcaguacgaugugucuucugguuaauuuggcccuccuguaucccggggcuacccuguucuuucaaaucagcaugucccucgauguggcaucucauugguuacaucugcacucgucaguagugcgaggaagcgaaagucacaagaugauugaccuuuccggcaacccugucuugcguaucuacuauacaucuagaccagcccuguucacucuaugcgcugguaaugagcucuuuuacugucugcuuuaucuguuccauuuuagcgaagggcccuuggugggauccguuggccucuucaggaugggccugugggugaccgccccuauagcguuacugaaaucacucaucagugucauucaccuuaucacagcagcccggaacauggcugcccuggaugcagcugaccgcgccaagaaaaaguga

SEQ ID NO: 54151 - RNA, 819 nt, Artificial Sequence
  derived and/or modified sequence opt3 from CDK10__Homo_sapiens__NP_443713
auggacaaggagaaagauggcauccccauuagcucccugagagaaauaacccuccuucugagguugcggcacccuaacaucguggaguuaaaggaagucguuguggggaaucaucuggagucuauuuuccuaguaaugggauacugcgaacaggaccucgccucacugcuugagaacaugccaacaccguuuagugaggcucaagugaaauguaucguccugcaaguguugcgcggucuccaguaucugcaccgaaauuucauuauccaucgugaucugaagguuagcaaccucuuaaugacugacaaaggcugcgugaagacggcagauuuugggcuggccagagcguacggaguccccgugaagccuaugaccccaaaaguaguuacacuuugguauagggcucccgaauugcugcuaggcacuaccacacagaccacuuccauagacaugugggccguggguuguauccucgcagagcugcuugcccaccggccucuguugccagggacaucugaaauucaucagaucgaucucauuguccagcuguuaggaacccccucggagaauaucuggccuggcuucucaaagcugccacucgugggccaguacagccuucgcaaacagccguauaacaaucugaagcacaaauuucccugguugagugaggcugggcuaagacugcuccacuuccuguuuauguacgacccuaagaagagggcaacggccggagauugccuugaauccucuuauuucaaagagaagccacugcgguugcccauaagcggugugugugaaggcugccgcgagccuggguga

SEQ ID NO: 54152 - RNA, 2388 nt, Artificial Sequence
  derived and/or modified sequence opt3 from CDK11B__Homo_sapiens__NP_001778
augggcgacgagaaggauagcuggaaagugaagacccuggacgaaauccuccaggagaaaaagagaaggaaagaacaagaggaaaaggccgagauuaagcggcuuaaaaacuccgaugaccgcgauucuaagcgagacucacuggaggaaggggaguugcgugaucacagaauggaaauaacaaucaggaauagucccuaccggcgcgaggacagcauggaggauagaggagaagaggacgauuccuuagcuauuaaaccuccacagcagaugucuaggaaggaaaaagcacaucaccggaaggacgagaagcgcaaagaaaagcgaagacauaggucgcacucagccgaggguggcaaacaugcgcgggucaaggagaaagaacgugagcacgaacgcagaaagaggcaccgggaggaacaggauaaagcucgacgcgagugggagagacaaaagaggcgggaaauggcccgcgagcauagcagaagggaacgugaccggcuggagcagcuagaacgaaagagagagagggagcgcaaaaugcgggaacagcagaaggagcaaagagaacagaaagagagggagcgccgagcagaagaacggcguaaggaaagagaggccaggcgcgaaguuagugcucaccaucggacuaugagagaggacuauuccgauaaagugaaggcaucucacuggagcagguccccgccccgaccuccacgcgagcgguucgaacucggggacggaagaaagcccggcgaggccaggccugcuccagcccagaaacccgcgcagcugaaggaagagaaaauggaggagcgugaucuucugucagacuugcaagauaucagugacagcgagcgcaagacgucuuccgcagaaucaagcagugccgagucugguuccgggagcgaagaggaagaggaggaagaggaagaggaggaagaggaaggaucgaccucugaggaauccgaggaggaagaggaagaggaagaggaggaagaggaagagacaggcucaaacagugaagaggcuagcgagcaguccgccgaagagguaucugaagaggagaugagcgaagaugaggaacgggagaaugaaaaccaccuccugguggucccugagucaagauuugacagggauaguggcgaguccgaagaggcagaagaggaagugggggagggaacuccacagagcucugcucugaccgagggugacuacguuccggauucacccgcccucaguccuauugaauuaaaacaagagcugccaaaguaucuucccgcguugcagggcugccgaagcguggaagaguuccagugucugaaucggaucgaagaggggacauacggagucguguaucgcgccaaggacaaaaagaccgacgagauaguagcacuaaaaagacucaagauggaaaaagagaaggaaggcuuuccuaucacuucccugagggagauuaacacaauccuuaaggcucagcauccaaauauuguuaccgugcgggagaucgucguggguucuaacauggauaaaauauacauugugaugaauuaugucgaacacgaccugaagucguugauggagacgaugaaacaacccuuccucccgggggaaguuaagacucugaugauccaguuacugcgaggagugaaacaucuccacgauaacuggauucuucauagagaccugaagaccagcaauuugcuacugucccacgccggcauccucaaaguaggcgauuuugggcuggcucgcgaguacggaucaccucuuaaggccuacacacccguggucgugacucugugguauagggcaccagaauugcuccugggugccaaggaguacaguaccgcuguugacauguggucugugggcugcaucuucggggaguuacugacacagaaaccucuauuucccggaaagagcgaaauugaucagauaaacaaagucuucaaggaccucggcaccccauccgagaaaaucuggcccgguuauucagaacugccugcggugaagaagaugacguuuagcgagcacccauacaauaaccuucguaaacgguucggggcauugcugucugaucaaggcuuugaccucaugaauaaguuccugacuuauuuuccgggaagaaggauuuccgccgaagauggccuuaaacaugaguacuuccgcgagacaccccugccuaucgacccaaguauguuccccaccuggccugcuaagagcgaacagcagcgaguaaaaagagggacuucuccacggcccccggagggagguuugggcuauucccagcucggggaugacgaccugaaggaaacaggauuucacuuaaccacgaccaaccaaggcgccucagcagccgguccuggguucagucugaaguuuuga

SEQ ID NO: 54153 - RNA, 4446 nt, Artificial Sequence
  derived and/or modified sequence opt3 from CDK12__Homo_sapiens__NP_055898
augcccaacagcgagagacacggcgggaagaaggacggauccgguggcgccucugggacccugcagccuucaaguggaggcgguagcuccaauucuagggaacggcaucgccucgugucgaagcacaaacgacauaagucaaaacacagcaaggauauggggcuugucacaccagaggcugcaagucugggaacuguuaucaagccguugguggaauacgacgauauuuccucugacagcgauacguucuccgacgauauggccuuuaaauuagaccguagagagaacgaugaaaggcggggcucagaccgcagugauagacugcauaagcacaggcaccaucaacaccggcgcagccgagaccuacucaaagcgaagcagaccgagaaagagaagucucaggaaguauccucaaagagcggcaguaugaaagauagaauaucuggguccagcaagaggucgaaugaggaaacagacgacuauggaaaagcucagguggccaagucuuccucaaaagagagucggagcuccaagcugcauaaagagaagacucguaaggaacgcgagcuuaaaucuggucacaaggauagaagcaaaucacacaggaagcgggaaacccccaaaaguuacaagacagucgacuccccuaagcgacgcagcagaucuccacauaggaaauggucagauaguagcaagcaagacgauucccccucuggcgcaucguaugggcaggacuacgaucugagcccuucccggucacacaccaguucuaacuaugacagcuacaaaaaguccccaggaucaacuagccgcagacagucugugagcccucccuauaaagagccaagugccuaccagagcucuacaagguccccgucacccuacagucgucggcaacgaagcguuucgccuuauuccagaaggcgcucuagcucauacgaacggaguggcuccuauucugguagaagcccaucccccuacgggaggcgccgaucaagcaguccuuucuugucuaagcggucccucagccguucgccacugcccucaagaaagucuaugaaaaguaggucccgcagcccggcuuauucucggcauagcuccucacacaguaagaaaaagagauccucuuccaggucacgacauaguagcaucuccccugugcgccugccccucaauucuucguuaggagcagagcugagccggaaaaagaaggagagagccgcugccgcggcagccgcuaaaauggauggcaaggaaucaaaaggcuccccagucuuucuuccuaggaaggagaacaguucuguggaagccaaagacagcggguuggaguccaagaaacugccccguucaguaaagcuagaaaagucugcaccagauaccgagcucguuaaugugacgcaccugaacacugaggucaaaaauagcagugacaccggaaaggugaaacuugacgaaaacuccgagaagcaccuggugaaagauuugaaggcucaggguacacgcgacagcaagcccauugcccucaaagaagagaucgucacuccuaaggaaaccgagacaucugagaaagaaaccccaccgccccugccuacgauugcgucaccacccccuccauuacccacuacaaccccgccuccacagacucccccucugcccccacucccucccaucccagcccuuccgcagcaaccuccccugccacccucccagccugcauucagucagguuccagcuagcucgacaucuaccuugcccccuuccacgcauagcaagaccucagccgugaguucucaagcuaauucccagccgccaguacaggugagcgucaaaacacaggugucaguuacugccgcaauaccccaccuaaagaccaguacacugccuccacucccccugccuccgcuucugcccggcgaugacgauauggacagcccaaaggagacuuugccuuccaaacccgugaagaaagaaaaggagcaacggaccagacaucuccugacagauuuaccacugccucccgagcuaccagggggagaccucucuccgccugauagccccgaaccaaaagccaucacucccccucagcagccauacaagaagaggcccaaaauuugcuguccucgauauggcgagcggcgccagaccgaauccgacugggguaagagaugcgucgauaaauuugacaucauugggaucauaggcgagggaacguacggccaaguguacaaggcuaaagauaaggacacaggggaacugguagcgcuuaaaaagguuagguuggacaacgagaaggagggauucccgauuaccgcaauccgggaaauuaaaauccugcgacagcucauccacagaucaguggucaauaugaaggagauugugacugauaaacaggacgcccuggauuuuaagaaagacaagggugcuuucuaucuugucuuugaauacauggaucacgaccugaugggcuugcucgagucugggcuggugcauuucagugaagaucacauaaagucguuuaugaaacaguuaauggagggacuggaguauugucauaagaaaaacuuccuacaccgcgacaucaagugcagcaauauucuccugaacaacuccggccaaaucaaacuugccgauuuugguuuggcaaggcuguacaauucugaagagucacguccauauaccaacaagguuauaacacucugguaccggcccccugaacuguuacugggggaggaaagauauacccccgccauugacguguggagcuguggcugcauccuuggagaguuguucacuaagaaaccaaucuuccaggcuaaucucgagcuggcccagcuagaacugauuuccaggcucuguggcaguccuugccccgcaguauggccagaugucaucaagcugccuuacuuuaacacaaugaaaccgaagaaacaguaccgccgaagacuucgggaggaguucucuuuuauucccagcgcggcuuuggaccuguuagaucauaugcucacgcuggacccaucaaagagguguaccgccgaacaaacucuucaguccgacuuccugaaggauguggaguugaguaaaauggcaccucccgaccucccacacuggcaggauugccacgaacuguggagcaagaaacgccguagacaacggcagucugggguuguggucgaggaaccucccccguccaagacaucaaggaaagagaccacaagcggaacuucgaccgaaccagugaaaaauucuaguccugcucccccacagcccgccccugguaagguagaguccggcgccggggacgcaauaggacuagcugauaucacgcagcaacugaaccagagcgagcucgccgugcugcuuaauuugcugcagucacagaccgacuuauccauuccgcaaauggcgcagcuccugaacauccauucuaaucccgaaaugcagcagcaacuugaggcccugaaccagagcaucagugcucuaacagaagcaacuucccagcaacaggauagcgagaccauggccccagaagagucucucaaggaggcuccuucagcccccguuauucugccuagugcagaacagacaacuuuggaggcguccagcaccccagccgacaugcagaauauacuggcugucuuacucucucaacugaugaagacgcaggaacccgccggcucgcuugaggaaaacaauucagauaaaaacagcgguccucaggggccacgccgaacacccaccaugccgcaggaggaggcagcugaaaagagaccuccagagcccccuggcccacccccgccucccccaccucccccacugguggaaggagacuuguccagugcaccccaagagcucaauccugccgugacugccgcucugcuacagcugcuuucucagccagaggcggaaccgcccggccaccucccucaugagcaccaggcccugcggccaauggaauauagcacaaggccccgcccuaacagaaccuacgggaacacugauggaccagagaccggcuuuuccgcaaucgacacagacgaaaggaacucaggucccgcuuugacggagagucugguccaaaccuuaguuaaaaaucggacuuucucugggagccucucccaucugggagagucaagcucuuaucagggcacagguuccgugcaguuuccuggcgaucaggaccuucguuucgcccgcgugccgcuggccuugcacccaguagucgggcaacccuuucucaaggcugaaggaaguagcaauucggugguucacgcagagaccaaacugcagaacuacggcgaacuagggccuggaacaacuggcgccuccucuucaggugcggggcugcauuggggaggccccacccagagcagugcuuaugguaaacuuuaccgaggcccaacgagagugccucccaggggagggcggggccgcggggucccauauuga

SEQ ID NO: 54154 - RNA, 4539 nt, Artificial Sequence
  derived and/or modified sequence opt3 from CDK13__Homo_sapiens__NP_003709
augcccagcuccucugacaccgcccugggcgggggagguggccucucaugggcugagaagaaacuugaagagagaaggaagcggcgccgauuccugaguccucagcaaccaccguuguuacugccccuacuccagccucagcugcuucagccacccccuccacccccuccacuguuguuucucgcagccccggggacagcggcugccgcagccgcugcagccgcugccagcuccucuugcuucucgcccggaccuccacuggaagugaaacgucuggcgagaggcaagaggcgggccggugggcgccaaaaacggaggcggggaccccgcgcaggccaggaggcugaaaagcgaagagucuuuucacucccucagccacagcaagauggcgggggaggugccagcaguggcgggggaguuacucccuuaguggaguacgaggacguauccucucagagcgaacagggccugcuuuuggguggggcauccgcugccacggcggccaccgcagcuggaggcacaggcgggucaggagguaguccggccucuagcuccggcacucagaggagaggggagggaucagaacgucgcccuagaagggaucggcgaagcaguucuggccgcuccaaggagagacacagggagcaucggcgcagagacggucaaaggggcggcagcgaggcuucgaaaucucguucccggcacucacauaguggagaagaacgagccgagguggcaaagagcggcuccucuagcucaagugggggaagaaggaaauccgccagcgcuaccucuucaaguagcuccucucgcaaggaucgggacucgaaagcgcacagaagcaggacaaaguccucaaaggaacccccaagugcauauaaagagccucccaaggccuaccgcgaggauaaaaccgaaccaaaggcuuaucgacggcguagaucucugagcccccuagguggcagggacgauuccccugucucacaucgcgccagccagucucuccgguccagaaaaaguccaagcccggcagggggagggucuucccccuacucaaggcgacugccucgcaguccaagccccuauucgcggagaagguccccuucuuacagccgucacucaaguuaugagcgcgguggggacguguccccaucucccuacagcuccucaagcuggcggagaaguaggucuccguacuccccuguucuucgacggagcggcaagucgcgcucaagaucuccauauaguuccaggcacagccggucucgaagcagacaucgccuguccaggucacguagucggcacagcucuaucucccccucaacuuugacacucaaaaguagccuggccgcugaauuaaacaagaauaagaaagccagagcagcggaggcugccagggcagccgaagcugccaaggcagcugaggccaccaaagcggccgaggcugcagccaaggcugccaaagcauccaacacgucuacuccuaccaagggaaauacagaaacuucggcgagcgccucacagaccaaccaugugaaggaugucaaaaagauuaaaauagagcacgcucccuccccaaguucuggcgggacacugaagaaugacaaagccaagaccaagccuccccuccaagugacgaaaguagaaaacaaucuuaucguugauaaggcaacuaaaaaggcugugauugucggaaaagagagcaaguccgccgcaacaaaggaagagucagugucucugaaagagaagaccaaaccauugacuccgagcaucggugccaaggaaaaagagcagcacguggcucuagucacaaguacccugccuccccucccacugcccccuaugcuuccagaagacaaggaggcggacucccugcgcggcaacauuagcguuaaagccgugaagaaggagguagaaaagaaguugcgaugucuccuggcagauuuaccccugccuccggagcuaccagggggagacgaucucucuaaaucacccgaagagaagaaaacggcuacccagcugcauuccaagagacggccuaagaucugcggcccaagguacggugaaacaaaagagaaggacauagauugggggaaacgcuguguggacaaguucgauaucauuggcaucauuggagagggcacuuaugggcaggucuacaaagcccgugacaaggauaccggagaaaugguggcccuuaagaaaguuagauuggacaaugagaaggaaggcuuucccaucacagcuauacgggagauuaaaauccugaggcaacucacucaccagaguauuaucaacaugaaggaaaucgugaccgauaaagaggacgcacuggacuucaagaaggauaaaggugccuuuuaucuugucuucgaguacauggaccaugaucugaugggguugcucgaaagcggacuggugcacuuuaaugagaaccauauuaagucguucaugcgccaguuaauggaaggccuggacuauugccacaaaaagaauuuucuacaccgagauauaaaauguucuaacauccuccugaauaacagaggucagauuaaacuugcggacuucggcuuggcucggcuguacuccagcgaggaaucaaggccuuacacaaacaaaguaaucacccucugguaucgcccgcccgagcuguuacugggggaggaaagauacacuccagccauagauguuuggaguugcggauguauucuuggcgaguuguuuacgaagaagccuaucuuccaagcaaaucaggaacucgcccagcuggagcuaaucucuaggauuugcgggucccccuguccagcuguguggccugacgucaucaaacugcccuauuucaacacaaugaagcccaaaaagcaguaccggcguaaacuccgcgaggaauuuguguucauuccggcagccgcgcuggaucuuuuugacuauauguuggcucuggauccuagcaagcgaugcaccgccgagcaagcauuacagugugaguuccucagagacgucgaacccucaaagaugccacccccugaucugccacuuuggcaggacugccaugaacuguggaguaaaaagaggcggcgccagaaacaaaugggaaugacugacgaugugagcaccauaaaggcccccagaaaagacuugucccucggccuggaugacucuaggacaaauaccccucaggguguucuaccgagcucccagcugaagucacaagggucuaguaacguggcuccaguaaagacuggacccggccagcaccucaaucauucggagcuggccauccuuuugaaccuguuacagagcaaaacauccgucaauauggcagauuuugugcagguucucaacauuaaggucaauucugagacgcaacagcagcugaacaaaaucaaucuuccugcugguauccuggccaccggcgaaaagcagacugaccccucaacaccacaacaggagagcuccaaaccucuagggggaauacagcccaguucucagaccauucaaccaaagguggaaacagaugcggcccaggcagcugugcagagcgccuucgcuguacuccugacucaauugaucaaggcacagcagucaaaacagaaggacgugcuguuagaggaacgggagaacggcuccgggcacgaggccagucuccaacugcgaccuccgcccgaaccaagcaccccuguuucuggacaggaugaccuuauucagcaccaggauaugagaauccuggaguugacgcccgaaccagaccgcccuaggauucucccaccggaucaacggccaccugagcccccagaacccccuccggucaccgaggaggaccuggacuaccguacagaaaaucagcaugugcccacuaccuccucaagccuaacagauccacacgccggcgugaaagcugcgcugcuucagcuccuggcacagcaucaaccucaggacgaucccaagagagagggugggaucgacuaucaggccggagauacuuacgucucgaccucugacuacaaagauaacuuuggcaguuccagcuucucauccgcuccuuauguuucuaaugacgguuugggcagcaguuccgccccaccccuggaaaggcgcagcuuuauagggaacucugauauccagucauuagacaacuacaguacggcauccagccacucuggaggcccuccacaacccucggccuucucagagagcuuuccguccaguguggcuggguauggagauauuuaccucaaugcgggcccuaugcuguucucuggugacaaggaccaucgguuugaguauagccacgggccaaucgccgugcuugcaaacuccucagaucccaguacaggaccugaaucuacccacccacugcccgcuaagaugcauaauuacaacuauggcggcaauuugcaggagaacccgagcgggccuucccucaugcacggacagacuuggacaucacccgcccaagguccaggcuacagccagggguaccgaggacauauuucuaccuccacuggcagagguagggggcgcggacugccuuauuga

SEQ ID NO: 54155 - RNA, 1410 nt, Artificial Sequence
  derived and/or modified sequence opt3 from CDK14__Homo_sapiens__NP_001274064
augugcgaccugaucgagccccagccugccgaaaagauuggcaaaaugaagaaacucagaaggacccuuagcgaguccuucucucggauagcucugaagaaagaugacacaacuuuugaugaaaucugugugacgaagaugucaacccgcaacugccaagggauggacagugucauuaagccauuggauacaaucccggaggacaaaaagguucgagugcagcguacucagagcaccuucgaucccuuugaaaaaccugcaaaucagguaaagagagugcacuccgagaacaaugccuguauuaacuucaaaacaucuucgaccggaaaggagucaccaaaggucaggcggcauagcagucccuccucuccuacuagcccaaaauuugguaaggcggacuccuacgaaaaauuagagaagcugggcgaagggucauaugcuacaguguacaaaggaaagaguaaaguuaauggcaagcuaguggcccucaaggucauccgccugcaagaggaggaagguacccccuucacggcaauaagagaggccagccuucugaaaggguugaagcacgcuaacaucgugcuccugcaugauauuauccacacuaaagaaacccugacacucguauuugaguauguucauacugacuuaugccaguacauggauaagcacccuggaggccugcacccagacaaugugaaacuuuucuuguuucagcugcuaaggggccucucuuauauucaucagcgguacauccugcaccgcgaucuuaagccgcaaaaccuguugauauccgacaccggggaacucaagcuggcagacuucggauuagcccgagcuaaaucaguccccagccauacauauaguaaugagguggugacccugugguacagaccuccagauguccuccuugguucuacggaguacuccacuugucuggacauguggggcguugggugcauuuuuguggaaaugauccagggaguagccgcguuccccggcaugaaggauauucaggaccaguuggagaggaucuuucuagugcuggguacaccuaacgaagauaccuggccagggguccacagccucccccacuucaaaccggagcgguucacucuguauucgucuaagaaucuucgucaagcauggaacaaacuguccuacgugaaucaugccgaagacuuggcuucaaagcuccugcaguguaguccuaagaaccgcuuaagcgcccaggcagcucugucccacgaguauuuuucugaucuacccccaagacucugggagcugacagacaugagcucaaucuucaccguuccuaaugugaggcuucaacccgaagccggagagaguaugcgggcguuuggcaaaaacaacuccuacggcaagagcuugucuaauucaaaacauuga

SEQ ID NO: 54156 - RNA, 1290 nt, Artificial Sequence
  derived and/or modified sequence opt3 from CDK15__Homo_sapiens__NP_001248364
augggccaggagcugugcgccaagaccgugcaacccggguguagcugcuaccacuguuccgaaggaggugaggcucauucuugcagaaggucacagccugaaacaacugaggcagccuucaaacucacggaccuuaaggaagcgaguuguagcaugaccuccuuucacccacggggccugcaggcugcccgcgcacagaaauucaagucuaaacgaccgcguucgaacucagauugcuuucaagaggaggacuugagacagggguuccaguggaggaagaguuuacccuuuggagccgcuagcuccuaucugaaucuagaaaagcucggcgaggguucuuacgcaacagucuauaaagggaucagccggauuaacggacagcugguugcccuuaaggugauauccaugaaugcugaagagggcguaccuuucacugccauccgcgaggcgucacuguugaaaggccucaagcaugcaaacauugugcugcugcacgauaucauucauaccaaagaaacacucaccuuugucuucgaguacaugcacacugacuuagcccaauauaugagucagcacccagggggacugcauccccacaaugugagacuuuuuauguuccaguugcugaggggucuagcuuacauccaucaccagcacguucuccaucgggaucugaagccucaaaaccuucugauaagccacuugggcgaacucaagcuggccgacuuuggguuagcacgcgcuaaaucuaucccaucccagacauauucaagcgagguggucacccugugguaccgacccccugaugcccuccuuggagcgacggaauacaguucugagcuggacauuuggggcgccgguuguaucuucauugagauguuucaggggcaaccauuguucccgggaguguccaauauccuagaacagcuggagaagauaugggaaguacucggcguucccacugaggauaccuggccuggcgugagcaaacugccaaacuauaaucccgaaugguucccucuuccaacacccagaucgcugcaugucguguggaacagguuggggcgggugccggaggcagaggaccucgcuucucagaugcugaagggauuuccucgugaucgcgucuccgcccaggaggcuuuaguucacgacuacuucucagcccugcccagucaacuauaucagcucccagaugugagcgguguaagacugaaaccugaaaugugcgaccuuuuggcauccuaccagaagggccaucaccccgcccaguuuucuaaauguugguga

SEQ ID NO: 54157 - RNA, 1713 nt, Artificial Sequence
  derived and/or modified sequence opt3 from CDK16__Homo_sapiens__NP_001163931
augccccuguacggcagagccagggaccacgugacccauccuagcauccucgggacacggccaggacgcccgauggcuggucccauuacugcagccgucccugagaagauaugcaacggcgcguucuguuccugcucuggggcuuuuccacuugaucccaauaacccuucacugggaccauugcccaguaucagccacuuaaaucugcgaacgcagauugccauggaccguaugaaaaagaucaaaagacaacuauccaugacccucaggggcggucgggggauugauaagacaaacggagcaccugaacagaucggccuggacgagucuggcgggggagguggcucggauccaggggaagccccgacucgcgcugcacccggagagcuuagaucagccaggggcccucugagcagugcuccagaaauaguucaugaggacuugaaaauggguuccgauggggagucugaccaggccagcgcgaccuccucagaugaagugcagagucccguacgggugcgcaugcgaaaucacccuccaagaaagaucagcacagaggacauuaacaagaggcucucucugcccgcagauauccggcugccggaaggauaucucgagaaauuaacccugaauagcccuauuuucgacaagccccuuucacgucgcuugagaagggucagccugagugagaucggcuuuggcaaacuagaaacuuacauaaagcucgauaaacugggggagggaacauaugccaccguguacaaggguaagucuaaacuuacggacaaccugguugcuuugaaggaaauucggcucgagcaugaagagggcgccccauguacugcaauccgagaggugucccuguuaaaagaccugaagcacgcuaauauugucacccuccacgauaucauccauacagaaaaaucccuuacucugguguucgaguauuuggacaaggaucuaaaacaauaccuggacgauugcgggaacauuauaaauaugcacaacguaaagcucuuucuguuccagcuucugcgcggauuggccuauugucauagacagaagguucuccacagggaccugaaaccucagaauuuacugaucaacgaacggggcgagcuaaagcucgcggauuuuggucuggcccgcgcaaaaucgauucccaccaagacauacucuaaugaaguggucacccuuugguacagaccacccgacaucuugcugggguccacggauuauucaacucaaauagacauguggggcgugggaugcauuuucuacgagauggcuacaggcaggccucucuuuccagggaguaccguggaggaacagcugcacuucaucuuucguauccuuggaacuccgacagaggaaaccuggcccgguauucugagcaacgaggaauuuaaaacguauaacuacccuaaguaucgggccgaggcuuugcucucccaugccccacgacuggauucugacggcgcagacuuacugaccaagcuacuccaguucgaggggagaaauaggaucagcgccgaagaugcuaugaaacaccccuucuuccugucacuuggagagcgcauucauaaguugccugacacaacuagcauauuugcgcugaaagaaauccagcuccaaaaggaggcaucccugcggaguucuucaaugccagauaguggcagacccgccuucagggucguugacaccgaguuuuga

SEQ ID NO: 54158 - RNA, 1572 nt, Artificial Sequence
  derived and/or modified sequence opt3 from CDK17__Homo_sapiens__NP_002586
augaagaaauucaagagaaggcugagccucacccuucggggcucccagacaaucgacgagucucugucagaauuggccgagcaaaugacuauugaagagaacaguagcaaagauaaugaacccauagugaagaacgggcgcccuccaacgucccacucuaugcauucguuuuuacaccaguacaccggaucauucaaaaagccgccccugcgacguccucauagcgucaucgguggcagucuaggguccuuuauggcuaugccaagaaauggaucuaggcucgacauuguucacgagaaccugaagaugggcagcgauggugaguccgaccaggcaucagggacaaguagcgaugaagugcagucucccacuggaguaugccuucggaaucgcauccauagaaggauuuccauggaggaccugaacaaacgguugucacucccugccgauauccgcauaccagacggcuaucuggaaaagcugcaaaucaauagucccccuuucgaucagccaaugagccgaagaucuaggcgggcgucccucagcgagauuggcuuugggaaaauggagaccuacaucaaguuagaaaaacugggagaggguacauaugcuaccguguacaagggccguucgaagcucacugaaaacuuggucgcccugaaagagauucgccuagaacacgaggagggggcaccguguacagccaucagagaagugucucuccugaaggaccuuaaacacgcuaauauaguuacccugcaugauauugugcacacggacaaguccuugacucucgucuucgaguaucuggauaaagacuuaaagcaguacauggacgauugcggaaacaucaugucaaugcauaaugugaaacuguuucucuaucagauucuuaggggccuggcauacugucaccggcgaaagguauugcaccgcgaccuaaagccccaaaaccugcucaucaaugaaaaaggugagcugaaacuugccgauuucgggcuggcuagagccaagaguguuccuaccaagacauacagcaacgaaguggucacuuugugguauaggccacccgacgugcuccugggauccucugaguacagcacccagaucgauauguggggcgugggcugcauauuuuucgagauggcgucagggcggccuuuauuuccaggaaguacagucgaagacgagcugcaucuaauuuuccgccuccuggguacccccucccaggaaacguggccgggcaucagcucuaaugaggaauuuaaaaacuauaacuucccuaaguacaagccccagccacuuauuaaucacgcaccuagauuggauucagaggggaucgagcugauaacuaaauuccuccaauaugaaaguaagaaaaggguuagcgccgaggaagcuaugaagcauguguacuuucguucccugggaccccggauucacgcccuuccagagucuguaucgaucuucagccugaaagagauccaguugcagaaggaccccggcuuucgaaacuccucauauccugaaacaggucaugggaagaauagaaggcaaaguaugcuuuucuga

SEQ ID NO: 54159 - RNA, 1425 nt, Artificial Sequence
  derived and/or modified sequence opt3 from CDK18__Homo_sapiens__NP_002587
augaucaugaacaagaugaaaaauuucaagagaagguuuagccuguccgugccccggaccgagacaauugaagagucucucgccgaguucacugaacaguuuaaccaacuucacaaucgccgaaacgaaaaucugcaguugggcccuuuagggcgugacccaccgcaggagugcucaacguucagucccaccgauagcggagaggaaccuggucagcuguccccaggcguccaauuucagagaaggcagaaccagcggcgcuucucuauggaggacguuucgaaaagacuaucacuccccauggauauaaggcugccucaagaauuucuucagaagcugcagauggagagcccagacuugcccaaaccucucagucggaugucccgccgagcuucucugagcgauaucggguucggaaagcuggagacauacgugaagcucgacaaauuaggcgaagguacuuaugcaaccguauuuaaggggagauccaaacugacagagaaucuuguggccuugaaggaaauuaggcuggagcaugaagagggagcgccauguaccgcuauccgggaggucucacuacucaaaaaccugaagcacgccaauauugugacucuucaugaucugauccacacagaccguaguuugacccucguuuucgaauaccuggauagcgacuuaaagcaguaucuggaucauugcggcaaccucaugucuaugcacaaugugaaaauauuuauguuccaacuucugcgcggcuuggcauacugucaccauagaaagauccuacacagggaccugaaaccgcagaaccuccugauuaaugagcggggagaacuuaagcuggccgauuuuggauuggcucgagcaaaauccguccccacgaagacuuauucaaacgaggugguaacccucugguaccgcccuccagacguucuguuagguagcacagaauauaguacucccaucgacauguggggcguggggugcauucauuacgagauggccaccggaagaccucuguucccaggcucuacagucaaagaggaacuacaccucaucuucaggcugcuugguacccccacggaggaaacuuggccgggggugacagcuuuuuccgaguuccggaccuacagcuuuccuuguuauuugccccagccacugauaaaucacgccccucgccucgauacugacgggauucaucugcuuucgucucuguugcucuacgaauccaagucaagaaugagugcggaggcagcccugagccacuccuauuucaggucuuuaggcgagcgugugcaucaacuggaagauacagcuagcaucuuuucacuaaaggagauucagcuccagaaagaccccggcuaccgggggcuggccuuccagcaaccaggacgagguaagaacagaaggcagaguaucuuuuga

SEQ ID NO: 54160 - RNA, 1329 nt, Artificial Sequence
  derived and/or modified sequence opt3 from CDK19__Homo_sapiens__NP_001287892
augagcgccugcagagagaucgcucugcucagggaacuuaagcaccccaacgugauugcacugcagaaagucuucuugucccauucugaccggaagguuugguuacuguuugauuacgccgagcacgaccuauggcauauaaucaaauuccaccgcgcgucaaaggcuaauaaaaagccuaugcaacucccacgaaguaugguaaagagccugcuuuaucagauucuggauggcauccauuacuugcacgccaacugggugcuccaccgugaccugaaaccggcaaauauucuggugaugggggaaggacccgagagagguagggucaagaucgccgauaugggcuuugcucgccucuucaacuccccuuuaaaaccacuggcagaccuugaucccgugguugugaccuuuugguaucgggccccugaauugcugcuaggggcuagacauuacacaaaggccauagacaucugggcgauuggauguaucuucgcagagcuccugacuucugagccaauuuuucacugcaggcaggaagauaucaaaacgucgaaucccuuccaucacgaccagcuugaucggauauuuucagucaugggcuucccugccgacaaggauugggaggacauucgcaagaugccagaauauccgacccugcaaaaagacuuucgaagaacaacuuacgcuaacagcaguuugaucaaguauauggagaaacacaaggugaaacccgauuccaagguauuccuccuguuacagaaacugcucaccauggacccuacaaagaggauuaccucugagcaggcccuucaggauccauacuuucaagaagacccccugccuacuuuggauguuuucgcagguugucagaucccauaccccaagcgggaguuccuaaaugaagacgauccggaggaaaaaggggacaagaaccagcagcaacagcagaaucaacaucagcagccuacagcucccccacagcaagccgcggccccuccccaggcaccacccccucagcagaacagcacccaaacgaauggaacugcuggcggcgccggggcuggaguggguggcaccggggccggacugcagcacucccaggauucaagucucaaccaggucccaccgaauaaaaagccccgucugggcccuagcggugcaaacucugggggaccagugaugcccuccgacuaucaacauucaagcagucgccuuaauuaccagucuuccgugcagggcagcucgcagucucaauccacacugggcuauucaaguagcucccagcagucuagccaauaccacccuucacaucaggcccacagauauuga

SEQ ID NO: 54161 - RNA, 723 nt, Artificial Sequence
  derived and/or modified sequence opt3 from CDK1__Homo_sapiens__NP_203698
auggaggacuacaccaagaucgagaaaauuggcgaagggacauauggaguggucuacaaggguagacacaaaacuacgggccagguuguggccaugaagaaaauaaggcuggaaagcgaggaagaggggguacccuccaccgcuauccgggagauuucucuccuuaaggaacugcgccauccuaacaucgugucauugcaagaugucuuaaugcaggacagucgacuguaucuaauuuucgaguuucucagcauggaucugaagaaauaccuugacuccaucccaccgggacaguauauggauucuucgcuggugaagguugugacauugugguaccguucacccgaaguccuccugggcagcgcaagauauaguacuccuguggacauaugguccaucgguaccauuuucgccgagcuggcgaccaaaaagccacucuuucacggggauucugagaucgaccaguuauucaggauuuuucgggcucugggaacacccaauaacgaaguauggccugagguugaaagccuucaagauuacaaaaauacuuucccaaaguggaagcccggcuccuuggccucacaugugaaaaaccuggacgagaauggccuagaucuccugaguaagaugcuuaucuacgacccugcaaaacgcauaagcgggaagauggcccugaaccacccauauuuuaaugauuuggacaaccagauuaaaaagauguga

SEQ ID NO: 54162 - RNA, 1041 nt, Artificial Sequence
  derived and/or modified sequence opt3 from CDK20__Homo_sapiens__NP_001034892
auggaccaguacugcauccugggcagaauuggggagggagcccacgguauaguguucaaggcuaaacaugucgaaaccggcgagaucguugcacucaagaaaguggcccuuaggcggcuggaagauggguuucccaaccaagcguugcgcgagauuaaggcuuuacaggaaauggaggacaaucaguauguagugcagcugaaagccgucuucccucacggaggcgguuuugugcuagcauucgaguuuaugcucagcgaucuggccgaaguugugcgacaugcucaacguccacuugcacaggcccaggucaaguccuaccugcagauguugcucaaggggguggcuuucugucacgccaacaauaucguacauagagaccugaaaccggcgaaccugcucauuucugcaucaggacaauuaaagaucgccgauuuuggccuggcuaggguuuucagucccgacggcagccggcuuuauacacaccagguggccacucgcugguacagagcaccugaguugcuguauggggcuaggcaguacgaucagggagucgaccuaugguccguggguugcauaaugggcgaacuccugaaugggucuccacuuuuucccggcaaaaacgauaucgagcaacuguguuauguguugcggauucucggcacgccuaauccacaggucuggcccgagcugaccgaauuaccugacuacaacaagaucucguucaaagagcagguuccaaugccgcuggaagaggugcuccccgauguaucaccucaagcccuugaccuguugggucaguuucuacuguacccaccccaccagcgcauugcggccagcaaggcacuccugcaucaguauuucuuuacagcuccucuuccagcccaccccagugaacugccgaucccucaacgacucgggggacccgcuccaaaggcccauccuggacccccacacauacacgauuuccauguggacagacccuuggaggagucccuguuaaauccugaacugauuaggccauucauccuagagggcuga

SEQ ID NO: 54163 - RNA, 348 nt, Artificial Sequence
  derived and/or modified sequence opt3 from CDK2AP1__Homo_sapiens__NP_004633
augagcuacaagcccaaccuggccgcucacaugccugcagccgcgcucaaugcugccggcuccgugcauucuccaucaaccaguauggcaacaagcucccaguauagacaacuucugucugacuacgggccgcccucguugggauauacucaggguacgggcaacucacaggucccucagagcaaauacgccgaguuacuggcuaucauugaggaacuagggaaggaaauaaggccaaccuaugcaggaaguaaauccgccauggagcggcucaagcgcggcaucauucacgcucgaggucugguucgugaaugccuugccgagacagagagaaaugcgaggucuuga

SEQ ID NO: 54164 - RNA, 381 nt, Artificial Sequence
  derived and/or modified sequence opt3 from CDK2AP2__Homo_sapiens__NP_005842
augagcuacaagcccaucgccccugcuccauccucuaccccgggcucaaguacacccgggccuggaacuccagugcccacggguagcgucccuuccccaucuggcucgguucccggggcaggagccccuuucagaccacuguuuaacgacuucggcccgcccucaauggguuaugugcaggcgaugaaaccuccaggggcucaaggaagccagaguaccuacacagaucuccuuuccguaauugaggaaaugggcaaggagauaaggcccacuuaugccggcucuaaaagcgcaauggaacggcugaagcgcgggaucauucacgcccgagcuuuggugcgugagugcuuagcagaaaccgagagaaaugccaggacauga

SEQ ID NO: 54165 - RNA, 897 nt, Artificial Sequence
  derived and/or modified sequence opt3 from CDK2__Homo_sapiens__NP_001789
auggagaacuuccagaagguggagaaaaucggcgaagggaccuacggagucguuuauaaggccagaaauaaacugacaggugaagugguagcucucaagaaaauuaggcuugacacugagacggaaggcgugcccagcaccgcaauacgggagaucucccuguugaaggaguuaaaccacccuaauauugucaagcugcuagaugugauccauacagaaaacaaacucuaccugguuuuugaguuccuucaccaagaccugaagaaauuuauggaugccucugcguugacugggauuccacucccgcugaucaagucauaucuguuccagcucuuacagggacuggcuuuuugccauagucaccgcgugcuucaucgagacuugaaaccccagaaucugcuaauaaacaccgaaggcgccaucaagcucgcagauuucggucuggcccgugcuuuuggggucccugugagaacauacacccacgagguaguuacucuuugguauagggcaccagagauucuguugggauguaaguacuauagcacagccguggacaucuggucccucggcugcauuuucgcugaaauggucacccggcgcgcccuguuucccggcgauucugagaucgaccaauuauucagaauauuuaggacgcuggggacuccugaugaagugguguggccaggagucaccucgaugcccgacuacaaaccuucauucccaaagugggcgcggcaggauuuuagcaaaguugugccgccccucgacgaggauggucgcagucuucugucccagauguugcacuacgacccuaauaagcgaauuucugcaaaagccgcucuagcccauccauucuuccaggacguaacaaagcccgugccucaccugagacucuga

SEQ ID NO: 54166 - RNA, 918 nt, Artificial Sequence
  derived and/or modified sequence opt3 from CDK3__Homo_sapiens__NP_001249
auggacauguuccagaagguggagaaaaucggcgaagggaccuacggagucguuuauaaggccaaaaacagagagacaggucaacugguggcucucaagaaaauuaggcuugaucuggaaauggagggcguacccucaacugcaauacgggaaaucuccuuguuaaaggagcugaagcacccuaauauugugcgccuacucgacgucgugcauaacgagcgaaaacuguaccuuguuuuugaguuccugucucaggauuugaagaaauauauggacucaacgccagggagugaacucccgcugcaccugaucaagagcuaccucuuucaguuacugcagggaguguccuucugccauucucaccgugucauucauagagaucuuaaaccccaaaauuugcugaucaacgaacuaggcgccauaaagcucgcggacuuuggucuggcuagggccuucggggugccucuucggaccuauacacacgagguaguuacucugugguaccgcgcaccagagaucuugcucggaucgaaguuuuauaccacagccguggauauuuggucaaucggcuguauuuucgcugaaauggucaccagaaaagcacuguuucccggcgacagcgagaucgaucaguuauucaggauauuucggaugcuggggacuccuagugaagacacauggccaggagugacccagcuccccgauuacaaggguuccuucccuaaauggacgcgcaagggccuugaggaaauugugccaaaucuggagccggaggggcgagacuugcuaaugcagcugcuccaauacgaucccucucagagaaucacugccaaaaccgcucuggcccacccuuauuuuagcuccccagaacccagcccugcggcaaggcaguacguccuucagcgguuccgucauuga

SEQ ID NO: 54167 - RNA, 912 nt, Artificial Sequence
  derived and/or modified sequence opt3 from CDK4__Homo_sapiens__NP_000066
auggccaccagcagauacgagcccguggcugaaaucggcgucggggcauauggaacaguuuacaaggccagggacccucacuccggucauuucguggcgcugaaaucuguacgggugccaaacggcgggggaggcggugggggacucccgauuucaacuguccgcgagguggcucugcuucgacguuuggaagccuuugagcaccccaauguugugagauuaauggaugucugcgcaacgaguaggaccgaccgggaaauaaaggugacacugguauucgagcauguugaucaggaccuacgcacuuaucucgauaaagccccuccacccggccugccugcugagaccaucaaggaccuuaugagacaauuucugaggggcuuggauuuccuccacgcaaacuguauugugcaucgggaccugaaaccagaaaauauccuggucacaagcgggggaaccgugaagcucgccgauuuugguuuagcucgcauuuacuccuaucagauggcccugacucccguggucguuacacuuugguaccgagcgccugagguguugcugcagucuaccuaugcaacgccaguagacauguggucggugggcugcaucuucgccgaaauguuuagaaggaagccgcuauucugugggaacucagaggcugaucagcucggaaaaauauuugaccugaucggccuucccccugaggaugacuggccacgggacgucagccugccccguggugccuucccuccacgcgggcccagaccggugcaaaguguugugccugaaauggaggaauccggagcacaguugcuccuggagauguuaacuuuuaauccccacaagaggauuucugcuuuccgggcccugcagcacagcuaccuccauaaagaugaaggcaacccagaguga

SEQ ID NO: 54168 - RNA, 783 nt, Artificial Sequence
  derived and/or modified sequence opt3 from CDK5__Homo_sapiens__NP_001157882
augcagaaguacgagaaacuggaaaagaucggcgaggggaccuauggaacaguguucaaagccaagaacagagaaacucacgagauugucgcucucaaaaggguucggcuugacgaugacgaugaaggugugcccagcuccgcacugcgcgagauaugcuuguuaaaggagcugaagcauaaaaauaucguacgacuacacgacgugcuccauucugauaagaaacugacgcuugucuuugaguucugugaccaagaucugaagaaauacuuugacucaugcaacggcgauuuggacccugagauugugaagaauggggaacucaagcuggccgauuucggacuggcgcgugcuuuuggcaucccaguuagauguuauagugccgagguggucacccucugguacaggccgcccgacguguuauucggugcaaaacuguauagcacauccauugauauguggucugccgggugcaucuuugcugagcuugcaaacgccggacggccuuuguucccaggcaaugacguagacgaucagcugaagcgcauauuuagacuacucggcacucccaccgaagaacaguggccuucgaugacaaaacugccagacuacaagcccuauccuauguacccagcuaccacuucacuuguuaacguggucccgaaacugaaugccacagggagggauuugcuccagaaccuguuaaaguguaaucccgugcaacggaucagcgcggaagaggcacugcagcacccuuacuucagugacuuuugcccacccuga

SEQ ID NO: 54169 - RNA, 924 nt, Artificial Sequence
  derived and/or modified sequence opt3 from CDK5R1__Homo_sapiens__XP_011523740
augggcaccgugcugagccucucccccucuuacagaaaggccacacuuuucgaggacggggcugcaacugucggacacuauacggccguucagaacaguaaaaaugcgaaggauaaaaaccugaagaggcauucaaucauuagcguguugccuuggaaacggauaguagcuguguccgccaagaagaaaaauucuaagaaaguccaaccaaacucgucauaccagaauaacaucacccacuuaaauaacgaaaaucugaagaaaagccuaaguugcgcaaaccucuccacauuugcccagccgcccccugcucagccacccgcaccuccagccucucaacugagcgguucccagacuggcgggucaaguagcgugaagaaggcuccccauccugccguuaccucugcgggaacaccaaaacgcgugauuguccaggcauccaccucagagcuucugcgauguuugggcgaguuccucugccguagauguuauaggcugaagcaccugagcccgacugaccccgugcucugguuacggaguguagaucgcucucugcuuuugcaggguuggcaagaccagggguuuaucaccccugccaauguuguguuccuguacaugcuaugcagagaugucauuuccagcgaagugggaucggaccaugaacuccaggcugugcugcuuacaugucuguauuugucuuacuccuauaugggcaacgagaucucauacccacucaaacccuuucuggucgagaguugcaaggaagccuucugggauagguguuuaagcguuauaaaucugauguccucuaaaaugcuccagaucaacgcagacccucacuacuuuacgcaaguguucagcgaucuuaagaaugagucaggccaggaagacaaaaagcggcuguugcuagggcuggaucgcuga

SEQ ID NO: 54170 - RNA, 1104 nt, Artificial Sequence
  derived and/or modified sequence opt3 from CDK5R2__Homo_sapiens__NP_003927
augggcaccgugcugagccucucccccgccucuucagcuaaggggagaaggccuggaggucuuccagaggaaaagaagaaagcaccgcccgccggcgacgaggcgcuagggggauacggcgcuccuccagucgguaaagggggaaaaggcgaaagucgguugaagcgccccagcguuuuaaucuccgcccugacauggaagcgacugguggcagccucugcuaaaaagaaaaagggcucgaaaaagguaacuccuaagccagcaucaacggggcccgauccucucgugcagcaacguaacagagagaaucugcuuaggaaaggacgggacccaccggaugguggcgggaccgccaagccccuggcugucccugugccaacaguucccgccgcggcagccacuugcgaaccuccaagcggaggcagugcugccgcacagcccccggguuccgggggaggcaaaccucccccaccucccccacccgcuccucagguggccccaccgguccccggcgggucuccucgcagagugauuguacaggcgagcaccggagaguugcucaggugucugggugacuucguuugccggcgcuguuaucgacugaaggagcucuccccaggcgaauuaguggggugguuuagaggagucgauaggucacugcuuuugcaaggcuggcaggaccaggccuucauaacacccgcaaaccugguguuuguguaccuacucugccgggagagucugcguggugaugaacuugcuagcgccgcugagcugcaggccgcauucuugaccugucucuaucuggccuacucuuauauggggaaugagaucuccuacccuuuaaaaccauuucuggucgaacccgacaaggagcgcuucuggcaaagaugccucaggcuuauucagcggcugucaccgcagauguugcgacuaaacgcugauccucacuuuuucacucagguuuuucaagaccugaaaaaugaaggcgaggcggcagccagcggaggcgggccacccaguggaggugcuccugccgcaucuuccgccgcucgcgauagcugugccgcaggcacaaagcauuggaccaugaaccucgacagauga

SEQ ID NO: 54171 - RNA, 1761 nt, Artificial Sequence
  derived and/or modified sequence opt3 from CDK5RAP1__Homo_sapiens__NP_001265096
augcacccccugcagugcgugcuccaaguccagagaagccuuggcugggggccucuggccuccguuucuugguugucauuaaggaugugucgggcucauaguagccuguccucuaccaugugcccaucgccggagcgccaggaagacggagcacgaaaggauuucucaagccgucuagccgcgggucccacauuucagcacuuccucaaaagugcuuccgccccucaagagaagcugucuagcgaaguggaggacccacccccuuaccuuaugauggaugaacuguugggcagacagaggaaaguauaucucgagacuuacgggugucagaugaacgugaaugacacggagaucgcaugguccauucugcagaagucaggauaucugcggaccaguaaccuccaagaagccgaugucauauuacuggugacaugcagcauccgcgagaaagcugaacagacuauuuggaauagacuucaucaguugaaggcacugaagaccaggcggccacgcucucgaguuccccuaagaaucggcauucucgguuguauggccgagaggcugaaagaggaaauccuuaaccgggagaagaugguggacauacuggcugggccugaugccuaccgugacuugccacgccuccuggcggucgcagaauccggacagcaagccgcuaauguguuacugucacucgaugagacauaugccgacguaaugccgguucagaccagcgcaagugcuacuucugccuuuguguccaucaugagaggcugcgauaacauguguagcuacugcauuguccccuucacaaggggccgggaacgaucgcgcccuaucgcgucuauucuugaggaggugaaaaagcuguccgaacagggguugaaagaggugacccuacugggacaaaaugucaacucauuuagagacaauagugaaguucaguucaacagcgccgugccaacgaaucucuccagggguuuuacuaccaacuauaagacaaagcagggcgggcugcgguucgcacaccuucuggaucagguaucucgcguggaccccgagaugagaaucagguuuacuagcccucauccaaaagacuuccccgaugaagucuugcaacucauacacgagcgugacaauauuuguaagcagauccaucugccggcucagucaggaaguucccggguguuagaggccaugcgaagaggcuacagcagggaggcuuacguugagcuggugcaccacauucgcgaaucuaucccuggugucucacuaaguagcgauuuuaucgccggguucugcggagagaccgaagaggaccaugugcagacaguaucccuccugcgggagguucaauauaacaugggcuuucuuuucgcauacucuaugagacagaccagggccuaucaccgcuugaaagaugacgugcccgaagaggucaagcugcgacggcucgaagaacugauuacgauauuccgugaggaagcuacuaaagcgaaucagacaucggugggcuguacccagcuuguccugguggagggguugagcaagagauccgcaacugaucucugcggaaggaacgacgguaaccugaaaguuaucuuuccagaugccgaaauggaggacgugaauaacccuggcuuacgcguacgggcucaacccggggauuacguccuggugaagauuacaucagccaguucucagacccuaagaggacacguucucugcaggacgacccugcgagacagcuccgcauauuguuga

SEQ ID NO: 54172 - RNA, 5445 nt, Artificial Sequence
  derived and/or modified sequence opt3 from CDK5RAP2__Homo_sapiens__NP_001011649
augauggaccuggugcucgaagaagaugucaccguucccggcacacuuagcgggugcuccggacuggugccuucuguaccggacgauuuggacgguaucaacccgaaugccggcuuagggaacggacugcuacccaaugugucagaggaaacugucaguccuacgagagcuaggaacaugaaggauuucgagaaucagauuaccgaacucaaaaaggagaacuuuaaucugaaacuucggauauacuuccuggaggaacgcaugcaacaggaguuucacggcccaacagaacacaucuauaagacuaacauugaguugaaaguggagguugaaagccucaagcgagagcugcaggaacgugagcagcugcucaucaaggcauccaaagccguggaaucuuuagcggaggcuggugggucggagauucaaagagucaaggaagacgccaggaaaaaggugcagcagguagaggaucugcuuaccaaacggaucuugcugcuagaaaaggacguuacagcagcccaggcugagcucgaaaaggcauucgccggaaccgagacugagaaagcucugcgccuuagacuggaaucaaaguugagcgagaugaaaaagaugcacgaaggcgaucucgccauggcgcugguguuagacgagaaagauaggcugauagaagaacucaaacuuagucugaaauccaaggaggcauugauccaaugucuaaaggaagagaaaucucagauggccugccccgacgaaaaugucagcuccggcgagcugcgggggcucugugcugccccucgcgaggaaaaggagcgagaaacagaggcagcucagauggaacaucagaaagagagaaacucauuugaggaaaggauucaagcccuggaggaagaucuucgggagaaggaacgugagaucgcgaccgagaaaaagaauagucugaagcgcgacaaagccauucagggauugacgauggcacucaagagcaaagaaaagaaaguggaggaacugaacucugagaucgaaaaguuauccgcugccuucgcuaaggccagagaggcacugcagaaagcccaaacucaggaguuucaggguucagaagacuacgagaccgcucuaagcggcaaggaagcgcucagugcagcccugaggucucagaaucuuacaaaauccacugagaaccaccgguugcgacgcagcauaaagaaaauuacccaagagcugucggaucuccagcaggaaagagagaggcuggaaaaggaccuugaggaagcucaucgggagaagucuaaaggggauugcacaauccgcgaccugagaaaugagguggaaaaguugaggaacgaggucaacgaacgugagaaagccauggaaaaucgguauaagucccuccugucagagaguaacaaaaaguuacacaaucaggagcaaguuauuaaacaccugaccgaaagcacgaaccagaaggaugugcuacuccagaaguucaaugagaaagaccuggaaguaauccagcaaaacuguuaccuuauggcagccgaggauuuggaacugcgauccgagggacucaucacugagaagugcucuagccagcagccacccggcucaaaaacaauuuuuaguaaggagaagaaacaguccagcgacuaugaggaacugauacaaguguuaaagaaagagcaggauaucuacacccaucuggucaagucucuucaggagucagacaguauuaauaacuugcaagcugaacucaauaaaaucuucgcccugagaaagcagcuagagcaggaugugcugagcuaucagaaccucaggaaaacucuggaagaacaaauauccgaaauucgccggagagaggaggaaucuuuuucgcuuuacagcgaccagacauccuacuugucaaucugucuggaggaaaauaacagguuccagguugagcacuuuagucaggaagaguuaaagaagaaagugucugaccucauccaacuggucaaggagcuuuauaccgauaaucagcaucugaaaaagacgauuuucgacuugagcugcauggguuuccaggggaacggauuuccugaucgccucgcauccaccgaacagacagagcugcuagcgucaaaagaagacgaggauacuaucaagauuggcgaagacgaugagauaaauuuccugagcgaccaacaccuccagcagucuaacgagaucaugaaggaucuguccaaaggcggguguaagaacggauaccuucgacacaccgaaaguaaaauuagcgacugcgauggugcucaugccccaggcuguuuggaggaaggggcauuuaucaaucuguuagccccacucuucaacgagaaggcuacacugcuucuggagucucggcccgaccuacucaaagugguacgugaacuguugcugggacaauuauuucucacugagcaggaaguuuccggcgagcaccuggaugguaagaccgagaagacaccuaagcagaagggggagcuugugcauuucguccagaccaauucauuuaguaaaccacacgacgagcugaaguugagcugcgaagcccaacucgugaaagcaggcgagguccccaaggugggacugaaagacgcuucgguucagacuguggccacggaaggcgaucuacugagauucaagcaugaggcgacaagggaagccugggaggagaagccuaucaacaccgcucuuuccgcagaacaccgcccagagaaucuccacgggguacccggauggcaggccgcucuguugucucugccggguauuacuaaccgggaagccaaaaagagcagauuaccuauacucaucaaacccucaaggagucugggcaauauguaucgacuuccagcaacccaggaggucgugacacaacugcagucccagauuuuggaacuccagggggagcugaaggaguuuaaaaccugcaacaagcaacuacaucagaagcugauccuugcggaagccguuauggagggacgcccuacucccgacaaaacacuccugaaugcucagccacccgugggcgccgcauaccaggauucuccuggugaacaaaaggggauuaaaacgaccagcuccgucuggcgggacaaggagauggauucagaccagcagagaagcuaugagaucgauagugaaauauguccaccggacgauuuggcuucuuuacccuccugcaaagagaacccugaagacgugcugagcccaacuucgguagccacauaccucucaucuaagagucaacccuccgcaaaggugagcguuaugggcaccgaucagucugagagcaucaauacauccaacgaaacugaguaucugaaacagaagauucacgaccuugagaccgaacuggagggauaccagaauuucaucuuucaauugcagaaacauucacaguguagugaagccauuaucacgguccuaugcggcaccgagggggcucaggauggacugagcaagccuaaaaacgguucugacggcgaagagaugacauucuccucacuccaccaagugagguacgugaagcacgucaagauacuggggccacuugcgcccgagaugauugacagucguguuuuagaaaaucugaaacagcagcucgaggaacaggaguauaaguugcaaaaagaacagaaccugaacaugcagcucuuuagcgagauccauaaucugcaaaacaaguuccgcgaucuuuccccgccucgguacgacucucuggugcagucgcaggccagagaguugagccuacagaggcaacagauuaaagauggacacggcaucugugugauaucacgacagcauaugaauacuaugaucaaggcauucgaggagcugcuccaggcuuccgacguagauuauugcgucgccgaagguuuucaagagcaguuaaaccagugugccgagcugcuugaaaaacuggagaaacucuucuugaaugggaagagugugggcguugaaaugaacacccagaaugagcugauggaacggauugaggaggacaaccucacauaccaacaucugcuuccagaaucucccgagccuagcgcuucccaugcacuaucagauuaugaaacuucugaaaagagcuuuuucagucgcgaccagaagcaggauaaugaaaccgagaaaacguccgugauggucaacagcuuuucucaggaccuguugauggagcacauccaagaaauuagaacauuaaggaagcggcuggaggaaucaaucaaaaccaaugagaagcuccgaaagcagcuggaaagacagggauccgaguucgugcaaggcaguacuagcauauuugccucggggucugagcuucacuccagccugacaucagaaauucauuuccuccgcaaacagaaccaggcguugaaugcuaugcugaucaagggaaguagggauaaacagaaggagaacgacaaacuacgugaaucucugucccggaagaccguuagccucgagcaccuucaaagagaguacgccucagugaaggaagagaaugaaaggcugcagaaagagggcagugaaaaggagcgccauaaccagcaguuaauccaagagguacgaugcagcggucaggaauuguccagaguccaggaggaagugaaacugcggcagcaacuccugucucagaacgacaaacuucugcagagccucaggguggaguugaaagcauaugaaaagcuggaugaggagcaccgccguuuaagagacggggauaaguaccccauggaauccgacaauucauuugaucuauucgacucuagucaagccgucacuccaaaaucgguuagcgagaccccuccccuguccggaaacgauacagacucucucucaugugauagcggcuccagugcuacgucuaccccaugcgugagccggcuuguaacuggucaucaccugugggcaucaaagaauggcaggcacguguuggggcugauugaagacuacgaggcccuccugaaacagaucucccagggacagcgccuucucgcggaaauggauauucaaacacaggaggcuccgaguagcaccucucaggagcugggcacaaaggggccucaucccgccccauuguccaaauuugucucaagcgugucgacugcaaagcugaccuuagaagaggccuaucgaagacuaaaacugcucuggcggguuucucuucccgaagacggacaguguccucugcacugcgagcaaauaggcgagaugaaggcugaagugacgaaguugcauaaaaagcuguucgagcaggagaagaagcuccagaacacaaugaaacugcuucaguuaaguaagaggcaagagaaggucaucuuugaucagcuggugguuacccacaaaauucuccgcaaggccagagguaauuuggaacugaggccagggggagcacaccccggcacuugcuccccuagccggccggguucauga

SEQ ID NO: 54173 - RNA, 1521 nt, Artificial Sequence
  derived and/or modified sequence opt3 from CDK5RAP3__Homo_sapiens__NP_788276
auggaggaccaccagcaugugcccaucgauauucaaaccagcaagcugcucgacuggcuugucgauagaaggcacugcucccugaaauggcagucuuugguuuuaacaauacgggaaaagaucaacgccgcuauucaggacaugccugagucagaagagaucgcacagcugcuaaguggcagcuacauucauuauuuccacugucuccgcauccuggaucuucugaaagggacugaagccuccacgaagaauauauuuggacgauacucuucgcaacguaugaaagacuggcaggagaucauugcguuguaugagaaggauaacaccuaccucguggaacugucaagccugcucguaagaaaugugaacuaugagaucccaaguuuaaagaaacagauugcuaagugccagcaacugcagcaggaauacuccaggaaagaggaggaaugucaggccggugcagccgagaugcgggaacaauucuaucauucuugcaagcaguacggcaucacaggggagaauguccgcggagaacuuuuggcucuggugaaagaccuaccgagccagcucgcagagauaggcgccgcugcccaacagucccugggugaggcgauugauguuuaccaggcaucagugggguuugucugugaaagucccacugaacaggugcuuccuaugcugagauucguacaaaagaggggaaacagcaccguuuaugaauggcggacaggcaccgagccaucuguggucgaacgcccccacuuggaggagcucccugaacagguggccgaggacgcuaucgauuggggcgacuuugggguggaagccgucuccgagggaacugauucagguauuagcgcagaagcugccggcaucgacugggggaucuucccagagagugacucuaaggaucccggaggcgacgguauugauuggggagacgaugcgguugcccugcagauaacaguguuagaggcagggacccaggcuccugaaggcguagcccgaggcccagacgcucugacgcuccuugaguacacugaaaccagaaaucaauuucuggaugaguugauggagcuagaaaucuuccuggcccagagggcaguggagcucuccgaagaggccgacguccugagcgugucgcaguuucagcuugcuccggcgauucugcaagggcagacaaaagaaaagaugguuacuauggugucugucuuggaggaucucaucggaaaacugaccuccuuacagcugcagcaccuauucaugauacucgcaucaccccgguauguggaccguguaacagaguuucugcaacagaaacuuaagcagagucaauugcuggcccucaagaaagaacugaugguucagaagcagcaggaggcucuugaggagcaagccgcacuggaaccuaaguuggaucuccuguuagagaaaaccaaggagcugcagaaacuaauugaagccgacaucagcaagcgcuacuccgguagaccagugaaccucaugggcacgucucuguga

SEQ ID NO: 54174 - RNA, 981 nt, Artificial Sequence
  derived and/or modified sequence opt3 from CDK6__Homo_sapiens__XP_006715898
auggagaaggacggccugugcagagccgaucagcaauacgaauguguggcugagaucggggaaggagcauaugguaaagucuucaaggccagggaccucaaaaacggcgggcgguuuguugcgcuuaagcgcgugcgaguacagaccggagaggaaggcaugccccugagcacaauucgugagguggcugucuugagacacuuagagacuuucgaacauccuaaugugguuaggcuguuugaugugugcacggucucccggaccgaccgcgagacaaaacuaacucucguguucgaacacguagaucaggaccugaccacauaccuugauaagguuccagagccgggugugcccaccgagacuauaaaggacaugauguuucagcuguugagagggcucgauuuccugcauucucacagggucgugcaucgggaccugaaaccucaaaacauccucgugacaucaaguggacagauuaaguuagccgauuuuggccuggcacgcaucuauagcuuccagauggcccuuaccuccgucguugugacguugugguaccgagcuccagaaguacugcuacagucuucguaugcaacucccguggaccucuggucagucggcuguauuuuugccgagauguucagaaggaaaccucuguuucgggggagcagugauguggaccaacuuggaaagauccuggacguuauagguuugccaggcgaagaggauuggccccgugacguggcucucccucgccaggccuuccacuccaaaucugcgcagccaaucgaaaaguuugucaccgauauugacgagcuggggaaggauuuacugcucaaaugccuuacauucaauccggcaaagagaaucagcgccuacuccgcucugucacaccccuauuuccaggacuuggagagguguaaagaaaaccuagauagucaucugccuccaagccaaaauacuucugagcucaacaccgccuga

SEQ ID NO: 54175 - RNA, 1041 nt, Artificial Sequence
  derived and/or modified sequence opt3 from CDK7__Homo_sapiens__NP_001790
auggcccuggacgucaagagcagagcuaaaagguacgagaagcucgauuuccuuggcgaagggcaguuugcaaccguguauaaagcccgggacaagaacacaaaucagaucguugcgauuaaaaagauaaagcugggacaccgcuccgaggcuaaagaugguaucaaccgaacugccuugcgugaaauuaaguuacugcaggagcuaucucaucccaauaucauuggccuccuggacgcauucgggcacaaaucaaacaucagucuuguguuugauuucauggaaacggaccuggagguaauaaucaaggauaauagcuuggugcucaccccuucccauauuaaagccuacaugcugaugacacugcagggacucgaguauuuacaccagcauuggauccugcacagagaccuuaagccaaacaauuugcugcuagaugaaaacggcguccucaagcuggcugacuuuggucuugcaaaaucuuucgggucgccgaauagggccuacacucaccaagugguuacccggugguaucgcgcucccgagcuguuguuuggagccagaauguacggcgugggcgucgauaugugggcgguggggugcauucucgcagaacuguuacugaggguaccuuuccucccaggagacucagaucuugaccagcugacacggaucuuugagaccuuggguacucccacagaggaacaguggccugacauguguagccuaccagauuauguuaccuucaagaguuuucccggcauaccucugcaucacauuuucuccgccgcuggggacgaucuccuggaccuuauccagggacuguuuuuguucaacccaugcgcccgcauuacggcaacucaagcucucaaaaugaaguacuucucuaaucgaccgggccccaccccugguugucagcugccaagacccaacugcccuguggagacauuaaaagaacagagcaauccagcccuggcgaucaagaggaaacggacugaggcccuagaacaagggggacuccccaagaagcugaucuuuuga

SEQ ID NO: 54176 - RNA, 1395 nt, Artificial Sequence
  derived and/or modified sequence opt3 from CDK8__Homo_sapiens__NP_001251
auggacuacgauuucaaggugaaacugagcuccgagagagaaagggucgaggaccucuuugaauaugagggcugcaagguugggcggggaaccuacggucacguguauaaagccaagcgcaaagauggcaaggacgauaaggacuacgcucuuaaacagaucgaagggacaggaauuucuaugucagcaugucgagagauagcccuguugcgugaguuaaagcaucccaacguaaucagucugcaaaaaguguuccuaagccacgcggauagaaaggucuggcuccuguuugacuaugcugaacaugaucuuuggcacauuaucaaauuccauagggccuccaaggcaaauaagaaaccugugcagcugccacggggcaugguuaagucuuugcucuaccagauucuggacgguauccacuaucugcacgccaacugggugcuccaucgcgauuuaaaaccggcuaauauacuggucaugggggagggacccgaaagaggcagggugaagaucgcagacaugggcuuugcccggcuuuucaacucgccuuugaaaccacuggcugaucuagaccccguaguugugacuuuuugguaccgcgccccugagcuccugcuuggggcgcgacacuacacgaaggcaauugacaucugggccauuggaugcaucuucgcugagcuguugaccucagaaccaauauuucauuguagacaggaggauauuaaaacaagcaaucccuaucaccacgaccaacucgauaggaucuucaacgucauggguuuuccugccgacaaggauugggaagacauuaagaaaaugccagagcauaguacucugaugaaggauuuccggcguaauaccuacacaaacugcuccuuaaucaaauauauggaaaagcacaaagugaagccggacucuaaggcauuucaucugcuccagaaacuucugaccauggaucccaucaagcgcauuacuagcgagcaggcuaugcaggacccuuacuucuuggaggauccacuacccacauccgacguguucgccggcugucaaauaccuuauccaaaaagagaauuucugaccgaggaggaacccgacgauaagggggacaaaaagaaucagcagcagcaacagggaaacaaucacacgaacggcacuggucauccggggaaucaggauucaagucacacccaaggaccuccccucaagaaagucaggguugugccaccuacaacuaccagcggcggccugaucaugacaucugacuaccagcgguccaacccccacgcggccuauccaaaucccgggccuucaaccagccagccacagaguucuaugggauacuccgcaacgagccaacagccgccccaguacucgcaucagacucaccgauauuga

SEQ ID NO: 54177 - RNA, 1119 nt, Artificial Sequence
  derived and/or modified sequence opt3 from CDK9__Homo_sapiens__NP_001252
auggccaagcaguacgacagcguggagugccccuucugugaugaagucuccaaauaugagaagcuggcuaaaaucggccaagggaccuuuggagaaguuuucaaggcaagacacaggaaaacaggucagaagguggcccucaagaaaguacuuauggagaacgaaaaggagggcuuuccuauuacugcgcugcgggagauaaaaaucuugcaguuacugaagcaugaaaauguggucaaccuaauugagaucugccgcacgaaggcuucuccauacaaucgauguaaagggucaauuuaucucguguucgacuuuugcgaacacgaucuggccggacuucugaguaacguuuuggugaaguucacccucagcgagaucaaacgugucaugcagaugcugcugaauggccucuacuauauacauagaaacaagaucuuacacagggacaugaaagcagccaaugugcugauuacacgggaugguguacuuaaguuggcugacuuugggcuggcacgcgccuucucccuagcuaaaaacucucaaccgaauagauacacuaacaggguugugacccucugguaucggcccccugagcugcuucugggagaacgcgauuacggcccacccaucgacuuguggggcgccggguguauuauggcggagauguggacacgaucgccuaucaugcagggaaauaccgaacagcaucagcucgcacugauaucacaauuaugcgguagcauuacuccagaggucuggcccaacguggauaauuacgaacuguaugagaagcucgagcuugugaaaggccagaagagaaaggucaaagacaggcugaaggccuacguucgggauccuuaugcuuuggaccuaaucgauaaacugcucgugcuggacccagcccagcguauugacagugaugacgcacuuaaccacgacuuuuucugguccgauccgaugcccucugaucugaaggggauguugagcacacaccucaccuccauguuugaauaccuggcuccuccacgcagaaaaggaucacagaucacgcaacagaguacuaaucagagcaggaaccccgccaccacaaaccaaacugaguucgaacggguauuuuga

SEQ ID NO: 54178 - RNA, 1740 nt, Artificial Sequence
  derived and/or modified sequence opt3 from CDKAL1__Homo_sapiens__NP_060244
augcccagcgccuccugcgacacccugcucgaugacaucgaggauauugugucucaggaagacucaaagccucaagauagacacuucgucaggaaagacguugugccaaagguacggcgccgaaacacacagaaauaccuucaggaggaagagaauaguccgcccagcgauuccacuauaccuggcauccagaagauuuggauccguacguggggguguucucauaacaauucggacggagaauauauggcuggucaacuggcagccuacggcuauaaaauuaccgagaacgcgucagaugcugacuugugguuacugaauagcugcacagugaagaacccagccgaggaucacuuuagaaauaguaucaagaaagcacaggaagagaacaagaaaauaguccuagccgggugugugccccaggcucagccuaggcaagacuaccucaagggacuguccaucauuggcguucagcagaucgaucggguggucgaagugguagaggagacuauuaaaggucauucuguucgccuucuggggcagaagaaggacaauggaagaagguugggcggcgcacggcucgaccugccaaaaauccgcaagaacccccugauagaaauuaucagcauuaauaccgggugccucaacgccuguacauauugcaaaaccaagcacgcucgaggaaauuuagccuccuacccuaucgaugagcugguggacagagcgaaacaaucauuccaggaaggugucugugagaucuggcuuacaagugaagauacuggcgcauaugggagggacauuggaaccaacuugccaacgcugcuauggaagcucguggaggugauaccggagggcgccaugcugcggcuugguaugacuaaucccccuuacauccuggaacauuuggaggaaauggcuaaaauucucaaccacccacgugucuacgccuuucugcacauccccguucagagcgcaucugauuccguguuaauggagaugaagcgcgaauauugcguagcugacuucaagagaguggucgauuuucugaaagagaaggugccugggauaaccauugccacagacaucaucuguggauucccaggcgagacugaucaagacuuucaggaaaccguuaaacucguggaggaauacaaguuccccucacuuuuuauuaaccaguucuauccgaggccuggcacacccgcggccaaaauggagcaggucccagcacaagugaagaagcagcggaccaaagaucugagccgaguauuucauaguuacucuccuuaugaccacaagaucggggaacgccagcagguuuuggugacggaggaguccuucgacagcaaauuuuacgucgcucauaaucaauucuaugaacaggugcuaguccccaagaacccagccuucaugggaaaaaugguggagguugauauuuacgaaucggguaagcacuuuaugaagggccagcccgugucugacgcuaaaguauacacuccuuccauaucaaagccacuggccaaaggggaggucaguggacucacaaaggauuucagaaauggccuggguaaccagcuuagcuccgggucucacaccagcgcagccucacaaugcgacagugcuuccagcaggauggugcugccgaugccccgguugcaucaggauugugcgcuccgcaugucuguuggccuggcauuacugggacuacucuuugccuucuuugugaaagucuauaauuga

SEQ ID NO: 54179 - RNA, 1077 nt, Artificial Sequence
  derived and/or modified sequence opt3 from CDKL1__Homo_sapiens__NP_004187
augauggagaaguacgagaaaaucggcaagauuggggaaggaagcuaugguguggucuucaaaugcagaaacagggacaccggccagauaguugccaucaagaaauuucuggaauccgaggaugaccccgugauuaagaagaucgcucuccgggaaauucgcaugcuuaaacaacugaagcacccuaauuugguaaacuuacuggagguguuccgacguaaaagaaggcuacaucucgucuuugaguacugugaucacacagugcugcaugaacuugaccgguaucagcgcgggguuccagagcaccuggugaagucuaucacuuggcagacguugcaggcagucaauuucugccauaaacacaacuguauacacagagaugugaagccggaaaauauccucauuaccaagcauucaguaaucaaacugugcgacuuuggauucgccaggcugcucacaggccccagugauuacuauacugacuacguugcgacccggugguaucgcagcccugaguuacuggugggugauacacaauacgggccacccgucgacgugugggcuauuggauguguguuugccgagcuuuuguccggcgucccucuguggccaggcaagucugauguugaccagcuauaccucauccgaaaaacccugggggaucuuauacccagacaccaacagguguucucgacuaaccaguauuuuucaggaguaaagauuccugacccagaagacauggagccgcuggaauugaaauuccccaauaucagcuacccugcacucggucuguuaaagggcugccugcauauggauccaacacagaggcucaccugugagcagcuucugcaccaccccuauuuugaaaacauucgggagaucgaggacuuggccaaagaacauaauaagccuacgcguaagacucuacgcaaaaguagaaagcaccauugcuucaccgagacauccaaacugcaguaccucccacaacugacugggucuagcauccuucccgcucuggauaacaagaaauauuacugugacaccaagaaguugaauuauagguuuccgaacauuuga

SEQ ID NO: 54180 - RNA, 1482 nt, Artificial Sequence
  derived and/or modified sequence opt3 from CDKL2__Homo_sapiens__NP_003939
auggagaaguacgaaaaccugggccucgugggggagggaagcuaugguauggucaugaaaugcagaaauaaggacaccggcaggaucguugccauuaaaaaguuccuugaauccgaugacgauaaaauggugaagaagauagcuaugcgggagaucaaacuguugaagcaguuacgccacgaaaaccugguaaaucuacucgagguguguaaaaagaaaaagcgaugguaccuggucuuugaguucguggaccauacaauucuugaugaccuggaauuguuucccaacgggcucgauuaucaaguugugcagaaguaccuguuccagaucauuaauggaaucggcuuuugccacucucauaacauaauccaccgugacauuaaaccugagaauauccuggucucacagaguggugugguaaagcucugugauuucggguuugcaagaacuuuagccgcgccaggagaaguuuauacggacuacguggcuaccaggugguaucgggccccggagcugcuugucggcgaugugaaauacggcaaggcaguggacgucugggccauugggugcuugguuacagagauguucaugggagaaccccuguuuccuggugauagcgacaucgaccaacuauaccauauaaugaugugucucggcaaccugauuccacgccaccaggagcuuuucaauaaaaaccccguguuugcugggguaagacugccugaaaucaaggagagggaaccauuggagcggcgcuaucccaaacucuccgagguggucauugaucuggcaaagaagugcuuacacaucgacccugauaaacgaccauucugugccgaacugcuccaucacgacuuuuuccagauggauggauucgcugagagauuuucucaggaacuucaacugaaggugcagaaagacgccaggaauguuucguugucaaagaaaagccagaaccggaagaaggagaaagaaaaggaugacagucuaguggaggagcguaaaacucuggucgugcaggauaccaaugcggacccgaagaucaaagauuacaaacucuucaagauuaagggcuccaagauagacggugaaaaagcagagaaggggaaccgcgccucuaaugcuagcugccugcaugacuccagaacaucacacaacaaaaucguacccaguaccagccuuaaggauuguucuaacguuuccguggaccacacuaggaauccuucagucgccauuccaccccugacacauaacuugagcgcaguggcuccuaguaucaauucuggaaugggcaccgaaacgauaccaauucaaggcuaucgggucgaugagaagacuaaaaagugcuccauccccuuugugaaaccgaaccgacacagcccuucggggaucuacaauauuaacguuaccacacucgugucuggacccccacuguccgacgauucaggugccgacuuaccucagauggaacaucagcacuga

SEQ ID NO: 54181 - RNA, 1779 nt, Artificial Sequence
  derived and/or modified sequence opt3 from CDKL3__Homo_sapiens__NP_001107047
auggagauguacgaaacccugggcaaggugggggagggaagcuaugguacagucaugaaaugcaagcacaaaaacacuggccagaucguugccauuaagauauucuacgaaagacccgagcaauccgugaauaaaaucgcuaugagggaaauuaaguuucucaagcaguuccaucacgagaaccuuguaaaucugaucgagguguuucggcagaaaaagaaaauucauuuggucuucgaauuuaucgaccacacgguguuagaugagcugcagcauuauugucacgggcuagaaucuaagcgccuccgaaaauaccuguuccaaauacuucgugcaaucgacuaucugcacucaaacaauauuauccauagagauauuaagccugagaacaucuugguuagucagagcggaauaaccaagcucugcgacuuuggcuucgccaggacacuggcggcuccaggugauauuuacacugacuauguggccacccggugguaccgcgcaccggagcugguccucaaagauacauccuacgggaagcccguggacaucugggccuuaggauguaugauuaucgaaauggcuaccggcaauccuuaucugccaucuucgucagaucuugacuugcugcacaaaaucguacuaaagguuggcaaccucagcccccaucugcagaauauuuuuaguaaauccccuauauucgcaggggugguccuuccacaggugcaacaccccaagaacgccaggaaaaaguacccuaagcugaauggauugcucgcugauaucgugcacgccugccugcagauugacccagcggauagaaucucuagcuccgacuuacugcaucacgaguauuuuacucgggacgguuucauagaaaaauuuaugccggagcucaaggcaaaacuucugcaggaagccaaggucaacucauugauuaaacccaaggagaguagcaaggagaaugaacuacgcaaagaugagcgaaagacaguuuacaccaacacgcugcucucuuccucagugcugggcaaagaaaucgagaaggagaaaaagccuaaggaaaucaaaguaagagugauuaaggucaaagggggaaggggcgacaucagcgagccaaagaaaaaggaauaugagggugggcuuggacagcaagaugcuaaugaaaacgugcaucccaugaguccugacacuaagcugguuaccauugagccacccaacccgauaaauccuucuacaaacuguaauggcuugaaagaaaacccccacugcggcggguccgugacuaugccaccuaucaaucucaccaacagcaaucugauggccgcaaacuuaucgucuaaucuguuccaucccuccguccggcuaacagagcgugcuaagaaacgcagaaccucaagucagagcauuggacaggugaugccaaacuccaggcaagaggaucccgguccuauccagucucagauggaaaagggcaucuucaaugagcggacggggcacagcgaccagauggccaacgaaaauaaacgaaagcucaacuuuucacgcagugauagaaaagaguuccacuuuccagagcugccgguaacuauucaauccaaggacacaaagggaauggaaguuaaacagauaaagaugcuuaaaagggagagcaagaaaaccgaaucuucaaagauccccacuuugcugaauguggaucagaaccaggagaagcaagaaggcggugacgggcauugugagggcaaaaaccucaagcggaaucgcuucuuuuucugguga

SEQ ID NO: 54182 - RNA, 948 nt, Artificial Sequence
  derived and/or modified sequence opt3 from CDKL4__Homo_sapiens__NP_001009565
auggagaaguacgaaaaacuggccaagaccggcgaggggagcuauggaguggucuucaaaugcagaaacaagacauccggucagguuguggcugugaaaaaguuuguagaaucugaggacgaucccgucgugaagaaaaucgcacucagggaaauucggaugcuuaagcaacugaaacacccuaauuugguuaacuuaauagagguguuccgccgaaagcguaaaaugcaucuggucuuugaguacugugaccacacucuacucaaugaacuggagagaaacccaaauggcguggccgaugggguaaucaagucaguucuuuggcagacgcugcaggcguugaacuucugccauauucacaauuguauccauagggacauuaagccggaaaacauccucauaaccaaacagggaaucauuaagaucugcgauuuuggcuucgcucaaauucugauccccggugacgccuauacagauuacguggcaacucggugguaucgcgccccugagcugcucgucggggacacccaguacggaaguagcguggauauaugggcuauuggcuguguguuugcagaguuacugacaggccagccacuuuggcccgggaaauccgacgucgaucaguuguaucugaucauuagaacccuaggaaagcucaucccuaggcaccaaucuaucuucaaaucgaauggcuuuuuccacgguauuucaauaccagaacccgaggacauggaaacucuggaggaaaaguuuagcgauguucauccuguggcccuuaacuucaugaaagggugccugaagaugaauccagacgaccgguugacauguagucagcuccuggaguccucuuacuuugauagcuuccaggaggcucagaucaagcgcaaagcccgaaacgaaggaagaaauaggcggcgucaacagguauuaccgcugaaguccuga

SEQ ID NO: 54183 - RNA, 3093 nt, Artificial Sequence
  derived and/or modified sequence opt3 from CDKL5__Homo_sapiens__NP_001032420
augaagauccccaacauuggcaaugugaugaacaaauucgagauacugggggucguuggagaaggugccuacggcgugguacucaagugcagacacaaagagacccaugaaaucguggcuauuaagaaauuuaaggacagcgaggaaaaugaggaggucaaggaaacaacucuuagggagcugaaaauguugcggacguuaaagcaggaaaacaucguggagcugaaagaggcauuccgccgacgugggaagcuauaucucguuuuugaauacguggagaaaaauaugcuggaacuucuggaggaaaugccuaacggagucccaccggagaaggugaaguccuauauuuaccaauugaucaaagccauacacuggugucauaagaaugauaucguacacagagacauuaaacccgagaaccuccugaucucucauaaugauguucugaagcucugcgacuucggcuuugcgaggaacuuaucagaagguaauaacgcuaauuauaccgaguacguggccacacggugguaucgcaguccugaacugcuuuugggggcaccauacggaaaaagcgucgauaugugguccgugggcuguauucugggcgagcuaucugacgggcagccccucuucccuggagaaucggagaucgaucagcuguuuacuauacagaaggugcuugguccacugcccucagagcaaaugaaauuguucuacagcaacccuagauuucacggccucagguucccagccgucaaucacccgcagagucuggaacggcgcuauuuagggauucugaacuccguucuccuugaccugaugaagaacuugcuaaagcuggaucccgcugaccgauaccucaccgagcagugccugaaucauccuacauuucagacccaaagacuucuggauaggucuccaagccgguccgcaaaacguaagcccuaucacguggaaucaaguacuuugagcaaccgcaaucaggccggaaaaucuacagcucuccagucccaucacagaucaaacagcaaggacauccagaaucugaguguaggcuuaccuagggccgaugagggucugccagcgaacgaaucuuuccuaaaugggaaccucgcaggagccucccugagcccccuucacaccaaaacguaccaagcuaguucucagccgggcuccacuucaaaggacuugaccaauaacaauauuccucaucugcucagucccaaggaggccaaaagcaagacagaguuugacuucaacaucgauccaaaaccuuccgaaggccccgggacuaaguaucugaaaucuaauagccggucacagcaaaaccgacacaguuucauggaguccagccagucuaaggcaggaacccuucagccaaaugaaaagcagucacgccauaguuacaucgacacaauuccccaaagcuccagaucuccuucguauaggaccaaagcuaagagccacggugcccuguccgauucaaaaagugugucuaacuugagcgaggcgcgggcccagauagcagagccauccacgucacgcuacuuuccgagcucuugucucgaccugaacucccccacaaguccuacuccaaccagacauagcgauacuaggacauuacugucucccuccggccguaauaaccggaaugaagggacccuagacucacgaagaacgaccacaaggcacaguaagacuauggaggaacucaaacugccugagcacauggauagcucgcauucccacucucuuagcgcuccacaugaaucauucaguuacggauugggcuauaccucccccuuuucuagccagcagcgcccgcaccggcacuccauguacgucacaagagacaaggugagggccaagggucuggaugggucacucagcaucggccaaggaauggcugcccgcgcaaacagucugcaguuacugucuccucagccaggcgagcagcuucccccugagaugacuguugcccgauccagcgugaaagaaaccucgcgggaggggacaucaucuuuccauacccgucaaaagagugaaggaggugucuaucacgacccccauuccgaugacggcacugcuccaaaagagaauagacacuuguacaacgacccugugcccaggcgcguagggagcuuuuaucggguuccaucuccgagaccugauaauagcuuccaugaaaacaauguguccacgagggucucaagucuccccagcgagucuuccucaggaacaaaccacaguaagcgacagccagcguuugaccccuggaaaagcccugagaauauuucccacucugaacagcugaaggagaaagaaaagcagggcuucuuucgcucgaugaagaaaaagaaaaagaaaagccaaaccgugccaaacucagauucccccgaccuacugacucuccagaagaguauccauucugcaagcaccccuuccucacggccgaaggaguggagaccagagaaaauaucugaucugcagacacaaagccagccccuuaagaguuugaggaaacuguuacaccucuccagcgccucuaaucauccugcuucauccgacccacguuuccagccccugaccgcccagcaaacuaagaacaguuuuagcgaaauucgcauccacccucuuucgcaggcaucugguggguccagcaauauccggcaggagccggcccccaaaggcagaccagcucugcaguugccugauggaggcugcgacgggaggcgacaacggcaucacucaggaccccaggaucgcagauucaugcucaggacaacggaacagcagggugaguacuuuuguugcggcgacccaaagaagccucacacccccugugucccaaaccgggcccugcaucgaccgauuaguucuccugcacccuauccagugcuacaaguuagagggacuuccaugugccccacacuccaggugcgcggaaccgaugcguucagcuguccuacacagcaaucaggcuucucguuuuucguaaggcacgucaugcgugaagcucugauccaucgggcccaggugaaccaggcagcccugcuuacuuaccacgagaaugcugccuugaccgguaaauga

SEQ ID NO: 54184 - RNA, 495 nt, Artificial Sequence
  derived and/or modified sequence opt3 from CDKN1A__Homo_sapiens__NP_000380
augagcgagcccgccggcgacgugagacagaacccuugcggguccaaggcuuguaggcggcuguucggaccagucgauucugaacaacucucacgcgacugcgaugcacuuauggccgguuguauucaggaggcgcgagaacguuggaauuuugacuucguuaccgagacaccgcuggaaggcgauuuugcuugggagagagugaggggguugggauuacccaaacuguaccuaccuacuggcccacggcgcgguagagacgagcucgggggaggcaggcggcccggcacgaguccugcccugcuucaggggaccgcagaagaggaucacguagaccugagcuuguccugcacacucgugccacgcucuggagaacaggccgaggguucgcccggcgggccuggagauucacaaggccgaaagagaaggcagacuagcaugaccgacuucuaucauaguaaacggcgucugaucuuuuccaagcgcaaaccauga

SEQ ID NO: 54185 - RNA, 597 nt, Artificial Sequence
  derived and/or modified sequence opt3 from CDKN1B__Homo_sapiens__NP_004055
augagcaacgugagagucuccaauggcucucccucacuggagaggauggacgcccggcaggcugaacacccuaagccaagugcaugccgcaaccucuucgggccgguugaucaugaggaacuuacccgagaccuggagaaacacugucgugauauggaagaggccagccaaagaaaguggaauuuugacuuccagaaccauaaacccuuggagggaaaguacgaauggcaggagguggaaaaagguuccuuaccugaguuuuauuacaggccaccccggccuccaaagggcgcgugcaagguacccgcucaggagucucaagaugugucggggucacgcccugccgcaccacugaucggagccccggcuaauagcgaagacacacaccuagucgaucccaaaacugacccuagugauucccagacgggccucgcagagcagugugccgguauuagaaagaggccagcuaccgacgauucuagcacacagaacaaacgggccaaucgcacugaagagaacguguccgacgggucacccaaugcgggaaguguugaacaaaccccuaagaaaccaggccugcgaagaaggcagacauga

SEQ ID NO: 54186 - RNA, 951 nt, Artificial Sequence
  derived and/or modified sequence opt3 from CDKN1C__Homo_sapiens__NP_000067
augagcgacgccucccugagaucuaccucaacaauggagaggcucguggcucggggcacuuuccccguccuuguucgcacgagugcaugccgaagccuguuugggccuguggaucacgaagaguugucccgugaauuacaggccagacuggcggagcuaaacgcugaagaccaaaauaggugggauuacgacuuccagcaggauaugccacuccggggaccgggucgccugcaguggaccgagguagacucugauucggugcccgccuuuuauagagagacaguccaaguggggaggugucggcuucuguuggcaccucgcccaguugccguggcugucgcagugucacccccucucgaaccagccgcugagagccuggacggccuggaagaggcccccgagcagcucccuaguguaccaguuccggcgcccgcauccacuccuccacccgugccugucuuagccccagcucccgccccggcuccugcacccguggccgcgccaguggccgcaccugucgcuguugccgugcuggcucccgccccagcacccgccccugcuccagcgccggcacccgccccuguagcugccccagcacccgccccugcuccagcccccgcaccggcgccugcuccagcccccgcaccugaugccgcuccccaggaaucugccgagcagggagcaaaccaaggccagcgaggucaggaaccacuugcugaccaguugcauagcgggaucuccggaagaccugccgcgggcaccgccgcugcaucagccaauggcgcugccauuaagaaacugagugggccccuaauaagcgauuucuuugcaaagaggaaacggucugcgccagagaaguccucaggagacgugccggccccuugccccagcccaagugcugcccccggugucggcucuguggaacaaacaccucguaaacgccucagauga

SEQ ID NO: 54187 - RNA, 471 nt, Artificial Sequence
  derived and/or modified sequence opt3 from CDKN2A__Homo_sapiens__NP_000068
auggagcccgccgcuggcagcuccauggaaccuucugcagacuggcuggccaccgcggcugccagagggaggguggaggaaguccgggcacuccuugaggccggagcucugccaaacgcacccaauucauacggucgccgaccgauccagguuaugaugaugggcagugcccguguggcugaauuguuacugcuacacggggccgagccuaacugcgcggauccagcaacacucacuagacccguacaugacgccgcuagggagggauuccuggauacgcuugugguccugcaccgggccggcgcacgcuuggacgugagagaugcuugggguaggcucccuguugaccuggccgaggaacuggggcaucgggauguggcgcgcuaucuccgagccgcagcuggaggcaccagaggcagcaaucacgccaggauugacgcugccgaagggccauccgauauacccgacuga

SEQ ID NO: 54188 - RNA, 1743 nt, Artificial Sequence
  derived and/or modified sequence opt3 from CDKN2AIP__Homo_sapiens__NP_060102
auggcccaggaggugagcgaauaccugucccaaaaccccagagucgcugcauggguugaggcccucaggugcgacggcgaaaccgauaagcacuggcggcaucgccgagacuuccuucugcguaaugcgggggauuuggcuccugccggaggugcagccucugcuucaacagacgaggcagccgaugcugaaaguggcacuagaaacaggcaguuacagcagcugaucagcuuuuccauggccugggcgaaucacguguuccuagggugucgguauccacaaaaaguaauggacaagauucucucuauggcagagggaauaaaagugacggaugccccgaccuacacaacucgcgacgagcuggucgcuaaggugaaaaagagaggcaucucgucaagcaacgaagguguugaggaacccaguaagaaaagggugauugaggggaaaaauuccucugccgucgagcaggaucaugcaaagaccagcgcuaagacagaacgggccuccgcgcagcaggagaacucaaguaccugcaucggaagcgccauuaaaucugaauccggcaauucagcacgcagcaguggcaucucuucccaaaacagcucgacuucugacggggaucgauccgugucaagucagagcuccucuagcguaucaagucagguuacaaccgcuggauccgguaaggccagcgaggcugaagccccugacaagcacggcucugcaucauuugugagucuucugaaaagcuccgucaauucucauaugacgcagucgacugauagcagacaacaguccgggucaccaaagaaaagugccuuggagggaucuagcgcuuccgcgucacagucgucuuccgagauagaagugccccuccugggcaguagcgguucuuccgagguggaacugccucucuuaucaaguaagccaagcucggagaccgcauccucugggcugacaagcaaaacuucaagugaagccuccgucucuagcuccguugcuaagaacucaagcaguucuggaaccucccuuuugacacccaaaagcucgucaucuaccaauacgagucugcuaacuuccaagagcacaucucaaguggccgcaagccuccuggccuccaagucaaguagccagaccucuggcucccuuguaucaaaaaguacuagccuggcuuccgugucucaguuggccagcaagagcucaucccagacaaguaccucucaacucccuagcaaauccacgucacagucuagcgagaguuccgucaaguucagcuguaaacugaccaacgaggacgugaagcagaagcagccauuuuucaauagguuauauaaaacaguugcauggaagcugguggcggucggcggguuuucuccgaacgugaaucacggagaacuccuuaacgcugccaucgaggcacugaaagccacuuuggacguauucuuuguuccccuaaaggaacuggcugaucucccucaaaacaaaucaucccaggagaguauugugugcgaacugcgguguaagagcgucuaccuugguaccggcugcgggaagucgaaagagaaugccaaggcaguggcuucucgugaggcccugaaauuguuccucaagaaaaaggucgugguuaagaucuguaaacgcaaguauagaggauccgaaauugaggaccugguguuacuggaugaagagagcaggccaguaaaccuacccccugcgcucaaacacccacaggagcugcuuuga

SEQ ID NO: 54189 - RNA, 417 nt, Artificial Sequence
  derived and/or modified sequence opt3 from CDKN2B__Homo_sapiens__NP_004927
augagagaggaaaacaagggcaugcccagcgggggagguuccgacgagggccuggccucugcugcagccagggggcucguggaaaaaguccggcagcuucuggaggcgggagcugauccuaauggcguuaaccgcuucggucgacgugccauccaagugaugaugauggggucagcaagaguagccgaauuguuacugcuacacggagcugagccaaauugcgcagacccggccacccucacaaggcccgugcaugaugcugcccgggagggcuuucuggacacucuugucgugcugcaccgcgcgggcgcaagauuggauguuagggacgccugggggcggcucccuguggaucuggcugaggaacgcggacaucgagacgucgccgguuaccugagaacggcaaccggcgauuga

SEQ ID NO: 54190 - RNA, 507 nt, Artificial Sequence
  derived and/or modified sequence opt3 from CDKN2C__Homo_sapiens__NP_001253
auggccgagcccuggggcaacgaacuggcuagcgcagccgcgagaggggaccucgagcagcuuaccucccuguugcaaaauaacgugaaugucaacgcucagaauggauucgguaggacagccuuacagguuaugaagcugggcaacccugaaaucgcacggcgccuacuccugcgaggggccaauccagaucuuaaagaccguacuggauuugcugugauucacgaugcagccagagcuggcuuccuggacacguugcagacccuccuggaguuucaagccgauguaaacauagaagacaaugaggguaaccugccgcuccauuuagcggcaaaggaggggcaccugaggguggucgaguuccuugugaaacauacagccucuaauguuggacaccggaaccauaagggcgauacugcuugcgacuuggcccgccuguacggcagaaaugaaguggucucacuaaugcaggcaaacggggcuggaggugccaccaaucuccaguga

SEQ ID NO: 54191 - RNA, 501 nt, Artificial Sequence
  derived and/or modified sequence opt3 from CDKN2D__Homo_sapiens__NP_001791
augcugcucgaggaagugagggccggcgacaggcuuagcggggcugcagcccggggagauguccaggagguucgccgacuguugcaccgugaauuagugcaucccgacgcgcugaacagauucgguaagaccgcucuacaaguaaugauguuuggcuccacagccaucgcacucgagcugcuuaaacagggggccucuccuaaugugcaggauacuucaggaacgaguccaguccacgacgcugcaaggaccggcuuccuggauacauugaaggugcucguugaacauggugccgacgugaacgucccggaugggacuggagcucugcccauucaccuggccgugcaggagggccauaccgcgguaguuagcuuucucgcagccgaguccgacuuacaccggcgcgaugcuagaggccugacaccucuugaauuggcccugcaaagaggggcacaggaccuaguggauauacuccagggacacauggucgcuccacuguga

SEQ ID NO: 54192 - RNA, 519 nt, Artificial Sequence
  derived and/or modified sequence opt3 from CDKN3__Homo_sapiens__NP_001124323
augaagcccccuagcuccauccagaccucuugcaaauucaaggacgugagaaggaacguccaaaaagauacagaggaacugaagucauguggcauucaggacauauuuguuuucugcacucgcggggagcucaguaaauaccgggugccaaaucuucuggauuuguaucagcaguguggaaucauuacgcaccaucacccgaucgccgacgguggcacccccgauauugcuagcugcugugaaaucauggaggaauuaacaacuugccugaagaacuaccgaaagacccuaauacauuguuaugggggacucggccguuccugccugguagcagccugucuucuguuguaccucucugacacaaucucgccugagcaagcgauugauucacugagagaccugagggguagcggggcuauccagaccauuaaacaguauaauuaccuccacgaguuucgggauaaguuagccgcacaucugaguucccgcgacucucagagcagauccgugucaagguga

SEQ ID NO: 54193 - RNA, 564 nt, Artificial Sequence
  derived and/or modified sequence opt3 from CDNF__Homo_sapiens__NP_001025125
auguggugcgccagccccguggcugucguugcauucugugccggccugcucgugucccacccuguacuuacccaggggcaagaggcgggagguagaccaggcgcugacugcgaaguguguaaggaguuucugaacagguucuacaaaucuuugaucgaucgcggggucaauuuuucauuagacacaauugaaaaggagcugauaaguuucugccuagauacuaaaggaaaggaaaaccggcucuguuauuaccugggcgccacgaaagacgcagccaccaagauccuuagcgaggugacacgaccgauguccguucauaugcccgcuaugaagauuugcgagaaacugaagaaauuggauucucagaucugugaacucaaguaugagaaaacucuggaccuggcaucgguggaucuccguaagaugagagucgccgaauuaaagcagauucugcacucauggggugaggagugcagggcuugugccgagaaaaccgacuacgugaaucuuauccaggaauuggcgccuaaguaugcagccacacauccaaaaaccgaacuguga

SEQ ID NO: 54194 - RNA, 603 nt, Artificial Sequence
  derived and/or modified sequence opt3 from CDO1__Homo_sapiens__NP_001792
auggagcagaccgaagugcugaagcccagaacacucgccgaccuuaucaggauucugcaccaauuguucgcuggcgaugaggucaacguugaagaggugcaggcaauaauggaagccuacgagagcgacccuacugagugggcgauguaugcuaaauuugaucaguaccgguauacgcgcaauuuaguagaccaggggaacggaaaguucaaucugaugauccuaugcuggggugaaggccauggguccucuauucacgaucauaccaacucacacuguuuucucaaaaugcugcaaggaaaucuuaaggagacacuguucgccuggccagacaaaaagaguaacgaaauggugaagaaaagcgagcgagucuugcgugagaaucagugcgcauacaucaacgauuccauuggccuccauagaguggaaaauaucucucacacugagccggccguuucgcugcaccuguauucacccccuuuugacaccugucaugcuuucgaucagaggacaggucacaagaacaaagugaccaugacuuuucauagcaaguucgggauacggacaccaaaugcaaccaguggaucccucgaaaacaauuga

SEQ ID NO: 54195 - RNA, 3864 nt, Artificial Sequence
  derived and/or modified sequence opt3 from CDON__Homo_sapiens__XP_011541167
augcaccccgaccugggcccucucugcacccuucuguacgugacauugacuaucuuauguagcuccgucucuucagaucuggccccauauuucacgagugagccgcuaagcgcuguucagaagcucgggggacccgugguacugcauugcuccgcacaaccugugaccacaagaauuucuuggcuucacaacgguaaaacucuggacggcaauuuggaacaugucaagauacaccaggggacccucacaauccugucgcugaacucaagccucuuaggauacuaucagugucuggccaauaacaguauuggcgcgaucguguccgguccagcuaccguuucuguggccguccuuggggauuuuggaagcuccacuaaacaugugauuacagcagaggaaaagucagccggcuucaucggcugcaggguacccgagaguaauccuaaagcugaaguucgguacaagauacgcgggaagugguuggagcacagcaccgagaacuaucugauccuaccaucuggaaaucuccagauucugaacgugucccuugaagacaaagguucauacaagugugcagccuauaaucccgucacgcaccaacugaaaguggagccuaucggccgaaaguugcucgugagccguccaaguucugaugacguccauauucugcacccgacucauucccaggcuuuagccguucugagcagaucgcccgugacccucgaaugcguagugucuggggucccugcgccacagguguacuggcuuaaagauggacaggacaucgcacccggcuccaacuggaggcggcuguacucacacuuggccacagauaguguugacccugcugauagcgguaauuauuccuguauggccgggaacaagucuggagacgugaaguacgucacuuauauggugaauguacuagagcacgcaagcauaucaaaaggccugcaagaucagauuguuagucucggcgcuaccgugcauuuuacaugcgacguccacgggaacccagcccccaauuguaccugguuccauaacgcgcagccgauccacccuuccgcccgccaucugacggcaggaaacggucuuaagauuagcggcgugacugucgaggacguggggauguaccagugcguugcugauaauggaaucggcuuuaugcacucuacagguagacuggaaaucgagaacgacgggggcuucaaacccgugauuauaaccgccccaguaucagcuaaggucgccgauggagacuuugugacuuugaguuguaaugcaagcggccucccuguucccgugaucaggugguaugauucccacgggcugauuacaucucauccaucgcaagucuuacggagcaaaucccgcaagucacagcugagucgacccgaaggacuaaaccucgagccuguguacuucguacugucucaggccggugcuagcucccuucacauccaagcggugacccaggaacaugcaggcaaauauauaugcgaggccgcuaaugagcacgggacgacccaggccgaagcaucauugaugguugucccauuugagacaaacacuaaggccgaaaccgugacacugccggacgcugcccagaaugaugacagaagcaagagggauggaucugagacuggccuccuguccaguuuccccgugaaaguccacccuagcgcaguugaaucugcgccagagaagaacgcuuccgguauuucagugcccgacgccccuaucauccuuaguccaccccaaacccauacaccggauaccuacaaucugguguggcgggcagggaaagacggcggauugccuauuaacgccuacuuuguaaaguaucguaaacucgacgauggcgucgggaugcugggaagcuggcacacugugcgcguuccagguucggagaaugaauuacaucuggcugagcuagaacccuccucucucuacgaggugcugauggucgccagaagcgcagcuggcgaagggcagccugccaugcuuacguucaggacaucaaaggagaagaccgcgaguuccaaaaacacucaggccucuagcccacccgugggaaucccuaaguaucccguuguguccgaggcugcaaauaacaauuuuggcguagucuugaccgacucaagccggcacaguggugugccagaagccccggaucgaccuacaauuucuaccgcuuccgagacuagcguguacgucacauggauaccccgcgccaacgggggcucgccaaucacggcauucaaaguugaauauaagagaaugaggaccucaaacuggcugguggcggccgaggacauucccccuucuaaacucaguguagaggugcggucccuggaaccaggaagcacuuacaaguuccgcgucaucgcuaucaaucauuauggcgagucuuuuagaagcuccgccucaaggcccuaccaggugguuggguucccuaaccguuuuaguagccggccgauuacaggaccacacauagcauacaccgaagcugugucugauacacaaaucauguuaaaguggacuuauauucccuccucaaauaacaauaccccuauccagggcuucuacauuuauuaccgaccaacggacagugauaacgacagcgauuauaaaagagacgucguggaggguuccaagcaguggcacaugaucgggcaucugcagcccgaaaccucuuacgauauaaaaaugcaaugcuuuaaugagggaggcgagucggaguucagcaacguuaugaucugugaaacaaaggugaaaagggucccuggugccucagaauauccgguaaaggaccuuuccacucccccaaauaguuugggcucugggggaaacgugggcccugcaaccagccccgcccgcuccucagauaugcucuaccugauuguugggugcgugcuaggagucauggugcugauccucaugguauuuauugcuaugugucuguggaagaaucggcagcagaacacaauccagaaauacgacccaccuggcuaucuuuaccaagguucugacaugaaugggcagaugguggauuauacuaccuugagcggagcgagucagauaaacggcaauguccacgguggcuuccugacgaacgggggauuauccagcggcuacucucaucuccaccauaagguucccaacgccgugaaugggauugugaacggaucacugaauggcggucuuuauuccgggcacaguaacagccugacaagaacccacgucgacuuugagcauccacaccauuuggugaauggaggcgguauguacacugcaguuccgcaaaucgauccucucgaaugcguaaacuguaggaauugccgcaacaauaaccgauguuucacaaaaaccaauucgacuuuuucuuccucacccccacccguggucccugugguugcuccauauccccaggacggccuggagaugaagccucuaagccacgugaaagucccggugugccugaccagugccguaccagauugugggcagcuccccgaggaaucugucaaggacaacguggagccuguucccacacagcggacgugcugucaagauauugugaaugacgucuccagcgauggaucagaagacccagccgaguucagucguggccaggaagggaugaucaaccugagaauaccugaucaccuucaguuggcuaaaagcugcgugugggagggagacuccugcgcacauucugagaccgaaaucaauauuguuagcuggaacgcccugaucuuacccccagugccugagggcugugcggaaaagacuaugugguccccgcccgguauuccacucgauucaccuacagagguccugcagcaacccagggagaccuga

SEQ ID NO: 54196 - RNA, 789 nt, Artificial Sequence
  derived and/or modified sequence opt3 from CDR1__Homo_sapiens__NP_004056
auggccuggcuggaggacguggauuuccucgaagacgucccccuucuggaggauaucccuuuguuagaagacguuccacugcuagaggaugugccgcuccuggaagacaccagcagacuugaggauauuaaccugauggaggacauggcuuugcucgaagauguagaccugcuggaggauacagacuuucucgaagauuuagacuucuccgaggcaauggaccugagggaggauaaggacuuucuugaagauauggacucuuuggaggauauggcccugcuagaagacguggaucuccuggaggacacugauuuccuugaagaccccgauuuucuggaggcgauagacuugcgggaggacaaagauuuccucgaagacauggauucacuggaggacuuagaagcuaucggccgcugcggguuuaguggacgacacgguuucuuuggccguagaagguucagcgggcggccuaagcuguccggacgccucggccuucuggguagaaggggguuuucuggacgguugggcggcuacuggaaaacguggauuuucuggaagaccuggaucuuuuggaaaacauggauuuuccgcaagacuuauaucggguggaagaccuggauauucucgggacgauguggucuaacaggcagaccaggguuuggaggcaggcggcguuucuuuuggaaaacccugacugauuggaagacauggaucucauucuggaaaacccucauugacuggaagacguggaucagcuuuuggaaaacucugauugauuggaagaucuga

SEQ ID NO: 54197 - RNA, 1365 nt, Artificial Sequence
  derived and/or modified sequence opt3 from CDR2__Homo_sapiens__NP_001793
augcuggccgagaaccucguggaagaguucgaaaugaaggaggacgaacccugguacgaucaccaggaccuucaacaggaucugcaguuggcugcagaguuaggcaaaacccugcuagacagaaauacagagcucgaagauagcguccagcaaauguauacuacgaaccaggagcagcugcaggaaaucgaguaccuuaccaagcaaguugagcuguugaggcagaugaaugaacagcaugccaaaguguaugagcagcucgacguaacagcgcgggaacuggaggaaacuaaccaaaagcugguggcugauuccaaagccucucagcagaagauucucucauuaaccgagacaauagagugccugcaaaccaauaucgaccaccuucagagucaggucgaagaguugaagucuuccgggcagggacgccgaucuccugguaaaugugaucaagaaaagccagcaccgucguuugccugccugaaagagcuauacgaccuccgucagcauuucguguaugaucacguuuuugcugaaaagauuacuucacugcagggccagcccagcccugacgaggaggaaaacgagcaucuuaaaaagacagugaccaugcugcaagcacaguugagucucgaaagacagaagagggucacgauggaggaagaguacgggcugguguuaaaagaaaauuccgaacuggagcagcaacucggagccacuggcgcuuaucgggcccgcgcgcuugaacuggaggcagagguagccgaaaugagacagauguugcagucugagcacccauucguuaacgguguggaaaagcuaguccccgauagccuguacgugccuuuuaaagagccaucccagucacuccuggaagagauguuccuuaccgugcccgagagucacaggaagccucugaaacggagcagcuccgaaacaaucuugucaagccucgcugggagugacauugucaagggacaugaggaaacuuguauccgccgagccaaagcaguuaagcaaagaggcauaucucuguuacacgagguggacacccaguacuccgcucugaagguaaaauaugaggagcuacucaagaaaugccaggaggaacaagauagccugucgcauaaggccgugcagacaucuagggcggccgcaaaagaccuuaccggcgucaaugcucaguccgagccaguggccucagggugggaauuggcuaguguuaacccggagcccgugagcuccccuacgacuccacccgaauacaaggcccuguuuaaggagaucuucucuuguauuaaaaagacaaaacaggagaucgaugaacaacggaccaaguaucguagccucucaagucacuccuga

SEQ ID NO: 54198 - RNA, 1338 nt, Artificial Sequence
  derived and/or modified sequence opt3 from CDS2__Homo_sapiens__NP_003809
augaccgagcugagacagaggguggcccacgaacccgucgcuccuccagaggacaaggaaagcgaguccgaagcaaaaguugauggcgagacagccucugacucagagagucgggcggaaagcgcuccgcuccccguguccgccgaugacacuccugagguacuuaaccgcgcacugucuaauuugucgucacgauggaagaacuggugggugcgugggaucuuaacgcuggccaugauugcuuucuuuuucauaaucauuuaccuaggaccaaugguccucaugaucauugugaugugcguucaaaucaaauguuuucaugaaauaaucaccauugguuauaauguguaccacagcuaugaucugcccugguucagaacacuuaguugguacuuucuguugugcgucaacuauuucuuuuacggcgagacugugaccgacuauuucuuuacacucguacagagggaggaaccucugcggauccuguccaaguaccaucgcuucauuucuuuuacccucuacuuaaucggguucuguauguuuguucugagccuugugaaaaagcacuauagauugcaguucuacauguucggauggacucaugucacacugcuaauaguggugacccagucccaccucgucauucacaaucuguuugagggcaugaucugguucauuguuccaaucucaugcgugaucuguaacgauauuauggcauauauguuugguuucuuuuucgggaggacgccccuuauaaagcugaguccuaaaaagacuugggaaggauuuaucggcggcuucuuugccaccguaguguucggguugcuccugagcuacgucaugucuggauaucggugcuuuguguguccaguugaguacaauaacgacacaaauuccuucacuguggauugcgaaccgucagacuuauuucgccugcaagaguauaacauucccggugucauccagagcgugauaggcuggaaaaccguacgaauguacccuuuccagauucauaguaucgcucucucuacauucgccucccuuaucgggccauuuggaggcuucuuugcgagcgguuucaagagagcauuuaaaauuaaggauuucgccaauaccauccccgggcacggaggcauuauggacagguuugauugucaguaccugauggcuacguucguuaacguguauauagccucguuuauccggggcccuaauccaucuaaguugauucaacaguuccuaacucugcgucccgaccagcagcuccauaucuuuaacacacugcgcucccaccuuaucgacaaagggaugcugaccucaacuacagaggaugaauga

SEQ ID NO: 54199 - RNA, 1641 nt, Artificial Sequence
  derived and/or modified sequence opt3 from CDT1__Homo_sapiens__NP_112190
auggagcagagaagggugaccgacuucuuugcccggcgccgacccggcccuccacguaucgcuccgcccaagcuggcaugcagaacaccuagcccagccaggcccgcgcuccgggcuccugccuccgcaacuucugggucacgcaaaagagccaggccacccgcugcaccuggacgggaucaagcccgcccaccggcucgaagaaggcuucggcugagugucgacgaaguuagcucccccucuacgccugaggccccagauauucccgcguguccuucgccaggucagaagaucaaaaagucaacccccgcagccggccagccgccucacuugacaagcgcucaggaccaagauacuauaagugaauuagccuccugccugcagcgugcacgcgagcuaggggcuagagugagggcccucaaagcgucugcccaggacgcaggagaaagcuguacccccgaggcugagggccggccagaggaaccuugcggugaaaaggcccccgcuuaccagcgauuccaugcccuggcacaaccagggcuucccggacugguauugccuuauaaguaccaggugcucgccgagauguuucgcuccauggauacaauugucggcaugcugcacaacagaucagagaccccaacuuucgcuaaagugcagaggggcguucaggacaugaugcggcgcagauuugaagaguguaauguggggcaaaucaagacagucuauccggcgaguuacagguuccgucaggaacggagcgugcccaccuuuaaagauggaacgcgaagaucugacuaucagcugacuauugagccucucuuagaacaagaggcagauggugccgcuccacagcugaccgccuccaggcuuuugcagcgccggcagaucuucucacaaaagcugguagagcauguuaaagaacaccauaaggcauuucuagccagccucagucccgcuaugguggucccugaggaccagcugacaagauggcacccaagguucaacguggaugaagugcccgacauagagccggccgcacuuccucagccacccgcgacugaaaagcugaccacagcucaggaggucuuggcccgcgcacgaaaucucaucucuccucggauggagaaagcccugucccaauuagcucugcguagcgccgcacccucgucuccaggcuccccuagacccgcucucccagccaccccgccugcgacgcccccagccgcuucacccagugcacuuaaggggguuagccaggaccuguuggaaaggauucgcgccaaagaggcucagaagcagcuagcccaaaugacucggugcccugaacaggagcagagacugcagaggcucgaacgacugccagagcuugcacgcgugcugcgguccguauuugugucugagagaaaacccgcguugagcauggaagucgccugugcuaggauggugggaucaugcuguacaaucaugaguccuggcgagauggaaaagcaccuccuguuacuguccgagcuacucccggauuggcugagccuucaucguauucgcaccgacacuuacguuaaauuggauaaggccgcagaccuggcucacaucacagcccggcucgcacaucaaaccagagccgaggaaggucuguga

SEQ ID NO: 54200 - RNA, 642 nt, Artificial Sequence
  derived and/or modified sequence opt3 from CDV3__Homo_sapiens__NP_001127894
auggccgagaccgaagagagaagccuggacaacuucuuugcuaagagggauaaaaagaaaaagaaagaacgguccaaucgcgcagccucugcggcuggcgccgcagggucagccggagguaguagcggcgcugcaggggccgcuggaggcggugccggggcgggaacacgacccggcgacggcgggacugcauccgccggagcugccgguccuggcgcagcuacgaaggccgugaccaaggaugaggacgaauggaaagagcucgagcagaaggaagucgauuacucugggcuucguguucaagcgaugcagaucucgucagagaaagaagaggacgauaacgagaagagacaggacccaggagauaauugggaagagggcggugggggaggcggcgggauggagaaaagcaguggaccguggaacaagacagcccccgugcaggcaccuccagcucccguaauugugacugaaaccccugaaccagccaugacauccggugucuauaggcccccuggcgcucggcugaccacuacacgcaagaccccacaagggccgcccgagauauacucugacacgcaguucccuagcuugcaguccacugccaaacacguggagucaagaaauagguauuuaaaguga

SEQ ID NO: 54201 - RNA, 798 nt, Artificial Sequence
  derived and/or modified sequence opt3 from CDX1__Homo_sapiens__NP_001795
auguacgugggcuauguccuggacaaggauagccccguuuacccugggccagccagaccggcuucccucggacuugguccccaggcauauggcccuccagccccucccccagcgcccccucaauacccagacuucucuucauauagucacguggagccggcucccgccccuccaaccgcauggggagcccccuuuccugcuccaaaagaugacugggcagccgcuuacgggcccggcccggccgcgccugcagccagccccgcuucccuggccuucgguccaccucccgauuuuucuccaguacccgcaccuccagggccgggacccggcuuguuagcucagccucugggcgggccaggaacacccucgucaccuggugcccagaggccaacucccuaugaauggaugcggcgcagcguggcggccggcgggggaggcgguagugggaagacgcgaaccaaagacaaguaccgugucguguacacagaucaucagagacuagagcucgaaaaagaguuccacuauuccagguacaucacuauucggcgcaagucugaacuggcagcuaaccuuggacugaccgagagacaaguuaagauaugguuucagaauaggcgggccaaagagcgcaaggugaacaaaaagaaacagcagcaacagcagccgccucagccacccauggcucaugacaucacagccaccccugcaggccccagcuugggcgggcucugcccauccaauacuucacugcuggccacaaguagcccuaugcccgucaaggaagaguuccucccauga

SEQ ID NO: 54202 - RNA, 942 nt, Artificial Sequence
  derived and/or modified sequence opt3 from CDX2__Homo_sapiens__NP_001256
auguacgugagcuaucugcucgacaaggaugucuccauguaccccucuucaguuagacacaguggcgggcuuaaccuggccccucagaauuucgugagcccaccgcaauaucccgacuacggagguuaucauguagcugcagccgcggcugccgcagccaacuuggauuccgcucagucuccuggcccaucguggcccgcagccuacggggcuccuuuaagggaggacuggaauggauaugccccaggcggugcggcagccgcugccaacgcaguggcucacgggcugaauggaggcucacccgccgcggccaugggcuacagcaguccugcagauuaccauccacaccaucacccgcaccaucacccccaucacccugcugccgcuccauccugcgccucugggcuacuccagacccugaaccccggaccuccaggucccgcagccacagcugcggcagaacagcuuagcccgggcgggcaacggcgcaaucugugugaguggaugcgaaaaccugcccagcaguccuugggaucacaggucaagacucguacgaaagacaaguauagagugguuuacaccgaucaccaaaggcucgaacuggagaaagaauuucauuauagucgguacaucacaauucgcagaaaggcugagcuggccgcaacucucggcuuaagcgagaggcaagugaagauaugguuccagaaccggcgcgccaaagaacgaaagaucaauaaaaagaaacugcagcagcagcagcaacagcagcccccacagccucccccacccccuccacaaccgccccagccucagccagguccccuuagaucugucccugagccauugucccccgugucaagccugcaggcuaguguaucuggguccguuccgggagugcuaggcccuaccggcgggguccucaacccaacagugacccaauga

SEQ ID NO: 54203 - RNA, 855 nt, Artificial Sequence
  derived and/or modified sequence opt3 from CDX4__Homo_sapiens__NP_005184
auguacggcagcugccugcucgagaaggaagccgggauguaucccggaacccuuauguccccugguggcgacgggacagcuggaacuggcgguaccgggggaggcggcucuccaaugccggcaucaaacuucgccgcggcucccgccuuuagucacuacaugggguauccucauaugccaagcauggauccccacuggccuucccugggagugugggguucuccauacucgcccccuagagaggacuggucagucuauccaggcccgagcaguacgauggggacaguucccgugaaugauguaacuuccucuccugcagccuucuguagcaccgacuacuccaacuugggaccagugggcggugggacaucaggaaguagcuuacccggccaggcuggcgggucucuggucccuaccgaugcaggagccgcuaaagccuccucaccaagcaggagucggcauucucccuaugcguggaugcgcaagacugugcaaguuacagguaaaacccgaacgaaggaaaaauaccguguggucuacacugaccaccagagacuagagcucgaaaaggaguuucauugcaauagguauaucaccauucagcggaaguccgagcuggcagugaaccuuggccugagcgaacgccagguaaaaauaugguuccaaaauagaagggccaaggagcggaaaaugaucaagaaaaagauuucgcaguuugaaaacucugggggauccguucagucagauagugacagcaucuccccgggcgaguugccuaauacauucuuuacuacccccucugcugugcgcgguuuccagccaauugagauccaacaggucauagugagcgaauga

SEQ ID NO: 54204 - RNA, 1623 nt, Artificial Sequence
  derived and/or modified sequence opt3 from CDY1B__Homo_sapiens__NP_001003894
auggccagccaggaguucgaaguggaggcuaucgucgacaagagacaagauaaaaacggcaauacccaguaccugguuagguggaagggguaugacaaacaggaugacacaugggaacccgagcagcaccucaugaacugcgaaaagugugugcaugauuuuaaucggcgccaaacugagaaacagaagaaguuaacguggaccacaacuucccgaauuuucucuaacaaugcacguagaaggaccucacggaguacaaaagccaacuacagcaaaaauuccccuaagaccccaguaacugacaagcaccaucgcucuaaaaacagaaagcuguuugcggcuucgaagaaugugaggcggaaagccgcaucaauauugagcgauacaaagaacauggagaucauuaauaguaccaucgaaacguuagccccggacucccccuucgaucacaaaacugucucuggauuucagaagcuggagaaacuagacccuauugcugcagaucagcaagacaccgugguuuucaaggugacagaagguaaacuccugcgcgauccacuuagccgacccggcgccgagcagacugggauccagaacaagacccagauacauccucugaugucccaaaugucaggaagugucacagcuagcauggccaccggcucugcgacgagaaaggguaucgugguauugauugacccacucgcagccaaugggacuacagacaugcacaccuccguucccagggugaaaggaggccagcggaacaucacugaugacucacgugaucagccuuuuauuaagaaaaugcacuucacaauccgccugaccgagagcgcuaguacguauagagacauagucgugaagaaagaagauggcuuuacccaaauugugcugucuacaagguccacugagaagaaugcccucaacaccgaagucaucaaggagauuguuaacgcauuaaauagcgcugccgcggacgauucgaaacuggugcuuuucucugccgcaggguccguauuuugcuguggauuggacuucgguuacuuugugaagcaucugcggaacaaucgaaacacagcuucacuagaaauggucgauacuaucaaaaauuucgugaacaccuucauccaguuuaagaaaccaauuguugugagugucaauggcccggccauagggcucggagcuagcauccugccccuuugcgaccuggugugggccaacgagaaggcaugguuccagacaccuuauaccacuuuuggccaguccccagaugguuguucuagcauuacguuccccaagaugauggggaaagccucagcuaaugagauguugaucgcgggacgcaagcucacagcaagagaagccugcgcuaaaggccugguaagucaaguuuuucuuaccggcacuuucacccaggaggugaugauacagauuaaggaacuggccuccuacaacccuaucguccucgaggaauguaaagcacuugugaggugcaauaucaagcuggaguuggagcaggccaacgaacgggagugugaaguccuacgcaagauuuggagcucugcucaagggaucgagucaaugcugaaauauguggaaaauaagauugacgaguuuuga

SEQ ID NO: 54205 - RNA, 1626 nt, Artificial Sequence
  derived and/or modified sequence opt3 from CDY2B__Homo_sapiens__NP_001001722
auggccagccaggaguucgaaguggaggcuaucgucgacaagagacaagauaaaaacggcaauacccaguaccugguuagguggaagggguaugacaaacaggaugacacaugggaacccgagcagcaccucaugaacugcgaaaagugugugcaugauuuuaaucggcgccaaacugagaaacagaagaaguuaacguggaccacaacuucccgaauuuucucuaacaaugcacguagaaggaccucacggaguacaaaagccaacuacagcaaaaauuccccuaagaccccaguaacugacaagcaccaucgcucuaaaaacugcaagcuguuugcggcuucgaagaaugugagaaggaaagccgcaucaacauugagcgauaccaagaacauggagauaaucaauaguacgauugaaacuuuagccccggacucccccuucgaucacaaaaagaccgucucuggauuucagaaacuggagaagcuagacccuaucgcugcagaucagcaagacacagugguuuucaaagugacugaagguaagcuccugcgggauccacuuagccaucccggcgccgagcagaccgggauucagaacaagacacagaugcacccucugaugucccaaaugucaggaagugucaccgcuagcauggccacgggcucugcgacucgcaaagguaucgugguauugauagacccacucgcagccaaugggacaaccgacaugcacacuuccguuccccgagugaagggaggccagagaaacaucacagaugacucaaggggccagccuuuuauuaaaaagaugcauuucaccauccggcugacggagagcgcuauuaccuaucgugauaucgucgugaaaaaggaagacggguuuacacaaauagugcugaguacucgcucuaccgagaagaaugcccucaacacagaagucauuaaagagaugguuaacgcauuaaauuccgcugccgcggaugacagcaagcuggugcuuuucucggccgcaggaucuguauuuuguugcgguuuggauuucggcuacuuugugagacaccugaggaacgaccggaauacugcuucccuagaaauggucgauaccaucaaaaacuucgugaauacauucauucaguuuaagaaaccaaucguugugucagucaacgggccggccaucggacucggcgcuaguauucugccccuuugugaccuggugugggccaaugagaaggcaugguuccagaccccuuauacuacguuuggucagagcccagaugggugcuccucuauaacauuccccaagaugaugggaaaagccagcgcuaacgagauguugaucgcgggccgaaagcucaccgcacgcgaagccugugcuaaaggccugguaucacaaguuuuucuuacugggaccuucacacaggaggugaugauucagaucaaggaacuggccaguuacaaugcaauaguccucgaggaaugcaaagcccuugugagauguaacauuaagcuggaguuggagcaggcuaaugaaagggagugcgaaguccuacggaagaucugguccagcgcccaaggaaucgagucuaugcugaaauauguggaaaacaagauugacgaguuuuga

SEQ ID NO: 54206 - RNA, 1521 nt, Artificial Sequence
  derived and/or modified sequence opt3 from CDYL2__Homo_sapiens__NP_689555
auggccagcggcgaccuguacgagguggaaagaaucgucgauaagaggaaaaacaagaaagggaagugggaguaucucauucgguggaaaggauacgguuccaccgaagacacaugggagcccgaacaccaucuucugcacugcgaggaguucauagaugaauuuaauggcuugcauaugucuaaggacaagcgcaucaaaucagggaagcagaguagcacuuccaaauuacugcgagauucucguggaccuucgguugagaagcuaucacacagaccaagcgacccgggcaaaaguaaggguacgucccauaagaggaaacggauuaacccaccucucgcuaagcccaaaaagggguauucuggaaaacccagcuccggcggcgaucgcgcaaccaagacagugucauacagaacuaccccuagugggcugcaaaucaugccacuuaaaaagagccagaauggaauggaaaacggugacgccggcucugagaaggaugagaggcacuucgggaauggaucccaccagcccggccuggacuugaacgaucauguaggugaacaggacaugggggagugugaugugaaucacgcgacacucgcugaaaacggacugggcucagcccugaccaauggcgggcucaacuuacauagcccugucaaacggaagcuggaggcagaaaaagacuauguguuugacaagcgccuucgauacaguguuagacaaaaugagucuaacugcagguuccgggauauugugguccguaaagaggaaggauuuacucacaucuugcuguccagccagacaucggacaauaacgcccuaaccccagagauaaugaaggaagugcgcagagcucucuguaaugcagccacggaugacucuaagcugcuucuguuguccgcuguagguucaguuuucugcaguggccucgauuauagcuaccugaucgggagguuauccucugaccggcgaaaagagagcacucgcauugccgaagcgaucagagauuuugugaaggcauucauucaguuuaaaaagccgaucgucguggccauaaacggacccgcucugggccucggugccucaauucuuccucugugugacaucgugugggcaagugagaaggcuugguuccagaccccauacgccacaauuagguugacucccgcggggugcuccagcuauaccuuuccucaaauccuaggcgucgcccuggcaaacgagaugcuguucuguggacggaaacugacagcucaggaagccugcucucgcggccuuguuucacagguguuuuggccaaccacguucagucaggagguaaugcugagagugaaggaaauggcuagcuguuccgccgucguguuggaggaaucuaaaugccucguuaggucguuccucaagagcguguuagaggaugucaaugagaaagaaugucugaugcuaaagcaacucugguccucaaguaaagggcuggacucucuuuuuagcuacuugcaggauaagaucuaugagguguga

SEQ ID NO: 54207 - RNA, 1239 nt, Artificial Sequence
  derived and/or modified sequence opt3 from CDYL__Homo_sapiens__NP_001137442
auggaccuggccaagagcggcaucaaaauucucgugcccaaguccccugucaaaucuagaaccgcuguugauggguuccagucagagaguccagaaaaacuugacccgguggagcaaggacaggaagauacaguagcacccgagguggccgcggaaaaaccugucggugcucuguugggcccaggggccgagagggcacggaugggaagccgcccccgaauacacccuuuagugccacagguucccggcccugugacugccgcuauggcaacgggucuggccgucaacgggaagggaaccuccccauuuauggacgcucuaacagccaauggcacuaccaacauccagacaucugugaccggcguaacugcgucgaagcguaaauucauugaugacagaagggaucaaccguuugacaagcggcuccgcuucucaguuagacagacagagagcgcauacagguaucgggauaucgugguccgcaaacaggacggguuuacccauauucugcuuaguacgaaguccucugaaaauaacagccugaaucccgaggugaugcgagaagugcaguccgccuugucaacugcugccgcagaugacaguaaacucguccugcugagcgcuguuggaucuguguucugcuguggucucgauuuuaucuacuucauaagaagguuaaccgacgaccggaagcgugaguccacaaagauggccgaggcgauccgcaacuuuguaaauacuuucauucaauuuaaaaagccuaucauuguggccgucaacggcccagcaaucgggcugggagcuucaauacuucccuugugcgaugugguuugggccaaugaaaaggcuugguuccagaccccuuauacaaccuuuggccagagcccagacgguuguaguacggugauguuccccaagauuaugggaggggccucugcaaacgagaugcugcuauccggcagaaaacucacugcccaggaggcuugcggcaaggggcuggucagccaaguguucuggccgggaacauuuacccaggaaguaaugguuaggaucaaagaacuugcgucguguaauccugugguccuggaggagucuaaggcauuggugcggugcaacaugaagauggaacucgagcaggccaaugaacgagagugugaaguccugaaaaagauuugggguuccgcucaaggcauggauucaauguuaaaauaccugcagcgcaagaucgacgaguucuga

SEQ ID NO: 54208 - RNA, 1278 nt, Artificial Sequence
  derived and/or modified sequence opt3 from CEACAM16__Homo_sapiens__NP_001034302
auggcccugaccggcuacagcuggcuccuucuguccgcuacauucuugaacgugggggcagagaucucuauuacuuuagaacccgcccagccuucagagggagacaaugucacgcugguugugcacggucuaaguggcgaacuccuggcguauagcugguacgcugggccaacccuuuccguaucuuaucugguggccucguacauagucucaacaggagaugagacuccgggccccgcacauaccgguagagaagccgugaggccugacgggagcuuggauauccaaggaauuuuaccacggcacaguggcacauauauccugcagaccuuuaaccgccagcugcagacugagguuggcuacgggcaugugcaaguccacgagauucucgcucagcccacaguguuagcaaauuccaccgcccugguagaacgacgugacacgcuuagauugaugugcucuagcccuuccccaacugcugagguuaggugguucuuuaacggaggugcccugcccguggcgcuacggcucggccugucaccugaugggcgcguccuugcaagacauggaaucaggcgggaagaggccggcgcuuaucagugugagguguggaauccagugagugucagccgcucugaaccgauaaaccugaccguuuacuucggucccgagcgaguggccaucuugcaggacuccacaacuagaaccgggugcacaauuaagguagauuuuaauaccucacucacgcuguggugugugagcaggaguugcccugaaccagaguacgucuggacuuucaacggacaagcacucaaaaauggccaggaccaccugaacaucucuuccaugacagcugcccaggaaggcaccuauacuuguauugcgaagaauacaaaaacccuccuuagcgggucggccucugugguugugaagcuguccgcagcugccgucgcuacgaugaucgugcccguaccuaccaaaccaacagagggacaggauguuacuuugaccgugcaagguuaccccaaggaccuacuggucuaugccugguaccggggcccggcaucagagccuaaccgucuccugagucagcuucccagcgggacauggauagccggaccagcucacacuggccgcgaaguggguuuuccuaauugcucccuguugguccagaagcucaaccugaccgauacagggagauauaccuuaaaaacugugacgguucaaggcaagacagagacccuggaaguggagcuacagguagcgccccucggauga

SEQ ID NO: 54209 - RNA, 900 nt, Artificial Sequence
  derived and/or modified sequence opt3 from CEACAM19__Homo_sapiens__NP_001121365
auggagauccccaugggcacccaggggugcuucagcaagucccugcuccuuucugccucaauucugguguuguggauguuacaaggaagucaggcugcacuguacauacagaaaaucccugaacagccacaaaagaaccaggaccuacuccugagcguccaggguguuccggauacauuucaggacuucaauugguaucuuggcgaggaaacuuacgggggaacgagacuguuuaccuauauucccggcauccaaaggccucagcgggaugguuccgccauggggcagcgcgacauugugggauucccaaacggcucuauguugcuccgacgugcgcagcccacagauucgggcacuuaccaaguagcuaucaccauaaauucagaguggacaaugaaagccaagaccgaagugcaggucgcagagaaaaacaaggagcugccuagcacucaucugccaacaaaugccgggauccucgcugcaaccauuaucggaaguuuagccgcuggugcccugcuuauuuccuguaucgcguauuugcuggugacgagaaacuggaggggccagucucaccggcuacccgcaccucgcgggcaaggaagccucuccauacugugcucagccguuaguccagugccgagcgucacucccucuaccuggauggcuacaacugaaaagccugagcuuggcccagcccacgacgcuggugauaauaacauuuacgaagugaugcccuccccuguacuguugguuucaccaaucagcgacaccagaaguauuaaucccgcaaggccgcucccuacacccccacaucugcaggccgagccugagaaccaccaguaucaggauuuacugaaucccgacccagcgcccuacugucaacucgugccuaccucuuga

SEQ ID NO: 54210 - RNA, 1395 nt, Artificial Sequence
  derived and/or modified sequence opt3 from CEACAM1__Homo_sapiens__NP_001020083
augggccaccugagcgcuccccuccauagagugagggucccuuggcaggggcuucuguugaccgccuccuuacugacauucuggaacccaccgacuacggcacaacuaaccacagagucuaugcccuuuaauguugccgaaggaaaggaggugcuccugcuuguacacaaccugccucagcaguuguucgguuacucaugguauaaaggcgaacggguggacgggaaucgccagaucgucggauacgcgauuggcacucaacaggcuaccccaggucccgccaacagugggcgagagacaauauauccuaaugcaagccuccugauccagaacgugacccagaaugauacuggauuuuacacacugcaaguuauuaaguccgaccucgugaacgaagaggccaccggccaguuccaugucuauccagaguuacccaaaccuucuaucucgucaaauaacagcaauccaguggaagauaaggacgcuguagcauuuacgugcgagccggaaacucaggauaccacauaccugugguggauuaacaaucagagucuucccguuuccccucguuugcaacugucuaacggcaauagaacucuaacccuccugagcgugacaaggaacgacaccgggccauaugagugugagauccagaaccccgucuccgccaaucggucagauccugugacgcuuaacgugacuuacggaccagacacacccaccauaaguccgagcgauacuuacuaucgcccuggugcuaaucugucuuuguccugcuacgccgcgucaaaucccccagcacaguauagcuggcucaucaacggcacauuccaacagaguacccaggaacuguuuauuccuaacaucacggucaauaacucuggguccuacaccugucacgccaauaacagcguuacaggaugcaauagaacuaccgugaaaacaauuaucguaacugaguuaucgcccguggucgcuaagccacagauaaaggccucuaaaaccacagugaccggcgacaaggauuccguuaaccugacuuguucaacgaaugacacagguauuaguaucaggugguucuuuaaaaaccaaagccuccccuccucugaacggaugaaacuuagccaggggaauaccacucugucaauuaacccugugaagcgcgaggaugcaggaaccuauuggugcgaagucuucaacccaaucaguaagaaucaguccgacccgaucauguugaacgugaauuacaacgcucuaccccaggagaauggccugagcccuggcgccauugcggggauaguaaucggaguuguggcccucgucgcacugauugcuguggcccuugcuuguuuucugcauuucgguaagacagggucuucaggcccauugcaauga

SEQ ID NO: 54211 - RNA, 882 nt, Artificial Sequence
  derived and/or modified sequence opt3 from CEACAM21__Homo_sapiens__XP_006725457
auggggcccccuagcgccugcccacacagagaguguaucccguggcagggccugcuccuuaccgcuucccuguugacauucuggaacgcacccacuacggccugguuauuuauugcgucugcuccuuucgaaguggccgagggagaaaauguccaucugucaguuguguaccuaccagagaaccucuauaguuacgguugguauaagggcaaaaccguagaacccaaucaacugauagcagccuacgugaucgacacacacgucaggacuccugggccagcuuauagcggacgggagaccauuucccccucuggcgaucuucauuuucagaacgugacacuggaggacaccgguuacuauaauuugcagguuacuuaccgcaacucgcagaucgaacaagcaucacaccaucuccgaguguacgagagcgucgcccagccuaguauucaggcuuccucuacaaccgugacggaaaaggggagcguaguucugacuugccacaccaauaacacaggaacuuccuuccaguggaucuuuaauaaccaacgucuccaggugaccaaaagaaugaagcugucaugguucaaucacgucuuaacaauagauccaaucaggcaggaggacgccggcgaguaucagugugaagugaguaacccggugagcucuaaucgguccgauccccugaaacuuaccgucaagucagacgauaacacguugggcauucugaucgggguucuagugggaagccuccugguagcggcacuugugugcuuucuguugcuccgcaagacugguagagccagugaccaaucugauuucagggagcagcagccuccagcuuccacacccggccaugggccuagcgacucgucuauuuccuga

SEQ ID NO: 54212 - RNA, 639 nt, Artificial Sequence
  derived and/or modified sequence opt3 from CEACAM3__Homo_sapiens__NP_001264092
auggggcccccuagcgccuccccacacagagagugcaucccguggcaggggcugcuccuuaccgcuucucuguugaacuucuggaaucccccuacaacugcaaaguuaacgauugaaucaaugccacugaguguggccgagggaaaagaaguccuacuccugguucauaaccuuccccaacaccuguuugguuacagcugguauaagggcgagaggguggacggcaauuccuugauaguaggauacgugaucggcacccagcaggcgacaccuggugcugccuauucugggcgggaaacuauuuacaccaacgcaucgcuccugauccagaaugucacacaaaacgauauuggauucuauacccuccaggugaucaaaucagaccugguuaaugaggaggccacuggccaguuucauguguaccaggaaaacgcuccaggcuuacccgucggggcaguggccggaauaguaacagguguucuggugggcgucgcucuuguggccgcguugguguguuuccugcuacucgcaaagaccgggcgcccuuggagccugccacaacuuugccuguuggaugucccgagucuccacugucccggaccuccaacgcagccccaggacuccucuuuucaucuguga

SEQ ID NO: 54213 - RNA, 735 nt, Artificial Sequence
  derived and/or modified sequence opt3 from CEACAM4__Homo_sapiens__NP_001808
auggggcccccuagcgccgcuccaagaggcggacacaggccguggcagggucugcucaucaccgcaucccuucugacauucuggcaucccccuacuacggugcaauuuaccauugaggccuugccaucuucagcggcugaaggcaaggacgucuuacugcuagccugcaacauaagugagacaauccaggcauacuauuggcacaaagggaagacugccgaaggaagcccccucauugcuggcuacaucaccgauauucaggcaaauaucccuggugccgcuuauuccgggcgggagacaguuuacccaaacggaucucugcuuuuccagaauauaacccuggaagacgccggcucguauacuuugcgcacaaucaacgcgucauacgauagcgaccaagcaaccggccagcuccaugugcaccagaauaacguacccgggcugccugugggagccgucgcugguauugugacgggcguucuggugggggucgcccucguggcagcuuuaguauguuuucugcuuuugagucgaacuggacgugccuccauccagagagaucugagggagcaaccaccgcccgcgucuaccccuggccaugguccaagccaccgguccacauucucagcaccccuaccuaguccacgcacugccacccccauuuaugaggaacuccuguacagcgacgcuaauaucuacugccagauagaucacaaagccgacguugugucuuga

SEQ ID NO: 54214 - RNA, 2109 nt, Artificial Sequence
  derived and/or modified sequence opt3 from CEACAM5__Homo_sapiens__NP_001278413
auggagagccccuccgccccuccacacagauggugcaucccguggcagaggcugcuccuuaccgcuucucuguugacauucuggaaucccccuacuacggcaaaguuaaccauugaaucaacaccauuuaauguggccgagggcaaagaaguccugcuacucguucauaaccugccccaacaccuuuucggguacaguugguauaagggagagcggguggacgguaaucgccagauaaucggcuacguaauugggacucagcaggcgaccccuggaccagcuuauagcggccgagaaaucauuuaccccaacgccucccuguugauccaaaauauaauccagaacgauacagguuuuuauacccuccaugugauuaaaucugaccuggucaaugaggaggcaacugggcaguuccguguguacccugaacugccaaagccgucgaucucaagcaacaauaguaaacccguugaggauaaggacgccguggcuuuuacaugugaaccugagacccaggaugcaacguaucucuggugggucaacaaucaauccuuaccagugucucccagacugcagcuuagcaacggaaauaggacuuugacccuguucaacguaacacggaaugacacugccuccuacaagugcgagacccagaacccuguuucagcucgcagaagugauagcgugauucuaaacguccucuacggcccagacgcccccacaaucucuccgcugaauaccuccuauaggucaggcgaaaaccuuaaucugagcugucacgcggcaaguaacccucccgcccaguacucuugguuugugaaugggacguuccaacaguccacucaggaguuguuuauaccaaacauuacagugaauaacagcggaucguauaccugccaagcucauaauucugauacuggucucaaccggacaaccgucacgaccaucacaguuuacgccgaaccucccaaaccauucauuacuuccaauaacucaaaucccguggaggacgaagaugcaguagcucugaccugugagccugagauccagaacacaacuuauuuauggugggugaauaaccagagucugccagucagcccgcgccuccagcuuuccaacgacaaucgaacccugacauugcuaucugugaccagaaacgauguuggccccuacgaaugcgggauccaaaaugagcugagcguggaccacucagacccugucauucucaacgugcuguauggaccagaugaccccacuauaaguccuuccuacacguacuauaggccaggcguaaaucuuagccugucuugucacgccgcgucaaaucccccggcccaguacaguugguugaucgaugguaauauucagcagcauacacaagaacucuuuaucagcaacauaaccgagaagaacuccgggcuguauacuugccaggcaaacaauucugcuucgggacacagccggaccacaguuaaaaccauuacuguguccgccgaauuaccuaagccaucaaucaguucuaacaauagcaaacccgucgaggacaaggaugcuguggccuucacaugugagccugaagcacagaacacgaccuaccuguggugggucaauggccagucccuacccgugucaccacgucuccaacugagcaacggcaaccgcacucuuacauuguuuaauguuaccagaaacgacgccagggcuuaugugugcgggauccagaacucuguauccgcgaaccggagugauccugucacacuggacgugcucuacggacccgauacuccaauuaucagcccgccugacucuuccuaucugucaggugcaaaucuuaaccugaguugucauagcgccucgaaucccuccccacaguacucuuggcgaauuaacggcauaccccagcaacacacccagguuuuguucaucgcuaagauuacgccuaauaacaaugggaccuacgccugcuucgugagcaaccucgcaacaggacgcaauaacucaaucgucaaaaguaucacuguguccgccucuggcaccagcccaggucuguccgcuggggccacaguaggcauuaugauaggaguguuaguuggcgucgcacugaucuga

SEQ ID NO: 54215 - RNA, 1035 nt, Artificial Sequence
  derived and/or modified sequence opt3 from CEACAM6__Homo_sapiens__NP_002474
auggggcccccuagcgccccaccgugcagacugcacgugcccuggaaggagguccuccuuaccgcuucccuguugacauucuggaacccuccaacuacggcaaaauuaaccaucgaaucuacacccuuuaauguugccgagggcaaggaagugcugcuacucgcgcauaaccugccucagaauaggauuggauacucaugguauaaaggugagcggguagacggcaacagucuuauagugggguacgucaucggaacucaacaggcuaccccaggccccgccuauagcggucgcgaaacaauuuacccuaaugcaucccuguugauccagaacgugacccagaaugauacuggguucuauacacuccaaguuauuaagucugaccuggugaacgaggaggccaccggacaguuucacgucuacccagaacugccgaaacccucgaucucaagcaauaacaguaauccuguggaggauaaggacgcuguagcauucacgugugaaccagagguucagaacacuaccuaucucuggugggugaauggccaguccuuacccgucucuccucgacugcaacuuagcaacggcaauaugacauugacucugcuauccgugaagcguaacgaugccgggucauacgagugcgaaauacagaacccagcuagugccaauagaagcgaccccgugacccucaacguccuguacggaccggauguuccuacaaucucucccuccaaagcgaauuauaggccaggugagaaccuuaaucugucaugucaugcagccagcaacccucccgcucaguacaguugguuuauuaauggcaccuuccagcaaucuacgcaggaauuguuuaucccaaacauuacugugaauaacuccgggagcuauaugugccaggcccacaauucggcaacaggacucaaccggaccacuguaacaaugaucaccgugucuggcuccgcucccguccugucagccguggcgacgguugguauaaccauugggguguuagcccgcgucgcacugaucuga

SEQ ID NO: 54216 - RNA, 798 nt, Artificial Sequence
  derived and/or modified sequence opt3 from CEACAM7__Homo_sapiens__NP_001278414
augggcagccccuccgccugcccuuacagaguguguaucccauggcaggggcugcuccuuaccgcuucucuguugacauucuggaacuuacccaauucagcacaaacuaacauugacgucguuccguuuaauguggccgagggaaaggaaguacugcuagugguccacaacgagagucagaaucucuaugguuacaacugguauaaaggcgaaagggugcaugcgaauuaccggauaaucggguauguuaagaacauuagccaggagaaugcuccuggaccagcccacaacggccgcgaaacgaucuaccccaaugguacccugcuuauucagaacgugacacauaaugaugcagggaucuauacucugcacgucauaaaagagaacuuggugaaugaggaaguaacccgacaauucuacguguuuuccgagccuccaaagcccucuaucacaucgaacaacuucaauccuguugaaaacaaagacauugucgugcugaccugccagccagagacucagaauacaaccuaccucuggugggugaacaaucagucacugcucgucagcccgcguuuacugcuuaguacggauaacagaacuuugguucugcuauccgccaccaagaaugacaucggacccuaugagugugaaauucaaaacccugugggcgcuucuaggagcgauccaguaacacucaaugugcgguacgaguccguccaggcaucaagucccgaccugagcgccggcacugcugugucuaucaugauagggguucuugccggaauggcgcugauuuga

SEQ ID NO: 54217 - RNA, 1050 nt, Artificial Sequence
  derived and/or modified sequence opt3 from CEACAM8__Homo_sapiens__NP_001807
augggccccaucagcgccccuuccugcagauggaggauuccauggcaggggcugcuccuuaccgcuucucuguucacauuuuggaacccgcccacuacggcacaauugaccauagaggccgugccuucaaaugcggcugaaggaaaggaggucuuacugcuaguucacaaccucccacaggacccccgggguuacaauugguauaaaggcgaaacaguggaugccaaccgccgaaucauuggguacguaaucaguaaucagcagauuacuccuggaccagcauauagcaaccgugagaccaucuaccccaaugccucccugcuuaugagaaacgugacaaggaaugacaccggcucuuauacucugcaagucauaaaguugaaccucaugucggaagaggugacaggucaguucucaguucauccugagaccccaaaaccgagcaucaguuccaauaacucuaaucccguggaagauaaggacgcugucgcauuuacgugugagccugaaacucagaacaccacauaccuguggugggugaaugggcagagccugccaguaucaccccggcuccaauuauccaacggaaaccgcacucugacccuuuugaguguuacaagaaaugaugugggcccuuaugagugcgagauucagaacccagccagcgcuaauuucucugaccccgucacccugaacgugcuauacggcccggaugccccuacgaucucccccucagacacuuacuaucacgcgggggugaaucucaaccugagcugucaugcagccaguaauccaccuucucaguacuccuggagcgucaacggaacauuucagcaauauacccagaaacuuuucauucccaauaucacuacaaagaacucggguucuuacgcuugccacaccaccaauuccgccacgggcaggaaccggacaacuguucgcaugauaaccgugucagaugcacugguacaggggaguagcccaggauuguccgcucgagccacagugucuauuaugaucggcguccucgcgagaguggcccugauuuga

SEQ ID NO: 54218 - RNA, 1182 nt, Artificial Sequence
  derived and/or modified sequence opt3 from CEBPA__Homo_sapiens__NP_001274353
augagaggcagggggcgggccggaagccccgguggccgccgacguagaccugcucaggcagggggaaggcggggcuccccaugccgcgagaacucuaauucaccgauggaaagugccgacuucuacgaggcggaacccagaccuccaaugagcucccaucugcaaucucccccucacgcuccaucgucagccgcauuugguuuccccaggggagccgggccugcucagccaccggcacccccugccgcuccagagccccucggcggcaucugugaacacgagaccagcauugauauaagugccuauaucgacccugcggcauuuaacgaugaguuccuugccgaccuguuucagcauucccggcagcaagaaaaggcuaaagccgcaguggggccaacaggagguggcgggggaggcgauuucgacuaccccggugcuccggccgggccuggaggcgcggucaugcccggcggggcccacggaccaccucccgguuauggcugcgcagcugccggguacuuggauggacgcuuagagccacuguaugaacgaguuggcgcucccgcccuaagaccucucgugauuaagcaggagccaagggaggaagacgaggcaaaacagcuggcccuugcuggucuguuuccguaccagcccccuccacccccuccacccucucauccgcacccucacccacccccugcgcauuuggcagcuccccaccuccaauuccagaucgcccauugugggcagacuacgaugcaucugcagccaggccacccuacacccccaccgaccccuguacccagcccacaccccgccccugcacugggagccgcuggccucccagggcccggauccgccuuaaagggucugggcgcagcgcacccugaucuucgggcuucagggggaaguggcgccgguaaagcaaagaagucuguggacaaaaauagcaacgaauaucguguccgcagagagaggaauaacauugccgugcggaagucccgagauaaagcuaagcaacgcaauguugaaacucagcagaaaguguuggagcugaccucagacaacgauagacuaaggaagcgggucgagcaacucagccgcgaacuggacacacuuagagggaucuuuaggcagcugccggagaguucuuuggugaaggccaugggcaauugcgcauga

SEQ ID NO: 54219 - RNA, 1038 nt, Artificial Sequence
  derived and/or modified sequence opt3 from CEBPB__Homo_sapiens__NP_005185
augcagagacugguggccugggaccccgcuugccucccucuuccaccgcccccuccagcauucaagagcauggaggucgccaacuuuuacuaugaagcggauugucuggcugccgcauacggcgggaaagccgcucccgcagccccuccagcugccaggcccggaccucggccaccggcgggugaguugggcuccaucggggaccacgaacgcgcaauugauuucucucccuauuuagagccucugggagccccacaagcucccgccccugcaaccgcuacagacacuuuugaagccgcgccacccgccccggcuccugcacccgccucaaguggccagcaucacgauuuccuaagcgaccucuuuuccgaugacuacggugggaagaauugcaaaaagccagcugaguauggauacguuucucugggccgacuuggcgccgcaaaaggggcccugcauccuggauguuucgcucccuugcacccacccccuccaccgcccccuccacccgcggagcucaaggcagaaccugguuuugagccagccgauugcaagcguaaagaagaggcuggcgcccccgggggaggcgcagguauggccgcuggguucccguaugcccugagagcauaccugggauaccaggcggugccuucgggcucaagcggcagucucuccacgucuagcuccucaaguccacccgggaccccuagccccgcugacgccaaggcaccaccuacagccuguuaugcuggagccgcacccgcuccaucucagguaaaauccaaggccaaaaagacuguggauaagcauucagacgaguacaaaauaaggcgggaacgcaacaauaucgcggucagaaagagcagggauaaagccaagaugcggaacuuagagacccaacacaaagugcuggaacuuacagcugagaaugaacgcuugcagaagaaaguugagcagcugagucgagagcuaucuacccucagaaaccuguuuaagcagcuuccggaaccucuguuggcauccagcggucacugcuga

SEQ ID NO: 54220 - RNA, 810 nt, Artificial Sequence
  derived and/or modified sequence opt3 from CEBPD__Homo_sapiens__NP_005186
augagcgccgcucuguucucccucgacggccccgcaagaggggccccuuggccagcggagccggcucccuuuuacgaaccuggaagggccgguaagccaggccgcggggcagagcccggagcccuuggcgaaccuggugcugcagccccagcuauguaugaugacgagucugccaucgauuucucagcguacauugacaguauggcagccgugcccacccuggaauugugccacgaugaguuauuugcugaccuguucaacagcaaucauaaagccgggggagcaggcccucuagagcuccugccaggcgggccggcucggccccuuggaccugguccagccgcgccccgacuguugaagcgugaaccugauuggggcgacggggaugccccaggaucccuccugcccgcacaggucgcugccugugcucaaacaguugugucucuggccgcagccggccagccgacuccucccacgucgccagagccucccagaucaagcccaaggcagacccccgcuccugguccagcgcgggagaaaagugcagggaagcgcggaccggacagaggcucccccgaauauaggcagcggcgcgagcgaaacaauauagccguaagaaaaucuagggauaaggcuaagcggcguaaccaagaaaugcagcagaaacucguggaguuaagcgccgaaaaugagaagcugcaccagcgcgucgaacaacuuacaagagacuuggcaggccugaggcaguuuuucaaacagcuaccuuccccacccuuucucccugccgcugggacugccgauugccgguga

SEQ ID NO: 54221 - RNA, 846 nt, Artificial Sequence
  derived and/or modified sequence opt3 from CEBPE__Homo_sapiens__NP_001796
augagccacggcaccuacuaugagugcgaacccagagggggacagcaaccucuggaguucuccgguggcagggccgggccaggagaacucggcgacaugugugagcaugaggcuucuaucgaucuuucagcauacauugagaguggugaggaacagcuguugagcgacuuauuugccgugaagccggcgcccgaggcucgggggcugaaaggaccuggcacaccagccuucccccacuaucuaccuccagauccccgcccuuuugcauacccaccgcauacuuucggccccgaccgaaaggcccucgggccuggaauauauuccucuccagguucguacgauccccgugcugucgcaguuaaagaagaaccuagaggcccagaggggucaagggccgcuagccggggaaguuauaacccccugcaguaccagguggcccacugcggccaaacggcgaugcaucuuccgccuacccuggcagcccccggucagccauugcgcguacucaaggcuccucuggccacagcagcucccccauguucuccccugcucaaagccccuuccccagcggggccguuacacaagggaaagaaagccgugaauaaggacagccuggaauacagacuuaggcgggagcgcaacaauaucgcaguccgaaaauccagagauaaggcuaaaaggcggauuuuggaaacucagcagaaggugcuggaguauauggccgaaaacgagcgucuacgcucaagaguugagcaacucacccaggaacuggacacacuuaggaaucuguuucggcagauccccgaggcugccaacuugauuaagggcgugggcgggugcaguuga

SEQ ID NO: 54222 - RNA, 453 nt, Artificial Sequence
  derived and/or modified sequence opt3 from CEBPG__Homo_sapiens__NP_001239225
augagcaagaucucccagcaaaacucuacccccggcgugaaugggauuucagucauacacacacaggcccaugcuaguggacugcagcagguuccucaacucgugccagcagguccgggcgggggaggcaaagccguagcgcccagcaagcaguccaaaaagucuucgccuauggacagaaacucagaugaguacaggcagcggcgcgaacgaaauaacauggcugugaaaaagagccgucuuaagaguaaacagaaggcccaagacacucugcagagagucaaucaguugaaagaggaaaacgagagguuagaagcaaagaucaaacugcuaacgaaggagcucuccgugcugaaggaucuuuuccuggagcacgcccauaauuuggcugacaacguucagucuauuagcaccgaaaauacaacugcagauggugacaacgccgggcaauga

SEQ ID NO: 54223 - RNA, 3165 nt, Artificial Sequence
  derived and/or modified sequence opt3 from CEBPZ__Homo_sapiens__NP_005751
auggccgcugugaaggagccccuggaguuccacgcaaaaagaccuuggaggccagaggaagccgucgaggacccggaugaagaggacgaggauaacacaagcgaagcggagaauggcuuuucccucgaagagguucuucggcuugggggaacaaagcaggacuacuugauguuagcuacucuggaugagaacgaagaggugaucgacgguggcaaaaagggggccauugaugaccuacaacagggagaacucgaggcauucauacagaaucugaaccuugccaaauauacgaaggcuucucugguagaagaggaugagcccgcagaaaaggaaaauucaaguaaaaaggaagugaaaaucccuaagauuaacaauaaaaacaccgccgagagccagcgcacauccgucaauaaggugaagaacaaaaaucgaccagaaccccauucugacgagaacggcucgacuaccccuaagguuaaaaaggauaaacaaaauaucuuugaguucuuugaacgucagacauugcuccugagaccaggugggaagugguacgaccuggaguauucaaacgaauacagccucaaaccccagccucaggauguggucaguaaguauaagaccuuagcucaaaaacuguaccagcacgagauuaaucuuuucaaguccaaaacuaacucucagaagggagccagcuccacauggaugaaagcgaucgugucaaguggcaccuugggcgacaggauggcagccaugauacugcuaauccaggacgaugcuguacauacgcuccaauuuguugaaacucuggugaaccuugucaagaagaaagggagcaagcagcagugccugauggccuuggacaccuucaaagagcuccugauuacagauuuacugccagacaaucggaagcuccgcaucuuuucucaaagaccguucgauaaacuugagcagcuguccucaggaaacaaggacagcagggaucggcgcuugauucuaugguauuuugaacaccagcugaagcaucucguggcagaguucgugcagguccuggaaacucuuagucacgacacccugguuacaaccaaaacgcgagcuuugacuguggcccacgagcuccuguguaauaagcccgaggaagagaaagcguuacugguacaaguggucaacaagcuaggugauccucagaauagaaucgccacaaaagcaucucaucuccuggaaacccuuuugugcaagcacccaaacaugaagggcgugguuuccggggagguggaaaggcugcucuuucggagcaauauaucgucuaaagcucaguacuacgccauuuguuuccugaaccagauggcucuuucccaugaggagucagaacuggccaauaaguugaucacugucuauuucugcuuuuuccguacaugugugaaaaagaaagacguagagaguaagaugcucagcgcacuguuaaccggaguuaaccgcgccuaccccuauucccaaacgggcgaugacaaagugagagaacagauugacacccuguuuaagguccuacacaucgugaauuucaacacaucuguccaggcucucaugcugcuuuuucaggugaugaauagccaacagacuaucucagauagguacuauaccgcguuguaccggaagaugcuggacccuggucucaugacaugcaguaaacaggcaauguuccugaacuuaguuuauaagucccugaaagccgauauugugcuucgacgcguaaaggcuuuugucaaaagauugcuccaggugacuugucaacagaugccacccuucauaugcggggcccuguaccuaguuagcgagauccugaaggcaaagccgggacucaggucucagcuggacgaucacccugaaucagacgaugaggagaauuuuauugacgccaacgaugacgaagauauggagaaauucaccgacgcugauaaggaaacagagaucgugaaaaagcuggaaaccgaggagacuguccccgaaacggacguggagaccaaaaagccagaaguagccaguugggugcauuuugacaacuugaagggcggcaaacaacugaauaaguacgauccuuucagccggaaccccuuauuuuguggggcagagaauacaucccucugggagcugaaaaagcugucuguucacuuccauccaucggucgcgcuguucgcuaaaacuauauugcagggaaacuauauucaguacagcggugacccccuccaggauuuuacccugaugcgcuuccuagacagauuuguguauaggaauccuaagccacacaagggcaaagaaaacacagauuccguggucaugcaaccgaagcguaaacauuucaucaaggacauccggcaccuucccguuaauucaaaagaguuucucgccaaggaagagagucagauuccuguggaugaaguguucuuucaccgauacuauaaaaagguagcagucaaggagaaacagaagagagacgccgaugaggaaucuaucgaggacguggaugacgaagaguucgaggaacugauugauaccuuugaggacgacaacugcuucagcuccgggaaagaugacauggauuuugcuggaaauguuaagaaaaggacuaagggcgccaaggacaacacacuugaugaagacucagaggguagcgaugacgaauuggggaaucuggaugacgaugaggugucuuuaggcuccauggacgacgaagaguucgcagaggucgaugaagacggaggcacguuuauggaugugcucgacgaugagagugaaagcguuccagagcuggaggugcauucuaaaguauccaccaagaaaucaaagcgcaaagggacugacgauuucgacuucgcuggaaguuuucaggguccccggaagaagaaaagaaaccuuaaugauagcucgcuguucgucuccgccgaagaguuuggccaccuacucgacgaaaacauggggucuaaguucgauaauauaggaaugaacgcgauggccaacaaagacaaugcuagccugaagcaauugaggugggaggcagaacgcgaugacuggcugcauaaccgagacgccaaaucaaucauuaagaagaaaaagcacuuuaaaaagaaacggaucaagacaacccagaagaccaaaaagcagcguaaauga

SEQ ID NO: 54224 - RNA, 813 nt, Artificial Sequence
  derived and/or modified sequence opt3 from CECR1__Homo_sapiens__NP_803124
auggacagccuggaguggaacugggcccucguguacgaacuuuccggcgagcaccaugaugaagaguggucugucaagaccuaucaggaaguugcucaaaaauucguggagacacaccccgaguuuaucgggauuaagauaaucuacucagaccauagaaguaaagauguagcagugauugccgaaagcaucaggauggcgaugggacugcggauuaaguucccuacugucguggcugguuuugacuugguuggccacgaggauacggggcauuccuuacacgacuauaaagaagcccugaugaucccagcaaaggauggagugaagcuaccguacuucuuucacgccggcgagaccgacuggcaggguacaucuauagaucgcaauauccucgacgcucugaugcuuaacacuacccgaauugggcauggauucgcacugucgaaacaccccgccguccguacauauucauggaagaaagauaucccuauugaggugugcccaaucagcaaucagguauugaagcucguuagugaccugagaaaccaucccguggcuacccugauggccacuggccacccuauggucauauccucugaugacccagcgauguuuggcgcaaaagggcucagcuacgacuucuaugaaguguuuaugggaauugguggcaugaaggccgauuuaaggacacugaagcagcuugcuaugaacuccaucaaauacucaaccuugcuggagagugaaaagaauacguucauggagauuuggaaaaagcggugggacaaauuuaucgccgauguggcaacuaaguga

SEQ ID NO: 54225 - RNA, 4395 nt, Artificial Sequence
  derived and/or modified sequence opt3 from CECR2__Homo_sapiens__NP_001276976
augugccccgaggaaggcggggccgcuggacugggugagcucagaagcuggugggaagugccugcaaucgcccacuucuguucccuuuuuaggaccgcguuccggcugccagacuuugagauugaagaguuggaggcugccuuacaucgcgaugacgucgaguucauaucugaucugaucgcaugccuacuccagggcuguuaccaacgacgugacauuacaccgcagacuuuucacucauaucuggaggauaucauuaacuacagaugggaacuugaggaggggaagcccaauccucugagggaagccaguuuccaggacuugccacuccggacgcgcguugagauccugcauagacugugcgauuauaggcucgacgcugaugacguguuugauuuacugaaaggacuugacgcagauagcuugcggguagaaccccugggcgaggacaacuccggugcccuauacugguauuucuacgggacccgcauguauaaggaagacccugugcagggaaaaucuaauggcgagcucucgcugucacgagagagcgaaggccaaaagaacgucaguuccauaccagggaaaacaggaaagagaaggggucggcccccuaagcguaaaaagcugcaggaggaaauccuuuugucugagaaacaggaagagaauagccucgcuuccgagccacagacucgccacggcucacaagggccgggacagggcaccugguggcuguuaugucagacagaagaggaauggagacaggugaccgagaguuuuagggaacggacuagccugcgagagcgccaacucuacaaacuucugucugaggauuucuugcccgaaauuugcaacaugaucgcccagaaggguaagagaccucagaggacaaaggcggagcuacauccacgguggauguccgaccaccugucaauuaaacccguuaagcaagaagagaccccugugcucacgcgcaucgagaaacagaagagaaaagaagaggaagaggaaaggcagauacugcuugcaguccagaagaaagagcaagagcagaugcugaaggaagaacguaagcgggaauuggaggaaaaagugaaggccguagaggaucgagcuaaaagaaggaagcuccgcgaggaacgggccuggcuguuagcacaggggaaagagcugccacccgaacuaagccaccucgacccgaauaguccuaugagagaggaaaagaagacuaaagaucuguuugagcuugacgaugacuucaccgcuauguacaagguuuuggauguggucaaagcccauaaggacucuuggcccuuucuggagccaguggaugaauccuaugcgccuaacuacuaucagauuaucaaagcccccauggacauuagcucgauggagaagaagcucaauggaggccuguacuguacaaaagaagaguucgugaacgacaugaagacuauguucaggaauugccgcaaauauaacggcgagucuuccgaauacaccaagaugucagauaaucuugagcgauguuuucaccgggcaaugaugaaacauuucccaggggaagacggagauacagacgaggaauuuuggauccgugaggaugagaagagagaaaagaggcgcagucgggcugguagaagcggcgggucccacgucuggaccaggucucgagaccccgagggaagcucacgcaaacaacagccuauggaaaacggcgguaagagucugccaccgacgcggagagcccccuccagcggggaugaccagucuucaaguagcacucagccuccaagggagguuggcacauccaauggacguggcuucucucaccccuugcauugcgggggaaccccuucgcaagcuccauuucucaaccagaugcgccccgccgugccggguacuuucggcccucugcgggggagcgauccagcaacauuauauggauccucaggcguacccgaaccucaccccggugagccagugcagcagagacaaccuuuuaccaugcagcccccagucgggaucaacagucugaggggcccgcgacuaggaacgccugaggaaaaacagauguguggcgggcucacccaucugucuaauaugggaccccacccagguagccuucaauugggccagauuuccgggcccucacaggacggaagcauguacgccccugcucaguuccaaccaggcuuuauacccccucggcaugguggggcgccggcacgcccacccgauuucccugagucuuccgaaaucccacccagucacauguacagaagcuauaaguaccugaacagggugcacucugccguuuggaauggcaaccauggagcuacaaaucagggcccucucgggccggacgagaaaccccaccugggaccaggcccuucccaucagccccggacuuuaggucacgugauggauucacgagucaugagaccaccugugcccccaaaccaguggaccgaacaaaguggguuucugccgcacggaguaccuagcucgggcuauaugcggcccccaugcaaguccgccggucauaggcuucagcccccuccaguucccgcaccuucuagcuuguucggcgccccggcucaggcccuccguggggugcagggaggcgacucaaugauggacaguccagagaugauugcaaugcaacagcuguccucucgggucugucccccuggggugcccuaccacccacaucagccugcgcaccccagacuaccaggaccuuuuccgcaagucgcucaucccaugagcgugacaguuuccgccccaaaaccugcacugggcaaucccgguagggccccagagaacucagaagcucaggagccugaaaaugaucaggccgagccccucccggggcuggaggaaaagccaccuggagugggcacuagcgaggguguauaucuuacccaguugccccacccaacacccccucugcaaaccgacugcacucgccagaguucuccgcaggaacgagagacggucggccccgaauuaaaguccagcucgucagagucugcagauaacugcaaagcuaugaaggggaaaaauccauggccuagugacuccagcuaccccggaccugccgcgcagggcugugugagagaucucucuacaguugccgaccgcggggcucugagcgagaacggagugaucggcgaagcauccccaugcgguucagaggggaagggacuuggcaguagcgguucugaaaaacuguugugucccaggggccgcacccuccaagagacuaugccuugcaccgggcagaaugccgcuacaccacccuccaccgauccgggacugacuggcgggacagucucacaguucccuccacuauauaugcccggacuggaauacccuaacagugccgcacacuaccauauaagcccaggccuccaggguguggggcccguaaugggaggcaaguccccggcgucucacccucaacauuuucccccacguggcuuccagucgaaucacccucauagcgggggauuccccagauaucggccaccccaggguaugagguacucauaucacccuccaccgcagcccuccuaccaccauuaucaacgcacgccuuacuaugccuguccacagaguuuuucugacuggcagcgaccccugcacccucaaggcagcccauccgggcccccugcuucacagccgccacccccuagaucucuuuucagcgauaagaacgccauggcaaguuugcagggaugcgagacccugaacgcugccuuaacuucccccacacggauggacgcaguggccgcuaaaguuccaaaugauggccagaacccuggucccgaggaagagaagcucgacgaaagcauggagaggccagaaucuccgaaagaguuucuggaucuugacaaucauaacgcggccaccaagcgccaaucaucccugagugcaagcgaguaccuauacgggacaccucccccacucucgucuggaaugggcuucggcuccagcgcuuuucccccucacucagucaugcugcagacugggccacccuauaccccucagagaccggccagucacuuccagccaagggccuacucuucccccguggcugcauugccuccacaucaccccggagccacgcaaccuaauggucugagccaggaaggccccauuuaucggugucaggaggaaggguuaggacauuuucaggcggugaugauggagcaaaucggcacccguucagguauccgcgggccauuccaggagauguaccgaccgaguggaaugcagaugcacccuguccaaagccaggcuuccuuucccaaaacaccaacugccgcaaccucucaggaagagguuccuccccauaagccaccuacacucccccuggaccagagcuga

SEQ ID NO: 54226 - RNA, 777 nt, Artificial Sequence
  derived and/or modified sequence opt3 from CELA1__Homo_sapiens__NP_001962
augcuggugcucuacggccacagcacccaggaccuucccgagacaaacgccagagucguugggggaacugaagcugguaggaacuccuggccuucucaaaucucacugcaguaucggaguggcgggagccgcuaccauacgugcggaggcaccuugauucgacagaauugggugaugacagcagcccacuguguagauuaucagaagacuuuccguguggucgcgggugaccauaauuuaucccaaaacgaugggaccgagcaguacgugucuguucagaaaauagugguccacccauauuggaacucggacaauguggcugccggauacgauaucgcacugcuaagacucgcccagucaguaacacugaauagcuauguucaacuuggcgugcugccgcaggaaggcgcuauuuuggcaaacaauagucccugcuacaucaccggguggggaaagacuaaaacaaacggucagcucgcccagacccugcaacaggcuuaccugccuuccgucgacuaugccauuuguucuagcuccucauacuggggcaguacggugaagaauacuauggugugcgcagggggagauggcgucaggagcgguugucagggggacucuggaggcccacuccauugcuuaguuaacggcaaauauuccgugcacgggguaaccucauuugugagcagucggggauguaaugucucucgcaagcccacaguguucacucaaguuuccgcguacaucagcuggauaaacaaugugaucgccucgaacuga

SEQ ID NO: 54227 - RNA, 882 nt, Artificial Sequence
  derived and/or modified sequence opt3 from CELA3B__Homo_sapiens__XP_011539434
augaugcugagacuccuuagcucccuguuguuaguggccgucgcuucuggcuacgggcccccuucaaguaggccaagcucccggguugugaacggagaggacgcaguaccguauucuuggcccuggcaagugucgcugcaguacgaaaagucagguagcuucuaucauaccugcggcgggagucuaaucgccccugauugggucgugacagcgggacacuguauuuccucuagccgcacuuaccagguugugcucggcgaguaugaccgagcugucaaagaagguccagaacaggugauacccaucaauuccggggaucuguuuguacacccucuuuggaaccguucaugcguugccuguggaaaugacauugcacugaucaaguugaguagaagcgcccagcucggcgaugcugugcaacuggcaucucugccacccgccggcgacauucucccuaacgagacgccaugcuacaucaccggguggggaagguuauauacaaaugguccgcugcccgauaaacuucaggaggcuuugcugccugucguggacuacgagcauuguucccgguggaacugguggggcucaagcgugaagaaaacuauggucugcgccgggggagauauacgcaguggcuguaauggugacucugggggaccacuaaacugccccaccgaagauggcggcuggcagguucacggggugacauccuucguaagcgcguuuggauguaauaccagaaggaagccuacuguguucacacgggucucggcauuuaucgacuggauugaggaaggucucugccgcauggagaccacgcuggccugucuuccaggcucucagaagcugcaagggaacaaagcucccgagucccgaacuuga

SEQ ID NO: 54228 - RNA, 1539 nt, Artificial Sequence
  derived and/or modified sequence opt3 from CELF1__Homo_sapiens__NP_001166110
auggccgcuuucaagcuggacuuucuccccgagaugaugguggaucacugcagccuuaacuccucuccugucagcaaaaagaugaauggcacccuggaccauccagaucagccggacuuggaugcaaucaaaauguucguugggcaagugcccagaacauggagugaaaaggacuuaagggagcuguuugaacaguacggagccguauaugagauuaacgugcuacgggaucgcagccagaauccuccacaguccaaagguuguugcuucgucacuuuuuacacgcgaaaggcggcucucgaagcccaaaacgcacugcacaauaugaaggugcuucccggcaugcaucacccuauacagaugaaaccagccgacucugagaagaacaauguugaggaucguaaacuguucaucgggaugauuucgaagaaauguaccgaaaacgacaucagagugauguuuucaucauucggacagauugaggaaugcaggaucuugcggggccccgauggucucagucgcgggugugcuuuugucacauucacuaccagagcaauggcccagacagcuauaaaggccaugcaucaagcgcagaccauggagggaugcuccucuccuauggugguaaaguuugcagacacucagaaagauaaggagcagaaaaggauggcccaacagcugcagcaacagaugcagcagaucagcgcugccuccguuuggggcaaucuggcaggccucaacacauuagggccacaauaucuggcucuuuacuugcagcugcuacagcagaccgccucaaguggaaaucucaacacgcugagcucucuucacccgauggguggccugaaugcgaugcaauugcagaaccucgccgcacuggcugccgcugccuccgcagcccagaauacucccucagggaccaacgcuuuaacaacuagcaguucuccucuguccgugcucaccagcucgggaucuuccccaucaaguagcuccucuaacagcgucaaucccauugcgucacuuggcgcacugcagacauuggccggugcuaccgccgggcuaaacgugggaagucuggcaggcauggccgcucucaauggcgggcugggauccagcggucuuucuaacggcacggggucaacuauggaagcccugacacaagcauauaguggaauccagcaguacgcggcugccgcauugccuacccucuauaaucagaaccuguuaacucaacagagcauuggcgccgcugguucccagaaggaggggccagaaggcgccaaucuguucaucuaccaccuaccccaagaguuuggagaccaggaccuccugcagauguucaugccguucggcaacguggucucugcaaaaguuuuuauagauaagcagacaaaucuuucgaaauguuucggguuugugagcuacgacaacccuguauccgcucaagccgcgauucagucaaugaauggauuccagaucgguaugaagcgguugaaggugcagcugaaacgcaguaagaacgauucuaaacccuauuga

SEQ ID NO: 54229 - RNA, 1473 nt, Artificial Sequence
  derived and/or modified sequence opt3 from CELF2__Homo_sapiens__NP_001020247
augaacggcgcccuggaccacagcgaucagcccgacccugaugcuaucaagauguucguggggcaaauuccaagauccuggucugagaaagaacucaaggagcuuuuugaaccguacggagcagucuaucagauaaauguucugagggaccggucacagaaucccccucagaguaaagguugcuguuucgugaccuuuuacacacgcaaggccgcguuggaggcucaaaacgccuuacauaacaucaaaacucugccaggcaugcaccaucccauucagaugaagccugcagauagcgaaaaguccaaugccguagaggaccgaaaacuauucaucgggauggugucuaagaaaugcaacgagaaugauauucgugucauguuuucgccauucggacagaucgaagaguguagaauacucaggggccccgacggucugucacgggggugcgcuuuugugacguucagcacccgcgcaauggcccagaacgcuaucaaggccaugcaccaaagucagacaauggaaggauguuccucuccuauuguugugaaauuugcggauacucagaaggacaaggagcagagaaggcuucaacagcagcuggcacaacagaugcagcaguugaauaccgccacauggggcaaccucaccggccucgggggacugacuccacaauaucuggcuuuacugcagcaggccacaagcuccucaaaucuuggugcauucaguggcauccagcaaauggcugggaugaacgccuugcagcugcagaaucuagcgacccucgccgcagcugccgcugccgcacagacgagcgccacuucuaccaacgcuaauccgcuguccacaacuucaagcgcgcuuggagcacugaccagucccgucgccgcuucuacaccuaacuccaccgccggcgcagccaugaacagcuugacgucgcucgguacucugcaaggguuagcuggagccacagugggccugaauaacauuaaugcacucgcgguagcucagaugcuuucuggcauggccgcacugaacgggggauugggugccaccggccuaacuaaugggacagcuggaaccauggaugcccugacgcaggcauacuccggcauccagcaauaugcugccgcggcccucccaacccuguacucacagagucuucugcagcaacagagcgcugcagguucccagaaagaggggcccgaaggcgccaacuuguuuauauaucaucucccucaggaguucggagaccaagauauucugcagauguuuaugccauucggcaauguuaucucugcuaagguguucauugacaaacagacaaacuuaagcaagugcuuuggguucgucucauacgacaaucccgugagugcccaggcagcgauccaagccaugaacggauuucagaucgguaugaaacggcugaaggugcagcuaaaacgcuccaagaaugauagcaagccguacuga

SEQ ID NO: 54230 - RNA, 1458 nt, Artificial Sequence
  derived and/or modified sequence opt3 from CELF4__Homo_sapiens__NP_001020258
auguacaucaagauggccacccuggcuaacggccaggcagacaaugccagccucuccacaaacgggcuuggaucuucacccgguagugcgggccacaugaaugggcugagccauuccccuggaaacccaucuacuauuccgaugaaagaucacgacgcuauaaaguuguucaucggccaaauucccagaaauuuagaugagaaagaccugaagccucuauuugaagaguucgguaaaaucuaugaacucacggugcugaaggauagguuuaccgggaugcauaagggaugcgccuuccuuacauacugugagcgggaaucggcacugaaagcccagucagcuuugcacgagcagaagacucucccaggcaugaaccgccccauucaggucaaaccugcagacagcgagagucgaggcggguccucuugccugcgucaaccacccagccaggauagaaagcuguuuguuggaaugcucaauaaacagcaguccgaagacgaugugaggcgguuauucgaggccuuugguaacaucgaagaguguaccauacugcgcggcccugacgggaauagcaagggaugcgcuuucguaaaguauaguagccaugccgaggcgcaagcagccaucaacgcccuucacggcucucagacaaugccaggugcuuccucaucauugguggucaaauuugcagauaccgacaaggaaagaacuaugaggcggaugcagcagauggcugggcaaaugggaauguucaauccgauggccauucccuuuggcgcguacggcgccuaugcacaggcuaugcagcaacaggccgcucugauggccaguguggcacaagggggauaccuaaacccuauggccgcuuucgcggcagcccagaugcagcagauggcugcccucaauaugaacggucuggcagccgcuccaaugacacccaccucuggcggguccacgccuccaggaaucacugcccccgcaguuccgagcauuccuucgcccaucggcgugaaugguuuuaccgggcuuccaccucaggcgaacggccagcccgcugccgaggcagucuucgccaacggaauacacccauaucccgcucaaucuccuacagccgcagauccacugcagcaggcuuacgccggcgugcagcaauacgcggggccggccgcuuaucccgcagccuacggacagauuucccaggcuuucccucagccacccccuaugaucccacaacagcagcgcgaaggucccgagggcuguaauuuguuuauuuaucaucucccgcaagaguucggggacgccgaacugaugcagauguuuuuaccuuucggauuuguaucauucgacaacccagcaagugcgcagacugccauccaggcuaugaauggcuuucaaaucgguaugaaacgacugaagguucagcucaaaagacccaaggaugccaacaggccuuacuga

SEQ ID NO: 54231 - RNA, 1230 nt, Artificial Sequence
  derived and/or modified sequence opt3 from CELF5__Homo_sapiens__NP_001166144
auggccagacugaccgagagcgaagcuaggcggcagcaacagcagcuccuucagccccgcccuuccccaguggggucuucaggcccggagcccccuggaggucaaccagacggcaugaaggaucuggacgcaaucaaauuguucgucgggcagauuccccgacacuuagaugaaaaggaccugaaaccucuauuugagcaguucggacguauauacgaacucacaguucugaaggauccauauacuggcaugcauaaagguugcgccuuucuuacguacugugcgagagacagugcuaucaaggcccagaccgcacugcacgagcaaaagacauugcccgggauggccaggccuauucaggugaaaccagcugauagcgagucccggggaggccgcgacagaaaacucuucguaggcaugcugaacaagcagcagucugaagaggaugugcugaggcucuuucaaccguucggggucaucgacgaaugcacuguguuacggggacccgaugguucgucaaagggcugugcauuuguuaaauucagcagucauaccgaggcccaggcugccauucacgcgcugcaugggucccagacaaugccuggagcaucuagcucccuuguggucaaguuugccgacaccgauaaggagcgcacuuugcgaagaaugcaacagauggugggccagcuggguauccuaacaccaucacucacccugcccuucaguccuuauagcgcuuacgcccaggcacuuaugcaacagcagacgacuguacugucuaccuccgggucauauuugagcccaggaguugcuuuuagucccugccacauacagcaaaucggcgccgugucucucaauggccugccggcgacaccuauugcccccgcauccggggucgugccauucccuggaggucaccccgcuuuagaaacuguguacgccaacggccuggucccauaucccgcucagagcccuaccguugccgagacacuccauccagcauuuucgggggugcagcaguacaccgccauguacccgacggcugcgaucacucccauugcacacucuguaccucaaccacccccucuucugcagcagcagcaaagggaaggaguguggcggcauggcgccgacgcugacgucccaacauugcgucaguaucacuuccuacaggguguguacggguccucauaucaacccgagcagguuuuccgccugagagaacucuga

SEQ ID NO: 54232 - RNA, 1365 nt, Artificial Sequence
  derived and/or modified sequence opt3 from CELF6__Homo_sapiens__NP_001166155
auggccgcugcacccggcgggagcgcccagccugcgggaccagguccgagacugggcuucuccaccgcugacucuggggugggaaugucaggccucaaccccgguccugccgucccaaugaaggaucacgacgcaaucaaacuuuuuguugggcaaauucccaggggacuggaugagcaggacuugaagccuuuauucgaagaguuuggccggauauacgaacugacagugcuaaaagaucgccucacuggccugcacaaggggugcgccuuccuuacguauugugcucgagacagugcacugaaagcccagagcgcuuugcacgagcagaagacccucccaggaaugaaucgucccauccaaguaaagccugccgcguccgaagguagaggcgaggauaggaaacuguuuguggggaugcugggaaagcagcagggcgaggaagacguccggcgccucuuccagccauuuggucauauugaggaaugcacaguguuaagaucuccggaugggacuucgaaaggaugugcauucguuaaguuuggcucacaaggcgaggcccaggcugccaucagggggcugcacggaagccggaccauggcuggugcaaguuccucucuuguggucaaauuggccgacacagaucgcgagcgagcgcugagaaggaugcagcagauggccggccaucuaggggcauuccaccccgcuccucucccacugggagccugcggcgcuuacaccacugccauucuucaacaccaggcagcccuguuggcugcggcacagggucccgggcucggcccuguggccgcuguagccgcacaaaugcagcauguugccgcuuuuagccugguggccgcaccauuacugcccgcggcugccgcaaacuccccgccuggaucaggccccgggacacucccaggacuuccugcccccaucggugucaauggcuucgggccacugacuccccagacgaacggacagccuggcagugacacuuuguauaauaacggucuaagcccauacccggcucaaucucccgggguggccgauccucugcagcaggcauaugcuggcaugcaccauuacgccggaccagaaggcuguaaucucuuuauauaucaucugccccaggaguucggggacgcggaacuuauccaaaccuuccugccuuuuggagccguggucuccgcuaagguuuucguggaccgggcaacaaaccagucaaagugcuuugguuucgugagcuuugauaauccaaccagugcccagaccgcuauucaggccaugaacggcuuccaaaucgggaugaaacguuugaagguacagcucaaacgccccaaggacgcaaauagaccguacuga

SEQ ID NO: 54233 - RNA, 2271 nt, Artificial Sequence
  derived and/or modified sequence opt3 from CEL__Homo_sapiens__NP_001798
augcugaccaugggcagacuccagcuugugguccugggguugacaugcuguugggccguugcuagcgcagccaaguuaggagcgguguacacugaggguggcuucguagaaggggugaacaaaaagcugggacuacucggcgacuccgucgauaucuuuaaagguauucccuucgcugccccuacgaaggcacuggagaauccacaaccgcaccccggguggcagggaacccuuaaagccaagaacuuuaagaaaaggugccugcaggcuacaauaacucaggacucuaccuauggcgaugaagacuguuuguaccucaauaucugggugccucaaggccggaagcagguuucacgcgaucugccagugaugauuuggaucuaugggggagcauuccugauggguaguggccauggggccaacuuucucaauaacuacuuauaugacggagaggaaauugcuacacgaggcaaugucaucgugguaaccuucaacuaccguguugguccccugggguuucuuagcacuggagaugccaauuugccuggcaacuauggccugagagaccagcacauggcgauagcaugggugaaaaggaauaucgccgcuuucgggggagauccaaacaauauuacacuauuuggugaguccgccggcggggcaucugucucgcuccagacccugucacccuacaacaagggacuuauccggcgcgcuauuagccaaaguggcguggcccuguccccuugggugauccagaaaaauccauuguucugggcgaagaaggucgccgagaaaguugguugcccggugggggacgcagcuagaauggcccagugucucaagguaacggaucccagggcucugacuuuagccuacaaagugccucuggcaggccucgaauauccaaugcuucauuacgucggauuugugcccguuauagacggcgauuucauuccugccgacccaaucaaccuguaugcuaacgcggcagacauugauuacaucgccgggaccaauaacauggacggacacaucuuugcuucuauugauaugcccgccauaaauaaggguaacaaaaaggugacagaggaagacuucuauaaauuggucagcgaguucacuaucaccaagggccuacgcggggcaaagacaaccuuugauguguacacggaguccugggcccaggacccgucacaagaaaauaaaaagaaaacuguaguugauuucgagacagacgugcuguuucucgucccuaccgaaauugcucuggcccagcaucgggcaaacgcgaagagugcuaaaacuuaugccuaccuuuucagccaccccucucgaaugccaguguacccuaagugggucggagcagaucacgccgacgauauccaguauguguuuggcaagcccuucgcuacaccaaccgguuacagaccccaagacaggacgguuuccaaagccaugauagcauauuggaccaauuuugcuaagacaggggacccuaacaugggcgauucagccgugccaacucauugggagccguacaccacagaaaauagcggauaucuggagauuacuaaaaagaugggcaguucuuccaugaaacggagcuugcguaccaacuuccuccgcuacuggacacugaccuauuuagcgcugcccacuguaacggaccaggaggccacaccugucccacccaccggggauucggaagcuacuccugugccacccaccggagacucugagacagcaccgguuccuccaaccggugauuccggcgcucccccugugcccccaacuggggacucaggagccccucccgucccaccgacaggcgauaguggugccccucccgugccacccacgggggacagcggcgcaccuccaguacccccuaccggagauuccggcgcgccgccagugcccccuacuggggacucuggagccccacccguuccuccgacaggcgauagcggugcucccccagucccucccaccggggacucaggagccccaccugugcccccaacaggcgaugcagguccgccucccgugccacccacuggcgacaguggggcuccuccaguucccccuaccggagacuccggcgccccgccagucacgcccaccggggauagcgaaacagcaccugugcccccaacuggagacucuggcgccccucccgugccaccuaccggugauucagaggcugcgccgguacccccaacagacgauaguaaggaagcccagaugccugcagucaucagauuuuga

SEQ ID NO: 54234 - RNA, 9045 nt, Artificial Sequence
  derived and/or modified sequence opt3 from CELSR1__Homo_sapiens__NP_055061
auggcucccccuccaccgcccgugcugccuguccuccuucuguuggccgccgccgcggcuuuaccagccaugggccugagagcagccgcuugggaacccaggguuccugggggcacccgggcauucgcccuacgcccagguugcacuuacgcugugggcgccgcguguacuccccgagcaccucgugaacuccuggacguugggagagacggaaggcuugccggccggcgcagagugagcggugcugggaggccacugccguugcagguccggcucguggcccgcuccgcacccacggcucugucucgaagacugagggcccggacccaucucccuggaugcggcgcgcgugcccgcuuauguggcaccggggcaagacugugcggagcucuuuguuuuccaguucccgguggcugcgccgcugcccaacauucagcauuggccgcuccuacuacccugccagcguguaggugucccccgcggccucgaccccgcuguccagggagaccuaucugccuacccccaggaggcagugugaggcuccggcugcuuugugcacugcgcagagccgcuggugccgucagggugggguuggcacucgaggccgcuacagccggaacccccuccgcauccccuucuccaucgccgccccugccuccaaacuuacccgaagcgcgugcuggcccugcccggcgagcaagaaggggcacuucagggcgcggaagccugaaguucccaaugcccaauuaccagguagcccucuuugagaacgaaccggcugguacacuuauucugcaguugcacgcccauuacaccauugagggcgaggaagaacggguuaguuauuacauggaagggcuauucgacgagagauccaggggauauuuucgcaucgauucugcaacgggcgcugugagcacugacuccguccuggaucgagagaccaaagaaacacacgugcuccgggugaaggccgucgacuacucaacuccuccacguagugcgaccacauauauuaccguucuggugaaagauacgaaugaccauagccccguauucgagcagucugaauacagagagagggugcgcgaaaaccuugaggucgguuacgaggugcugacuauccgggccuccgauagagacucaccuauuaaugcuaacuugagguaucgaguucucgggggcgcaugggauguguuucaacugaaugaaagcaguggagucgugucuacacgcgccguauuagaccgggaggaagcugccgaguaccagcugcuaguugaagcaaacgaucagggcagaaaucccgggccacucuccgcgaccgccacuguguauaucgaggucgaggacgaaaacgacaauuacccucaguucagcgagcaaaacuaugugguccaggugcccgaagauguuggacugaauacagcugugcuuaggguacaggccaccgaccgugaucagggucaaaacgcagcuauacacuacucgaucuugucuggcaaugucgccgggcaguuuuaucugcacucccucucaggcauucuggacgugaucaacccacuugauuucgaggacguucagaaguacagucugagcauuaaagcacaagauggcggucgcccgccuuugaucaacuccucugggguggucagcgugcagguacucgacgugaaugauaacgaacccauauuuguuucaaguccauuccaggccacgguccuggagaaugugcccuuaggcuacccugugguccauauucaggcuguugacgcggauuccggagagaacgcccggcugcacuauaggcucguggacaccgcaagcacauuucucggcgggggaucugcugguccaaagaaucccgccccuacuccggacuucccauuccaaauccauaacucaaguggcuggauuaccgugugcgccgaacuggauagggaggaaguagagcacuacagcuuuggggucgaggcuguggaccacggaucucccccuaugagcucgagcacauccguuucaaucacugugcuugaugucaaugacaacgauccaguguucacccagcccacauaugaauugcgacugaaugaggacgcagccguuggcaguucugugcucacccugcaggcgcgggaucgcgacgcuaacagcguaaucacuuaccaguuaacgggugggaauacaagaaacagguuugcccuguccucacaacggggcggaggccuuauuaccuuggcacucccucuggauuauaagcaggaacagcaguacguccuagccgugacugcuagcgacgggacccgaucucauacagcacacgugcugauaaaugucaccgaugccaacacucauagaccgguuuuccaauccagucacuauacagugagcguaucugaggaccgccccgugggaacguccaucgcgacccucucagcuaaugaugaagacacuggcgagaacgccaggauuacauacgucauccaggacccagugccucaguuucguauagaucccgacagugguaccauguacacaaugauggagcuggauuaugaaaaccagguugcauacacucuuaccauuauggcccaagacaaugggaucccacagaaaagcgauacgaccacauuggagauccugauuuuagacgcuaacgauaaugccccucaguuccucugggacuuuuaucaaggaucgaucuucgaagaugcacccccauccacuucuauucuacaggugagcgcuaccgaccgggauucaggcccgaacgguagacuucuguacacauuucagggcggggacgauggagacggcgacuucuauauagagccuacaaguggggucaucaggacccagcgccgauuggauagagaaaauguggccguuuacaaccucugggcgcuggccguggaccggggaucccccacgccacuaucugcaagcgucgagauucaaguaacaauccuggauaucaaugacaacgcucccauguuugagaaggaugaacucgagcuguucguggaagagaauaacccuguuggcuccguggucgccaaaauuagggcuaaugacccagaugaaggucccaacgcacagauaauguaucagaucguggagggggacaugcgccacuuuuuccagcuugauuugcugaauggagacuuacgugccaugguagagcucgauuucgaagugagacgggaguacguccugguugugcaagccaccucagcuccucuugugagcagggcgacuguccacauucugcuaguggaccagaacgacaauccgccaguucuccccgauuuucagauccuguucaacaacuacguaacaaauaagaguaacucuuuuccuaccggcgugauugguugcauccccgcacacgacccagaugucuccgacagcuugaauuauacuuucgugcagggcaacgaacugcgcuuacuccugcuugauccugccaccggggagcugcaauugucgcgagaccucgauaauaacagaccccuggaggcucuaauggaaguuucagugucugacggaauacauagugucacagccuuuuguacgcugcgggugaccaucauuacugaugacaugcuuacaaauuccaucaccguaaggcucgagaacaugagccaggaaaaauuccugucuccauugcuggcauuauuugucgagggcguggccgcuguucucagcacaacuaaggaugacguguucgucuuuaaugugcagaacgauaccgacguuuccucaaauauucugaacgugacguucagugcgcuucugccugggggaguccgcggccaauuuuucccgagcgaagacuugcaggagcagaucuaccucaauagaacacugcuaaccacuauaucuacccagagggugcugcccuuugaugacaacauuugccuucgggagccaugugaaaauuauaugaagugcguauccgugcuccguuucgauucaagugccccuuuccugagcuccacaacuguuuuguuucgccccauccacccaauuaacgguuuacgauguagaugcccucccggguucaccggagacuacugugagacagaaaucgaucugugcuauucugacccguguggcgcaaacgguaggugccggucgcgcgagggcggguacacgugugaaugcuuugaggauuucaccggagagcauugcgaagucgacgcuagaagcggaagaugcgccaauggggugugcaaaaacggaggcacuugugugaaucuccugauagguggguuucacugcgucuguccaccuggagaguaugaacggcccuacugcgagguaacaacccgaucauucccaccccaauccuuugugacuuucagaggccuucgccagagguuucacuucacaaucagucugaccuuugcaacgcaggaacggaacggcuugcuacuguacaaugggcguuucaacgagaagcaugauuucauugcccucgagaucguugacgaacaggugcaacugacuuuuucugcuggagagaccacaaccacugucgccccuaaagugccgagcgguguuuccgauggcagauggcacucagugcagguccaguauuacaauaagcccaacauugggcaucuuggauuaccacacggcccuucuggugagaagauggcggugguaacaguggacgauugugacaccacaauggcaguuagguucgggaaggacaucggaaauuauagcugcgccgcucagggcacucaaaccggcaguaaaaagucccuggaucucacggggcccuugcugcucggaggugucccuaaccugccagaggacuuucccgugcauaaucgccaguucgugggcuguaugcggaaccuuagcgucgaugggaagaauguugacauggccggauuuauagcuaacaauggcacacgagaggguugcgcagccagaaggaacuucugugaugggcgccggugccagaauggaggaaccugcgugaacagauggaacauguaccugugugaaugcccuuugcguuuuggcgggaaaaauugugagcaggcuaugccacacccccaacuauucucuggagaaucaguaguguccuggagugaccugaacauuaucaucagcgucccgugguaucucgguuuaauguuuaggacucggaaggaggauucggugcugauggaagccaccucuggcgggccuacauccuuccgccuucagauucugaauaacuaccuccaguuugagguuagccacggaccaucagacguggagagugucauguugucuggccugcgaguaacugauggugaauggcaucaccuccugaucgagcuuaaaaaugugaaggaagacuccgagaugaaacaucuaguuaccaugacgcuggauuaugggauggaccaaaacaaggcagacauuggaggcauguugcccggcuuaacagugagaagcgucguggucgggggagcgucagaagauaaggugaguguuaggcgggguuuccgcggcugcaugcagggggugagaaugggaggcaccccuacuaauguagccacacugaacaugaauaacgcucucaaagugagggucaaggacgguugugauguugacgauccaugcaccagcucccccuguccgccuaauucucgaugccacgacgccugggaggauuacagcugugugugcgacaaaggguaccugggaauaaacugugucgaugcaugccaucuuaaucccugcgagaacaugggcgcuugugugcgguccccaggcucaccucagggguauguaugcgaauguggacccucucacuacgguccauauugcgagaauaagcuggaccuccccuguccucguggcuggugggggaacccagugugcggaccgugucacugcgccguuaguaaaggcuuugaucccgacuguaacaagacuaauggucagugccaauguaaggaaaacuacuauaaauugcuggcacaggauacaugccuaccuugcgacuguuucccacaugggucgcacagcagaaccugcgacauggccacgggccagugugcuugcaagcccggagugaucggccgccaguguaauaggugcgauaacccuuucgcggaggucacuacccuggggugugaagugauuuacaauggaugcccaaaagccuuugaggcagguaucugguggccccaaacaaaguucggccagccugcugccgucccguguccaaaaggguccgugggaaacgccguucggcauugcucuggcgagaaggguuggcuacccccugaacuuuuuaauuguaccacaauuucauucguagaccugagagcaaugaacgagaaguuaagccgcaaugaaacucagguggauggggcuagggccuugcagcugguccgagcgcuccgguccgcuacccaacacacgggcacacuguuuggaaacgacgugagaacugccuaucagcuucugggccacguucuccagcaugagaguuggcaacagggguucgauuuggcagccacccaggacgcugauuuucacgaggacgugauccauucuggaagcgcacuguuagcccccgcgacaagggcugccugggaacagauacaacgcucagaggguggcaccgcacagcuacugcgucggcucgaaggguacuucuccaaugucgccagaaacgugaggcgcacuuaccuucgaccauuuguaaucgugaccgcuaauaugauucuggccguugauaucuucgacaaauuuaacuucacaggagcacgggucccuagauuugauacgauucacgaggaguuccccagggaguuggagaguagcgugucuuucccagcugacuuuuuccgcccgccugaagagaaggaaggcccccugcucagaccagccggucggaggacuacaccccagacaacccguccugggccaggcacugagcgagaagcgcccaucucccgcagacggaggcauccugacgaugccggacaguuugcaguggcucuggucauaauuuaucgcacacuuggccaacuccugccggagagauacgacccagaucggaggucauugcgacugccccaccguccuaucaucaauaccccaaugguuagcacguuaguguauucggagggggcaccccugccuagaccccuggaacgcccaguacucguggaguucgcacuucuggaagucgaggaacggacuaaaccggugugcguauuuuggaaccacucuuuggcugugggaggcacagguggguggagugccaggggaugcgagcugcucuccagaaaccgcacccaugucgccugucagugcagccacaccgcgucauucgcugugcugauggacauuucccggagggagaauggcgaaguacuuccuuuaaagauaguuacuuacgcagccgugucucugagccucgcugccuugcuggucgcauuugugcuacugagucucgugcgaaugcuuagauccaaccugcauagcauccacaaacacuuggccgucgcucuguuccucucucagcugguuuuugugauugguaucaaucagacagagaaccccuucuuauguaccguaguggcgauucuucugcauuauaucuacaugucaacauuugccuggacucucgucgaaagucuacacguguaucggaugcugacggagguuaggaauauagauaccggcccaaugcgcuucuacuacguggucggguggggaaucccugcaauugugacaggcuuggcuguagggcuggacccccaaggauauggcaacccagauuuuugcuggcucucccuucaggacacucugaucuggagcuucgccgguccuauuggggcaguuaucauaauuaauaccgugacaucugucuugucggccaaggugucaugucagcguaaacaucacuacuauggaaagaagggcaucguuagccugcucagaaccgcuuucuuacugcuucugcuaaucuccgccacuuggcuccuggguuugcuggcggugaaccgagaugcacucaguuuucauuaccuuuucgccauauuuucuggccugcaggggcccuucgucuuacuguuucacugcguguugaaucaagagguaaggaaacaccucaagggagugcugggcgggcggaaacuacaucuugaagacagcgcuacgacccgcgccacacugcucacuagaucccugaacuguaauaccacauucggagauggcccggacauguugaggaccgaucugggugagucaacugcaagucucgacucuaucguccgggacgaagggauacagaaacuuggaguuagcuccggccuggugcgcggcucacacggggagccagaugcuagcuuaaugccuagaucuugcaaagaucccccaggacaugauuccgacagugauagcgaacugucguuggacgagcaguccucuucauaugccagcagucacuccucugauagcgaggacgauggugucggcgcugaagagaagugggaccccgcccgaggggcagugcacucaacaccuaagggagaugcgguagccaaccaugugccggcuggcuggccagaccaaucccucgccgaaagugauagcgaggaccccucugguaaaccuaggcugaagguugaaacgaaagugucagucgagcuacaccgggaggaacaggggucccaucguggagaguaucccccagaccaggaaagcggcggcgcagcucgccuugccucuagucagccucccgagcaaagaaaggggauucugaaaaauaaggugaccuauccaccuccgcucacucugacagaacagaccuugaagggaagguuacgggagaaacuggcagauugugagcagucgcccaccuccagcagaacaucaucucucgguagcggcgggccagacugcgccaucacuguuaaguccccuggacgcgaacccggccgagaucaccuuaacggugucgcgaugaaugugaggacggggagugcucaggccgacggaucagauucugagaaaccauga

SEQ ID NO: 54235 - RNA, 9939 nt, Artificial Sequence
  derived and/or modified sequence opt3 from CELSR3__Homo_sapiens__NP_001398
augauggccaggaggcccccuuggcggggccuaggagggcgcagcaccccaauccuccuucuguuguuacugucccuauucccgcucucucaggaggaacuggguggcgggggacaccagggcugggaccccggucuugcugccacuacugggccucgagcccauauuggaggcggcgcgcuggcuuugugcccagagucaaguggggugcgugaagauggaggucccggccucggggucagagagccuauauuuguuggacugaggggccggcgccagagcgccagaaauuccagggguccacccgaacagccuaaugaggagcuggggaucgaacacggagugcagccacucggcucucgggagcgcgaaacgggccaagggccgggaucgguauuauacuggcgacccgaggugucaagcugcgguagaaccggcccucugcagagggggagucuuuccccaggagccuugucuagcggcguccccgguuccgggaacucaaguccucugccaagcgacuuccugauucggcaucacggccccaagccggugucuucccagcguaaugccggaacaggcucacgcaaaagaguugggacugcuaggugcuguggagagcucugggcaaccgguagcaagggccagggggaacgggccacaaccaguggagcugagcgaacugccccucgcagaaacugccugcccggcgcgucugguuccgggccagaacuugauagcgcaccuaggacagcccggaccgcucccgccucgggcucugcaccacgcgaguccagaacggcucccgaaccugccccaaaaaggaugcguucacggggacuguuucgauguagauucuugccgcaaaggcccggcccucgcccacccgggcucccugcgcggccagaggccagaaaggugacaagugcaaauagggcucgcuuucgacgggccgcuaaccgucauccccaguucccgcaguauaauuaccagacccuggucccugagaacgaagccgcaggaacagccguguuaagaguaguugcucaagacccagaugcgggugaggcaggcaggcugguguauagccucgccgcucuuaugaacucccgcucucuggaauuguuuagcaucgacccccagucagggcugauucggacugccgcagcccuggauagagagaguauggaaaggcacuaccuccgagucaccgcucaggaccacggauccccucgccugagcgccacaaccaugguggcagugacggucgcggaucggaacgaccauucucccguuuucgagcaagcucaguauagagagacucuuagggaaaauguggaggaaggcuacccaauccugcaguugcgugccacagauggugacgcaccucccaacgccaaucuccgcuaucgguuuguagggccaccggcugccagagcagcugccgcggccgcuuucgagauagauccuaggucaggccugaucaguaccagcggacgaguggaccgggaacacauggaguccuacgaguuagucguggaagcaucugaccagggccaagagcccgggccacgcucggccacuguuagagugcauauuacaguccuggaugaaaacgacaaugcuccccaguuuagcgagaaaagguacguggcccagguacgggaggauguucgaccucacaccguggucuuaagagugacggcaaccgaccgcgauaaggacgcgaacggacucguccacuauaacaucauuuccggcaauucaaggggucauuucgccaucgauagucugacaggggaaauacaggugguugcuccacuugacuuugaggccgaacgugaguacgcauugcggauuagagcucaagaugccggaaggcccccucugucuaacaauacuggccucgcaagcauccaggugguagacauuaacgaucacaucccgaucuucgucuccaccccauuccaggugucaguucuggaaaaugcaccccuuggucauagcgugauucacauacaggcugucgacgcggaccauggcgagaacgcccgccuggaguauucuuugacagggguggcaccugauacuccauuuguaaucaauuccgcuaccggaugggugaguguuagcggcccccucgaccgagaaucugucgagcacuacuucuuugggguggaagccagagaucacggauccccuccgcugucagccagugcuagcgugacagucaccguuuuagacgugaacgauaaucggcccgaguucacuaugaaggaauaucaucugaggcuaaacgaggacgcagccgugggcacgucgguagucuccgugacagcgguugaucgcgacgcuaauucugccauuagcuaccaaaucaccggugggaacacucguaauagauuugcaauaucaacccagggaggcgugggucucgucacacuggcccuuccauuggauuauaaacaggagcgguacuucaagcuggugcucaccgcuagugacagggcacugcacgaucauugcuacguucacauuaacaucacugacgccaauacacaccgcccuguguuucaguccgcgcauuauucuguaagcgucaacgaagaucgacccaugggcuccacgaucguggugauuucagcuagcgacgacgaugucggggagaacgccagaaucaccuacuuacuggaagacaaucuuccacaauuccggauugaugcagacaguggagccauaacuuugcaggcuccucucgauuaugaggaccagguuacauacacccuggccaucacagcaagggauaacggcauuccccaaaaagcugacacuaccuauguggaaguaauggugaaugaugucaacgacaaugccccacaguuuguggcgucucacuacacggggcuaguuuccgaggaugccccgccuuucaccagcgugcugcagaucucggcaacagaccgcgaugcucaugccaacggaagaguccaguauacuuuucaaaauggcgaggacggugacggggauuucaccaucgaacccacaucaggaauugugaggacuguucggcgucucgaccgcgaggcugugucugucuacgaacugaccgcauacgccguagaucgaggcgugccaccccuuagaacgccuguuaguauacaggugaugguccaggacgugaacgauaaugccccaguauuucccgcugaggaguucgaagugagggucaaggagaacuccaucguugguagcgugguggcgcagauuacagcagucgacccugaugaaggcccgaaugcccacaucauguaucaaauuguggaggggaacaucccagaauuguuccagauggacauauuuucuggggagcugaccgcuuuaaucgaucucgacuacgaggcccggcaggaauauguuauuguagugcaggcaacuagcgcaccccuggucucccgcgcuacagugcauguuagacuuguggaucaaaaugacaacucaccuguccugaauaacuuccagaucuuguuuaacaauuacgugaguaacaggagcgacaccuuccccucuggcauuaucgggcggauaccagcguaugauccugacguauccgaucaccucuuuuacucauucgagcgaggaaaugaacugcagcuacuggucgugaaccaaacaaguggcgagcucagacugagccgcaaacuugacaauaacaggcccuugguugccuccaugcuggugaccgucacagaugguuuacacucugugacggcacaguguguucuccggguggucauuaucaccgaggaacugcuugcuaauucgcugacugugcgucuagagaacauguggcaggaaagauuucucagcccacuguuggggagguuccuggagggaguagccgcaguguuagccacuccugcugaagacguuuuuauuuucaauauccagaacgauaccgacgucggcggcacagugcucaaugugucauuuuccgcccuggcgccgcgcggggcaggagccggugcugccggccccugguucaguucugaggaacuucaagagcagcuguauguccggcgagcugcauuggccgcuagaagccuccuggauguacuaccauuugacgauaacgugugccugagggagccuugugaaaauuacaugaagugcguuuccgugcuucgcuucgacucaucugcccccuuccucgcaagcgcgaguacucuguuucggccaauacagccuaucgccggguugagaugucguugucccccgggauucaccggcgauuuuugcgagacggaacuggacuuauguuacuccaacccaugcaggaaugguggggcuugugcccggcgcgagggaggcuauacaugcgucugucgaccuagauucaccggcgaggacugcgaacucgauacugaggcagggaggugugugcccggaguuugccggaacgguggcaccuguacagacgcuccaaacgggggauuucgcugccagugucccgccggcggugcauucgaagggccuagaugcgagguggccgcuaggagcuuuccgcccucuucauucgucauguuucgaggacugcggcaacguuuccaucuuacucuguccuugaguuuugcgaccgugcagcagagcggccuccuguucuacaauggcagacuaaacgaaaagcacgauuuccuggcccuugagcucguagcaggacaggugcgccugacauauucgacgggagagucuaauaccguugucuccccaacugugccugguggcuugagcgacgggcaauggcauacagugcacuuaagguacuauaacaaaccccggaccgaugcucugggaggcgcccaggguccuucaaaggacaaagucgccguucucaguguggaugacugcgauguagcaguggcucugcaguuuggggccgaaauuggaaauuacucuugugcggcugccggcguccagacuuccagcaagaaaucacuugaccugacaggcccauugcuacuagggggagugcccaaccucccugagaauuucccaguuagucauaaggauuuuaucgguugcaugagagaccugcacauugauggccgcaggguggacauggcagccuucgucgcuaacaaugggaccauggcaggaugucaagccaaacuucacuuuugcgacagcggccccuguaagaacuccgguuucugcucugaacgaugggggagcuuuuccugugauugcccgguaggauucggcggcaaggacugucaguuaacgauggcgcauccucaccauuuucgggggaauggaacucugucauggaacuucgguucugauauggcugugaguguuccaugguaucucggcuuggccuuuagaaccagggcaacacagggggugcugaugcaaguccaggccggaccccacucgacccuccugugccagcuugaccgcggccuguugagcgugacugucacacgugguuccgggcgggcuucucaccuacugcucgaucaggugaccguuucagacggcagauggcaugauuuaaggcuggagcuucaagaggaaccuggaggccgccgagggcaccaugugcugaugguaagccucgacuucuccuuguuucaggauacaauggccgugggaagugagcugcagggucucaaagucaagcagcugcacguuggcgggcuuccacccggaucugcagaagaggcuccgcaaggccuaguggguuguauccagggggucuggcugggcagcacuccuucaggaucccccgccuuguuaccaccuagucaucgggugaaugcggaacccggcugcguagugaccaacgccugcgcaagcgggccaugucccccucacgcugacugcagagaucuguggcagacguucucuuguacaugccagccaggauacuacgguccgggcuguguugacgccugccuccugaaucccugucaaaaccagggguccugcaggcaccuuccuggagcaccacauggcuauaccugugacugcguggguggguacuucggccaccauugugagcaccgcauggaucagcaaugccccagaggaugguggggcucaccuacuugcgggccauguaauugcgacguccacaaaggauuugaucccaacuguaacaagaccaauggccagugccauuguaaagaguuccacuaucggccuagggguagcgacucgugccugccgugugauugcuacccaguggggucuacaagucguuccugugcuccccauagcggacagugcccuugucgacccggcgcccucggucgccagugcaacucaugcgacuccccauuugccgaggucacugcgucuggcuguagaguguuguaugaugcuugcccuaagagccugcggagugggguuugguggccccaaaccaaguucggaguacuagcaacggugccauguccgaggggcgcccugggggcugccguccgccucugcgacgaggcacagggauggcuugaaccugaucuguuuaauuguacaucccccgccuucagagaguugagccuacugcucgacggccuggaacuuaacaaaaccgcucuggauacuauggaggcgaagaaacucgcccagcgguugagggaggugacaggucacaccgaccauuacuuuucucaggauguucgagugacugcacgucuguuagcucaccuacuggccuucgaaucacaccaacagggguuuggacucacagcaacccaggacgcccauuucaaugagaaccuucugugggcuggcagugccuugcuggcgccagaaacgggugaccucugggcagcccugggccagagagcucccgggggauccccuggcagcgccgggcuuguccgccaccucgaggaauaugcagcuacucuggcccggaauauggaguugaccuaccugaacccaaugggauuagugacacccaauauaaugcuaucuauugauaggauggagcauccuucgucaccgagaggcgcucgccgguacccaagguaucacagcaaccuguuucgaggucaagacgccugggauccccacacccauguacuccuuccuucccagaguccaagacccucuccuagcgaagugcugcccacauccucaaguaucgaaaauucuacuaccagcuccguugucccaccgccugcacccccagaaccugagcccgggaucucaauuaucauuuugcugguguaccggacgcucggaggccugcuuccagcgcaguuccaggccgaaaggcgcggcgcucguuuaccucaaaaccccgugaugaauagcccggucguuucuguggccguauuucacgggagaaacuuccugcgaggaauacucgaguccccaaucaguuuggaguucaggcugcuacagacagcaaaucggagcaaggcuauuugcgugcagugggacccucccggucuggccgaacaacauggcgucuggacugcacgcgauugugagcucgugcacagaaacgggucgcaugccaggugccgguguucccgcaccggaacauuuggcguucuuauggacgcgucuccaagagaacgacuggagggugauuuggaacugcucgcuguguucacccacgucgugguagccguuucaguggcagcccuggucuuaacugcugccauccuucugagccucaggagucuaaaauccaacgugcgggggauucacgcaaauguggcugccgcgcugggagucgcugaguugcuguuucuccuuggcauccaucguacccacaaccagcugguuugcacagccguggcaauauugcugcauuauuucuuucucucuacguucgccugguuauuuguacagggccugcaccuuuaccgcaugcaaguggagcccagaaaugucgacagaggggcuaugcgguucuaucaugcacugggauggggugugccugccguucuacucggccuggcggugggguuggauccggaaggauacggcaacccagacuuuuguuggaucagcguccacgagccccugauuuggucauucgccgguccugugguacucguuaucgugaugaaugggacuauguuucuucuggcugcaagaaccuccugcaguacaggacaacgcgaagccaagaagaccagcgcuuuaacucugcgaucuucauucuugcuccugcuacuugucuccgccagcuggcuguuuggccuccuggcagugaaccacucuauuuuggcuuuccauuaucugcacgccggccucugcgggcuucagggacuggcgguuuuacuguuguucugugugcucaaugccgaugcaagggcugccuggaugcccgcaugccugggucggaaagccgcuccagaggaggccagaccugcgcccggccuagggccaggagcuuacaacaauacagcacuuuuugaagagaguggccugauccguauaacccucggugccucgacggucuccagcgugucaucugcucgcagcgggaggacucaggaccaggacucccaacggggaagaaguuaccugcgagauaacguauuggugaggcauggcucagccgcagaccacacagaucacucuuuacaggcccaugcuggcccuaccgaccuggaugucgcgauguuccaccgcgacgccggggcagauagcgacuccgauagugaccucagccuugaagaggaacggucccugucuauuccgucaagcgagucggaggauaauggaagaaccaggggucgcuuucagcguccccuaugucgggccgcucaguccgaaagacugcucacucauccaaaggacguugauggcaacgacuugcugaguuauuggccugcacuuggggagugcgaagccgcucccugugcccugcaaacauggggaucugagcgaaggcucggcuuagacaccagcaaagaugcggcaaauaacaaucagccagacccugcccugacaucaggugaugaaacuuccuuggggcgcgcucagcggcaaagaaagggaauccugaaaaacaggcuccaguacccccuugugccgcagacgcgcggcgccccagagcugucuuggugcagagcagcuacccuaggccaccgggccgucccugcggccaguuaugggcgaaucuacgcuggagguggcacagggagccugucccagcccgcaucaagguauagcucucgugagcaacucgacuugcugcuuagacggcagcugagucgcgaaagguuagaggaagccccagcucccgugcuccgaccucuguccagacccggaagccaggaguguauggaugcagccccaggccgguuggaaccuaaggaccgcgguucaacucugccgaggagacagcccccacgggauuacccuggggcuauggccggacguuucggcucucgcgacgcacucgaucuuggcgcccccagggaguggcuguccacccuaccaccuccccgaagaacacgggaccuggauccgcaaccuccaccccucccuuugucgccacagaggcagcugagccgcgaccccuuacuuccuaguagaccacuggauucucucucccggagcucaaacaguagggagcagcuggaccaaguacccucccgccauccgagccgagaagcguuggggccucugccccagcuccuuagagcucgugaggacucugugucaggaccaagccacggucccuccaccgaacagcuggauauucuaucuaguauacuggccucguuuaauagcuccgcauuaucaucuguucaaagcaguuccacuccucucggcccacacacgaccgccacacccucagcuacugccucugugcuggggccuagcaccccacgguccgcaacaagucauagcaucucugaguugucaccggacuccgagguccccaggagcgaaggacacaguuga

SEQ ID NO: 54236 - RNA, 4086 nt, Artificial Sequence
  derived and/or modified sequence opt3 from CEMIP__Homo_sapiens__NP_001280227
augggcgccgcugggagacaggacuuccuguuuaaggcaaugcucaccaucagcuggcuuacacugacuugcuuccccggagccacguccaccguggcggcugguuguccugaucaaucuccagaguugcagccguggaaccccggccacgaccaggaucaucacguccauauugggcagggaaaaacauuacugcuaacuucaagugccaccguuuacagcauacacaucuccgaaggcgguaagcucgugauuaaagaccaugaugagccuaucguacugaggacacggcacauucuuaucgacaaugggggagaacugcacgcaggcucugccuugugcccauuucaaggcaacuucaccauaauccucuaugggcgcgcugaugaggguauucagcccgacccuuacuauggacugaaguacaucggcguggggaaaggaggcgcacuggaacuccauggucagaagaaguuaucguggacuuuucugaauaaaacacuucacccagggggaauggccgagggcggcuauuucuuugagcgaucaugggggcaucguggagucauugugcacguuaucgaucccaagagcgguaccgugauacacagugacagauucgauacguacagguccaaaaaggaaucugagcgguugguccaguaucugaacgcugugccugacggccgcauucuaagcguagccguuaaugaugaaggguccagaaaccucgacgacauggcgaggaaagcaaugacuaagcugggaucaaagcauuuucuucaccugggcuuccggcauccauggagcuuuuugaccgugaaagguaauccgaguucuuccgucgaggaucacaucgaguaccaugggcaccgcggcucagccgcugcccgaguguucaagcucuuucaaacagaacacggagaguacuucaacgugagccugaguucugaauggguccaggacguugaguggacugaaugguucgaucaugacaaagugucccagaccaagggcggggagaaaauuagcgauuuauggaaggcacaccccggaaaaaucuguaauagaccuaucgacauucaggcuacaaccauggaugguguaaaccugucgacggagguggucuauaagaagggccaagacuacagguuugccugcuaugaucgggggcgugcgugucgcucuuacagagugagguuccucugcggaaaaccaguucggcccaaacuuacugugacaauagacaccaaugucaacuccacuauccugaauuuggaagauaacgugcagucauggaaaccuggcgacacucuaguaauugccaguaccgacuauagcauguaccaggcagaggaauuucaaguucugccaugucgauccugcgcucccaaucaggugaaggucgccgguaaaccgauguaucuccauaucggggaggaaauagauggcguggacaugcgcgcugaggucggacugcuuucuagaaacauuaucgugaugggcgagauggaagauaaguguuacccuuacaggaaccacaucugcaauuucuuugacuucgauacguuugggggacacauuaaguucgcccuggguuuuaaagcagcccauuuggagggcaccgaacucaagcacauggggcagcagcugguuggacaauaucccauccauuuccacuuagcuggcgacguggaugagcgggguggguacgacccaccuacauauauucgcgaucugagcauacaucacacuuuuucaagauguguaaccguccacggcaguaacggacuacucaucaaagacgugguuggcuacaauucccuggggcauugcuucuuuacagaagauggacccgaggagaggaacacuuucgaccacugccuuggcuugcuggucaagagcgguacccuccugccaucugaucgugacucaaaaauguguaagaugauuacagaagacaguuaucccggguacaucccuaagccacggcaggauugcaaugcggugagcaccuucuggauggcaaacccgaauaacaaucuuaucaacugugccgcugccggauccgaggaaacuggcuuuugguucauuuuucaucacgugcccacggguccuucuguaggcauguauucgccaggguacagcgagcauauaccccugggaaaauucuacaauaaccgagcacacuccaauuauagagccggcaugaucauugacaacggggugaagacaaccgaggcuucagccaaagauaagaggccauuuuugaguaucauuucugcacgcuacagcccacaccaggacgcggauccccucaaaccgcgggaaccugcuaucauaagacauuucaucgccuauaagaaucaggaccacggagcauggcugaggggcggugauguuugguuagacuccugccgcuuugccgauaacgggauuggacugacucuagcuucaggcgguaccuucccauacgacgauggcagcaagcaagagaucaaaaacucucucuuugucggggaauccggaaaugugggcacagagaugauggacaaccgaauuugggggcccggaggccuggaucauaguggucggacccuuccuaucgggcagaauuuccccauacguggcauucaguuguaugacggaccaaucaacauucagaauuguacuuuuagaaaguucguggcccuggaagguaggcacacaagcgcacucgcuuuucgccugaacaaugccuggcaaucuugcccucacaacaaugucacgggcaucgcguucgaggacguucccauaaccucccggguguucuuuggggagccaggaccgugguucaaccaguuagauauggacggcgauaaaacuucaguguuucaugacguagaugggagugucagcgaauacccuggaucguaucugacaaagaaugacaacuggcuugugagacaccccgauuguaucaauguuccagacuggaggggcgccauuugcuccgguuguuacgcucagauguacauccaggcauauaaaaccucuaacuugcgaaugaagauuaucaaaaaugauuuccccagccauccucucuaccuggagggggcccuaacacgcucaacucacuaucaacaguaccagccaguggucacccugcaaaagggauauacgauacauugggaccagaccgcucccgccgaacucgcaauuuggcugaucaacuuuaacaagggcgauuggauccgggugggccuuugcuacccuagagggacaacuuucaguauuuuguccgacguucacaauaggcuguuaaaacagaccucuaagacaggaguguuuguacguacucuccagauggacaaagucgagcaaagcuauccgggucgcucccacuacuacugggaugaagacucaggccugcuuuuccugaaguugaaagcgcagaacgagcgggagaaguuugccuucuguagcaugaaggggugcgaaagaaucaaaauuaaggcucucauaccaaagaaugccggagugagugauugcaccgcaacggcuuaucccaaguuuacagagagggccguggucgacguuccuaugccuaaaaagcuguucggcucucagcuaaagaccaaagaucauuuccuggaagugaagauggaguccagcaaacagcacuuuuuccaucucuggaacgacuuugcauacaucgaaguagaugguaagaaauaucccucgucagaggacgggauucaaguggucgugaucgauggaaaucagggccgaguugugucucacacaaguuuccggaacuccauucugcagggcaucccuuggcagcuuuuuaauuacgucgccacaauaccggacaacagcaucguguugauggcuucuaaggggcgcuauguuagcagaggacccuggaccagggugcuggagaaguuaggugcggaucggggccucaaacugaaggaacaaauggccuucgucggguuuaaaggauccuuccgaccaauuuggguaacucuugacaccgaggaucacaaggcaaaaaucuuucaggugguuccuauucccguggucaagaaaaagaagcuguga

SEQ ID NO: 54237 - RNA, 744 nt, Artificial Sequence
  derived and/or modified sequence opt3 from CEMP1__Homo_sapiens__NP_001041677
augggcaccagcuccacagacucucagcaagccgggcacagaaggugcucaacuucuaacacgagcgcugagaaucugaccugucucucccuucccggaucuccugguaagacagcaccacugccgggccccgcccaggcgggggcuggacagccuuugccaaaaggcugcgccgcagugaaggccgaagucgguauccccgcuccucacacuucgcaggagguucggauucacauacgccgauuacugucaugggcagccccaggggcuuguggacuacguagcacccccugcgcccucccucaagcgcugccacaggcaagaccgugucccgggaggugguucuuuccuggcugcagucuuccaacaggcggagcccagaccauccuguccuuguggacuuggcggcauuuccucaacugggcucugcagcaacgcgaagagaauagugguagagccaggcgggugcccccuguaccacgcacagcacccgugagcaaaggcgaagggucccacccgccucagaacucaaauggagagaaggucaaaaccauuacgcccgaugugggccugcaucagagucucacuagcgacccaaccguugcuguguuacgagccaagagagcgccugaggcccaucccccaaggucuuguuccgguucacugacagcacgggucugccacaugggggugugucagggacaaggcgauacugaagacggccguaugacccuuaugggguga

SEQ ID NO: 54238 - RNA, 450 nt, Artificial Sequence
  derived and/or modified sequence opt3 from CEND1__Homo_sapiens__NP_057648
auggagagcagaggcaaguccgccucuucacccaaaccugacaccaaggugccacaggucacaacugaagcuaaaguuccgcccgcagccgaugggaaggcgccucugacgaaaccaaguaagaaggaggcucccgccgaaaaacaacagccuccagcagcccccaccacagcuccugcaaagaaaacuagcgccaaggcugacccagcccuccuuaacaaucacuccaaccugaaaccggcgcccaccgugccuucuucgccagaugcaacacccgagccuaagggaccaggugacggcgccgaagaggaugaggcugccucagggggacccggcgguagggggccguggagcugcgaaaauuucaacccuuuguuaguagcaggaggcguggcugucgccgcgaucgcccugauucuaggcguggcauuucucguucggaagaaauga

SEQ ID NO: 54239 - RNA, 345 nt, Artificial Sequence
  derived and/or modified sequence opt3 from CENPA__Homo_sapiens__NP_001035891
augggccccagaaggcggagccgcaagccugaggccccacgacguagauccccgucucccaccccuacaccagggcccucaaggcggggaccuagucugggugcuagcucccaccagcauucucgcagaaggcaaggcuggcucaaagaaauccggaaacuucagaagucgacucaccuguugauucgcaaguuaccauucucacgacuggcagccgaggcguuucuagugcaucucuucgaagacgcuuaccugcuuacgcugcacgccgggagagucaccuuguuucccaaagauguucagcucgcaaggcggauacguggacuggaggaaggccuggguuga

SEQ ID NO: 54240 - RNA, 1800 nt, Artificial Sequence
  derived and/or modified sequence opt3 from CENPB__Homo_sapiens__NP_001801
augggccccaagagaaggcagcugaccuuccgggagaaaagccgcaucauucaagaaguggaggaaaacccugaccuccgaaagggggagauagcccguagauuuaauaucccaccguccacacuuucuacuauucugaaaaacaagagggcuaucuuggcaucagaacggaaauacggagucgccaguacgugccgcaagaccaauaaguuaagccccuaugauaaacuggagggucuacucauugcgugguuccagcagaucagagcugccggccugccuguuaaggggauaauccuuaaagagaaggcacugaggauugccgaagaguugggaauggacgauuuuacagcuuccaacggcuggcucgaccgguuccgccgaagacacggugugguaucuuguucggggguggcaagggcccgggcucguaaugccgcgccacgcacucccgcagccccugcuucaccagccgcaguccccagcgaaggaaguggcggcuccaccacaggguggagagcuagggaggagcagccuccaucuguggccgaaggauacgcgagccaagauguguuuuccgccaccgagacuucacugugguaugacuuccugccggaucaggcagcuggucucugcggcggggacggacggccccgacaggccacacagcgcuuaaguguucugcuuugugcuaacgccgauggcagcgaaaaauugccuccacuggucgcagguaagucugccaagcccagagcugggcaagcgggacuaccuugcgacuacaccgcaaauuccaaaggcggcgugacgacucaggcccucgcuaaguaucugaaagcccuugauaccaggauggcagccgagucacggcgcguacuguugcucgcugggagacuggccgcacagagcuuagacacaaguggacugaggcauguucagcucgcguuuuucccacccgguacugugcacccgcuugaacguggcgucgugcaacaggugaaggggcauuaccggcaggcuaugcuguugaaagccauggcagcccuagagggacaagauccuucuggccugcagcucggucugaccgaggcuuuacacuuugucgccgcagcuuggcaggccguugaacccuccgacaucgcggccuguuuccgagaggcuggguuuggcggaggcccaaacgcaacaauuaccacgagccugaagucggaaggggaggaagaggaggaagaggaagaggaagaggaggaagaggaaggagagggugaggaagaggaagaggaaggcgaggaggaagaggaagaagggggagagggcgaggaguugggugaagaggaagagguggaagaggagggggacguagauucugacgaagaggaagaggaggaugaagaguccucaagugaaggccucgaggccgaagacugggcucagggaguggucgaggccggcgggagcuucggagcauauggugcgcaagaggaagcccagugcccuacucugcauuuucuugagggcggggaagauuccgacucugauagcgaggaagaggacgaugaggaagaggacgaugaagacgaggacgaugacgaugacgaagaggauggagacgaggugcccguuccaucauucggcgaagcuauggccuacuucgcaauggugaaaagauaccugacaaguuuucccaucgaugacaggguccagucccacauacuacaccucgagcaugaucuggugcacguaacccgcaagaaucaugcucggcaggccgguguuagagggcuuggccaccaaagcuga

SEQ ID NO: 54241 - RNA, 2832 nt, Artificial Sequence
  derived and/or modified sequence opt3 from CENPC__Homo_sapiens__NP_001803
auggccgcuagcggccuggaccaccucaagaacggguacagaaggcgguucugccgccccucccgagcacgugauaucaauaccgagcagggacaaaacgugcuugaaauucugcaggacuguuuugaggaaaaaucuuuggccaaugauuucucaacaaacaguacuaagagcgucccuaauuccacgagaaaaauaaaggauaccugcauccagucuccaucgaaagagugucagaagucacaucccaagagcguucccgugaguuccaaaaagaaagaagcgucuuuacaauuuguaguggagccuagcgaggcuacaaacagguccguccaggcccacgaagugcaucagaagauucuggcaacugacguuucaaguaaaaauaccccagacagcaagaagaucucuucccggaacauuaaugaucaccauucagaggccgacgaagaguucuaucuaagcguggguagucccucuguccuccuggaugcuaaaacauccgugagccagaacguaaucccuucgucugcacaaaagcgcgagaccuacacuuuugaaaauuccguuaacaugcuuccaucaaguacagaggugagcgucaaaaccaagaaaagacugaauuucgacgauaaggugauguugaaaaagauagaaaucgacaacaagguguccgaugaggaagacaaaacgucugagggccaggagaggaagcccagcgggucaagucagaaucggauucgcgacuccgaauaugagauccagcgacaagccaaaaagagcuuuucuacucucuuccuggaaaccgucaaaagaaagucagagaguagcccuauuguuaggcacgcugccacagcgccaccgcacuccugcccgccugaugacacuaagcugaucgaagaugaguuuauaauugacgagucugaucagucguucgcaagccgguccuggaucaccauuccacguaaagccggaucacucaagcagcgcacaaucagucccgcugaaucuaccgccuuacugcaaggcagaaaaagcagggagaagcaucacaacauccuuccuaaaacguuggcaaacgacaagcauucccacaagccacaccccguggaaacuucacagccgagcgauaaaacaguacuggacaccucuuacgcucuaauuggugagacugugaauaacuaucgguccacaaaguacgaaauguauaguaaaaaugccgagaagccuagccgaucuaaacgcaccauaaagcagaagcagagaaggaaauuuauggcgaagcccgccgaggaacaacucgaugucgggcaguccaaagacgagaacauccauacgucacacauuacccaggaugaauuucagcggaauagugaccgcaacauggaggagcaugaagagaugggaaaugacugugugagcaagaaacaaaugccaccuguuggcucgaagaaauccucuacaagaaaggauaaggaagagagcaaaaagaaaagguucucaagugaauccaagaacaaacuggugcccgaggaggucacuucuaccgugacaaagagccgucggaucucccgaagaccaucagacugguggguaguuaagagcgaagagagucccguguacucuaauuccagcgucaggaacgaacuuccuaugcaccauaauucgucacgcaaaucuacuaagaaaaccaaccagaguuccaagaauauacggaaaaagacaauuccacugaagagacagaaaaccgcaacuaagggcaaccagagggugcaaaaauucuugaaugcugaggggagcggagguaucgucggccacgaugaaaucucucgcugcagccucuccgagccgcuggagucagacgaagccgauuuagcuaagaaaaagaaccuggacuguagucgaagcacgcggucuuccaagaacgaggauaauauuaugacagcccagaacgugccccucaaaccucagaccucaggguacacuugcaauaucccaaccgaaaguaaccuugacagcggagagcacaagacauccguucuggaagagucuggccccucgcguuugaauaacaauuaucuaaugagcgguaaaaacgauguggacgaugaggaaguacaugggucauccgacgauaguaagcagucuaaagucauuccuaagaauagaauacaccauaaacuggugcucccaagcaacacccccaauguuaggcgcacuaagcggacaagacugaagccgcuugaguacuggaggggagaacgaaucgacuaucaaggccgcccuuccggcggguucgugauuucaggaguccugucuccagacacgaucagcaguaaacggaaggcaaaagagaacaucgguaaggugaauaaaaaguccaacaagaaaagaauuuguuuggauaaugacgagaggaagaccaaccucaugguaaaccugggcauacccuuaggggauccucugcagcccacucgugugaaagacccagaaacacgcgagaucauucuaauggaucucguucggccucaggacaccuaccaauuuuucgucaagcacggagaacugaaaguguauaagacacuugauacucccuuuuucagcaccggcaaguugauccuggguccacaggaggaaaaagggaagcagcacgugggccaggacauucucgucuuuuacguuaauuucggagaucugcuuugcacgcugcaugagaccccguauaucuugucuacaggcgacucauuuuacgugccuuccgggaacuacuauaauaucaaaaaccucagaaaugaggaaagugugcuguuauucacucaaauaaagagguga

SEQ ID NO: 54242 - RNA, 7743 nt, Artificial Sequence
  derived and/or modified sequence opt3 from CENPE__Homo_sapiens__NP_001273663
auggccgaggaaggcgcuguggcagucugcguuagagugaggccccugaacagccgggaggaaucccucggggagaccgcccagguauacuggaagacagacaauaacgugaucuaucaagucgauggaucuaaaucauucaauuuugaccgcguguuccacgguaacgaaacuacgaagaauguuuacgaggagauugcggcuccuauaaucgauagugccauucagggcuauaacgggaccaucuuugcauacggacagacagccagcggcaaaacuuauaccaugauggguuccgaagaccaucuuggggugauuccacgagcuauccacgauauauuccagaagaucaaaaaguuuccggaccgugaguuccuguugagagucucuuacauggaaauuuauaaugagacaaucaccgauuuacuguguggaacucaaaagaugaaaccccuaauuaucagggaggacgugaaccggaauguauacguugcagaucucacagaagagguggucuacaccucggaaauggcccugaaguggauaacgaaaggcgagaagucacgccauuauggcgaaacuaaaaugaaccagagaagcaguaggucccacaccauuuuucggaugauccuugagucucgcgagaagggggaaccuagcaauugcgagggauccgugaaggugucacaucugaacuuggucgaccucgcugguagugaacgagccgcgcagacaggcgcagccgggguuagacugaaagagggauguaauauuaacaggagccuguucauccucggccaggugaucaagaaauuaucugauggucaaguagggggauuuauuaauuaccgggacuccaagcugacucguauacuucagaacucauugggcggcaacgcuaaaacccgcaucauuugcacaaucaccccagugagcuucgaugaaacgcugacugcccuacaguuugcaaguacagcuaaguauaugaaaaauacccccuacgucaacgaggugucuacugacgaggcccuccugaagagauauaggaaggaaauaauggaccuuaaaaagcagcuggaggaaguuuccuuggagacacgggcgcaagccauggaaaaagaucagcucgcacagcuguuagaggagaaggaccugcuccaaaaagugcagaaugaaaagauugagaaccuuacccgaaugcuggucacgagcucgucuuugacccuacagcaggaacugaaggcuaaacgcaagagaagggugacauggugucucgggaaaaucaauaagaugaaaaacuccaauuacgccgaucaauucaacaucccuacuaauauuaccacaaagacucacaagcugucaaucaaccuucugcgggagauugacgagaguguaugcagcgaauccgauguuuuuucuaauaccuuggacacacucagcgagauagaauggaacccagcuaccaaacuguuaaaucaggagaacaucgaaucagagcugaauagucuacgcgccgauuaugacaaccucgugcuggauuacgagcagcuuagaacugaaaaggaggaaauggaguugaaacugaaggaaaaaaacgaccucgaugaguucgaggcacuggaaaggaagacgaagaaagaccaggagaaugaacuuuccagcaaggucgagcuguugcgugaaaaagaggaccaaauuaagaaacuccaggaguacaucgauucucagaagcuggaaaacaucaaaauggacuuaucauauagucuggagagcauugaagaucccaagcagaugaagcaaacacuauucgacgccgagaccguggcucucgaugcgaaacgggaguccgcauuucugcgaucugaaaaucuugaguugaaggaaaaaaugaaggagcuggccacuaccuacaaacagauggaaaacgacauacagcucuaucagucgcaacuggaggcuaagaagaaaaugcaggucgauuuagagaaggaacugcagagcgccuucaaugagaucacaaaacuuaccuccuugauugacggaaaggugccuaaagaucuccuguguaaccuagaacuggaggguaagaucacugaccuccaaaaggaacugaauaaagagguugaggaaaacgaggcacuuagagaagaggugauuuugcugucagaauuaaagagucucccaucugagguagagaggcugcgcaaagaaauccaggauaagagcgaggaacuucacauaaucacauccgagaaagacaagcuguuuucagaggucgugcauaaggaaagccggguucagggcuugcucgaggaaauugggaaaacgaaggaugaccuggccaccacucagucuaauuacaaauccacagaccaagaguuccagaacuuuaagacccuacacauggauuucgaacagaaauauaagauggugcuggaggagaaugaaagaaugaaccaggagaucgucaaucucaguaaagaagcucaaaaguuugacagcucucugggagcccuuaagacagaguuguccuacaaaacucaggaacugcaggagaagaccagggaggugcaggaacgcuuaaacgagauggaacaacucaaagagcagcuggaaaaucgagauucaacgcuucagaccguagagcgggagaagacacugauuacugaaaaacuacaacagacccucgaggaagugaagacacugacucaggagaaggacgauuugaaacagcugcaagagaguuuacagaucgaacgugaccagcucaagagcgauauacaugacaccguuaacaugaacauugauacgcaggagcaacugagaaaugcacuugaaucgcugaaacagcaccaggagacaaucaacaccuugaaguccaaaauuucugaagaggucagcaggaaucuccacauggaggaaaacacuggcgagacaaaggacgaauuccagcaaaagaugguggguaucgauaaaaagcaggaccuggaggcgaaaaauacccagacucuaaccgcugaugugaaggacaacgaaauaaucgagcagcaacgcaaaauuuuuucacugauccaggagaagaaugaacuucagcaaaugcucgagagugucauugccgaaaaggagcagcugaaaacagacuugaaggaaaacaucgagaugacgauagagaaucaggaagagcugcgguuacucggggaugaacugaaaaagcagcaagagauuguugcacaggagaaaaaccaugccaucaagaaggaaggcgagcuuuccagaaccugcgacaggcuggcugaaguggaggaaaaauugaaggagaaaucucagcagcuccaagagaagcagcagcagcugcuaaaugugcaagaagagaugagcgaaaugcagaaaaagaucaacgagauugaaaaucugaaaaacgagcuuaagaauaaggagcucacucuggaacacauggagacagaacgauuggaguuagcccagaaacugaacgaaaacuaugaggagguaaaguccaucaccaaagaacgcaagguccucaaagagcugcaaaagucauucgaaacagagcgggaucaucuuagaggauacauuagggagauagaagcaacuggccugcagaccaaggaggaauugaaaaucgcucacauucaucuaaaggagcaccaggaaacgaucgacgagcugcgucgcagcgugagugagaaaacagcccagauuaucaauacccaagaucucgaaaagucucacacuaaacugcaggaggaaauaccgguucuucaugaggaacaggaguuacugcccaacgugaaggaggucuccgaaacccaggagacaaugaaugaacucgaguugcugacugaacaaagcaccacaaaggacucgacgacccucgcgcggaucgagauggagagacugaggcuuaacgaaaaauuucaggagucacaggaagagauuaagucucugacuaaagagcgagauaauuugaagacaaucaaagaagcccuagaggugaagcacgaccagcugaaggaacauauucgggagacccucgcuaaaauccaagaaagucaguccaagcaggagcagagcuuaaacaugaaagagaaggauaaugaaacuacaaaaauaguuucugagauggaacaauucaagccuaaagacagcgcacugcuucgcauugagaucgaaaugcuggggcucuccaagagauugcaggagucacacgaugagaugaagaguguggccaaagaaaaggacgaccugcagaggcuccaagagguacugcagagcgaaucugaucagcuuaaagagaacaucaaggaaauugucgcuaaacaccuagagaccgaggaagagcugaagguggcccauuguugcuugaaggaacaggaggagacgauaaaugaauuacgggugaaccuguccgagaaagaaacugagaucucaaccauucaaaagcagcucgaagcaaucaaugacaaacugcagaacaagauucaggagaucuacgagaaagaagagcaauuuaauauaaagcagaucagugaaguccaggagaagguuaacgaacuuaaacaguucaaggagcaccgaaaagcgaaggauagcgcccugcaauccauugagucuaaaaugcucgaauugacaaauagacugcaggagucgcaggaagagauccaaauuaugaucaaggaaaaggaggagaugaaacgcgugcaggaagcucuacagauagagagggaccagcugaaggaaaacaccaaagagauuguagccaagaugaaagagagccaagaaaaggaguaucaguuccucaaaaugacugcagugaaugaaacacaggagaagaugugugaaaucgagcaucuuaaggagcaguuugaaacccaaaaacugaacuuagagaacaucgaaacagagaauauucguuugacucagauccugcacgaaaaccucgaggagaugcggucagucaccaaggaaagagaugaccugagguccguggaggaaacgcuuaaaguugagcgcgaucagcugaaggaaaaucuccgagagacaauaaccagagacuuggagaaacaggaagagcugaagauugugcauaugcacuuaaaggaacaccaagagacuaucgauaaacuacggggaauugucagugagaagaccaacgaaaucucuaauaugcagaaagaccuggagcauagcaacgaugcucucaaggcccaggaccuuaaaauacaagaagagcugaggauugcacacaugcauuugaaggaacagcaggagacaaucgauaagcugcgcgguaucguguccgagaaaacugacaagcucucaaauaugcagaaagaccuggaaaacucuaaugccaagcuucaagagaaaauucaggaacucaaggcuaacgagcaccagcugaucaccuugaagaaagauguuaaugaaacgcagaagaaagugagcgagauggagcaacugaagaaacagauuaaggaccagaguuuaacacuauccaagcuggaaauagagaaccucaaucuugcgcagaaacugcaugaaaacuuggaggaaaugaagagcgucaugaaagagcgugauaaucugagacggguagaggaaacccucaagcuggagagggaccaacuuaaagaaucuuuacaggagacuaaggcccgcgaucuggagauccagcaggaacucaaaacagcacgaauguugucaaaggagcacaaggaaaccguggacaaacugagagagaagauuuccgaaaaaacuauccaaaucagugauauucagaaggaccuagauaaaagcaaggacgagcugcagaagaaacaagaucggcagaaccaccagguuaagccagagaaaaggcuccuuucggacggccagcaacaucugacagaaucuuugcgcgagaagugcuccagaauaaaagaacugcucaagagguacagcgagauggaugaccacuaugaaugccugaaccgguuaucacuugaccuggagaaggagaucgaauuccagaaagagcucaguaugcgugugaaggcuaaucuaucucugcccuacuugcagaccaaacauauugaaaagcuguuuacggccaaccagcgcuguuccauggaguuccaccgaaucaugaaaaagcucaaguauguccuuagcuacgugacuaaaauuaaggaagagcaacacgagucaaucaauaaauuugaaauggauuucauagacgagguagaaaagcagaaagagcuguugaucaagauucagcaucugcagcaagauugcgacgugccuaguagagagcucagggauuuaaaacugaaccagaauauggaccuucacaucgaagagauucugaaggauuuuagcgaauccgaguucccaucuaucaagaccgaauuucagcaaguccuaagcaaccggaaagagaugacacaguuccucgaggaauggcugaauacccgcuuugacauagagaaguugaaaaacgggauucagaaggaaaaugauagaaucugucagguuaacaauuucuuuaacaauaggauuaucgccauaaugaacgaguccacagaauucgaggagcggucagcuacuaucucuaaagaaugggagcaagaccugaagagucucaaggaaaaaaaugagaagcuuuucaaaaacuaucagacccugaagacgucguuagcaagcggagcccaggugaaccccacaacucaggauaauaaaaacccgcaugugaccucccgagcgacacaacugaccacugaaaagauuagagaguuggagaauucucuccacgaagcuaaggagucagccaugcauaaagaaagcaagaucauuaaaaugcagaaggagcuggaggucaccaacgacaucauagcaaaacuacaggccaaggugcacgaauccaauaagugccuugagaaaacaaaggaaacgauucagguucugcaagacaaaguagcucucggcgcaaagccuuacaaagaggaaaucgaggaucugaagaugaaauuggugaagaucgaccuggagaagaugaaaaacgccaaggaauuugagaaagaaauuagugcgacuaaggcuaccgucgaguaccagaaagaagugauccgccuccuuagggagaaucugcggcguucucagcaggcccaagauacaagcguuauaucagagcacaccgacccccagccauccaacaagccuuuaacuuguggugggggcaguggaauugugcagaauacaaaggcacugaucuugaaaagcgaacauauuagacucgagaaggaaaucucuaaacugaagcaacagaacgagcagcuaauaaaacagaagaaugaacuucuguccaacaaucaacaccucucaaacgaggucaagaccuggaaagagaggacgcugaagcgcgaagcccauaaacaggugacuugcgagaauagccccaagucgccaaaaguaacaggcaccgcuucuaagaagaaacagaucacccccagucaguguaaggaacggaacuugcaagauccugucccaaaagaguccccgaagagcugcuucuuugacucacgauccaaaucuuuacccagcccucacccagugagauauuucgauaacaguucccuggggcucugucccgagguucagaaugccggagcagaaagcguggacucucagccugguccauggcacgcuucaaguggcaaggauguccccgagugcaagacucaguga

SEQ ID NO: 54243 - RNA, 9345 nt, Artificial Sequence
  derived and/or modified sequence opt3 from CENPF__Homo_sapiens__NP_057427
augagcugggcccuggaggaauggaaggagggccuccccaccagagcacuucagaaaauccaagaacuggaggggcaguuggacaagcuaaagaaggaaaaacagcagaggcaauuccagcuggauucccuagaggcagcccuccagaagcagaagcaaaaaguggagaaugaaaagacugagggaacuaaucugaaacgggaaaaccagcgccuuauggagauuugcgagucucuggaaaagacgaaacagaagauaucacacgaguugcaggucaaggaaagucaaguuaauuuucaggagggucagcucaacagcggcaaaaagcaaaucgaaaaacuggagcaggagcugaagcgauguaaauccgaacucgagcguucucagcaggcggcucaaucggccgacgugucauuaaauccuugcaacaccccacagaagauuuucacaacuccgcugacccccagccaguacuauaguggguccaaauacgaagaucuuaaggagaaguauaauaaagaaguagaggagagaaagagguuggaagcugaggugaaagcccugcaggcuaagaaagcaucucaaacacuaccucaggccaccaugaaccaucgggacaucgcucgccaccaggccagcuccucagucuuuaguuggcagcaagaaaagacuccaagccaucucucuuccaauucacagagaacacccauuaggcgggauuucagcgcgaguuacuuuucuggagagcaggaagugaccccuucccgcagcacgcugcagaucggcaagcgagacgcaaacucgucuuucuuugauaauuccucaaguccacaccuucuggaccaauugaaagcccagaaccaggagcucagaaauaagauaaacgagcuggaauuaaggcugcaaggucaugagaaagaaaugaaggggcagguuaauaaauuccaggagcuccagcuucaacuggagaaggcuaagguggaauugaucgagaaagaaaagguccuaaacaaaugucgggaugagcuggugcguacuaccgcccaguaugaccaggcaagcacaaaguacacugcucucgaacagaaacugaagaaacuuaccgaggaucuguccugccaacgccagaacgccgagucugcgagauguagcuuggaacagaaaauuaaggagaaagaaaaggaguuucaggaggaacucucaaggcaacagcggaguuuccagacacuggaccaagagugcauccagaugaaagcccgauuaacccaggaacugcagcaagcaaagaauaugcacaacguacuacaggcugagcucgauaaacugacguccguuaagcagcagcuugaaaauaacuuggaggaauuuaagcaaaaacugugucgcgccgagcaggcuuuccaggccagccagauuaaggagaaugaacucagaaggucuauggaggaaaugaaaaaggagaacaaucugcuuaaaucacacagugagcaaaaggcacgggaagugugccaucuggaggccgaauugaagaacaucaaacagugucucaaucagagccagaacuuugcugaggaaaugaaggcgaaaaauacuucccaagagacaaugcugcgcgacuuacaggagaagauaaaccagcaagaaaauucucugacccuagagaaacucaagcuggcagucgccgaccuugaaaagcagagagauugcucgcaggacuugcugaaaaagagggagcaccauauugaacagcucaacgauaaacugagcaagacugagaaagaguccaaggcuuuacugucagcccuugaauugaagaaaaaggaguaugaagaacucaaagaagagaagacacuguucaguuguuggaaaucugagaaugaaaagcuacugacccaaauggagagcgaaaaagagaaccuccaguccaagaucaaccaccuggagacgugccuuaagacccagcagauuaaaucacacgaauacaaugagcgugugcggacauuggaaauggaccgagagaaccugagcguggaaaucagaaauuuacauaacguccucgauucuaaguccguugagguggagacucaaaaacuggcauacauggaacuucagcagaaggccgaguucagugaccagaaacaccaaaaggaaaucgagaauaugugccugaagaccagccaguugacaggacagguagaagaucucgagcauaaacugcaacuacugucuaacgagauuauggacaaggauagguguuaucaggaccuccacgcugaauacgagucccugcgcgaucuuuugaaaucaaaggacgccagucuggugacuaaugaagaccaucagcggagcuuacucgcauuugaucagcaacccgcgaugcaccacucguucgcuaacauaaucggcgagcagggcuccaugccuucugaaagaagcgagugcaggcuggaggccgaccagucacccaagaauagugcaauucuucagaaccgcgucgauucccuggaauuuucucuagagagccaaaagcagaugaacuccgaccuccagaagcagugugaagaacuggugcaaaucaaaggggagauagaagagaacuugaugaaggccgaacagaugcaucagucauucguugcugagaccagccagcgaauuaguaaacugcaagaagauacaucugcccaccagaauguggucgcagagaccuuauccgcucucgagaacaaggaaaaagagcugcagcuucugaaugacaagguggaaacugagcaagccgaaauccaggaguugaagaaaagcaaccaucuccuggaggauucgcuaaaggaacugcagcuucucucagagacgcugucuuuggagaagaaggagaugaguuccaucauuagccugaacaaacgggaaaucgaggaguuaacacaggaaaauggaacccucaaggagauuaacgcgucucugaaucaagaaaagaugaaccuuauacagaaaagcgaguccuuugccaauuauaucgacgagcgugaaaagucaauuagugagcugagcgaucaguacaaacaggaaaaguugauccuccugcaaagaugcgaggaaacugguaacgcuuaugaggaccuaucucagaaauacaaggcagcccaggagaaaaauuccaagcuggaaugucuucucaacgagugcaccucacugugugaaaauaggaagaacgaguuggaacaguuaaaagaggcuuucgccaaggagcaccaagaauuucugacaaaacucgcauucgcggaggaacgcaaucagaaccugaugcuugagcuggaaaccguacagcaagccuugcggagugagaugacugauaaucagaacaauagcaaguccgaggcuggcgggcuaaaacaggaaaucaugacacugaaggaggaacagaacaagaugcaaaaagagguuaacgaccuccugcaggagaaugaacagcuuaugaaggugaugaaaacgaagcacgagugccagaacuuagaaucugagccgauuagaaauucggucaaagaaagggagagcgagcgaaaccaauguaauuuuaagccccagauggaucuggaagugaaggagauaucacucgacuccuauaacgcccaguugguccagcuggaagcaaugcuccgcaauaaagagcugaaacuucaagaaagugagaaagagaaggaaugccugcagcaugaguugcagaccauccggggagaccuagaaacuucuaaccugcaagauaugcagagccaggagauuuccggccucaaagacugugaaaucgaugcugaggagaaguacauuucagguccucacgaauuaucuacaagccagaaugacaacgcccaucugcaaugcagucuucagaccacaaugaauaagcugaacgagcucgagaaaaucugcgagauauugcaggcagagaaguacgaacuggugacugagcucaaugauuccagaagcgaauguaucaccgccacgaggaaaauggcugaggaaguugggaagcugcuuaacgaggugaaaauucuaaaugacgauucuggacuguugcacggcgaguuaguagaagacaucccaggcggggaguucggagaacagcccaacgagcaacauccugucucacuggcgccacucgaugaauccaauaguuaugagcaccugacccuuagcgacaaggaggugcagaugcacuuugccgaacugcaggagaaauuccucucguugcagucugaacauaagauucugcacgaucaacauugccagauguccagcaagaugucagagcuacagacauacguugacagucugaaagcagaaaaccucgugcuuucuacuaaccugcguaauuuucagggugauuuagucaaggagaugcaauugggccuggaggaagggcucgugcccucccugagcucaaguuguguaccggacagcuccucucuuagcucccugggagacucaucuuucuaucgcgcucucuuggagcagaccggcgauaugagucuguuaucgaaccuagaaggugccgugagcgccaaucagugcuccguugacgaggucuucuguucuucacugcaagaggaaaaccucacacggaaagagacuccuagcgcucccgcaaaggggguggaagaacuugaaucccugugcgagguguacagacagaguuuggagaaacuggaagagaagauggaaucucagggcaucaugaagaauaaagagauacaggaacucgagcaacugcuuagcucagagaggcaggaacucgauugucugcgaaagcaguauuuguccgagaacgaacaguggcaacagaaacugaccagugucacguuagagauggaaagcaagcuagccgcggagaaaaagcagacagagcagcugucucucgaacuugagguugcucggcugcaauugcagggacuggaccucuccucacgcagccugcuuggcauugauaccgaagacgccauccaggggagaaaugagucgugcgauauuucuaaggagcacacaagugaaacaaccgagaggacuccaaaacaugacgugcaccaaaucugugauaaggacgcacagcaggauuuaaaccuggacauagagaaaaucaccgagacaggagccgugaagccuacgggugaaugcuccggcgagcagagccccgacaccaauuacgagccacccggggaagauaaaacucaaggaucauccgaguguauuucugaacucagcuuuaguggcccuaacgcuuugguaccaauggacuuccuggguaaucaggaggauauccacaaccuacagcugcgggucaaggaaacauccaaugagaaccuccgacuucugcaugugauugaggacagagaucgcaagguugagagcuugcugaaugagaugaaagaacucgacucuaagcugcacuuacaggaggugcaacuuaugaccaaaaucgaagcaugcauagagcuggagaagauugucggggaacucaaaaaggagaacucagaucuaagugaaaaacuggaguauuuuuccugcgaccaucaggaguugcugcagaggguggaaacaagcgagggccucaacucugaucuugaaaugcacgccgacaagucgucacgugaggauaucggagacaauguugcgaaggugaacgauagcuggaaagaacgguuccuggacguagagaaugaguuguccagaaucaggagugaaaaggcuucuauugagcacgaagcccuguaccucgaggcagacuuagaagucgugcagacugagaaacugugucuugagaaggauaacgaaaauaaacaaaaggugaucgucugccuggaggaagaauuaagcguugugaccuccgaacgcaaccagcuccgaggcgagcuggacacgaugucaaagaaaacaaccgccuuggaucagcugagugagaagaugaaagaaaagacucaggagcucgaaucucaucaaagcgagugucuucacugcauucagguagcugaggccgaagugaaagagaagaccgaacuguuacagacacuguccucagacgucagcgaguugcucaaggauaaaacucaucugcaagaaaagcuacagucucuugagaaagacucccaggcacugagucucaccaagugugagcuggaaaaucagauagcucaauugaacaaagagaaggaacugcucgugaaggagagcgaaucgcuucaggccagacuguccgagucugauuacgagaaauuaaauguuucaaaggcgcuggaagccgcauugguggagaaaggggaauuugcucuccggcugagcaguacacaggaggaaguccaccagcuaaggcgcggaaucgagaaacuucgugugagaauugaggccgacgagaaaaagcaacugcauaucgcugagaagcucaaagaacgggagagggagaacgauucccugaaggacaaaguugaaaauuuggagcgcgaauuacagaugucugaggaaaaccaggagcuggugauucucgaugcagagaauagcaaggccgaagucgagacgcuuaaaacccagaucgaagagauggcccgaucacugaagguauucgaacuagaccuggugacucucagauccgagaaagagaacuugacaaagcaaauacaggaaaagcagggucaacugagugagcuugauaaacugcucagcucuuuuaagucauuacuggaagagaaagaacaggcugagauccagauuaaggaggaauccaaaaccgcgguugagauguugcagaaucaacugaaggaacucaacgaggcaguggccgcucuuugcggcgaccaggagaucaugaaggccacugaacagagccuggacccgcccauugaggaagaacaccagcuacggaacucuaucgaaaaacugagggcacgccucgaggccgaugagaagaaacaauuguguguccugcagcagcuuaaggaaagugagcaccaugcugaccuguuaaaagggagaguggaaaaucucgagagggaacuggagauagcgcggacaaaccaggagcacgccgcauuggaagcugaaaauucgaagggagaaguagagacccugaaggccaaaauugaaggcaugacgcaaucccuccguggucuugagcuggauguggucacuauccgcagcgagaaggaaaaccuaaccaaugagcugcagaaagaacaggagcgaaucucagagcucgaaauuauaaacucuagcuucgagaauaucuugcaagaaaaggagcaggaaaaaguucagaugaaggagaaguccaguacagcaauggagaugcugcagacccaauuaaaagaacuuaacgagagaguggccgcucugcauaaugaccaggaagccugcaaggcgaaagagcagaaccucucaucucagguggaaugucuggaguuggagaaggcacaacugcuccaggggcuugaugaagccaaaaauaacuauauuguccugcagagcuccgugaauggccuaauccaggagguugaagacggaaagcaaaaacuggagaagaaggaugaagagauuaguaggcucaaaaaccagauccaggaccaggagcaauuaguaagcaagcugucccagguggaaggcgagcaccaguuguggaaagaacaaaaucuugagcugcggaaccucacugucgagcuggaacagaagauacagguguugcagucuaaaaacgcuucacugcaagauacacuagagguucuccagagcucguacaagaaucuugaaaacgagcuggaauuaaccaagauggacaaaauguccuuuguggagaaggucaauaaaaugacagccaaggagacugaacugcagcgcgagaugcacgaaauggcucagaaaaccgcagagcuccaagaggaacugaguggggagaagaacagauuggccggagaacuucagcugcuccuggaggaaaucaagucuagcaaagaucagcuaaaggaguugacgcuggaaaauucagagcucaaaaagucccuugacugcaugcauaaagaccagguggagaaggaaggcaagguaagggaggaaauugcugaguaucaacugcgguuacacgaggccgagaaaaagcaucaggcacugcuccuggauacaaacaaacaguacgaggucgaaauccaaaccuaucgagagaaguugacuucuaaagaagagugucuuaguagccagaagcuggagauugaccuccugaaauccucaaaggaggaacuaaauaacagcuuaaaggcgaccacacagauccuggaagaguugaaaaagacuaaaauggauaaucucaaguacgugaaccagcugaaaaaggaaaaugagagagcccaagguaagaugaaacuucugauaaagucuugcaaacagcucgaggaagagaaggaaauucugcagaaagaguugagucagcuucaagcugcccaggaaaagcagaagaccgggacgguuauggacacaaaaguggaugagcugaccacugagaucaaggaacuaaaagagacacucgaagagaagaccaaagaggcagacgaauaucuggauaaguacugcuccuuacugaucagccacgagaaguuggaaaaagcuaaggagaugcucgaaacucaggucgcccaucuguguucacaacagucuaaacaggacucccgcggaucgccucuucugggcccagugguucccgguccuagcccaauucccagugugacagagaagaggcucucuuccggccagaacaaagcaagcgggaagcggcaacguucaaguggaaucugggagaauggcagagggccgaccccugccacgccagaauccuucagcaagaaaucuaagaaagcugucaugucaggaauacaccccgcggaggauacugaaggcaccgaguuugaaccugaggguuugcccgaggugguaaagaaaggguucgccgacauuccaacaggaaagaccagcccuuacauccugaggcgcacaacuauggcaacccggacguccccacgacuugcugcccagaaacuggccuuaucuccacuaagucucggcaaggaaaaccuggcagagucgagcaagccgacagcugguggcuccagaucacagaaagugaagguugcccaaaggucuccugucgauagcgggacuauucugcgcgaacccaccacaaaaagugugccagugaauaacuugcccgagcgguccccuaccgacucaccaagagaaggacuccgugucaagaggggccggcugguacccucuccuaaagcggggcuugagagcaacggauccgagaauugcaaggugcaguga

SEQ ID NO: 54244 - RNA, 744 nt, Artificial Sequence
  derived and/or modified sequence opt3 from CENPH__Homo_sapiens__NP_075060
auggaggaacagccccaaaugcaggacgccgaugagccugcugacagcggcggggaagguagagcaggaggcccaccccagguggccggggcgcaggcugccugcuccgaggauaggaugacccugcuccuucggcugcgcgcacaaacaaagcagcaguuguuagaauacaaaucuauggucgacgccucagaggagaagacuccggaacagaucaugcaagagaaacagauugaagcuaagauagaggaucuggagaacgaaaucgaggaaguuaaaguggcauucgagauuaagaagcuagcccucgaccgaaugcgucugaguacggcucuuaaaaagaaucuggagaaaaucagcagacaguccucuguauugauggauaacaugaagcaccuccuggagcugaauaaacucauuaugaagucgcagcaagagucaugggacuuagaagagaagcugcuugauaucaggaaaaagcgguugcagcugaaacaggccagcgaaaguaagcuacucgagauacaaaccgagaaaaacaagcagaaaaucgaccuggauuccauggaaaauucugaacgcauuaagaucauuagacagaaccuucagauggaaaucaagauaacaacugugauucaacaugucuuucagaaucugaucuugggaagcaaagugaacugggcggaggacccugcacucaaggaaauuguucugcaguuagagaaaaauguggauaugauguga

SEQ ID NO: 54245 - RNA, 4017 nt, Artificial Sequence
  derived and/or modified sequence opt3 from CENPJ__Homo_sapiens__NP_060921
auguuccugaugcccaccagcuccgagcucaacucuggccagaauuuucuuacacaauggaugacuaacccuucaagagccggggugauccugaauaggggauucccaauuuuggaagcugacaaggagaaacgggcagccgucgauauaaguacgagcuuuccgaucaaggguacccacuucuccgacucuuuuucguucauuaacgaagaggauucauuacuggaagaacagaaacuagagagcaauaaccccuacaagccucagagugacaaauccgaaacacauacugcguuuccaugcaucaagaagggcccccagguugcugccugucacucugcaccugggcaucaagaggaaaauaaaaacgauuucauuccagaccucgccagcgaguuuaaggagggagcuuauaaagauccccuguucaagaaacuugaacagcugaaggaggugcagcagaagaaacaagaacaguugaagcgccagcagcucgagcaacugcagcgacugauggaagaacaggagaaacucuuaaccaugguauccggccaaugcacacugccuggucuuucauugcugccagacgaucagagucagaagcaccguagcccggggaauaccacuacaggagaaagagcaaccuguugcuuucccucuuacguguauccugacccaacgcaggaggaaacuuaccccuccaacauccuaucacaugagcaaagcaauuucuguaggaccgcccacggcgauuuuguccucacaaguaaacgggcuucuccuaaccuguucuccgaagcccaguaucaggaggcgccaguggagaagaauaaccuuaaagaagagaaucgcaaccaccccacuggcgaaagcauacugugcugggagaagguuaccgaacagauccaagaggcaaacgacaagaauuugcagaaacaugaugacucgucugagguggccaacauugaagagagaccgaucaaggcugccauuggggaaaggaaacagacauucgaggacuaccucgaggaacagauccaacuggaggaacaggaguuaaagcagaaacagcugaaggaagcagagggaccucuccccauaaaggcuaaaccaaagcaaccuuuucuuaaacggggugagggccuggcccgcuucaccaaugcgaaguccaaauuucagaaggggaaggaaucaaaauuggucacgaaccagaguacuagcgaggaucaaccccuauucaagauggaccgacagcagcugcagagaaaaacagcccucaagaauaaagaacugugugcagauaacccaauucuuaagaaggacuccaaagcuaggaccaagucuggaagcgugacucugucacaaaaacccaagauguugaaaugcaguaaucggaagucccucagcccuucuggccugaaaauccagacagguaagaagugugaugggcaguuucgugaccagauuaaauucgagaacaagguaaccucaaauaacaaagaaaauguuacggagugcccaaagccgugugauaccggaugcacaggcuggaacaaaacucaaggcaaggaccgcuuaccccugaguaccgggccugccagcagacuagcugccaaguccccaaucagggagacaaugaaagaaucugagucgagccucgaugugucccugcagaagaaacuugaaacuugggagcgggaaaaggagaaagagaauuuggaacuggacgaguuucucuuccuggaacaggcagccgaugagaucucauuuaguucuaacagcuccuucguccuuaagauucuggagcgagaccagcaaauaugcaagggacaccgcaugucaagcacccccgugaaagcugugccucagaagacaaauccagcggaccccaucucucauuguaacagauccgaagauuuggaccacaccgcaagggagaaagaaagugagugcgaagucgccccgaagcagcuccacagccugucuuccgcugaugaguuacgggagcaaccuuguaaaauucgcaaggccguucagaagucaacgagugaaaaccagacugaguggaaugcaagagacgaugaaggugugccaaacagcgacucguccacagauucugaggaacagcuggacguaaccaucaaacccagcacugaggauagggagcguggcauaucaagucgggaagacuccccucaagugugcgaugacaaggggcccuuuaaagauacccgaacacaggaggacaagagaagggacgucgaucuagaccucucugauaaagacuauagcuccgaugaaucaauuauggagagcaucaagcauaaagugagugaaccaucucgcuccagcucgcugucacuuucuaagauggacuucgaugacgagcggaccuggacugauuuggaggaaaaucuguguaaccacgacguugugcucggaaaugagaguacauacggcacgccucagaccugcuaccccaacaaugaaaucgguauucuggauaagacuaucaaaagaaagauugccccagucaaacgcggggaggacuuauccaagagcaggcgaucucggagcccgccuacauccgagcugaugaugaaauuuuuccccucacuuaagccaaagcccaaaagugauagccauuugggcaacgaacucaagcugaauauaucucaggaccaaccuccaggagacaacgcucguucccaggugcuaagagagaaaaucauugaacuggagaccgaaaucgagaaguucaaagccgagaaugcaucacucgcgaagcugaggaucgaacgcgagagugcucuugaaaaguugcggaaagagauugccgauuuugaacagcagaaggcaaaagagcuggccagaauagaggaguucaagaaagaggaaaugaggaaguuacaaaaggagcgaaaaguauuugaaaaguauacaacugcugcccgcaccuuccccgacaaaaaggagcgggaggaaauccagacgcucaaacagcagauugcagaucugagagaggaccuuaagaggaaggaaaccaaauggagcuccacacacucucgucugcgcucgcaaauccagauguugguucgggagaacacugaucucagagaggaaauuaaggugauggagagguuucgacuggacgcuuggaaacgggccgaagcgaucgagagcucacuagaagucgagaagaaagauaagcuggccaauaccuccgugcgcuuccagaacagucaaauaucuagcggcacacaggucgagaaauacaagaagaauuaucucccuaugcaggggaacccgccaagaagguccaaaucagcucccccucgggaccugggaaaccuugauaagggucaggcagccucuccacgagaacccuuggagccucugaauuuuccggaccccgaauacaaagaggaagaggaggaucaagacauccagggcgaaauuagccauccagacgggaagguggagaaaguuuauaagaacggauguagagugaucuuauucccuaauggcacucgcaaggaaguaagugcugaugguaaaaccauuacggucacauuuuucaacggggacgugaagcagguuaugcccgaucagagggugaucuacuauuacgccgcagcgcaaaccacucacacaaccuacccagagggccucgaaguccugcacuuuuccagcggacagauagagaaacauuauccugacggccguaaggagauuacuuuccccgaucagaccgugaaaaaucuuuuuccagacgggcaggaagagucuaucuucccggauggaacaauuguacgggugcaaagagacgguaacaagcugaucgaguucaauaacggccagagggagcuacacacggcccaguuuaagcgccgagaguacccugaugggaccguuaaaacugucuaugcuaauggacaucaagaaacaaaguacagaucaggccggauaagggugaaagacaaggaggguaacgugcucauggauaccgaacuguga

SEQ ID NO: 54246 - RNA, 810 nt, Artificial Sequence
  derived and/or modified sequence opt3 from CENPK__Homo_sapiens__NP_001253967
augaaccaggaggaccuggaucccgacagcaccacagaugugggcgacgucacuaauacggaagaggaacucaucagagagugcgaagagauguggaaggauauggaggaaugucaaaacaaacuuucccugauugggaccgagacauugacugacucuaaugcccaguuaucacugcuaauaaugcagguuaagugccucaccgcugaacugagucaguggcagaaaaagacaccugagaccaucccacuuacugaggaugugcugauuacauugggaaaagaagaguuccaaaagcucaggcaggaccuggaaaugguacugagcaccaaggaguccaaaaacgaaaagcucaaagaggauuuagagcgggaacagcgcuggcuggacgagcaacagcagaucauggaaucucuuaauguguugcacucggagcugaagaacaaagucgaaacguuuucagagagccgaauuuucaaugagcuaaagacuaagaugcucaacaucaaagaauacaaggagaaacugcuuaguacccugggugaauuuuuggaggaucauuucccgcuccccgaccguuccgugaagaaaaagaaaaagaauauacaggaaucuagcguuaaccugaucacauuacacgagaugcuggagauucucaucaauagacuuuuugaugugccucaugacccauaugucaagauuuccgacucauucuggcccccuuacguggaacuguugcuaaggaacggcaucgcacugcggcacccagaggaucccacucgcauaagacucgaagccuuucaucaauga

SEQ ID NO: 54247 - RNA, 1062 nt, Artificial Sequence
  derived and/or modified sequence opt3 from CENPN__Homo_sapiens__NP_001094095
auggacgagaccguggccgaguucaucaagagaacaauucugaaaauacccaugaacgaacucacuacgauccuuaaggcuugggauuuucugagcgaaaaucaguugcaaaccgucaacuucaggcagcggaaagaguccguugugcagcacuuaauucaucugugcgaagagaagcgcgcaucuaucucagacgccgcgcuacucgauauuaucuacaugcaguuucaccaacaucagaaaguaugggagguguuccagaugaguaagggcccuggggaagacgucgaucuguuugacaugaagcaguucaaaaauagcuuuaagaaaauacuucaacgagcucugaagaacgugacaguuuccuuccgugagacugaagagaaugccguguggaucagaauugcauggggaacccaguauacaaaaccaaaccaguacaagccgaccuaugucguguacuauucucagacucccuacgccuuuacaucgucaagcauguugaggcggaauaccccucuccugggucaagcucugacgaucgcaaguaagcaccaucagauuguaaaaauggaucuccgcuccagauauuuagacucucugaaggccaucguuuucaaacaguacaaccaaacuuuugagacccacaauagcacaacuccacuucaggaaagguccuugggccuggauauaaacauggacucacggauuauccacgagaauauuguggaaaaggagcgcguccagcgaaucacccaggaaacauucggggauuacccccaaccucagcuagaguuugcucaguauaaacucgagaccaaguucaaaaguggacugaacggcagcauccuugccgaaagagaggaaccacugagguguuugauuaaguucucuuccccucaucuccuggaggcguuaaagucacuggcacccgccgcucucgugugccggauacagaaacuucuguguuacagcgguagucacucucaagggacgcaggacccauccagcuggcagaaggauuuguaucuacuguuugugccgcucuacccccguugcuga

SEQ ID NO: 54248 - RNA, 885 nt, Artificial Sequence
  derived and/or modified sequence opt3 from CENPO__Homo_sapiens__NP_001186732
auggccggcauccuggcuagcgggcucggagugcuugcacaccuggagagauuggaaacccaggucuccaggucucggaagcaaucagaggaauuacagaguguucaggcccaggagggugcgcugggcacaaaaauucauaagcuacgccgacuccgugacgaacugagagcugugguaaggcaccggcgcgccagcgugaaagcaugcauagccaacgucgagcccaaucaaacuguggagaucaacgaacaggaggcucuugaagagaagcuggagaauguuaaagcaauuuugcaggccuaccauuucacggggcucuccggaaagcugaccucuagaggcgugugugucugcaucucgacagcuuuugaagguaaccugcucgauucauauuucguggacuuaguaauucagaagccucugaggauccaccaucacagcguuccaguguuuauaccgcuugaggaaaucgccgcgaaauacuugcaaacuaauauucagcacuuccuguuuagucuaugugaguaucucaacgcauacuccgggcggaaguaucaggccgaucgccugcagucugacuucgcugcccuucugaccggacccuugcaacgaaauccucucugcaaccuguuaaguuuuacauacaaacuggauccaggcggccaguccuuccccuuuugugcaagacuccuuuauaaggaccugaccgcuacuuugccuacagaugucaccgugacgugccaggggguggaaguccuaucaacuagcugggaggagcaaagggccagccaugaaacccuguucuguacaaaaccacuccaccagguuuuugcgucuuucacucggaagggagagaagcuggacaugucccuugugucauga

SEQ ID NO: 54249 - RNA, 807 nt, Artificial Sequence
  derived and/or modified sequence opt3 from CENPQ__Homo_sapiens__NP_060602
augagcggcaaggccaacgcuuccaaaaagaaugcacagcaacuuaaaagaaaccccaagaggaaaaaggacaaugaggaagugguccucucugagaacaagguucggaauaccgugaaaaagaacaaaaaucaccuuaaggaucugucaagugaagggcagacaaaacauacuaacuugaagcacggaaagacggccgcgagcaaacgcaagaccuggcagccuuuauccaaaucuacacgagaccaucugcagacuaugauggagucgguaaucaugaccauucuaucaaauagcauaaaggaaaaagaggagauccaauaccaccucaacuuccugaagaaacgucuucugcagcagugcgaaacauugaaggugccaccgaagaaaauggaggaucucaccaaugucaguucccugcugaacauggaaagagcuagggacaaggccaaugaggagggucucgcauuacugcaggaagagauugauaaaaugguggaaacuacagagcuuaugaccggcaacauccaaucuuugaagaauaaaauucagauccuggccagcgaaguugaggaggaagaggaacgggugaagcagaugcaucagauaaacuccucagggguccuaagucuccccgagcugagccaaaagacgcuuaaagcuccuacucugcagaaggaaaucuuggcacucauuccaaaccagaaugcccuguuaaaagaccuggauauccuccacaacucuucccaaaugaagucaaugagcaccuuuauugaggaggcuuauaaaaagcuggacgccaguuga

SEQ ID NO: 54250 - RNA, 1257 nt, Artificial Sequence
  derived and/or modified sequence opt3 from CENPU__Homo_sapiens__NP_078905
auggcccccagaggcaggcggcgcccucgaccacaccguagcgagggggcuagaagguccaagaacacccuggaacggacacauucuaugaaagacaaggcaggacagaaaugcaagccgaucgauguguucgacuuucccgauaauucagacgucaguagcauuggucgccucggcgagaacgaaaaagaugaggaaacuuacgagacguucgacccuccacuucacuccaccgccauauaugcggaugaggaagaguuuucuaagcauugugggcugucguugucaagcacacccccuggaaaggaagcuaaaagaaguuccgacacuucuggcaaugaggccagcgagaucgaauccguuaagauuucagccaaaaagccagguaggaaauuacggcccaucagugaugacagcgagucuauugaagaguccgauacccgccgaaaggugaagucagcagagaaaaucagcacacaaagacacgaaguaauaaggaccacugcuaguucugagcuguccgaaaagccugcagagagcgugacaucgaaaaagaccgggccacuaucugcccagccguccgucgaaaaagagaaccucgcuaucgaaucacagaguaagacgcagaaaaagggaaagauuagccaugacaaacggaagaaaucccguucuaaggccaucggcagcgauacuucagacauugugcacaucuggugccccgagggcaugaaaaccagugacauaaaggagcugaauauuguucuuccugaguucgaaaagacacaccuggaacaucaacagcgcaucgaguccaaaguguguaaggcggcaauugccacuuuuuacgucaacgugaaagaacaguucaucaagauguugaaagagagccagaugcucaccaaucugaagagaaagaacgcuaaaaugaucucugauauugagaagaaaaggcaacggaugauagaaguacaggacgagcugcuccgauuagaaccacagcugaagcagcuucaaacaaaauaugaugaguugaaggagcgcaagucaagucugagaaaugccgcauacuuucuaagcaaccucaaacagcuguaucaggacuacuccgauguucaagcucaggaacccaaugugaaggagaccuaugacucuucgagccuuccugcccuguuguucaaagcgaggacgcuccugggggccgaaucccacuuacggaacaucaaucaucagcuggagaagcuccuugaucagggauga

SEQ ID NO: 54251 - RNA, 819 nt, Artificial Sequence
  derived and/or modified sequence opt3 from CENPV__Homo_sapiens__NP_859067
augagaaggagccgguccucugccgcugcaaagcugcgcggccagaaacgaucaggggccagugcggcucccgccgcaagcgccgcugcagcccucgcuccuuccgccacccguacaagaaggucugcgucgcaagcaggaucaaagagccaggccguggagaaaccaccgagugaaaagccccggcuucgcagauccucuccuagggcucaggaggaagguccaggcgagcccccuccacccgaacuggccuuguuaccuccaccgcccccuccacccccuacuccagcaacgcccaccagcuccgcuucaaaccuggaccuaggggagcagcgggagcgcugggaaacauuccaaaaacgacagaagcucaccagugagggagccgcgaagcugcuucuggauacuuuugaauaccagggcuuggucaaacacacaggugggugccauuguggagccguuagauucgaggugugggcaagcgcugaccuccacaucuuugauugcaauuguucuauuugcaagaaaaagcagaacaggcauuucauaguaccggccucccgguuuaaacugcugaagggcgcugagcacaucaccacuuauacauucaauacccauaaggcccaacacacguuuuguaaacguugcggcgugcagucauucuacacuccucgcagcaaccccgggggauuugguauugcaccacacugucucgacgaaggcaccgucagaaguauggugacagaggaguucaaugggucugauugggaaaaggccaugaaagaacauaagacuaucaaaaacauguccaaggaguga

SEQ ID NO: 54252 - RNA, 267 nt, Artificial Sequence
  derived and/or modified sequence opt3 from CENPW__Homo_sapiens__NP_001012525
auggcccugagcaccaucgugucccagagaaagcaaauuaaaaggaaggcuccccggggcuuccucaaacgcgucuuuaagcguaaaaagccucagcuucgacuggagaagucuggggacuuguuaguucaccugaacugccuacucuucgugcauagacuggcagaagagucaaggacaaaugccugugcgaguaaaugccggguaauaaacaaggaacacgugcuugcugccgcaaaagucauccugaagaaaagccgcggauga

SEQ ID NO: 54253 - RNA, 636 nt, Artificial Sequence
  derived and/or modified sequence opt3 from CEP112__Homo_sapiens__NP_001032402
augugggccagccugucccucgaccaccccucugcuaaggagaaccaggcacuuagacugaucgaaaugagggaggaaaauggcaacgugccuaaaaccgagcaagccgggucauugaagccauuacgggauacaggaaaaaguaaucugaaggagaaaaaggcgaacagcaagcuaaaacagauugagaaggaguacacucagaaacucgcuaaguccucucagauaaucgccgaacugcaaacgaccauuucgucacuuaaagaggaaaauagccagcagcagcuggcagccgagcgccgauugcaagacguccgucagaaguucgaggaugaaaagaaacagcucaucagagacaacgaucaggcuauuaagguucugcaagacgagcuggaaaauaggaguaaccaggugcggugcgcagagaaaaagcuccagcauaaagaauuagagucccaagagcagaucacauauauacgccaggaauacgagacuaagcugaaaggucuuaugccggccucuuugagacaggaacuggaggauaccaucagcucccuaaagucacaaguaaauuuucuccagaagagggcuaguauucugcaggaagaacuuacaaccuaucagggccggcgcuga

SEQ ID NO: 54254 - RNA, 2883 nt, Artificial Sequence
  derived and/or modified sequence opt3 from CEP120__Homo_sapiens__NP_001159698
augcugguggucgaggccaaguucgacggcgaacagcucgcuaccgaucccguugaccacacagaucaaccugaguuugcaacugaacuugccugggagaucgacagaaaagcgcugcaucagcacagguugcagcggacgccaauuaaguuacagugcuucgcucuggauccggugaccagcgccaaagaaacaauaggguacaucguacuagaccuccgcacugcacaagagaccaagcaggcccccaaaugguaucagcugcuuuccaacaaguacacaaaguuuaaaucugagauucagaucucaauugcucuggaaaccgauacuaagccuccaguggacaguuucaaagcaaagggagcucccccucgagaugguaaagucccagccaucuuggccggccucgacccccgugauauaguggcgguucugaaugaggaagggggauaucaucaaaucggcccugcagaguacuguacagacagcuuuauuauguccgugaccaucgccuucgcuacgcagcuggagcagcucauuccaugcacuaugaaguuaccggaaagacagcccgaguuuuucuuuuauuacucucugcuugguaacgaugucaccaaugaaccuuucaacgacuugaucaauccaaacuuugagcccgaaagggccucggugcggauacgcucaagcguagagauucugagaguuuaucuagcacuccaaaguaagcugcagauccaccuuuguugcggggaccagucccugggaucuacagagauuccuuugacuggccuccugaaaaagggcagcaccgaaaucaaucaacauccagugacagucgagggggcuuucaccuuagaucccccgaacagggccaaacagaagcuggcgccuauccccguggaacucgccccaacggugggagucuccguugcacuucagcgggaggguauugacucacagagucugauagaauugaaaacucaaaaugagcacgagccugaacacagcaagaaaaaggugcuaacacccaucaaggagaaaacccugacuggcccaaagucucccacaguauccccugugccaucacauaaccagagcccgcccaccaaagaugacgcuacggaaagugaggucgaaucucuccaguacgauaaggacaccaaaccuaauccaaaggccuccagcucggugcccgcuucucuggcccagcuuguuacaacuuccaacgcaucagagguggccagugggcaaaagauugcugucccugcgaccagccaccauuuuuguuucuccaucgaucugcgcucuauacacgcauuggagauuggauucccaaucaauugcauccuccgauacagcuaucccuuuuucggcucagccgcuccgauuaugacaaacccuccaguggaaguaaggaaaaauauggagguuuuucugccccagaguuacugugccuucgacuuugcaacuaugccucaccaguuacaggauaccuuccugagaaucccccuacucguggaacuguggcauaaggacaaaauguccaaggaucuuuugcuggguauugcccggauacaacucagcaacauccugucuucagagaaaacacguuuucuugggaguaacggagagcagugcuggcgccagaccuauagcgaauccgucccagugauugcugcccagggcucuaauaacagaaucgcagaccugucguacacugucacguuggaggacuauggccucgugaagaugagggaaaucuucauuagcgauuccucacaagggguuagugcggugcagcagaagccuucuagccugcccccagcuccguguccuuccgagauacaaacagaaccccgggagaccuuagaguacaaagccgcacuggaacuagagauguggaaggaaaugcaggaggacaucuuugaaaaucagcucaaacagaaggagcuggcccacaugcaagcucuugccgaggaauggaaaaagcgagaucgcgagagagaaucauugguaaagaaaaaggucgcagaguauacuauucuggaaggaaaacuccagaagacccugaucgacuuagagaaaagggagcagcagcuggcuagcguggaaucugagcuucaacgggaaaagaaagaguugcaguccgagcgccagagaaaccuccaggaacugcaagauaguauuaggcgugccaaggaggacugcauccaucagguugaacuagagcggcugaagauaaaacagcucgaagaggauaagcaccgacugcaacagcagcuuaaugacgcggagaacaaauacaagaucuuggaaaaagaguuccagcaauuuaaggaucagcagaauaacaagccagaaauuagacugcagagcgagaucaauuuacucacacuggaaaaaguggagcuugagaggaagcuggaaucugccaccaaauccaaguugcauuacaaacaacaguggggucgcgcucucaaggagcuggcacggcuaaagcagagagaacaggagucacaaauggccaggcugaaaaagcagcaggaagaacucgagcagaugcgccugcgauaucuugcugccgaagagaaagacacugucaagacagaacggcaagaguugcuggauauucguaacgaguuaaauagacucaggcagcaggaacaaaaacaguaccaggacaguacggagaucgcaagcggcaagaaggaugggccccacggaucggugcuggaagagggccuugacgacuaucugacccgccuaauagaggagcgggauacucucaugagaacagguguauacaaccacgaggacaggauuaucuccgaacuggaucgacagauucgcgagaucuuggcgaaaucuaaugccagcaacuga

SEQ ID NO: 54255 - RNA, 3285 nt, Artificial Sequence
  derived and/or modified sequence opt3 from CEP128__Homo_sapiens__XP_006720119
auggccgagagcuccucugaaucagaccacuucagaugcagggaucggcugagucccugggcugcacgcagcacccaucgaggcacacguucccucccuacuguggaggucacggaaaagguuaacaccaucacaucuacucuucaggacaccucgagaaaucugaggcaaguggaucagauguuggggcgguaccgcgaguauucaaacggacaggccggugcgauugaacacuuaaaagagagccuggagcagaguauagaccaacuaagaucccagaggcuccugcgcaauucuggcgggcggagcaucuccguaacaucacuuagugcuagcgaucuggacggaggcaccgguucugaauugcaucacuuuccaccgacuucaccccucaaggauuacggggacccucagggaauuaaacgaaugagauccaggacaggcgugcgguucguccaggagaccgaugacaugacgcaacugcauggcuuucaccagagccugcgugaucucaguucugaacagauccgcuuaggggacgauuucaacagagagcuguccaggcggagccgaucggacgccgagacuaagcgcgcacuugaagaguugaccgaaaaacugaaugaggcccagaagcaagaagugguuucugacagaguggagaggcggcuacaggagcucgaacgcgagaugagaacagaaagggagcuggucgaacgucggcaggaucaacuuggacugauguccuugcagcuccaggaggcucugaagaaacaggaggcaaaggccgacgaacacgagggugcuauuaaaaacaaguuacgacaaacugaaaccgagaaaaaucagcuggaacaggagcucgagcuuucaagaaggcuguugaaccagagugaaggcagccgcgagacacuacugcaucaaguggaagaacuccggacccagcugacgaaggccgagggggauagaaagggacuucagcaccagguaucccaaaucucuaaacagcagagcaauuaucaggacgaacaaggcgaggauuggagguuucgccgagguguugaacgggagaagcaggaccuggaaaaacagaugucagauuugcgugugcaacucaacuucagugcgauggcauccgagcuggaggaagucaagagauguauggagaggaaagacaaggaaaaagcccauuuagcuagccagguggagaaucugacucgcgaacuagagaacggggagaagcagcagcuccaaaugcuggaucggcuuaaggaaauacagaaucacuuugacacaugcgaggccgaaagaaaacacgcagauuugcagaucucugagcugaccaggcaugcugaagacgccacuaagcaggcggagcgauaccucucagagcugcaacagagugaagcccuuaaagaggaagcagagaagcgccgggaggaccugaaauugaaggcucaggaaagcauuagacaguggaagcucaaacacaagaaacuggagagggccuuagaaaagcaauccgagacaguggaugaacugaccggcaaaaacaaucagauccuaaaggagaaggacgagcucaaaacgcagcuguaugcugcccuucaacagauugaaaacuugcguaaggagcugaacgauguccucaccaaacgcgcacugcaggaagaggaauuacauucuaaggaggagaaacugcgggacaucaagucgcaccaggccgaucuugaauuggagguuaagaauagccucgacacaauacauagacuggaauccgagcugaaaaagcaaucaaaaauucagagucagaugaagguggaaaaagcucaccuagaggaggaaaucgcggagcucaagaaaucucaggcacaagauaaggccaagcugcuugaaaugcaggagagcauuaaagacuuguccgcuaucagggccgaucuggcaaacaaguuagccgaggaggagcgagcuaaaaaggccguacucaaagaccugucagaucuuacugcacaggcuaagagccgggacgaagagaccgcgacaaucauuacucagcugaaguuggaacgcgaugugcaccaaagagagcucaaagaccugaccucuucccuacagagugucaagacaaaacaugagcagaauauacaggaacugaugaagcacuucaaaaaggaaaagagcgaagccgagaaccauaucaggacccucaaagcagaaucucuggaggagaagaauauggccaaaauucaccggggacaacuugaaaaguugaaaucccagugugaccgacugacugaggaauuaacgcagaacgagaaugaaaacaagaagcucaaacugaaguaccaaugccuuaaagaucagcuggaggagagagaaaagcacaucucaauagaggaggagcaucuacgcaggauggaggaagcucgucuccagcugaaagaccaguugcuguguuuagagacagaacaagagaguauucucggcgugaucgggaaggaaaucgaugccgcaugcaaaaccuuuagcaaggacucgguugagaagcugaaaguguucuccucuggaccagauauucacuaugacccccaucgguggcuugcugagagcaagacuaaacugcagugguugugugaggaacucaaggaaagagagaauagggagaaaaaucugcgccaccagcuaaugcugugccgacagcaacuuagaaaucucaccgaaaacaaggagucagaacugcaguguuuguuucagcagaucgagcggcaagaacagcuguuagaugagauucauagggaaaagcgcgaccuccuggaggagacacagcguaaagaugaagagauggguagucuucaagacagagucauagcccuggaaaccuccacucagguggcguuggaucaccucgagucuguaccugagaagcugagccuacuggaagacuucaaagauuuucgggacuccugcucaagcagugagaggacagacggccgcuacucuaaguaccgaguuagacggaacucccuucagcaccaucaggaugacacgaaauauaggaccaagagcuucaagggggaucgcacuuuccucgaaggaucgcacacaagaggccuggaccauucaucuaguuggcaagaucacuccagguuuuugagcucuccacgguucagcuacgugaacuccuuuaccaaacguacagucgcccccgacucagcuaguaauaaggaggaugcaacuaugaacgguaccagcucucagccuaaaaaggaagaguauggguccuga

SEQ ID NO: 54256 - RNA, 3135 nt, Artificial Sequence
  derived and/or modified sequence opt3 from CEP131__Homo_sapiens__NP_001009811
augaagggcaccagagccaucgggagcgugcccgagagguccccugcuggagucgaccugucucucacaggucuuccaccgcccguuucacggcgcccuggcagugcagccacuacgaaaccaauugugcgaagcguauccguggucaccgggucugaacagaagcguaaagugcuggaggcgacaggacccggcgguucgcaagcuauaaacaauuugagaaggucaaacagcacuacccagguuagucagccucgguccgggucuccacgccccacagaaccuaccgauuucuuaaugcuguuugagggaagcccauccggcaagaaaagaccggccucacuaaguacugcacccagcgaaaagggcgccacauggaaugugcucgacgaucagccuaggggguucacccugccaucuaacgcucgguccucaagcgcacuugacagucccgccggaccucgccgaaaggagugcacggucgcucuggccccaaauuuuacugcgaacaauagaucuaacaaaggugcagugggcaauuguguaaccacaaugguucacaacagguacacucccuccgagcgggccccgccuuugaaaagcucgaaucaaaccgcucccucucucaacaauaucauuaaagccgcaacaugcgaaggguccgagucaaguggauucggcaagcugccaaagaacgugagcuccgcuacccauucugcccguaauaacacgggugggagcacuggacugccucgcagaaaggaagucacagaggaggaagcggagagguuuauccaccaggugaaccaggccaccgugacuauucagcggugguaucgacaucaaguccagcgcagaggcgcaggcgcugccaggcucgaacacuuacugcaggcuaagcgggaggaacagcgccaaagaucaggggagggaacacuuuuggaucugcaucagcagaaagaggccgcaaggcguaaggcccgggaagagaaagcucgacaagcgagaagggcagccauccaggaacuacagcagaagcgcgcucuccgggcccaaaaagcaaguaccgccgagagaggucccccagaaaaucccagggagacgcgcguuccuggcaugcgacagccagcucaggagcuguccccgacccccgggggaacagcccaccaggcacuuaaggcgaacaauacuggcggugggcugccugcugccggcccaggagaccgguguuugcccaccagcgauucuucaccugaaccacaacagcccccggaggaccguacacaggaugugcucgcacaggacgccgcuggcgauaaccuggaaaugauggccccuaguagagggagcgcaaaauccaggggaccauuagaggaacugcuccacacucuucaacuguuggagaaggagcccgacguacuaccucgcccccggacccaucacagagguagguacgcuugggccucugaagaggaugacgcgucgagccugacagccgacaaucucgaaaaguucggcaaacuguccgcuuuuccagagccucccgaggaugggacccuucugucagaagcaaaguugcagaguauaaugucuuuccucgacgagauggagaaaagcggacaggaucagcuggacucccaacaggagggcugggugccagaagccgguccggggccuuuagagcugggcucagaggucagcacuucugugaugcgacuaaagcucgaaguugaggagaaaaagcaggcuaugcugcuuuugcaacgcgcccuggcacagcagcgggaucucacggcgagaagggugaaggaaacagaaaaagcccugucccgucagcuucaacgccagcgggagcauuaugaggcuaccauccagagacaccuggccuuuauugaccaguugaucgaagauaagaaaguccucagugagaagugcgaagcagugguagcugagcugaaacaagaagaccagagguguacugagcgaguugcccaggcacaggcccaacacgaguuagaaauuaagaagcugaaagagcuaaugagcgcuaccgaaaaggcgcggcgcgagaaauggaucucugagaagaccaaaaagauaaaggaagugacagucagaggacucgagcccgaaauucagaaacugaucgccaggcauaagcaggaggugcggcgacuuaaauccuugcacgaagcagagcugcuccaaucagaugagagagcuagucagcgcugccugaggcaggccgaagaguuacgugaacagcuggagcgggaaaaggaggcccuuggccaacaggagagagaaagggcucgccagcgacagagagcagaguuggaagaacuccggcaacagcuggaagagagcucguccgcccuaacuagggcgcugcgcgcugaguucgaaaaagggcgugaggaacaggagagacggcaucagauggagcucaacacacugaagcaacagcuugaauuggagaggcaggccugggaagcaggacgcacgcgaaaagaggaagccuggcuguuaaauagagagcaggagcuccgggaagagauuaggaagggucgcgacaaggaaaucgagcuggucauccacagacuugaagcugauauggcacuggccaaagaggagucugaaaaggcggcugagagcaggauuaaacgguugcgugacaaguacgaagccgagcucucagaacuggagcaaagugagcgcaaacuacaggaacgauguuccgagcugaagggccagcucggggaagcagagggagagaaccugagacuucaaggcuuggugaggcagaaggaacgggcccuggaggacgcucaggccguuaaugaacaguuaucuagcgagcgcuccaaccucgcacaagugauaagacaggaauuugaggauaggcuggcugccucagaggaagagacccggcaggcgaaagccgaacuugcaacucugcaggcucgacaacagcuagagcucgaagagguacauagacgcgucaagacagcccuggcuaggaaagaggaagcagugagcaguuugcggacccagcacgaggccgccguuaagcgugcugaccaccuggaagaguuacucgaacagcauagaaggccaacacccucuacuaaauga

SEQ ID NO: 54257 - RNA, 3423 nt, Artificial Sequence
  derived and/or modified sequence opt3 from CEP135__Homo_sapiens__NP_079285
augaccacagccguggagagaaaguacaucaacauuaggaaacggcuggaccagcucggcuaucgccaaacucuuacggucgaaugccugcccuugguugagaaguuauucagcgaucuggugcacaccacagaaucccuacgacagucuaaacucucagcuguaaaggcagagaaagaaagugccaauuuugacuucgugcuggagccuuacaaacuugagaacgcgcgucugagcagagaaaauaacgaguuguaucucgaacugaugaagcugagggagcauuccgaucagcacgucaaagagcucaagacuucuuuaaagaagugugcucgggaaaccgccgaccugaaauuucuuaauaaccaguacgcacauaaguugaagcugcuagagaaagaaucgaaggccaaaaaugagcgcauacaacagcuccaggaaaagaaccugcacgcugugguucagacaccaggggguaaaaagagaucaaucgcauucaggcggcaacgcaugcagauugaugagccggugcccccuagcgaggucaguuccuauccagugccccagccugacgauccauacaucgccgaccuucugcagguagcugauaaucgaauccaagaauugcagcaggagguucaucaacuccaggaaaaacuggccaugauggagucuggagugagagacuauagcaagcagauugaauuaagggagcgggagauagaacgucuguccgucgcgcucgauggcgggcgcucacccgacgugcuuagucuggagagcagaaacaagaccaaugaaaaauugaucgcacaccuaaacauucagguggauuuucugcaacaggccaauaaggaccucgagaaaaggauccgggaacugauggagacuaaggagacagucaccucugaaguugugaaccuuuccaauaaaaacgagaagcugugccaggaauugacggagauugaccagcucgcucaacagcuggagcgacacaaggaagagguauuagaaacugccgauaaagagcugggagaagcaaagaaagagaucaagcgcaaacuaucagagaugcaggaccucgaagagaccauggcuaagcugcagcuugaauugaaccugugucaaaaggagaaagaaagacucagcgaugagcugcuugugaagagugaccuggagacagucgugcaucaguuggaacaggagaaacagaggcucucuaagaaaguugaauccuucgccgugacugagcggcaacugaccuuagaagucgagcgcaugagacuggagcacggcauaaagaggcgugaucggagcccuucgcgacuagacacauuucucaaggguauugaagaggaaagagauuacuacaaaaaggagcuggagaggcuucagcauaucauucagcgccggucuugcuccaccucauauagugcgagagagaaaagcuccaucuucaggacgccagagaagggggacuacaauucugaaauccaccaaauuacucgcgagcgagaugaauugcagcggaugcuggagcguuuugagaaauauauggaagacauacagagcaacgugaagcuccugacagccgagagagauaaauuaucaguacuguacaaugaagcacaggaggaacuuagugcuuugaggaaggaguccacccaaacuacagccccgcacaacaucguuagccucauggagaaggaaaaagagcuggcucuaucugaccugcgccggauuauggccgaaaaggaggcacucagagaaaaacuggagcauaucgaggaagugucacuuuucggaaagagugaguuggagaaaaccauagaacaccugacgugugucaaucaucaguuagagagcgaaaaguaugagcucaaguccaaagugcugauuaugaaggaaaccaucgagucucuugaaaacaaacugaagguccaggcccagaaauuuucgcacguggcuggcgacagcucccaucaaaagacagagguuaauucauugaggaucgugaacgagcagcuccagcgaaguguagaugacuaccagcaccgccugucuauuaagcggggcgaacuagagagcgcgcaagcacagaucaaaauucuggaagagaagauagaugaacucaaucugaaaaugacuucccaggacgaggaggcccacgucaugaagaaaaccaucggggugauugauaaggaaaaggacuuccuucaagagacaguugaugagaaaacugaaaagaucgcuaacuugcaggaaaaucuggccaacaaagagaaggcaguggcccagaugaaaaucaugauuucagagugcgaaagcucugucaaucaguuaaaggagacccucgugaacagagacagggaaauaaauucccugcgucgccaacuugaugcugcccauaaagagcuggacgagguaggacggaguagagaaaucgcauuuaaggagaacaggcgacuacaggaugaccucgcgacaauggcucgggaaaaccaggagauuagccuggaauuggaggccgcagugcaggagaaggaagagaugaaaucucgcguucacaaguauaucaccgaagucuccagaugggagucacugauggccgcuaaagaaaaggagaaucaagauuuacucgacagguuccagaugcugcauaaccgggccgaggacugggaagugaaagcacaccaggcugagggugaaaguagcucggugcgacuugagcuguuguccauugauacugaaagacgccaccucagggagcgugucgagcugcuagaaaaggagauccaggaacauauaaaugcccaccaugcguacgagucucaaaucagcucaauggccaaggcuaugagucggcuggaggaagaacuuagacaccaggaagacgagaaagcaacgguucucaacgaucuguccucuuugagggaacuguguauuaaguuagacagcggcaaagauaucaugacacagcagcucaauuccaagaaccuggaguucgagcgcguggugguagaacuugagaaugucaaaucagaaagcgaccuguugaagaagcaacucaguaacgagcgacauaccgugaaaaaucuggaaucucuacuggccacuaacagagauaaggaguuucacucccaccuuaccagccaugagaaagacacagaaauucagcuccugaaggagaaauugaccuuaucggaaucaaagcugacuucucagagucgggagaauacaaugcucagggcuaagguugcccaacugcagacggauuacgacgcacuuaaacgccagaucuccaccgaacguuaugagagagagcgggcgauacaggaaaugaggcgccacgggcuggccacucccccuuugagcucuacacuacgaagcccaucccauucacccgagcacagaaacguguga

SEQ ID NO: 54258 - RNA, 4965 nt, Artificial Sequence
  derived and/or modified sequence opt3 from CEP152__Homo_sapiens__NP_055800
augagccuggacuucggcuccguggcccuccccguccagaacgaggaugaagaguacgacgaagaggauuaugaaagagagaaggagcuucaacagcuguugaccgacuuaccucacgauaugcuggacgaugaccuaucuucaccagaacuccaguacagugauugcagcgaggacgggacagauggacagccgcaucaccccgaacaacuggagauguccuggaaugagcagaugcuuccuaaaucucagucgguuaacgguuauaaugaaauccagucacuguacgcuggcgagaagugugggaacgugugggaagagaauaggagcaaaacugaagaccggcauccaguauaucaccccgaggagggaggcgaugaaggugggaguggauacuccccuccaucuaagugcgagcaaacggacuuguaucaucuccccgaaaacuuucgcccuuacaccaauggccagaaacaggaguucaacaaucaggcaacaaacgugauuaaguuuagcgacccacaauggaaucacuuccagggcccguccugucaggggcuggaacccuacaacaaggucacuuauaaaccuuaccaaucaagugcccagaauaacggaagcccagcgcaggagauaaccgguucugauacauuugagggccugcagcaacaguuccucggggcuaaugaaaacuccgccgagaacaugcagaucauucaguuacaagugcugaauaaggcaaaagaacgacagcuugagaacuugaucgaaaagcugaaugagucagagcgucagauuagauaucuaaaccaccagcucguuaucauaaaagacgaaaaggauggacugacccuuagccugagggagagucaaaaguuguuucagaauggcaaagaacgggagauccagcucgaggcccagauuaaggcucuggaaacucaaauccaggcauuaaaagugaacgaggaacagaugauuaagaaaucucgcacaaccgagauggcccuggaaucccucaagcaacagcuugucgaccugcaucacagcgagucguugcagagagcuagggagcagcaugaaucuaucgugaugggucuaacgaaaaaguacgaggaacaaguacugucccuccagaagaaucuggaugccacuguuaccgcgcuuaaagagcaggaagacauaugcucacggcugaaggaucacgugaaacaguuggagcgcaaccaagaggcaauuaagcucgaaaagacagagaucauuaauaagcugacucgaaguuuagaagagagccagaagcagugugcccaucugcuacaguccgggucuguccaagaaguggcucagcuccaguuccaacugcagcaggcccagaaagcacacgcuaugagcgccaacaugaauaaggcgcuucaagaggaguugaccgaacugaaagacgagaucucacucuaugaaagugccgcaaagcugggaauccaccccuccgauagcgagggcgagcuuaacauugaacugacagagucuuacguggacuugggcaucaaaaaggucaauuggaagaaaucaaagguuaccaguauagugcaggaagaggauccuaacgaggagcucagcaaagacgaguuuauucugaaguuaaaagcugaaguacagagacugcuaggguccaauucuaugaagaggcaucucgugucgcagcugcaaaacgaccuuaaggauugccacaaaaagaucgaggacuugcaucaggucaaaaaggaugagaaaagcauagaaguggaaacgaagacugacacauccgagaaaccaaagaaccagcuguggcccgagucaaguaccucugauguugugcgggacgauauucuccuguuaaagaaugaaauccagguccugcaacagcagaaccaggagcuuaaagaaacugagggaaaguugcguaauacaaaccaagaccucuguaaucagaugcgccagauggugcaagauuucgaccacgauaaacaggaagccguagacagaugcgagaggaccuaucagcagcaccaugaggcuaugaagacgcaaauccgggaaagccugcuagccaaacacgcacuggagaagcagcagcucuuugaagccuacgagcgaacccaucugcagcuucgcuccgaguuggauaagcugaacaaagaaguuacagcugugcaagaguguuacuuagaagucugcagagagaaggacaaucucgaacugacucuuaggaaaaccacagagaaggagcagcagacucaggagaaaauuaaggaaaagcugauccaacaguuggaaaaagaguggcagucaaagcucgaccaaaccauuaaagcgaugaagaaaaagacacuggauugugguagccagaccgaccaggugacuacgucugaugucauauccaagaaagaaauggcaaucaugauugaggagcagaagugcacaauccaacagaaccuagaacaggagaaagacaucgccauuaagggcgcuaugaaaaagcuggaaauagagcucgaacugaaacacugcgagaauaucaccaaacagguggagauugccguucaaaacgcacaccagcgguggcuuggggaauugccggagcuggccgaauaucaggcuuuagugaaggccgagcagaaaaagugggaggaacaacaugagguaagugucaauaaacgcaucagcuucgcagugucugaagcgaaggagaaauggaaguccgaacucgagaacaugagaaagaauauucugccuggaaaagagcuugaagagaagauccacucacugcagaaagaacuagagcucaagaacgaagagguucccguggucauaagggcugagcuggccaaagcacguagugaauggaauaaggagaagcaggaagagauccaucggauucaggaacaaaacgagcaggauuaccgacaguuuuuggacgaucacagaaacaaaaucaaugaggugcuggccgcugccaaggaagacuucaugaaacaaaagacugaguuacuccugcagaaagaaaccgagcuucagacaugucuggaucagagcaggcgcgaguggaccaugcaagaagcaaagcggauucaguuggagaucuaucaguacgaagaggacauacucacuguacugggcgugcuacugucggauacacagaaggaacauauuuccgacucugaggauaaacaacuucucgagaucaugagcacgugcucaaguaaguggauguccguucaguauuucgaaaaacugaaggguuguauucagaaggcuuuucaggacaccuugccacuguuagucgagaacgccgacccugaauggaagaagagaaauauggcggagcucucuaaagauagcgccucccaagggacuggccagggagaccccggcccagcugcagggcaccacgcccagccccuggcacuucaagccacagaagcagaggcggaggaaaacaauaaggugguggaggaacugaucgaggaaaacaaugauaugaaaaacaaguuggaggagcuccagacccugugcaaaacaccuccaaggucacuaagcgccggagcuauagaaaaugccugucugccgugcagugguggcgcacuugaggaacuccgcgggcaguacaucaaggcugucaaaaagauuaagugugacaugcugcgauauauccaggagucuaaagagcgggccgcagaaaugguuaaggccgagguguugcgugaaagacaagagacugcuaggaaaaugcgcaaguacuacuuaauuugccugcagcagauccuccaggaugacggaaaagaaggcgcggagaagaagauaaugaacgccgcauccaaacuggcuaccauggccaaacuucuggagacgcccauuagcucgaaaucacaaucuaagaccacacagagugccuugccucuaacuuccgaaaugcugaucgcugugaaaaagagcaagcggaaugauguaaaccagaaaaucccauguugcauugagucuaagagcaauuccgucaacaccaucacaagaacucucugugaacaggcacccaaaaggcgagccgcgugcaaucugcaacgccuuuuagagaacucagaacaucagaguauuaagcacguggguagcaaagagacccaucuggaguuccaguuuggggacggcucuugcaagcaccucaacuccuugccucggaauguuucaccagaguucgugcccugugaaggagaaggcggguuuggacugcauaagaaaaaggaucuccugagugacaacgguagcgagucccuuccgcacucugcugccuauccuuuccugggcacguuggggaauaaaccaucgcccagaugcacaccuggacccagcgaaucaggcuguaugcacauaaccuuuagggauuccaacgagcgucuaggucugaaggucuacaaaugcaauccacucauggagagugaaaacgcagccucugaaaagagccaaggguuagacgugcaggaaccucccguuaaagacggcggagaucuguccgacugucuuggcuggccaucaucuagcgcuacucugaguuucgauucccgcgaggcuagcuuugugcaugggcggccgcagggaacacucgagaucccuucugaaucaguaaaguccaagcaguucagucccagcggcuauuugucggacaccgaggaaucuaauaugauuugccaaacuaugaaaugucagagauaccagaccccauaucuguccgaggaaacaacguaccucgagcccgguaagaucagcgucaacugcgggcacccuucaaggcauaaagccgaucgacugaagagugacuuuaaaaagcuaucuuccacccuuccaagcucagugugucagcaacccagucggaagcugauugugccuuugagcucccagcaggauucuggauucgacagcccguuugucaauuuagauuga

SEQ ID NO: 54259 - RNA, 4212 nt, Artificial Sequence
  derived and/or modified sequence opt3 from CEP162__Homo_sapiens__NP_055710
auggccaacugcagccaggaggaacuggacgaggaauuugagcaauuuaugaaggaacucuccgaugacucuuucgagaauagcgauaaaaccgcuagacagaguaagaaagagaugaagaaaaaggacacagugcccugguggaucacugaagaugacuuuaaggaugacggccuucuggggacgaacgucagcuacuugaaaaccaagaaaacaucccagccuguuauggagauugaagaggagucugcagaaaagauacaguucuuaaaaucgucaggaacuagccugcuaaguaccgauucccucgagacaaaugaacuggugguaucugagcuuaaccacagcucccugggugugggcuuggacacccucgaagaacaggaggaaaaggagcaguuuuucgccaggcuggaaaaggggcugacuucaaguaucgauuauagccggcucaauaaagaguuagacucuaacgauuccacacauuuuaaggcgcugcacucaaaucaggcuaacgccgaacuuaccgacgacgagcaugagaaugaaagcaaacacgaggaauuggcagagaacuacagugaugacuucgaagaugaguaugucggagccccacugacgacuaaggacgaggaaaugccgucuaaagagaacuccaagagcgagaaaauuucggugcccaagcaggaggaggaaaagaccggcaugcuagcuaacguugugcuccuggauucucuugacuccgucgcagaggugaaucuggaugaacaagacaaaaucacaccuaagccacgcuguuugcccgagaugacugaaaacgagaugaccgguacagggguaucauacggacagaguagcuccgauguugaggcccuccaucaggcuuauugccacauugcccacucucugggcgacgaagauaaacagaagaucgagagcaauaccguggaagacauaaaaucaagugucaagggccauccucaagagaacgaagagaacuccaagaauaucagcacgauggagucugacuuaccaacuguggaggagcugaugaaacccauucgaaucgauucauuugggauuaguggauucgaccuccagccugugagcuccgaaaaggucgcggagcguaaagaaacagaguuuuucucuucgcuuccacugaagaugaacccgaauaucuugagccaggauucccaacacguuaaccuauuuuucgacaaaaaugaugagaacgugauacugcagaagaccacuaaugaaucaauggagaacaguuguccccagguaacagaagugaccgcaacggaggagcaugucgacaagauguaccucaauauucugaggaaaaagaucaccgugaacucuagcucccuuucacaggaugacaaaauuaauaagacauauagaucacaacugucuuccgaagaagaaggugccguuaugggcaaacaagugccuuacaagaaggcucggagugccccacccuugcucaaacgcaagccucagagcgggcuguacgcaucugucagauccucaggauauggcaaaccaaguagccccuuaaagauguucucgacucuggagaaaaagaccuccgaagauaucaucaaaucuaagaaucuaaggagcauuucaacaaguaaucagccgcggaagaaagagauacucuccgguacuaagcugaucaaaccugcugcccuugacaagcccgcgcacaaaaccgagucuugcuugagcacacgcaagaaguccgaaaacccaaccgagacugauucauguauucaauuccagacggacagccugggguacugcggagaaaauaaagagaagaaacuccugauguucaagcgagugcaggaagccgaggauaaauggagaggcgcacaggcucuuaucgagcaaauaaaggccacauuuagugaaaaggagaaagaacuggagaacaaguuggaggaacucaaaaagcagcaggagaaagaacuguucaaguuaaaccaggacaauuauauucugcaagcuaagcuaucuuccuuugaggaaaccaacaaaaagcagagguggcuccacuucggcgaggccgcagacccuguaacuggggagaaacugaagcagauccaaaaagaaauccaggagcaggaaacccuuuugcagggauaccaacaggagaaugaacggcuguauaaccagguuaaggaucuccaggagcaaaauaaaaagaacgaggaacguauguuuaaggagaaucagagccuguucucggaaguggccucauuaaaagagcagaugcauaagucucgcuuucugagucaggucguggaagacuccgagcccacaagaaaccaaaauuucaccgaucuuuuggcugagcucaggauggcgcagaaagaaaaggacagccugcuagaggauauuaaacggcugaagcaggacaagcaagcacucgaagucgauuuugagaaaaugaagaaagaacgagaccaggccaaggaucagaucgcuuacgugacuggugagaaacuguaugagauuaagauacuugaagagacacacaagcaggaaaucucucgcuugcagaaaagacugcaaugguacgccgagaaccaggaguuacucgacaaggaugcacugaggcuucgggaagccaaugaggaaauugagaaacugaaguuggaaaucgagaaacucaaggcugagagcggcaacccauccauccgccagaagauuagacugaaagacaaggccgcagaugcgaaaaagauacaagaccuagaaaggcagguuaaagagauggaagggauccugaagcgucgguaccccaauucacucccugcucugauucuugccgcaagugccgcuggagacacgguggauaagaacaccguagaguucauggaaaaacgaaucaagaaauuggaggccgaccuggagggcaaggaugaagacgcuaaaaagagcuuaagaacuauggagcagcaguuucagaaaaugaagauucaauaugaacagaggcucgagcagcaagaacagcugcuugcauguaagcugaaucagcaugauucuccacgcaucaaagcccuagagaaggagcucgacgauauaaaagaagcgcaccaaaucacaguccggaaccuggaggccgaaauugacguguugaagcaucagaacgcugagcuggauguuaaaaagaaugacaaggaugacgaggacuuccaguccaucgaguuccagguggaacaagcacacgccaaagcuaaguuagucagacucaacgaggaacuggccgcgaaaaagagggaaauucaggaucuuucaaaaaccguggagcgccugcagaaggaccgacggaugauguugaguaaucagaacagcaagggucgugaggaaauguccgcaaaaagagccaagaaagauguacuccacucuucgaaggggaaugcuaacagcuuuccgggcacacuggacucaaaacuauaccaaccccauacuuucaccgauucccacgugagugagguucugcaggaaaauuauaggcuuaagaacgagcucgaaggacugaucucugagaagaaugaguugaaaaugaaaagcgaagccgucaugaaccaguuugagaacuccaugcgccgggugaaggaagacacggcagcucauauagccucacugaaggcaucucaccagagagagauugaaaaauuacucugccaaaaugccguggagaauagcaguuccaaggucgcugagcugaacaggaaaaucgcgacccaggaaguucuuauucgacacuuccagagccaagugaaugagcugcagucuaagcaggaaucauuggugguauccgagguccgcgaggaaauccuccagaaggagauaacaaaacugcuagaggaacugcgggaagccaaggagaaccauacuccugagaugaaacacuuugugggccuugaaaagaaaaucaagcaaauggagaugagacaugcacagagggaacaggagcuccagcaaauuauccagcagacccaccagguuguggaaacagagcaaaacaaggaggucgaaaaauggaagcgucuggcucaguugaaaaaucgcgaguuagaaaaguuccggacugagcuggauaguauucucgacgugcugagagaacuucauaggcaggggguugugguaccagucgccuuugccgaugagaugaacgcucccgaguacuga

SEQ ID NO: 54260 - RNA, 4368 nt, Artificial Sequence
  derived and/or modified sequence opt3 from CEP164__Homo_sapiens__NP_001258862
auggccggcagaccccugaggaucggggaccagcucgugcuugaggaagauuacgacgagaccuauauuccuagcgaacaagagauacuggaguucgcucgggaaaucggaauugauccaaucaaggagccggaauugaugugguuagcacgcgaggguauugucgcgccccugccuggcgaauggaaaccaugccaggacaucacaggggauauauacuauuuuaacuucgccaauggacaguccaugugggaccaccccugugaugagcauuaccgaucucuaguuauccaggagcgugcuaagcucucaacuuccggcgccauuaaaaagaaaaagaagaaaaaggagaaaaaggacaaaaaggauagagacccuccaaagagcucccuggcacuugguucuucgcuggcccccgugcacguaccuuugggagggcucgcuccacugaggggccugguggauacgccgcccucagcacuccggggcagccaaagugucuccuuagggucuagcguggaauccggacgccagcugggugaacuuauguugccuucacagggccugaaaaccagugccuauacaaaggggcuacucggaagcaucuacgaggacaaaacugcucugucucuucugggcuugggugaagagaccaacgaggaagaugaggaagaguccgacaaucagucaguucauagcaguucugaaccacucagaaaccugcacuuagacauuggggcccugggaggcgauuuugaguaugaggaaucccucaggacaagccaacccgaggaaaagaaagacgugucgcuugauucugacgcggcaggcccuccaacccccugcaagccguccucaccuggggccgauaguagccuguccucugcugucggaaaaggucggcagggcagcggggcccgccccggauugccagagaaggaagagaaugagaagucagaaccuaaaaucugucgaaaccuagugacucccaaggcagacccaacaggcagugagcccgcuaaagccuccgaaaaggaggcgccugaggauaccguagacgccggugaagaggggagcagaagggaagaggcagcuaaagaaccaaagaagaaagccucugcucuggaggagggcucaagugaugccagccaggaacucgagauauccgaacauaugaaggagccgcagcugucugacucgauugcaagcgaucccaaauccuuccacggacuugacuuuggcuuccggucacguaucagugaacaccuguuggacguugaugugcucucuccugucuuagggggagccugccgccaagcucagcagccacuggguauugaggacaaggaugacagccaauccucacaggaugagcugcagagcaaacagucuaagggccuagaagagagauaccauaggcucagucccccucugccacacgaggaacgggcgcaaagucccccgcgaagccuugcaacggaagaggagccuccacaggggcccgaaggacagccugaguggaaggaagccgaggaguugggcgaagacucugcugccucccugucacuccagcugagucuucaacgcgagcaggcacccagcccuccagccgcuugugaaaaagguaaggagcagcauucgcaggccgaggaacuggggcccggccaagaggaagcagaggauccagaagagaaaguggcgguguccccgacuccucccgucucuccagaaguuagaagcaccgagcccguggcuccuccagagcaguugucagaagccgcacucaaggccauggaggaagcuguagcccaggugcuggagcaggaccaaaggcacuuacuggaaaguaaacaggagaagaugcagcaacuacgggagaagcucugccaggaagaggaagaggagauccugcgccuucaccagcagaaagaacaauccuugucuagccugagagagaggcuccagaaggcaaucgaagaggaagaggcucguaugcgggaggaagagucccagcgacugucaugguuaagagcccagguccaaagcaguacacaggcggaugaagaccagauuagggccgagcaggaggcuucucugcaaaaacuucgcgaagaguuggaaucccagcagaaggcagagcgggccagccucgaacagaaaaauagacaaaugcuggagcagcuaaaggaagagauagaggcuucggaaaaaucagagcaggccgcacugaacgcggccaaggaaaaggcucuccaacagcugagggagcagcuugagggagaacgcaaagaggccguggcaacuuuggaaaaggagcauucugcugaacuggagcgauuauguaguucccucgaggccaaacaccgggaaguugugagcucucugcagaagaaaauccaagaggcacagcagaaggaagaggcccagcuucaaaagugccugggccaggucgaacaucgugugcaccagaaaagcuaccauguagcuggguaugagcacgaguuguccucacuccugagagaaaagaggcaggagguugaaggagagcacgaacgccggcuagauaaaaugaaggaggagcaucaacaggugauggcgaaagccagagaacaguacgaggcagaagagaggaagcaacgagcugagcugcucggucaccugaccggcgaacuugagcgcuugcagcgggcccaugaaagagagcuggaaacagucaggcaggagcagcacaagcguuuagaggaccuccgccggagacacagggaacaagagcgaaaacugcaggaucuugaacuggaccuagagacccgggccaaggacgugaaagcucgccucgcacuguuggaaguccaggaggagacggccagaagggaaaagcagcaacuguuagaugugcagcggcagguugcgcucaaaagugaggaagcuacugccacacaucagcaacuggaggaagcacagaaggagcacacccaucuucugcagagcaaucaacaguugcgagagauucucgacgaacugcaggccagaaagcuaaaacuggagucucagguggaucuucuccaagcucagucccagcagcugcaaaagcacuuuucaaguuuggaagcagaggcccagaaaaagcagcaucuguuacgcgagguaacugucgaagagaacaaugcgagcccccacuucgaaccugaccuccacaucgaggaucugaggaaaucccuugggacaaaccagaccaaggaagugucuucgagccugucacaauccaaagaggacuuguaucucgauagucugucuagccauaauguuuggcaccuacuguccgcugagggaguggcccuucguucagcaaaggaauuucucguccagcagacgcggucuaugagaaggcgccagaccgcccugaaggcugcccaacagcauuggcgacacgaguuggcaagcgcucaggaaguggccaaagacccgccaggcauaaaggcguuagaggauaugcggaaaaaccuggaaaaggagacaagacaucucgacgagaugaaaagugccaugaggaagggucacaaucugcuuaagaaaaaggaagagaaacugaaccaauuggaauccagccuaugggaggaagcaucugaugaggggacucugggcggaucacccaccaagaaagcuguaacauucgaccucuccgauauggacagucugagcucggagucuuccgagagcuuuucaccuccacaccuugacaguacucccucuuuaaccucccgcaagauucauggccugagccacucacuccgucagaucaguagccaguuguccucugugcugagcauccucgauucccugaacccucagucaccgcccccacuucuggccucuaugccugcucaauugcccccaagagacccuaagaguacacccaccccaacuuacuaugggucgcuagcacgguucagcgcccuguccucugccacgccgacaucaacccagugggcuugggauagcggacagggcccuaggcuccccuccaguguugcgcagacugucgacgacuuuuuacuggaaaaauggcgcaaguacuucccaucugguauuccccuucugagcaauucaccuaccccacucgaaucccgauugggguauaugagugcaagcgagcaacugagacuccugcagcauucucacucccaggugcccgaggccggaucaacaaccuuccagggcaucauugaagcuaaccggagguggcuugagcgcgugaaaaaugauccuagacuaccgcuguuuagcucgacuccaaagcccaaagccacauugucuuuacugcaacucggucuggaugaacacaacagggucaagguuuaccgguucuga

SEQ ID NO: 54261 - RNA, 4461 nt, Artificial Sequence
  derived and/or modified sequence opt3 from CEP170__Homo_sapiens__NP_001035863
augagccugaccuccugguuccucgugucuucaggcgggacaagacacaggcuuccccgggagaugaucuuugucggacgcgacgauugcgaacugauguugcagagucgaagcguugacaagcaacaugccgugauuaacuacgaugcuuccacugacgagcacuuaguaaaagaucuggguucucuaaauggcacguucgugaacgacguccguauaccugaacagaccuauaucacacucaagcuggaggauaaacuuagauuuggguacgacacuaaucuguucaccgugguucagggagaaaugagggugccagaggaggcauugaagcaugaaaaauuuacaauucagcuccaacugucgcagaagucaagcgagagugaacuguccaagucugccagcgcgaaauccaucgauucaaaggucgcugacgccgcaaccgaggugcagcacaaaacuacagaggcccucaagagugaagagaaagcuauggauauuagcgcaaugccgcggggcacccccuuauauggucagccuucuugguggggagacgaugaaguagacgagaagcgcgccuucaagacgaacggaaaaccagaagagaagaaucaugaggcuggcacuuccggcugugggaucgacgccaaacaaguugaggaacagucagcggcagccaacgaagaggugcuguuucccuucugcagagaaccuagcuacuuugagauaccaaccaaggaguuccagcagcccagucaaaucacagaaucuacuauucacgagaucccuaccaaagauacaccauccagccacauuaccggagcuggucaugccucguuuacgaucgaguucgacgauucuacuccgggcaaggucacaauaagggaccacgugaccaaauuuacuuccgaucagcggcauaagucaaagaaaaguagccccgggacacaggaccuuuuggggauucaaaccggcaugauggcaccugaaaauaagguggcugauuggcuggcccagaacaauccaccccagaugcuaugggaacgcacggaggaggacuccaaaucuaucaagagcgaugucccuguuuaucucaaacgacugaaggguaacaagcacgacgaugggacccagucagacagugaaaaugcgggagcccacagaagguguuccaaacgggcaacacuugaggaacaucugcgucgccaccauagcgagcacaagaaauugcaaaaggugcaggcuacugagaaacaucaggaccaggccguaguguucggcgucgaugacaaccaagauuacaauagaccagugauuaacgaaaagcacaaggaccucaucaaagauugggcucugucuucagccgcagccguuauggaggaaaggaagcccuuaaccacaaguggcuuccaccauagcgaggaagggacuuccucuucgggaagcaaacggugggugucccagugggcuucacuggcggcaaaucacacccgacaugaccaggaggagcgcaucauggaauuuagugccccgcucccucuugagaacgaaacagagauuucugaaagcgguaugaccgucagauccacuggcucagcuacgagccuggccucucagggggagaggcggcgcagaacauugccccaacuaccaaacgaggaaaagucccuggagagucacagggcaaaagugguaacccagcguagcgaaauaggagagaagcaggauacugaacuccaggagaaggagaccccuacacaaguuuaucagaaagacaagcaggaugccgaccggccccugucuaaaaugaaucgagcugugaacggcgaaacccuuaagacugguggggauaauaaaacacuguugcaccucggcuccucagccccaggaaaggagaaaagugaaacggacaaggagaccagccuggucaagcaaacuuuagcaaaacugcagcagcaggagcaaagagaagaggcgcaguggacacccaccaagcuaucguccaaaaacgugucuggccagacagauaagugcagggaagagacuuucaaacaggaaagccaaccuccagagaaaaauucagggcauaguaccuccaagggagaccgcgucgcucagucugagagcaaacggagaaaggccgaagagauccucaaaucccagacgccgaaggguggcgacaaaaaggaaucaagcaagagucuggugaggcaggggucuuuuaccauugagaaacccuccccuaacaucccaauagaacuuauuccccacaucaauaagcaaacaagcucgacuccuucaucuuuggcacugaccagugccucccgcauccgagagcggagcgagucucucgauccagacagcuccauggauacaacucugauucuuaaagacaccgaagcuguuauggccuuccuggaggcaaaguugcgugaagauaacaaaacggacgagggacccgauacaccgucauacaauagagacaacaguaucagcccugaaucugauguggacaccgcuuccacuauuucacucguaacaggcgagaccgagaggaagaguacucagaagcgcaagagcuuuaccucccuguacaaggaucgguguucuacagguucgccaagcaaagacgucacgaagucauccaguucuggggccagagagaaaauggaaaagaaaaccaagagcagguccacugaugugggcucacgagcggacggacgcaaguucguucagucuagcggccggauaagacaacccaguguggacuuaacagaugacgaucagaccuccagcgucccucauucugccaucucagacauuauguccagugaucaggaaacauauagcugcaaaccccacgggaggacuccacugaccucggcugacgagcaugugcacucuaagcuagagggauccaaaguaacaaagagcaaaacgucaccugugguuagugguucuuccagcaagucaaccacucucccccguccacgcccgacccggacaagucugcuuagaagggcacgauugggcgaagccagcgauuccgagcuggcugacgccgauaaggcaucugucgcgagcgaaguguccacuaccucaucuacaaguaaaccucccacggggcggcgcaauaucucgagaaucgaccuccuggcccagccaaggcggacccgauuaggaagccuguccgcuagaucugauucagaggccacuauuagccgcuccagugcaucuagcaggacagcugaagccauaauccguucaggcgcacggcuugugcccuccgacaaguuuaguccuagaauuagggccaacagcaucucucgcuuguccgacucaaaagucaagagcaugaccucggcucacgguucugcgaguguuaauucccgauggagacgguucccaacugauuacgccagcacaucagaggacgaguuuggguccaacaggaauagccccaaacauacccgccuccguacgagcccugcacugaagacuaccagacuacaaagugcuggcuccgccaugccgacaucuucuucauucaagcaccggauuaaagaacaggaggauuauaucagggacuggaccgcccaucgcgaagagauagcucgaaucagucaggaucuggcacucauugccagagaaaucaacgacguggcgggagagauugauuccgugacuagcucuggcacagcuccaucgaccacaguaucaacugccgcaaccacgcccgggagcgccaucgacacacgggaggaacuggucgauaggguguuugacgagucccuuaacuuccgcaagauaccuccauugguucacaguaaaacccccgaaggaaauaacggcagaucuggugauccuaggccgcaggcugcagagcccccagaccaucugacuauuacccggcgucgcacauggagccgagaugaagugaugggggacaauuuacuccuguccucagucuuucaauucaguaagaaaaucagacagucuauugacaagacugccggaaagaucaggauacuuuucaaagauaaggaccggaacugggaugacaucgagagcaaacugcgcgcggaguccgaagugccuauuguuaagaccucaagcauggagaucucuuccauuuugcaggaacucaaaagaguggagaagcagcugcaagcuaucaaugccaugauagaucccgacggcacgcuagaggcacugaacaauauggguuuuccaagugccaugcucccuucgcccccaaagcagaaaagcuccccgguaaacaaucaccacucuccuggccagacacccacccuggggcagccagaagcuagggcccuucaucccgcagcugucucagccgcggccgaguucgaaaacgcagagagcgaagcugauuuuaguauucacuucaaucgguuuaacccugacggagaggaggaagaugugacugugcaagaguga

SEQ ID NO: 54262 - RNA, 7614 nt, Artificial Sequence
  derived and/or modified sequence opt3 from CEP192__Homo_sapiens__NP_115518
auggaggacuucagaggaaucgccgaagagagcuuucccuccuuccugaccaacucucucuuuggaaauucagggauucuugaaaacgugacucugaguagcaauuuggguuuaccugucgcuguuuccacucuggcuagggaucggucuucgacggacaaccgcuacccagauauacaggccucauaucuaguggagggccgauucagcguaccgaguggguccucucccggaagccaauccgacgcggaaccucgugagagacuccagcugucauuucaggaugacgauaguaucagcaggaagaaaucuuacguggagucccagcggcuuucaaaugcucugagcaagcagagugccuugcagauggaaaccgcaggcccagaggaagaacccgccggugcuacugagucucuccaggggcaggaccuguucaaccgcgcauccccucuggaacaagcccaggauagcccaauugacuuucaccuccagucguggaugaauaacaaagagcccaagaucgucguguuagaugcuggaaaacacuucgaagacaagacucugaagucugaucuuucccacaccucauugcuggagaaugaaaaacuaauucucccuacaagucuggaggacagcuccgacgaugacaucgaugacgagauguuuuaugaugaccaucuugaagccuacuucgagcagcuggcgauaccaggcaugaucuaugaagauuuggagggcccggaacccccugagaagggguuuaaacucccaaccaacggacugagacaagcaaaugagaacgguucuuuaaauugcaaguuccagagcgaaaacaauucaagucugauuucccucgacagccacucuucagagacuacacauaaagaaagugaggaaagccagguuaucugucuucccggcaccuccaacucuauugggacgggagauucgaggcgguacacugacggcaugcugccuuuuagcuccgguaccugggggacagagaaggagaucgaaaacuugaagggaauagugccagaucuaaauucagagugcgccaguaaagacguccuggugaagacucuccgcgcuauugacgugaaacugaacucugauaauuuccacgacgccaacgcaaaucgaggcggcuucgaucuuaccgaccccguuaagcaaggggcugaauguccgcaccagaacaaaacagugcugcauauggauggaugcuuggacaccgagacgccuacugucagcauccaggagaauguggauguggccucccucaagcccauuucagacagcgguaucaacuuuacagaugcgaucuggucuccaaccugugaaagaaggacuugcgagugucacgaauccauugagaaaaauaaggacaagacagaucugccucagagugucguuuaucaaaacgaagagggccggugggugaccgacuuagccuacuacacgagcuucaauucuaaacagaaccugaauguaucccuaucagaugagaugaacgaagacuuucguagugggagcgaggcauucgaccucauagcucaggaugaagaggaauuuaauaaggagcaucaguucauccaagaggaaaacauugacgcccacaacaccucgguggcucugggagauacauccuggggcgccacuaucaauuauucucuuuugcgcaaaagcagaucaaccagugaccuggauaaggacgaugcauccuaccucaggcugucucuuggugaguuuuucgcccagcggagcgaagcucuggggugcuugggcggaggcaacaaugucaaacgacccuccuuuggguauuucauacgcucaccagagaagagagaacccauugcgcucaucagaaagagcgacgugagucggggaaaccuggagaaagagauggcacacuuaaaucaugaucuguacucuggugaccuaaacgaacagucccaggcccaacucagcgagggcucgaucacacugcagguugaagcuguggagucaacuucucaggucgaugagaaugacgugacccuuacagccgauaaggggaaaaccgaagacacauuuuucaugaguaacaagccucagcgcuauaaagacaaguugccagauuccggagacagcaugcugagaauuucuacgaucgcaagcgccauugcugaggccuccguaaauacagauccgucacaacucgcagcgaugauaaaggcucugaguaacaaaaccagggacaagacuuuucaggaagaugagaaacagaaggacuacagccacguucgucauuucuuacccaaugaucuggaaaaaucuaacggcuccaaugcccuugacauggagaaguauuugaagaaaaccgaggugucacgguacgaaagugcacucgagaacuucagccgagccuccaugucugauacaugggaccugucgcuaccuaaggaacaaaccacucaggauauccacccagucgaccugagcgcuacaucaguguccgucagagcccccgaggaaaauacggcagcuauuguguacguugagaacggugagagugaaaaccaggagucuuuuaggaccaucaauagcuccaacucagugacuaaucgcgaaaacaauucugccguagucgacgugaaaacauguagcaucgauaacaagcuccaggacguugggaaugaugagaaagcgaccaguauuuccacaccuagcgacucuuauucauccgugcggaacccaagaauaacaagucugugccuuuugaaggauugugaagagaucagggacaaucgcgagaaccaacgacagaaugaaugcgucagcgagauuucgaacucugaaaaacaugugaccuucgagaaucaccggaucguaucccccaagaacagcgaucugaagaauacgucaccggagcacggcggacguggcagugaagacgagcaggaaucuuuuagaccuuccaccagcccauuaucacauaguagccccuccgagauuucugggacaagcuccucaggaugcgcccucgaaucuuucgguagugcugcacagcaacagcagccucccugugagcaggagcugucgccacuugugugcagcccugccggcguuuccaggcugacuuacgucucugaacccgagucaagcuauccaaccacagcuacugaugacgccuuggaagaucgcaaauccgacaucaccagugagcucucuacgacaauaauccaagggagcccggcagcgcuggaagaacgggccauggagaagcuaagagaaaaagugccuuuucagaacaggggaaagggcacccugucauccauuauccagaacaauagugauacucgaaaagcuacagagaccacuagccucucuuccaagcccgaauacgugaagccagacuuccgcuggucaaaagaccccagcucgaagucugguaaccugcuugagaccagugaagucggguggacauccaauccugaggaguuggauccaauucggcuggccuuacucggcaaaagcggacugucaugucaaguuggcuccgcaacgucucaccccgugagcugccaggaaccuaucgacgaggaucagagaauaaguccgaaggacaaauccaccgcugggagggaauuuagcggacaggugucucaucaaacuacaucagagaaccaguguaccccaauucccaguuccacaguacacagcucugucgccgauaugcagaauaugccugcagccgugcacgcacuucugacucagccaucgcuaucagcggcccccuucgcacaacguuaucucggcacccugccuagcacggguuccacaaccuugccgcagugccaugcugggaacgccacuguuuguggauuuaguggcggucugcccuacccagccguggcuggcgagccuguccaaaauucuguggcaguugggaucugcuuaggaagcaacauuggcuccggguggaugggaaccucaagucucuguaaucccuauucuaacacacugaaucagaaccuucugagcacuaccaagccauucccugugcccuccguaggcacaaauugcgguaucgaaccaugggacucaggggucacgagcggauugggcucugugcgcgugccggaggaacucaagcugccucacgccuguugcgucgguauagcgucccaaacccuacugaguguucuuaaccccacugaucgguggcuccaggugagcaucggcguacugucgauuuccgugaauggggagaaagucgacuugucuacauacagaugccugguguuuaagaacaaagcuaucauuaggccacaugccaccgaagagaucaagguuuuauucauacccucaagcccuggaguguuucgauguacuuucagugucgcauccuggccaugcucuacagaugccgagaccauugugcaggcugaagcacucgccagcacgguuacucugaccgcgaucgcugagucacccgugaucgaagucgagacagagaaaaaggacguacuugauuucggcgaccugaccuacgggggauggaaggccuugccucucaaacugauuaaucggacucacgcaacagugccgauccgccuaauuauaaacgccaacgcuguugccuggagauguuuuaccuucuccaaggagagugugagggcaccagucgagguggcucccugcgccgauguagugacacggcuggcgggcccuagcgucguuaaucauaugaugcccgccucuuaugacggucaggacccagaauuucuuaugaucuggguacucuuccacucaccuaaaaagcaaauuuccagcucugauauccuggacagugcagaggaauuuucggcuaaaguggauauugaggucgacucccccaacccaacuccuguguugcgaagcguuucauuaagagcccgcgcugggaucgcaaggauacacgccccgcgugaucugcagaccaugcauuuccucgccaagguagcuucuagccggaaacagcaucugccccuuaagaaugcgggaaacaucgaaguguaccuggacauuaaggucccagagcaaggcucccauuuuaguguggauccuaaaaauuugcuacugaagcccggugaggaacacgagguuaucgugucauucacgccaaaagacccugaagcaugugaggagaggauucucaagaucuuuguccagcccuucggcccgcaguaugaagugguacugaaaggggaggucauaucuagcggauccaagccacuuaguccuggccccugcuuagauauuccaagcauccuguccaacaagcaguuucucgccuggggaggggugcccuugggcaggacacaacugcagaaacucgcucugcgcaauaacucugccucaaccacucagcaucuucgacuguugaucagaggucaggaccaagauuguuuccagcuacagaauaccuucgggagcgaacagcggcugacaucgaacugcgagauuaggauacacccuaaggaagacaucuuuauuuccguucucuucgcaccgacucgcuuaaguuguaugcuggcccgucuugagaucaaacaacugggaaauagaucucagcccggcauuaaguuuaccaucccacucagcggcuacgggggaacgucaaacuugauacuggagggugugaaaaagcucuccgacucuuauauggucacagugaauggccugguuccugggaaggaaaguaaaaucguguucagcguccggaacaccggauccagggcugcguuugugaaggccguaggcuucaaagauucacagaagaaagugcuucuagaccccaagguucugcgcauuuuuccugauaaguucgucuugaaagagcgaacucaagaaaaugugacauuaaucuacaacccaagcgacagagguauuaacaauaagaccgcaacugagcugucuacaguguaucucuuugggggagaugaaaucagucggcagcaguacaggcgcgcucugcuucacaaacccgagaugauaaagcagauucugccugagcauuccguccuccaaaacaucaauuucguagaagccuuucaggacgaguugcuggugaccgaaguuuacgaucuaccacagagacccaacgacgugcagcuguucuauggcagcaugugcaaaaucauucucucagucaucggcgaguuuagggauuguauaucuucccgggaguuccuucaaccgucgagcaaggcaagucuggaaucuacguccgacuuaggggccagcggaaagcacgguggcaaugugucauuggauguucugccugugaaagggccacagggaaguccccuccugucccgugcugcccgcccuccacuugaccagcuggcgagcgaggaacccuggacuguccucccggagcauuugauucugguggcaccuucucccugcgauauggccaagaccggccgauuccagaucguaaacaauucagugagauuacuaagguuugaacugugcuggccagcucacugucucacaguuaccccucaacacgguugcgucgcccccgagagcaaacuucagauucugguguccccaaacucuaguuugucgacaaagcagagcauguuccccugguccgggcugaucuacauacauugugacgacggacagaaaaagauugugaaaguccaaauccgggaggaucucacucagguugaacugcuuacccgccucacgucaaagccuuuuggcauccugucuccagugagcgagccgaguguaucccacuuggugaagcccaugacaaaaccuccaucaacuaaggucgaaauuagaaauaaaucuaucaccuuccccacaaccgagccuggcgaaacuagcgaguccugccuggaguuagaaaaccaugggaccacagacgugaaguggcaccuaaguagccuggcuccacccuauguuaaaggaguggaugagucuggugacgucuuuagggcaacguacgccgcuuuccgguguucaccuauuuccggccuccuugaaagccaugggauacagaagguaaguaucacuuuucugccgcgaggaagaggcgauuaugcccaauucugggacguggagugccacccauugaaggaaccccacaugaaacauacccugcgcuuucagcucucuggucaguccauugaggcagagaaugaaccugagaacgcgugucugucgacagauagccuuaucaagaucgaccacuuaguuaaacccaggcggcaggccgugucagaggcuuccgcccguauuccagagcaacuggaugucaccgcaagagggguguacgcuccugaagacgucuauagguuccgccccacuucugugggagagagucggacacucaagguuaauuugcgaaacaauagcuuuauaacccauucacugaaauuccuauccccaagagagccguuuuacgugaagcacagcaaguacucucugagggcccagcacuauaucaacaugccuguacaguucaaacccaagagugcaggcaaauucgaagcccuccuugugauucagacggaugagggcaaguccaucgcuauucgccugaucggggaagcguugggcaaaaacuga

SEQ ID NO: 54263 - RNA, 504 nt, Artificial Sequence
  derived and/or modified sequence opt3 from CEP19__Homo_sapiens__NP_116287
auguacaugggcaugaugugcaccgccaagaaaugugggaucagauuccagcccccugcuauuauacugaucuaugagagcgaaauuaagggaaaaaucaggcaacggauuaugccagugcgcaacuuuuccaaguucucugacugcacacgagcagccgagcagcucaaaaauaacccgcgucacaagucauaccuugaacaggucagucugagacaguuggagaaguuauuuagcuuccugagggguuaucuauccggccaaucucucgcggaaacuauggagcagauccagcgggagacgaccauagaucccgaagaggaccugaauaaacuugaugacaaggaacuggcuaaacgcaagucgaucauggaugaguuguuugagaaaaaccagaagaagaaagacgauccuaauuucguuuacgacauugaaguggaguuuccacaagaugaccagcuccagucaugugggugggauacagaaagcgccgacgaguucuga

SEQ ID NO: 54264 - RNA, 7329 nt, Artificial Sequence
  derived and/or modified sequence opt3 from CEP250__Homo_sapiens__NP_009117
auggagaccagaagccccggacugaacaauaugaagccucagucccuccaacuugugcuggaggaacaggucuuggccuuacagcagcaaauggcugaaaaccaggcagccucuuggaggaagcugaaaaauucacaggaggcgcagcaacggcaggcuacacuuguucgcaaacuccaggccaaggugcugcaguaccgaagcuggugccaagaacuugagaagcgucuggaggcaacugggggaccaaucccgcagagaugggaaaacguagaggaacccaauuuggacgagcuccuggugaggcuggaggaggaacagcaacggugugaaagccucgccgaggucaacacgcaguuacgccugcacauggaaaaggcugaugugguuaauaaggcacuuagagaggacguggagaaguugaccgucgauugguccagggcccgggacgaacugaugcgcaaggagucucaguggcagauggaacaagaguucuuuaaagguuaucuaaagggcgaacaugggcgacuccugucgcuuuggagagaggugguaacauucaggcggcacuuucuggagaugaaaucagcuacugaucgugacuugauggaacucaaggccgagcauguucgccugagcggaaguuuacugaccugcugucucagacuuacagugggcgcgcaguccagggaaccuaacgguucugggcggauggauggacgagagccagcacagcuguugcuacugcucgccaagacccaggaacuggagaaagaggcucacgaacgcagccaagagcuuauucagcugaagucccagggcgacuuggaaaaagccgagcuccaggauagagucacugagcugucagcauuacugacacaaagucagaagcagaaugaagacuacgagaaaaugauaaaggcucuaagggaaaccguggagauccucgaaacgaaccauacugagcugauggagcacgaagccagccuuucucggaaugcgcaggaggaaaaauugucccugcaacaggugauuaaggauaucacccaggucaugguugaggaaggcgacaacauugcccaagggucaggacacgagaauagccucgagcuggauaguucuaucuucucccaguuugacuaucaggacgcagauaaggcucuuacacuggugcgcagcguauugacuagaaggcgucaggccgugcaagaccuccggcagcagcuggcugguugccaggaagccgucaacuuacugcaacagcagcaugaucagugggaggaagagggcaaagcacuacgacaaagacuccagaagcugaccggggaaagggacacacuugccggacagaccguggauuugcaaggcgagguugacucgcugucuaaagagcgcgaacuccugcagaaggcucgggaggaauuaagacagcagcuggaggugcuugagcaagaagcguggagguugcgccgagucaauguggagcuccagcugcagggugauuccgcacaggggcaaaaagaggaacagcaggaggaacugcaccuggccguacgggagcgugaaagacuccaggagaugcugaugggacuugaagcuaagcaaucagagaguuugagcgaacugauaacguuaagggaggcccucgaguccucucaucuggaaggcgagcuucugcgccaggaacagacugagguuacagcagccuuggcucgggccgaacagagcaucgcagagcucucaaguuccgagaacacccugaagacugaaguggcggaccuaagagcugccgcagucaaacugagcgcccucaacgaggcucuggcccuugauaaggugggcuugaaucaacagcuguuacagcucgaagaggagaaccaaucugucuguucaaggauggaagcagcugagcaggcccgaaaugcgcuacagguggaccuugccgaagcugagaaacgccgggaagcacugugggagaagaacacacaccuagaggcccagcuccaaaaagcugaagaggccggggcagaacugcaggcggauuugagagacauucaggaggaaaaggaggagauccagaagaaacugagugaaagcaggcaccaacaggaggccgcuaccacgcaguuagaacagcuccaucaagaggccaagcgucaggaagagguucuggcacgcgcugugcaggagaaagaagcccuuguacgggagaaggcagcccuggaagucagauugcaagcuguggagagggaccgacaggaucucgcggagcagcugcagggacuauccucugccaaagaacugcuugagucgagccucuucgaagcacaacagcaaaauuccguuauugaggugaccaagggucagcuggaaguccaaauccagacagugacucaggcuaaggagguaauacagggcgaggugcggugcuugaaacuggaauuagacaccgagcgcucacaagccgaacaggagagagaugccgcugcaaggcagcucgcccaggcggaacaagaggggaagacagcucuggagcagcagaaagccgcacacgaaaaggagguuaaccaacuucgggaaaaaugggagaaggaacgaaguuggcaucagcaggagcuggccaaggcuuuggagucucucgaaagagagaagauggaacuggagaugcgccuaaaggagcagcaaacugaaauggaggcaauucaggcccagagggaagaggaacguacccaggcggagagcgcucugugucaaaugcagcuugagacagaaaaagagcgggucucccuccuggaaaccuuguuacagacucagaaggagcuggccgacgcaucacaacagcucgaaagacugaggcaggauaugaaagugcaaaaacuuaaagagcaggagacgacaggaauccugcagacccaguugcaagaagcccagcgcgagcuaaaggaagcugcccgacagcacagagacgaucuggcagcucuccaggaggaaaguucuucccugcuucaagacaagauggauuuacagaaacagguggaggaccugaagagucagcucgucgcccaagaugacagccagcgguugguugagcaggaagugcaagagaaacugagggaaacucaggaguacaaucgcauucagaaggagcucgaacgugagaaagcgucucugacccuuucccugauggaaaaggagcagagauugcuagugcugcaagaagccgauucaauccggcagcaggagcucagugcauuaaggcaggacaugcaagaggcucagggcgaacagaaggagcugagcgcccagauggaacuucugcgccaagagguaaaagaaaaggaggcugacuuucucgcacaggaggcccaguugcuggaggaacucgaagccucgcauaucacagagcagcaacugcgagcuucccuuugggcgcaggaagcaaaagccgcucagcuacaacugagauugcggucuaccgagagccaguuagaggcccuggcagccgaacagcagcccgguaaccaagcucaggcgcaggcccagcucgcaucacuguauagugcucuacagcaggcccugggguccgucugcgagucuaggccugaacucagcggcggaggcgauuccgcaccaucaguguggggguuggagcccgaccagaauggagcccgcagccuguucaagagagguccucuacugacugcucucagugccgaggcgguugcaucugcccuucacaaacugcaccaggauuuauggaagacacaacagacgagggacguguugcgggaucagguccaaaagcuggaggaacgucucaccgacacugaagcugagaaaucccaggugcauacagaacugcaggaucuucagcgccaacugagccagaaccaggaggagaagucgaaaugggaaggcaagcaaaauucacucgagucugaauugauggagcugcacgaaaccauggccaguuuacaaucccgacuaagaagggcugagcugcagcggauggaggcacagggggaacgcgagcuccuucaggccgcuaaagaaaaccugacagcccaaguugagcauuugcaggcagcggugguagaagccagagcucaggccagcgcagcuggcauucuggaggaggaccucaggacugcccggucugcacugaaacuuaaaaaugaagaggucgaaagcgagcgagagagagcccaggcucuccaagaacagggcgagcugaagguggcgcaggguaaggccuugcaagaaaaccuggcauuacuaacccagacgcuggcugagcgcgaagaggagguggaaacccucagggggcagauacaggagcuugaaaaacaacgggagaugcagaaggccgcccuggaauugcugucccucgaucugaaaaagcguaaucaggaggucgaccuucagcaagagcagauccaggaauuagagaaauguagaucaguucuggaacaccucccaauggcagugcaggagagggaacaaaaguugacaguacagcgcgagcagauucgggagcuggaaaaggaucgagagacucaaagaaacgugcuagaacaccagcugcucgagcuugagaaaaaggaccagaugaucgaaagucagaggggccaaguccaggaucugaaaaagcaguuggugacccuggagugccucgcucuggaauuagaggaaaaccaucacaaaauggagugucagcaaaaacuuauaaaggagcuggaaggacagcgcgagacacagcggguugcccucacucaucuaacccuggacuuggaagagagaagccaggaacugcaagcgcagucuucccagauucacgaccucgagucacauaguacggugcuugcucgugagcugcaagaaagggaucaggaggucaaaagccagcgggaacagaucgaggaauugcaacgccagaaggagcaccugacacaggaccucgagcgaagagaucaggaauuaaugcugcaaaaagagaggauccaggugcuugaagaccagcggacccgccagacuaagauucuggaggaggaucuagaacaaaucaaacucucccugagagagaggggccgagaauugacaacccagcggcagcugaugcaggagcgugccgaagaggggaagggaccgucuaaggcacaaagagguucgcucgagcacaugaaacuuauucugcgcgacaaggaaaaagagguugaaugccagcaggagcauauacacgaauuacaagagcugaaggaucaguuggagcagcagcuccaaggccugcauaggaaagugggggaaacuagccuacuucugucacagcgggagcaggaaaucgucguacuccagcaacagcugcaggaggccagagaacagggagaguugaaggagcaaucccugcagagucagcucgacgaagcucaacgcgcacuugcccagagggaucaggagcuggaagcguuacagcaagagcagcagcaggcucaaggccaggaggaacgagugaaggagaaagccgacgcacugcagggugccuuggaacaggcucacaugacccucaaggagcggcauggggaacugcaagaucacaaagagcaggccagaaggcuagaggaggaacuugcaguugaaggccgccgugugcaggcucuggaggaaguccucggagaccugcgggccgagucuagagagcaggaaaaggcguuguuagcccugcaacagcagugcgcagagcaagcucaggaacacgagguggaaacaagggcccuccaggacagcuggcuucaggcacaagcuguacugaaagagcgcgaucaggagcuagaagcccugcgagccgagucccagucaucucggcaucaggaagaggcggcuagagcaagggccgaggcucuccaagaagccuugggcaaggcacacgccgcucugcaggggaaagagcagcaucuucuggaacaggcggagcucagccgcaguuuagaagccuccacggcaacccugcaagcuagcuuggacgccugucaggcacacucuagacagcuggaggaggcccuccggauucaagaaggagagauccaggaucaggaccuuagguaccaggaagaugugcaacagcugcagcaggcucuagcccaacgugacgaggaacugcgacaccagcaggagcgcgagcagcucuuggaaaagucacuggcgcaaagaguccaggagaauaugauccaggaaaagcagaaccuuggccaagagcgggaagaggaggaaauuaggggucugcaucaguccguucgcgaguuacagcucacucuggcacaaaaagaacaggagauauuggagcugagagaaacacagcagcggaauaaccucgaggcccuuccccacagucauaagaccagcccuauggaggaacagucgcugaaacuagauucucuggaaccaaggcuccagcgagaguuggagcgucugcaggcugccuuaagacagacagaagcacgcgagaucgaauggcgggagaaggcucaagaccuugcccugucccucgcucagacuaaagccagcgugucaagucugcaggaaguggcaauguuuuugcaggcgucuguccuggagagggauuccgagcaacagagacuccaggacgaacuugagcugacccgccgggcccuagaaaaggagaggcugcacagccccggggcuacgucaacagccgaauuaggaagucgaggcgagcaaggugugcagcucggcgagguuagcgggguagaagcagagccuuccccagauggaauggaaaagcagucuuggagacagcggcuggagcauuugcaacaggcuguggccaggcuugagauugaccgcagccgucugcagagacacaauguccagcuccgauccacccuggaacaaguggagagggaacggcgcaaauugaagagagaggcaaugagggccgcgcaggcuggcucacuggaaaucucuaaagccacugcaaguucgcccacccagcaggaugggcggggacaaaagaacagcgacgccaaaugcguugcugagcuacagaaggaggugguccuccuucaggcccaacugacauuagaacgcaagcagaaacaggacuauauuacuagauccgcacagaccucucgagagcuggcuggccuccaccauucacugagccacuccuugcuugccguggcgcaagcuccggaagccacaguacuggaggcagaaacgaggcggcucgaugagagucugacccagucucuaacuagcccuggucccgucuugcugcauccaucaccuuccacaacccaggccgcuagucguuga

SEQ ID NO: 54265 - RNA, 7440 nt, Artificial Sequence
  derived and/or modified sequence opt3 from CEP290__Homo_sapiens__NP_079390
augcccccuaacaucaauuggaaggagauuaugaaaguggacccagaugaccugccgagacaggaagagcucgccgauaaccuucugauaagcuuguccaaggucgaaguuaaugaguuaaaaucugaaaagcaagagaacgugauccaccuguucaggauuacccagucacuaaugaaaaugaaggcucaggagguagaacucgcacuggaggaaguggagaaggccggcgaggaacaggcgaaauuugagaaucaacuuaagacaaaagucaugaagcuggaaaacgaguuggaaauggcucagcagagugccgggggacgggacacucgcuuccuccgaaaugagaucugccagcuggagaaacaacuggaacagaaggaucgugagcucgaagacauggagaaggaauuagagaaagagaagaaagugaacgaacagcuggcacuuagaaaugaggaagccgagaacgaaaauagcaaguugaggcgggagaacaaacgccugaagaaaaagaaugagcagcuaugucaagauauuaucgacuaccagaagcagauagauucccaaaaagaaacgcuccugucuagaaggggugaggacucggauuaucggucacagcuuagcaagaaaaacuacgaacugauccaguauuuggacgagauucagacccucacagaggcuaaugaaaagaucgagguucaaaaccaggaaaugcgcaaaaaccuggaggaaagugugcaggagauggagaagaugacugaugaauacaaucgaaugaaggcaauuguccaucagaccgacaacgugaucgaccaauuaaaaaaggagaaugaucacuaucagcugcagguacaggaacucacagaccuucugaaauccaagaacgaggaagaugaccccauaaugguugccgugaaugcuaaagucgaggaguggaaguugauucuaucuagcaaggaugacgaaaucauugaguaccaacagaugcugcauaaccucagagaaaaacugaagaaugcccagcuugaugcggacaaauccaacgugauggcacugcagcaaggcauccaggagagggauucacagaucaagauguugaccgaacaaguggagcaguauacuaaagagauggaaaagaauacaugcauuauagaggaccucaagaacgaacugcagcggaauaaaggggccaguaccuuaagccagcaaacgcacaugaagauccagucuacucuggauauucuaaaagagaagaccaaagaggcugaacguacagccgagcucgcagaagcugacgcccgcgagaaggacaaagaacuggucgaggcgcuuaagagauugaaggauuacgaguccggaguuuacggccuggaagacgccgugguagagaucaaaaacuguaagaaucagauaaaaauuagggaucgggaaaucgagauccucacuaaggaaauuaacaaacuggagcuuaagaucucagacuuucuggaugagaaugaagcauugcgagagcgcgugggucucgaaccuaagaccaugauugaccugacagaguucagaaacagcaaacauuuaaagcagcaacaguauagggcugaaaaccagauacugcuaaaagagaucgagagucucgaagaggaacggcuggaucuuaagaaaaagauucgccagauggcccaagagagagggaagaggucugcuaccuccggauugacgacugaggaccugaaucucacagaaaacaucagccagggcgaucguaucucggagcggaaacuggacuuacugucucuuaagaauauguccgaagcccagucaaaaaacgaguuuuugagucgagaacucauugagaaggagagagaucuggaaaggagccgcaccgucauagcaaaauuccaaaauaagcuaaaggagcugguggaagagaacaaacagcucgaagagggcaugaaggagauccugcaggccauuaaagaaaugcagaaggacccagauguuaaagggggagagacuucccuuaucauucccucuuuggaacggcuggugaaugcuaucgagagcaagaacgcggaagguauauuugacgcaucauuacaccucaaagcccaagucgaccagcugacaggcagaaaugaggagcuuaggcaggaacugcgcgagagucgaaaggaagcuaucaacuacucccagcaauuggccaaggcaaaucucaaaauugaucaccuggagaaggagaccagccuacugcggcagucugaagggucaaacgugguauucaaaggaaucgaccucccugauggcauugccccaaguagcgcuuccaucauaaauucucagaacgaguaucugauucaucuuuugcaggaacuggagaauaaggaaaaaaaguuaaagaaccucgaggacucgcuggaggauuacaaccguaaauuugccguuaucagacaccaacagagccuucuguauaaggaauaccuauccgagaaagaaacguggaagaccgagucaaaaacaauuaaggaagagaagaggaaacucgaggaccaggugcagcaagaugcaaucaaggucaaagaauauaauaaccuguugaaugcgcugcagauggacagugaugagaugaagaaaauauuagcugaaaacucucgcaagaucacugugcuccaggucaaugagaagagccugauucggcaauacaccacacuuguggaacuggagagacaguugaggaaagagaacgaaaagcagaaaaaugagcuccuguccauggaagccgagguuugcgagaagaucgguugucuacagcgauucaaagaaauggcaauuuuuaagaucgccgcucugcaaaaggugguagacaacucagucagccuuucugagcucgaacuggccaauaaacaguacaacgaguugacugcaaaguaucgcgauauacugcagaaagacaauauguuagugcagcggaccuccaaccucgaacaucuggagugcgagaauauuagucuuaaggaacaaguugagagcaucaacaaagaacuggagaucacaaaggaaaaauugcacaccauugagcaggcuugggagcaggaaacuaagcucgggaaugagucuuccauggauaaggccaaaaagucaaucacgaacagugacauugugagcauaucgaaaaagaucacaaugcuggaaaugaaagagcuaaacgaaagacagagggcggagcacugucaaaagauguacgagcaucugcguaccucccuuaagcagauggaagagcgcaauuucgaacucgagacuaaauuugccgagcugaccaagauuaacuuggacgcucagaaagucgaacaaauguuacgggaugagcuggcagacucugugagcaaggccguaucagaugcugacagacagaggauccucgaacuggagaaaaaugaaauggagcuuaagguggagguuaguaagcugcgagaaauuuccgauaucgcccggcgccaggucgagauauugaacgcacagcaacagucuagagacaaagaaguggagagccuaaggaugcagcugcucgauuaucaggcgcaauccgacgaaaagucacugaucgccaaacuucaccagcauaaugugagcuuacagcugagugaggcuacagcccucggaaaguuggagucuauuaccuccaaacugcagaagauggaagcauacaaccuccggcuggagcaaaagcuugaugaaaaagagcaggcucuguauuacgcccgauuggaaggcagaaaucgcgcaaagcaccuaaggcagacuauccagagccugcgucggcaauucucgggcgcccuccccuuagcucagcaggagaaauucucaaagacaaugauucaacugcagaacgacaaacuuaagaucaugcaggagaugaaaaauucucagcaagaacauagaaacauggagaauaagacgcuggaaauggagcucaaguugaaagggcuggaggaacucauaaguacccugaaggauacuaaaggagcgcagaaggucauuaacuggcacaugaaaaucgaggaacuuaggcuacaggagcugaaguugaaucgcgaauuaguuaaggacaaagaggagaucaaguaucugaacaauauuauauccgaauacgagcgaacaaucagcucucucgaagaggaaauugugcagcaaaacaaauuucacgaggagagacagauggccugggaccagcgggaaguggaucuggagaggcagcuugacaucuucgaucgccaacagaaugaaauucugaacgcagcucagaaguuugaggaagccaccgguagcaucccugacccaucccucccguugcccaaccaacuggagauagcccuacguaaaaucaaggagaauauuagaaucauucuggaaacacgggcuacuugcaagucacucgaggaaaaacuuaaggagaaagagagugcacugagguuagccgaacagaacaucuugagccgcgauaagguaauaaaugagcugcgacucagacugccugcgaccgcugaacgggagaaacuuauugccgaacugggcaggaaggagauggagccaaagucucaucacacgcucaaaaucgcacaucagaccaucgccaacaugcaggcucgcuugaaucaaaaggaagagguccugaaaaaguaccagagauuacuagaaaaagcaagggaggaacagcgggagauugugaagaaacacgaggaagaccugcacauccuccaucaccgucuugagcugcaggccgauuccucauugaacaaguucaagcaaacagcgugggaccugaugaaacagagucccacuccuguuccaaccaauaagcauuuuauacgccucgcugaaauggagcagacaguggccgaacaggaugacagccuguccucucuucucgucaaacugaagaaagugucgcaagauuuggagcgacagagagagauuacugaacugaagguuaaggaguucgaaaacaucaaauuacagcuacaagagaaucacgaggacgaagugaagaaaguaaaggcagaggucgaagaucugaaauaucuccuugaccagagccagaaggagucacagugucugaaguccgaauugcaagcccagaaagaggcuaacaguagggcccccaccacgacaaugcggaaucugguggagcgccucaagucucagcuggcacuuaaagaaaagcagcaaaaagcuuuaagcagagcccugcucgaguugagggcggaaaugaccgccgcagcugaggaacggauuaucuccgccacuucacagaaggaggcucaucugaacgugcagcagauagucgaccgacacacaagagagcuaaagacccaaguugaagaucugaaugagaaccuccuuaaacugaaggaagcauugaaaacuucuaagaaucgcgagaacagccugaccgacaaccucaaugaucugaacaaugaauuacagaaaaagcagaaggccuacaacaaaauucuuagggagaaggaggaaaucgaccaggagaaugaugaacugaaacggcaaaucaagcgucucacaagugggcuacagggaaaaccgcugacggacaacaagcaguccuugauugaggagcugcaaagaaaagugaagaagcucgaaaaucagcuugagggcaaaguagaagagguggaucugaagccuaugaaagaaaagaacgccaaagaggaguugaucaggugggaagaggguaagaaguggcaggcuaaaauugaagggauacgcaauaagcugaaagagaaggaaggcgaggucuuuacccucacuaaacaguuaaacacacugaaggaccuuuucgcgaaggcagauaaagagaagcugacccuacaacggaaacucaagacaacuggaaugaccguggaccagguucugggcauccgagccuuggaaagcgagaaagaacuggaggaacucaagaagagaaaucuugaucuggagaacgacauuuuauauaugagggcucaccaggcccugccccgcgauucuguggucgaggacuugcaucuccagaaucgguaccugcaagaaaaacuacacgcacuugagaagcaguuuucaaaagacacguauuccaagccaaguaucagcgggaucgaaucggaugaccauugccagagagagcaggagcugcaaaaagaaaaccucaagcugucuuccgagaauauugaauugaaauuccagcuggagcaggccaacaaggaucucccucgucuuaagaaccaagugagggaccugaaagaaaugugugaguuuuuaaagaaagagaaggcugaaguucagcggaaacugggacacgugcgcgguagcggccgaucagggaagacaauacccgaguuggaaaagaccaucggacucaugaaaaaggucguagagaaagugcagagagaaaaugagcagcugaagaaagcgaguggcauucuaacuucugagaagauggccaacaucgaacaagagaaugaaaagcuuaaagcagagcuggaaaagcucaaagcucaucugggucaccaguuguccaugcacuacgagagcaagaccaaagggacagagaagauuaucgccgaaaacgagagguuacggaaggaacugaaaaaggagacugaugcagccgagaaacuccgcauagcuaagaauaaccuugaaauccugaaugagaaaaugaccguucagcuagaagagacaggcaagagacugcaguucgccgaaucaaggggaccacaacucgagggcgcggacaguaaaagcuggaaguccauuguggucacgcgaauguaugagaccaaguugaaagaacuggagacugauaucgcaaagaaaaaccagucuauuacagaccuuaagcagcuggugaaagaagccaccgagcgggaacagaagguaaauaaguacaacgaggaucucgagcaacagaucaaaauauuaaagcaugugcccgaaggggcugagacugaacagggacugaaacgugaguugcagguccugagacucgccaaucaccaacuugacaaggaaaaagcugagcugauucaucagaucgaggcaaacaaggaucagagcggugccgaauccacaauuccugacgcugaccaacuaaaggagaaaaucaaggaucuggaaacccagcucaaaaugucagacuuggagaagcagcaccugaaagaggaaauaaagaagcuuaaaaaggagcuggaaaauuuugauccaucuuucuucgaggaaaucgaggacuuaaaauacaacuauaaggaggaaguuaaaaagaauauucuccuggaggaaaaggugaaaaaguugagugagcagcugggcguggaacucacgucgccggucgccgcaagcgaggaguuugaagaugaggaagagucccccgugaacuucccuaucuacuga

SEQ ID NO: 54266 - RNA, 906 nt, Artificial Sequence
  derived and/or modified sequence opt3 from CEP41__Homo_sapiens__NP_001244087
augagccugagaaggcacaucggcaaccccgaguaccucaugaagcggauuccucagaauccacgcuaucaacauauaaaaucccgacuugacaccgggaacucuaugacaaaguacacugaaaaacuggaggaaaucaagaaaaauuaucguuacaagaaggaugaguuguucaaaagauuaaaggugacgaccuuugcccagcugauuauccaggucgcuucacuaagugaccagacacucgaaguuacugcagaggagauucaaaggcuggaagauaacgacagcgccgcguccgauccggacgcugagaccacagcccggaccaauggaaaagguaaccccggcgaacagucuccuucgccagagcaguucaucaauaacgcaggggccggagauucaagccgcaguacucuucaguccgugauaucuggcguaggugagcuggacuuggauaaggggcccgugaaaaaggcugaaccucacacaaaggacaaaccauaucccgauugcccuuuucuccugcuggacgucagagauagggacagcuaccaacagugucauaucgugggagcauauuccuacccaauugccacccucucacggacgaugaauccguacaguaacgacaucuuagaguauaagaaugcucacggcaaaauuaucauacuguacgaugacgaugaacgccuugccagccaggcggcaacuaccaugugcgagcgaggcuucgaaaacuuguuuaugcugucugggggaagacuaaaucaggccaacuccucagguagggagagcaagguucccggcgcucggagugcccaaaaucucccugggggaggcccagcaucucauuccaacccccguagccugucgucuggucaccuucaggggaaaccuuggaaguga

SEQ ID NO: 54267 - RNA, 1395 nt, Artificial Sequence
  derived and/or modified sequence opt3 from CEP55__Homo_sapiens__NP_001120654
augagcuccagaucuaccaaggaccugaucaaaucaaaguggggcaguaaacccagcaacuccaagucugagacaacucucgaaaaacuuaagggggagauugcccaccugaagacgucgguggaugaaauaaccucaggaaaagguaaguugacagacaaagagaggcaucgguuacuggaaaagauccgcguccuagaggcugagaaagaaaagaaugcauaccagcucacugagaaggauaaagaaauucaacgacugcgugaccagcuuaaggccagauauagcaccacagcgcuguuggagcagcucgaggaaaccacuagggagggcgaacggcgcgagcagguucugaaagcucugagugaagagaaggaugugcucaaacaacaguuauccgccgcaacaucuagaaucgccgagcuggaaagcaagaccaacacgcuuagguugucccagacuguagcuccuaauugcuucaacucaaguauuaauaacauccacgagauggaaauacagcugaaagacgcacuagagaagaaucaacaguggcucguguacgaucagcagcgggaagucuaugugaaggggcugcuugccaaaaucuuugagcuggagaagaaaaccgaaacagcugcccauagcuugccacaacagacuaagaaaccggagucugaaggauaccuccaggaggaaaagcaaaaguguuauaacgaccuguuagcguccgccaaaaaggaucuggagguugagcgccagaccauuacacagcucucauucgaacuuagcgaguuucgaagaaaauacgaagagacccagaaggaggugcacaaucugaaccaauugcuauauagucagaggcgggcagacguccagcaucuggaagaugaccgucacaaaacggagaagauccagaagcuccgcgaagagaaugauauugcuagaggcaaacuggaagaggagaagaaaaggucugaagaacuucugucccaagugcaguucuuguacacuagccuccugaagcagcaggaggagcaaacacggguagccuuacuggaacagcagaugcaggcaugcacccuagacuuugagaacgagaaacucgaccgacaacacguucagcaucagcugcacgugauccuuaaggaauugcgcaaggcuagaaaucaaauaacucagcuggagucgcucaaacagcugcaugaguucgccauuacagaaccccuugucaccuuucagggugaaacggagaacagggagaagguggcggccucuccuaaauccccaaccgcagcucugaaugaaucauugguggagugucccaagugcaacauccaauacccugccacagaacaccgggaucuccugguccacguugaguauuguaguaaauga

SEQ ID NO: 54268 - RNA, 1476 nt, Artificial Sequence
  derived and/or modified sequence opt3 from CEP57__Homo_sapiens__NP_001230705
augcugaccagaaucgacaacagcuucgccgagcccuccaggucuaauggcucaauggugcggcacaguagcuccccuuacgucguuuauccaucugauaagccguuucucaacucggaccuucgccgaucacccagcaaaccuacacuggcuuacccagaaaguaauucccgugcaauuuucucugccuugaagaacuuacaggauaaaauaagaaggcuggagcuagaacggauccaagcggaggaaagcgugaagacucucucccgcgagacgauugaguauaaaaagguacuggacgaacagauccaggagagagaaaauucaaagaacgaggagaguaaacauaaucaggaacuuaccagccaacuguuggcugccgagaacaagugcaaucuccuggaaaaacagcuggaguacaugaggaacaugauuaagcacgcagaaauggagcggacaucugugcucgagaaacaggucuccuuagaacgcgagcgacagcaugaucaaacucacgugcagucacagcuggaaaaacuugacuugcuggagcaggaauauaauaagcuaaccacaaugcaagcccucgcugagaaaaagaugcaggagcuggaagcaaaacuucaugaggaagaacaggaaagaaagaggaugcaagccaaagcugccgagcugcagaccggguuggagacuaaccggcucaucuuugaagauaaggcgacacccuguguuccuaaugcacgucgcauaaagaagaagaaaagcaagccacccgagaaaaagaguucuagaaacuacuucggagcccagccucacuauaggcugugcuuaggugacaugccauuuguggcuggcaaauccaccagcccgucgcacgccgucguggcaaauguacagcugguucuccaucuuaugaagcaacacucuaaggcucuguguaacgaucgggugaucaacuccauucccuuggccaaacaggucucaagucgagggggaaagagcaaaaagcuauccgugacgccuccaucuagcaauggcaucaacgaggagcugucagaggugcuccagacucugcaggacgaguucggucaaaugaguuuugaucaucagcagcuugcgaaacugauucaggaaucccccaccgucgaauugaaggacaagcucgagugcgaacuggaggccuuaguugggcgcauggaggcaaaagcuaaucaaaucacaaaggugagaaaauaccaggcccagcuggaaaagcagaaacuagagaagcaaaagaaagaacucaaggcuacuaaaaagacccuggaugaggaaaggaacucuagcucacggaguggaauaacaggcaccacgaauaaaaaggacuucaugaaacuucgcccuggcgagaagagaaggaagaacuugcagcugcucaaagacaugcagagcauucaaaauucccugcagucuucgagccuuuguugggauuacuga

SEQ ID NO: 54269 - RNA, 1488 nt, Artificial Sequence
  derived and/or modified sequence opt3 from CEP63__Homo_sapiens__NP_001035842
auggaggcccugcucgaaggcauccagaacagagggcacggagguggcuuccuuaccagcugcgaggcugaacugcaagaguugaugaagcagauugacauaaugguggcacauaaaaaguccgaaugggaggggaggacacacgccuuagagacuugucugaaaauccgggaacaggagcuaaagucucuccgcucacagcuggaugucacgcauaaagaaguuggaaugcuucaccaacagguggaggagcaugaaaagauuaagcaggagaugaccauggaauacaaacaggagcugaagaaauugcacgaagaacucugcauccugaagcgaaguuaugagaaacugcaaaagaagcagaugcgugaauuuagaggcaauacaaagaaccacagggaggaccggagcgaaauugagcgccucacugcgaagaucgaagaguucagacagaaauccuuagauugggagaagcagaggcugauauaccaacagcagguaucuucgcuugaagcucaacggaaagccuuggcagagcagucagaaaucauucaggcccagcuggugaaucgcaagcaaaaacuagagagcgucgaacucaguucccagucugagauccagcaucugagcuccaaacuugagcgagcuaacgacaccauuugugcaaaugaacuggagaucgaaagauugacaaugagggugaacgaucucguugguaccucaaugacugugcugcaggagcaacagcagaaggaggaaaaauuacgggagagugaaaagcugcucgaggcccuucaggaagagaaacgugagcugaaggcugccuugcaaagccaggaaaaucuaauacacgaggcgcgcauucagaaagaaaagcugcaggagaaggucaaagcaacaaacacccaacaugccguggaagcuaucucucucgaguccguaucagccacgugcaagcagcugagccaggagcuuauggaaaaauaugaggaacugaagagaauggaggcacacaauaacgaauacaaagcugagauuaagaaguugaaagagcaaauccuccagggggaacagaguuauucuuccgcccuggagggaaugaagauggaaaucagccacuuaacucaggagcugcaucaaagggacauuaccauagcgucgacaaaagggucuuccucagauauggagaagcggcuacgagccgaaaugcagaaagcagaggacaaggcuguugaacacaaggagauccucgaucagcuggaaagucuuaaauuggagaaucgccaucugagcgagauggugaugaagcucgaacugggccuucacgaguguucccugcccgucucuccuuugggcagcauugccacuagauuucucgaagaggaggagcugaggucacaucacaucuuagagcggcuggacgcucacauagaggaacuaaaacgcgaaagugagaagaccgugagacaguucacagcccucaaauga

SEQ ID NO: 54270 - RNA, 2274 nt, Artificial Sequence
  derived and/or modified sequence opt3 from CEP68__Homo_sapiens__NP_055962
auggcccugggcgaggaaaaggcugaggcagaagccagcgaggacaccaaagcgcaguccuacgggagaggaucuugcagggaacgggagcucgauauccccgguccuaugucaggcgagcaaccaccgcgccuugaagcugaagggggacugauuagucccguguggggcgccgaagguauaccugcaccaacauguuggaucgggacugaccccggaggcccuagccgagcccaccagccacaggcuuccgaugcaaaccgugagcccgucgccgagagaucugaaccugcuuugucgggcuuaccaccggccacgauggggucaggagaccugcuacucagcggugagagucagguugaaaagaccaaacuguccucuagcgaggaguucccccaaacacuuucccugccuaggacuaccacaauuugcucaggccaugaugcggacaccgaggaugacccaaguuuggcagaucucccccaggcccuggaccugagccagcagccucacucuuccgggcucucauguuuaagccaauggaagagugugcugucuccaggauccgcugcccagcccagcucgugcucuaucuccgcaucaaguacuggcagcucccuucagggucaucaggagcgggcugaaccgcgcgggggaucuuuggccaaaguaagcucaagucuggagccuguggucccccaagaaccauccagcgugguuggccuaggcccuagaccccaguggucuccacagcccguguuuucagggggagaugcgaguggucucggcaggcggcgccugagcuuccaagccgaguauugggcauguguccuuccugacucccugccaccgucucccgaucgacacucgccuuuguggaauccaaacaaggaauacgaggaccuccuggacuauacauaccccuuaagaccugggccacagcugcccaagcaucucgauagcagggugccggcugacccuguacuucaggauuccggaguugaccuggauucauuuagugugucuccagccagcaccuugaaaucccccacgaaugucucaccuaacugucccccagcugaggccacugcacuaccuuucagcggcccccgggaaccaucucugaagcaguggccgucccgugugccucaaaaacagggugggaugggccucgccaguuggagccagcuggcuucuacaccccgcgcgccaggauccagagacgcaaggugggagcggcgagaacccgcccuucgcggcgcuaaggauagacugaccauugggaaacacuuggacaugggaucaccucagcucaggacucgggaucgcgguuggccaagucccagaccugagagggaaaagcguaccagccaaucggcccggcgaccgacaugcaccgaguccagauggaagucugaggaagagguggaaagcgacgaugaguaucuggcauuaccagccaggcugacgcaggucucaagucuaguuuccuaccucggcucuaucagcacucuggugacacuucccaccggggacauaaaaggacaguccccuuuggagguaucagacagcgauggcccagcuaguuuucccucuuccagcucgcagucacaacugccuccgggugccgcacuccaggggucuggcgaccccgaaggacagaauccaugcuuccugcgcaguuuugugcgggcgcacgauuccgcuggcgaggggagccuuggaucuagccaggcccugggugucuccucaggcuugcucaagacuagaccuagucugcccgcaagguuagaccgcuggccauucagcgauccugacguggaagggcaacugccccgaaaaggaggcgagcaggguaaggaaucucuaguucagugugugaaaacauuuugcugucaacucgaggagcugaucugcuggcuuuauaacgucgccgaugugaccgaccaugggacggcugcccgguccaauuugaccucacugaagaguagccuccagcuguaccgucaguucaaaaaggauauugacgaacaccaguccuuaacagagucuguacugcaaaagggcgaaauccuuuugcagugccuccuggagaacacuccaguucuagaagaugugcugggaagaauugcaaaacagucgggcgagcucgagagccaugcugacaggcuguacgauucaauccuugccuccuuggacaugcuggcgggguguaccuuaauaccggacaagaaaccuauggccgcuauggaacaccccugcgagggagucuga

SEQ ID NO: 54271 - RNA, 1944 nt, Artificial Sequence
  derived and/or modified sequence opt3 from CEP72__Homo_sapiens__NP_060610
auggccagagcuggccccaggcuggugcucagcgaggaagcaguccgggccaaguccgggcuuggaccucaccgcgaccuggcggaguugcaaucuuuaucaaucccagguaccuaccaagagaaaauuacacaucugggccacagucuaaugagccucacugggcugaagucccuugaucugucucgaaacucguugguuucacucgagggaauacaguaucugacggcucuggaaagccucaauuuauacuauaacugcaucaguucccuggccgagguguuccgucuucaugcauugaccgagcugguagacguggauuuuagacuaaauccggucgugaaaguugaacccgacuaccgacucuucgugguccaucugcuuccuaagcugcagcaguuggaugaccggccagugcgcgccucugagagaaaagcuagcaggcuccacuuugcauccgaagauucacuggacaguaaggagagcguacccgccucuuuaaaggagggccggccucaccacccacgcgcuaaauguacagaagcccuggcgaagcaaucccucguuauggaugcagacgaugaggccgugcuuaaccugauugcugaaugcgagugggacuugggucgacccccugggucaacuagcuucagucagaaaggaagagaagccgauucuaggggcucccaggagagccggcaucuacugucgccacagcucguccaauaucaguguggcgacucugggaagcagggacgugagacccgcagauccucaugcagggguuguugccuggagaaaaugccguggagucagcuuuguggcgaacugcccccuuuguacggggcagaaccagaggcuagccgggcccccaggccucacacauauuuuaccccacaucccgacuccauggauacugaagacucugcgagcucacaaaagcucgaucugaguggagagauggugccgggcccuuuacccgccccagguaagugccgcaaaagaaggaugccuguggggcgguuccagacauuuuccgaccaggagggacugggcugucccgaacgcacccacggcagcucugucccaaaggagucacuaaguagacaagauagcuccgaaucuaggaaugggcguacgcucucgcagcccgaggcaagcgaaacugaggagcagcggucccgaggaguuaccgacacaagagaaccuucaccagguagucacucugcucugccgggcaaaaagacugcccuucaggcugccuugcuggagacccuccuggaucuuguggacaggagcuggggagggugccgcucccugcauucaaacgaagcauucuuggcccaagcucggcacauccucagcucuguagaggaguuuacagcggcacaggauuccagugccauggugggcgaagacgucgguagccuggcuuuagagucuaaaucccugcagucaagacuagccgaacagcaacagcagcaugcaagggagaugagugaagugaccgccgagcuccaccauacgcacaaggagcuggaugaccuucgccagcacuuggacaaaagccuggaagaaaauucgcgacucaagucccuguuacugucuaugaagaaagaaguuaagagcgcugauacugccgcaacacuuaacuugcaaauugcggggcuccagaccucagugaaacggcuguguggcgagaucgucgaacuaaagcagcaucuggagcacuacgacaaaauacaggagcucacucaaaugcugcaggaaagucauuccucucuugugagcacaaaugagcacuugcugcaggaauuaucccaaguacgugcucagcacagagccgagguugaacagaugcauuggucauaccaggagcucaagaagaccauggcacuguucccccacagcagugccucucauggaggcugccaggcuugcuga

SEQ ID NO: 54272 - RNA, 1755 nt, Artificial Sequence
  derived and/or modified sequence opt3 from CEP76__Homo_sapiens__NP_001258918
augagccugcccccugagaaggccuccgaacucaaacagcuuauccaccaacagcugucuaagauggacgugcauggcagaauuagggagauauuggcugaaaccauccgggaggaauuagcaccagaucagcagcaccugucaacagaggaccuaauuaaagcccuccgccgacgugggaucauugaugacgucaugaaggagcugaacuucguuacugauaguguggaacaagagcuuccgagcucccccaaacagccuaucugcuuugacagacagucuacgcugaagaagucggauggaaccaggauggcggacucaacaacuauguugagcauaagugauccaauccauaugguacucauuaaaaccgacaucuucggugaaacaacccugguggcuuccuacuuucuggaguggcggucuguccucggcagcgagaauggggugacuuccuuaacaguugaacugaugggagugggcaccgagucaaaggucaguguggguauucuuaacaucaaauuggaaauguaucccccucugaaucagacgcuaagccaagagguaguuaacacucagcucgcccuggaacgccagaagaccgcagagaaagagagacuuuuccugguguacgccaagcagugguggagggaauauuugcaaauacggccaucucacaauucccgccucgucaagauuuuugcucaggaugagaacgggaucaaucgacccguguguucauacgugaaaccucugagagcaggaagguuacuggacacaccacggcaggccgcucguuucgucaacguucucggcuaugaacgcgccccggugauuggcgggggagguaagcaagagcaguggugcacucuucuggcguuuuuguguagaaauaaaggcgauugcgaagaccaugcaaaccuacuguguagccuccugcuuggguacggacuggaggccuucguaugcgugggcaccaaggcuaaaggugucccccacgccugggugaugacaugugggaccgacggagcaaucacguuuugggagaguuugacuggccacagguauauccauaagccuacaaauccagaugaacccccuguugcugagcagccaaaaccccucuacccguaccggaccauuggcugcguguucaaccaccagauguuucuggggaauugucaaccuucugacgccgucgaaacuugcguguucgauuuaaacgacgaguccaaguggaagcccaugagcgaagaggcgauaaaaucgguaugugccccaggagcaacaaccucucugccucccuuuccaccccuaugcgcuuccacgaucgaugccucaguuaccaguaaugagauugaaaugcagcuccgacugcuugugagcgagcaucgcaaggacuugggucugacaacugucugggaagaucagcucuccuaucugcuuucuccugcucuggccagcuacgaguucgagagaaccacaucaaucagugcaggcaacgaagaguuccaggacgccauaaggcgggcugugccagaugggcacacuuuuaaaggauucccgauucacuuugucuaucgcaacgcgagaagggcauucgcuaccugcuugcguucccccuuuugugaagagaucaucugcugucggggcgaccaagugcgacucgccguuagagugaggguauucacauacccugaaagcgccugcgcagucuggauuauguuugccuguaaguaucgcucugugcuguga

SEQ ID NO: 54273 - RNA, 2106 nt, Artificial Sequence
  derived and/or modified sequence opt3 from CEP83__Homo_sapiens__NP_057206
augguggucagcaccuucacagacauggauacuuuucccaacaauuucccuccaggcggggacuccggacugacggguucucagucagaguuucaaaagaugcucaucgaugaaagacuuaggugcgagcaccauaaagccaacuaccagacccugaaggcugaacacacacgguugcagaaugagcauguuaaauuacagaacgaacugaagcaccuauucaaugagaaacaaacucagcaggagaagcuccagcugcuucuggaagaguugcgcggcgaacucguggagaagaccaaagaccuggaggaaaugaagcugcaaauucucacaccgcagaaauuagagcugcuucgagcacagauacagcaagaauuggagacccccaugcgugaaagauuuaggaaccuggaugaggagguagaaaaguaucgggccguguacaauaaacuacgcuaugagcauacuuuccucaagagugaauuugagcaccagaaggaagaguacgcgagaauccuggacgaggggaaaauuaaguaugaaagcgagaucgcuaggcuugaagaggauaaagaagaacugcggaaccaguugcucaaugucgaccugacaaaggauuccaaacgcguggagcaauuagcccgagaaaagguuuaccugugucagaaacucaagggacuugaggcagaaguggccgagcugaaggcugagaaagaaaacucugaggcacaggucgaaaaugcccagaggauucaagugagacaguuggcugagaugcaggccaccguacggucgcuagaagcggagaagcagucagcaaaccugcgugccgagcgccucgaaaaagagcugcaaagcaguuccgaacagaauacguuccuuaucaacaagcugcacaaagcugagagagaaauaaauacuuugucuagcaagguuaaggagcucaaacauuccaacaagcuggagaucaccgacauuaaauuagaaacagccagggcaaagucagagcuggaacgggagcgaaacaaaauccagagugaacuagauggccuccagagcgacaaugagauucugaaggcugccguggagcaccauaagguccuuuugguggaaaaagaucgcgagcugaucagaaaggugcaagcggccaaagaagaggguuaucagaagcucgucguucugcaggacgagaaacuugaacuggagaacagguuggcagaccucgaaaagaugaagguggagcacgauguauggcggcagucugaaaaagaccaauacgaggagaagcugcgcgcuucccagauggccgaagagauaacuagaaaagaauuacagucagugaggcugaagcuacaacagcagauugucaccaucgagaaugcugaaaaagagaagaacgagaauagcgaucucaaacagcaaauuaguucucugcagauccaggugacaucccuugcccagagcgaaaacgacuugcucaauucgaaccaaaugcugaaggagaugguugaacgucugaagcaggagugccggaauuuucgaucucaggcagaaaaagcccaguuagaggcugagaagacccuggaagagaaacaaauccaguggcuugaagagaagcacaaauugcaugagagaauuacggauagggaagagaaguacaaccaggcgaaggaaaaacuccaacgcgcagccauagcucagaagaaacggaagucccugcacgagaauaaacuaaagagacugcaggaaaagguggagguccucgaggccaaaaaggaggagcuggaaacugagaaccaggugcuuaauaggcaaaacguaccuuucgaagacuauacacgcuugcagaaacgacugaaggauauccagcggcgucauaaugaguuuagaucauuaauucucguuccaaacaugcccccuaccgcaaguaucaacccagugagcuuccaguccucugccaugguccccagcauggagcugccuuuuccaccgcacaugcaagaggaacagcaucagagggaacuuucacuguugcgcaaacggcucgaggaacuggagacuacacagagaaagcaacuagaggaacuggggaguuccggagaguga

SEQ ID NO: 54274 - RNA, 2418 nt, Artificial Sequence
  derived and/or modified sequence opt3 from CEP85L__Homo_sapiens__NP_001035940
auguggggcagauuccuggcccccgaggcuagcgggagggacuccccuggaggugcacggucuuuuccagccggcccggauuacucaagugcguggcuccccgcuaacgaaagccuuuggcaggccaccacagugccuuccaaucaccgcaacaaucauauccgacgucacucuauugcaucggacucaggggauacuggaauaggcacgagcugcagugacuccgucgaggaucauucuaccagcuccgguacacugucauucaagccaagucagagcuugaucacuuuacccaccgcccacguuaugccuucuaacuccucagcuagcauuaguaaacugagagaaucucuaacaccagacggguccaaguggagcaccucgcucaugcagacucugggaaaucauucuaggggcgagcaggauuccucacuugacaugaaagauuuucggccccugcgcaaguggaguagcuuguccaaacucacagcaccugacaacuguggccaagggggaaccgugugcagagaagagucuaggaauggucuggagaagaucggcaaggccaaagcucugacgagccaacuccggacuauugggccaucauguuuacacgauaguauggaaaugcugcgccuugaggacaaggaaaucaacaaaaagcgauccagcaccuuggauugcaaauauaaguucgagucuuguucaaaggaggacuuuagagccaguagcuccacacugaggcggcagccgguagacaugacuuacucugcgcuacccgaaucgaaaccuauaaugaccagcuccgaggcauucgaaccacccaaguaucucaugcugggacagcaggccgugggcggugucccuauccaaccaucagugcguacacagauguggcuuaccgagcagcugcgcacgaaucccuuggaagggagaaacacugaggauaguuacucucucgcuccguggcagcaacagcagauugaggacuuuaggcaaggaagcgaaacaccuaugcagguucugaccggcuccucacggcagagcuauucucccggcuaccaggauuucuccaaaugggagaguauguuaaagaucaaagaagggcugcuccgacaaaaggagauugugaucgaccgccagaaacagcagauaacucaccuucaugaaagaauuagggauaaugagcugcgggcccaacacgcaauguugggacauuaugucaacugcgaggacagcuacguggcuucucuacagccacaguacgaaaauacaucccugcagaccccuuuuucagaggaaaguguaagccacucgcaacagggugaguucgaacagaagcucgccuccacggagaaggagguucugcagcuuaacgaauuucugaaacaacgcuugucucucuucagcgaggaaaagaaaaagcuggaggagaaauuaaagaccagagauagguauaucucaagucugaagaaaaagugucagaaagaauccgagcagaauaaggaaaaacaacgucggauugagacacuagaaaaguaccucgcggaccugcccacucuugaugacgugcagucucagagcuugcagcugcaaauccucgaggagaagaacaaaaaccugcaggaagcccuuaucgauaccgagaagaaacuggaagagauuaagaaacagugccaggacaaggaaacacaauugauaugucagaagaaaaaggagaaagagcucgucacuaccgugcagucccugcagcaaaagguggaacgaugcuuagaggacggcaucagacugccaaugcuagaugcaaaacagcuccagaaugaaaacgacaaucugaggcaacagaacgagacagcuucaaagauuaucgauagccagcaggacgaaauagaucgcaugauucuugagauccaaaguaugcaggggaaauugucuaaggagaagcugaccacucagaaaaugauggaggaacucgaaaagaaagagcggaauguccagagacugacgaaggccuuacuggagaaccaaaggcagacagacgaaaccuguucccuuuuggaucagggacaggagcccgaccaaagccgccagcagacuguucucucgaaacgaccucuguuugaucuaaccgugaucgaccagcuguucaaggaaaugucaugcugccucuucgaucugaaggcucuuuguucuauuuugaaucaacgggcccagggcaaagagccaaaccugaguuuacuccuggguauccguuccaugaauugcagcgcagaagagacagagaacgaccacucuaccgaaacucuuacaaagaaacugagcgauguaugucaguugagaagggacauugacgagcuccgcacgaccauauccgaucgguaugcccaagacaugggggauaauugcaucacucaguga

SEQ ID NO: 54275 - RNA, 2352 nt, Artificial Sequence
  derived and/or modified sequence opt3 from CEP89__Homo_sapiens__NP_116205
augcugcucggcuucagaagggggcggcgcagccacuuuaagcauaucauucacggacuucugcccgccgcuuccguggcaccuaaagccgcggucccacgaaccccgcccccucguucuccaaaccccucaccugagagaccaaggagugcuuuggccgcagccauauuagcuacaacucugacgggucggaccguugcaaucccccagccucgccaaagaagcagguccgaaucugacgugucgucaguagagcaggauagcuucauugaaccauacgccacaaccagucagcuacggccgcgccccaauuggcaguccgagaugggccgaagaucuagccucccuuccuuugaaacucuggacuauggggaugaggaggacaucgaaacacaacuuucaaguagcggaaaggagcugggcgaugugucugcuagggaagaccggggugggcauuccgaugacuuguacgccgucccacaccguaaccaggugccccuccugcaugagguuaauucagaggaugacgaaaacauuagccaccaggauggauucccuggcaguccacccgcgccgcagcgcacccaacagaaagacggcaagcacccugugcugaaucucaaagaugagaagcccccauuaugcgaaaagccucccccaucucccgacaucacugggagagcaaggcagcgguauacagagauaacccgagaaaaauuugaggcccugaaggaggaaaacauggaccuuaauaacaugaaucaguccuugacgcuggagcuaaacacuaugaaacaagcuaugaaggaacuccagcugaaacuuaagggaauggagaaggaaaaacgcaagcugaaagaggccgagaaggcaagcucgcaggaagucgcugccccugaguugcucuaccugagaaaacaagcgcaggaauuaguggaugagaaugacggucugaagaugaccguacauaggcucaacguugaacuuucucgguaucagacaaaauuccgccaccuguccaaggaggagucauugaauaucgaaggccuaccaaguaaggggccgauucccccuuggcugcucgauaucaaauaccugagcccacuucuguuggccuaugaggacaugaugaaggaaaaagaugagcucaacgcaacucugaaggaggaaaugagaauguuuaggaugcgugugcaggaggucgugaaagaaaaugaggaauuacaucaagagcugaacaaguccucugcugugaccagcgaggaauggcggcagcuacagacacaggccaagcucguccuggaggaaaacaaacuuuugcuggagcaacucgaaauucagcagcgaaaggcuaaagacucacaccaggagagacugcaagagguuaguaaacuuaccaagcagcugauguugcucgaagccaagacgcacggacaggagaaggaacuggcagagaauagggaacaguuagagauccugcgcgccaaaugucaagagcuaaagacucauuccgauggcaaaauagcuguggaaguacacaagagcauugugaacgagcucaaaucucagcugcagaaggaagaggagaaggaacgggcggagauggaggaacuuauggaaaaauugacaguccugcaagcacagaagaaaucacuccuguuagagaagaauagucugaccgagcagaacaaagcccuugaagcugaguuggaaagagcccagaagaucaauaggaaaagccaaaagaagauugaggugcucaaaaagcagguugaaaaagcaauggguaacgagauguccgcccaucaguaccuggcuaaucuaguggggcuggccgagaacaucacucaggaacgcgacucucucaugugccuggcaaagugucuugagucggaaaaagauggagucuugaauaaggugaucaagagcaacauucgacugggcaaauuagaggaaaagguaaaaggcuacaagaaacaagcggcucucaagcugggggacauaucccaccggcuucuggagcagcaggaggauuucgccggaaagacagcacaguaucgucaagaaaugagacauuugcaccagguucucaaagacaagcaggaggugcuggaccaagcccuacagcagaauagggaaauggagggugagcuggaagucaucugggagucaaccuuucgcgaaaaccggagaauuagggagcuccugcaggauacgcuuacccgaacaggcgugcaagacaauccccgcgcuuuggucgccccuagucugaacggggugucucaggcagauuuacucgacggaugcgauguuuguagcuacgaccugaaaucccacgcuccaacuugcuga

SEQ ID NO: 54276 - RNA, 804 nt, Artificial Sequence
  derived and/or modified sequence opt3 from CER1__Homo_sapiens__NP_005445
augcaucugcuccuuuuccagcuguugguguuacugccccuaggcaagaccacaagacaccaagacgggaggcagaaccagagcucccucucuccuguccugcuuccacggaaucagcgcgagcugccgacuggaaaccacgaagaggccgaagagaaacccgauuuguuuguugcugugccucaucucguagcaacgucaccagccggugaaggccaacgacagcgugagaagaugcugaguagauucgggagguuuuggaaaaagcccgagcgggaaaugcacccuagccgcgacuccgauucugagccauuucccccuggaacccagucgcugauccagccaauugacggcaugaaaauggaaaagucaccgcucagagaggaggcgaagaaauucuggcaucacuucauguuuaggaagacacccgcuagccaaggugugauauuaccuaucaaaagucacgaaguccauugggagacuugccggaccgugccauucucccagacaauuacccacgaagggugugagaagguugugguccagaauaaccugugcuuuggaaaauguggcucugugcauuuccccggcgccgcacagcacagccacacuuccugcucacauugucuuccugccaaguuuacaaccaugcacuugccacugaauugcacggaacuaaguagcguaaucaagguugugaugcucgucgaggagugucaaugcaaagugaagacugaacaugaggaugggcacauucugcaugcuggaucucaggacuccuucauccccggugugucagcauga

SEQ ID NO: 54277 - RNA, 1614 nt, Artificial Sequence
  derived and/or modified sequence opt3 from CERK__Homo_sapiens__NP_073603
augggcgccaccggggcugcagagccccugcagagcgugcucugggucaagcaacagagaugcgccguuucccuugaaccugcgagggcucuguugcggugguggcgcucuccaggaccgggugccggcgcacccggggccgacgcuuguucagugccuguaagugagaucauugcaguggaagagacagauguccacggaaaacaucagggcagcgguaaguggcagaaaauggaaaagccauacgccuucacugugcacugcguuaaacgagcucguagacauagguggaagugggcccaagugacguuuuggugucccgaggagcaguuaugccaccuguggcuacagacccuccgggaaaugcuggagaaacuuacaucccgcccuaaacaucuguuggucuucauaaacccauuugggggaaagggccagggcaaaagaaucuaugaaaggaagguggcgccccucuucacucuggcaucuauuaccacagacaucauuguaaccgagcacgccaaucaagcuaaagagacucuguacgaaaucaacauagauaaguaugacgggaucguuugugugggaggugauggcauguuuucggagguccuccacggguuaauuggacggacacagcgcucagccggcguggaccagaaucauccucgagcagugcuggucccaagcagucuuagaaucgguauuaucccggcuggguccaccgauugcguuuguuacucuacggugggaacuagcgacgccgaaaccuccgcguugcacauaguagugggcgauucacuggccauggacgucaguagcgugcaucacaacucuacacuacucagguauuccguuucacugcuuggcuacggguucuauggagauauuaucaaggacagcgagaaaaagcgguggcuggguuuggcacguuacgauuuuaguggccucaaaacuuuccugucucaccauugcuacgaagggaccguguccuuuuuacccgcucagcacacagucggaagcccucgcgacagaaagccauguagggccggcugcuucgugugucggcaaucgaaacagcagcuggaggaggaacaaaagaaagcucucuauggucuugaggccgcagaagacguagaggaauggcagguugugugcgggaaguuucuggccauuaaugcuaccaacaugucuugcgcgugucgacgcucccccagaggcuugaguccugcagcccaucuaggagauggcucaagcgaccugauccucaucaggaagugcucccgguucaauuuucugcgcuuccuuauuagacacacgaaccagcaggaucaauucgacuuuacuuucgucgagguguacagggucaaaaaguuucaguucacaucuaaacauauggaggaugaagacagcgaucugaaggaagggggaaagaagcguuuuggucacauauguucaagucacccauccugcuguugcaccgugagcaauucuucauggaacugugacggcgagguuuugcauagucccgcuaucgaggugcggguacacugccagcucguccgacuguucgccagagggauugaagagaauccgaagccugauagccauuccuga

SEQ ID NO: 54278 - RNA, 1677 nt, Artificial Sequence
  derived and/or modified sequence opt3 from CERKL__Homo_sapiens__NP_001025482
augcccuggagaaggcggcgcaaccgagugagcgcccuggagggcgggcgugaagaggaagcuccuccagaggcagccgcggucccgcccgcucuccuuaccuccccucagcaaacagaagccgcagccgagagaauccuguugaggggaauuuucgagauaggucgggacucuugcgauguuguguuaucagaacgcgcucugagauggaggccaauccagcccgagcggccugcaggcgacaguaaguacgaucuacucuguaaagaagaguuuauugagcugaaggacaucuucagcguaaaacuuaagcgccgaugcuccgugaaacagcagagaucugggacucuguugggaauuacgcucuuuaucugucugaagaaggaacaaaauaaacugaagaacucgacccucgauuuaauaaaucugucagaggaccacugcgauaucugguucaggcaguuuaaaaagauucuugccggcuucccaaaccggcccaagagcuugaagauccugcuaaauccucagagucauaagaaagaagcuacacaggucuauuacgagaagguggaaccacuccugaaacuugccgguauuaagacugacguuaccaucauggaguaugaggggcacgcgcuguccuugcucaaagaaugugagcugcaaggauuugauggcggccaucguaagccguuauucgcaauacacuggucugugcagcgccuguuuacagggaugcagacccucgaacccagcgucgugugcguaggaggugacggcuccgccucagagguugcucaugcccuucuguugagagcacagaaaaacgcugggauggaaacugauaggauucuaacaccugugcgggcccaacugccacucggacugauccccgcgggcaguaccaauguccuugcccacagccugcacggugugccucaugugauuacggcaacuuugcacaucaucauggggcauguccagcucguugacguguguaccuucucuacagcuggaaagcuguuacgauuuggcuucuccgccauguuuggcuucgggggacgcacucuggcucuagccgagaaguacagauggaugucaccaaaccagaggcgggauuucgcaguagugaaagcccucgcuaagcugaaagcggaggacugcgaaauuagcuuucuucccuucaauaguucugacgauguccaagagcgcagagcacaggguuccccgaaaagcgacuguaacgaucaguggcagaugauacaaggccaguuuuugaaugugucgaucauggccauuccuugccuguguucuguugcucccagggggcucgccccaaacacccgucugaauaacggauccauggcacuuaucauagcccggaauacaucacgaccugaguucauuaaacaccugaagagauaugcuagugugaagaaccaguuuaacuuccccuuugucgaaaccuacacgguggaagagguaaaaguucacccaaggaauaacacuggcgguuauaaucccgaggaagaggaagacgagacagccagcgagaacugcuucccuuggaauguggauggggacuugauggaagucgcauccgaggugcauauccgccuccacccacggcugaucucuuuauacggcggaagcauggaagagaugauuccgaaguga

SEQ ID NO: 54279 - RNA, 720 nt, Artificial Sequence
  derived and/or modified sequence opt3 from CERS1__Homo_sapiens__NP_001277194
augcccgagagcgccuggaaguuccuguuuuaccucggcuccuggucuuauucagcuuaccuucuguucgggaccgacuauccauuuuuccacgauccuccgaguguguuuuacgacuggacacccggaauggcagucccuagagauaucgccgcggcuuauuuguuacaggguagcuucuacggccauuccauuuaugccacucuguacauggacacguggaggaaagauucuguugugaugcuacuccaccauguagugacccugauacuuaucgucucgucauacgcauuucgguaucacaacguggggauucugguuuuguuccuccaugacaucagcgaugugcaacuggaauuuacaaagcugaauauuuacuucaaaagucgcggaggcuccuaucaccgacuccacgccuuagcugcagaccuggguugccuuucuuuuggguucagcugguuuugguuccguuuguacugguucccacugaagguccuauaugccacuucccauuguucacucagaaccgugcccgauaucccuuuuuacuucuuuuucaacgcucugcuucuguugcucacacugaugaauuuauauugguuucuguacauaguagccuucgcggcaaaaguucucaccggacaggugcacgagcuuaaggaccugagggaauacgauacugccgaggcucagaguuugaagccaagcaaagccgaauga

SEQ ID NO: 54280 - RNA, 1203 nt, Artificial Sequence
  derived and/or modified sequence opt3 from CERS2__Homo_sapiens__XP_011507753
auggugccccuggcccuccacuucccuggcgaggucgggcuucaggaaaccgcuguuagaaugcugcaaacauuguacgacuauuuuuggugggagagguuauggcugccagugaaccuaacuugggcagaucucgaagaccgggauggacgcguauacgccaaggcgagcgaccuguauaucacgcuuccgcuggcucuccucuuccugauugugcgauacuuuuucgagcuguaugucgccacccccuuggcagccuuacugaauauaaaagaaaagacacgucuuagagcuccuccaaacgcaacuuuggagcauuuuuaccugaccuccgguaaacagcccaaacagguggagguugaacuacucucuaggcagucaggccugagugggcggcaaguggagcgcugguucagaaggcggcgcaaucaggaucgaccuagccuucugaagaaguuuagagaagccuccuggagguucacauuuuauuugaucgcuuucauugccggaauggcggucaucguggacaagccaugguuuuacgauaugaaaaagguaugggagggcuaccccauucagucuaccaucccuucgcaguauugguacuauaugauagagcucucauucuacuggagccuguuauuuaguaucgcauccgacguuaaacggaaggauuucaaagaacaaauuauccaccauguggccacuauuauccugauaucuuucagcugguuugcuaacuauauucgugccgguacacucaucauggcacuucacgacuccucagauuaccuguuggagagugcuaagauguucaauuaugccggguggaagaauaccugcaacaacauuuuuaucgucuucgcgaucguguuuauuauaacgcgccuagugauccugccauucuggauucuccauuguacucuggucuacccgcuugaacuguaccccgccuuuuucggauauuacuuuuucaauagcaugaugggcguuuugcagcuccugcacaucuuuugggcauauuuaauacugagaauggcucacaaauucauuaccggcaagcuaguggaggacgaaaggucugaucgggaggagacagaauccucagagggggaagaggccgcugccggagguggcgcaaaaagccgaccucucgccaacgggcauccaauccugaauaacaaucaccgcaagaacgacuga

SEQ ID NO: 54281 - RNA, 1185 nt, Artificial Sequence
  derived and/or modified sequence opt3 from CERS3__Homo_sapiens__NP_001277270
augcugcacaccacagccagaagggcugcacggauguucuggacuuuuaaggagugguucuggcucgaacgcuuuuggcuucccccuacgaucaaauggagcgaccuggaggaucaugacggcuugguguucgucaagccaucccacuuauacguuaccauuccguaugccuuucugcuacucauaauccgacguguguucgaaaaauuuguagcgucuccccuggcuaagucauucgggauuaaagagacagugagaaaggucacuccuaacaccgugcuugaaaacuuuuucaagcauaguacaaggcagccacugcaaaccgauaucuacggauuggccaaaaagugcaaucucacugagcggcagguugagcgcugguuuagaagcaggcggaaucaggaacgccccucccgacugaaaaaguuccaggaggcauguuggagauuugccuucuaucugaugauuacaguggcugguaucgcauuccucuacgacaaaccuugguuauaugaucugugggaagucuggaacggcuacccaaagcaaccccuuuugccuucucaguauugguacuacauacuggagaugucguuuuauuggucacuacucuucaggcugggguuugacgugaagcggaaagauuuccuugcccacaucauucaucaccuggcugccaucagcuugaugaguuuuuccuggugcgcgaauuacauucguucuggaacccucguaaugaucguucacgacguggcagauauauggcuggagagcgccaagauguucuccuaugcuggcuggacgcagacuuguaacaccuuauuuuucaucuuuucaacaauuuucuuuauuagucgccugaucgucuucccauuuuggauccucuacugcacucuuauucugccgauguaucauuuggaacccuucuucagcuacauauuucuaaaucugcagcucaugauccugcaagugcuucaccuguauugggguuacuacauuuugaaaaugcucaacagauguaucuucaugaagucuauacaggacgugagguccgaugacgaggauuaugaagaggaagaggaggaagaggaagaggaagccaccaaagggaaggagauggacugccugaaaaauggauuacgggcagagcgacaucugauuccuaacggccagcacggccacuga

SEQ ID NO: 54282 - RNA, 1185 nt, Artificial Sequence
  derived and/or modified sequence opt3 from CERS4__Homo_sapiens__NP_078828
augcugagcuccuucaacgagugguuuuggcaggacagauucuggcucccuccuaaugugaccuggacagaacuugaggauagggacggccgggucuacccacacccgcaagaucuguuggccgcuuuaccccuggcacucguucuccuggccaugcgccuugcguuugaacgauucaucgggcugccuuugucucguuggcucggagugagagaccagacuaggcggcagguaaagccaaacgcuacgcuggagaaacauuuucugaccgaaggucaccgccccaaggagccucagcucucauuacuggccgcacaaugcggccuuacauugcagcagacucagagaugguucaggcggcgccgaaaucaagauagaccacagcugaccaaaaaguuuugugaggccaguuggagguuccuauuuuaucucagcuccuucgucgggggacugucugugcuuuaccaugaaucguggcugugggcucccgugaugugcugggaccgguauccuaaccagacauugaaaccaucacucuacuggugguaucuguuagagcugggcuuuuaccucagccuucugauucguuugccguucgauguuaagcgcaaggacuuuaaagaacaggugauacaccauuucgucgcagugauccuaaugaccuucaguuauuccgccaaucugcucagaauugguucucugguacuucuguugcacgauagcuccgacuaccuccuggaggcuuguaagaugguuaacuacaugcaauaucaacaggugugcgaugccuuauuucugaucuucucauuugucuucuuuuacacuaggcuagugcuauuccccacacagauucuguauaccacguacuaugagaguaucagcaaucgggggcccuuuuucggauacuacuuuuucaacggccuuuugaugcugcuccagcugcuucacguguuuuggucuugucugauauugcgaaugcucuauuccuucaugaaaaagggccagauggaaaaagacauccgcucagaugucgaggaaagcgacaguucugaggaagcggcagccgcucaggagccacugcaauuaaagaauggggccgcaggaggucccagaccugcuccaacugacggccccaggucccggguugccgggcgccugaccaacagacauacaacugcgaccuga

SEQ ID NO: 54283 - RNA, 1179 nt, Artificial Sequence
  derived and/or modified sequence opt3 from CERS6__Homo_sapiens__NP_001243055
auggccggcauccuggcuugguucuggaacgagagauuuuggcucccccacaaugugaccugggcagaccuuaagaacacagaagaggccacuuucccucaggcggaagaucuguacuuggcuuuuccauuagccuucugcauuuuuauggucaggcugauauucgagcgguuuguugcaaaaccgugugccaucgcucuaaauauucaagcaaacgggccccagaucgccccuccaaaugcuauucucgaaaagguguucacggccaucaccaaacaucccgacgagaagcgccuggagggacuuagcaaacagcuggauugggacguacgauccauacagcguugguuuagacaaaggcggaaccaggaaaagccuucuacauugacucgcuucugcgagucaauguggagauuuaguuucuaucucuacguguuuaccuauggugucagguuccugaagaaaacaccauggcuguggaauacccggcacuguugguacaacuaucccuaccagccucucacuacagauuuacauuauuacuacauccuggaacuuagcuucuauugguccuugauguuuucucaguucaccgacauuaagcgcaaagauuuuggcaucauguuccugcaccaucuagugucgauuuuucucaucacguucucauacguuaauaacauggcgcgaguggggacucugguccuuugccugcacgacagcgcagaugccuugcucgaggcugccaagauggcaaauuaugcuaaauuucaaaagaugugugaccuguuauucgugauguuugccguaguuuucauaaccacaagacugggaauuuuuccacucugggugcuuaacacuacccuguucgagaguugggaaaucgucggcccguaccccuccugguggguguuuaauuugcuacugcuccuggugcagggucuuaacugcuucuggucuuaucugauugucaagaucgcguguaaagccguuagcagggggaaggcaggaaaauggaauccuuugcacguguccaaggaugaccggucagauaucgagaguagcucugacgaagaggacuccgaaccacccggcaaaaacccucauacagcuaccacgacuaacggcacaucagggaccaauggauaccuccugacugguagcugcaguauggaugacuga

SEQ ID NO: 54284 - RNA, 1704 nt, Artificial Sequence
  derived and/or modified sequence opt3 from CES1__Homo_sapiens__NP_001020365
auguggcugagagccuucauccucgcuacccuuagcgcauccgccgcguggggccaccccucuucaccuccaguggucgacacaguucaugggaaggugcugggaaaauuuguaaguuuggaggguuucgcucagccgguggccauauuuuuaggcauucccuucgcaaagccuccacuggggccccuaagguuuacuccuccacaacccgccgaaccuuggagcuucgucaaaaacgcuacguccuacccaccgaugugcacccaggaucccaaggcaggacagcuccugucugagcuuuuuacaaaucggaaagaaaacaucccucugaaguugucggaggacugucucuaucugaauauuuacacuccagccgaucugaccaagaaaaaccgccuccccgugaugguuuggauccacggcgguggguuaauggugggagcugccucaacauaugacggccuggcgcuugcagcccaugaaaaugucgugguaguuaccauucaguaccgauugggcaucuggggguucuuuagcacuggagaugagcacagucgugguaacuggggccaucuggaccaaguggcugcccuaagauggguccaggauaauauagcauccuucgggggaaacccuggcucugugacaaucuuuggugagagcgcugggggagaauccgugucaguccucguucugaguccacuugccaagaaucuguuccacagggcgauuagcgagucuggcguggccuugaccuccguacucgugaaaaagggcgacgucaaaccccuggcagaacagaucgcuauuacggccgggugcaagacuaccacaucagcugugaugguucacuguuuacggcagaagacugaggaggaacugcucgagaccacacuuaaaaugaaguuucugagcuuggaucuacaaggagacccgcgcgaaagucagccucugcucgguaccgugaucgauggcaugcugcuucugaaaacgcccgaggaauugcaggccgagagaaacuuccauacugucccauauaugguggggauaaauaagcaggaguucggauggcucauuccuaugcaacugaugucuuaccccuuauccgaaggccagcuggaccagaaaacagcaaugagccuacucuggaagucguauccacugguaugcaucgccaaagagcuuauucccgaagcuaccgagaaguacuugggugggacugaugacacaguuaagaaaaaggaccuguuucucgaucugaucgcggacgugauguucggcgucccuucugugaucgucgcaaggaaccaccgggaugccggagcuccaaccuacauguaugaauuucaauaccgcccguccuucucaagugacaugaaacccaagacggugauuggcgaucauggggacgagcuuuuuagcguuuucggagccccuuuucugaaagagggugcauccgaagaggaaauacgauugucuaagauggugaugaaguucugggccaauuuugcuagaaacggcaauccaaacggggagggacucccccacuggccugaauauaaccagaaagagggcuaccugcagaucggugccaauacccaggcagcgcaaaaguuaaaagauaaggagguagcuuucuggacaaaccuguuugccaaaaaggcagucgaaaagccaccccagacugagcacauugaacuauga

SEQ ID NO: 54285 - RNA, 1872 nt, Artificial Sequence
  derived and/or modified sequence opt3 from CES2__Homo_sapiens__NP_003860
augaccgcccagagcagaucccccacaacuccuacguucccaggcccgucucaaaggacaccccugacaccuugcccagugcagacuccccggcucgggaaggcucuuauccacuguuggaccgacccuggacagccacugggugagcagcaacgcguccgacgucagagaacagaaaccucagagcccacuaugagguugcaucgguuacgcgcaagacugagugccguugcgugcggccuacuccugcuucuggugagggggcagggacaggauagcgcuuccccuauucggacaacccacacgggccaaguauuggguucucucgugcaugucaaaggggccaacgcaggagugcagacuuuucugggcauaccauucgccaagccgccccugggcccucuccgcuuugcuccacccgaaccuccagagucguggucagggguucgagacggaaccacacaccccgcaauguguuuacaggaucugacugccguggaaagcgaguuccuuagucaguuuaauaugaccuucccguccgacucuaugagcgaggauugcuuguaccuguccaucuauaccccugcucauucacacgaagguaguaaccuacccgucaugguguggauucacggcggggcccucguauuuggaauggcgagccuguacgacggcucuaugcuugcagcccuggagaauguuguggucgugaucauucaauauagauugggugugcucggguucuuuuccaccggagauaaacaugcuacgggcaacuggggcuaccuggaccaggucgccgcauuaagguggguucagcaaaauaucgcucacuucgggggaaacccagaucgggugacuauauuuggugaaucagccggcgggacaagcguaaguucucugguggucuccccuaucagccagggacucuuccauggcgcgauuauggagucggguguggcccuucugcccggguugaucgcaucuuccgcugacguuauuucaaccguggucgccaaucuaagugcuugugaucagguggacagcgaggcccugguaggcugccuccguggaaaguccaaagaagagauccuggcaauaaacaagccauuuaagaugauucccggcguuguggauggggucuuccuuccucgccacccacaggaacuguuggccucugcugacuuccaaccggugcccagcaucgucggagugaauaacaaugaguuugguuggcucauuccuaaaguuaugagaaucuaugacacucagaaggaaauggauagggaggcgucacaggcagcccugcagaaaauguuaacacugcuaaugcucccacccaccuucggcgaccugcuucgggaggaauacaucggggauaacggagacccucaaacguugcaggcucaguuucaggagaugauggccgauaguauguucgugauuccagcacugcaaguagcccacuuucaguguucccgagcucccgucuauuucuacgaauuucagcaucagccgagcuggcucaagaauauacgcccuccacacaugaaagccgaccauggcgaugagcugcccuucguguuuagaucuuucuuuggugggaacuacaucaaguucaccgaagaggaggaacaacuuucaaggaagaugaugaaauauugggcaaauuuugcgcggaacggcaacccuaauggagagggccugccccacuggccauuguucgaccaggaggaacaguaccuccaacugaacuuacagccugcuguugggcgcgcccugaaggcacauagacuacaguucuggaaaaaggcccucccccagaaaauucaagaacuggaggagccagaagagaggcacacagaacuuuga

SEQ ID NO: 54286 - RNA, 633 nt, Artificial Sequence
  derived and/or modified sequence opt3 from CES3__Homo_sapiens__NP_001172105
auggagcagaugagcagagaagacaugcuggccaucuccacccccgugcucacaucucuugaugucccuccagagaugaugccgacuguuauugacgaauaccugggcucaaacagugaugcucaagcaaagugccaggccuuccaggaguuuaugggggacguguucauaaauguacccacggugagcuuuuccagguauuugcgggauucuggaucgccugucuucuuuuacgaguuccagcaccgcccaagcucauuugcgaaaaucaagcccgcuugggugaaagccgaccauggugcagaaggcgccuucguuuuugggggaccuuucuuaauggaugagaguucccgacuggcuuuuccagaagcaaccgaggaagagaagcaacuaucucucacaaugauggcccaguggacucacuucgcucguaccggcgaccccaacagcaaagcccugccuccauggccgcaguuuaaucaggcggagcaauaucuugaaauuaaccccgugccuagagcaggucagaaguucagggaggccuggaugcaguucugguccgaaacacugccaucaaagauccagcaauggcaucagaaacagaagaaucggaaagcucaagaggauuuguga

SEQ ID NO: 54287 - RNA, 519 nt, Artificial Sequence
  derived and/or modified sequence opt3 from CETN1__Homo_sapiens__NP_004057
auggccagcggcuucaagaaacccuccgcugcaucuaccgggcagaagagaaaaguggccccuaagccagagcugacagaagaccaaaaacaggaggucagggaagcguuugaucucuucgacguugauggaucagguacuaucgacgcuaaggagcuuaagguggccaugcgggcacugggcuuugaaccgcgcaaagaggagaugaagaaaaugauuagugaaguagaucgagaggggacgggaaagaucagcuucaacgacuuuuuggccgugaugacccagaaaauguccgaaaaggauacaaaggaggagauauuaaaggcuuuccgucuguuugacgaugacgaaacuggcaaaauuucuuucaaaaaucuaaagagagucgcaaacgagcucggugaaaaucugaccgaugaggaacuucaggagaugaucgacgaggccgauagggacggggacggagaagugaacgaggaagaguuucugcggauuaugaaaaagacaucguuguacuga

SEQ ID NO: 54288 - RNA, 519 nt, Artificial Sequence
  derived and/or modified sequence opt3 from CETN2__Homo_sapiens__NP_004335
auggccagcaacuucaagaaagcuaauauggcauccucuucacagagaaagaggaugagucccaaaccugagcugaccgaagaacaaaagcaggaaauccgggaggccuuugaccucuucgaugcggacggcacagggacuauugaugugaaagaacuuaaggucgcuaugcgcgcccugggauuugagccaaagaaagaggaaauaaagaaaaugaucagcgagauugacaaggaagguacgggcaaaaugaacuucggggacuuuuugaccguuaugacacagaagauguccgagaaggauacuaaagaggaaaucuuaaaggcauucaaacuguuugaugacgaugagaccggaaagauuucuuucaaaaaucuaaagcgaguggccaaagaacucggcgagaaccugacagacgaggagcuucaggagaugaucgaugaagcugaccgugauggugacggggagguaucggaacaagaguuucugagaauaaugaagaagaccucauuguacuga

SEQ ID NO: 54289 - RNA, 504 nt, Artificial Sequence
  derived and/or modified sequence opt3 from CETN3__Homo_sapiens__NP_004356
augagccuggcccucagauccgaacuuguggucgacaagaccaaaaggaagaaacggcgcgaacugucugaggaacagaagcaagagaucaaagaugcuuucgaauuguuugacacagauaaggacgaggcaauugauuaccacgaguuaaagguugccaugcgagcgcugggcuucgacgugaaaaaggcugauguacuaaaaauacucaaggacuaugaucgugaagccacugggaaaaucacguuugaggacuucaacgaaguggucaccgauuggauucuggagagagacccccaugaggaaauccuuaaggcauuuaagcuguucgaugacgacgauucaggaaaaauuaguuugaggaaucuccggcgcguggccagagagcugggugaaaacaugagcgacgaggaacugagggcuaugaucgaggaguuugauaaggacggcgauggggaaauaaaucaggaggaguucaucgcaauuaugacaggagacaucuga

SEQ ID NO: 54290 - RNA, 1482 nt, Artificial Sequence
  derived and/or modified sequence opt3 from CETP__Homo_sapiens__NP_000069
augcuggccgcuaccgugcucacacuugcacuguugggcaacgcccacgcgugcagcaaggggacuucccaugaggcuggaaucgucuguagaauuacgaaacccgccuuacugguucuaaaucacgaaaccgcaaaggugauacagacagccuuccaaagggcuucuuacccugacaucacuggugagaaagcaaugaugcuccugggccagguaaaguaugggcuucauaacauucagaucucacaccugaguauugccagcucccagguggaauuggucgaggcuaaaucuaucgaugugucgauacaaaauguuucaguggucuuuaagggaacccucaaguacggcuauacaaccgccugguggcuggguaucgaccagagcauugauuucgaaaucgacagugcgauugaucugcagaucaacacucagcucacaugcgacuccgggcgggugcgcaccgaugcaccagacuguuacuuaucuuuucauaaacugcuuuugcaucugcaaggagagcgagagccgggcuggauaaagcagcuauucacgaauuuuauuagcuucacucucaaacugguacuuaagggccagaucugcaaagaaauuaacguuaucuccaauaucauggccgauuuugugcagacccgugcugccucaauucugagugacggggauauaggagucgacaucagcuugacaggugaucccgugauuacugcaucuuaucucgagucccaccacaagggccacuucaucuacaagaacgugucagaagaccugccuuuaccaaccuuuagccccacacugcucggggacaguagaaugcuuuauuucugguuuucugagagggucuuccauucccuggcuaaaguugccuuucaagauggacgguugaugcuaagccugaugggcgacgaguucaaggcggugcucgaaaccugggguuucaauacgaaccaggagauauuucaggaaguagucgggggauucccuucgcaagcccaggugacugugcacugucugaaaaugccaaagauuucuugccagaauaaaggcguuguggucaacuccucagugaugguaaaguuucuuuucccccgcccugaucagcaacacaguguugcauacacauuugaggaagacaucgugaccacuguccaggcuagcuacuccaaaaagaagcuguucuugucucuccuggauuuucagaucacaccaaaaaccgugagcaauuuaacggagucaaguuccgagagcguccagucuuuccugcaaucaaugauuaccgccgugggcaucccggaaguuaugaguagacuagaggugguauuuacagcucucaugaacagcaagggggucucccuguucgacauuauaaaucccgaaaucauuacuagggauggauuucuuuugcugcagauggacuucgguuuuccugagcaucuccugguggauuuccuucagucucugucguga

SEQ ID NO: 54291 - RNA, 534 nt, Artificial Sequence
  derived and/or modified sequence opt3 from CFAP126__Homo_sapiens__NP_001013647
auggccaccaacuacagcgcuaaucaguaugagaaggcauucuccucuaaauaccugcaaaacuggucacccacaaagccuacuaaagaaaguaucagcucccacgagggcuauacgcagauuauagccaaugacagagggcaucuccuuccaucugugccgaggucgaaggcgaaccccuggggaucauuuauggguaccuggcagaugccucugaaaaucccacccgcucgggucacauugacuagccgcaccacagccggcgcagccaguuuaaccaaguggauucagaagaauccugaucugcuaaaggcuuccaacgggcucugcccagaaauccugggaaagccccacgacccugauucucaaaagaaacuucgaaagaaaagcauuacuaaaacaguucagcaggcacguuccccaaccaucauaccgucaagucccgccgcuaaucugaacagcccugacgaguugcagucuucccauccaucagccggccacacgcccgguccucaaagaccagcgaaaagcuga

SEQ ID NO: 54292 - RNA, 1104 nt, Artificial Sequence
  derived and/or modified sequence opt3 from CFAP36__Homo_sapiens__NP_001269690
auggccgcugaggaagaggacgaaguggagugggucguugaaagcaucgcaggcuuccugagagggcccgauugguccauuccuauacucgacuuuguggagcagaagugcgagguaaacuguaaaggaggucacgugaucaccccaggcucuccggaacccgucauucuuguggccugcguuccucugguguucgaugacgaggaagagucaaaguugacauacacugagauccaucaagaauauaaagaguuagucgaaaagcugcuagagggguaccucaaagaaauuggaaucaaugaggaucaguuucaggaggcguguacgaguccacuggcuaagacccacacaagccaggccauacuucaacccgugcuggcagccgaagacuucacuaucuuuaaggcuaugaugguacagaaaaacauugagaugcaguugcaggcaaucaggauuauccaagaacggaauggcguucucccugauugccugaccgacgguuccgauguggucucugaccuggagcaugaagagaugaagauacuccgcgagguguuacgaaaaucgaaggaagaguaugaucaggaagaggaacguaaaagaaagaagcagcugucagaggccaaaacagaggaaccaaccgugcacagcagugaggcugccauuaugaacaauucccagggggacggagaacauuucgcgcaucccccuucugaggucaagaugcacuuugcaaaccaaagcaucgagccacuuggcaggaaaguugaacgguccgagacuucaaguuugccgcagaaggaucugaaaauucccggccuagaacacgccagcaucgaggggccuaucgcuaaucucucugugcugggaacagaggaacuucgccagagagagcacuaccugaagcagaaaagggacaaguugauguccaugcggaaggacaugcgcaccaaacaaauucagaacauggaacagaaggguaaaccaacgggcgagguagaagagaugacugaaaagcccgagaugaccgccgaggaaaaacaaacacuccugaagcgaagauuacuggcagagaagcucaaagaagaggugauaaauaaguga

SEQ ID NO: 54293 - RNA, 2949 nt, Artificial Sequence
  derived and/or modified sequence opt3 from CFAP44__Homo_sapiens__NP_060808
augaaggagcccgacgaucaggacaccgauggcgagaaaagcgugacauccaagucugacgggaaaaagucacugagaaguagcaaauccgagucuaggucgccuguccaagaagauaacacuuuccucgaggacgauacggacgaaaccuuuacaaagggagaggguucauaccuugaggaagauagcgacgaggaacggcuggagggcaguuuguccucuuuccaguauggggauuuacagagcacuaccguuccacagcaaacaccggcccccgcuguggaggaagcagaggaagagguaaagaaaaagaucuccgaaucauuuuucuacgacuauauggagcuggccaguaugccuuuugugacccuagauagcaauauuccacucgaccugcuuacucugguccacucuuucggauacgacugccgcaaacgagcgaacuugcagcuccuggaugacuccauagcuaucuauauugccggcaaucagcugaucuuucucaacuuaaagacaaaagagcagauuuaccugcguucaagcaguggugaagggaucggagugauaggcguucauccccacaagaccuauuucacgguggcagagaagggcucuuuuccugauaucauuaucuacgaauacccaucccuuagacccuauagggucuugcgggacgggacugagaaaggauacgccuauguggauuucaauuacagcgguaaccugcuagcuucgguaggcucuaauccugacuauacccucacaauuuggaacuggaaggaagaacaaccaauccugcgcacuaaagcauuuucccaggagguuuucaaggugaccuuuaauccggauaaagaagaacagcuuacaaccucagggaguggacauauaaaguucugggaaauggccuucacguuuacuggccugaaauugcaggguagccucgggagauucggaaagacaauuaccacugacaucgagggcuacauggaacugcccgauggcaaggucuuauccgggucugaguggggaaacaugcugcucugggaggguggccuuauuaaaguggaacuguguagggggacaagcaagucaugccacaauggaccuaucaaccaaaucauguuguaugagggcgaagugauuaccgucgguagugacggguacguucggauaugggauuuugagacgaucgacaccgcugacgugauugaugagacaggccuacuggaaaucgagccaauaaaugaacuccagguagacaaaaacgugaaucuguucuccaugauuaagaugaacgagacuggaaacaauuuuuggcuugcccaggaugcgaacggcgcaaucuggaaacuggacuugagcuucucuaauaucacccaagaucccgaaugucucuuuucauuccauaguggggccauugaggcugucgccgugagcccucugacauacuuaauggcaacuaccgcucuggacugcuccguucgcaucuaugauuuugccucuaagacaccacuagcgcagaugaaguucaaacagggagguaccgcccucgugugggucccccgaauggugaacuuuacuggcgcacagauuauaguaggguucgaggacggaguugugagaauccuggaacuuuacgauccgaagggcuugacgauuuuugcugguaggaaaaagauccuggacgccgauauccaacucaaacaggucuucaagccucacacagcuugugugaccgcccuggcauaugagcgggacggggaaauucuugccacuggcucgaaggaucagaccgucuucuuuuucgagguggaacgugacuacaaacccauaggauauaucaauacaccaggcccuguuugccagcugauguggagccccaugucccacccagagucaaccuugcucauuaucugugagaacggguacauucuggaagcucccuuaccuacuaucaagcaagaggaagacgaucaugacgugguaaguuaugagauaaaagauaugugcaucaaguguuuucacuucucuagcgucaaauccaagauucugcgccuaaucgaaauugagaagagagagaggcagcgggaacucaaagagaagauccgagaagaacgcagaaauaaacuggcggcagagaugggagaagacggugagaaggaauuucaggaggaagaggaggaaaaagaggaagaggaagaggaggaggagccacuuccggaaauauucauucccucaacaccuagcccaaucuugugcggcuuuuacucugagcccgggaaguucugggugucccugggaggcuacgauagugguuuucucuaucauugugaguucccuccaugcgacgagagcucugauuuuaaagagcagaaggacgaacccauugauguuagguaccuggccgacacggaggauaacccgauccaaaccauaacuuucaauaucaacaaggugaugauguuuugcgggaugaaaaauggcgcuauucgggucuauguguuaaaccagaaugacccuucccugacaucacuuguagauuacuggcacuucaacaugcacgacaauaacuauggauguaucaagaguauugccaacagcuucgacgaucgcuuuuuggugaccgcaggcgccgacgggaauaucuucguuuuuaacauauucucggaauuuaugcucagaaaagauaugaaggcuaaagucccaucccccagguucggaauugagacagagccuauccccgaagacaucgaggauccaaaggccuacucuauugaaaaugcacgucggaagcgagagcaugacaaacugaugaaggaagugggcgagaucaaagcgagaaagagggagcagauuaaagcucuacgcagcgaauuuugcaaccugcucgagaugaaugaaaagcugccuaagcacaugcaguucaaacggacugugucacuuauauga

SEQ ID NO: 54294 - RNA, 1659 nt, Artificial Sequence
  derived and/or modified sequence opt3 from CFAP52__Homo_sapiens__NP_001074025
auggacaacaagaucagccccgaggcccagguggcugaacuggagcucgaugcagucauuggcuucaaugacauaauccuuugggauuacaaaaacagagaacuguuggccagguuaucccugcacaaggggaaaauugaggcgcuagcuuuuucuccuaaugaccucuaucugguuucacuuggagguccagaugacggcagugugguaguguggagcaucgccaagcgggaugcaauuugcggguccccggccgcuggacugaacgucggcaaugcaaccaacgugaucuucucucgcugucgagacgaaauguuuaugacagccgguaaugggacuauacguguuugggaguuggaucuccccaacagaaaaaucuggccuacggagugccaaaccggacagcugaagaggauugugaugucgaucggcgucgacgaugacgauucauucuuuuaccugggcacaacuaccggggacauucucaagaugaauccacggacaaaauuacugaccgacgugggacccgcuaaggauaaauucagccuugguguaagugccauccgcuguuugaagaugggcgggcugcuaguuggauccggcgcgggucuccugguguuuugcaaaucuccuggguauaagccaauaaagaaaauucagcuucagggaggcaucacuagcauuacacugagaggcgaagggcaucaauucuuggucggaaccgaggaaucccacaucuacagggugucauuuacggacuucaaggagacucucaucgcaaccugucauuuugaugccguggaggacauugucuuccccuuugguacagcugaacuguucgccacuugcgcaaagaaggauauacggguuuggcacaccaguagcaaccgcgaguuacugcgaaucacagugccuaauaugaccugucauggcauugacuucaugagagaugggaaaucuaucauauccgcuuggaacgacggaaagauuagggccuuugcgccagaaacgggccggcucauguauguaaucaauaacgcccaccguaucggugugacugcaauugcuacaaccucagauugcaaacgcgucaucagcgggggcggagagggcgaagugagaguuuggcagauugggugucagacucagaaacuugaggaggcccugaaggaacacaaaaguucuguguccugcauaagggucaagcggaauaacgaggaaugugugacagcuagcaccgacggaacgugcaucauuugggauuugguacgacuacgcagaaaccaaaugauccuggccaauacccucuuccagugcguuuguuaccauccggaggaauuucagaucauuacaucggguacugacaggaaaauagcauauugggagguguucgacggcaccgucauccgggagcuggaagggucucuuuccggaucaauuaacggcauggauaucacacaggagggugugcacuuugucacugggggcaaugaccaucuggugaagguuugggauuacaacgaaggagaggugacccacguaggcgucgggcacaguggaaauauuacacgcaucagaauaagccccgguaaccaauacaucguguccguuucugccgacggcgcuauuuugagguggaaauauccuuacaccagcuga

SEQ ID NO: 54295 - RNA, 1545 nt, Artificial Sequence
  derived and/or modified sequence opt3 from CFAP53__Homo_sapiens__NP_659457
auguacagccagagauucggcaccgugcaaagggaggucaaggggcccacaccuaaaguugugaucguacgguccaagccaccgaaaggacagggugccgaacaccaucuggagcgcauucgacguucucaccagaagcauaacgcuauacucgcaucaaucaaaaguagcgaaagagacaggcuuaaggccgagugggaucagcacaaugacugcaagauucuggauuccuuggugcgggcgcgcaucaaagacgcuguccaaggcuuuauuaucaacauagaagagagaaggaauaaguuacgggagcugcuagcccucgaagagaacgaauauuucacugagaugcagcugaaaaaggagacgaucgaagagaaaaaggaucgcaugcgagaaaagaccaaacuucugaaggagaaaaaugaaaaggagagacaggacuuuguggcagagaaauuggaucagcaauucagggaacggugugaggaacuccguguugagcugcugucuauucaucagaagaaagugugcgaagaacgcaaggcccagaucgcuuuuaacgaggaacucucgagacagaaguuagucgaggaacaaauguucucaaaacugugggaggaagacaggcuugcaaaggagaaacgggaggcccaggaagcucgacgccagaaggaguugauggaaaauacaagacuggggcuaaacgcccaaauuacuagcaucaaagcgcagaggcaggcaacccagcuccugaaggaggaggaagcccggcuuguggagaguaauaacgcucaaauaaagcacgaaaaugagcaggauaugcugaaaaagcagaaagccaagcaggaaacacgcaccauuuugcaaaaagcacuccaggagagaaucgagcacauucagcaggaauacagggacgagcaagaucugaacaugaaguuaguacagcgugcucugcaggaccuccaggaagaggccgauaagaaaaagcaaaaacgggaagacaugauccgagagcagaagaucuaucauaaauaccuugcgcagagaagggaggaagagaaggcccaagaaaaggaguuugaccgcauucuggaagaggauaaagcaaagaaauuggcugagaaggacaaagaacuacggcuggagaaggaagccagaaggcagcucguugaugaggugauguguacucgcaaacugcagguccaggagaagcuccaacgagaagcuaaggagcaggaggagcgggccauggaacagaaacacauaaaugagucccugaaggaguugaacugcgaagagaaagaaaauuucgcacguagacagaggcucgcccaagaguaucgcaagcagcugcagaugcagaucgcuuaccaacagcagucucaagaagcggagaaagaggaaaagcggagagaguuugaagcaggaguggccgcuaacaagauguguuuagacaaagugcaggagguccugagcacacaucagguucuaccccagaacauucacccuaugaggaaggccugcccauccaaacuucccccuuga

SEQ ID NO: 54296 - RNA, 3366 nt, Artificial Sequence
  derived and/or modified sequence opt3 from CFAP57__Homo_sapiens__XP_011539101
augagcgccguggucgcucagacccugcacguuuucggccucagaucccauguggcaaacaauaucuuuuacuucgacgagcaaauuauaaucuuucccucugggaaccacugcguaaaguauaauguggaucagaaauggcagaaguucauuccuggaucagaaaaaucccaggguaugcuugcccugagcaucuccccaaacaggcgguacuuggcgauuucugagacaguccaagaaaagccggcuaucacuauauaugaguuaucgucaauccccugucgcaaacgaaaggugcugaauaacuuugacuuccagguucagaaguuuauuagcauggccuucaguccugauuccaaauaccuacucgcacagacgucuccacccgaaagcaaucugguguauuggcuuugggagaagcaaaaagucauggccaucgugcguauugacacccagaacaauccuguauaccagguuuccuuuucaccacaggauaacacacaagugugcgucacuggcaaugggauguucaagcuguugagauuugcugagggaacccucaaacagacaaguuuccagaggggcgaaccccaaaacuaucuggcacauaccuggguggccgacgauaagaucguggucgguacugacacagggaagcuguuucucuucgagagcggagaucagcggugggaaaccucuauaaugguuaaagagccuacgaauggcuccaagucauuagacgugauucaggagagcgaaagucugaucgaguucccaccgguaucuaguccccuuccuagcuacgaacagaugguggcugccucgucucacucccaaaugucaaugccacaggucuuugcgauugcagccuacaguaaaggcuucgcuuguagcgccgggcccggacgcguguugcuguuugagaagauggaagagaaagauuucuauagagaguccagggaaauccggaucccuguugacccacagucuaacgaucccagccagucagacaagcaagacgugcuaugccucuguuuuaguccguccgaggaaacucuggucgcaagcaccucuaaaaaucagcuuuacucaauuacaaugagucugacugagauaagcaagggugaaccugcucauuucgaguauuugauguacccccuccacuccgccccaaucaccggccuggcgacaugcauucgcaagccuuuaaucgccaccuguucucuggaucgaucgauaagacucuggaacuaugagacgaacacucuugaacuguuuaaagaguaccaggaagaggcauauagcauuuccuugcaccccucagggcauuucaucgugguaggauuugcugacaagcuaaggcugaugaaucuccugaucgaugacauucggaguuucaaagaauacucuguucguggcugcggugaguguagcuuuuccaacgggggacaccuuuucgccgcugugaauggcaacgucauccauguguacacaaccacuucacuggagaauauuagcucuuugaagggccacacagggaaaaugcuccugaccuuugaugaccaguucuuacugacggccgcagaagauggaugccuauucaccuggaaggucuuugacaaggauggucgcggcauaaaaagagagagggaagugggguucgccgaggagguucucgugacaaagacugacauggaagagaaagcucaaguaaugcuggaacuuaagacccgggucgaggaauugaaaauggagaacgaguaucagcugcgacucaaggauaugaauuacuccgaaaagaucaaagagcugacagacaaguuuauucaggaaauggagagucuuaaaacuaagaaccaggugcugcgcaccgaaaaagagaagcaagacguuuaucaccaugagcacaucgaagauuugcucgacaagcagagcagagagcugcaggauauggaauguugcaauaaccaaaaauuacugcuagaguacgaaaaguaucaggagcuccagcugaaaucucagaggaugcaagaggaauacgagaagcagcuucgggacaaugaugaaacaaaaucccaggcguuggaggagcugaccgaguucuaugaagcaaagcuccaggagaaaacuacgcuguuagaagaagcccaagaggacgugcgccagcagcugagagaguuugaagagacaaagaagcagaucgaagaggaugaagacagggagauucaagauauaaaaaccaaguacgagaaaaaguuacgugacgaaaaagagucaaacuugcggcucaagggagaaacuggcaucaugcgaaagaaauucaguagccugcagaaggagauugaagagagaaccaaugauaucgagacacuaaaaggugaacagaugaagcugcaaggggucauuaaaucgcucgagaaggacauccagggccugaagagggaaauacaggagcgcgaugagaccauccaggacaaagaaaagcggauuuacgaccuuaaaaagaaaaaccaagaguugggaaaguuuaaguucgugcuggauuauaaaaucaaggaacuuaaaaagcagauugagccaagagaaaaugagaucaggguaaugaaagagcagauacaggaaauggaggcugaacucgagaacuuucauaagcaaaacacucagcuggaacuuaauauuacagagcuguggcagaaauugcgcgccacggaccaggagaugcgacgggaacgucaaaaggagagagaucucgaagcacuggugaagagguucaaaaccgaccuacacaacugcguugccuacauccaggagccccgccugcucaaggaaaaaguccggggccuguuugagaaguaugugcagagagcugauaugguggagauugccgggcuuaauacugacuugcagcaagaauacacaaggcagcgagagcaucuggaacgcaacuuagcaacccucaaaaagaaggucguuaaagagggagagcugcaccggacagauuaugugagaaucaugcaggaaaaugugucccuuauaaaggagaucaacgaacugaggcgugagcuaaaauucacucgcucucaaguauacgaccucgaagcggcucugaaguugaccaaaaagguccggccucaggaggugagcgagacggaaccaucaagagauaugcugaguaccgccccgacagcaagguuaaaugagcaggaagagacuggucgaauuaucgaaaugcagcggcucgagauucaacgccugagagaccagauccaggagcaggaacaaguuaccggcuuucacacacuugccggggugaggcugcccuccuugucuaacagcgaggucgaucucgaagugaagacuaauuga

SEQ ID NO: 54297 - RNA, 2619 nt, Artificial Sequence
  derived and/or modified sequence opt3 from CFAP58__Homo_sapiens__NP_001008723
auggccgaggaaaagggcgggaaacaggugcuggaggaaagcgcuuucgaggaaauggagagagacuuucaaggaguccuccacgagcuuuccggugauaagucucuggaaaaauucaggaucgaguacgaacgguugcaugcaguuaugaagaaaucauaugacaacgagaagcgcuuaauggccaagugccgagagcugaaugcggaaauugugguaaacagugcuaaaguggccaccgcacuaaagcucagccaggaugaccagacaacuauagccucccugaaaaaggagaucgaaaaggcuuggaagauggucgauucugcauacgacaaggagcagaaagccaaggaaacgauucuugcucugaaagaggagaucgugaauuugaccaagcucguugaacaaggcucggggcugucaauggaucagcacagcaacauucgugaccugcucagauuuaaagaggaagugacaaaggagagggaucaguuacugagugaagucgugaaacuucgggaguccuuggcccagacuaccgagcaacagcaggaaacagagcgcucuaaggaagaggcggaacaugcaaucagccaguuccaacaggagauacagcaaagacagaaugaggccuccagggaauuucggaagaaagagaagcuggaaaaagagcuaaagcagauccaggcugacauggauucacgccaaaccgagauuaaagcccuccagcaguauguacagaagaguaaggaagaacugcaaaaacuugaacagcagcugaaggagcagaaaaucuugaacgaacgagcagcuaaggagcucgagcaauuccagaugagaaaugccaaacugcagcaggaaaacgagcaacacagcuuaguuugugaacagcugucucaggagaaucaacagaaggcgcucgaacuuaaggccaaagaggaggaagugcaucagaugaggcuggacauuggaaaguugaacaaaauccgggagcagauacacaagaaacuacaccauacugaagaucaaaaggcagaggucgaacagcacaaggagacacugaaaaaucagauugugggccucgagcgugaaguggaggcuuccaagaaacaggccgaacuggaccgcaaggcuauggacgagcuucugagagagagggauaucuugaacaaaaauaugcucaaggccgucaacgcaacccaaaaacagacggaccugguuaaguuacaugaacaggccaagcggaaucuggagggugaaauucagaacuacaaagaugaggcucaaaagcagcgaaaaaucaucuuucaccuagaaaaggagcgcgacagauauauuaaccaggcgucagaucucacucaaaaagugcugaugaauauggaggacauaaagguaagggaaacccagaucuucgauuaccggaagaaaauugcagagagcgaaaucaaacuuaaacagcagcaaaacuuguaugaggccgugcgcagugacagaaaucuguacucuaagaaccucgucgaagcucaggaugagauaacagacaugaaaaggaagcugaagauuaugauccaccagguggaugagcuuaaagaagacaucuccgccaaggagagcgcacugguuaaauugcaucucgaacagcaacguauugagaaggaaaaagagacucugaaggccgaguuacagaagcugcggcagcaggcucuagaaaccaaacacuuuaucgagaagcaagaagccgaggagcgaaaacuccugagaauuauagcagaagcggacggggagaggcuucgccagaagaaagaauuggaucaggugaucucggagcgggacauucugggaucucagcucgucagaaggaaugaugaacuggcuuuacuguacgagaagaucaaaauccaacaguccgugcuuaacaagggcgagucacaguauaaucaacgcuuggaagacaugcggauucuccgacuggagauaaagaaacuacguagagaaaagggcauccuggccaggaguauggcaaacguagaggaacuccgccaggaguucuuucauaugcagcgggagcugcuuaaagaaagaacaaggugccgagccuuggaggaggagcuggaaaaucccuuaaacguucaccgcuggcggaagcucgaggcuagcgauccuaaugccuacgagcugauucagaaaauccauacccuucaaaagagacugauuuccaagacggaagagguggucgaaaaagaguugcuccugcaggagaaggaaaaacuauauauggagcugaagcacgugcucgcaaggcagccagggccggaagcugccgagcagcugaaacuuuaccgucgcacuuugcacgacaagaagcaacagcugaaagucuuaucuagcgaacucaacauguaugaggugcagucaaaggaguacaaauaugaaguugagaagcugacaaaugaacuucagaaccugaaaaagaaguaccuagcgcaaaaacggaaggagcagcuccagaaaaauaaggauaccgcccccauggacaacacuuuccugauggugaaaccuaacggaccagguuuuacaggcgggggauuccccuugagaaguaccaagaugacguucuga

SEQ ID NO: 54298 - RNA, 3714 nt, Artificial Sequence
  derived and/or modified sequence opt3 from CFAP61__Homo_sapiens__NP_056400
augagcgugcugaccucccccagaggcaaggucgagguugugcacugcaggcggacagaaucucaggacguauacuguaucaaaucacucauucgcaaguucacuugcaaacuuuuugggaagcugaacauaaucuauuuguuagagaaagccaaucuggcugugacgcuauguaacgauaaggaagagauuauggcacaagccaccuuccucgacuacccuaauuggaacgucgcgaagcaggaugacugggugaguguuuuucgagaacuggauagcgacaucccaugcacaccgcuuaauacucuguucaugcauuuguuuguggcugucgaugaguauuccgugggauguugcaaagagauucuccguaccguauacaaggccguucccgaacugcacuucaucuuucugauagugccuucuuauaugucgcucgguucaacauuaaucaccgucuucgaccaggugggcaacauuccaugucugacuuacgaggaagauuuugcagugcauaucugccacagacauagccacuauccccagcuucacgucaggaaagcccggguugaggaccaugaugacuugaugccuauuuucaugcgcuacgauacaauccugaaggagaccuacggggaauauuuucuagcugagcucauagaagcacaagacgaggaaaaucacgccgugguaugugagguggagggaacggcugucggcuucaugagugugugcuccagaguuaacaugcagcugcuucaugaauguuuugaccuggguccauuccacggguugugcuucccccacccugaugacgugcucgagucuccacaggaucugagcgucaggcggucccaggacgccgaauuacgcucaaguagccaaggaucucagaaaauuguggaggaacugcaggagccgguaucccccgauacuauggagaauauccagggcaacauugcgcgagaagcagccucagaggaagcucucaccgccguucaaagcggcaaugugagugagccugaagacaucgagaaacuuucugauaucuccacaggguacgcacaguaucaucacgucagcucgagaucucuggcuuccuuggugcuaccagaggaacccguccauuuuaggccuauuuaccggggagccucagcggccuucugcauacagcuguuuuguaucgacgagaaguaugaagcacguagucucgauuucaugaacuuuguguucagccuguuuuccgacaaaaauuucugcguuauuucucuuccacaccugacucccgaguuuuucuugauccaaaacuuugugaagaugguaccguucaauaccuguacacucgagcaggaucuguacgucuuucaucgcgcugguuuacugaaaagcauaaacauuagauucgccacccuacucgacacgccuggcguggaaaaccugguuucaacucuuauguugaauaagaguauccuggaggaccucgauagguauaacaaagcucggaaggaccccgaugggacacugcuucaggccuucguggcagaagucgccgagcagaucgugggaauugcuguaauccgaaaugaaauggacauugaguacauacgcucccacuacaacaucgaggauuuuauuuauuucagccaccaucaaagagaggaacacggccauaugcaccacuuugcgcugaauccaaucuucaggcauuacaccaaauuuuucuugaaggaaauccuccggcuggguuuuaagucuugcuuauauuaccgcguguauccuaaaucaagagaggggaaguuccagaaccccuacgcacacagucugacuagcgcccuacauuaucucguuccagucaggccccgucggcagauuguguacccucuggaaaaacuuggaauaaaugcuccauccaaggccgugucuaaagacccgaugucguacgcauugaaccacacaaaucgaaagcugacccucgagcccaagaucacggucaacgccaaaauuaucguugugggcgcuagcuccgugggcauuucauuucuggagaccuuaguauucuguagucauaugaaguuuaauaaccugacacuuaucucuacucacggguugccuggaaagaagcuccuggauaccgaacagagaaaauuccuagccagcgaccacugcuuuaaugauaaggacuaugcacugaugucccucuguucaugggucaacgugguuguggguaggaugacaggcauagaucgcgcggcuaagcaugucgugcugagcacugacgagaucguuccauacgaucaccuuauuuugugcaccgggcaacaguaucaggugcccuguccuacagaagccgacaucucucagcaucugaccaaucgggagguaccaaacuccagucaaagaagguacacuggaaaaguccccugcaaccacuucacguuaaaugaagaggaggacuguuucaaggcacucauuuggauccgcaacaauagcauaacaaccgaaggcaacauuaucguguaugguaauacuauugauaccuacacaaccguggagacucugcuuaaccugggggucucuggcucccgaauccauuugguucagccgccuccagccucaacaauaacgugcaucaauaacuauaguguggaaagcgcuguagccgacgcacucggagcugccggcgugaccauguaccgggaugcgauucuggcccaguggaaugacgggcuacaccccgauccuaucuacucggcuuccuuuacuacacccaccaaaccauuccgucugcagugcucuauguuuuucagcuuuugugagaagaacgucgacuaugagacauucaaagcacucaaugaugccugccugguguacgacucaagacuuguuauugauacuaacuuucacaccaaugacaucgcuauaagggccgcaggaaguuugacgaaguucuccaaccgcuauuacucuaaugaauggacccauagcaacuuuuccucaaaggagauugguuuccaacuggcggccgcuauguuacaccucuuugauccuacacuggaacccgugacugagccaccggccaaccuugaccggcugaucccuauguauaaaggcgcaaagauccagggagggauucuacccggcagcuaccauuaucuccacaucgcuaaaccagccauucccaccccucuggaaguccagauggcacaaccaaauuacgguuuggagcuggugacagggagugccaagaacggcacuuacuucagaauacacaucaauaaauauaagaugguugagaccauuacguguuuaucuagggaacccuucccugcuuccaacuacauccgacucuuuggacagcaugagcagcugcuuaauaaccugugcgcgcgcuaugaugaaaauuugauuacagaccucuacagcuauuucaccgagccguggugucuggcccuauuucacgaccgguucaucgaucugagaaaagaacuuaggcagauacucgcaucgaaggaggaggaagaccugccaucaaucgagcaauuggcucaucagauugaagaugaggaaaucaaccccacugagaagccucgucaguaccugaaacgcguguuugaggaaucuauuuauaagacauuagucgagcggaguacccucgacuaccugcacuacaauagauaucaucuuccaauguacgccuggcccggcaucguauga

SEQ ID NO: 54299 - RNA, 2826 nt, Artificial Sequence
  derived and/or modified sequence opt3 from CFAP69__Homo_sapiens__NP_001034795
auguggaccgaggaagccggcgcuacagcagaggcccaggaaagcgggaucagaaacaaguccucuucaaguagccaaauucccguggucggaguugugacugaggacgaugaagcgcaggacguauucaaaccuauggaucugaauagggugauaaagcuccuugaggagacggacaaagauggucuggaagagaagcaguugaaauuugucaagaaguuagugcagugcuaccaaaacggccugccacuacgggaccucgcucagaucuucaaaauucugaaucuuuguuccgggaagaucaaaaaccagccgcgcuuuauugaaucugccuaugauaucauaaagcugugcggauugcccuuccucaaaaagaagguuucggacgagaucaccuacgcagaggauacagccaauucaauugcucugcugggcgaccucaugaaaaucccuagcagugaauuaaggauucagaucuguaagugcauaguggauuuuuaucacgcagagccacccaaaaagcauauuccugguuaccaacaggccuccucuagcuauaaaauccagauggcugaagucgggggacuggccaagacuauggugcaguccaugacccuuuuggagaaccaacugguagaaaaacuauggguucucaaggugcugcagcaccuuucaacaagugaggucaauuguaccauuaugaugaaggcgcaggcagccagcggcaucugcacucaucugaacgacccagaucccucuggccaacucuuguuccguuccucagagauccuguggaauuuacuggagaaaagcaguaaggaggaagugauucagcagcucucuaaccuugagugucuguuggcucuaaaagaaguguuuaagaaucuguucaugagaggguuuucccacuacgacaggcagcuccggaacgacauacuggucaucacaaccauuaucgcccaaaauccugaggcaccaaugauagagugcggauucacgaaagaucuuauucuguuugcuacuuucaacgaaguuaagagccagaauuugcucgugaagggucugaaauuaucgaacucuuaugaggacuuugaacugaagaaacuacucuucaacguaaucgugauccuguguaaggaucuuccgaccguccaguugcugauugacggcaaagugauccucgcccuguucacauacguuaagaagcccgagaaacagaagauuauagauugguccgcggcccaacaugaagaacuucagcugcacgcaaucgcuacuuugucaaguguggccccucuccugauugaggaauacaugagcugccaggggaaugcucgcgucuuagccuuucuggaguggugugaauccgaggacccauucuuuucucacggaaacagcuuccauggcaccggugggagaggaaauaaauuugcacagaugagguauucacuacggcuccugcgcgccgugguauaccuugaggaugaaacaguuaacaaggacuugugcgagaaaggcaccauccaacagaugaucggcauuuucaagaauauaaucaguaagcccaacgaaaaagaggaagcuauugugcuggagauccaguccgauauucuccugaucuuaagcgggcugugcgagaaucacauacagcgaaaggaaaucuuuggaacggagggugucgacauugugcuucaugucaugaaaacugauccuagaaaguugcaaucuggccucggguauaacgugcugcuauucucaacacuggacaguaucugguguugcauucucggauguuacccaagcgaagacuauuuucuggagaaagaaggcaucuuccuuuugcuggauuuacucgcgcugaaucagaagaaauuuugcaaccuuauacuggguauuaugguugaguucugugacaaucccaagaccgcagcccacgugaacgcuuggcaggggaagaaagaucaaacugccgcauccuugcucaucaagcuguggaggaaagaggaaaaggagcuaggcguaaaacgggacaagaauggaaagauuaucgauaccaaaaagccgcuguuuacaucuuuccaggaggaacagaaaauaaucccucuccccgccaacugcccaucgauugcugucauggacgugagcgaaaauauccgugccaagauuuacgcaauccugggcaaacuugauuucgagaacuugccugggcuguccgcggaggacuuuguuacguuauguauaauucaccgcuaucucgauuucaagaucggagaaaucuggaacgagauuuacgaagagaucaagcuggagaaacuuagacccgugaccacagacaagaaagcucuggaagccauuacuaccgcaucagagaauauagguaagauggucgccagucuacagucugauaucauugaaagccaggcuugccaagacaugcagaacgagcagaaaguguacgccaagauccaagcaacacauaagcagagggaacucgcuaauaaauccugggaggauuuucuggcccggacuucaaacgcgaagaccuugaaaaaggccaaaagccugcaggagaaggcuauugaagcaucucgauaucacaaacgcccacagaaugccaucuuccaucaaacacacauaaagggcuuaaacaccacuguacccuccgggggagugguuacggucgagaguaccccugcuagacucgugggcgguccacugguggacacagacaucgcccuuaagaaacugccgauucgagggggcgcauugcagcgggucaaggcgguuaaaaucguggaugcccccaagaaaagcauuccuacuuga

SEQ ID NO: 54300 - RNA, 1362 nt, Artificial Sequence
  derived and/or modified sequence opt3 from CFAP97__Homo_sapiens__NP_001278962
auggaccaguucggcgauauccuggagggggaaguggaccacagcuuuuucgauuccgacuuugaggaaggaaagaaaugcgagaccaacucugucuucgauaagcaaaaugacgaucccaaagaaagaauugacaaggauacuaaaaacguuaauucaaacacagguaugcagacgaccgagaauuaccucacagagaagggcaacgaaaggaaugugaaguuuccuccagagcauccgguagaaaacgacgugacucagaccgucaguagcuucucccuucccgccucuucgcggagcaaaaagcugugugaugugacaaccggguugaaaauacacguuagcaucccuaaucgcauuccaaagaucgugaaagagggagaggacgauuauuacacugacggcgaagagaguuccgacgaugguaagaaguaucaugucaaaucuaagagcgcuaaacccuccacaaacgugaagaaaucaauucgaaagaaauacugcaagguaaguucaucuuccucaagcaguuuaucuuccagcucgucuggguccggaaccgacugucuggaugcaggcucagacagucaccuaagcgauuccucuccuagcucaaagaguuccaaaaagcauguuagcggcaucacgcuccugucuccaaaacacaaguauaaaucagggauaaagaguacugaaacccagcccagcuccacaacuccuaagugcggacacuacccagaggaaucugaggacaccgugacagaugucucgccgcuuagcacccccgacaucuccccucugcaaucauuugaguuggguauugccaaugaucagaaagugaagaucaaaaagcaggaaaacgugagucaggagauuuaugaagacgucgaggaucucaaaaauaacucuaaguaccugaaggcggcuaaaaagggcaaagaaaagcaugagccagacguuagcuccaaaucaagcucugugcuggacuccagucucgaucaccgucauaagcaaaagguauuacacgacacgauggaucugaaucaccuuuugaaagccuuccugcagcuagacaagaaagggccccagaagcaucacuuugaucagccuagcguggcaccaggcaaaaacuacucuuucacuagagaggaagucaggcaaaucgaccgggagaaccagcgccuccugaaggaacuuuccagacaggccgagaaacccggaucaaagaguacaauaccgaggagcgcugaucauccucccaagcuguaucacucggcauugaaucggcaaaaagaacagcagcgcauugagcgagagaaccucaccaucucccugugucauccagguuggucugccgugacuuga

SEQ ID NO: 54301 - RNA, 2295 nt, Artificial Sequence
  derived and/or modified sequence opt3 from CFB__Homo_sapiens__NP_001701
augggcagcaaccugucuccccagcucugccuuaugccuuucauccugggguuguuauccggaggugugaccacaacuccauggucacuggccagaccgcaaggcaguuguagccuagagggggucgaaauuaagggaggcuccuuuaggcuccugcaggagggucaggcucuugaauacguuugccccucuggguucuauccuuacccagugcagacgcggaccugucgcucgacaggaucauggagcacucugaaaacccaagaccagaagacaguacgaaaagcagagugccgugccauacacugucccagaccucaugauuuugaaaauggcgaguauuggccaaggagucccuacuauaacguguccgacgagaucucuuuccacugcuacgauggcuauaccuugcgggggagcgcgaaucgcacuugucaggucaacggaagaugguccggucagacagcuauuugcgacaauggcgccggguacuguucaaacccuggaaucccaauuggcaccaggaagguggguagucaauaccggcucgaagauagcguuacguaucauugcucucgcgggcugacucugcgaggaucccagagaaggaccugucaggagggcggcucauggagcgggacagaaccgaguugccaggacucuuuuauguacgauacuccccaagagguggcagaggccuuccucuccagcuuaaccgaaacaaucgagggagucgacgcugaagauggucacggcccuggggagcagcagaaacggaagauagugcuggacccaucgggaucuaugaauaucuaucuuguauuggauggcuccgacucaauuggugcaaguaacuuuaccggggccaagaaaugccugguuaaucuaaucgaaaagguggcuagcuacggcgucaaaccccguuauggacucgugacguacgccacuuauccuaagauuugggugaaagucuccgaggcggauucuagcaacgcagacuggguuacaaagcaacugaaugagaucaacuacgaagaccauaaacuuaaaucaggcaccaauacuaagaaagcccugcaggcuguguacaguaugauguccuggccagaugacguacccccggagggguggaaccgcacaagacacgugauaauuuugaugaccgauggacuccacaauauggguggcgacccuaucacggucauugaugaaaucagggaccuguuauauaucgggaaggaucggaaaaacccccgagaggacuaccuggauguguauguuuucggagugggcccacucgucaaccaggugaauauuaacgcccuugcaagcaagaaagacaaugaacagcauguauuuaagguuaaggauauggagaaccuggaggacguguucuaccaaaugauagacgaaucucagucauugagucuaugugguauggucugggagcaccgcaaagggaccgauuaucauaagcagccuuggcaggcuaaaaucagcgugauuagacccuccaagggccacgaaucuugcaugggagccgucgugucggaguacuuuguucugacagcggcccacuguuucacuguggacgauaaagaacauagcaucaagguauccgucggcggggagaagagggaccucgagauagaagugguucuguuucacccaaauuauaacauuaauggaaagaaggaggcagguauccccgaauuuuacgauuacgacguggcucuuaucaaacugaagaacaaauugaaguauggccaaaccauucggccuaucugccucccauguacagaggggacuacccgcgcccugagauuaccgcccacaaccacuugccagcagcagaaggaggaacugcuaccugcucaagauauuaaagcccucuucgucucagaggaagagaagaaacugacgaggaaggaaguguacauaaagaauggagacaagaagggcaguugugagcgugaugcacaguaugccccagguuacgacaaaguaaaggauaucucugaggugguuacaccccgguuucuuugcaccgggggcgucagcccuuaugcugacccaaacacuugucgaggagauuccggcgggcccuugauugugcauaaaagaucaagguucauccaggugggagucaucagcuggggcguuguggacgugugcaagaaucagaaacgccaaaagcagguaccggcgcacgcacgggacuuucauauuaaccuguuccagguccucccuuggcugaaagaaaaacuucaagaugaggaccuggguuucuuguga

SEQ ID NO: 54302 - RNA, 672 nt, Artificial Sequence
  derived and/or modified sequence opt3 from CFC1B__Homo_sapiens__NP_001072998
augaccuggagacaccaugugaggcuccuguucacagucagccuugcccugcagaucauuaacuugggcaauuccuaccaacgggagaagcacaacgggggacgcgaagagguuacuaaaguggcuacgcagaagcaucgacagucucccuuaaauuggaccucaagucacuuuggugaaguaacaggcagcgcagagggguggggaccugaggaaccacugccguauuccugggccuucggcgagggugcgucugcucgucccagaugcuguaggaacgggggaacuugcgugcuaggcucguuuugugucugcccugcccauuucaccggccgguacugugaacacgaccagcgcagaucagagugcggggcacucgaacacggagccuggacacugagggcuugucaucuuugccgguguauauuuggugcacugcacugcuugccacuccaaacccccgaucgcugugacccuaaagauuuccuggccagccaugcucacggcccaagugccgggggagcgcccucccugcucuuacugcuuccuugcgcauugcugcaccgacuacucagaccagacgccccggcucaucccaggucucuggugccuagcguucuucagcgggagcgucgcccaugcggcagacccggucuggggcacagguuguga

SEQ ID NO: 54303 - RNA, 672 nt, Artificial Sequence
  derived and/or modified sequence opt3 from CFC1__Homo_sapiens__NP_115934
augaccuggagacaccaugugaggcuccuguucacagucagccuugcccugcagaucauuaacuugggcaauuccuaccaacgggagaagcacaacgggggacgcgaagagguuacuaaaguggcuacgcagaagcaucgacagucucccuuaaauuggaccucaagucacuuuggugaaguaacaggcagcgcagagggguggggaccugaggaaccacugccguauucccgugccuucggcgagggugcgucugcuagacccaggugcugucggaacgggggaacuugcgugcuaggcucguuuugugucugcccugcccauuucaccggccgcuacugugaacacgaccagagaaggucagagugcggggcacucgaacacggagccuggacacugcgggcuugucaucuuugccgcuguauauuuggugcacugcacugcuugccacuccaaacccccgaucgaugugacccuaaagauuuccuggccagccaugcucacggcccaagugccgggggagcgcccucccugcucuuacugcuuccuugcgcauugcugcacagacuacucaggccagacgccccggcucauccccggucucuggugccuagcguucuucagcgugagcgcagaccaugcggcaggcccggucuggggcaccgguuguga

SEQ ID NO: 54304 - RNA, 762 nt, Artificial Sequence
  derived and/or modified sequence opt3 from CFD__Homo_sapiens__NP_001919
augcacagcugggagagacuggccgugcucguccuucugggcgcugcagccugcgcggcucccccuagggggcggaucuugggaggucgcgaagccgaggcacaugcccgaccauacauggcuuccguucaguuaaacggcgcacaccugugugggggagugcuaguagccgaacaaugggugcucucugcugcccauugccuggaggacgcggcagauggcaagguccaggugcuucugggugcccacucauugagucagccggaacccagcaaacgucucuaugacguucugagagcugugccucauccagauucccagcccgacaccauugaucacgaccugcucuuacugcaacuuucugagaaggccacauuggggccugcagucaggccacugcccuggcagcggguggaucgcgacguagcuccuggaacucuaugugauguugccggcuggggcauagugaaucacgcggggagaaggccagacucgcuccagcauguccugcuuccggugcuggaucgggccacgugcaaccgccgaacccaccaugacggagcaaucacagagagauugaugugugcugaaucaaauaggcgggauagcugcaaaggugacaguggcgggccccucguguguggaggcguccuggaggguguugugacuuccgggucucguguaugcggaaaccgcaagaaaccuggcauuuacaccagaguggccagcuaugcugccuggaucgacuccgucuuagcauga

SEQ ID NO: 54305 - RNA, 900 nt, Artificial Sequence
  derived and/or modified sequence opt3 from CFDP1__Homo_sapiens__NP_006315
auggaggaguucgacagcgaagauuuuuccaccucugaagaggacgaagauuacgugcccucaggcggggaguauagugaggacgaugucaacgaacugguuaaggaggacgaaguggauggagaggagcagacacagaaaacucaagguaagaaaagaaaggcccagagcaucccugcuaggaaacggcgccagggcgggcucucccuugaagaggaagaggaagaggacgcaaauucugagucggaaggaucaagcagugaggaagaggaugacgccgcggaacaagagaagggcauugguuccgaggaugcucgaaagaaaaaggaagacgagcugugggccucuuucuugaacgauguagggccaaaaagcaaggugccgcccuccacgcaggucaaaaagggagaagagaccgaagagacaucaaguagcaaguuacuggugaaagcagaggaacuagagaagccuaaagaaacugagaagguuaaaauaaccaagguguuugacuucgccggcgaggaaguccgugugacaaaagagguagacgcuaccucuaaggaagcaaaguccuuuuucaaacagaaugagaaggaaaaaccacaggccaacguucccucagcucucccuagccugccagccggcagugggcuuaagagaucuuccggaaugagcucgcuguuggguaaaaucggcgcgaagaagcagaaaaugucuacucucgagaaguccaaacuggauugggagucauuuaaggaagaggaagggauuggagaggaacuggcaauccacaauaggggcaaagaggguuacauugagcggaaggccuuccucgaccgcguggaucauagacaauuugaaaucgagagggacuuacggcugaguaagaugaaacccuga

SEQ ID NO: 54306 - RNA, 3696 nt, Artificial Sequence
  derived and/or modified sequence opt3 from CFH__Homo_sapiens__NP_000177
augagacugcucgccaagaucauuugccuuaugcugugggcuauauguguggcagaggacugcaacgaauugcccccuaggcggaauaccgagaucuuaacaggcagcugguccgaucagacuuacccagaagggacgcaagccauuuauaaaugucgcccgggauaccgaucucuggguaacgucaucaugguuugccguaagggcgaguggguggcgcuaaauccccucagaaaaugucagaagaggccuugcgggcacccaggagacacccccuucggcacauuuacucugaccggugggaacguauucgaauauggagugaaagcugucuacacauguaaugagggcuaucagcuucugggcgagauuaacuaccgggaaugcgauaccgacggguggacuaaugauaucccuauaugugaggugguuaagugcuugccagugacagcccccgaaaacggaaagaucgucucaagugcaauggagccugaccgcgaguaucauuuuggucaggccgugagauucguauguaauagcggcuacaaaauugaaggggaugaggaaaugcacugcuccgacgauggauuuuggucuaaggagaaaccaaagugcguugaaaucucguguaaaucaccggacgugauuaacggcagccccaucagucaaaagauaauuuacaaggagaaugagagguuccaguauaaaugcaacauggguuacgaauauuccgagcgcggggaugcugucuguaccgaaucuggauggcggccucucccaagcugcgaggaaaaguccugugacaaucccuacaucccuaacggcgauuauucaccacugcgaauuaaacauagaacgggcgacgagaucacuuaccagugcaggaauggguuuuaucccgcaacccggggaaacacagccaaguguacuuccaccgguuggaucccggcuccucguugcacacugaaacccugugacuacccagauauuaagcacggcgggcucuaccaugagaacaugcgcagaccuuauuuccccguggccgugggaaaauacuauagcuacuauugcgacgaacacuuugagaccccaucuggcuccuacugggaucacauacauuguacgcaggacgguuggucacccgcggucccuugcuuaaggaagugcuauuucccauaccuggaaaauggguacaaccaaaaucacggccggaaguuuguucagggaaaaagcaucgauguggcaugucauccgggcuaugcccuucccaaggcucagacuacaguaaccugcauggagaacggguggaguccuacuccacgauguauucgcgugaaaacaugcucuaaguccagcaucgacauagaaaauggauucauuucggagucucaguacaccuaugccuugaaagagaaggcaaaguaccaauguaaacuggguuaugucacggcugauggcgaaaccuccgggucaaucacaugcggaaaggacggcuggagugcccagcccacuuguaucaaaagcugcgauauuccuguguuuaugaacgcgagaaccaagaaugacuucacaugguucaaacuaaacgauacucucgacuacgagugucacgacgguuaugaauccaauaccgggucuacaaccggcagcaucguuugcggauacaacggcuggucagaucugccaauuuguuacgagagggagugcgaacuucccaagauagacgugcaccuggucccggaucggaagaaagaccaguauaaggugggggagguauugaaauuuaguugcaagccuggauucacuaucguugguccaaauuccgugcaauguuaccauuuuggccucagccccgaucugccuauuugcaaagaacagguccagucuugugggcccccaccugaguuacugaacggaaaugugaaggaaaagacgaaagaggaguauggccacucagaagucguggaguacuauugcaacccccgcuuccucaugaaggguccaaauaaaauccaguguguugacggggaauggacaacccuuccggugugcaucguagaggaaaguacuuguggcgauauuccugagcuggagcauggaugggcccaauugagcagucccccauacuauuacggcgacucugucgaauuuaacugcucggagagcuucaccaugauagggcacagauccaucacauguauucauggaguguggacccagcuaccccagugcguugcaaucgauaagcugaaaaaguguaaaucaaguaaccucauuauccuggaagaacaccuuaagaauaagaaagaauuugaccacaacucuaauauaagguaccguugccggggcaaggaggguuggauccauacugugugcauuaacgggcgaugggauccugaggucaauuguagcauggcucagauccaacugugcccacccccuccgcagauuccaaacucccacaauaugacaacgaccuugaacuauagagacggagaaaaagugucaguacucugucaggagaauuaccugauccaggaaggcgaggagauaacuugcaaggaugguagguggcaaagcauucccuuauguguggagaaaaucccuugcucucagccaccccagauugagcauggcacaaucaacuccagucgcagcucucaggaauccuaugcccacgggaccaagcugucauacacaugugagggaggcuuccggauaagugaagagaaugagacuaccugcuauauggggaaguggagcucgccuccgcaaugugaaggacuacccugcaaauccccaccugagaucucucacggcguugucgcucauaugagcgacucauaccaguauggugaagaggugacguacaaguguuuugaaggguucggaauugacggccccgccaucgcaaaaugccucggugagaaguggagucacccaccuuccugcauuaaaaccgauugucugucucuucccagcuuugagaacgccaucccaaugggcgaaaagaaggacguguacaaagcuggggagcaggucacauauacuugcgcgaccuacuauaagauggauggagcauccaauguuacauguauaaacucaagauggacuggcaggccgaccugccgcgacacgagcugugugaauccucccacagugcaaaacgccuacauuguaagucgacagaugucuaaauauccauccggggaacggguccguuaccagugcagaagccccuaugagauguucggagaugaagaggugauguguuugaacggcaauuggaccgagccuccacagugcaaggacucgacugguaaaugugggcccccuccgccaaucgauaacggagacaucacaucauuuccccugucuguuuacgcuccugccaguuccguggaauaccaaugccagaaucucuaucagcuggagggcaacaagaggauuaccugucgcaauggucaguggagcgaacccccaaagugccuucauccuugcgucaucucucgggagauuauggagaacuacaauauagcacugagauggacugccaaacaaaaguuguauagcaggaccggcgaauccguggaguucguuuguaaacgaggguaccgccucucaagucggagccacacacugagaacgaccugcugggauggaaaguuagaauaucccacuugugcuaaaagguga

SEQ ID NO: 54307 - RNA, 993 nt, Artificial Sequence
  derived and/or modified sequence opt3 from CFHR1__Homo_sapiens__NP_002104
auguggcugcucgugagcgucauccuuauuuccagaauaucuucaguuggcggggaggccaccuucugcgacuuucccaagaucaaccacgguauucuguacgaugaagagaaauauaagccuuucagucaggugccaacaggagaaguauuuuacuauagcugugaguacaauuucguguccccgucuaaaucguuuuggacuaggaucacgugcaccgaagagggcuggucacccacaccuaaguguuugcgguuaugcuucuuuccauucgucgagaacgggcauagcgaaaguuccggacaaacucaccuggagggcgacaccgugcagauuaucuguaauacagguuaucgccuacagaacaaugaaaacaauauaucuugcguugagcgaggguggagcacucccccuaaaugucguuccaccgauacaucaugcgugaacccacccaccguccagaaugcucauauccucaguagacaaaugagcaaguacccuucuggagagagggugcgguaugaaugucgcuccccauacgagauguuuggcgacgaagagguaaugugccugaacggcaauuggacggaaccgccccaguguaaggauucaacugggaaaugcggaccuccacccccuauugacaacggugauaucaccagcuucccacuuaguguuuacgcacccgccucuuccguggaguaucagugccagaaucuguaccaauuggagggcaacaagagaauuacauguaggaaugggcaguggagcgaaccgccuaaaugccuccaccccugugucaucucgcgggagauaauggaaaacuauaacauugcgcugcgcuggacugcuaagcagaaacuguaccuccgaaccggagagucugccgaauuugugugcaagagaggcuauagguuauccucacggagucauacacugcguaccacguguugggacgguaaacuugaguacccaacuugcgcaaagcgcuga

SEQ ID NO: 54308 - RNA, 813 nt, Artificial Sequence
  derived and/or modified sequence opt3 from CFHR2__Homo_sapiens__NP_005657
auguggcugcucgugagcgucauccuuauuuccagaauaucuucaguuggcggggaggccauguucugcgacuuucccaagaucaaccacggcauucuguacgaugaagagaaauauaagccuuucagucaggugccaaccggugaaguauuuuacuauagcugugaguacaauuucguguccccgucuaaaucguuuuggacaaggaucacuugcgcugaagagggcuggucacccacgccuaaguguuugcgguuaugcuucuuuccauucgucgagaacgggcauagcgaaaguuccggacaaacccaccuggagggcgacacagugcagauuaucuguaauacugguuaucgccuacagaacaaugaaaacaauauaucuugcguugagcgaggguggagcacacccccuaaaugucguuccaccaucucagcagagaagugcggaccacccccuccaauugauaacggcgacaucaccaguuuucuccugagcguguacgccccgggaucuuccgucgaauaucagugucaaaaucuuuaccagcuggaggggaacaaucagauuacuugcagaaacggacaguggucagaacccccuaaguguuuggauccaugcgugaucagccaagagauaauggaaaaauacaauauuaagcucaaauggacaaaccagcagaagcuguauaguaggaccggugacaucguagaguucguuugcaaaucuggcuaccaucccacgaagucccacagcuuucgggcgaugugucagaaugggaagcugguguauccuucgugcgaggaaaaauga

SEQ ID NO: 54309 - RNA, 810 nt, Artificial Sequence
  derived and/or modified sequence opt3 from CFHR3__Homo_sapiens__NP_001160096
augcugcuccuuaucaacgugauucugaccuugugggucagcugcgccaauggccagguuaagcccugugacuucccugauauaaaacacgggggauuauuucaugagaacaugagaaggccauacuucccgguggcuguagguaaguauuacuccuauuacugcgacgaacacuuugagacacccucuggcucauauugggauuacauccauuguacucaaaauggguggaguccugcagugccaugccugcggaaauguuauuuccccuaccuagaaaacggauacaaucagaacuauggccgcaaguuuguccaggguaauagcacggagguggccugccacccuggguacggacucccaaaagcgcagaccacaguuacuuguaccgaaaagggcuggucccccacaccucgaugcauucgugugaacucuucggagaaguguggcccaccgcccccuaucucaaauggggacaccacuagcuuccugcuuaaagucuaugugccacaaaguagaguagaguaccagugccagcccuauuacgaacugcagggauccaacuauguuacauguucuaauggugaguggagcgaaccuccaaggugcauucaucccugcaucauaaccgaggagaacaugaauaagaacaauaucaaauugaagggccgguccgaucgcaaauacuacgcuaagacgggggacacuauugaauuuauguguaagcucggauauaacgccaacaccucaauccugaguuuccaagcagugugcagagagggcauugucgaauacccgaggugugaguga

SEQ ID NO: 54310 - RNA, 1734 nt, Artificial Sequence
  derived and/or modified sequence opt3 from CFHR4__Homo_sapiens__NP_001188480
augcugcuccuuaucaacgugauucugaccuugugggucagcugcgccaauggccagguuaagcccugugacuucccugagauacaacacgggggauuauacuauaaaucccugagaaggcuauacuuuccagcugcagccggucagucuuauucauacuauugcgaucagaacuucgugacaccgaguggcagcuacugggacuauauccauuguacucaggauggguggucccccacgguaccuugccuccggaccuguucuaagucggacguggaaauugagaauggauuuaucucagaaagcaguuccauuuacauccugaacgaggaaacacaauacaauugcaaaccaggcuaugcgacugcugaggguaacucuagcggguccauaaccugucuucagaauggauggucaacacagcccaucugcauuaaguucugugauaugccugucuuugagaacagucgcgccaaaagcaauggcaugugguucaagcugcacgacaccuuggauuacgaaugcuaugacggcuacgagucuuccuaugggaacacuacagauucaaucguguguggagaagacgguuggagccaucucccaaccugcuacaauaguucugagaacugcgggcccccuccaccgauuuccaauggcgauacgacuagcuuuccccagaagguuuaucugccuuggucgcgaguggaguaccaaugucagucuuacuaugaacugcagggauccaaauacgugaccugcucaaacggcgacuggagugagccaccccguuguaucagcaugaagccuugcgaguucccagaaauacagcacggucaucucuauuacgaaaauacaagaaggcccuauuuuccggucgcaacugggcaauccuacucuuauuacugugaucagaacuucguaaccccuagcggaucauacugggacuauauucacugcacacaggacggcugguuacccaccguuccaugucugcggacgugcaguaaauccgauaucgagauugagaacggcuuuaucagcgaaucuucaaguaucuacauucuuaauaaggagauacaauauaaauguaagccuggguacgccacugcugacggaaacagcuccgguucuaucacaugcuugcagaauggcuggucggcacagcccauuuguaucaaguucugcgauaugccaguguuugaaaacagccgcgccaaauccaaugggaugagauucaagcugcacgacacccuagauuaugagugcuacgacggauaugaaauaucauacggcaacacuacagguaguauugucuguggggaggauggcuggucucauuucccuaccugcuacaauagcuccgagaaauguggacccccaccgcccaucucaaacggcgacacgaccagcuuucuccugaagguguaugugccucagucuagggucgaauaccaaugccaguccuauuacgagcuucaggggaguaauuauguuacauguagcaacggagaauggucugagccaccccggugcauccacccuuguauuaucacugaagagaauaugaacaaaaauaacauucagcugaaggguaaauccgauauaaaguacuaugcuaagaccggcgacacaaucgaguucaugugcaaauugggguacaaugccaacacuucagugcucaguuuucaagcgguaugucgcgaaggaauuguggaguacccacgaugcgaauga

SEQ ID NO: 54311 - RNA, 1710 nt, Artificial Sequence
  derived and/or modified sequence opt3 from CFHR5__Homo_sapiens__NP_110414
augcugcuccuuuucagcgugauccugauuuccugggucucuaccguuggcggggagggaacauugugcgacuuucccaagauacaccaugguuucuuauacgaugaagaggacuauaacccuuuuucacaggugccaacuggcgaaguauucuacuauaguugugaguacaauuuugugagcccguccaaaucuuucuggacgagaauuaccugcacagaagagggguggucgcccacuccuaagugucugaggaugugcucauuuccauucgucaaaaacggacacagcgagaguuccggccuaauccaucucgaaggugauaccgugcaaaucauuuguaauacaggguauucucugcagaacaaugagaagaacaucagcugcguugaacggggaugguccacucccccuauauguucauuuaccaaaggcgagugccacgugccaauccuugaggccaaugucgacgcucagcccaagaaggaaaguuacaaagugggcgauguacugaaguucagcugucgcaaaaacuugauucgaguugggucugacuccgugcagugcuaucaauuuggauggucaccuaauuucccaacauguaagggucagguccguagcugcggcccgcccccucagcucaguaacggggaggugaaagaaaucagaaaggaggaauacggacauaaugagguggucgaguacgauugcaacccaaauuuuauuaucaacggccccaagaaaauacaguguguugacggugaauggaccacgcugccuacuugcguggagcaaguaaagaccuguggguauauuccagaacuggaguacggauaugugcagcccucugucccgccuuaccagcacggcguguccguugaagugaauugcaggaacgaguaugcaaugaucggcaacaauaugauuacauguaucaacgggaucuggacugagcuccccaugugcgucgccacccaccaguuaaaacgguguaagauugcgggagugaauauaaaaacacugcuuaaguugagcgguaaagaguucaaccauaauucgcgcaucagauacaggugcucugauauuuuccgguaucgccacuccguauguaucaacggcaaguggaauccagaaguugacugcaccgaaaagcgagagcaauuuuguccucccccaccccagauaccuaacgcucagaauaugacgacuacagugaacuaccaagauggggaaaaagucgccgugcugugcaaggagaauuaccuacucccagaggcaaaagaaauugucugcaaggacggaagauggcagucacugccgagguguguggagaguaccgccuauugcggucccccuccaagcaucaacaauggcgauacuacauccuucccccuuucuguuuacccuccagggagcaccgugacguaucggugucagucauuuuacaaacugcagggcaguguaaccgucacaugccguaacaagcaaugguccgaacccccgcgcuguuuggacccuugcgugguuagcgaggagaauaugaacaagaacaauauccagcucaaauggagaaacgacggaaagcuguaugcuaaaacuggcgaugcaguggaguuccaguguaaguuuccacauaaagccaugauuucuucacccccuuucagggcuaucugccaggaagggaaguuugaauaccccauuugugaguga

SEQ ID NO: 54312 - RNA, 1752 nt, Artificial Sequence
  derived and/or modified sequence opt3 from CFI__Homo_sapiens__NP_000195
augaagcugcuccacguguuccuucuguuuuugugcuuccauuuaagauuuuguaaagucaccuacacaagccaggaggaccugguugaaaagaaaugccuagccaagaaauauacucaccucuccugugauaagguguucugccaacccuggcagagguguaucgagggcacgugcguauguaagcugccuuaccagugcccgaaaaacgggaccgcugugugugcaacaaaucggcgcucuuuuccaacuuauugccagcaaaagucacuugaaugucugcaucccggaaccaaauucuugaacaaugguacaugcaccgccgagggcaaguuuagugucagccucaaacacgggaacacugacuccgaaggaauuguggagguuaagcugguggaucaggacaagacaauguucauaugcaaaucuucguggucaaugcgagaggcgaaugucgcuugucuggaucucggcuuucagcagggugccgacacccaacguagauucaaguuaagcgaucugaguaucaacuccacggaaugccuucaugugcacuguaggggguuggagacuucucuggcagaaugcaccuuuacaaaacggcgcacuaugggauaccaggacuucgccgauguaguuuguuauacccagaaggcugacagcccuauggaugacuuuuuccagugcgugaauggcaaauacauuucccaaaugaaggcaugugauggcaucaacgacugcggggaccagucagaugagcuauguugcaaagccugucagggaaaggguuuccacugcaagaguggcgucugcauuccaagccaauaucaguguaauggggagguggacugcaucacaggagaagaugaggugggcugugcugguuuugccucugucgcgcaggaagagaccgaaauacucacggcagacauggaugccgagagaaggcggaucaaaucccugcuucccaagcugucaugcgggguuaaaaaccgcaugcauauucgaagaaagaggaucgugggaggcaaacgggcucaguugggcgaccucccuuggcaaguagccauuaaggaugcaagcgggaucacuuguggagguauauacauuggcgggugcuggauccugacagcugcccacuguuuacgugcgaguaagacccaucgcuaccagauuuggacuacaguggucgacuggauccacccagaucugaaaagaaucgugauugaguauguugacaggauaaucuuccacgaaaauuacaacgccggaaccuaucagaaugauauugcacucaucgagaugaagaaagacggcaacaagaaagacugcgaacuuccccggucuauaccugcuugugugccaugguccccguaccuguuucagcccaaugauacgugcauugucagcgguugggggcgagagaaggacaacgaacgcguguucucguugcaauggggcgagguaaagcuaaucucuaacuguuccaaauuuuauggaaauagauucuacgagaaggaaauggagugcgccggcaccuaugaugggucaaucgacgcuugcaaaggagauagugguggcccucugguuuguauggacgccaacaaugugacauacgucuggggaguggucagcuggggcgaaaacugcgggaagccagaguuucccgguguguacacuaaaguugcaaauuauuucgauuggauuuccuaccauguggggaggccuuuuaucucucaguauaacguauga

SEQ ID NO: 54313 - RNA, 501 nt, Artificial Sequence
  derived and/or modified sequence opt3 from CFL1__Homo_sapiens__NP_005498
auggccagcggcguggcugucuccgacgggguuaucaagguguucaacgauaugaaaguaagaaagucuucaacccccgaggaagugaaaaagaggaaaaaggcaguccuguuuugccucagugaggacaagaaaaauauuauacuugaagagggaaaggaaauccuggugggugauguuggccagacaguggacgauccuuacgccacuuucgucaaaauguugccagacaaggauugucgguaugcguuauacgacgcuacguaugagaccaaagagagcaagaaggaagaucugguguuuauuuucugggccccggaguccgcaccccuaaaaucuaagaugaucuacgccucgucaaaagacgcuauuaagaaaaagcucacagggaucaaacacgaacugcaagcaaacugcuaugaggagguaaaggaucgcuguacucuugccgaaaagcugggaggcagcgcuguuauaaguuuggaggguaaaccucucuga

SEQ ID NO: 54314 - RNA, 501 nt, Artificial Sequence
  derived and/or modified sequence opt3 from CFL2__Homo_sapiens__NP_068733
auggccagcggcgugaccgucaacgacgagguuaucaagguguucaaugauaugaaaguaagaaaguccucuacacaggaagagauuaaaaagaggaaaaaggcugugcuguuuugccucucagacgauaagcggcagauaaucgucgaagaggcaaaacagauucuugugggggacaucggagauacuguugaagaccccuacacgaguuucgugaagcuguugccuuuaaacgauugucgcuaugcccuguacgacgcgaccuaugagacaaaagagagcaagaaagaagaucuagucuuuauuuucugggcuccagaguccgccccgcucaagucuaagaugaucuacgcaucgucaaaagacgccauaaagaaaaaguuuacugguaucaaacacgaauggcaagugaauggccuggaugacauuaaggaucgaagcacccuuggggagaaacugggaggcaacguaguugugaguuuggaggguaagccccucuga

SEQ ID NO: 54315 - RNA, 666 nt, Artificial Sequence
  derived and/or modified sequence opt3 from CFLAR__Homo_sapiens__NP_001120656
augagcgccgaggugauccaccaggucgaagaggcucuggacaccgaugaaaaggagaugcuccuuuuccugugcagagacguugcaauugaugugguacccccuaacgugagggacuuguuagauauacugcgggaacgcggcaaacuauccgucggggaccucgccgagcugcuuuaccgagugcguagauuugaucuguugaagaggauccucaaaauggaccggaaggcgguugagacacaucugcugcgcaauccacaccucgugucugauuauagagucuuaauggcugaaauuggagaggaccuggauaaaucagacgugaguagccuuaucuucuugaugaaggauuacauggguaggggcaagauuuccaaagaaaagucuuuucuggaccuaguaguugagcucgagaaacugaaccuuguggccccggaccaacuggauuugcucgaaaagugucugaaaaauauccaucggauagacuuaaagacuaagauccagaaauauaagcagucgguccagggggcaggaacgucauaccgcaacgugcugcaagccgcuauucagaaaagccucaaggaucccaguaauaacuuccgaaugaucaccccuuaugcacacugcccagaccuuaaaauucugggcaauuguuccauguga

SEQ ID NO: 54316 - RNA, 1410 nt, Artificial Sequence
  derived and/or modified sequence opt3 from CFP__Homo_sapiens__NP_002612
augaucaccgagggcgcccaggcucccagacugcuccuuccuccacuguuguuacugcuaacacucccggcaacugggagcgaccccgugcugugcuucacgcaauacgaagaguccucuggaaaguguaaaggucuucugggcgggggagucucaguugaagauugcuguuugaacaccgccuuugcguaucagaagaggaguggcggucucugccagccuugucggagcccacgcuggucccuguggucuacaugggcucccugcucggugacuuguucagaggggagccagcugcgauaccguagaugcguaggauggaauggccaauguaguggcaaaguggccccugggacccucgaauggcaguuacaggcaugcgaggaccagcaauguugcccagagaugggagguugguccggcugggggcccugggaaccuugcucugucacauguagcaagggaaccaggacucggcgcagagccugcaaccacccagcuccgaaauguggcggucauugccccgggcaggcacaggaguccgaagccugugauacacagcaagugugcccuacccacggagcuugggccacguggggcccauggacucccuguucagcgaguugccauggcgggccucacgagccaaaggagaccaggagccggaaguguucugcacccgaaccgucccagaaaccucccggaaagccaugcccuggucuggccuaugagcagcgccgauguacaggccuucccccaugccccguugcugggggauggggcccuugggguccagugucaccgugccccgucacuuguggguugggccaaaccauggaacagagaacaugcaaucauccugugccacagcacggaggccccuucugugccggggacgcaaccaggacgcacauuugcaacacugcuguaccuuguccaguugauggagagugggacagcuggggugaauggagucccugcauacggcguaauaugaaaucuaucuccugucaggagauuccgggccaacagagccgcgggagaacaugcaggggacggaaguuugauggccaucgaugugccggucagcagcaagacauccgccacugcuacucgauucagcauuguccucugaaagggucuugguccgaguggucaaccuggggccuaugcaugccacccugcggaccuaaccccacuagagcgaggcagcggcucuguacaccacugcuuccuaaguaucccccaaccgugaguauggucgaaggccagggggagaagaaugugacguucuggggacgcccgcugccuagaugcgaagaguugcaaggucagaaacucguggucgaagagaagaggcccugucugcacguuccagccugcaaagaucccgaggaagaggaauuauga

SEQ ID NO: 54317 - RNA, 4443 nt, Artificial Sequence
  derived and/or modified sequence opt3 from CFTR__Homo_sapiens__NP_000483
augcagagaagcccccuggagaaggccuccguggucucuaaacucuucuuuucauggaccaggccuauccuucggaagggcuaccgccaacgacuggaauugagugacauuuaucagauaccaagcguugauuccgcugacaacuuaucugagaaacuggaacgugagugggauagagaacuagcaucgaagaaaaauccgaagcucaucaacgcccugaggcggugcuucuuuuggcgcuucauguuuuacgggauuuuccuuuaucugggagaggugacaaaggcgguacagcccuugcuccuggguagaaucauugcuucauacgacccugauaauaaagaggaaaggagcaucgccauauaucugggcaucgggcucuguuuacuguuuauugugcggacucuuuugcugcacccagcaaucuucggacuacaucacauuggcaugcagaugcgcaucgccauguuuagucucauauacaagaaaacgcugaaacuuuccucucgaguccuggacaagauuagcaucggucaauuggugucccuccugucaaacaauuuaaacaaguucgaugaggggcuggcucucgcacauuuuguuuggauugcuccccuucagguggcccuguugaugggacuaaucugggaacugcuccaggccagugcguucugcggccugggcuuucuuaucguccuggcauuguuccaggccgggcucggaagaaugaugaugaaguauagggaccaacgggcugguaaaauuagcgagcgucuggugauaaccucugagaugaucgaaaauauucaguccguaaaggccuacuguugggaggaagcaauggagaaaaugaucgaaaacuuacgccagacagagcugaagcuaacuagaaaagcugccuacguuagguauuucaauucaagcgcguuuuucuuuaguggcuucuuuguggucuuccucucugugcugccuuacgcccuuauaaaggggauuaucuugcggaaaaucuuuaccacaauuuccuucugcaucgugcugcgaauggcagucacccgccaguuuccaugggcuguucaaacuugguaugauagccucggagccauuaacaagauacaggacuuccugcagaagcaagaguacaaaacacuugaauauaaucugaccacgacugaggugguaauggaaaacgugaccgcuuuuugggaggaaggcuucggugaguuguuugagaaggccaaacagaauaacaauaacagaaagacaucgaacggggaugacucucucuucuucuccaauuuuucacuguuaggaacucccguccugaaagauaucaacuucaagauugaaaggggccagcuacucgcaguggccggcaguaccggggcuggaaagacaagccugcuuaugguuaucaugggugaguuggaaccuuccgagggcaaaaucaagcacucugggcggauuagcuuuuguucacaguucaguuggauaaugccaggaaccaucaaagaaaauauuaucuuuggcguguccuacgacgaguaucgcuacagaagcgucauuaaggcgugccaacuggaggaagacaucucuaaauucgcagagaaggauaacauagugcucggugaagggggcaucacgcugucaggaggccagagggcccguauuaguuuagcucgggccguauacaaggacgcagaucuguaucuuuuggacagcccguuuggguaccucgauguucugacugagaaagagaucuucgaauccugugugugcaagcuaauggccaauaaaacaaggauucuggucaccucuaagauggagcaucucaaaaaggcugacaagauccugauacuucacgaaggaucgagcuauuuuuacgguacuuucuccgaguugcagaaccugcagcccgauuuuucaaguaaauuaaugggcugugacucuuucgaucaauuuagcgccgaaagacgaaauuccauucucacagagacccugcaccgcuucucacuugagggggacgcaccugugagcuggacggaaaccaagaaacagucuuucaagcagacaggagaguuuggcgaaaaacggaagaacuccauccugaauccaauuaacaguaucagaaaauucagcauaguccagaagacucccuugcaaaugaaugguaucgaggaagauucugacgagccucucgagaggcgccugucccuagugccagacucagaacagggggaggcgauucugccccgaaucaguguuauuagcaccggcccgacacuccaggcucggcguagacagucggugcugaaccuuaugacucauuccguaaaucaaggacagaacauccacaggaagaccacagccucuacccgcaaagucagcuuggcaccucaggccaaucugacugaauuagauauauauucacggagacucagucaagagacgggccuggaaauuuccgaggagaucaacgaagaggaccuuaaggaaugcuuuuucgaugacauggagucuauccccgcugugacaaccuggaacacuuaccugagguauauuaccguucauaaaagccuaaucuuugugcucauuuggugucuggucauauucuuggccgagguggcagcuucccugguaguguuauggcuccuggggaauacaccacuucaggauaagggaaacucaacccacagccgaaauaacaguuacgccguuaucauuacuucuacauccagcuacuaugucuuuuacaucuauguggguguggcggacacgcuguuggccaugggcuucuuucgcgggcucccucugguccacacccuaauuacuguuucgaaaauccugcaucacaagaugcuucauucagugcuccaggcucccaugucuacacugaauaccuugaaggcaggaggcauacugaaccgguucaguaaagauaucgccauuuuagacgaucuccugccacuuacaaucuuugacuucauucagcuguugcucaucgugauaggugcuauugccguagucgcagugcugcaacccuacaucuucguugcgacugugccugucaucguggccuuuauuaugcuaagagcuuauuuccugcagaccucccagcagcuuaagcaacucgaaagcgaggggaggucuccaauauuuacgcaccugguuaccagcuugaaaggcuuauggacacugcgugccuucggacgccagccguacuuugaaacucucuuccauaaggcacugaaucuucacaccgcuaacugguuucuguauuuguccacacuacggugguuccagaugagaaucgagaugauuuuugugaucuucuuuauugccguaacuuucaucucaauacugaccacgggcgaaggggagggaagggucggcaucauucucacacuggcaaugaauaucaugaguacccuucagugggccgugaacagcucuauugauguggacuccuuaaugcgaucagucagucggguuuuuaaauucaucgauaugcccacugaggguaagccuacaaagagcaccaaaccauacaagaaugggcaacuguccaaagugaugauaauugaaaacucucacguaaagaaagacgacaucuggcccucgggaggccagaugacugugaaggaucucaccgcuaaguacacagaggguggcaaugcgaucuuggaaaacauuagcuucucaaucuccccugggcagcgcgucggacugcucggcagaacggggaguggaaaaucuacccugcuuagcgccuuucugagguugcuaaauacugagggcgaaauacaaauugacgguguguccugggauucaaucacacugcagcaguggcggaaggcauucgggguuauuccacagaaaguguuuaucuucucuggaaccuuucgaaagaaccucgaccccuaugagcaauggagcgaucaggagauauggaaagucgcugacgaagugggcuuaagaaguguuauugagcaguucccggguaagcuggauuuugugcuugucgacggcgggugcguacugucccauggacacaaacagcucaugugcuuggcccgcagcgugcugucuaaggccaagauccuccugcuugaugaaccuucagcucaucuagacccaguuacauaccaaaucauuaggcguacucugaaacaggcauucgccgauuguaccgugaucuugugcgagcaccggauugaagcgauguuagagugucagcaguuucuggucauagaggaaaacaaggugagacaauaugacuccauccagaaacuccugaaugagaggagucuuuuccgccaggcuauuagccccucggaucgaguaaagcuguuuccucacagaaacucuuccaaaugcaagagcaagccccagaucgccgcacucaaagaagagacggaggaagaggugcaagacacacgguuguga

SEQ ID NO: 54318 - RNA, 351 nt, Artificial Sequence
  derived and/or modified sequence opt3 from CGA__Homo_sapiens__NP_000726
auggacuacuauagaaaguacgccgcuaucuuccuggugacccucagcgucuuucuucacguucugcauuccgcacccgaugugcaggacugcccugaguguacauugcaagaaaacccauucuuuucucagccgggcgcccccauuuuacagugcaugggguguugcuucucaagggcguauccuacuccacugcggaguaaaaagacgaugcuaguacagaaaaaugugaccagcgaguccacauguugcgucgcuaagucuuacaaccgcgugacuguuaugggagguuuuaaaguggaaaaucacaccgccugucauugcucgacauguuauuaccacaagucauga

SEQ ID NO: 54319 - RNA, 468 nt, Artificial Sequence
  derived and/or modified sequence opt3 from CGB1__Homo_sapiens__NP_203695
augagcaagagacugcuccuucuguuguuacuguccaugggcgggaccugggccucuaaagagccccuaaggccucggugccgcccaaucaacgcuacacucgcaguggaaaaggagggauguccggucugcauuacuguuaauacgaccauaugugccgguuacugccccacaaugacucgagugcugcagggcguacuuccugcgcugccacaaguggucuguaacuaucgugacgugagauucgaaucaaucagguugcccgggugcccucggggaguuaauccaguggucaguuacgcuguggcccucagcugucagugcgcacugugucgcagauccaccacagauugcggcggucccaaagaccacccucugaccugugaugacccaagguuucaggauucuucgucaagcaaggccccgcccccuagucucccaucccccucucgguuaccugggccauga

SEQ ID NO: 54320 - RNA, 492 nt, Artificial Sequence
  derived and/or modified sequence opt3 from CGB2__Homo_sapiens__NP_203696
augagcaagggccugcuccuucuguuguuacuguccaugggagggaccugggccucuaaagagccccuaagaccuaggugccggccaaucaacgcuacacucgcaguggaaaaggaggguuguccggucugcauuacuguuaauacgaccauaugugccggcuacugccccacaaugacucgcgugcugcaggggguacuuccugcgcugccacaaguggucuguaacuaucgagacgugcguuucgaaucaaucagauugcccggaugcccuaggggcguuaauccaguggucaguuacgcuguggcccucagcugucagugcgcacugugucggcgcuccaccacagauugcggugggcccaaagaccacccucugaccugugaugacccaagauuucaggccucuucgucaagcaaggcuccgcccccuagucucccaucccccucuagguuaccuggaccaagcgauacucccauucugccgcaguga

SEQ ID NO: 54321 - RNA, 498 nt, Artificial Sequence
  derived and/or modified sequence opt3 from CGB5__Homo_sapiens__NP_149032
auggagauguuccagggccugcuccuucuguuguuacugagcaugggagggaccugggccuccaaggaaccccuaagaccuaggugccggccaaucaacgcuacacucgcaguggagaaagaagguuguccggucugcauuacuguuaauacgaccauaugugccggcuacugccccacaaugacucgcgugcugcaagggguacuuccugcgcugccacagguggucuguaacuaucgagacgugcguuuugagucuaucagauugcccggaugcccuaggggcguuaauccaguggucucauacgcuguggcccucaguugucagugcgcacugugucggcgcagcaccacagauugcggugggcccaaggaccacccucugaccugugaugacccaagauuccaggauuccucuucgucaaaagccccgcccccuagccucccaagucccuccagguuaccuggaccaucugacacucccauucugccgcaauga

SEQ ID NO: 54322 - RNA, 498 nt, Artificial Sequence
  derived and/or modified sequence opt3 from CGB7__Homo_sapiens__XP_011525821
auggagauguuccagggccugcuccuucuguuguuacugagcaugggagggaccugggccuccagagaaaugcuaaggccccggugccgcccuaucaacgcuacacucgcaguggagaaggaagguuguccagucugcauuacuguuaauacgaccauaugugccggcuacugcccgacaaugacucgagugcugcaagggguacuucccgcgcugccucagguggucuguaacuaucgugacgugagauuugagucuaucagguugccaggaugcccccggggcguuaauccuguggucucauacgcuguggcccucaguugucagugcgcacugugucgcagaagcaccacagauugcggugggccaaaagaccacccccugaccugugaugacccuagguuccaggccuccucuucgucaaaggcuccaccgcccagccucccuaguccaucccgguuacccggaccuucugauacuccaauucugccccaauga

SEQ ID NO: 54323 - RNA, 3612 nt, Artificial Sequence
  derived and/or modified sequence opt3 from CGN__Homo_sapiens__XP_005245422
auggagcaggcccccaacauggcugaaccuagaggcccaguggaccacgggguccaaaucagguucauuaccgagccgguuagcggagcagaaauggguacacugcggcgcggcgggcgacgucccgccaaggaugcgagagcuuccacuuacggaguggccguaagggugcagggcauagcaggucagccuuuugucgugcucaauucuggggagaaaggaggcgacucauucggcguucagaucaagggggccaacgaucaaggagcuaguggugcacuuagcuccgaccuggaauugccagagaaucccuauucucaggugaaaggcuuuccugccccaucgcagucaagcacgagugaugaggaacccggggcuuacuggaacggaaaguuacugcggucccauucucaggccagccuagcgggcccugguccagucgacccguccaaucgcucaaacaguaugcucgagcuggcacccaaaguggccagcccugggucuaccauugauacagcuccacuuuccucaguagacagccugaucaauaaguucgauagucaauugggaggccaggccagaggcaggacugggcggcgcacccgaaugcugcccccugaacagagaaagaggucuaaaucccucgacagccggcugccacgugauacauuugaggagcgcgaaagacagucgaccaaccacuggacuucuuccacaaaguaugacaaucauguuggaaccucaaaacaacccgcacagagucagaaccucagcccguuauccgguuucucuaggagccggcaaacgcaggauugggugcugcagucauuugaggaaccucgacgcagugcucaggaccccacuaugcuucaauucaaguccaccccagacuugcugagagaucagcaggaggccgcgccucccggcagcgucgaccacaugaaagccacaauuuacgggauccuaagggaaggaucuucagagagugagacuagcgugcggcgcaaggugucccucguccuggaaaagaugcagccacuuguuauggugucuucgggcagcaccaaagcaguagcuggucaaggggagcugacaagaaagguggaagaguugcagaggaaacucgaugaagaggucaagaaacgucagaagcuggagcccucccaggugggcuuagaacggcaacuggaggaaaagaccgaggaaugcucacgacuccaggagcuucuggagagaaggaagggagaagcccagcagaguaauaaggaguugcaaaacaugaaacgccuacuggaccagggcgaagaucuccggcaugggcuggagacgcagguuauggagcuucaaaauaagcugaaacacgugcagggaccugaaccagcuaaggaggucuugcucaaagaccuguuagaaacuagagagcugcuagaagaggugcucgaggguaagcagaggguagaagaacagcugcgccuucgagaacgggaguugacagcccugaagggcgcacucaaagaagagguugccucucgugaucaagagguggaacacgucagacagcaguaucagagggacaccgagcaacugcgccggagcaugcaggaugcuacucaggaccaugcggugcuugaagcagagagacagaagauguccgcccuggucaggggguugcaacgagaacucgaggagacaucagaagagaccggacacuggcagagcauguuucagaaaaacaaggaagaucugcgcgcuacgaaacaagaguuacugcagcuacggauggagaaggaagagauggaagaggaacucggcgagaagauagaggugcugcagagagaacuugagcaggccagggcaucugccggugacacccgucaaguugaaguguugaaaaaggagcugcuccgcacacaggaagaacugaaagaguuacaggcugaacggcagucccaagagguagccgggagacauagggaccgagaacuggagaagcagcuugcagucuugcggguggaagcggaucgcggcagagagcucgaggaacagaaucugcagcuacagaaaacucugcaacagcucaggcaggacugugaggaagcuaguaaggccaagaugguugcagaggccgaggcuaccgugcugggacaacggcgagccgcagucgaaacaacucuuagagagacccaggaagagaacgaugaguuccgcaggcguaucuugggccuggagcagcaauuaaaagagacacgggggcucguggacggaggugaagcuguagaggccagacugagggauaaacuucagcgccuggaagcggagaaacagcaguuggaagaggcccucaacgcuagccaagaggaagagggcucucuggcagccgcuaagcgagcccuagaagcaagacuggaggaagcgcagcgggggcucgccaggcugggacaggagcagcaaacccuuaaucgcgcuuuggaggaagagggcaaacagcgugaagugcugagacgggguaaggccgaguuagaggaacagaaaaggcuccuggaccgcacuguugaucgacuuaacaaggagcuggaaaagauuggggaggacuccaaacaggcacuacaacagcuccaggcucaacuggaagauuacaaggagaaagccagacgggaggucgcagacgcccagaggcaggcuaaggauugggcgucagaagccgagaaaacgaguggcggauugagccgccugcaggacgaaauccaaagauuaaggcaggcacuccaggcuucgcaggccgagcgggauacagcccgucuggacaaggaacuucuggcucaacgcuugcagggccucgagcaggaggcagaaaauaagaaacgaucccaggacgauagagccaggcaacugaaggggcuagaggaaaaagugucucggcuggagaccgaacuugacgaggagaagaacacuguggaacuccugaccgaucgcgucaauagaggaagggaccagguugaucaguugcggacagagcugaugcaggaacgaagcgcgagacaagacuuagagugcgauaaaauuucacucgagcgccagaacaaggaccugaagaccaggcuugcuaguuccgaaggcuuucagaaaccgucugccagccugucccaauuggagucacagaaucagcuccugcaggaacggcuacaagcagaggaacgugagaagacugugcugcagagcacaaacagaaaacuugagaggaaggugaaagaacucaguauccagauagaggaugaacgccagcacguaaaugaccaaaaggaucagcugucuuugcgggucaaggccuuaaaacgacagguggacgaggcugaagaggagauugaaagacuggauggucucaggaagaaagcacagcgcgagguugaggagcaacacgaagugaacgagcagcugcaggcccggaucaagucccuugagaaagacagcuggagaaaggcgucgcguucagcugccgaaucugcacugaaaaaugagggguugaguuccgacgaagaguucgauagcgucuaugaccccucuagcauugccucccuacugacggagucaaaccuccaaaccaguagcuguuga

SEQ ID NO: 54324 - RNA, 3909 nt, Artificial Sequence
  derived and/or modified sequence opt3 from CGNL1__Homo_sapiens__NP_116255
auggagcuguacuucggcgaauaucagcacgugcaacaggaguacgggguccaucucagacuugccagcgacgauacccagaaguccaggucuucacagaacaguaaagcuggaagcuaugguguuuccauccgggugcaaggcauugacgggcaccccuacauaguacugaauaacacagaacgcugcuuggcaggaacuucuuuuucggagaauggcccuccauucccgcccccugugaucaacaauuuaccacugcauucaagcaacgguaguguccccaaggaaaauuccgaggagcuacagcucccugaaaacccauaugcccagcccucuccuauucgaaaucugaaacagccacuucugcacgaggggaagaacggaguguuggaucguaaagacggcagcguuaagccgucccaucuccugaauuuucaaagacaccccgaacugcuccagccuuacgauccagagaagaacgaguuaaaucugcagaaccaccagcccucagaaaguaauuggcuuaaaacguugaccgaggaaggcaucaacaacaagaaaccuuggacauguuucccaaagcccagcaauucucaaccgacuuccccuucacuggaggaccccgcgaaaagcggggugaccgcuauuaggcuaugcaguucugucgugaucgaagauccaaagaagcagacauccguauguguuaacgugcagagcugcaccaaagagcgggucggagaggaagcccucuuuacuucgggucgcccucugacagcacauucuccccacgcccauccagagaccaagaaaacgagacccgacgugcuuccuuucaggcggcaagauuccgcuggcccagugcuggacggggcacgcucacgaagaaguagcuccucuagcacuaccccgacaucagccaauaguuuguauagguuucuccuggaugaccaggaaugugcuauacacgccgauaacgucaaucggcacgagaaccgucgcuacauccccuucuuaccuggaacuggcagagacauugacaccgguuccaucccagggguugaucagcugauugaaaaguuugaccagaaacccggacuccaaaggcggggccgaagcggcaagcgcaauagaaucaacacagaugacaggaaacggucucgcucaguggauagugcguucccuuuugggcuucagggaaauagcgaguaccugauagaguucuccagaaacuuggguaagucuucggaacaucuacugaggccaagccagguaugcccccagcguccgcucucccaagagcggcgaggcaagcagucaguggggagaaccuuugcaaaacugcagggagccgcucacggcgccaguugugcacauucuaggccuccacagcccaauauugacgguaagguccuugaaacggaggggagccaagaauccacugugauccgcgcuccuucacugggcgcccagagcaaaaaggaggaggaaguuaaaacagcgaccgccacuuugaugcuccagaaccgggcaacagcuaccucucccgauuccggagccaagaagauuagugugaaaacguucccaagcgcuucuaauacccaggccacaccugaccuguuaaagggccaacaggagcugacucagcaaaccaacgaagagacagcaaaacagauccuauauaauuaccucaaggagggguccacugauaacgacgaugccaccaaaagaaaggucaaccugguguucgaaaagauccagacacuuaaaucaagggcugcgggaagugcacaggguaauaaccaagccugcaauagcaccucggagguaaaggacuugcuggaacagaaauccaagcucacuauugagguugcugaacugcagcgccagcuucaacuggaggugaaaaaccagcagaauauaaaggaggaacgagagcggaugcgugccaacuuggaggagcucagaucucagcacaaugaaaaggucgaggagaacagcacgcugcaacagagguuagaagagucagaaggcgagcugcgcaaaaaucuagaggaacucuuucaggugaagauggagcgggaacaacaucagacagagaucagagaccugcaggaucagcuuagugaaaugcacgacgaguuggauuccgcaaaaaggucugaggaccgagaaaagggggcccugauugaggaacuccugcaagcuaaacaggauuuacaggaccugcuuaucgccaaggaggaacaggaggauuugcuccgcaaacgggagagagaacugaccgcacuaaagggagcgcugaaggaggaagucagcucccacgaccaagagauggauaaacucaaggaacaguaugacgcugagcugcaggcccuuagggagucaguggaagaggcaacuaaaaacguugaaguguuggccagccguaguaauaccucugagcaggaucaagcuggcacagaaaugcgcguaaagcuguuacaggaggagaacgaaaaacuccagggucgguccgaggaacuggagagaagggucgcccagcuucaacgacagauagaggaccugaagggggaugaagcaaaggcuaaagagaccuugaagaaauacgaaggcgagauucggcagcucgaagaggcccuggugcaugcgcgcaaggaggaaaaagaggccguuagcgcuagaagggcacuagaaaaugagcuggaagccgcucaaggaaaccucucgcagacuacacaggagcagaagcaacugucagagaaacuuaaagaagagucugaacagaaggagcaguugcggcgacugaaaaaugaaauggagaacgagagauggcacuuaggcaagacgaucgaaaaacuccagaaggagauggccgacaucguggaagcaagucgcaccuccacucuggagcuucaaaaccagcuggacgaguauaaggaaaagaauaggcgugagcuagcggaaaugcagcggcagcucaaggagaaaacacuggaagccgaaaagagcagauugaccgcuaugaaaaugcaagaugagaugaggcugauggaagaggaauuacgcgacuaccagcgagcccaggaugaggcacucacaaagagacaacugcuugaacagacucugaaagacuuggaguaugagcucgaagcuaagucucaucugaaggaugaccggagcaggcuagucaaacagauggaggauaaggugucccagcuggaaauggagcuugaagaggagcgcaacaauucagaccuccugagugaacguauuagcagaucucgggagcaaauggaacaguugaggaacgagcuguuacaggagcgcgccgcacgacaggaucucgaaugugacaaaaucucccuggagagacaaaauaaggaucuuaaaucacggauuauacaccuggaagggaguuacaggagcuccaaggagggauugguagugcagauggaagcccgcaucgcugagcucgaggacagacuggaaucugaggaaagggaucgggcgaaccuacagcugucgaaucgucgccuugagcgaaagguuaaagaacucgucaugcaaguggacgacgagcaccugagcuugaccgaucagaaggaccaguuaucacugagacucaaagccaugaagaggcaaguggaggaagcagaggaagagauugaucggcuggaauccaguaaaaagaaacuucagcgcgagcuggaggaacagauggacaugaacgagcauuugcagggucagcuaaauucuaugaagaaggaucugagacucaaaaagcugcccagcaaaguccuugacgauauggacgaugacgaugacuuauccacggacggcgggucacuguacgaagcuccaguuucuuauaccuucagcaaggauaguacaguggccucccaaaucuga

SEQ ID NO: 54325 - RNA, 999 nt, Artificial Sequence
  derived and/or modified sequence opt3 from CGRRF1__Homo_sapiens__NP_006559
auggccgcuguguuccuggucacccucuacgaguauagcccccuguuuuacaucgcaguuguguucacaugcuuuauuguaacuacgggccuuguguuggggugguucggaugggacgucccugugauauuaagaaacuccgaagagacccaguuuucuacaaggguuuucaagaaacaaaugcgccaggugaagaauccauuuggucuggaaaucacuaacccgucaagugccagcauuaccacaggcaucacccuaacuacagauugucucgaggacucccugcuuaccugcuauuggggguguucuguccagaaacuguacgaagcguugcagaagcacguguauugcuuccggauuucgacgccccaagcucucgaggaugcccuguacucagaguaucuguaccaggaacaguacuuuaucaaaaaggacagcaaggaggaaauauauugucagcucccucgagauacuaaaaucgaggacuucggaaccguaccacguaguagauaccccuuaguugcacugcuuacauuggccgaugaggacgauagggaaauuuaugacaucauuuccauggugucugucauccauauaccugaucggacuuacaagcugagcugccgcauucuauaucaauaccuccugcuugcucagggccaguuucacgaccugaaacaguuguucauguccgcaaauaacaauuuuaccccaucaaacaauaguagcucugaggaaaagaacacagauagaucccuccuggagaaaguggguuuaucagaaagcgagguggagcccagugaagaaaauucuaaggacugugucguuugccaaaacgggaccgugaauuggguacugcucccuuguaggcauacgugccuuugugacggaugcgugaaguauuuccagcagugcccaaugugucggcaauucguccaggaguccuuugcccugugcagccagaaagagcaggauaaggacaaaccgaagacuuuguga

SEQ ID NO: 54326 - RNA, 819 nt, Artificial Sequence
  derived and/or modified sequence opt3 from CH25H__Homo_sapiens__NP_003947
augagcugccacaacuguuccgacccccaggugcuguguucuucaggccaacucuuccuucagccucugugggaucauuugagaaguugggaggccuuacugcagagcccauuuuucccggucaucuuuuccauuaccacauacguuggguucugccuacccuuugugguacucgacauacugugcucuugggugccugcucuuaggcgguauaagauccacccagauuucucgcccucagcacagcaacuguugccuugucucggacagacucuguaccagcaugucauguuuguguucccaguuacgcugcuccacugggcccgcagccccgcguuacugccucaugaagcuccagagcuuuugcugcuacuccaccacauucuguuuugccuucuguuguucgacauggaauuuuucguguggcaucuccugcaccauaaagucccgugguuauaucgaaccuuucacaaggugcaccaucagaauaguuccucuuucgcccuggcaacacaauacaugagcguaugggagcucuuuucccuugguuucuucgauaugaugaacguuacucuguugggcugucacccccuaaccacacugaccuuucauguggucaauaucuggcucucaguggaagaccacaguggguauaacuucccuuggagcacucaucgucuggugccauuuggaugguacggcggugucguucaccacgaucuucaucacucucauuucaauugcaacuuugcccccuauuucacacacugggacaaaauucuggggaccuugagaacggcuuccgugccugcaagguga

SEQ ID NO: 54327 - RNA, 660 nt, Artificial Sequence
  derived and/or modified sequence opt3 from CHAC1__Homo_sapiens__NP_001136248
augggcggggcccagcuggagcuccccagcggagcuagaccuggugugugcgucaggcgguccuuccgcgcacacgccggcgaccaaccacgacguccgcccgggccuaucccaguucccggaaccaugaagcaggaaucugcggcuccuaacacaccacccacuucacagaguccuacgccaagcgcccaguuuccgagaaaugauggcgacccccaagcacuuuggauuuucgguuacgggucccugguguggaggccugauuuugccuauucugacucgcggguaggauucgugcgcggcuacucaagaagguuuuggcagggcgauaccuuccaucgggggagcgacaaaaugccaggacgcgucgugacauuguuagaggaucacgaagguuguacuuggggcguugcuuaucaggugcagggggagcaaaaccccggauaccugggcccugcaccagaagaggccauagcuacccagauccuagccugccgagguuuuagugggcauaaucucgaguaucugcuuagacuggcggacuucaugcaguuguguggaccccaggcacaagaugaacaccucgccgcuauugucgacgccgugggcacaaugcugccgugcuuuuguccuaccgagcaggcacuggcucucguauga

SEQ ID NO: 54328 - RNA, 1323 nt, Artificial Sequence
  derived and/or modified sequence opt3 from CHAD__Homo_sapiens__XP_011522516
augcacggcagcagacugggggagaggccccggccucucccacgcggaggucgaggccguaucuccgggagagaaagggugaagccgucuggacuugacgcuccccggcgcucauggcugggcugcagauugaggagugguccuccauacaaagaagggggacggcccgagcgcuuaggccuggccgcagcccgagcgccuccaccccuacucccuccagcuccggcccccggcgucccugcaaugguuagaccaaugcugcuucugagcuuggggcuccuggccggacugcuccccgcuuuagcagccuguccucagaacugccauugucacuccgaucugcaacaugugauuugcgacaagguaggucuucagaaaauaccaaaggugucugagaaaaccaaguugcugaaucuacagaggaacaauuuccccguccucgcugccaacucguuucgggcgaugccgaaucuggugucacuucaccuucagcauugucaaauccgugaaguugcagccggcgcuuuccgcggguugaagcagcucauuuaucuguacuuaagccacaacgauaucagagugcugagggccggagcauuugacgaucucacagagcuuacuuaucuguacuuggaccacaauaaagucacggagcuaccucggggccugcucaguccccuggugaaccuuuucauucugcaguugaauaacaauaagauccgagaacuccgcgcuggugccuuucagggggcgaaagaucugagaugguuauaucuguccgagaacgcccuaucuagccuccaaccaggagcacuggacgauguagaaaaucuugcuaaguuccauguugacaggaaccaguuguccucauacccuagugccgcucugagcaaacuccggguggucgaggagcugaagcugucucacaauccccugaaguccauaccagauaacgccuuucagucauucggccgcuauuuggaaacccucuggcuggacaacacaaauuuagagaaauuuagcgauggcgcauuccugggggugacuacccuaaagcaugugcaccucgaaaacaauagacugaaccagcuucccaguaauuuuccuuucgacucuuuggagacacuggcccucaccaacaauccauggaaaugcacuugucaacugaggggauuacgucgguggcuggaagcuaaggcgucccgaccggacgcaacaugcgccagccccgcuaaauuuaagggucagcacaucagagauaccgacgccuucaggucguguaaauucccuacgaagcgcucuaagaaagcaggccggcauuga

SEQ ID NO: 54329 - RNA, 2871 nt, Artificial Sequence
  derived and/or modified sequence opt3 from CHAF1A__Homo_sapiens__NP_005474
augcuggaggaacucgagugcggcgcccccggggcuagaggagcagccaccgcgauggacuguaaggauaggccugcuuucccagugaaaaaguuaauccaggcccggcugccguuuaaacgcuugaacuuaguccccaaggguaaagcagacgauaugagcgacgaucaaggcacauccguucagucuaagucaccugaccuggaagccagucuagauacucucgagaauaacugccacguggggagcgacauugauuuccgaccaaagcugguaaauggaaaaggcccccuugacaacuuucugcguaauagaauagaaacguccaucggucagucuaccgugauuaucgauuugacagaggacucgaacgagcagccugauucacucgucgaccauaauaagcugaacagcgaagcuaguccauccagggaggcaauuaaugggcaacgggaagacacuggagaucagcagggccugcucaaagccauccagaacgacaaguuagcuuuccccggcgagacccugucugauauaccuuguaaaacagaggaagagggggugggaugcgguggcgccgggcgcagaggagacagccaagaauguuccccaaggucaugcccggagcuuaccaguggcccccggauguguccucgcaaggaacaggauagcuggucugaggcgggugggaucuuguuuaagggaaaaguuccaauggugguccugcaggacauucuagcagugcgacccccucagaucaagucccucccagccacuccccaaggcaaaaauaugacaccggagucagaaguacuggagagcuucccugaagaggauaguguucuuucucacuccagccugucgucucccuccucaaccaguagcccagaaggcccucccgcuccacccaagcagcauuccucuacgagcccuuuuccaacuucaaccccguugagaaggauuacaaagaaguucgugaaagggaguacugagaagaacaagcuccggcugcagcgugaccaagagcgcuuaggaaaacagcugaagcucagagccgaaagggaggaaaaagagaaacuuaaagaagaggcaaagcgggcuaaggaggaagccaaaaagaaaaaggaggaagagaaagagcugaaggaaaaggagcgacgcgaaaagagagagaaggaugaaaaagagaaggcggagaaacagagguugaaggaagaacggcgcaaggaaagacaggaggcccuagaagcaaaacuggaggagaagaggaaaaaggaagaggaaaaacgucuccgggaggaagagaagcgaaucaaagcugagaaggccgaaauaaccagauuuuuccaaaagcccaaaacaccucaggcuccaaagacccuggccgguuccugcggcaaauuugcacccuucgagauuaaggaacacaugguccuugccccuaggcgccggacggcuuuucauccagaccuguguagccaguuggaucagcuccugcaacagcagucuggggaguucucauucuuaaaagaccugaagggaagacagccccuaaggaguggcccgacucacgugagcacacgcaaugcggacaucuuuaacuccgauguggucauuguugagcgagguaagggggacggcgugccugaacggcguaaauucggaagaaugaagcuccugcaauuuugcgagaaucacaggccagcauacuggggcaccuggaacaaaaagacugcccuuauccgcgcucgggaucccugggcccaggacacaaaauugcuggauuaugaaguagacucugaugaggaaugggaggaggaggagccuggggaaucgcucagccauuccgagggagacgaugacgaugacaugggugaagaugaggacgaggacgauggcuucuuugugccccacggguaccugucagaagacgagggagucaccgaagagugugcagauccagaaaaccauaaggugagacagaaacuuaaagccaaggagugggacgaguuccuggcuaaaggcaagagguuucgaguuuugcagccugugaaaaucgguugcgucugggccgcagaucgcgacugcgcgggggaugaccucaaggugcugcaacaguucgcugccuguuuucuugaaacgcugcccgcacaggaggaacaaaccccaaaggccaguaaacgggagagaagggaugagcagauucuagcucagcuccugccgcuuuugcacggcaauguaaacggaucuaagguuauaauccgugaguuccaggaacacugccgccggggccugcucagcaaucauacaggguccccuagaucacccagcacuaccuaucugcacacaccaacucccucugaagacgccgcaauuccuuccaaaaguagguuaaagcgacugaucagcgagaacucuguguacgaaaaacggccagauuuucgcauguguugguauguccauccccaagugcuucaguccuuccagcaggagcacuugccugucccgugccaauggucauacgugaccaguguuccaagcgcucccaaggaggacucgggauccgugccuucuacagguccaagccagggcacccccauaucacucaaaagaaagagugccggguccauguguauuacucaguuuaugaagaaaaggcggcaugauggacagaucggcgcggaagacauggacgguuuccaagccgauacggaggaagaggaagaggaggaaggggacugcaugaucguagaugucccugacgcugcagaggugcaggccccguguggcgcugccucuggagcaggcgggggaguuggcguggauacagguaaggcgacccugacugccagcccccuaggggcuuccuga

SEQ ID NO: 54330 - RNA, 1680 nt, Artificial Sequence
  derived and/or modified sequence opt3 from CHAF1B__Homo_sapiens__NP_005432
augaaggugaucacaugcgagauugccuggcacaacaaagaacccgucuacagccuggacuuccagcauggcacagcugggagaauacacaggcucgcauccgccggaguugauacuaaugugcggaucuggaagguagagaaagguccugacggcaaggcgauuguggaauuucuuucuaaccuggcucgccauacgaaagccgucaaugugguucgauucucaccaaccggggagaucuuggcaaguggaggcgaugacgccgugauuuuacuguggaaggucaacgauaauaaggaaccggagcaaaucgcuuuucaggacgaggaugaagcacagcuaaacaaagagaauuggacagugguaaagacucuccguggucaccuggaagacguuuaugauauauguugggccaccgacgggaaccuuauggcuagcgccuccguggauaauacagcgaucauuugggacgucucuaaaggacagaagaucucgauuuucaacgagcauaaaucauacgugcaaggcgugaccugggauccccugggccaguaugucgcaacuuugagcugcgacagaguucucaggguguacaguauccagaagaagcggguagccuuuaauguguccaaaaugcugucugggauaggagcugagggugaagcccgcagcuauagaauguuccacgacgauuccaugaagucauuuuucaggcggcugaguuuuacaccugacggcagccucuuacugaccccagcagggugugucgagucuggagaaaacgugaugaauacgacuuacguuuucucccgcaaaaaccuuaagcgacccauugcucacuugccuugcccaggcaaagccacccuggcggugagauguugccccgucuauuuugagcuaaggccugugguagaaacagguguugagcucaugucacugccauaccggcuuguguucgccgucgcaagcgaggauagugugcuguuguacgacacucagcaaucuuuuccguucggguaugucuccaauauccauuaccacacccucagcgauauuucguggucuuccgacggagcuuuccuggccaucucaaguacagauggcuauuguagcuuugugaccuucgaaaaggacgaguuaggcaucccccugaaagaaaagccuguucucaacaugcguacgccagauacugcuaagaaaacaaagucccagacccaucgcgggucuagccccggaccuagaccaguggaggguacucccgccucaaggacacaggacccgaguuccccuggcaccacgcccccacaggcacggcaagccccugcucccaccguaauucgagauccacccagcauaaccccugcggucaaaucuccacuuccggggcccucagaagagaagacucugcagccuaguagccagaacaccaaagcacacccaucccgcagagugacauugaauacucuacaagccuggucuaagaccacacccaggcggaucaaccugaccccucucaagacugacacgccacccucgagcguuccgacauccgugauuucaaccccuaguacugaggaaauccagucugagaccccaggagacgcucagggcagcccucccgaacugaaacgccccagacuugaugagaauaagggugggacagaaucccuggacccauga

SEQ ID NO: 54331 - RNA, 2439 nt, Artificial Sequence
  derived and/or modified sequence opt3 from CHAMP1__Homo_sapiens__NP_001157617
auggaggccuuccaggaacugagaaagcccagcgcuaggcucgagugcgaccacuguuccuuucggggcaccgauuacgaaaacgugcaaauccauauggggacaauucacccugaguucugcgacgaaauggaugcaggaggucuuggcaaaaugauauuuuaucagaagucugccaaacuguuccauugucacaagugcuuuuucacuucaaaaauguacaguaaugucuauuaccauaucacgagcaagcacgcguccccagacaaguggaacgauaaaccgaagaaucaguugaacaaagagaccgaccccguuaagucuccuccauuacccgagcaccagaaaauuccuuguaauucggcugaaccaaagucaauccccgcccugagcauggagacacaaaagcuagggagugugcucuccccugaaucuccaaaaccgacuccccugaccccucuugagccacagaagcccggaagcguaguguccccugagcugcagacaccauugcccucaccggaaccuaguaaacccgcaagcgucucuuccccagagccucccaagucagugccaguuugcgaaagccagaaacucgcccccgugccuaguccagagccgcaaaagcccgcuccugucucuccagaauccgugaaagcaacccugagcaaccccaagccucagaagcagucgcauuuuccagagacucugggucccccgucugccuccucaccugagaguccaguacucgcugccagccccgaaccuuggggccccuccccagcggcaucuccugagagccgcaaaucagcccgaacaaccagucccgaaccacguaagccguccccuagcgagucucccgaaccauggaaacccuucccugcuguuucaccagagcccagaaggccugccccggcagugaguccagggagcuggaagcccggaccuccaggcucuccccggccuuggaaauccaauccgucggcuagcuccggccccuggaagccagccaagccugcgcccucagucaguccagggccuuggaaacccauuccaucugugagcccgggaccuuggaagcccacgccauccgugucaagcgccucuuggaaauccaguagcgucucucccuccucauggaagaguccuccagcaagccccgagucguggaaauccgguccuccggaauuacgcaagacugcuccaacccugucucccgagcacuggaaggccguuccucccgugagcccagaacuuagaaaaccugggcccccauugucaccugagaucaggaguccggcuggcucccccgaacugcggaagccaucuggaagcccugaucuauggaaacucucccccgaccagcgcaagacaucaccagccagccuggauuuuccugagagucaaaaaucuucccgaggcgguagccccgaccuuuggaagucgucauucuuuauagagccgcagaagccaguauucccugaaacuagaaaacccgggccaucuggacccagugaguccccuaaggcagccagcgauaucuggaaaccggugcugucuauugacaccgaacccaggaagccagcuuuguuuccugagcccgcgaaaacagcaccuccagccagccccgaggcucggaagcgugcccucuucccugaaccacgcaaacaugcacuguuccccgaguuaccgaaguccgcccuguuuucagaaagucagaaggcugucgagcucggcgaugaacuucaaaucgacgccauugacgaucagaaaugugacauccuggugcaggaggaguugcuagcaagcccuaagaaacugcucgaagauacccuguucccaucuuccaagaaacuuaagaaggacaaccaggagucaagugaugcggaacugagcuccucugaguauauaaaaacggacuuggaugcuauggacauuaagggccaagaaucgagcucagaucaggagcagguugacguggaguccaucgauuuuaguaaagaaaauaagauggacaugacuucucccgagcagagcagaaacguccuccaauucacagaagagaaagaagccuuuauuuccgaggaggaaaucgcaaaguacaugaagagggggaaaggaaaguauuacugcaaaaucuguugcugucgggccaugaagaaaggugcugugcugcaccacuuaguaaauaagcauaacguucacucaccuuacaagugcaccauuugcggcaaagccuuccugcuagagucucuccugaagaaucauguggcagcucacgggcagagccuuuugaaauguccacgaugcaacuuugaaaguaauuucccccgcggauuuaagaaacaucugacucacugucaguccagacacaacgaggaggccaacaagaaacucauggaagcgcuggagccgccucuugaggaacagcaaauauga

SEQ ID NO: 54332 - RNA, 1893 nt, Artificial Sequence
  derived and/or modified sequence opt3 from CHAT__Homo_sapiens__NP_001136401
auggccgcuaagacccccagcuccgaggaaucuggccugccuaaacucccagugccgccccuucagcaaacacuggcaacuuacuugcagugcaugagacacuuagucucagaggaacaguucaggaagagucaggccaucguucaacaguuuggggcgccuggaggucugggcgagacgcuacagcagaaacuccuggaacggcaagagaagaccgcuaacugggugagcgaguauuggcuuaaugacauguaccugaacaaucgcuuggcccucccaguaaacuccucucccgcagugauuuucgcccgacagcauuuuccugggacagaugaccagcugcguuucgcugcaucgcugauaucaggaguccucagcuauaaagccuuacuggauagucacuccaucccaacugacugugcuaagggccagcuuucuggucaacccuugugcaugaagcaguacuaugggcuguuuagcuccuacagacuaccuggacauacccaggauacacucguggcccaaaauucaaguauuaugccagaaccggagcacguuaucguggcguguugcaaccaguucuuuguccuggacgugguaauuaauuucaggcggcuuagcgaaggcgaucuguuuacccaguugcgcaaaaucguuaagauggcaucuaacgaggacgagagacuucccccuauaggccuguuaacuuccgaugggaggucagaaugggccgaggcucggacagugcuggucaaagacagcaccaaucgcgauagucucgacaugaucgaacgauguauuugccuugugugucuggaugccccaggagguguggaguugucugacacgcauagagcacuacagcugcuccacggcgggggauauuccaagaacggcgcuaauaggugguacgacaaaagccugcaauucgucguuggucgggaugggacuugcggagugguaugugaacacucgcccuuugacggcaucgugcuuguccagugcaccgagcaucuguugaagcacaugacacagucuucccguaagcucauucgcgccgauucagugagugagcugccugcgccaagaagguuacgguggaaauguagccccgaaauccagggccaucuggccuccucugcagagaagcuacaacgaauaguuaaaaaccucgacuucauuguguacaaguuugauaauuaugggaaaacuuucaucaagaaacagaagugcagcccggacgcuuucauucaggucgcccugcagcuugcuuuuuaccgcuugcacagaaggcuggugccuaccuaugaaucagccaguauccggcgcuuccaagagggaagaguagauaacaucagguccgcaacacccgaagcccucgcuuuuguucgugcggugaccgaccacaaggcagccgucccagcuagcgagaaacugcuucuguugaaggaugccauucgggcacagacggccuacacugugauggcuauaacagguauggccaucgacaaucaucuccuggcauuacgagagcuggcgagagcuaugugcaaagaacuaccugagauguucauggaugaaaccuaucucaugucuaacagguuuguccugucaacaagucaggugcccacuaccacggagauguucuguugcuacggcccaguugugcccaacggguauggagccuguuacaauccucagccagaaaccauucucuuuugcaucagcuccuuccacucuuguaaggagacaucgagcuccaaauuugcaaaggccguagaggaaucauugauagacaugcgcgaccugugcagucuccugccgcccacugagucuaagccuuuagcuaccaaagaaaaggccacacggccaagccaaggccaucagcccuga

SEQ ID NO: 54333 - RNA, 429 nt, Artificial Sequence
  derived and/or modified sequence opt3 from CHCHD10__Homo_sapiens__NP_998885
augcccagaggcagcagguccgccgcuucucggccugcaucacgcccagccgcgccgagugcucaucccccugcccacccacccccuagcgcagccgcuccagcacccgccccuuccgggcagccaggacugauggcucaaauggccaccacagcggccgguguggccgucggcucugcuguugggcacgugaugggaucggcccucacuggcgcauucucaggugggagcagugagccgucccagcccgcuguacagcaggccccuacgccagcggcaccccaaccucuucagaugggaccaugcgcauacgaaauccgacaguuucuggacuguucuaccacacagagcgauuuguccuuaugcgagggcuucucagaagcucugaagcaauguaaauauuaccauggccuaaguagccuccccuga

SEQ ID NO: 54334 - RNA, 357 nt, Artificial Sequence
  derived and/or modified sequence opt3 from CHCHD1__Homo_sapiens__NP_976043
auggccacccccagccugagaggcaggcucgcucgguucgggaacccucgcaagccagugcuuaaaccgaauaagccccugaucuuggcaaaccgagucggagagcguagaagggaaaaaggugaggccacaugcauuacugaaauguccguuaugauggcguguuggaagcagaaugaguuucgggacgaugcuugccgcaaagaaauacaaggcuucuuagacugugccgcaagagcccaggaggcuaggaagaugcggucuauccaggagacgcugggggaaucaggaagucuacucccuaacaagcugaauaaacuucugcagcgcuuuccaaacaagcccuacuugagcuga

SEQ ID NO: 54335 - RNA, 684 nt, Artificial Sequence
  derived and/or modified sequence opt3 from CHCHD3__Homo_sapiens__NP_060282
augggcgggaccacaagcacuagaagggugacguucgaggccgacgaaaacgagaauaucaccgucguuaaggguauucggcuguccgaaaacgugauagaucgcaugaaagagucuucacccaguggaagcaagucccagcgauacucuggcgcuuauggggcaucgguaucagacgaagaacucaaacguagaguggccgaggaacuugcgcuggagcaagcuaagaaagaaagcgaggaucagaagagguugaagcaggccaaagaguuagaccgggaacgcgcagccgcuaaugagcagcugacaagagcaauccuaagggaacggauuugcagugaggaagaacgcgccaaggcuaaacaccucgcccgacaacuggaggaaaaggauagaguccuuaaaaagcaggacgcguuuuacaaggagcagcuggcaagguuggaggagcgguccucugaguucuaucgugugacuaccgagcaguaccaaaaagccgcugaggaaguugaggccaaguuuaaacgcuaugaaagccauccugugugugcagaucuccaggcuaagauccugcagugcuacagagagaacacacaccagacccugaaauguuccgcccucgcgacucaauauaugcauugcgucaaucacgccaagcagucaauguuagaaaaaggaggcuga

SEQ ID NO: 54336 - RNA, 333 nt, Artificial Sequence
  derived and/or modified sequence opt3 from CHCHD5__Homo_sapiens__NP_115685
augcaggccgcucuggaggugaccgcaagauacugcggcagggaacucgagcaauaugggcagugugucgccgcgaagcccgaaagcuggcagcgggacugccacuaccuuaaaauguccaucgcucaguguacaucuucacauccuauuauacgccaaauccgacaggccugcgcacagccauucgaggccuuugaagagugucugcgucagaacgaggcugcaguuggaaauugcgccgaacacaugagaagguucuugcaaugugcugaacaggugcagccgccccggaguccugccacuguagaggcgcagccauuacccgcaagcuga

SEQ ID NO: 54337 - RNA, 708 nt, Artificial Sequence
  derived and/or modified sequence opt3 from CHCHD6__Homo_sapiens__NP_115719
augggcagcaccgaguccucugaagggagaagggugucauucggagucgacgaggaggaacggguucgcgugcugcaggguguacgacucagugaaaacguggucaaucguaugaaggagcccagcuccccuccaccggcccccacaucuucgacuuuuggccuucaagaugggaaccugagagcuccucacaaagagucaacguugccaaggagcggaaguuccggcggucagcagcccucugggaugaaggaaggagugaaacgguacgagcaggaacaugcagccauccaagacaaguuauuccagguugcgaaacgcgagagagaggcugccaccaagcacagcaaggcaucccugccuacaggcgaaggcucaauuagucaugaggaacagaaaagcgugaggcuagcccgggagcucgaaucucgcgaggcugagcugcgaagaagggauacuuuuuauaaggaacagcuugagcggauagaacguaaaaaugcagagauguacaagcuguccucagaacaauuccacgaggccgcuagcaaaauggagaguaccaucaagccacgcagagucgaacccgugugcucuggguugcaggcccagauucuccauuguuauagggaccggccucacgagguacugcugugcuccgaucucguuaaggcguaccagcgaugugugagcgcagcccacaaaggauga

SEQ ID NO: 54338 - RNA, 333 nt, Artificial Sequence
  derived and/or modified sequence opt3 from CHCHD7__Homo_sapiens__NP_001011668
augaagugcgaggaaacccacgcccccaacagcaauuggguguacgucaugcugccuuccaaaaagacaguuagaaugccaucugugacucagaggcuccgggacccggauaucaaccccugucuuucagagagugacgcuagcacgcgcugccuggaugaaaauaacuaugaccgagagcguuguuccaccuacuucuugagauauaaaaauugcaggcgguuuuggaacucuauuguaaugcaacgcagaaagaauggcgugaaaccuuucaugccaacagcagccgaaagggaugagauauuacgggcggucgggaacaugcccuacuga

SEQ ID NO: 54339 - RNA, 5397 nt, Artificial Sequence
  derived and/or modified sequence opt3 from CHD1__Homo_sapiens__XP_005271923
augaacggccacagcgacgaggaauccgugagaaauucuucaggggagaguagccaguccgaugacgauucuggaucggccucagguagcggcaguggguccucuagcggauccucaagugacggcagcucuucccaaucagguagcagugauucugacuccgggagcgaaucgggaucucaguccgagucagaaagugauaccagcagggagaacaagguccaggcuaaacccccuaagguugacggcgcagaguucuggaaauccucuccaagcauccuggccgugcagcggucagcgauucucaagaaacaacagcagcagcaacagcagcagcaacaucaggcuaguuccaauagcggcucugaagaggauucaaguagcuccgaagacucugaugacucgagcuccgagguaaagcgcaagaaacacaaggaugaggacuggcagaugucagggaguggaucuccgagccaauccgguucagacagcgaaucugaggaagagcgagaaaaauccaguugcgaugagacagagagcgacuacgaacccaagaacaaagugaagucucguaagccucagaauagauccaaaucaaagaacggcaaaaagauacuugggcagaaaaagaggcagaucgauaguagcgaggaagacgaugacgaggaagauuaugacaaugauaaacggucgucccgcagacaagccacugucaacgugucuuacaaggaggacgaggaaaugaagacggauagcgacgaccuguuggagguuuguggagaagaugugccacagcccgaggaagaggaguuugaaaccauugagagguucauggacugccggaucggccgcaaaggugcaacaggggccacuaccacaauuuaugcugucgaagcagauggagacccuaaugccggcuuugagaagaacaaagagccaggcgaaauccaguacuuaauaaaguggaaaggguggucacauauccacaauaccugggagacugaagagacacugaagcagcaaaacgugcgaggaaugaagaaacuagauaauuauaagaaaaaggaccaggaaaccaaaagauggcucaagaacgcuagucccgaggauguagaguacuauaauugucagcaggaacugacggacgaucuucauaagcaauaccagauuguugagaggaucauugcccacuccaaccagaaaucugcggcagguuacccugacuauuacugcaaguggcagggccugccauauagcgaauguuccugggaggauggggccuugaucucaaaaaaguuccaagcuugcauagacgaauacuuuagccggaaccagaguaaaacuaccccguucaaggauuguaaggugcucaaacagcguccccgcuuugucgcccugaagaaacaaccuucuuauauuggaggccacgagggucuggagcucagagacuaccaguuaaaugggcugaacuggcuugcacauuccuggugcaagggcaauagcuguaucuuggcugacgaaaugggacugggcaaaacaauucagacuaucucguuccuaaacuaucucuuucacgagcaucagcuguacgggccauuccuucugguggugcccuugucaacccucacaucuuggcaaagggaaauccagaccugggccagucagaugaaugcggucguuuaccugggagauauuaacucccggaauaugauacgaacgcacgaguggacucaccaucagacaaagcgcuuaaaauuuaacauccugcucaccacuuaugaaauucuucugaaggacaaggccuucuuggguggccuaaauugggcauuuaucgggguggaugaggcucacagacugaaaaacgacgauagccuccuguacaagacacuuauagacuucaaaucuaaucauaggcuguugauuaccggaacgccucuccaaaacagccugaaggaguuauggucccugcuacacuucaucaugccagaaaaauuuucaaguugggaggauuucgaagaggagcauggcaagggucgggaauauggguacgccagccuccacaaggagcuggaacccuuucuuuugcgcagaguaaaaaaggacguggagaaaucucugccggcuaaggucgaacagauccucaggauggagauguccgcccugcagaaacaguauuacaaguggauucuuacccguaauuauaaggcacugucaaaaggcaguaagggaagcacauccggcuucuugaacaucaugauggagcucaaaaagugcuguaaucacugcuaccugauuaaaccucccgauaacaacgaauuuuacaauaagcaagaggccuuacagcaucugauacggucuucggggaagcuaauccuccuggacaaacuuuugauucgacugagagaaaggggaaaccgcgugcucaucuucagccagaugguucggaugcuggauaucuuagcugaguaucugaaguacagacaauuuccauuccagaggcuugacgguucaauuaaaggcgaauugcgcaagcaggcgcucgaucacuuuaaugcagagggguccgaggacuucugcuuucugcuaaguacucgagccggaggccuggguauaaaccucgcuucugccgacaccguggucaucuucgauagcgacuggaauccucagaacgaucugcaagcacaggcccgggcucaucguauugggcagaaaaagcaggugaauaucuauagacuuguaacaaaaggcuccguugaagaggacauuuuggaaagggccaagaagaaaauggugcuggaucacuuagucauccaacgcauggacacuaccggaaagacagugcuccacaccggcucagcacccucuagcaguacuccauuuaacaaagaggaacuguccgcgauacuuaaguucggggcugaggagcuguucaaagaacccgagggagaagagcaggagccucaggaaauggauaucgacgagauuuugaagcgggccgaaacgcaugagaaugaaccaggcccgcucacagucggugaugagcugcuaagccaguuuaagguggcaaacuucucuaauauggacgaggaugacaucgaacuggagcccgaaagaaacucaaaaaauugggaggaaauuaucccugaggaccaaaggcgacgccucgaggaagaggaacggcagaaggagcuggaagagauauacaugcuuccaagaaugaggaacugugccaaacagauuuccuuuaaugggagugagggacgucgcagccggucgagaagguauucuggcuccgauagcgacucaaucagugaagguaagcgacccaaaaagcggggccgcccuagaaccauuccaagggagaacaucaagggguucucugaugcugaaauacggcgauuuaucaaauccuacaagaaauucggaggccccuuggagagacuggacgccauugcacgcgaugcugaguuaguugacaagagcgaaacugaucucaggcgucugggggagcuugugcacaacggaugcaucaaagcccugaaggacucaaguagcggcaccgaacggacaggugggagacuaggaaagguaaaaggcccgaccuuuaggauuuccgguguccaggugaaugcgaagcucguuaucucucaugaggaagagcugauaccuuugcacaaaagcauuccauccgaucccgaggaacgcaagcaauauacuaucccuugucauacaaaagccgcucacuucgacaucgauuggggcaaggaggacgauucaaaccuguuaauugggaucuacgaauacggauauggcucuugggagaugauuaagauggaccccgaccucagucugacgcacaaaauacuuccagaugacccugauaagaaaccccaggcaaagcagcugcaaacccgagccgacuacuugaucaaacuccugucgagagaucuagcuaagaaagaagcccugagcggggcaggauccucuaagcggaggaaggcgcgcgccaaaaagaauaaagcuaugaagucaauuaaagugaaggaggagaucaagagcgacuccaguccacuuccgucugaaaaaagcgaugaggacgaugacaaggaugaaauuucauccgucaaacauccuaacaagaaaaucaagacugagcgugacagugaagagaagcccgagccagauguguauauaaaaaaggaacccgaggaaaaaagagaggccaaggagaaagaaaauaagaaggagcucaaacgggaaaucaaggagaaagaagacaagaaagacauuaaggagaaagauuuuaaggagaagagggaaaacaaaguaaaggaggcaauccagaaagaaaaggacauuaaagaggaaaagcugagcgagucuaaguccgauggccgcgagcgaucaaaaaagagcucggugucugacgcuccuguucacaucacagccaguggugaaccaguccccauauccgaggaaagcgaggaauuggaucagaaaaccuucucaauuugcaaggagagaaugcggccugugaaagcagcccugaagcaguuagacaggccggagaaggggcucuccgaacgcgagcaacuggaacauacaagacagugucuuaucaaaaucggagaucacauuacugagugccugaaggaguacaccaauccagaacagauaaaacaguggaggaagaacuuguggaucuuugugucuaaauucacggaguuugacgcucggaagcuccauaagcuguauaaacacgcgauuaagaaacgucaagaaagccagcagaauagugaucagaacuccaaucuaaacccccacgucauccgcaauccugacguugagcgacugaaggaaaacaccaaucaugaugacagcucuagagacucauacaguuccgauaggcaccuuacacaauaucaugaccaccacaaagaucggcaucagggcgacagcuacaagaaaucugauucgcgcaagagaccauacucaagcuucuccaacgguaaggaccacagggauugggaccauuauaaacaggauagucgguacuauucugaccgagagaagcacagaaaacucgaugaccaucgcagcagggaucaccgguccaaccuggagggcucauugaaggaccguagucacucugaccauagaagccacuccgaucauagguuacacucagaccaccgcagcucuuccgaauacacucaucacaaaaguagccgggauuaucgauaccauucggacuggcaaauggaucacagagccuccucuucagggcccaggagcccucuggaccagcgcaguccguauggaucccggucucccuucgagcauagcguggaacacaagucaaccccagagcacacaugguccaguagaaagacuuga

SEQ ID NO: 54340 - RNA, 1506 nt, Artificial Sequence
  derived and/or modified sequence opt3 from CHD2__Homo_sapiens__NP_001036037
augaugagaaacaaggacaaaagccaggaggaagauuccucucugcacucaaaugccaguagccauuccgcuucugaggaagcaucgggcucagacagcgggagucaauccgagucugaacagggaagcgaucccgguuccggccacgggucagagaguaacucaucuuccgagucaagcgaaagucagucugaguccgaaagcgagucggccggaucuaagucccagccugugcucccagaggcgaaagaaaagccggcuagcaaaaaggagaggaucgccgacgucaagaaaaugugggaagaguaccccgauguuuauggcgugcggcgcaguaaucgaagccgucaagaaccuuccagauucaacauuaaggaggaggcaucuagcgguucagaaaguggguccccaaaaaggcggggacagcgccagcuuaagaaacaggagaaguggaagcaagaacccagcgaggacgaacaggagcagggcaccucugccgagucagaaccugagcagaaaaagguaaaagcuagaaggccagugccccggcgcacagucccuaagccacgagugaaaaagcaaccgaaaacucagagaggcaagaggaagaaacaggauaguagcgacgaagaugacgaugacgaugaggcacccaagcggcaaacgcgucgcagagccgcuaaaaauguuuccuacaaggaagacgacgauuuugagaccgacucugaugaccugauagagaugacaggggaaggaguggaugagcagcaggacaacucggaaacuaucgagaaagucuuggauagcagguuagguaagaagggcgccaccggggcguccacaaccguguaugcaauugaggccaauggagacccuucaggcgauuucgacacugaaaaagaugagggugaaauccaguaccugauuaaguggaaaggguggaguuauauccauucuacaugggagagcgaagagucccuacaacagcagaagguaaaaggacucaagaagcuggagaacuuuaaaaagaaagaagacgagauaaagcaguggcuuggcaaaguuucaccagaagacguggaguacuucaauugccaacaggaacuggcuagcgaguugaacaagcaguaucagaucgucgagcgggugauugccgugaagaccucuaaauccacgcucggccaaacugauuuucccgcacacagucgaaagccugcuccaagcaaugaacccgaguaccuguguaaauggauggggcugccguacucugaaugcuccugggaggacgaagcccucaucggaaagaaauuccagaacuguauugauucauuucauagucgcaauaacagcaagaccaucccuacaagagagugcaaagcguuaaagcagaggccccgguucgucgcccugaagaaacagccagcauaucuugguggcgagaauuuggaacugcgcgacuaccaacuagaggggcucaacuggcuggcucacucgugguguaaguga

SEQ ID NO: 54341 - RNA, 6180 nt, Artificial Sequence
  derived and/or modified sequence opt3 from CHD3__Homo_sapiens__NP_001005271
auggccagcccccugagagacgaagaagaggaagaggaagagauggugguauccgaggaagaggaagaggaggaagaggaaggcgaugaggaagaggaggaagagguugaagcugcagacgaggaugacgaagaggaugacgaugagggggugcucgggagggguccuggccacgaccgggggcgcgaucgacacucuccaccgggaugccaccuuuuucccccuccacccccuccacccccuccacugccgcccccuccacccccuccacccccggacaaggaugacauccguuuguuaccuucagcccugggcgucaagaagagaaaaaggggucccaagaaacaaaaggaaaacaagccagggaaaccucggaagcgcaaaaagagagauagugaggaagaguuuggaagcgaaagggacgaguaccgggagaaauccgaaucuggcggcucggaguacgggaccggacccggucgcaagcgaagaaggaagcaucgggagaagaaggagaaaaagacaaaacgucgcaagaaaggcgagggggacggaggccaaaaacagguggaacagaagucaagcgcgacucuacuccugacguggggucuugaggaugucgaacacguguucagugaggaagacuaccauacccugacaaauuauaaggcuuuuucccaguucaugagaccauugauugccaagaaaaaccccaagauaccuaugucuaaaaugaugacuauccucggggcaaaguggagggaguuuagcgccaauaacccauucaagggauccgcugcagccguugcugccgcggcagccgcugccgcagcugccguggcggagcaagucucagccgcagugaguagcgcuaccccgauugcccccucuggcccuccagcucugcccccuccacccgccgcagauauccagccgccuccaauucggcgagccaaaacaaaggaaggcaaagggcccggacacaagcgcagauccaaaucaccuaggguacccgacggucggaagaagcugcgcggcaaaaagauggcuccacucaaaaucaaguuagggcugcuuggaggcaaaagaaagaagggugggagcuacguuuuucagagugaugagggcccugaacccgaggcggaagagucugacuuggauuccggaagcgugcacucggcaucuggcaggccagacgggccgguccguaccaaaaagcugaaacggggacgaccugguagaaagaaaaagaaagugcuaggcugucccgccguggcuggggaggaagaggucgauggauaugaaacugaccaucaggauuacugcgagguuugucaacagggcggugaaauaauccucugcgacacauguccaagggccuaucaccuggugugccuugaccccgagcuggaucgcgcaccugaggggaagugguccuguccacauugcgaaaaggagggcguacagugggaagccaaagaggaggaagaggaauacgaggaagagggagaggaagagggcgaaaaggaggaagaggacgaucacauggaguacugucgggugugcaaagacgggggagaauugcucuguugcgaugcuugcauuucaaguuaucacauccauugucugaaucccccuuuaccggacauuccaaacggugaguggcugugccccagauguaccugcccuguccucaagggcagggugcagaaaauccuucacuggcgcuggggagaaccacccguugccgugccugcaccgcaacaggcggauggaaaucccgacgucccaccuccccgaccacugcagggccggagcgagcgugaguucuuugugaaguggguagguuuguccuacuggcauuguucuugggcuaaggagcuacaacuggagauauuccaccucguuauguauagaaacuaccagaggaaaaaugauauggacgaaccucccccacuggauuaugggagcggcgaggacgauggaaagucagacaaacgcaaggugaaagacccgcauuacgccgaaauggaggagaaguauuaccgguuuggcauuaagccugaauggaugacgguccacagaaucauuaaccacaguguggauaaaaaggggaauuaccauuaucuugucaaauggagggaccugcccuacgaucaguccacuugggaggaagacgagaugaacaucccagaauaugaggagcacaagcagagcuacuggcgacaucgcgaauugaucaugggagaggaucccgcacaaccucggaaauauaagaagaaaaagaaagaacuccagggcgacgguccacccucuucaccuaccaaugauccgacagugaaguacgagacucagccaagauucauuaccgccacagggggaacccugcacauguaucaguuagaaggccugaacuggcuaagguuuaguugggcucaagguacggacacuauacucgccgaugagaugggccuggggaaaacaauccagaccauuguuuuccuuuacagcuuguacaaggagggacacacuaaaggccccuuccugguguccgcaccucucucuacaaucauaaauugggaacgugaguuucagaugugggcucccaaguucuauguagucaccuacacgggggacaaggauucgcgcgccauuauccgggaaaacgaguuuagcuucgaagacaacgcgaucaaaggaggcaagaaagccuuuaagaugaaaagagaggcucaggugaaguuccauguucugcuuaccuccuaugagcugauuacaaucgaucaagcagccuuggguucaauuaggugggcuugccucguggucgacgaagcccaccgacugaagaauaaccagaguaaauuuuuccggguguuaaauggguacaagauagaccauaaacugcuacucacuggaaccccacugcagaacaaucuugaggaauuguuucaucugcucaacuuccugacaccugagcgcuuuaauaacuuagagggcuuccuggaagaguuugcagauaucucuaaggaagaccagauuaagaaacuucaugauuugcucgguccccacaugcugagaaggcuaaaagcggacguauucaaaaauaugccagccaagacugagcugaucgugcggguugaacucagcccuaugcagaaaaaguauuacaaauauauccugacccgaaacuucgaggcucuuaauuccagaggcgggggaaaccaggucucauugcugaauauuaugauggauuuaaagaaguguugcaaccacccguaccucuuucccguggccgcaauggagagcccaaaacugccuucuggcgcuuacgaagggggagcccuuauaaaguccaguggcaaacugauguugcuccagaagaugcugcgcaaacuaaaggagcaaggucauagggugcugaucuucagccagaugacaaagaugcucgaccugcuugaagauuucuuggacuaugagggguacaaauaugaacguauugauggaggcaucaccggugcacugcggcaggaggccauugacagauucaaugcucccggcgcgcagcaauuuuguuucuuacucucuacuagggccgggggacugggcaucaaccuugcaacggcugauacagucauaaucuuugacuccgacuggaacccacacaaugauauucaggccuucucacgcgcccaucgaaucgggcaggcuaacaagguuaugauuuacagauuugugacccgggcaaguguggaggaaaggaucacucagguagccaaacgcaagaugaugcugacccaccuagucgugcguccuggacucggcagcaaagcggguucgauguccaagcaagagcuggacgauauauugaaauucgggacagaagaacuguuuaaggacgaaaaugagggagagaacaaggaagaggauucuagcguuauucauuaugacaaugaagcuaucgccagauuacucgaucggaaccaggacgcaaccgaggauacugacgugcagaauaugaacgaguaccugucaaguuucaaagucgcccaguaugugguuagggaagaggauaagauugaagagaucgaacgcgagauaaucaaacaagaggaaaauguggaccccgauuacugggagaaacuucugcgacaccacuacgaacagcagcaagaggacuuggcuagaaaccucggcaaaggcaagcggguaaggaagcaggucaauuauaacgacgcagcccaggaagaucaggacaaucaauccgaguacucuguggggagcgaggaagaggaugaagacuuugaugagcgcccggaaggaagaaggcaguccaaacggcagcugcguaacgagaaggacaaaccacuaccuccccugcuugcgcgcguggguggcaauauugagguccucggguucaacacacgacagagaaaggcuuuccugaacgccguuaugagguggggaaugccaccccaagaugcauuuacgacccagugguuggugcgggaccugcgcggcaaaacugaaaaggaguucaaggccuauguaucauuauuuaugagacaucucugcgaaccuggugcugaugggagcgagacauucgccgacggagugccgagggagggccugagucggcagcagguccuuacccgaaucggcgugaugucucugguuaaaaagaaagugcaagaauuugagcacauuaaugggagaugguccaugcccgaauugaugccagauccuagcgcagacucgaagcgcucaucuagggcuaguucccccacaaaaacuagcccuaccacgccagaggccucugcgaccaacagccccuguacauccaagccugccacuccagcacccucagaaaagggagaggguauccggaccccgcucgagaaagaagaggcugaaaaucaggaggaaaagccugagaaaaacagucguauaggcgagaagauggaaacagaggccgaugcuccaagccccgcaccuucucugggggaaagacuagagccaaggaaaauuccccuggaagacgaggucccgggagugccuggcgagauggaacccgagccagguuaccgcggggaccgggaaaaguccgccacugagucaaccccuggagagcgaggcgaagagaaaccccuugauggccaggaacauagagagaggccagaaggggagacgggagaccucgguaagcgcgaggauguuaagggcgaccgggaacugagacccgggccucgugaugagccaaggaguaauggacggcgcgaagagaaaacagaaaagccgcgauucauguuuaacaucgccgacggcgguuucaccgaguugcacacuuuauggcagaaugaggaaagagcugcgaucagcuccgggaaacugaacgagauuuggcacaggcggcaugauuauuggcuccuggcaggaaucgugcuucacggcuacgcccgcuggcaagacauucagaaugaugcucaguuugccauaaucaacgaacccuucaagacagaggcaaauaaaggcaacuuucuggaaaugaagaauaaguucuuggccagaagguucaaacuacuggagcaagcucucgucauugaggaacagcugcgacgggcggccuaucuuaacuuaucucaggagccugcacauccagcuauggcccugcacgcacguuuugccgaagcugagugccucgccgagucgcaucagcacuugagcaaggaaucacuggcggggaauaaacccgcaaacgccguacuccacaaggugcugaaccaacuugaggaacuguuguccgacaugaaagcugauguuaccagacuaccugccacucugagucgcaucccacccauugcugcaaggcuccagaugucugagcggagcaucuuauccagacuggccucaaagggaaccgaaccucauccgacaccagcuuaucccccuggucccuacgccacgccaccuggcuauggggcagcguucucugccgcucccgugggagcccuugcagcugccggcgcaaauuacagccagaugccagccgguaguuuuauaaccgcugcgacuaacgggccgccuguccuggugaagaaagagaaggagaugguaggagcccucguguccgacggcuuggaccgcaaagaacccagggcaggcgaggucaucugcauugaugacuga

SEQ ID NO: 54342 - RNA, 5718 nt, Artificial Sequence
  derived and/or modified sequence opt3 from CHD4__Homo_sapiens__NP_001284482
auggccagcggccugggguccccaucuccuugcucagcuggaagugaggaagaggacauggaugcgcuccuuaacaauagccugccaccgccccacccugaaaacgaggaagacccagaggaggauuuguccgaaacagagacacccaagcuaaagaagaagaagaaaccuaagaaaccaagagaccccaaaauaccuaaaucuaaaagacagaagaaagaacugggugauucgucaggcgaggggccagaguucguggaagaggaagaggaagucgccuuacggagcgacagugagggauccgauuacacuccgggcaagaagaaaaagaaaaagcucggucccaaaaaggagaaaaagucuaagagcaaacgcaaggaagaggaagaggaagaggacgaugacgaugacuccaaagagccuaagucaagugcgcaacugcuugaagauugggggauggaggacauugaccauguuuuuagcgaagaggauuaucgaacgcugacaaauuacaaggcuuucucucaguuugugcguccauugauagccgcaaagaaccccaagaucgccguauccaaaaugaugauggugcucggagcuaaguggagagaguucucaacaaauaacccuuuuaaaggcagcaguggcgcaucugucgccgcugccgcggcagccgcuguggccguuguggaguccauggucacugcaaccgagguggcuccacccccgccucccguagaaguuccaauuagaaaggccaaaacaaaggaggggaagggaccuaaugcgcggcgcaaacccaaggguagcccaagagugcccgacgccaaaaagccuaaaccaaagaaggucgcaccgcugaaaaucaagcugggcggguucggaucgaaaaggaagcggucuuccucagaagaugacgaucucgacguggagagugauuuugacgaugcuagcauuaacuccuauucugugagcgacggcucaaccagucgcuccagccgaucuaggaaaaaguuaaggacuaccaaaaagaagaaaaagggugaggaagaggucaccgccguugauggguacgaaacggaccaccaggacuauugugaggugugccagcagggaggcgaaaucauacugugugauacuugcccccgggcuuaccauaugguaugucuugacccugauauggagaaagccccagagggcaaguggucaugcccccacugugaaaaagaggggauccagugggaagcaaaggaggacaauagugaaggagaggagauuuuggaagagguggguggcgaucuggaagaggaagacgaucaucacauggaguucugccgugucuguaaggacgggggagagcuacucugcugugauaccugcccuagcuccuaucacauccauugccugaacccaccccuuccggaaauuccuaauggcgaguggcuguguccacgcugcacaugucccgccuugaaagguaaggugcagaaaauccucauauggaagugggggcagccucccucuccaacuccuguucccagaccaccggacgcugauccuaacacccccucgccaaaaccccuggaaggcaggccugagcggcaauuuuucgugaaguggcagggaaugagcuacuggcacugcuccugggucucagaguuacagcuggaacuccauugucaggugauguuucgaaauuaccaacgcaagaacgacauggaugagccacccaguggcgacuucgggggagacgaagagaaaucuagaaagaggaaaaauaaggauccuaaauuugcggaaauggaggagcgguucuaucgcuacgguauuaagccggaauggaugaugauccacaggauucuuaaccacagcguagacaagaaaggccauguucacuaucugaucaaguggagggauuugccauacgaccaggcauccugggagucagaagauguggagauccaggacuaugaucuauucaaacaaagcuacuggaaccaucgugaacugaugcgaggggaagagggacggcccggcaagaaacucaagaaagucaagcugagaaaacuugaaaggccuccagagacacccaccguggacccuacggucaaauaugaacgccagccggaguaccuggaugccacuggugggacauugcaccccuaccagauggaaggccucaauuggcugcgguuuucuugggcucagggaaccgacacuauuuuagccgaugagaugggccuggggaagacagugcaaaccgcaguuuuccuauauucccucuacaaagagggacauaguaaggguccauuucuggugagcgccccucuuucuacgauaaucaacugggaaagagaguucgaaaugugggcucccgacauguauguagucaccuacgugggcgauaaagacuccagggccauuauccgcgagaaugaguuuucauucgaagacaacgcaauacgagggggaaagaaggcgagucggaugaaaaaggaggcuagcguuaaauuucacguguugcugacaucguaugaacucauuacuaucgauauggccauccugggcuccauugacugggcaugccuuaucgucgaugaggcccaccgucugaagaauaaccagucuaaauucuuuagaguguugaaugguuacagccuccagcauaagcuguuacugaccgggacaccacuacagaacaaucucgaagaacuguuccaccuuuugaacuuucugacuccugagagguuccauaaucucgaaggcuuucuggaggaguucgcugacauugccaaggaggaucaaaucaaaaaguuacacgacaugcugggaccccacaugcuucgccgguugaaagcagauguauucaagaacaugccaucaaaaaccgaacucaucgugagaguugagcugaguccgaugcagaagaaguauuacaaauacauucuaacaaggaauuuugaggcucugaacgcccgaggcgggggaaaucaggucucccuccugaacguggugauggaccuuaagaaauguugcaaccauccuuauuuguuccccgucgcggccauggaagcuccaaagaugcccaauggcauguacgaugguucugcacugauccgcgccagcgggaaauuacuccugcuucagaagaugcugaagaacuugaaagagggaggccaccggguucucaucuuuucccaaaugaccaagaugcuggaccuacuggaagauuuccucgagcaugaagguuauaaauacgagagaauugacggcgggauaacuggaaauaugaggcaggaggcuaucgaccguuuuaacgccccuggcgcacagcaguucuguuuucugcuuucaacgcgcgcagggggauugggcauuaaucuggccacagcugauaccgugaucauuuaugacagcgauuggaacccacacaaugacauccaagccuucagucgggcacauagaauaggucagaacaagaaagugaugaucuacagguuuguaacucgagcuucugucgaagaacggauuacccagguggccaagaaaaagaugauguuaacacaccucguugugcgccccgggcugggauccaagaccggcagcaugucgaaacaagaacuugaugacauccugaaguucgguacugaggagcuauuuaaagaugaagcaacagacggcgggggagauaauaaggagggcgaagacucaucugucauucacuaugaugacaaagccaucgagagacuccuggauaggaaccaggacgaaacggaggacaccgaguugcaggggaugaaugaauaccugaguuccuucaagguggcucaguacguugugcgggaggaagagaugggagaagaggaggaaguagagcgagaaauaauuaagcaagaggaaagcgucgauccugacuauugggagaaauuacucagacaucacuacgagcagcagcaggaagaucuggcgcgcaaccuuggcaaggguaaaaggauccguaagcaagugaauuauaacgacgggucucaggaggaucgggacuggcaggaugaccagagcgauaaucaauccgacuacucaguggccagugaagagggagaugaggacuuugaugaaagaagcgaggcaccgaggcgcccaucucgaaaaggccugagaaacgacaaggacaagcccuugccuccccuccuggcucgggucgguggcaacauugaaguucuaggguucaaugccaggcagcgcaaagccuuccugaacgcuaucaugcguuauggaaugccaccucaggaugcauuuacuacacaauggcuugugagagaccuccggggcaaguccgagaaagaguucaaggccuacguaucacuguuuaugaggcauuugugcgagcccggggcggauggagcugagaccuucgccgacggcgugccacgcgaaggucugagucgacagcacgucuuaacaagaauaggggugaugagccucauccggaaaaagguucaggaguuugaacaugugaauggaaggugguccaugccugagcuggcagaagucgaggagaacaagaaaaugucucagccgggcucgcccagcccaaagacuccuacccccucaacgccaggcgauacccaaccuaauacacccgccccggugcccccugcugaagacgggauuaaaaucgaggaaaacucccuuaaggaggaagagaguauugagggagaaaaagagguuaagucuacugcacccgaaaccgccaucgaguguacacaggcgccagcucccgccagcgaggaugaaaaaguggucguagagccuccggaaggugaggaaaagguggagaaggcagagguuaaagaacgcacugaggaacccauggagaccgaaccaaagggcgccgcugacguggagaaagucgaggaaaaguccgccauagaucugacgccuauugugguagaggacaaagaagagaagaaggaagaggaggagaaaaaggaggugauguugcagaauggggaaacacccaaagaucucaacgacgagaagcagaaaaagaauaucaagcaaagauucauguuuaacaucgcagacggaggcuucaccgagcugcacucacuauggcagaaugaagagagggcugccacugucaccaaaaagaccuaugaaauuuggcaccggcgucaugauuacuggcugcuugcggguaucauuaaccacggguacgcccgcuggcaggacauacagaaugauccucgauaugcaauccucaacgagccauuuaaaggagaaaugaauagaggcaacuuccuggagauuaagaacaaauuuuuggcuaggcgguucaaguuacuggagcaagcccucguuaucgaagaacagcugcgcagagcugcauaccuuaauaugucugaagaccccagccauccuaguauggcccugaacacuagguucgccgagguggaaugcuuggcugagucccaccagcaccuaagcaaggagucuauggcgggcaauaaaccagcaaacgccgugcugcauaagguccucaaacagcuggaggaacuuuuaucagauaugaaggcugacgugacccggcugcccgccacaauugcacgaaucccgccuguugccguaagacuccaaauguccgaacgcaauauauugaguaggcuggcuaaccgggcgccagagcccacgccucaacagguggcccaacagcaguga

SEQ ID NO: 54343 - RNA, 8148 nt, Artificial Sequence
  derived and/or modified sequence opt3 from CHD6__Homo_sapiens__NP_115597
augaagaugaaaauccagaagaaagaaaagcaacugagcaaccucaaagugcuuaaucacucccccaugucugacgccucagucaacuucgauuacaagaguccuagcccauuugacugcuccaccgaucaggaagaaaagauugaagacguugcuucucauugucugccgcagaaagauuuguauacagcagaggaagaggccgcgacuuuauuccccagaaagaugacgucgcacaauggaauggaggacucagggggagguggcaccggggugaaaaagaaaaggaagaagaaagaaccuggagaucaggagggcgcugccaaggguagcaaagaccgggaaccaaagcccaaacgcaagcgagagccuaaagagccaaaggaaccccguaaggcaaaagagccuaagaaagccaaggaacauaaagagccaaagcaaaaggauggggcuaaaaaggcaagaaaaccgagggaagccaguggaacaaaggaggcuaaagagaagcgguccugcacugacucugccgcgcgcaccaagagcagaaaagcauccaaggaacagggccccacaccuguagagaaaaagaaaaagggcaagaggaaaucagaaaccacuguggagagucuggaacuggaucaggggcucacaaacccaagccugcggucucccgaggaguccaccgaaucaacggacagccagaagcgccgaaguggaagacaagucaaaaggcggaaguacaaugaggaucuugacuuuaaagugguugacgaugacggugaaacuauagccgugcugggcgcugggcguaccucugccuuguccgcaagcacacucgcuuggcaggccgaggaaccuccagaggaugacgcgaacaucauugagaagauccuggccucgaaaacuguccaggaagugcaccccggagagccgccuuucgaucuggaacucuuuuauguaaaguaccgcaauuucucuuauuuacauuguaagugggcaaccauggaggagcuggaaaaagaccccagaauugcucagaagaucaaaagguuucggaacaagcaagcccagaugaaacacauauucacagagccagaugaagaccuuuuuaauccugauuacguugagguggaccgaaucuuggaagucgcucacaccaaggaugccgagacgggcgaggaagugacucauuaucuggugaaguggugcucccuacccuacgaggaaucaacaugggagcucgaagaggacgucgacccagcaaaaguuaaggaguucgaaagucuacaggugcuucccgagauuaaacacguagaacgcccugccagcgauuccuggcaaaagcuggagaaaucuagagaauacaagaacagcaaucaguugagggaguaucagcucgaggguaugaacuggcuguuauuuaauugguacaaccggaagaauuguauccuggcugacgaaauggggcucggaaaaaccauucagucaaucacuuuccuuagugagauauuucugcgcggcauucauggcccauucuugaucauugcgccgcuauccacaaucaccaacugggaaagagaguucaggacguggaccgagaugaacgcaaucguguaucacgggagccaaauuucucgucagaugauacagcaguacgaaauggucuaucgggaugcccaaggaaauccccugucagguguguuuaaguuccacguugugaucacaacuuuugagaugauucucgcugacugcccugaacugaaaaagauccauuggaguugugucauaauugaugaggcccaccgacuuaaaaacagaaauugcaagcuguuggaaggccucaagcugauggcauuagagcauaaagugcugcuaaccgggacaccacuccagaacagcguagaggaacuguucucccuuuugaauuuucuggagcccucucaguucccuucggaaacugccuuucucgaggaguucggagaccugaagaccgaggagcagguuaagaaacuucaaagcauccugaaaccaaugauguugaggcgccucaaagaugacguggagaagaaccuggcucccaagcaggagacaaucauugaagucgaguuaaccaauauccagaagaaauacuaucgggccauucuggaaaagaacuuuuccuuccuaacuaaaggcgcaaaucagcacaacaugccgaaucucauaaacacgaugauggagcugagaaaguguugcaaucauccuuaccuuaucaacggugcggaggagaagauuuuggaggauuuuaggaagacacacucaccagacgcucccgauuuccaacugcaggccaugauccaggcagccgggaagcucgugcugaucgacaaauuacugccuaaacuuauugcuggcggacacaaagucuugauauuuagucaaauggugcgcugucucgauauccuggaagacuaccuaauucagcgacgguauaccuacgagcguaucgacggcagaguuagggggaaucugcgccaggccgcaauugaucgguucugcaagcccgacucugauagauucguguuucuccugugcacuagggcuggaggucuuggcaucaacuugaccgccgcggacacauguauaaucuucgauagcgacuggaacccacagaaugaucugcaagcccaggcucgaugccaucgcauugggcaguccaaagcaguaaaggucuaucgguuaaucaccagaaacucauacgagagggaaauguuugacaaggccagccucaaacugggacuugauaaggcugugcugcaggacauuaaucguaaaggcgguacuaacgggguucaacaguugucuaagauggagguggaagaucuccugcgcaaaggcgccuauggagcacuaauggacgaggaagaugagggcuccaaguucugugaggaagacaucgaccagauacugcagcggagaacacacacgauuaccauccaaagugaggggaagggaagcacuuuugcgaaagccucuuucgucgcuuccgguaauaggacagauauuucacucgacgauccuaacuuuuggcagaagugggccaaaaucgcagaacuggacaccgaggcuaagaaugaaaaagagagucuugugauagaucgaccccggguacgcaagcagacaaagcauuacaacagcuucgaggaagacgaguugauggaauuuucggagcuggauuccgacucugaugaaagaccaacuaggagccggcgauuaaaugacaaagccagacgcuaucucagggcagagugcuuccguguggagaagaaccugcuuaucuuuggcugggggcgguggaaagauauucugacccacggaagauucaaguggcaccuaaaugaaaaagacauggagaugaucuguagggcccuccugguuuacugcgucaagcauuacaaaggcgacgaaaagauuaagucauuuaucugggaguugauaacgccgaccaaagauggucaagcucagacacugcagaaccacaguggguuauccgcgccugugccccgcggccgaaagggcaagaaaacuaaaaaucagcuccugauuccagagcuuaaagacgccgauuggcuggcaaccuguaaccccgaaguggucuugcaugacgauggcuauaagaaacaccucaagcaacauugcaauaaaguucugcuaagagugcggaugcuguacuaucuuaaggcugagauccucggggaagccgccgagaaggcuuucgaaggaucuccugcaagggagcuggacgugccauugcccgauaucgacuacauggagauuccuguagauuggugggacgccgaagcggauaagagccuguuaaucggcgucuucaagcacgguuaugagcgcuacaacgcuaugcgugccgacccggcacucuguuuucuggaaaaaguggggaugccagaugagaagucccuuucagccgaacagggaguuacagacggcacuagcgacauucccgagagagguaacaccgauaaagaggacaaugcugaagauaagguggacggccugcagaaacagacggagaguucuuccgaugggggagacggcgucuucagcgaaaagaaggaugacucgcgggcagcccaagaugggucagacccugauaaaucuccauggcccgugaguuccgcguugacagcuaggcuccgccgacugguuaccguguaucagagaugcaaccggaaggagcuauguaggccugaaauacugggaccgggcaaucaggguuacuggguacaggaggagauguuucgcagaacuagcgaaauggaccuuaucaacaaagaggcccaaaagagguggacacggcgugaacaggcagauuucuaccgcaccgucucuagcuuuggggugguguaugaccaggagaaaaagacuuucgacuggacccaguuucgaauuaucuccagacucgauaaaaagucagacgagagucuggaacaauacuucuauagcuuugucgccaugugcaggaauguuugccgguugcccacauggaaggauggaggcccaccugacacgaccauuuacguggagcccaucacugaagaacgcgcugccagaacauuauauaggauagaacugcuccggaaaguacgagaacaggugcugaaguguccacagcuucacgagagacugcaauugugccgcccuucucuauaccugcccgucuggugggaaugugguaaacaugauagggaccuccugaucggcaccgcaaagcacgggcuuaaccggacagauugcuauauuaugaaugacccacaguuauccuuccuggaugcuuaccguaacuacgcccagcauaaaagaucaggaacucaggcgccgggcaaucucuguugcuuguaucaaaccaacaguaagcuguacgagagccucacguauucccagaugucuaggacaucggaaagccuggagaaugaaccugagaaccuugugcgcguugagucacgggacgaucaccuguccuugcccgacgugaccugugaaaauuuuaucaguaagguccaggacgugauuucuaucaaccaugaugagagccuacugccagaaucccucgagucaaugauguacgggaaaaagguuuuaucucaggaacccagcaguuuccaagaguccccuagcacuaauaccgagucucgaaaagacgugauaacaauuucaaucuccaaggauggaaacugccagaguggcgguccagaagccgagaucgcaagcgggcccacuuucaugggaucgcuggaagcuggcggugucgcccaggcuaacauuaaaaauggcaagcaccuucugaugucuauauccaaggagggggagcucuguugcagcgaagcaggacagagaccugagaacaucggccaauuggaagccaaaugucuggccucaccgagucucaauccagggaacgagucuggauuuguagacaugugcucccugagcgugugcgauucaaagaggaaucuuaguagcgaccagcagcuaauugaucuguuggaaaacaaauccuuagagucuaagcugauccucagccaaaaucacuccgacgaggaagaggaagaggaagagaacgaggaagagaaucuggcuauggcgguuggcaugggugaacgccccgaggugcuucaucugaccgaaccuacaacgaacauuucacgggagaaaaaucagggguuccaggaugagaccaagaagggaucucucgaagucgcaaaccagacucccggcuugcaaagagccuuuccagcuccugccgcaugucagugccacuguaaacauauggagcguuggaugcacggccuggaaaaugacgaguucgagaucgaaaagcccaaagccuauauaccagaucuauuuaagaguaaaacaaacaccaucgcuauggagggggaaccuacugcgauuccgucgcagcccuucaaggugaaacacgagcugcucaaggaaccauggaaggagagcgccgagggacagaauguauuuccuacauacccccuugaagguuccgagcugaaaucugaagacauggauuucgagaacaaggacgacuaugauagggacggcaauugccauucacaagauuacccagggaaauacagcgaagaggaguccaagaguucuaccagcggaaucacgggcgacauuggugaugaauuacaggaggcacgggcuccuacuaucgcccaguugcugcaggagaaaacccucuauucauuuuccgaguggcccaaggaccgcgugauaauuaaccgacuggauaacaucugucacgucguucuuaaggggaaauggccgaguagccaacaguacgaaccaucuggaacacugccuacccccgugcucacuuccucagcaggcagcagaacaucguugucugagccagaggccgcugaacauaguuucuccaauggcgccgcgcuggcagcccagauccacaaggagagcuuuuuagcucccguguucaccaaagacgaacagaagcauaggcggccuuaugaguuugaggucgaacgcgaugccaaagcuagagggcuagagcaauucucagcaacacacggacacacuccgauuauccugaacgguuggcauggcgaauccgccauggaccucucuugcagcagugaggggucccccggagcuaccagcccauucccugugucugccucaacgcccaagauaggcgcaauuaguucccuucagggugcgcuggggauggauuugagcggaauccugcaggccggccucauucacccuguuacaggccaaaucguaaaugggucucugaggcgagacgacgcugccacccggcguagacgcggaaggcggaagcauguggaagguggcauggaucuuauauuucucaaagagcagacucugcaggcagggauuuuggagguccacgaagacccaggacaggcuacccugucgacaacucaccccgagggcccugguccagccaccucagcacccgaaccggccacggcugcgagcucccaagccgagaagaguaucccuucuaagagcuuacuagauuggcugagacagcaggcagacuacucccucgaagugccaggguucggagcuaacuuuucagauaagcccaaacagcgcaggccucgauguaaggagccaggcaaacuugacguuaguucucugagcggcgaggaacgggugcccgccaucccgaaagagccuggguugagaggauuccugcccgaaaauaaguuuaaccauacacucgccgagccaauucugagggauaccgguccucgccgucggggcagaaggccccgcuccgaacuuuuaaaagcaccaucaaucgucgcugacagccccucugggaugggaccucuguucaugaauggccucauugccgguauggauuugguggggcugcaaaacaugcgaaauaugccaggaauaccgcuaacuggccugguaggcuuucccgcgggguucgcuacaaugccuaccggagaggaggucaaguccacucucaguaugcuuccaaugaugcugcccgguauggccgcagugccucagauguuuggcguugggggauugcugagcccacccauggccacaaccugcacgucgacugcuccugcaucccucucuucaaccacaaaaagcggcaccgccgugacagaaaagacugcggaggacaagccgaguucccacgaugucaaaaccgacacgcuggcugaagauaagccaggucccgggccuuucucugaccagagcgagcccgccaucacaacuucauccccaguggcauuuaacccuuucuuaauucccggcguuaguccaggacuuaucuauccgagcauguuucugucuccuggcauggggauggcccuccccgcuaugcagcaagcccggcauucagagaucgugggacuagaaucccagaaaagaaagaaaaagaaaaccaagggugacaauccaaacagccaccccgagccugcaccaucuugugaaagggagcccaguggcgaugaaaauugcgcugagccuucggccccgcugccagcggagcgcgaacauggggcccaggcaggagagggcgcuuugaaggacuccaacaaugauacaaacuga

SEQ ID NO: 54344 - RNA, 8994 nt, Artificial Sequence
  derived and/or modified sequence opt3 from CHD7__Homo_sapiens__NP_060250
auggccgaccccggaaugaugucccuguucggggaggauggaaacaucuuuuccgaaggucucgagggccuuggggaaugcggauacccugagaauccagugaacccgaugggccagcaaaugcccauugaccaggguuucgcuucucugcagccuucauugcaucauccaaguaccaaucagaaccaaacaaaguuaacucacuuugaucauuauaaucaguacgaacagcagaaaaugcaccugauggaccaacccaacagaaugauguccaauacgccugggaacggacuagcauccccacauucucaguaucacacacccccugucccacagguuccgcacggcggcagcgggggaggucagaugggcguguaccccgggaugcaaaaugagaggcauggacagucauucguagauucgaguuccauguggggcccucgggccgugcaggucccagaccaaauacgcgcgcccuaucagcagcagcaaccucagccacagcccccgcagccugcucccucuggucccccugcacaagggcacccccagcauaugcagcagaugggaagcuacauggcccgaggcgauuuuuccaugcaacagcacggccagccacagcaacguaugucacaguucagucaggggcaagagggacucaaccaggguaaucccuuuaucgccaccagcggcccugggcaccugucucaugugccacagcaguccccgucaauggcucccagccuuagacacaguguucaacaguuccaucaccauccuucuacugcacugcacggagaauccguggcccacagcccaagguuuucgcccaacccuccacagcagggcgcuguccggccccaaaccuugaauuucucuucccgcucacagaccgugccgaguccuaccauuaacaauagcggucaguauuccagauacccauacucuaaccucaaccaggggcugguaaauaacacuggcaugaaucaaaaccugggacucacaaauaacacccccaugaaucagagcguuccuagguaucccaacgccgugggcuuuccaucaaauagugggcagggauuaaugcaucaacagccuauccaccccuccgguagccugaaccagaugaauacgcagacuaugcauccaucucaaccgcagggcaccuacgcgucaccucccccaaugagucccaugaaggcaaugagcaacccugccgggacaccacccccucagguccggccgggauccgcuggcauuccaauggagguggguucuuaucccaauaugccucacccacagcccucgcaccaaccuccgggggccaugggcaucggacagcgcaacaugggcccccgaaauaugcagcagagcagaccauucauagggauguccucagcaccuagggaacuuacuggacauaugcggcccaacgguugcccaggcgugggguugggagacccucaagcuauccaggagcgucugauucccggccagcagcacccaggucaacagccgaguuuucagcaacuaccuaccugucccccacuccagccccauccugggcugcaccaucagucuagcccaccccacccucaccaucagccgugggcccaacuucacccaagcccccagaacacaccucagaaaguccccguucaucagcacucaccaagcgagccuuuccuggaaaagcccgugccagauaugacccaaguaucuggcccuaaugcgcaguuggugaaauccgacgauuaccucccgaguaucgagcagcagccccaacagaagaagaaaaagaaaaagaacaaucauauugucgccgaagacccaagcaaaggauucggcaaggaugacuuuccugggggaguggacaaccaggagcugaaucgcaacucuuuagauggcucccaagaagagaagaaaaagaaaaagagaucaaaagcaaagaaagaccccaaggagccaaaggaaccuaaagagaagaaagaacccaaggagccgaaaacgccaaaggcuccuaagauccccaaagaaccaaaggagaaaaaggccaaaacugcuacacccaagccuaagaguagcaaaaagucguccaauaaaaagccggauucugaggccagcgcacugaaaaagaagguuaacaaagguaagaccgaagggucagagaauagugaccucgauaaaacucccccaccuagcccaccuccagaagaggacgaagaucccggagugcagaagaggcggucuagccgacaggucaaacgcaagagauauacagaggaccuugaguucaaaauauccgaugaagaggccgacgaugcugacgcggcaggcagggacucaccuagcaacaccagucagucugaacaacaggaguccguggaugccgaggguccaguaguugaaaagauuaugagcucgcggucagugaagaaacagaaggagucuggcgaagaggucgaaaucgaggaguuuuacgugaaauauaagaauuucaguuaccugcacugucagugggcuuccauugaagacuuggagaaagauaagcgcauccaacagaagaucaaaagauuuaaggccaaacaggggcagaacaaguuccuaagcgaaauugaggacgaacuguuuaaucccgauuacgucgagguggacaggauaauggauuucgcacguucuacggacgaucggggagagccgguuacccacuaucucgugaaauggugcagccugccuuacgaagacuccacaugggagcgaagacaagauaucgaccaggccaagauugaagaguuugaaaaacuuaugucaagggagccagagacugaacgcguagagcggcccccugcugaugacuggaaaaagagugaaagcucuagagaguauaaaaacaauaacaagcugagggaguaccaguuggaaggcgucaacuggcuccuguucaauugguauaacaugcgcaauuguaucuuagccgacgagauggggcugggaaaaaccauacaguccauuacauuucuauacgaaaucuaucucaagggcauccaugguccauuccuggugauugcaccccuuucaacuaucccgaacugggagcgagaauuucggaccuggacagaguugaauguuguggucuaccacgggagucaagcgagccguagaaccauucagcuguacgagauguauuucaaggauccucagggaagggugauaaaaggcuccuacaaguuccaugcuaucauuacuacguuugaaaugauccucacagacugccccgagcugcgcaacaucccauggcgguguguagugauugaugaagcccacagacuuaaaaauaggaacugcaagcuguuggagggucucaaaaugauggaccuggaacacaagguuuuacugaccggcacuccucuacaaaauaccgucgaggaacucuucucucugcuucacuuuuuggaacccucgcgauucccaagcgagacaaccuuuaugcaggaguucggggaucugaaaacugaggaacaggugcagaagcuccaagcaauacugaagcccaugauguuacgccggcugaaagaggacguggagaagaaccuugccccuaaagaagagacaaucauugaagucgaguugacgaauauccagaagaaauauuacagagcuauucucgagaagaacuuuaccuuccugucaaagggaggcgggcaggccaauguuccaaaccuacugaauacuaugauggaacucaggaaauguugcaaccacccguaucugaucaacggagcagaggaaaagauacuugaggaauuuaaagagacacauaaugcugagucccccgauuuccaguugcaagccaugauccaggcggccggcaagcugguguuaauugacaaacuccugccuaaacuuaaggcuggugggcaccgugugcugaucuuuagucagaugguacgcuguuuggauauucucgaagacuaccugauccagcggagauauccauacgagaggauagauggacgaguccggggcaaccuacgccaagcagccauugacagauucucuaaacccgauagcgacagguuuguguuccugcucugcacccgggcugguggccuggggaucaaucuuacagccgcagacacuugcauuaucuucgauuccgacuggaacccucagaaugauuugcaggcgcaagcccgaugucauagaauaggacagucaaagucuguuaaaaucuaccgccugauuaccaggaacagcuaugaacgugagauguuugacaaggcuaguuuaaaacucggccuggauaaggccgugcuucaguccaugagcgggcgggaaaaugcaacgaacggaguccagcaacugucuaagaaagagaucgaggaccuacucagaaagggcgcuuacggugcccugauggaugaagaggacgaagggucaaaauucugcgaggaagauauugaccagaucuugcugaggcgcacccacacaauaacuauugaguccgagggaaagggcaguaccuuugcaaaagccagcuucguggcuucgggcaaucgaacagauaucucuuuagacgacccaaacuuuuggcagaagugggcgaagaaagccgaacucgauaucgacgcacugaaugggagaaacaaucuuguuauugauacuccccgggugaggaagcagacccgccuguauuccgcuguaaaagaggacgaauugauggaguucagcgaucucgagucagacagugaagagaagccuugugccaaaccgcguagaccacaagauaagucucagggauacgcccgguccgaaugcuuuagggucgagaaaaaccugcuaguguaugguuggggccgcuggacggacauccugagccacgggcgauacaagagacagcuuacagaacaggauguggagaccauuugucggacuauacucgucuauugccugaaucauuacaagggagacgagaacaucaaaucauucauuugggauuugaucacacccaccgcugacggccaaacuagggcacugguuaaucacagugguuuaagcgccccugugccccgcgggagaaagggcaagaagguaaaagcgcaguccacccagccagugguccaagaugcugacuggcucgccucuuguaacccugacgcacuguuucaggaagauagcuacaagaagcaucuuaaacaccacugcaacaaggugcuguugaggguucggaugcucuauuaccugcgucaggaggugauuggcgaccaggccgauaaaauccuagaaggcgcugacuccucagaggcagaugucuggauacccgaaccauuccaugccgaggugccggcggacuggugggauaaggaggcugacaaaucucugcuuaucgggguuuuuaagcacggauaugaaaaguacaauaguaugcgcgccgauccugcacucuguuuccuggagcgaguggguaugcccgacgccaaagcuauugccgcagaacaaagaggcacagauauguuggcugacgggggagauggcggugaguucgacagggaagacgaggauccagaguauaagcccacgcggaccccuuuuaaagacgaaaucgaugaguucgccaacucgccaagcgaagacaaggaggaguccauggaaauucaugcgacugggaaacacucugagucaaaugccgaauuaggacagcuguacuggcccaacacaagcacccucacaacucgccugagaaggcuuaucaccgcauaucagcgguccuacaagcgacagcaaaugagacaggaggcucugaugaagacggaucgcaggcggcguagaccuagggaagagguccgcgccuuggaggcugaacgggaggcaauaauuagugaaaaacgacagaaguggacaagaagggaggaagccgacuuuuaccgcguagugucuaccuucggcguuaucuuugauccggugaaacagcaauucgacuggaaucaguuucgggccuucgcuagacuagauaagaaaagcgacgagucacuggagaaguauuuuuccugcuucgucgcgaugugucguagggugugccggaugccaguaaaacccgaugacgaaccuccagaccucaguagcaucauugagcccauaacugaggaacgcgcaucucgaacccuguacagaaucgaacuuuuaaggaagauucgggaacaggugcugcaucacccucagcucggcgagcgcuugaagcugugccaacccucccucgaucugccagaauggugggagugugggagacacgacagggaucuucuggucggagccgcuaaacaugguguuucacgaacagacuaucacaucuugaacgauccggaacuauccuuucuggacgcccauaagaauuucgcacagaaccggggcgccgggaauacuucgucucucaacccuuuagcugugggauuugugcagacacccccagucauuaguuccgcgcacauccaagaugagcgugugcuggagcaggccgaaggcaaaguugaggaaccugagaaucccgcagcuaaggaaaaaugcgaggguaaggaggaagaggaagagacagacgggagcggaaaggaaucaaaacaggagugugaggccgaagcauccucuguaaagaacgagcuuaaaggcguggaagucggcgccgauacggggagcaagaguauauccgagaaaggaagcgaagaggacgaggaagagaagcuggaagaugacgauaagucugaggagucaagucagccagaagcuggugccguguccagaggcaaaaauuucgacgaggaaagcaacgcgucuaugucgaccgcacgcgacgagacuagggauggguucuacauggaagacggagauccuucaguugcccaacucuugcacgagcggacauuugcuuucagcuuuuggcccaaggacagagugaugaucaaucgccuggauaacauuugcgaggccguccucaaaggcaaguggccggugaacaggcgacagauguucgacuuucagggucugaucccaggguauaccccuacuacaguagauagcccccuucagaaacggaguuucgcugaacuaucuauggucggacaagcaagcauuuccggcucagaggacaucaccacgaguccacagcugucuaaggaagaugccuugaauuuaagcgugcccagacagaggcgccgucggagaaggaagauagagauugaagcugagcgcgccgcaaaacgacggaaccugauggagaugguugcgcagcucagagaaucccaaguggucucagagaauggccaggaaaaggugguugaccugagcaaagccucuagggaggcuacuuccaguaccagcaacuuuucgucccuuucuucaaaguucauccugccuaaugugagcacaccggucagugaugccuuuaaaacccagauggaacucuugcaagcagggcugucccgcacuccaacaagacaucuacugaacggaucucucguggacggugagcccccuaugaagcggaggcguggccgacgcaaaaauguagaggggcuugaccuguuauucaugagccacaagagaaccucauuguccgcugaagaugccgaggugacaaaggcauuugaagaggacaucgagacucccccaacccggaacauuccuagucccggacagcuggauccagacacgaggaucccuguuauaaaucucgaagauggcacacgccuggucggugaggacgccccgaaaaacaaggaucuuguggaauggcugaaacuccaucccaccuacacuguggacaugccaagcuaugucccuaagaaugcugauguauuguucucuucauuucagaaacccaagcagaagagacaccgguguaggaacccaaauaaacuggacauuaacaccuuaacaggggaggaacgagugccuguugugaauaagcguaacggcaaaaagaugggaggcgcgauggcacccccgaugaaagaucuaccaagauggcuggaggagaacccugaguucgcagucgcucccgacuggacugauaucgugaagcaauccggguucguuccagagagcauguuugaccgccuccuuaccggacccgugguccggggugaaggcgccucuaggagagggcgccggccuaagagugagauugccagggcagcugccgcggcugccgcaguggccucgacguccggaaucaauccccuguugguaaacagccuguucgcuggcauggaccucacaucacugcagaaucuucagaaccuccagucucugcaauuggcaggucugaugggguuuccaccuggcuuagccaccgcggcuacugccggaggcgaugccaagaauccggccgcugugcuaccccugaugcucccagggauggccggacuuccuaacguuuucggucugggcggguugcugaauaacccccucagcgcagcuacaggaaauaccacuacagccuccagucagggcgaaccagaggacucaaccucuaagggugaggaaaaagggaacgagaaugaagaugagaacaaggacagcgaaaaauccacggaugcggucagugccgcagacagcgcuaauggcuccgugggagccgcaacugcuccugccggccugcccucuaacccgcuugccuuuaauccuuucuuacugucaaccauggcgccagggcucuuuuaccccagcauguucuugccuccaggacugggcggucuaacacugcccggguuuccugcucucgcaggacuucagaacgccgugggcucguccgaggagaaggcugccgauaaggcagaagguggcccauucaaagacggggagacccuggaaggaagugaugccgaggagucuuuggacaagacagcugaaagcucacugcucgaggaugaaauagcgcagggcgaggaacuggacuccuuagaugggggagacgagauugagaacaaugaaaacgacgaguga

SEQ ID NO: 54345 - RNA, 7746 nt, Artificial Sequence
  derived and/or modified sequence opt3 from CHD8__Homo_sapiens__NP_001164100
auggcagaccccaucauggaucuguucgacgauccuaaccucuuuggccuugacagccugaccgaugacuccuucaaucaggugacucaagauccaauugaagaggcuuugggguuaccgucuucacuggacagucuagaucagaugaaccaggacggagguggcggggaugucggaaauagcuccgcaucugaacucguucccccuccagaagagacugcccccacggaacugucgaaggagucaaccgcgccugcuccagagagcauaacccuucacgacuacacuacccagcccgccagucaagaacagccugcacagccagugcugcagacauccaccccgacuucuggcuugcuccaaguaagcaaaucccaggagauccugucacaggguaaccccuuuaugggggugagugccacagcugucucaucuuccucagcaggaggccagccuccacaaagcgcccccaagauugugauccugaaagcuccuccaaguucuuccguuaccggcgcccauguggcgcagauucaggcacaagggaucacgagcacugcccagccccucgucgcuggaaccgccaaugguggcaaggugacauucacuaaaguauuaaccgggacaccgcugaggccuggaguuucgauagugucuggcaacaccguccuugcagcuaaggugcccgguaaucaggccgcggugcagaggaucguccaaccaucccggccuguuaagcaguuggugcugcagcccguaaaagggucagccccagcaggaaaccccggcgcuacgggcccuccacuaaagccggccgugacucucacaaguacccccacucagggggaaagcaaacgcauuacacugguccuucaacagccucaguccggagguccacagggccaccgacaugugguucuggggucuuugcccggaaagaucgugcuccaaggcaaucagcuggcugccuuaacccaggccaagaacgcccagggucaaccugcuaaggucgugacgauucagcugcagguacaacagccacagcagaagauccaaauaguuccccagccgccuagcucacagccacagccccaacagccucccaguacccagccagugacacucuccagcguccagcaagcgcagauuauggggccuggccagucucccggacaacgucuuucagugccagucaaagugguucugcagccgcaggcaggcaguagccagggggccuccucuggauugucggugguaaagguccuaagcgcuuccgagguggccgcacugucaaguccugccucuagcgcuccccacuccgguggcaaaacugggauggaggaaaauagaaggcucgagcaucaaaagaaacaggaaaaggccaaccggaucguugcagaggcgauugcucgcgccagagcaaggggagaacagaauaucccacgggugcugaacgaggaugagcuucccucaguccgcccugaagaggaaggcgagaaaaagcgaagaaagaaaagcgccggugaaaggcugaaggaggagaaaccaaagaaaucuaagaccuccggggcuaguaagacaaaaggcaagagcaaauugaauacuaucacccccgugguaggaaagaaacggaagcguaacacaucuuccgacaacucagacguggaaguuaugccugcccagaguccgcgcgaggaugaagagagcucgauucaaaagagaagguccaaucggcaggucaaacgaaagaaauauaccgaagaccucgauauaaagaucacugacgaugaggaggaagaggaaguggacgugacgggcccaauuaaacccgagccuauccugccagagcccguccaggaaccugauggggagacauuaccgucuaugcaguuuuucguugaaaaccccagcgaggaagacgcagcuauaguggauaaggugcugucaaugcgcauuguaaagaaagagcuaccaaguggacaauacaccgaggccgaagaguuuuucgucaaguauaaaaauuacuccuaucuccacugcgaaugggcgacuaucucucagcuggagaaggacaaaagaauccaccagaaacuuaaaagguuuaagaccaagauggcccagaugcggcauuucuuucacgaagaugaggagccuuucaaccccgacuacguggaaguugaccgcauuuuggaugagagccauuccaucgacaaagauaauggugaaccagugauuuauuaccuggucaagugguguucacucccuuacgaggacagcacaugggaacugaaagaggauguggacgagggcaagauaagagaauuuaaaaggauccaaagucgucaccccgagcuuaagcggguuaaccgaccacaggcuucugcauggaagaaacuggaauugucccacgaguauaagaauagaaaccagcucagggaguaccaacuggaaggggugaauugguuacuguucaacugguauaaucgccagaacugcauucuagccgaugagaugggacucggcaaaaccauccagagcaucgcuuuccugcaggaaguauacaaugucgguauucaugggccguuucuugugauagccccuuugucgacuaucacaaacugggagcgggaauuuaauacguggaccgagaugaacacuauuguguaucacggcucacuggcaucuagacaaaugauccagcaguacgagauguauuguaaggacaguaggggacgccucauucccggcgcguacaaauuugaugcccugaucacaaccuucgaaaugauauuauccgacugcccagagcugcgagaaaucgaguggcggugugucauuaucgaugaagcucaucgucuuaagaacagaaauugcaaguugcucgacagccugaaacacauggaucuagagcauaagguucugcucacagggacuccccugcagaacaccguggaggaacuuuucucuuugcugcacuucuuagagccuagccaauuuccauccgaaucagaguuccucaaagacuuuggagaccugaagacggaagaacagguacagaaacuucaggccauucugaagcccaugauguugaggcgccucaaggaggauguggagaagaaucuggcaccuaagcaagagaccaucauagaagucgagcuaacaaacauucagaaaaaguacuaucgggcuauccuggagaaaaauuucaguuuucucagcaagggcgccggucacacuaacaugccgaaucugcuuaacaccaugauggaauugagaaaauguugcaaucauccauaccugauuaacggggcagaggaaaagaucuuaacagaguucagggaagccugucacauaaucccccaugacuuucaccuccaggcuauggugcgaucugcgggaaagcugguucuuauugauaaacugcuaccuaagcucaaagccggcggucacaaggugcugaucuucucccaaaugguccgcugcuuggacauucuggaggauuauuuaauccagcggagauaccucuaugagaggauagacggccgugugcgcgggaaucugcggcaggcagcuauugauagauucucaaaacccgacagugauagguuuguuuuccuucuguguacucgagccggaggcuuggggaucaaccucaccgccgcugacacgugcaucauuuuugauagcgacuggaauccacagaacgaucugcaagcacaggcccggugccaucgcaucggacaguccaaggcggugaaggucuacagacuaauuacaagaaauucuuaugaacgggagauguucgacaaggcuucgcugaaacuuggccucgacaaagccguacugcagagcaugucaggucgagaugggaacauaaccggaauccaacaguuuuccaagaaagaaauugaggacuugcugagaaagggcgcauacgccgcuaucauggaagaggaugacgaggguaguaaguucugugaagaggauauugaccagaucuuacuccgcaggacuacaaccauaacuaucgaaucugagggcaaagggagcaccuuugcaaaggccuccuucguggcgucagaaaaccguacagauauuucucuggacgauccuaauuuuuggcagaaaugggcuaagaaagccgaccuugauauggaccuguugaacagcaagaauaaccucguuaucgacacgccccgggugagaaagcaaaccaggcacuucaguacucugaaagaugacgaucuagucgaguuuuccgaccuggagagcgaagaugacgagcgcccacgaucuagacggcaugauaggcaccaugcauacggacgcacagacugcuuccguguggaaaagcaccuucucguauauggcugggggagauggcgggauauucugucacacggaagguuuaaacgccgaaugaccgagagagacguggagacaaucugucgggccauauuggucuacugcuuacugcauuauaggggcgaugaaaauauuaaggguuucaucugggaccucaucuccccugcugagaacgggaaaacuaaggaacugcagaaucacaguggacuuagcauuccgguuccccgcggcagaaaggguaaaaaggugaaaucgcagucuaccuucgauauacauaaggccgacuggaucaggaaauacaacccagacacgcuguuucaggaugaguccuauaagaaacacuugaagcaucaauguaauaaggugcuacugcggguccguaugcucuacuaucugcgccaggaagugauuggcgaccaggcagagaaaguucuugggggagcuaucgccagcgagauugauaucugguucccuguaguggaccaauuagaaguccccacaaccuggugggauucagaggcggacaagagucugcucauaggcguguuuaaacacggguacgaaaaguacaacacuaugcgagccgauccagcauugugcuuccuggagaaagcuggaagaccugacgauaaggccaucgcugcagaacacaggguucucgacaauuuuucugauauuguggagggcgucgacuucgauaaggacugugaggaccccgaauauaaaccgcugcaggguccaccuaaggaucaggacgaugagggggacccccuuaugaugauggaugaagagaucuccgugauugacggagaugaagcccagguaacccaacagccaggccaucuguuuuggcccccuggcagcgccuugacagcucggcuacgcagacuggucacugcguaccagaggucauauaaacgggagcagaugaagaucgaggcagccgaacgaggggacagacgcaggcggcguugcgaggcugccuucaaacucaaggaaauagcaagaagggagaagcaacagcgcuggacccggcgagagcagacagauuuuuacagagugguuaguacguucggaguggaauaugacccggauaccaugcaguuucacugggacagguuccgcacuuucgcccgguuagacaaaaagacagaugagagccugaccaaauacuuucaugguuucgucgcuauguguagacaagugugccgucuucccccagcggccggcgacgaaccucccgauccuaaccuguuuauugagccaaucacugaagagagggcaucccggacacucuaucgcaucgaguugcugcgaagacucagggaacagguucugugucacccccuucuagaggaccggcuggcuuugugccagccuccagggcccgaauuaccgaaguggugggagccugugcgccacgauggagaacugcucagaggcgccgcaaggcauggugucucucaaaccgacugcaauauuaugcaggauccagacuucagcuuucuggccgcucgaaugaacuacaugcagaaucaccaggccggggcgcccgcaccuucccuuucacgguguucuacgccacugcuccaucaacaguacacaagucguaccgccucgcccuugccgcugagaccugaugcucccguggagaaaagcccagaggaaacagccacccagguaccuucccuagagucucugacucucaaacuugaacacgaggugguugcucgcucaaggcccacaccacaggacuaugaaaugcgggucagccccuccgauaccacaccucuggugaguagaucugugccaccggucaaguuagaggacgaggaugacagcgacucagaauuggaucuguccaaacucagucccucuagcuccucaagcucgucuaguuccagcucauccucuagcacugacgagagugaagaugagaaggaggaaaaacugaccgaccaaucccgcagcaaacuuuacgaugaggaaucucugcucucauugacgaugagucaggacggauucccuaacgaggauggcgaacagaugacaccagagcuguuacuacugcaggagaggcaacgagcauccgaauggcccaaagaccggguacucaucaacagaauagaucuugugugccaggccguucugagcggcaaguggccuucuucgaggcgcucacaggagauggugaccgggggaauuuuggguccaggcaaucaucugcucgacagccccucccugacuccuggggaauauggagauaguccggucccaacaccccguucuagcuccgcugccucaauggcagaggaagaggcgagugccgugucuacagcugccgcacaauuuacuaaacuucggagaggcauggacgagaaggaguucaccguucagaucaaggacgaggaaggucucaaacugacguuucagaagcacaaauugauggcuaacggggugaugggagauggccacccucuguuccauaagaaaaagggcaauaggaagaaauuagucgagcuagaaguggaguguauggaggaacccaaccaccuggacguagaucucgagacacgcauuccagugaucaauaagguugacgggacccuucuggucggagaagaugccccucgacgggcagaguuggagauguggcugcagggucaucccgaauuugccguggacccaagauuccucgcuuacauggaggauaggcgcaaacaaaaguggcagagaugcaaaaagaacaauaaggcggaacugaacugucuuggcauggagccggugcagacugccaauagccggaacgggaaaaagggacaccacacagaaaccgucuuuaauaggguuuuaccuggccccauagcaccagaguccagcaagaagcgugcucgacgcaugagacccgaccugagcaaaaugauggcccucaugcagggugggucuacuggauccuugagucugcauaacacauuccaacacagcucguccggccuacagucugugucaagccugggccauaguuccgccaccucugcaagccucccuuucaugccauuuguaaugggaggggcucccucauccccucacguggauaguagcacgaugcuucaucaccaccaucaccauccgcacccacaccaucaccaucaccaucaccccggucugcgggccccuggcuauccaucuucacccgucacuaccgcguccgggacaaccuugaggcugccuccccuccagccagaggaagacgaugacgaggaugaagaggacgacgaugaccugagccagggauacgauucuagugaacgcgacuucucguuaauugaugacccgaugaugccugcuaauuccgauagcucagaggacgccgaugacuga

SEQ ID NO: 54346 - RNA, 1785 nt, Artificial Sequence
  derived and/or modified sequence opt3 from CHDH__Homo_sapiens__NP_060867
auguggugccugcucagaggccuugggaggcccggagcccuggcucggggugcauugggccagcaacagagcuuaggggcccgcgcgcuggcuuccgccggaucugagucacgagacgaauacaguuauguggucguuggcgcagguagcgccgggugugugcuagcuggacgucucaccgaggauccugcagaaagaguacugcuucuggaggccggcccaaaggacguguuggcuggcuccaaaaggcucucuuggaagauccacaugccggccgcgcuggucgcaaaccugugcgaugaccgguacaauugguguuaucauacagaagugcagcgcgggcucgauggaagaguuuuauacuggcccaggggucggguguggggcgggucgucaagccugaacgccauggucuaugugcgcggacacgcugaggacuacgagcgauggcagagacaaggcgccagggguugggauuaugcacauugccuuccuuacuuccggaaagcucaggggcacgaauugggagccagucguuaccgcggcgcggacggcccacugagaguauccagggggaagacuaaucauccccuacacugugccuuucucgaggcaacgcagcaggcuggauauccucugaccgaagauaugaacgguuuccaacaggagggcuuuggguggauggacaugacaauucacgagggaaaacgguggucugccgcuugcgccuaccuucauccagcacugagccgaacuaauuugaaggccgaagcugagacccucguuucccgcgugcuguucgaaggcacaagagcggucgguguggaguaugugaagaacgggcagucacacagggcauacgccaguaaagaagucauauuaagcggcggagcuaucaauucuccccagcugcucaugcuuuccggcauugggaacgccgaugaccugaagaaauugggaaucccuguugugugucaucuaccagguguaggccaaaaucugcaggaucaccucgagauuuauauccagcaagcaugcacccggccgauaacucugcacucagcccagaagccccuucgcaaaguguguaucgggcuggagugguuguggaaguuuacaggagaaggcgcuaccgcccaucucgagacggguggguucauuagaagccagccuggcgucccacaccccgacauccaguuucauuuccugccuagucaagugauugaccacggaaggguuccaacucagcaggaagcauaccaggugcaugucggccccaugcgugggaccucugugggaugguuaaagcugcgguccgcgaacccgcaagaucacccuguaauccagcccaauuaucuaagcacagagacugacauagaagauuuucgacucugcguuaaacugaccagagagauuuucgcucaggaggcccuugcaccauuuagggguaaggaauugcagccuggcucgcacauccaaucugacaaagagauugaugccuucgugcgcgcuaaggccgacuccgcauaccaucccucauguacaugcaaaauggggcagccaagugaucccaccgcugucguggacccucagacgcggguccugggaguggaaaaccucagaguuguggaugccagcaucaugccauccaugguaucuggcaaucugaacgcgccgacuaucaugauugccgagaaggcugcagacauaaucaaaggucagcccgcccuuugggauaaggacgucccuguguacaagccaaggacacuggcuacccaacgcuga

SEQ ID NO: 54347 - RNA, 1329 nt, Artificial Sequence
  derived and/or modified sequence opt3 from CHEK1__Homo_sapiens__NP_001231775
auggccgugcccuucgucgaagacugggaucugguucagacccucggcgaaggggcuuacggagaggugcaacuugcaguaaacagagugacagaagaggccgucgcggugaagaucguugacaugaaaagggcuguggauugcccugaaaauauuaagaaagagauauguaucaacaagaugcugaaucacgagaacgucgugaaauuuuauggucaucggcgcgaaggcaauauucaguacuuguucuuagaguauugcagcgggggagaacuguuugaccgaaucgagccagauauuggcaugccggagcccgacgcccagcguuucuuucaccagcuaauggccgguguaguuuaccuccaugggaucggaauaacucacagagauaucaagccugaaaaccugcuucuggacgagagggauaauuugaagauuuccgacuucggccucgcaacgguguuucgguauaacaaucgcgaaagacugcugaacaaaauguguggcacccucccauacgucgcucccgaguuacugaagaggcgggaguuccaugcagaaccuguggauguguggucuugcgggaucguccuuacagccauguuggcuggagagcugccaugggaccaacccucagauaguugucaggaauauagcgacuggaaagagaagaaaacuuaccuaaauccuuggaagaagauugacuccgccccacucgcgcugcuucacaaaauccugguugaaaacccgucugcacgcauaaccauucccgauaucaagaaagaccgaugguacaauaagccuuugaaaaagggugccaaaagaccaagggugacaucgggcgggguaucagagagccccaguggauuuuccaagcacauucagucuaaccucgauuucagcccugugaauagcgcuucaagugaagagaacgucaaguauuccucuucccagccagagccccggaccggccugucauuaugggacacuagcccgaguuacaucgauaaacuggugcaagguaucucuuuuucccagccuacaugccccgaccauaugcuccuuaacagccagcuguuggggaccccaggaucgucucagaauccuuggcaacgucuaguuaagcgcaugacgagauucuuuacuaaacuggaugccgacaaguccuaucagugucucaaagaaaccugcgagaagcugggcuaccaguggaagaaaucauguaugaaccaaggcgaugggcuugaguucaagaggcacuuccugaaaauuaagggaaaauugauagacaucgugaguagccagaagauuuggcuccccgcaacauga

SEQ ID NO: 54348 - RNA, 969 nt, Artificial Sequence
  derived and/or modified sequence opt3 from CHEK2__Homo_sapiens__NP_001244316
augagcaagacccugggcuccggggccugcggagaggugaaacucgcuuucgaaagaaagacauguaaaaaggucgcaaucaaaauuauaucuaagaggaaguuugccaucgguucagcgcgggaggcugaccccgcccuuaacguugaaacugagauugaaauccugaaaaaguugaaucacccuugcauuaucaaaauaaagaacuucuuugaugcagaggacuacuauaucguguuagagcugauggaaggcggggagcuauucgauaaaguagugggaaauaagcgccucaaggaagccacguguaaacuguacuuuuaucagaugcuucuggcuguccaauacuugcaugagaacggcauuauccaccgagaccucaagccagagaaugugcugcugaguagccaggaagaggauugccucauuaaaaucaccgacuucggucauuccaagauauuaggggaaacaucucugaugcguacucuuuguggaaccccgacauauuuggcacccgagguucuggugucggucggcaccgccggcuacaacagagcuguggauugcuggucacuagggguaauucucuuuaucugucugagcggauauccuccauucagugaacacaggacucagguuucccuuaaagaccagauuacaucugguaaguacaauuuuauccccgaggugugggccgaggucagcgaaaaagcgcuggauuuggugaagaagcuccugguggucgacccuaaagcacgguucaccacggaggaagccuuacgccauccauggcugcaagaugaggacaugaagagaaaauuucaggaucuccuuuccgaagagaacgagucaacugcucugccccagguuuuggcccagccuaguaccagcaggaagcggccacgcgaaggcgaggcagaaggggcugagacaacuaaacgaccggccgugugcgcggccguacuauga

SEQ ID NO: 54349 - RNA, 2751 nt, Artificial Sequence
  derived and/or modified sequence opt3 from CHERP__Homo_sapiens__NP_006378
auggagaugccccugccuccagacgaucaggaacucagaaacgugaucgacaaacuugcccaauucgucgcuaggaauggcccggaguuugaaaagaugaccauggagaagcagaaagauaaccccaaguucagcuuucuguucgggggagaauuuuacuccuauuacaaaugcaaguuggcauuagagcagcagcaacugauuuguaagcagcagacaccugagcuagaaccagccgcgacuaugcccccucucccacagcccccucuggcuccagccgcaccgauacccccugcccaaggugcuccaucuauggacgagcuuauccagcagucacaguggaaucugcaacagcaggaacaacacuugcucgcacugcggcaggagcagguuacggccgcuguggcccaugcgguagagcagcaaaugcagaaacugcucgaagagacccaguuagauaugaacgaguucgacaaucugcuucagcccauuaucgauacaugcacuaaggacgcaauuagugccggcaaaaacuggauguuuagcaaugcuaaguccccuccacacugugaauugauggccgggcaucugcgcaaccgaaucaccgcagauggagcucacuucgaacuacgucuccaucugauauaucuuaucaaugacgugcugcaccacugccaaagaaaacaggccagggaguugcucgcggcccugcagaaggucgugguucccauuuacuguacaucuuucuuagcaguggaggaagauaagcagcagaaaaucgcucggcugcuccagcuuugggagaagaacggcuauuucgacgauucgauuauccagcagcugcaaucaccggccuugggucuagggcaguaccaggcuacccugauaaaugaauauagcagugucgugcaaccuguacagcucgccuuucagcagcaaauucagacucugaaaacacagcaugaggaguucguuaccucccuugcacagcaacagcagcagcaacagcagcaacagcagcagcugcaaaugccccagauggaagccgaggugaaggcuacgccaccucccccagcgcccccuccagcaccggcccccgcuccugccaucccacccacuacccagccugacgacucuaaaccacccauucagaugccgggaagcuccgaauacgaggcaccuggcggcguccaagauccagccgcugccgggccccgcggaccugguccccacgaccagaucccaccuaacaagcccccaugguuugaucagccgcauccuguggcacccuggggccagcaacagccacccgaacagccuccauacccccaccaccaagggggaccuccgcauugcccacccuggaauaacucacacgagggcauguggggugaacaaagaggggacccuggauggaauggccagagggaugcgccauggaacaaccagcccgacgcugccuggaauagucaauucgagggcccuuggaacagccagcaugagcagccgcccuggggcggaggucagcgggaaccaccuuuccgcaugcaacgacccccacacuuuagaggcccuuuucccccacaucagcagcacccgcaguuuaaucaaccuccccacccacauaacuucaauagguuucccccucgguucaugcaggaugacuuuccaccccgucacccuuucgagcgcccgccauauccccauagauuugauuacccucagggggacuuccccgcagaaaugggaccaccucaccaccaucccggccacaggaugccacauccugguaucaacgagcacccgcccugggccgggccacagcauccugauuuugggcccccaccucacggauucaauggccaacccccgcacaugcggcgacaggggccaccucauauuaaccacgacgaccccucuuuggugccaaauguccccuauuuugaucucccugcuggacugauggccccguuaguuaaacuggaggaccaugaauacaagccccuagauccaaaggacauacgccucccucccccuaugccacccuccgagagacugcuugcagcuguggaagccuucuauucaccuccaagccacgauaggccccggaacagugaggguugggaacagaauggcuuguacgaguucuuucgcgcgaaaaugagagccaggcgucggaaggggcaagagaaacgaaacucuggaccguccagaagcaggucgcgcucuaagucccggggcagaucaaguagcagguccaauucucgcagcucaaaaaguuccgguagcuauucucgaucacggagucguagcuguuccagaucuuacucgaggagccgcucccggucaagaaguaggucucgaagcucccgcucacggagcagaucucaguccaggagucguagcaagucuuacuccccugggcgccggagaaggucacgaagucggagcccaacacccccuucguccgcuggccugggaucuaacagcgcaccacccaucccggacucacgccucggcgaagagaauaaggggcaucagaugcugguaaaaaugggauggagugguuccggcgggcuuggagccaaggaacagggcauucaagauccuaucaaagguggggacgugagagauaagugggaccaguauaaaggcgucggaguggcucuggaugaccccuacgagaacuauaggcggaacaagucuuacagcuucauagcccgaaugaaggcaagagaugaaugcaaauga

SEQ ID NO: 54350 - RNA, 1995 nt, Artificial Sequence
  derived and/or modified sequence opt3 from CHFR__Homo_sapiens__NP_001154816
auggagagacccgaagagggcaagcagagcccuccaccgcaacccugggggaggcugcuccggcuuggagccgaagagggugaaccucacgugcuguugcgcaaacgagaguggaccaucggccguagaagggggugcgacuuauccuucccaucuaacaagcuggucucaggagaucauugucggauuguuguggacgagaaaaguggccagguaacacuagaagauacuagcacguccgguaccgugauaaauaagcucaaagucgugaagaagcagacaugcccccugcagacuggggacguuaucuaccuuguguaucgcaaaaacgagccugaacacaaugucgcuuaccuguaugagucuuugucggagaagcaaggaaugacccaggaaucauuugaggcaaacaaagaaaauguguuccauggcacaaaggauaccagcggcgccggggcgggaagaggugcugacccaaggguacccccuaguuccccagccacucagguuuguuuugaggaaccgcagcccucuacaagcaccuccgaucucuucccuacggcaucagccaguagcacugagccaucucccgcuggccgggagcgcuccucaagcugcgggaguggaggcggugggauuucuccuaaaggauccggcccaagcguggcaucggacgaagucucuuccuuugccucagcucugcccgaucgaaagaccgccaguuucagcucccuggagccgcaagaccaggaagaucucgagccugugaagaaaaagaugagaggcgacggggauuuagaccugaacggacagcuuuugguggcgcagcccaggcggaaugcacaaacaguccacgaagacguucgugccgcugccgguaaaccagauaagauggaggagacucugaccuguaucauuugccaggaccuacuccaugauugugugucucugcagccuugcaugcacacauuuugugcagcuugcuacagcggcuggauggaacgcucaagucuuuguccaaccugcagaugccccguagagaggaucuguaaaaaccacauacugaauaacuugguggaagccuaucucauccaacaucccgacaagucccggagcgaggaagauguccagucuauggacgcgcgaaauaaaauuacgcaggauaugcugcagccuaaggugcgcagaucauucagugacgaggaggggagcuccgaagauuuacuggagcucucugacguugauucggaaagcuccgacaucucacaaccauacguggucugcaggcaguguccggaguaucggcgccaggccgcacagcccccucacugcccagcucccgagggagaaccuggcgccccacaagcucuuggugacgcccccaguacuucugugagccugacaaccgcaguacaggauuacguuuguccguugcaggggucccaugcccuaugcacuuguugcuuucagccuaugccagacagaagggcugagcgugaacaagauccccggguggcgccucagcagugugcagucugccugcagcccuucugucaccucuacuggggcugcacacgaaccggaugcuauggcugucuggccccauuuugcgagcuuaaccugggggacaaguguuuggauggagugcucaauaacaauucauacgaaagcgacauucugaaaaacuauuuagcuacgagaggucugaccuggaagaacaugcuaacagagucucucgucgcccugcaaaggggcguguuccuuuuguccgauuaccgcguuacuggggacaccgugcugugcuauuguugcggacuccggaguuuuagagagcugacauaccaguauaggcagaauaucccugcaagcgaacuucccguagccgucacuucucgcccagauuguuacuggggccgaaacugccggacccaagugaaagcucaccaugccaugaaguucaaucacauaugugagcagacacguuucaaaaacuga

SEQ ID NO: 54351 - RNA, 921 nt, Artificial Sequence
  derived and/or modified sequence opt3 from CHGA__Homo_sapiens__NP_001288619
augagaagcgccgcugugcuggcacuccuucugugcgccggccaggucaccgcguugcccguuaacuccccuaugaauaagggggacacagaggugaugaaauguaucguagaagugauuucugauacuuuaucaaagccaaguccgaugcccgucagccaagagugcuucgaaacgcugaggggagacgagcggauacuauccauccuccgccaccagaaccugcuuaaagaacugcaggauuuggcucuccagggugccaaggagcgagcacaucaacagaaaaagcacucuggcuuugaggacgaacugucggaggugcuggaaaaucagucaagccaggccgagcucaaggggcguagugaggcuuuagcaguugauggagccggcaaaccuggugcugaagaggcccaagacccagaagggaagggagagcaggaacauucccagcagaaagaggaggaagaggaaauggcgguggucccccaaggccuguucagaggcgggaagucuggagagcuugaacaggaggaggaaagguugagcaaagagugggaagauuccaagcgguggucaaagauggaccagcuggcaaaagagcuaaccgccgaaaagcgccucgagggucaagaggaagaggaagauaacagagacaguagcaugaaacugucuuuuagggcucgggccuacggcuuccgcgggccuggaccacagcuucgaagaggcuggaggcccuccucacgggaggauagccuggaggcagguuugccucuccaggugcguggguauccagaagagaagaaagaagaggaaggaagugcuaaucgcagaccggaggaccaggagcuggaaucuuuauccgccauugaggcggaacuggagaagguagcccaccaacuccaggcacuuaggcggggcuga

SEQ ID NO: 54352 - RNA, 2034 nt, Artificial Sequence
  derived and/or modified sequence opt3 from CHGB__Homo_sapiens__NP_001810
augcagcccacccugcuccuuagccuguugggcgccgugggguuagcugcagucaacuccaugccuguugacaauagaaaccacaaugagggaauggugacaaggugcaucauugaaguacugucuaacgcccuaucaaagaguagcgcgccaccgauaacucccgagugucggcaagugcucaaaacgucccgcaaggaugucaaagacaaggaaaccacagagaaugaaaacacuaaauucgaggugcgacugcuucgugauccugcugacgccucugaggcacaugaaucgucaagcagaggugaggccggcgcuccaggggaagaggauauccagggacccaccaaggcagacacagagaagugggccgaaggcggugggcacaguagggagcgggcugaugaaccucaguggucccuguacccaucugacagccagguuuccgaggaagugaaaacccgccauucagagaagagucaaagagaggaugaagaggaagaggaaggagagaauuaucagaaaggcgagaggggcgaagacagcucugaggaaaagcacuuggaggaacccggggagacucagaacgccuuucucaaugagcggaaacaggcguccgcaauuaagaaggaagaacuggucgcccgcucagaaacacaugcugccggacacagccaagagaaaacccacagucgagagaagucuucccaggaaagcggugaggaaacgggcucgcaggagaaccauccucaggaaucuaaagggcaaccaagaucccaggaggagucagaagagggagaagaggaugcaaccagugaaguggacaagaggcggacucguccgcgccaccaucacggcagaagcaggcccgaucgguccucucagggugggagccugccuucagaggagaaaggacacccacaagaagagagugaagaguccaauguaagcauggcuucucucggcgaaaagcgagaccaucacucaacacauuaccgcgccagugaggaggaacccgaguauggcgaagagaucaaaggguacccuggaguucaggcgccagaggacuuagaaugggagagauauaggggucggggcagcgaagaguaccgcgcccccagaccgcaguccgaagagucuugggaugaggaagacaagaggaacuauccuucgcuggagcuugauaagauggcacacggguacggagaagagagcgaagaggagcguggcuuggaacccgguaaagggcggcaucaccgaggcagaggaggcgagccaagggcuuacuucauguccgacacucgcgaagagaagcgguuucugggggaaggacaccauagagugcaggagaaucaaauggauaaagccaggcgccacccucagggugcuuggaaggagcuagaccgaaacuaucucaauuacggcgaagagggggcccccggaaaauggcagcagcaaggcgaucugcaggacaccaaggaaaaccgggaggaggcacguuuccaggauaagcaguauucaagucaucacacagccgagaaaagaaagaggcuuggugagcuguuuaacccauacuaugaccccuugcaauggaaaucuagccacuucgaacgccgggauaauaugaacgacaauuuucucgagggggaagaggagaacgaacugaccuuaaaugagaagaacuucuuuccugaauacaauuaugacuggugggagaaaaagccauucuccgaagaugucaacuggggcuacgagaagagaaaucuggcuagggugccgaaacucgaccuuaagcgacaguacgaucgcguggcgcagcuggaccaguugcuacauuaucggaaaaagucagcagaguuucccgauuucuacgacagcgaggaaccugucucuacgcaccaagaagccgagaacgaaaaagauagagcugaccagacuguucugacagaggaugagaagaaggaacucgagaaucuggccgcaauggaccuugaacugcagaaaauugccgagaaguuuucccaaaggggauga

SEQ ID NO: 54353 - RNA, 987 nt, Artificial Sequence
  derived and/or modified sequence opt3 from CHI3L1__Homo_sapiens__XP_011507410
augggcgugaaggccagccagaccggguucgucguucuggugcuccuucaaugcuguuccgcuuacaaacugguaugcuauuacacaucuuggucacaguauagagagggagacgguaguuguuuucccgaugcauuggacagguucuuaugcacucacaucauuuacagcuuugccaacauauccaaugaucauaucgacacgugggaauggaacgaugugacccuguauggcaugcuaaauacacucaagaaccggaauccuaaccugaaaacucuucugucugucgggggauggaauuucggcucgcagcgcgcggacuuugguccacgauucucaaagauugcuagcaacacccagagucguagaacauuuaucaaauccgugccgcccuucuugaggacccacggguuugauggacucgaccuggccuggcuguacccuggccggcgcgauaagcaacauuucacuacacucauuaaggagaugaaagcagaauuuaucaaggaggcccagccaggcaaaaagcaguuacugcuuucugcugcauugagcgccgggaaaguuaccauagacuccucauaugauaucgcuaagauuagucagcaccuggacuucaucagcauuaugacguacgauuuucauggagccuggagagguacuaccggccaccacucuccccuauucagggggcaagaagacgcguccccugaccgguucucaaauacaaucugugauuuucuccgcggagcaacugugcaucgaauacugggccagcaggucccauacgccaccaaggguaaccagugggugggguaugacgaucaagagagcguaaaaaguaagguucaguaccuuaaagacagacagcuggcuggagccauggugugggcauuggaucucgacgauuuccaaggcucuuuuugcggccaggaccugagguuccccuuaacaaaugcuauuaaggaugcccuggcggccaccuga

SEQ ID NO: 54354 - RNA, 675 nt, Artificial Sequence
  derived and/or modified sequence opt3 from CHIC1__Homo_sapiens__NP_001034929
augagcauccugcuccccaacauggccgaguucgacaccauuuccgaacuugaggaagaggaagaggaggaagcugcaacaucuucaaguagcccuuccucuucgucaagcgugaguggcccagaugacgaugaggaagacgaggaggaagaggaagaggaagaggaggaagaggaagaggaagaggaggaagaggaagaggaagccccgcccccuccaagagucguuuccgaggagcaccugaggcgguacgcgcccgauccuguguugguacgcggggcuggacauauaacuguguuugguuuaucuaauaaguucgacacggaauuuccaagcguccugaccggcaaaguggcccccgaggaguucaagacauccaucgggcgaguuaacgcaugccuaaagaaggcccucccugugaaugucaaauggcugcuuuguggaugccuguguugcuguugcacuuugggcuguucacucuggccagugauuugccugaacaagcguaccagaaggaguauccagaagcugauugaaugggagaauaaccggcucuaucacaaauuagcucugcauuggaaacuuacaaaacgcaagugugaaaccagcaauaugauggaguacguaaucuugauagaauuucugccgaaauaucccaucuucagaccugauuga

SEQ ID NO: 54355 - RNA, 498 nt, Artificial Sequence
  derived and/or modified sequence opt3 from CHIC2__Homo_sapiens__NP_036242
auggccgacuucgaugagaucuacgaagaggaagaggacgaagagagagcucuggaggaacagcuccuuaaguauagccccgauccuguggucguuaggggcuccgggcacgugaccguauuuggacugucuaacaaauucgagucagaauuuccaaguagcuugacagguaagguggcaccggaggaguucaaagccuccauuaaucgggucaacucuugcuuaaagaaaaaucugcccgugaacguucgcuggcuacucuguggcugccuguguugcuguugcacucuuggguguucgauguggccugugauaugccugucaaagcgaacgcguagaagcaucgaaaaguugcucgagugggaaaauaacaggcuguaccauaaacugugucuccacuggcgguuaaguaagcgcaaaugcgagaccaauaacaugauggaauaugucauucugaucgaguuucuuccaaagacacccauuuucagaccugacuga

SEQ ID NO: 54356 - RNA, 1344 nt, Artificial Sequence
  derived and/or modified sequence opt3 from CHIT1__Homo_sapiens__NP_001243054
auggugagaagcgucgccugggcuggcuucaugguucugcucaugauccccuggggguccgcagccaaacuugugugcuacuuuaccaacugggcgcaguauaggcaaggagaggcucgguuccugccuaaggacuuggauccaucuuuauguacacaccugauuuacgccuuugcagguaugacuaaucaucagcuaucaacgaccgaauggaacgacgagacacucuaucaggaguucaauggccugaagaaaauguuuacugauaugguagccaccgcuaacaaucgccagacauucgugaacagugcaauacgauuucuucguaaguacagcuucgacgggcuggauuuggacugggaguauccgggaucccaaggcucucccgccgucgauaaagaaagauuuaccacucucgugcaggaccuggcuaaugccuuccagcaggaggcgcaaacaucggguaaggagaggcugcucuuaucagcagccguuccugcugggcagaccuacguggaugccggauaugaagucgacaagaucgcacagaaccuggauuuugugaaucuuauggcuuacgacuuccacggcagcugggagaaaguaacgggccauaacaguccauuguacaagcggcaggaagaguccggggccgcggccucucugaauguugaugcagcugugcaacaguggcuacagaaaggaacucccgccagcaagcucauucuggguaugccuaccuauggccgcuccuuuacacuugcuucaaguagcgacacuagagucggggccccagcaaccggaucuggcacacccgguccuuucaccaaagaagggggaaugcuggccuacuaugaagugugcuccuggaagggcgcuacgaagcaaaggauccaggaccagaaagugccauacauuuuccgggauaaccagugggucggcuuugacgauguugagucauucaagacuaaagugagcuauuugaagcaaaaagggcucggaggugcgaugguaugggcacuggacuuagaugacuuugccggcuucaguuguaaucaggggcgcuacccgcugauccagacacuccgacaggaacuuucucugcccuauuugccuuccggaaccccagagcuagaagugcccaagccuggccaaccaagcgagcccgagcacgguccgucgccugggcaggauacuuuuugccagggcaaagcugacggacuguaccccaacccaagagaaaggucuuccuucuacucaugugccgcaggccggcucuuucagcaaaguugcccuacagggcuggucuucagcaauuccuguaagugcuguaccuggaacuga

SEQ ID NO: 54357 - RNA, 1320 nt, Artificial Sequence
  derived and/or modified sequence opt3 from CHKA__Homo_sapiens__NP_997634
augaagaccaaauucugcacaggcggggaggccgaacccagcccucugggacuccuucuguccugugguucuggcucagcugcaccagccccgggggugggacagcaaagagacgcggcuagugauuuggagagcaagcaguuaggcggucagcagcccccucuggcccuaccacccccuccaccccucccucugccacuuccgcugccccaaccuccacccccucagccacccgcagacgaacagccggagccuaggacucggcgccgagccuacuuguggugcaaagaauuucuccccggggcuuggcguggacugagagaggaugaguuccacaucuccgucauuaggggcggccugucuaacaugcucuuucaguguucguuaccagacacgaccgcaacacugggggaugaaccucggaagguucuuuugcgccuguauggagccauacuacaaaugggugcugaggccauggugcucgaaucaguaauguucgcgauccuggcagagagaagccuuggccccaaacuguacgggauuuuuccacagggaagguuggagcaguucauccccagucggcgccucgacacugaggaacuguccuuaccugauauuucugccgaaaucgcugagaagauggccaccuuucauggcaugaagaugccauucaauaaagaaccgaaguggcuguuugguacaauggagaaauaucucaaggaggugcuucgaauaaaauucaccgaagagagcagaaucaagaagcugcacaaauugcuauccuacaaccugccccucgaacuggagaaucuuaggucacuguuggaaaguacuccuagcccagucguguuuugccauaacgacugucaggaggggaauauucuccuguuagagggacgggaaaacucugagaagcaaaaacugaugcuaaucgauuucgaauauuccucauacaauuaucguggcuuugacauuggcaaccacuucugcgaguggauguacgauuacagcuaugaaaaguaccccuucuuucgcgcaaauaucagaaaauauccuacaaagaaacagcagcuccauuucauaaguucuuaccugccagcuuuucaaaacgacuucgagaaucuuuccaccgaggaaaagagcauuaucaaggaggaaauguugcuggagguuaacagguuugcccucgcgucgcacuuccugugggggcuuuggucuauugugcaggccaaaaucuccucaaucgaguuuggauauauggauuacgcacaggcucgguucgacgccuauuuucaccagaagcgaaaacugggugucuga

SEQ ID NO: 54358 - RNA, 1188 nt, Artificial Sequence
  derived and/or modified sequence opt3 from CHKB__Homo_sapiens__NP_005189
auggccgcugaagcaaccgccguggcgggcagcggggcugucggagguugccuggccaaggacggccuccagcaauccaaaugucccgauacaacuccuaagagaaggcgggcaucuucacuuagucgcgacgccgaacgacgugcuuaccaguggugcagagaguaucugggaggggcauggaggcggguucagccagaagaguugcgcguguacccgguaagcggcgguuuauccaaccugcuauucagauguucucuccccgaucaucugccuucggugggggaagaaccaagggagguccuucugcgguuguauggagccauccuccagggcguggacucacugguucuggaaagcgugauguuugcuauucucgccgagcgcaguuuaggcccccaacuguacggggucuucccugaaggacgacuugagcaguauauaccauccagacccuugaaaacgcaggagcugagggaaccugugcuaucugcggcaaucgccaccaagauggcucaguuucacgguauggagaugccauucacaaaagaaccgcacuggcucuuuggcacuauggagcgguaccugaagcaaauucaggaucuucccccuaccgggcugccagaaaugaauuugcucgagauguauagccugaaggacgagaugggaaacuuacguaaacugcucgaauccacacccucaccuguaguuuucugccauaaugauauccaggagggcaacauucuucuguugagugaaccagagaaugccgacagccuaaugcugguggauuuugaauacucuuccuacaacuaucgcgguuucgacaucgggaaucacuuuugugagugggucuacgauuauacccaugaggaauggcccuucuacaaggcaagaccgacugacuauccuacacaggagcaacagcuccacuuuauaaggcacuaccuggcugaagccaaaaagggagagacccuuucacaggaggagcaacggaaacuggaggaagauuugcucguggaggugagccgauaugcgcuggccagucauuucuuuuggggcuuauggucuauccugcaggcauccaugagcacgauugaguucggcuaccuagacuacgcucagucgcgcuuccaguuuuauuuccaacagaaggggcagcucacuucuguccacuccucaaguuga

SEQ ID NO: 54359 - RNA, 3516 nt, Artificial Sequence
  derived and/or modified sequence opt3 from CHL1__Homo_sapiens__NP_001240317
auggagccccugcuccuuggcagagggcugaucguguacuugauguucuuacugcuaaaguuuagcaaagccauugaaauaccuuccucuguccagcaaguuccaaccaucauuaagcagucaaaagugcagguagcuuucccguuugacgaguauuuccagaucgaaugcgaggcaaagggaaaccccgaaccuacauuuaguuggacuaaagaugguaauccauucuacuuuacggaccacaggauuauccccagcaacaauuccggcaccuuccggauaccuaacgaggggcauaucucucacuuucaaggaaaguaucgcuguuucgccucgaauaagcucggcauugcgaugucagaggaaaucgaguuuauugugccaagcguccccaaauucccuaaggagaaaaucgauccacuggagguggaggaaggugacccgauaguucuucccugcaacccuccaaaggggcugcccccuuugcauauuuacuggaugaauaucgagcucgaacacauugagcaggaugaacgaguguauaugagucagaaaggagaccuguacuuugcuaacgucgaggagaaggauucccguaaugacuauuguugcuucgccgcauucccaagacugaggacaaucgugcagaagaugcccaugaaacucacuguaaacucuuuaaagcaugccaaugauagcuccucaaguaccgaaaucggcagcaaagcuaacucuauuaagcaacggaaaccgaagcugcuuuugccucccacagaguccggcucagaaagcaguauaaccauccugaaaggggagauucuacuccuggaauguuuugcagagggacuuccaacuccucagguugacuggaauaagaucgguggcgaucugcccaaggggcgcgagacaaaagaaaacuacggaaagaccuugaaaauagagaaugugucuuaccaggacaagggcaacuauagaugcacggccuccaacuuccucgguacugcuacccacgauuuucacgucauuguggaagaaccacccagguggacuaaaaagccucagagcgccguguacucgacagggucuaauggaauccuguuaugugaagcggagggcgagccacaaccgaccaucaaguggcgggucaacggcucccccguugacaaucauccuuucgcaggggacgugguauuuccacgcgaaauuucauucacaaaccugcagcccaaucacaccgccguguaucagugcgaggcuaguaacguccauggaacgauccucgccaaugcaaacauugaugugguugacgugcgaccucuuauacaaacuaaagauggugaaaauuacgcuacagucgugggcuauagcgccuuucugcacugugaguucuuugcguccccagaggccguaguuucuuggcagaagguggaagaggucaaacccuuggaagggagaagguaccacaucuaugagaacggaacccuacagauuaaucggacuacagaagaggacgcaggcagcuacucaugcuggguggagaacgcuaucgguaagaccgccgucacggcuaaucuggauauccguaacgccaccaaacuccgcgugaguccgaagaauccuaggauuccaaagcugcauaugcuugaacugcacugugaguccaaaugcgacagccauuugaagcacucucucaaacugucauggaguaaggauggggaagcauucgagauaaacggcacagaagacggaagaaucauuaucgauggcgccaacuuaacuauuagcaauguuacccuggaggaccaggggaucuacugcuguuccgcucauacagcgcuagauucugcagccgacauaacucaagugaccguacucgacguccccgauccucccgagaaccugcaccuuucggaacggcagaaucgaagcgugcgcuugacaugggaggcuggagccgaccacaacuccaauaucucagaauauauuguugaguuugaagguaacaaagaggagccaggcagaugggaggaacugaccagggugcaggggaagaagacuacggucauccucccucuggcacccuucgugcgguaccaguuucgcguaauugccgugaaugaaguuggaagaagucaaccaucucagccgagcgaucaucacgagacaccucccgcugccccagacaggaacccccagaauauccguguccaggcaucccaaccuaaagagaugauaauuaagugggaaccacuuaaaucaauggagcagaacggccccggucuggaauaucgggugaccuggaagccucagggggcgccgguggagugggaagaggagacugucaccaaucauacauugcgaguuaugaccccagcuguguacgcccccuaugaugugaaaguacaggcaaucaaccaacucggcagcggaccugacccacagucugucacucuguacuccggcgaagauuaucccgacacagccccugugauucacgggguugaugugaucaauaguacguuagucaaggugaccuggagcacuguuccgaaagacagagugcacggaaggcugaaggguuaccagauaaacugguggaagacaaaaucucuacucgauggccgcacccaucccaaggagguaaauauccugcgguucuccgggcaaagaaacucaggaauggucccaagucuugacgcuuucagcgaauuucacuugacagugcuggccuacaacucgaaaggcgcagguccugaguccgaacccuauauuuuccagacuccagagggggugccugagcagcccaccuuucucaaggucaucaaaguugauaaggacacggcuacccugucuuggggcuuaccaaagaaacugaauggaaaccuuacaggcuacuugcuccaguaucaaauuaucaaugacacuuacgaaauaggggagcugaacgauauuaauaucaccacaccgagcaagccuucauggcaucuaaguaaccugaaugccacuaccaaauauaaguucuaccucagggcgugcacgucccagggauguggcaaacccaucacagaagagucuagcacccugggugaagggaaguaugccggacuuuacgacgauauuuccacucagggcugguuuaucgguuugaugugcgcuauugcacuguuaacacuccugcuucugaccguguguuucguaaagcgcaaccgaggcgggaaauacucagugaaggagaaagaggacuugcacccagaucccgaaauacagagcgucaaggacgagacuuuuggagaauauagugauucugacgagaaaccucucaagggcucccugcggagccuaaaucgugauaugcaaccaaccgagucggccgacucacugguggaauacggggagggagaucauggccucuucucugaagacgguaguuuuaucggggcuuaugccggauccaaggagaaaggcagcguugaaucuaacgguagcuccacagcaacguucccccugagagcguga

SEQ ID NO: 54360 - RNA, 1962 nt, Artificial Sequence
  derived and/or modified sequence opt3 from CHM__Homo_sapiens__NP_000381
auggccgacacccugcccagcgaguucgaugugaucgucauuggcacagggcucccugaauccauaaucgcugcagccugcucuagaucaggaaggcggguucuucacguggacagucgcagcuacuaugguggcaacugggcguccuuuucuuucucggggcuguugucaugguuaaaggaguaccaggaaaauagcgauauuguaagugacuccccaguguggcaagaucagauccuggagaacgaagaggcuauugcccuaucucgaaaagacaagacuauccagcaugucgagguguuuuguuaugcaagccaggaucuccacgaagacguugaggaagccggagcucugcagaaaaaucaugcacuugugacguccgccaacucaaccgaggcugccgauagugcguuccugccgacagaggacgagagcuugucuacuauguccugcgaaaugcucaccgaacaaacacccucaagcgauccugagaaugcacuggaagucaacggcgccgaggugaccggugagaaggaaaaucacugugacgauaaaacuugcguaccaaguacaucugcugaggacauguccgaaaacguucccauagccgaggacaccacggaacagccuaagaagaaucguaucacuuacagccagauuaucaaagaggggagaagguuuaacauugaucuggugucgaagcucuuauauucucggggacugcuuaucgacuugcugauaaaauccaaugucucacgcuacgcagaguucaagaacauuaccagaauccuagcuuuuagggaaggccggguggagcaagugccauguagucgcgccgaugucuucaauagcaaacagcucacaaugguugaaaagcgaaugcugaugaaguuucuuacuuucugcauggaguaugaaaaauaccccgacgaguacaagggcuaugaggaaauuaccuuuuacgaguaucugaaaacacagaaguugaccccuaaccuccaguacaucgugaugcauuccaucgcgaugacgucugaaacugccagcucaacaauugaugggcugaaagcaaccaagaauuucuuacacugucugggaagauaugguaacacuccauuucucuucccgcuuuacggccaaggggagcugccccagugcuucuguaggaugugcgcuguauuuggaggcauauauuguuugcggcacagugugcagugccuagucguggacaaagagucccguaagugcaaggccaucauugaucaauucggucagcgcaucauaagcgaacauuuucugguugaggacucuuacuucccugaaaacauguguucaagagugcaguacaggcagauuagucgggcuguccucaucacagaucgaagcgugcugaaaaccgacuccgaucaacagaucucuauucuuacgguaccagccgaggaacccgggaccuuugcaguucgcgugaucgagcugugcucgagcacaaugacuuguaugaagggaaccuauuugguccaccucacaugcacuuccucaaaaaccgccagagaggaccuggaaagugugguccagaaguuauucgugccuuacacagagauggaaauugagaaugaacagguugagaaaccaaggauacugugggcucuauauuuuaacaugcgggacucuagcgauaucucccgcucauguuacaaugaccuccccagcaacguguauguaugcucuggcccggauuguggccuggggaaugacaacgcggucaagcaagcagagacccuuuuccaggaaauuugcccuaaugaggauuuuugucccccaccucccaacccagaagacaucaucuuggauggagacucccugcagcccgaggccagugaaagcucugcuauuccugaggccaauuccgagacuuucaaggaaucaacgaaccucgguaaucuggaggaaaguagcgaguga

SEQ ID NO: 54361 - RNA, 1971 nt, Artificial Sequence
  derived and/or modified sequence opt3 from CHML__Homo_sapiens__NP_001812
auggccgacaaccugcccaccgaguucgauguggucaucauuggcacagggcucccugaaagcauacuugcugcagccugcuccagaucuggacagaggguucugcacaucgacucacggaguuacuaugguggcaauugggcgagcuuuuccuucucuggguuguuaucguggcugaaggaguaccaacagaacaaugauauuggagaagagucaacugugguauggcaggaccuaauccacgaaacggaggaggcuauuacccuccgcaaaaaggaugaaacaauccagcacacugaggccuuuugcuaugcaagccaagacauggaagauaacguggaggagauaggcgcccugcagaaaaauccaagucuuggugucuccaacaccuucacagaagugcuggacucugcuuugccggaggaaagccagcucuccuacuuuaauucagaugagaugcccgcaaagcauacccagaaaagugacacugaaaucagccuggagguuacagauguggaggaaucugucgagaaggaaaaguauugcggggacaaaaccuguaugcacacgguguccgauaaggacggagacaaagaugagucaaagagcacuguagaagacaaagccgaugagccuauucgaaaccguaucaccuacagucaaauuguuaaggagggcagaagguucaauaucgaccuggugucuaagcucuuauauucccagggccugcuuauagauuugcugauuaaaagcgacgucucgcgguacguggaauuuaagaacgugacacgcauccuagcuuucagagaggggaaagucgaacagguuccaugcucuagggccgauguguuuaauuccaaggagcucacuaugguagaaaaacggaugcugaugaaguuccuuaccuuuugucuggaguacgagcagcaucccgacgaauaucaagcguuccgccagugcucauuuagugaguacuugaaaacaaagaagcucaccccuaaccugcagcacuucguguuacacagcauugcaaugacguccgaaucuagcuguacuacaaucgauggacugaaugccaccaaaaacuuccuccaaugccuuggucgauuuggcaauacuccauuccuguuucccuuguaugggcagggagagaucccucagggcuucuguagaaugugcgcugucuuuggugggauuuacugucuaaggcauaaggugcagugcuucguuguggacaaagagucaggacggugcaaggccauaaucgaucacuuuggccaacguauuaacgcaaaauauuucaucgucgaagacaguuaccuguccgaggaaacauguagcaacgugcaguauaagcagauaucucgcgcuguacucauuaccgaccagucaauccugaagacggaucuugaccaacagaccaguauccugauuguuccaccggccgagcccggcgcgugcgccgugagagucacagaauuguguagcuccacuaugaccugcaugaaagauacauaccucgugcaucugacuuguucuucgagcaagaccgcaagggaggacuuagaguccgucgugaaaaagcuguuuacaccuuacaccgaaacugagaucaaugaagaggaacuaacgaaaccacggcuccugugggcucuuuauuucaacaugcgagauucaagugggauuucucgcagcuccuacaauggauugcccucaaacguuuaugugugcagcgguccugacuguggccuggggaaugagcacgccguaaagcaggcugagacacucuuucaggaaauauucccaaccgaggaauuuugucccccgccucccaacccagaggauaucauuuucgacggagaugacaagcaaccugaagcccccggcacuaauaacgucgugauggcaaaacuggagucuuccgaggaaaguaagaaucuugagagcccagaaaaacaucugcagaacuga

SEQ ID NO: 54362 - RNA, 723 nt, Artificial Sequence
  derived and/or modified sequence opt3 from CHMP1A__Homo_sapiens__NP_001076783
auggacgugcacggcgaggccgcuggggaagcaggacaggaggguggcgaagggcugcaaggaggcgccggucagucagaggaagggcccuccgcggagaagugcagagucuguccuugcguuuguagggagcggcauccacaggaggagcgccgaugcgaacucgcuucugauggagugccgcguagaaggucaggccuucagggcgccgacaguugugauuacgaagggggagaccaagaguauggucccggcgaucagagcccugggcagggaccagaacaccauggccccgcagagggucuguuguccgacgggcagguacgggccgcuggagcagaaccuggccgcccauacaucggcgaugggggauuacacgagcugggucaucaccccgaccacgccgcuggcgccgggggacaaccucaucacgcggauagaaggggcgaauggccagguggggcaggcccggcccagcccgcugcccggggacgccuaugccgaggcagagagcucugugcacagccugggggaccagcugugaccgaggucgguaggcuggaggaacuugccgugccccggcguugcgcgccuccacugccccgcgacguuuuggaaggcucuuguccgcucccuacagccucgugccugugugcagaucccgcugggcugagaccagccgcuacucucagguuaagcccugcccggcccgcauggccauga

SEQ ID NO: 54363 - RNA, 600 nt, Artificial Sequence
  derived and/or modified sequence opt3 from CHMP1B__Homo_sapiens__NP_065145
augagcaacauggagaagcaccuguucaaucucaaauuugccgcuaaggaacuuuccagaucugccaaaaagugcgacaaagaggaaaaggcagagaaggcgaaaaucaagaaagcuauucagaagggcaacauggaaguggccaggauacaugcagagaaugccauccggcagaaaaaccaagcugucaauuuccugcgcaugucagcacgaguugaugccguggcugcccguguacagaccgcggugacaauggggaaggucacuaagaguauggcaggagugguuaaaagcauggacgccacguugaagaccaugaacuuagagaaaauuuccgcucugauggauaaguuugaacaccaguucgagacacuagacgugcaaacucagcagauggaagauaccaugucuucgacaaccacucucacaacgccccagaaucaagucgacaugcugcuucaggagauggccgaugaggcaggucuggacuugaacauggaacucccucagggccagaccgggucagugggaacuagcguagcuagugccgagcaagaugaacugucccagagacuggcgaggcuccgggaccagguuuga

SEQ ID NO: 54364 - RNA, 519 nt, Artificial Sequence
  derived and/or modified sequence opt3 from CHMP2B__Homo_sapiens__NP_001231573
auggagcuggaaaucaagaaaauggccaagauuggcaacaaagaggcuugcaaggugcucgcaaaacagcuuguccaccugagaaagcaaaagaccaggacauucgccguuagcuccaaagugacuucuaugucaacgcagaccaagguaaugaauagucagaugaaaauggcgggggcuaugagcacaacugccaagaccaugcaggcagugaacaaaaagauggacccccaaaagacauugcagaccaugcagaauuuucagaaagaaaacaugaagauggagaugacugaagagaugauaaaugauacauuagacgauaucuucgacggauccgaugacgaggaagagucucaagauauugucaaccaggugcuggacgaaaucgguauugagaucucgggcaaaauggccaaggcuccuucagcagcccggagccuaccaagugcuuccaccucuaaagccacgauaagcgaugaggaaaucgagcgccagcucaaggcgcuggggguugacuga

SEQ ID NO: 54365 - RNA, 471 nt, Artificial Sequence
  derived and/or modified sequence opt3 from CHMP3__Homo_sapiens__NP_001005753
augaucagaagcaggaaggccguguccaaacuguacgcuucuaaggcacacaugaacucaguccucaugggcaugaaaaaucagcuugccguucugcggguggcggggaguuugcaaaagagcaccgagguaaugaaagcuaugcaguccuuagugaagauucccgaaauacaggccacaaugcgcgagcugucuaaggaaaugaugaaagcaggaaucauugaggaaaugcuagaggacacuuucgagucgauggaugaccaggaagagauggaagaggaggccgaaauggagaucgaucguauucucuuugaaaucacggcuggugcacugggcaaggccccuucaaaagucaccgacgcccuuccagagccggaacccccuggggcuauggcggcaagcgaggaugaggaagaggaagaggaagcccuggaggcuaugcaaagucgauuggccacacucagauccuga

SEQ ID NO: 54366 - RNA, 798 nt, Artificial Sequence
  derived and/or modified sequence opt3 from CHMP4A__Homo_sapiens__NP_054888
augagcagaaggcggcccgaggacggccuggggaaggccggaccuugcgugaugcgccaccauccaccgcgauccaaagcugaagucuggcguacccucagagguggcgggggaaggggcgagcuugcaaugucuggucuggggcgguuguucggaaagggcaaaaaggaaaaaggccccacaccugaggaagccauccagaaguuaaaggagacugagaaaauucugauaaagaaacaagaauuucuagagcagaagauccagcaggaacuccaaacggcgaaaaaguacgggaccaagaacaaacgcgcugcccugcaggcacuuagaaggaagaaacgguucgagcagcagcuggcccaaacagauggaacuuugucaacccucgaguuucagcgcgaagcuauugagaaugcaacaaccaacgccgaaguucugcgaacuauggagcuggcugcccagaguaugaagaaagcguaucaggacauggauaucgacaagguggaugaacucaugacagacauuaccgagcaacaggagguagcacagcaaaucagcgaugccauauccagaccaauggguuucggcgacgauguggacgaagaugaguuacuggaagaacuugaagaguuggagcaggaggagcuggcucaggaacuacucaaugucggggacaaagaggaggaacccucugugaagcugccuucgguuccaucaacgcaccuucccgccggaccugcaccaaagguggaugaggacgaagaggcucugaaacaguuggccgaaugggucagcuga

SEQ ID NO: 54367 - RNA, 675 nt, Artificial Sequence
  derived and/or modified sequence opt3 from CHMP4B__Homo_sapiens__NP_789782
augagcguguucggcaagcuguuuggggccggagguggcaaagcugggaagggaggccccaccccucaggaggcaauccaaagacucagggacacagaagagaugcuuuccaaaaagcaggaguuccuggagaaaaagauugaacaggaguugacugccgcgaagaaacacgguacgaagaacaaacgggcugccuuacaggcacugaagcgcaaaaagcgauacgagaagcaacuagcccagauagaugggacccucucuacaaucgaauuucagcgugaggcucuggaaaaugcaaacacuaauaccgagguccuuaaaaacaugggauaugccgcuaaggccaugaaagcggcacaugacaauauggauauugacaagguugaugagcugaugcaggacaucgccgaucaacaggaauuggcugaggaaauuucaacagccaucaguaaaccagugggcuucggcgaggaauuugacgaggaugagcucauggcagaacuggaggaacuggagcaggaagaacucgacaagaacuuacuggagauaagcgggccggaaaccguaccccuuccuaaugugccauccaucgcuuugcccucuaaaccugccaagaagaaagaggaagaggaugacgauaugaaggaacuggagaacugggcgggaucgauguga

SEQ ID NO: 54368 - RNA, 702 nt, Artificial Sequence
  derived and/or modified sequence opt3 from CHMP4C__Homo_sapiens__NP_689497
augagcaagcugggcaaauucuuuaaagggggagguuccucuaaaucaagagccgcucccaguccucaggaggcacucgugaggcuucgggaaaccgaggaaaugcugggcaagaaacaagaguacuuggaaaaccgcauccagcgagagauugccuuagcgaagaagcacgggacacagaauaaacgugcugcccugcaggcacuaaagagaaagaagagguucgagaaacaacucacucagauagacggaacgcugagcaccaucgaauuucagcgggaggcccuugaaaacucccauacaaauacugagguccugcgcaacaugggcuucgcugcaaaggccaugaagucuguucacgagaauauggauuugaacaaaauugacgaucucaugcaggaaaucaccgagcaacaggacauugcucaggaaaucucggaggccuuuucacagagaguggguuucggggaugacuuugaugaagacgagcugauggcggagcuggaggaacucgaacaagaggaauuaaauaagaaaaugacaaacauaaggcugccaaauguaccgagcaguucccuucccgcacagccuaaccggaagccaggaaugucuagcaccgcccgccgauccagagcugccucaagucagagggcagaggaggaagaugacgauaucaaacaauuggcugccugggcgacuuga

SEQ ID NO: 54369 - RNA, 516 nt, Artificial Sequence
  derived and/or modified sequence opt3 from CHMP5__Homo_sapiens__NP_001182465
augaacagacuguucggcaaggccaaacccaaggcuccuccaccgagccucaccgacugcaucgggacaguggauuccagggcagagucuauugacaaaaagauaucacggcuugaugccgaacuggucaaauacaaggaccagaucaagaaaaugcgcgagggacccgcgaagaauaugguuaaacaaaaggcuuugcgaguguuaaaacagaagcguauguaugaacagcagagagauaaccuggcccaacagaguuuuaauauggagcaggcaaacuacacuauucagagccuaaaggacacgaaaaccacaguagaugccaugaagcucggugugaaagaaaugaagaaggcuuauaaacaagucaaaaucgaccagauugaggaucugcaggaccagcuugaggauaugauggaagacgcaaaugagauccaagaagcccuguccaggucuuacggcacuccugaguuggaugaggacgaccucgaagcuggguggucgucaggaggcuga

SEQ ID NO: 54370 - RNA, 1302 nt, Artificial Sequence
  derived and/or modified sequence opt3 from CHN1__Homo_sapiens__NP_001020372
auggcccugacccucuucgacacagaugaguacagacccccuguguggaaaagcuaucuuuaccagcugcaacaggaagcuccacacccgaggcggaucacuugcacgugugaggucgaaaaccgccccaaauauuacggccgagaguuucaugggaugauuucccgugaagcagccgaccaguuguuaauaguugcggagggaucuuaucugaucagagagucacagaggcaaccugguaccuacacacuagcucuccgguucggcagucagacucgcaauuuuagacuguauuacgaugggaagcacuucgugggagaaaagagguuugagagcauucaugaccuuguaaccgauggccugaucacauuguacauugaaaccaaggccgcagaguauaucgccaaaaugacuauaaacccaaucuacgagcacguggguuauacaacccucaaucgggaacccgcuuacaagaagcauaugccuguccugaaagagacgcacgacgaacgcgauuccacugggcaggacggagugucugagaagcgaguucacaccuucagaggcccacauuggugcgaauauugugcaaacuuuauguggggccugauugcccagggggugaaaugcgcugauuguggacucaauguccacaagcaaugcucgaaaauggugcccaacgacuguaagccugauuuaaagcauguuaaaaagguauacucaugcgaccugacaacucuugugaaagcccacaccacaaagaggccaauggucguggauauguguauccgggagauugagagccgugguuugaauagugaaggccuguaucgcguguccggguucucugaccuaaucgaggacgucaaaauggcguuugauagagacggagaaaaggcagauauaagcguuaacauguacgaggacauuaauaucauuaccggcgcccucaaacuguacuucagggaucuuccgaucccccugaucacguaugacgcuuacccuaaguuuauugaauccgccaagauaauggauccagacgagcaguuggagacucuccacgaagcacugaaauuacugcccccugcucauugcgagacacuccgguaucuuauggcccaccugaagcgagugaccuugcaugaaaaagagaaccuaaugaaugcggaaaaccuggguaucguauucgggccaacucucaugcgcucacccgagcuggaugccauggcagcucuuaaugacauuagauaccagaggcugguggucgaguugcucaucaagaacgaagauauacuguuuuga

SEQ ID NO: 54371 - RNA, 999 nt, Artificial Sequence
  derived and/or modified sequence opt3 from CHN2__Homo_sapiens__NP_001035025
auguucagcgaggaacuguggcucgagaacgaaaagaaaugcgccguggugagaaaguccaaacagggcaggaagcggcaagagcuucuggcuguugcauuuggggugaaaguaggagugaaggguggcuucuuguggcccccuuuaaagcuguuugccuguucucagaucucaagucuaguccgccgagcggcucucacccacaaugacaaccauuucaauuacgagaaaacacacaacuuuaaggugcauacuuuccgugggccacacuggugcgaauauugugccaauuuuauguggggacugauugcacagggcguuagaugcagcgauuguggucuuaacgugcauaaacagugcuccaagcacgucccgaaugacugucaacccgaucugaaaaggauaaagaagguguacugcugugacuugacgacccucguaaaagcccacaacacacagcggccuaugguuguggauaucugcauucgcgagaucgaagcuagagggcugaagucugagggacuguauagggucucgggcuucacugaacauauugaggacgugaaaauggcauuugaucgggacggcgagaaggccgauaucucagcuaauguguacccagacauaaacaucauuaccggggcccucaaauuauauuuccgcgaucugcccaucccugucauuacauacgacaccuauagcaaguuuaucgaugcggcaaaaauaaguaaugccgacgaacgacuugaggcuguucacgaaguguugaugcugcuaccacccgcccauuacgagacucucagauaccugaugauucaccuuaagaagguaacaaugaacgaaaaagacaauuucaugaacgcagagaaucugggaaucguguuugguccuaccuugaugaggccaccggaggauuccacgcucacuacccugcacgacaugcgguaucagaaguuaauuguccagauccugaucgaaaacgaggauguccucuucuga

SEQ ID NO: 54372 - RNA, 765 nt, Artificial Sequence
  derived and/or modified sequence opt3 from CHODL__Homo_sapiens__NP_001191103
augaccgccggcagcgcucacucccagaaggugugcuucgcagacuuuaaacaucccuguuacaagauggccuauuuccacgagcugucuucaagagucaguuuucaagaagcgaggcucgcuugcgagagcgaagggggaguucuucuguccuuggagaacgaagccgagcagaaauuaaucgagucuaugcugcagaaucuaacaaagccugguacuggcauuucggauggggacuucuggauaggacucuggcggaacggcgauggucagacgucaggggcauguccagaccuguaccaauggagcgauggaaguaauucccaguaucgcaacugguacaccgacgaaccgucuugcggcagcgagaaaugugugguaauguaucaucagcccacagccaauccuggccuugggggaccauaccuguaucaguggaacgaugaccgaugcaauaugaagcacaacuacaucuguaaguacgaacccgagauuaauccuacugcuccaguggagaaacccuauuugaccaaccaaccuggugauacacaucagaaugucgugguuaccgaagcaggcaucauuccaaaccucaucuacguggucauaccgacuaucccccugcugcucuuaauucugguggccuuugggacaugcuguuuccagaugcuucacaaguccaaaggacguaccaagacgucaccuaaucagaguacuuuguggaucagcaaaucuaccagaaaggaguccggcauggaaguauga

SEQ ID NO: 54373 - RNA, 942 nt, Artificial Sequence
  derived and/or modified sequence opt3 from CHORDC1__Homo_sapiens__NP_001137545
auggcccugcucugcuacaacagaggcugugggcagagguucgaccccgagaccaauagcgaugacgcuugcacauaucacccuggagugccagucuuucaugaugcacuuaaggguuguacuaaaggccggcacaacuccgaaaagccgcccgagccuguuaaaccagaagugaagacgaccgagaaaaaggaacugugcgaguugaagcccaaauuccaagagcauaucauucaggccccuaagccaguagaagcgauaaaacgccccucuccugacgagccaaugacaaauuuagaacugaagaucucagcuagucuaaaacaggcccucgauaagcugaaacuuagcuccgggaacgaggagaauaaaaaggaagaggacaacgaugaaauuaaaaucggaacuucuuguaagaauggcgguugcucgaaaaccuaccaggggcuggagucauuggaagaggugugugucuaucacagcggagugccgauuuuucaugagggcaugaaguacuggaguugcugucgacguaaaacauccgacuucaacaccuuucucgcacaagaaggcugcacuaaggggaagcacauguggacaaagaaggaugccgguaaaaagguugugcccuguagacacgacuggcaucagaccggaggcgaggucacgaucucuguguaugcuaaaaauagccugccugaacuguccaggguagaggcaaacucaacucucuuaaauguucacauaguguucgaaggggagaaggaguuugaucagaacgucaagcuguggggagugaucgacgugaaacggaguuacgucaccaugacagccacuaagauugaaaucaccaugcgcaaagcugagccaaugcagugggccagccuugaauugcccgcggcaaagaaacaagagaagcagaaggaugccacaaccgacuga

SEQ ID NO: 54374 - RNA, 588 nt, Artificial Sequence
  derived and/or modified sequence opt3 from CHP1__Homo_sapiens__NP_009167
augggcagcagagccuccacccugcucagggacgaggaacuugaggaaaucaagaaagagacaggguucucucacucacagauuacucggcuguacagucgcuuuacgagcuuggauaagggagaaaacgguaccuuaucccgagaggacuuccaacguauacccgagcuggcuaucaauccucuaggcgauagaauuaucaacgcauuuuucccagaaggggaggaccaggugaauuuuaggggauucaugcggacacucgcccauuuucgcccgauugaagauaacgagaaaucuaaggacgucaauggccccgagccucugaacucgagaucaaauaaacuucacuucgcguuuaggcuguaugauuuggacaaggaugaaaagaucagccgggacgagcuccugcagguucugcgcaugaugguggguguaaacauaagugaugaacagcucggguccaucgcugaccgaacuauucaagaggccgaucaggacggagacucugcaaucagcuucaccgaauuugugaaagucuuagagaagguggauguugagcagaaaauguccauuagauuccugcauuga

SEQ ID NO: 54375 - RNA, 591 nt, Artificial Sequence
  derived and/or modified sequence opt3 from CHP2__Homo_sapiens__NP_071380
augggcagcagauccucucacgccgcugugauccccgacggggauucaauuaggcgggagaccggauucagucaggcaagccugcuccgccuucaucaccgauuucgugcccuggacagaaacaagaaagguuacuuguccaggauggauuuacaacagauaggcgcgcuggcugucaauccucuaggggaccggaucauugaaucuuucuuuccagauggaucgcagcgcguugacuucccgggcuuugugagaguacucgcccauuucaggcccguggaggaugaagacacagagacucaggauccuaagaaaccagaaccccugaacucacggcgcaauaaacuucacuaugcauuucaacuguacgacuuggaucgagacgguaagaucagcagacaugagaugcuccagguccugaggcugaugguggggguucaggugacggaggaacagcucgagaacauugccgaucggaccguccaagaagcugacgaggacggagauggcgcagugaguuucguagaguuuacaaaguccuuagaaaagauggacguugagcagaaaaugucuauccguauacugaaguga

SEQ ID NO: 54376 - RNA, 2328 nt, Artificial Sequence
  derived and/or modified sequence opt3 from CHPF__Homo_sapiens__NP_078812
augagagccagccugcuccuuuccgugcugaggcccgcuggcccugucgcaguugggaucucuuugggauucaccuuaucacugcuaagugugacauggguagaggaaccaugcgguccggggcccccucagccaggcgacagcgagcugcccccucggggaaacacuaaugccgcgcgccgaccaaacuccgugcaacccggcgcugaacgugagaagccuggugccggggaaggagcaggcgagaauugggagccaagaguccucccguaccaccccgcccagccuggccaggcugcuaaaaaggccgugaggacgcgguauauuucuaccgaacuugggauacgccagagacuguugguugcugugcucacaucgcaaacuacccugccaacacugggagucgccgugaacaggacccucggucaucgguuagagcgcguaguuuuucugacuggcgcgcgagggagaagggcacccccuggaauggccguggucacacuuggcgaggagcggccaaucggucacuugcaucuggcucuacgucaccuccuggagcagcauggggaugacuucgauugguuuuuccuugugcccgacaccacguacacugaagcccacggacuggcacgcuugaccggccaccucucacuggcuagcgccgcgcauuuauaucugggcagaccgcaggauuuuauugggggagagccuacacccgguagguacugucacggcggguucggagugcuccuuagucggaugcuguugcagcaacuacgaccacaucuggaaggcugccgcaaugacaucgucuccgccagaccugaugaguggcucgguagguguauucuggacgcaacugggguuggcugcaccggagaucacgaaggcgugcacuauucucaucuugagcugagccccggggagccaguacaggaaggagacccccacuuucgguccgcuuugacagcccauccugugcgcgauccaguccacauguaccagcuccauaaagcauucgccagagcagagcuggaaaggaccuaucaggagauccaagaauuacagugggagauacagaacacgucacaccuggccguggacggugaucgugcugcggcauggccgguuggcauccccgccccuagucggccagcuagccgauuugaggugcuaagaugggacuacuucacugaacaacacgccuuuucuugugcagacgggucccccaggugcccucuccgcggagccgaucgggcugacgucgccgaugugcugggcacagcacuugaggaauugaauagaagguaccauccagcgcugcgccuccagaagcagcagcugguaaacgguuaucgacgguucgaccccgcucgugggauggaguacacccuugaucugcaauuggaagcccucacuccgcagggcggaagaaggccucugacacgccggguucaguuacugagaccacuaucaaggguggagauucuccccgucccuuaugugaccgaggcaagccgacugacgguccuuuugccccuggccgcugccgaacgcgaccucgcaccaggcuuucuggaggcuuucgccaccgcggccuuagaaccuggggaugcugcagccgcucugacacuuuugcuccuguacgagccccggcaggcccaaagaguggcacacgcggacguuuucgccccagugaaagcucauguagccgagcuagaaaggcguuuuccgggagcacgcgucccuuggcugagugugcagacugcugcccccucuccacuccggcugauggaucuuuuguccaagaagcacccccuggacaccuuauuccuccuggcagguccugauacaguucuuacuccagacuuucugaauagauguaggaugcacgccaucagcggcuggcaggcuuucuuucccaugcauuuccaggcguuucacccugccguggcaccgccacaagggcccggaccuccagaguugggccgagacaccggucgguucgaucgccaggcugccucggaagccugcuuuuauaacucugacuacgucgcugcaagagggaggcucgccgcggcuuccgagcaggaagaggagcugcuagaaucacuggauguguaugaacucuuccugcauuuuaguagccuucacguauugcgggccguggaacccgcacuguuacagcgauacagagcccaaacauguuccgcucgccucucugaggaccuguaccauaggugccuucagagcguucuggaaggccuaggaucacguacccagcucgcaaugcuguuguucgagcaagagcagggcaauaguacuuga

SEQ ID NO: 54377 - RNA, 1221 nt, Artificial Sequence
  derived and/or modified sequence opt3 from CHPT1__Homo_sapiens__NP_064629
auggccgcuggcgcaggggccggaagcgcgcccagauggcugagggcucucuccgagccucuuucugccgcacagcugcggcgcuuggaggaacaccgauacucagccgcuggugugaguuuacuggaaccaccgcuacaacucuauuggaccuggcugcuucaguggaucccccuguggauggcaccuaacagcauuacauugcucggccuggccgucaauguugugacuacgcugguacucauauccuacugcccaaccgcuacagaggaagcccccuauuggacuuacuuacugugugcgcuuggguuguucaucuaucagucucuggacgcaauugauggaaagcaggcccguagaaccaacucgugcucaccucuaggcgagcucuuugaccaugguugugauagccugaguacaguguucauggcugucggggccuccaucgcagcuaggcuuggaaccuacccagacugguuuuucuuuugcucuuucauuggcauguuuguguucuauugugcccacuggcaaacuuacguuagcggcaugcugcgguuugggaaaguggaugucacagagauccagauagcguuggugaucguauucguucucuccgccuuuggaggugcaaccaugugggacuacacgauucccauccuggaaauuaaguuaaaaauccugccugugcucggcuuccuugggggagucauauuuucaugcaguaauuauuuccaugugauucugcacggcgguguggggaagaacggaagcacuaucgcuggcaccucugucuuguccccaggccuacauauugggcugaucaucauucucgccauaaugaucuacaaaaagucagcuacagauguuuucgagaagcacccgugucuguauauucuuauguuuggaugcguguucgccaaaguaagccagaagcugguggucgcacacaugacuaaaagugaauuguaccuccaggacaccguguuucugggucccggcuuacuguuccuagaucaauauuuuaauaacuucaucgacgaguacguugugcucuggauggccauggucauaucuuccuuugauauggugauuuauuucagcgcucugugucuucagaucucgcgccauuugcaccugaauaucuuuaagacagcgugccaucaggcaccugagcagguacaaguucucucuuccaaaucacaccagaacaauauggacuga

SEQ ID NO: 54378 - RNA, 396 nt, Artificial Sequence
  derived and/or modified sequence opt3 from CHRAC1__Homo_sapiens__NP_059140
auggccgacguggucguuggcaaggauaaagggggagagcagagacugaucagccucccccuuuccaggauucgggugauaaugaagucuucaccugaaguaaguagcaucaaccaagaggcucugguguugaccgcaaaagccacagaauuauucguccagugccuggcgacuuacuccuaucgccacgguucuggcaaggagaaaaaggugcuaacguacucggaccucgcuaauaccgcccagcagucagaaacauuucaauuccuggcagauauucuuccaaagaaaauccuggccagcaaguauuugaaaaugcucaaggaggagaaacgagaagaggacgaagagaacgauaaugacaacgagagugaucaugacgaagcugauuccuga

SEQ ID NO: 54379 - RNA, 2865 nt, Artificial Sequence
  derived and/or modified sequence opt3 from CHRD__Homo_sapiens__NP_001291401
augcccagccugccugccccaccggcuccccuccuucuguugggcuuacugcuacucggguccagaccugcaaggggagccgguccagagcccccugugcugccaauccggucugaaaaggagccccuuccuguccgcggcgcggcugggugcaccuucggaggcaaaguuuacgcccuggacgaaacauggcacccagauuugggugagccguuuggggugaugcgauguguacucugcgcaugugaagcaccccaguggggacguagaacuaggggcccuggccgggugucaugcaagaacauuaaaccagagugucccacgccugcuugcgggcaaccacgccagcugcccggacauuguugccagaccuguccgcaggagagaaguagcuccgaaaggcaaccuucuggucugucguucgaguauccccgggacccagaacaccgcucauacagcgaucgaggcgagccuggggcagaggaaagagccaggggagacggccauacagauuuugucgcucucuuaacugguccccggagucaggccguggcgcgugcacgcguuucccugcuuagaucuagcuugagguucuccauaucauaucggcgacuggaccgcccaaccagaaucagguuuagugauagcaaugggucugugcuauucgagcaccccgccgcuccuacacaggacggacucgucugcggcguguggcgggccguaccacgccugucccuuagacuguugagggcagaacagcuccauguugcucuggugaccuuaacucacccgucaggcgaggucugggggccccugauucgucaccgggcccucgcggccgaaacauuuagcgcaauccuuacccuggagggaccuccacaacagggugugggcgggauuacguugcuaacucugagugauaccgaggacucucuccauuuccugcuucuguuucgaggauugcucgaacccagauccggcggucugacacaggugccuuuaaggcugcagauccuacaccaagggcagcuccugcgcgagcuucaggcuaacgucagcgcccaagaaccaggcuucgcugagguuuugcccaaucugacugugcaggaaauggauuggcucguacugggagagcuucagauggcccuggagugggcaggccggccgggguugagaauaucgggacauaucgccgcuaggaagucuugugacgugcuccaguccguccugugcggugcggaugcauuaauuccugugcaaaccggcgccgcugggucagccagucugacacuacucggaaacggcagccugaucuaccagguucagguggucgguaccuccucugaagugguagcaaugacgcuugagacuaaaccacagcgccgagaccaacggacaguuuugugccacauggccgggcugcagcccggcggacacaccgcugugggcauuuguccugggcucggagcccguggugcacauaugcuguuacagaaugaacuguuucuuaacgucggcacuaaggacuuccccgauggggaguugagaggacacguggcggcucucccauauugcggccauagcgccaggcacgacacacugccugucccccuagccggugcccuggugcucccaccgguuaagucacaggcugccgggcaugcauggcugagucuugauacccacugucacuugcauuacgaagugcuguuagcuggccucggaggcuccgagcaagggacgguaaccgcccaucugcuuggaccucccggcacaccagguccccgccggcuguugaaaggguuuuauggaagcgaggcgcagggcgucgugaaggaccucgaaccugagcugcuaagacaccuggccaaagguauggcuucucucaugaucacuaccaagggcucaccacgcggggaacugcgaggacagguucacauagcaaaucagugcgaggugggcgggcuucgcuuggaggccgcuggagccgaaggcguccgggcacugggugcgcccgauacagccagugcugccccuccggugguaccaggguuacccgcacucgcuccugccaaaccaggaggccccgguagaccuagggacccgaacacuuguuucuucgagggccaacagcguccccacggggcacgcugggccccaaauuacgauccucugugcagccuuuguaccugccagcggagaacagugauuugugaccccguugucugcccaccucccuccuguccacauccggugcaagcuccugaucagugcugccccguguguccagaaaagcaggacgucagggaucugcccggacuaccucgaucucgggacccaggcgaggggugcuacuuugacggagaucgcucguggagagcggccggcaccagguggcaccccguugugccuccguucggucucaucaagugugcagugugcacuuguaaagggggaacgggcgaaguacauugcgagaagguccaguguccacggcuggcuugcgcccaacccgugcgaguuaacccuacagacuguugcaaacagugucccguggguagcggcgcccacccacaguugggggauccuaugcaggcugacggacccagaggcugccgcuuugcagggcaaugguucccagagucccagucauggcauccuagugucccgcccuuuggagaaaugucuugcauuaccuguaggugcggcgccggugugccacacugugagcgugaugacugcagccugccuuuauccugugggucaggaaaggaaagccggugcuguucuagaugcacugcgcacaggaggcccccagagacccgaacagauccugaacucgagaaagaggcugaaggcuccuga

SEQ ID NO: 54380 - RNA, 1137 nt, Artificial Sequence
  derived and/or modified sequence opt3 from CHRDL1__Homo_sapiens__NP_001137455
augagaaagaaauggaagaugggcgggaugaaauacaucuucagccugcucuuuuuccuucuguuggagggagguaagaccgaacaggugaaacacuccgagacauauugcauguuucaagacaagaaguacagggucggcgaacgguggcaucccuauuuagagccuuacgggcugguuuauugugugaacugcauuuguucugaaaauggaaacguacuaugcucacgcgugcgauguccaaauguccacugccucaguccggugcauauaccccaccuguguugcccucguuguccaggcgauggugagcuuagcugggagcauuccgacggggauaucuucagacagcccgccaacagggaagcucggcacucuuaccaccgcucgcauuaugacccuccacccucaagacaggcaggaggccugagcagguuuccuggcgcccggagucaccgcggggcguugauggauucccagcaggcuucuggaacuauuguucaaaucgugauuaauaacaaacauaagcacggucaggucugcgugagcaauggcaaaacguacucccacggggagucauggcauccaaaccuccgagccuucggaaucguagaauguguucuguguaccugcaaugugacaaagcaggagugcaaaaagauacacugcccgaacagauaccccuguaaguauccucagaaaaucgacggcaagugcuguaaagucugcccagguaagaaagcaaaggaggaacugcccgggcaaaguuuugauaauaaaggauacuucuguggcgaggaaacuaugccuguguaugagagcguguuuauggaagacggcgagaccacaaggaagauugcccucgagaccgaacggccaccccaggucgagguucauguguggacuauccguaaggggauuuuacagcacuuccauaucgagaaaauaucuaagcgcauguuugaagaacugccgcacuucaaacuuguaacaagaaccacguugucccaauggaagauuuuuacugagggagaggcucagaucucacagaugugcagcaguagggugugucggaccgaacuggaggaucuagucaaagugcucuaccuggaacgaucugagaagggucacugcuga

SEQ ID NO: 54381 - RNA, 1239 nt, Artificial Sequence
  derived and/or modified sequence opt3 from CHRFAM7A__Homo_sapiens__XP_011520455
augcagaaguacugcaucuaucaacacuuccaguuucagcugcucauucagcaucuuuggauagccgcuaacugugacaucgcagaugagagauucgacgccaccuuucacacaaaugugcuggucaacagcuccggccauugccaauacuugcccccugggauuuucaaaucuucauguuauaucgauguuaggugguuuccauucgacgugcagcacugcaaguuaaaauuuggaaguuggagcuacgguggcuggucccuggaucuacagaugcaggaagcggacauuucuggguauaucccgaauggagagugggaucucguaggcauacccgguaagcggucggaacgcuucuacgaguguugcaaagaaccuuauccagacgugacuuuuacggucaccaugcgacguagaacacuguacuacgggcuuaaccuguugauccccugugugcucauuucagcucuggcccugcucguuuucuuacugccugcagauagcggagagaagaucagucuuggcauuacuguguugcugucccuaaccgucuuuaugcuccugguggccgagaucaugccagcuacaucugacagcguaccccuuauagcacaauauuucgccuccaccaugauuaucguuggccugucaguggucgugacugugauugucuugcaguaccaucaccacgauccugacgggggaaagaugccaaaauggacaaggguuauccuccugaauuggugcgcuugguuuuuacggaugaagcgcccgggugaagauaaagugagacccgccugucagcauaagcagaggcggugcagucuggcgagcguagagaugucugcaguggccccuccacccgcuuccaacggcaaucuccuuuauaucggguuccgcggacuggacggcguccacugugugccuaccccagacucagguguugugugcgggcgaauggccugcagccccacgcaugaugaacacuugcuacacggaggccaaccgccugagggcgaccccgaucuggcaaaaauucucgaggaagucagauacauagcuaacagguuccggugucaggacgagagugaagccgugugcucugaguggaaguuugcggccuguguaguugaucgucugugccuuauggcauucuccguguuuacuaucauuuguaccaucgggauacugaugagcgcuccaaauuucgucgaagccgugucgaaggacuuugcuuga

SEQ ID NO: 54382 - RNA, 1383 nt, Artificial Sequence
  derived and/or modified sequence opt3 from CHRM1__Homo_sapiens__XP_011543044
augaacaccagcgcucccccugccguguccccaaauaucacaguccuggcaccgggcaaggggcccuggcagguugccuucauuggaauaacuacgggucuccuuucucuggcgaccgugacaggcaacuuguuaguacugaucucauuuaaagugaauacugagcuaaagaccgucaacaauuacuuccuccugagucuugcuugcgccgaccugauuaucgggacauuuagcaugaacuuguauaccacuuaccuccugaugggacacugggcacugggcacacucgccugugauuuauggcuggcucuugacuauguggcauccaaugccucuguuaugaacuugcugcuaauuucguucgauagauacuuuucagugaccaggccucucagcuaucgggcuaaacgcacgccacgacgugccgcgcugaugaucggucuugcauggcuggucaguuucguguugugggcccccgcuauacucuuuuggcaauaccugguaggggaaagaacuguuuuagccggacagugcuauauccaguuccugucccagccuauuaucaccuuuggcacagcaauggcugccuucuaccucccagugacugucauguguacccuuuacuggaggauuuaucgggagacagaaaaucgcgcgagagagcuggccgcauugcaaggcucugaaacccccgggaagggagguggcagcuccucaaguagcgagaggucucagccuggggcugagggauccccagaaacgccgcccggccggugcugucgcugcugucgagccccuagacuacugcaggcuuacucauggaaagaggaagaggaggaagacgaggguagcauggaaagucucacuucuuccgagggggaagaaccaggaagcgagguggugaucaagaugcccauggucgauccugaagcccaggcaccaacaaagcaacccccgaggucgucuccuaacaccguuaaacggcccacuaagaaaggccgugaccgcgccggcaaggggcagaaaccaagaggaaaggagcagcuggcuaagaggaaaacauuuucccuugugaaggagaaaaaggcggcacggacccugucagccauauugcucgcuuucauucugacguggaccccuuauaauaucaugguauuagugaguacauuuugcaaagauuguguccccgagacucugugggaacuagguuacuggcucugcuaugugaacagcaccauuaauccaauguguuacgcccugugcaacaaggcauuccgagacacauuccgccuuuugcugcucugcagaugggauaaaaggcgguggcgcaagauccccaagagaccuggcuccguucauaggacuccaucucgucaguguuga

SEQ ID NO: 54383 - RNA, 1401 nt, Artificial Sequence
  derived and/or modified sequence opt3 from CHRM2__Homo_sapiens__XP_011514073
augaacaauagcaccaacuccucuaauaacucacuggcccucacaagucccuacaagacuuucgagguggucuuuaucguucuuguggcuggcagccuguccuugguaacgauuauagggaauaucuuagugauggucucuauuaaagugaacagacaucugcagaccguuaauaacuauuuccuauuuucgcucgcaugcgccgaccugaucauuggaguguucucaaugaaucuuuacacacuguauacugucaucgguuacuggccuuugggcccagugguaugugaucucuggcuggcgcuggacuauguugugagcaacgcuagugucaugaaucucuuaauaaucuccuuugauagguacuucugcgugaccaagccgcugacauaucccgugaaacggaccacuaagauggccgggaugaugauugcagccgcuuggguccuuucuuuuaucuugugggccccugcaauucuguucuggcaauuuaucguuggagugcgcacaguagaagacggcgaguguuacauacaguucuuuagcaacgcugccgugaccuucgguacggcgauugcagccuuuuaccuaccagucaucauuaugacugugcucuauuggcacaucucccgagcuucaaaaagucguaucaagaaggauaaaaaggaacccguugccaaucaggacccugugagcccaucucugguccaggggagaauugugaaacccaacaauaacaacaugccuuccucagaugacggacuugagcacaauaagauacaaaacggcaaagcaccaagggauccgguaaccgaaaauugcguucagggcgaggagaaggaaagcaguaacgacucuacauccgugagcgcugucgccucgaauaugcgggaugacgagaucacucaggaugaaaacaccgugucuacaucccuggggcauucaaaggacgagaauaguaaacagaccuguauucgcaucggaacgaagacucccaaaagcgacuccugcacaccuaccaacacuacagucgaggugguugguucuagcggccaaaauggggaugaaaagcagaacauaguggcgagaaaaauuguaaagaugaccaaacagccagccaagaagaaacccccuccaucaagggagaagaaagucacgcggaccaucuuggcaauccuccuggcuuucauuaucacaugggcccccuacaaugugaugguuuuaauuaacacuuucugugcuccgugcauaccuaauaccguguggacaaucggauauuggcuguguuacauuaacaguacuaucaaucccgccugcuaugcacucuguaacgccaccuuuaagaaaacauucaagcaccuucugaugugccauuacaagaacaucggcgcuacccgcuga

SEQ ID NO: 54384 - RNA, 1773 nt, Artificial Sequence
  derived and/or modified sequence opt3 from CHRM3__Homo_sapiens__NP_000731
augacccugcacaacaauagcacaacuuccccucucuucccuaacaucucuucaaguuggauucauagcccauccgacgccggccuuccgcccgggacggugacccacuuuggaucuuacaaugucucgagagcugcagguaacuucucaagcccugauggcacaacugacgauccacugggagggcauaccguuuggcaagugguauuuauagccuucuugacaggcaucuuagcgcuggugaccauuaucgguaauauucuagucaucgugaguuuuaagguuaacaaacagcucaagacugugaauaacuauuuccugcuuucccuggcuugcgccgacuugauaaucggggucauuucuaugaaucucuuuacaaccuacaucauuaugaacaggugggcacugggaaaucuggccugugaucucugguuagcuaucgacuauguggcaagcaacgccuccguaaugaaucugcuuguuauaucauucgaucgguacuuuaguauuacgcgccccuugacuuaucgagcuaaacguaccacaaagagagccggcgugaugaucggccuggcgugggucauuagcuucgugcuaugggcacccgccauccucuuuuggcaguacuucguggggaaaaggacugucccacccggagagugcuuuauccaguuccugucugaaccuaccauuacauucgguaccgcuauagccgcauuuuauaugccaguuacgaucaugacuauucuuuacuggcggaucuacaaggagacagaaaagcgcaccaaagagcuggcuggcuugcaggccuccgggacugaagcggagacagagaacuucgugcacccgaccggaucaagcagaaguuguucuuccuaugaacuccaacagcagagcaugaagaggucgaaucggcgcaaauacggccgaugccauuuuugguucacgaccaagucuuggaaacccuccucagagcagauggaccaagaucacaguagcuccgacucuuggaacaacaaugaugccgcagcuagccuggaaaacucagccaguuccgacgaggaggauauagguagcgaaacaagagcuauuuauucuaucguauuaaagcugccugggcacucaacuauccucaauaguaccaagcugccaagcuccgacaaccuucaggugcccgaggaagaguugggaauggucgaccuagaaaggaaagccgauaagcugcaggcacagaaaucuguggacgauggcggcucguuuccuaagagcuucuccaaacucccaauucaacuggagucagccguugacacagcuaagacuucugaugugaauaguagcgucgggaaauccaccgcgacacuuccccugucauuuaaggaggcaaccuuggccaagcgguucgcucucaaaacucguagccagaucacgaagcgcaaaagaaugucucuggugaaggagaaaaaggccgcacagacauuauccgccauucugcuagcuuuuauaaucaccuggacuccguacaacauuaugguacucguuaauaccuucugugacaguugcaucccuaagacauuuuggaaccugggauauuggcuuuguuacaucaauagcaccgugaaccccgucugcuaugccuuguguaauaaaacuuucaggacaacguuuaagaugcugcuccugugccaaugugauaaaaagaaacggcgaaagcagcaguaccagcaacgccagucugugauuuuccauaagagagcaccagaacaggcgcuuuga

SEQ ID NO: 54385 - RNA, 1440 nt, Artificial Sequence
  derived and/or modified sequence opt3 from CHRM4__Homo_sapiens__NP_000732
auggccaacuucacccccgugaauggcagcuccgggaaccagucugucagacugguuacaucaaguagccacaauagguacgagacuguggaaaugguauuuaucgcuacggugaccggaucccucucucuugucacagugguugguaacauucuggugauguugucgauaaaggucaaucggcaauuacagacugugaacaauuauuuccuguuuucacuagcaugcgccgaccucaucauuggcgcguucagcaugaaccuguacaccguauauaucauuaaaggguacuggccucuuggagcuguugugugugaucugugguuggcccucgacuaugucgugaguaaugcauccgugaugaaccugcugaucauaucuuuugaucgcuacuucugcgucacaaagccacucaccuauccggcccgacguacuacaaaaauggcuggcuuaaugaucgcagccgcuuggguucugagcuuugugcuuugggcccccgcgauuuuguucuggcaguuuguaguggguaagagaaccgucccugacaaucaguguuucauccaauuucuguccaacccagcagugacguucgggacugccauugcugccuuuuaccuacccguugugaucaugaccguccucuacauacauauuucacuggcaaguaggagccgggugcacaaacaucgcccugagggaccaaaggaaaagaaagcuaagacacuugccuuccugaaaucucccuugaugaagcaguccguuaaaaagccuccaccgggcgaggcggccagagaggaacucaggaauggcaagcuggaggaagcacccccuccagcuuuacccccuccaccccggccgguagccgauaaagacacuucaaacgagagcaguucuggguccgcuacccagaauacaaaggaacgcccugccaccgagcugagcacgacugaggcaacaacccccgccaugccagcuccuccccuccagccacgagcgcuuaaccccgcaucgagauggucuaaaauccaaauugugacuaagcagacaggaaacgaaugcgucaccgccaucgagaucgugccugcuacgccagccgguaugaggccggcagccaaugucgcucggaaauucgccuccauugcacguaaccaggugcgcaagaaaagacagauggcggcuagggaacggaagguuacccgaacaauauuugccauccuguuggcauucauucuaacuuggacccccuauaaugugaugguacuggucaacacauuuugucaaucaugcaucccugauacuguguggaguauaggcuacuggcucuguuauguuaauagcaccauuaacccagccugcuacgcucuguguaaugccacauucaagaaaaccuuucgccaccuucuguugugccaguauagaaacaucgggacugcaagguga

SEQ ID NO: 54386 - RNA, 1599 nt, Artificial Sequence
  derived and/or modified sequence opt3 from CHRM5__Homo_sapiens__XP_005254198
auggagggcgacagcuaccacaacgccaccacagugaaugggacucccgucaaccaucagccucuggaaagacacaggcucugggagguuaucacgauugcugcagugaccgccguagugucccuuauaacaaucgucggaaaugugcugguuaugauuucuuucaaggugaacucacaauugaagacugucaauaacuauuacuuacugagucuagcgugcgcugaucucaucauugguaucuuuagcaugaaucuguauaccacauacauacuuaugggccggugggcccugggguccuuggcaugugaccucuggcuggcccuggauuauguggcuucuaacgcaucgguaaugaaucucuuaguuaucucauucgaccgcuacuuuagcauuacccgaccacugacuuaucgugccaagagaacaccgaaaagggcuggaaucaugauuggccuugccugguugaucaguuucauacugugggcgcccgcaauucuaugcuggcaguaccucguggguaagcggaccgucccucuggaugaaugucagauccaguuucuuuccgagccaacgauuacuuucgggaccgccaucgcugccuuuuacauccccgugucugugaugacaauucuguauugccgcauauacagagaaacugagaaaaggaccaaggacuuggcagaucuccaaggaagcgacuccgucacaaaggcugagaaacggaagccugcccaucgcgcgcuguuccgaucauguuuaagaugcccaaggcccacccuggcccagcgggaacguaaccaggcaaguuggucuagcucccgcagaucaacgagcacuacaggcaaaccuagucaggcuaccggcccaucugccaauugggcuaaggccgagcaacucacuacauguuccagcuauccgucgucugaagaugaggacaaacccgcaaccgauccuguucuucaggugguauacaagucccaggggaaggagucaccaggagaagaguuuagugccgaagagacggaagagaccuucgugaaagcugagacagaaaagagcgacuaugauacucccaacuaccuguuguccccugcggcagcccacaggccaaaaucucagaagugcgucgcuuauaaauuucggcuagugguuaaggccgacgguaaucaagagaccaacaauggcugucauaaagugaagaucaugcccugcccguucccugucgcaaaggaacccagcacaaaagggcugaacccaaacccuucacaccagaugacuaagcgaaaacgcgugguacucguuaaggagagaaaagccgcucagacccugagugccauucuucuggcauuuaucauaacauggacccccuacaauauuaugguguuggucuccacuuucugugacaagugcgugccagucacgcucuggcaccugggauacugguuaugcuaugugaacagcacaguuaaucccaucuguuacgcgcugugcaacaggaccuuccggaagacuuuuaaaaugcuacuccugugucgcuggaagaaaaagaaaguggaagagaaacuuuauuggcaaggcaauucuaaguugccuuga

SEQ ID NO: 54387 - RNA, 1353 nt, Artificial Sequence
  derived and/or modified sequence opt3 from CHRNA10__Homo_sapiens__NP_065135
augggccugagaagccaccaucucucccuugggcuguuguuacuguuccuacuccccgccgagugccugggagcugaagguaggcuugcacugaaguuguuucgggaccucuucgccaacuacaccucugcgcugcgcccuguggcugauacagaccagacucugaaugucacgcucgagguuaccuuaucacaaaucauugauauggacgaacgaaaccaggugcugacacuuuauuuguggauacgucaggaguggacugaugccuaccugagaugggacccaaaugcauauggcgggcuagaugccaucaggauuccgaguagccucguauggcggcccgacaucgugcuguacaacaaagcugaugcacagccuccaggauccgccucuaccaaugucgugcuucgccacgacggcgcuguuagaugggaugcccccgcgauuacaaggucgucaugucggguggacgucgcagccuuuccuuucgaugcucaacauugcggucugaccuuugggagcuggacucacggaggccaucaguuggacgugcgcccacgaggcgccgcagcuagucucgccgacuucguagaaaacguugaguggagagugcuggggaugcccgcgaggcggcgugucuuaacauauggauguugcuccgagccuuacccagaugugaccuuuacgcugcuccuucgcagaagggccgcagcuuauguguguaaucuguugcuaccgugcguccugaucucucuccuggcuccccuugccuuccaucugccugccgacagcggugaaaagguuuccuugggcgugacuguacuccuggcauuaaccguguuucagcugcuacucgccgagucaaugccacccgcugaaagugucccucugauagggaaauacuacauggcgacaaugacuauggugaccuucagcacagcacuuaccaucuugauuaugaaccugcacuauuguggaccaucuguucggcccgugccggccugggcucgagcccuccugcuuggccaccuggcacgcgguuugugcgucagagagaggggagagccuugugggcagucccggcccccagaacucucaccuagcccccaaaguccagagggcggcgccgggcccccugcuggaccaugccacgaaccgcgcugucugugcagacaggaggccuuacugcaucacguggcaacgaucgcgaauacuuuuaggucucaccgugcugcccagcggugccaugaagauuggaagcgacuagcaagaguaauggacagguucuuucucgccauuuucuucuccauggcucugguuaugagccuuuuggugcugguccaggcccucuga

SEQ ID NO: 54388 - RNA, 1374 nt, Artificial Sequence
  derived and/or modified sequence opt3 from CHRNA1__Homo_sapiens__NP_000070
auggagcccuggccucugcuccuucuguucagcuugugcuccgccggcuuagugcuggggucugaacacgagacccggcuagucgcuaagcucuuuaaagacuacucaaguguugugaggccaguagaagaucauagacagguggucgaggugacaguuggacugcaacuuauccagcugauuaacguggacgaagucaaucagauagugacuacgaacguacgcuugaagcagcaauggguugauuauaaucucaaauggaacccggacgauuacgguggcgugaagaaaauccacauucccagcgagaagaucuggcgaccugaccugguccuguauaauaacgcagauggggacuucgccauugugaaguuuaccaaagugcucuuacaguacacaggacauaucacuuggaccccacccgcgauauucaaguccuauugugagaucauugucacacacuuuccuuucgaugaacagaauugcucuaugaaacugggcaccuggacuuacgacgguucgguuguggcuaucaacccagagucagaucagcccgaccuuagcaauuuuauggaaaguggggaguggguaauuaaggagucccguggauggaaacauucugugacauauagcuguugcccugauaccccauacuuggacaucacguaccacuucgucaugcaaagacugccgcuauauuuuauagugaacguuauuauccccugucuccuguucuccuuucuuacuggccugguguucuacuugccuaccgacucaggcgaaaagaugacacucaguauuagcguccuguuaucucugacuguguuucuccuuguaaucguugagcugaucccauccaccucaagcgccgugcccuugauugggaaguauaugcuauucacaauggucuucgugauagcaaguaucauuaucaccgucauagugauuaauacgcaccauaggucuccuuccacucacguuaugccaaacugggugcggaaaguauuuaucgauacaauccccaauauuauguucuuuagcaccaugaagcgcccgucgagagaaaaacaggacaagaaaaucuucacugaggauauugacauaucugauaucuccggaaagccuggucccccaccuaugggcuuucauucaccccugauuaaacacccagaagucaagagugccaucgaggggaucaaguacauugcugagacaaugaaaagcgaccaggaauccaacaaugcagccgcugaguggaaguauguggccaugguuauggaucacauacuccugggaguguucaugcuugucugcaucauuggcacccuggcgguguuugcagguagguugaucgaacucaaccagcaaggguga

SEQ ID NO: 54389 - RNA, 1590 nt, Artificial Sequence
  derived and/or modified sequence opt3 from CHRNA2__Homo_sapiens__NP_000733
augggccccagcugcccuguguuccuguccuuuaccaagcucucucuuugguggcuguuguuaacaccagccgggggagaggaagcuaaaagaccgcccccuagggcaccaggugacccccugucaaguccuagcccaacugcccuaccccagggcgggucccacacggagaccgaagaucgccucuucaagcaucuguuucggggauacaaccgaugggcgcguccugucccaaauacaucugacguugugaucguaagauucggccuuucgauugcucaacugauagauguggacgagaaaaaccagaugaugacuaccaaugucugguugaagcaggaauggucagauuauaaacucagguggaacccgacagacuuugguaauaucaccagccugcgggugcccagugagaugauuuggaucccugauauuguucuguacaacaaugccgacggggaguucgcagugacucacaugacaaaggcccaucucuuuuccaccggaacgguccacugggugccacccgcuaucuauaagucuagcuguuccauagauguaacuuucuuuccuuucgaccagcaaaacugcaaaaugaaguuuggcucauggaccuacgauaaagcaaagaucgacuuagaacagauggagcagacaguugaucugaaagacuauugggaaaguggcgagugggccauugugaaugcuacugggaccuacaacagcaagaaguaugacuguugcgccgagaucuacccagaugucacauacgcguucgugauucgcagacuucccuuguuuuauaccaucaaucugauaauuccgugucuacucaucucuugccugacggugcuugucuucuaccugccuuccgacuguggagagaaaauuacuuugugcaucucaguucuccugagcuuaacaguguuccugcuccuuaucaccgaaauuauacccaguacuucucugguaaucccauugauuggugaauaucuacuguuuacaaugaucuucgugacccucuccauagucauuacgguguuuguucugaacgugcaucacaggagcccuucgacccacacaaugccccauuggguccggggcgcacuucuggggugugugccacgcugguugcucaugaaucgacccccuccaccgguagagcugugccaccccuuaagacugaagcuaucuccuuccuaccauuggcucgaaucaaacguugaugccgaggagagggaaguggucguggaggaagaggaccggugggcuugugccggacacgucgcaccaagugugggcacucugugcagccacggucaucuucacuccggggcuucuggacccaaagccgaagcguugcugcaggagggcgagcuccugcuuagcccucauaugcaaaaggcccuggaaggcguucacuauaucgcagaucauuugcguucagaggacgcugauaguuccgugaaagaagacuggaaguacguagccauggucaucgaucgcauuuuccucuggcuguuuaucauugugugcuucuuagggaccauaggacuguuucuaccacccuuccucgcugguaugaucuga

SEQ ID NO: 54390 - RNA, 1518 nt, Artificial Sequence
  derived and/or modified sequence opt3 from CHRNA3__Homo_sapiens__NP_000734
augggcagcgggccccugucccucccucuugcccugucuccaccgagauuguuacugcuacuccugcuuucacuguugcccguggcuagggcaagugaggccgaacaccgccucuucgagcggcuguuugaagacuacaacgagaucauucgaccugucgcgaauguuagcgauccagugauaauccauuucgaaguauccaugucucagcuggugaaggucgacgaggugaaccaaauuauggagaccaaucucugguuaaaacagaucuggaacgauuauaagcugaaauggaaucccucggacuacggaggugcugaauuuaugcguguuccugcccagaagauuuggaaaccagauaucgugcuuuauaacaaugcagucggcgacuuccagguggaugacaagacaaaggccuugcugaaauacacuggggagguaacguggauacccccugcuaucuuuaagucaagcugcaaaauugauguuaccuauuucccauuugacuaccaaaacuguacaaugaaguucggaaguugguccuaugauaaagcaaagaucgaccuagugcucauuggcucuagcaugaaucugaaggauuacugggaauccggugagugggccaucauaaaagcuccgggguacaagcacgacauuaaauauaacugcugugaggaaaucuaccccgacauuacuuauucacuuuacaucagaaggcugccuuuguuuuauaccaucaaucucauuauaccaugccuguuaaucaguuuccugacaguccucguguuuuaccuucccagcgauuguggagagaaggugacccugugcauuucugucuugcuaucccugacuguuuuccuccuggugaucacagaaaccauaccuucaacgagccuuguaauuccacugaucggcgaguauuugcucuuuacuaugaucuucgugacccugaguauugucaucacaguguucguuuuaaacgugcauuaccggacucccaccacacacaccaugccgucuugggucaaaacgguguuucugaaucuacucccucgcguaauguucaugacuagacccacauccaacgaaggcaaugcccagaagccaaggccucuguacggggcggagcuuagcaacuugaacuguuuuucgcgggcagagucuaaaggaugcaaggaagguuaucccugucaggacggcaugugcggguacugucaucaccgccgaauuaagauauccaauuucucagccaaccugaccagaaguagcuccucugagagcguugaugcugugcucucacugagugcccuuuccccagaaaucaaagaggcaauucagagcgucaaguauaucgcugaaaauaugaaagcccaaaacgaggcgaaggagauccaggacgauuggaaauacguggccauggucauugacaggauauuucuguggguguucacuuugguuugcauccucggaacagcaggccuguuuuuacagccccugauggcucgggaagaugccuga

SEQ ID NO: 54391 - RNA, 1884 nt, Artificial Sequence
  derived and/or modified sequence opt3 from CHRNA4__Homo_sapiens__NP_000735
auggagcugggcgggcccggagccccuagacuccuuccaccgcuguuguuacugcuagguaccggccuccugagggcuagcucccacguggaaacacgggcacaugccgaggaacgccuucugaagaaauuguucucuggguacaacaaguggucacgacccgucgcgaauaucagugacguugugcucguacguuuuggacugagcauugcucagcugauagauguggacgagaaaaaccaaaugaugacuacgaaugucugggugaagcaggaauggcacgauuauaaacucagaugggacccugccgauuacgagaacguuaccuccaucaggauuccaucugaguuaaucuggcggcccgacauugugcuguauaauaacgcagauggcgacuucgccgucacacaucuuacuaaggcucacuuguuucaugauggucgcgugcaguggaccccuccagcaaucuacaagucgucaugcagcauagacguaacauucuuucccuucgaucagcaaaauuguaccaugaaauuugggaguuggacuuaugacaaggccaaaaucgaucugguuaacaugcacuccagaguggaccagcuagacuucugggaaucuggagagugggucauuguggaugcugugggcacauacaauaccaggaaguaugaaugcugugccgagaucuacccugacauuacguacgcguuugucauccggcgccucccacuguucuauacuauaaaccuuauuaucccgugccuguugauuagcugucucaccguucugguguuuuacuuacccuccgagugcggcgagaaaaucacacuguguaucucaguacuccuuagucugacuguguucuugcuacugauuaccgaaauaaucccuagcacaucucucgucauuccacugaucggggaauaucuucuguuuaccaugauauucgugacguuguccauuguuaucacuguguucguccucaaugugcaccaucgaucacccagaacacacaccaugccuacuuggguaaggcggguuuuucuggauaucgugccacguuuacugcuaaugaagcgccccagcgucgugaaggacaacugcagaaggcucauugagaguaugcauaaaauggcaucugccccgcgguucuggccugaacccgagggagagcccccugcuacauccgguacccagagccugcacccaccaucgcccucuuuuugugucccucuugaugugccagccgaaccgggccccuccugcaagucaccuagugaccaguugccaccccaacagccucuggaggcagaaaaagcuagcccacaccccuccccggggccuugucgaccaccccauggaacgcaggccccuggccucgcgaaggcccgcucucugagcguucagcacaugucaagucccggugaggcaguggaagggggaguaagaugcaggucccggagcauccaauacugcgucccacgcgaugacgcugccccugaggcugauggccaggccgcaggcgcccuugcuucuagaaauacccauucagcggagcugcccccaccggaccagccuagucccuguaaaugcacauguaagaaagaaccaagcuccgugucucccucggcaacuguuaagaccaggagcacaaaggccccuccaccccacuugccucucuccccggcucugacucgugccguggaggggguccaauauauugcagaucauuuaaaagccgaagacaccgacuucucagugaaggaggauuggaaauacguagcuauggugauagaccggaucuuucuguggauguucauuaucguuugccuacucggaacagucggucuguuucuuccacccugguuggccggcaugaucuga

SEQ ID NO: 54392 - RNA, 1407 nt, Artificial Sequence
  derived and/or modified sequence opt3 from CHRNA5__Homo_sapiens__NP_000736
auggccgcuagaggcagcgggcccagggcacugcggcuccuucuguuggugcaguuagucgccggacgcugcggucuggcgggcgcugccgggggagcacaacgaggccuauccgagccuucuucaaucgccaagcacgaagacagucuccugaaagaucuuuuccaggacuacgagcguuggguuagaccaguggaacaucugaacgauaagauuaaaauaaaguuugguuuggcuaucagccagcucguagacguggaugagaaaaaucagcugaugaccacaaacgucuggcugaagcaagaauggauugacgugaagcucagguggaauccggaugacuaugggggaaucaaaguuauucgggugcccuccgauucugucuggacuccugacaucguguuauucgauaacgcagacggccgcuuugagggcacgucgaccaagacaguaauaagauacaaugggacuguuaccuggacaccacccgccaacuauaaaucaagcuguaccaucgaugugacuuucuuuccuuucgaccugcagaauugcaguaugaaguuuggauccuggacauacgacgguucucaggucgauauuauccuugaggaccaggauguggacaaaagggauuucuuugacaacggcgaaugggagauugugagcgcuaccggguccaagggaaaucggacggauucauguugcugguauccauacgucacuuauaguuucguuaucaagcgcuugccccuguuuuacacccuauuccucauaauuccuuguaucggccugagcuuucuuacagugcugguauucuacuugccaucuaacgaaggugagaaaauuugccucuguacuuccgugcuggucucauuaaccguguuccugcucguuaucgaggaaaucauuccgagcaguucuaaggugauaccccuuaucggggaguaucuggucuuuacaaugauuuucgugaccuuguccaucaugguaacgguuuuugccauaaauauucaccaucgaagcucgucuacucacaacgcgauggcaccucuagugagaaaaaucuuccugcauacacucccaaagcugcuuugcaugaggucccacgucgaccgguacuuuacccaaaaagaagagacugaaucaggaaguggccccaagagcucccguaauacacuggaggccgcuuuggauucuauccgcuauauuaccagacacaucaugaaagagaacgacgugagggaagucguggaggauuggaaguucauugcccagguucucgaccggauguuucuguggacguucuuauuugugagcauaguaggcucacuggggcuauucgucccugugaucuacaagugggcaaauauucucaucccaguucauaucggaaacgcuaacaaauga

SEQ ID NO: 54393 - RNA, 1440 nt, Artificial Sequence
  derived and/or modified sequence opt3 from CHRNA6__Homo_sapiens__NP_001186208
augcugaccagcaagggccagggguuccuccacggaggucuuugccugugguuguguguguuuacacccuucuuuaaaggcugcgucgggugugccacugaggaaagauuauuccauaagcuguuuucccacuacaaccaauucaucaggccuguugagaaugugucugacccaguaacggugcauuuugaagucgcuauuacccagcuagcaaacgugauauggaaugauuauaaacuccggugggacccgauggaguacgauggaaucgaaacacugcgcguucccgccgacaagauuuggaaaccugauaucgugcuuuauaacaaugcggucggcgacuuccagguggaggguaagacuaaggcucuguugaaauacaacgggaugauuaccuggacaccacccgccaucuuuaagucaaguugcccuauggauauaaccuucuuuccauucgaccaccagaauuguagccucaaauuuggauccuggacuuaugauaaggcagagaucgaccugcugauuaucggcucuaaaguagauaugaacgacuucugggaaaauucggagugggaaauuaucgaugccucaggcuacaagcaugacauaaaguauaacugcugugaggagauuuacacagacaucaccuacagcuucuauauucgacgucuccccauguuuuacacgaucaauuuaaucauuccuugccuguucauaaguuuucuuacuguuuugguguucuaucugccauccgauuguggggaaaaagucacccuaugcaucucugugcuccugagccuuacaguguuucuguuggucauuacugagaccaucccguccacaucacucguugugccccugguaggagaauacuuacuguucaccaugauauuugugacgcucaguauugucgugacuguuuucgugcuuaacauccacuauagaacaccuaccacucacacaaugccaaggugggucaagaccguguuucugaaauugcuaccccaaguacugcucaugcgguggccucuggacaagacgcgcgguaccggcagcgaugcuguuccaagagggcuugcaaggcggcccgccaaaggaaagcuggcuucucauggcgagccgcgccacuugaaagaauguuuccauugccacaaguccaaugagcucgccacaucaaagcgaagacugagccaccagccuuuacaguggguggucgagaacagugaacauucucccgagguggaagacgucaucaauuccgugcaguuuauugcggagaacaugaaaagccacaacgaaacuaaggagguugaggaugacuggaaauacguggcaaugguagucgauaggguguuccuguggguuuuuaucauugugugcgucuucgguaccgccgggcuauuccuccaaccacugcuuggaaauacaggcaagucguga

SEQ ID NO: 54394 - RNA, 1509 nt, Artificial Sequence
  derived and/or modified sequence opt3 from CHRNA7__Homo_sapiens__NP_000737
augagaugcagccccggcgggguguggcuggcccucgcugcaucccuucugcacgucucuuugcagggagaguuccaaaggaaguuauacaaagaacugguuaagaacuauaauccucuagagcggccaguggccaacgacucacagccgcucaccguauacuuuagucugagccuucugcagaucauggauguggacgaaaagaaucaggucuugacaacuaacauuuggcuccaaauguccuggacggaucacuaucugcaguggaaugugucugaguaccccgguguuaagaccgugcgcuucccugacggccagauauggaaaccagauauccugcucuauaacucggcggacgaacgauuugaugcuacauuccacacuaaugucuuagugaacucaagcgggcauugucaguaccugcccccuggaauuuuuaagaguuccugcuauaucgacguacguugguucccauuugauguucaacacuguaaacuuaaauucggcucuuggagcuacggugggugguccuuggaccugcagaugcaggaggccgauauuucaggauacauccccaauggcgagugggaccuagugggcauaccugggaagagaagugaaagguuuuaugagugcuguaaagaaccauacccggaugucaccuucacagugaccaugcggcgcagaacucucuauuacggacugaaccuucugauccccugcguguugauuagcgcacucgcccuguuagucuuucugcucccugcugacucuggugagaagaucucccuuggcauuacaguucuguugucacuaaccguguucaugcugcucguagcagagaucaugccagccacgagcgacagugugccccugauagcucaguauuuugccucuacuaugauuaucgucgggcuuuccgugguugugaccgucauugugcugcaauaccaucaccacgauccugacggaggcaaaaugccaaaguggacaaggguaaucuugcucaauuggugugcgugguuccugcggaugaagcgccccggugaagauaaaguucgaccggcaugccagcauaagcagagaagguguagcuuagccucgguggagaugucugcugucgccccucccccagcauccaacgggaaucugcuauauaucggauuccggggccucgacggcgugcacugcgucccuacucccgauucaggggugguuuguggacguauggcuugcaguccaacccaugacgaacaucugcuucacgguggccaacccccugagggggauccagacuuggccaaaauucuggaagaggugcgcuacauagcgaacagauuuaggugccaggaugagagcgaagccguauguuccgaguggaaguucgcagcuugcgucguggaccggcucugucugauggccuuuucuguuuucacaaucauuugcaccaucggaauacuuaugagcgcuccgaauuuuguggaagccgucucaaaagauuucgcauga

SEQ ID NO: 54395 - RNA, 1506 nt, Artificial Sequence
  derived and/or modified sequence opt3 from CHRNB1__Homo_sapiens__NP_000738
augacccccggcgcccugcucaugcuucugggggcuuugggagcaccuuuagccccaggugugaggggcagcgaggcggaagggaggcugcgggagaagcuauucuccggauacgacucuucaguccgcccggcucgagaaguuggcgaucgugugagaguaagugugggucucauccuggcccagcuuauuagccugaacgagaaagacgaagagauguccacaaaggucuauuuggaucucgaguggacugacuacaggcugucuugggaucccgcagaacacgacgggauagauucgcugcggaucacggccgagucaguguggcucccugacguuguguuacugaauaacaaugauggaaacuuugacgucgcucuugauauuagcgugguaguuaguuccgacggcucugugcgcuggcaaccacccggcaucuauagaagcuccugcucaauucaggucaccuacuucccuuuugauuggcagaauuguacaaugguguucaguagcuauucuuacgacuccucagaagugagcuugcagacugggcugggaccagacggucaaggccaucaggagauccacauacaugaggggaccuuuaucgaaaacggacagugggagauuauccacaaacccaguaggcuaauucagccuccaggcgauccgcggggugggcgcgaaggacaacgacaggaggucaucuucuaucucauaauuagaaggaagccccuguuuuaccuuguuaaugugaucgcaccuugcauucugaucacauugcucgccaucuucguauuuuaccugccacccgacgcuggcgagaaaaugggcuuaucuauuuucgcccugcucacccuuacuguguuucuguugcuacuggcggauaaggucccugaaacaucccucagcgugccaauaaucauuaaguaucugauguucaccaugguucuugugacguuuucggucauccugucugugguaguuuugaaccuccaucaccggucaccccacacucaucagaugccgcugugggugcgucagauauucauucacaaauuaccucuguaccuacgccucaagagacccaaaccagagagggaccugaugccugaacccccacauuguuccagucccgggagcggauggggucggggcaccgaugaguauuucauccgaaagccuccauccgacuuucuuuucccgaaacccaaucgcuuucaaccugaauugucugcaccagaucugagaagguucaucgacgggcccaaccgggccgucgcucuccugccugagcuucgcgaaguggucagcucaauuaguuacaucgccagacagcugcaggagcaagaggaucacgacgcauugaaggaagauuggcaguuuguggcuaugguuguggacagacucuuccuguggacauuuauuauauucacuuccguaggaaccuuagucaucuuucuggacgccacauaucaccuaccacccccggauccuuucccauga

SEQ ID NO: 54396 - RNA, 1509 nt, Artificial Sequence
  derived and/or modified sequence opt3 from CHRNB2__Homo_sapiens__NP_000739
auggccagaaggugcggccccguggcucugcuccuuggguucggacuguugcgguuauguagcggugucuggggcaccgacacagaggaacgccugguugagcaccuacucgauccuucccgauacaacaagcugauccguccagcaacuaaugggucugaacuugugacgguacagcugauggugucauuggcccaacucauuaguguccaugagagagaacagauaaugaccacaaacguguggcugacucaggagugggaggacuauaggcugaccuggaaaccggaagaguuugauaauaugaagaaaguucggcuccccagcaagcacaucugguuaccugacgugguccuguacaacaaugcggauggaauguaugaaguguccuucuacucuaacgcuguaguuucguaugacggcucaaucuuuuggcuuccacccgccauuuacaaaagcgcaugcaagauugaggugaagcauuucccuuuugaucagcaaaauuguacaaugaaauuccgcaguuggaccuaugacagaacugagaucgauuugguccugaaguccgaaguggccucucuagacgauuuuacaccaagcggugagugggacauaguggcucuccccgggaggcggaacgaaaauccugaugacuccaccuacgucgacaucacguacgauuucauuauccgccgaaaaccacuguuuuauacuauuaaccuuaucauaccgugcguucugauuaccucauuggcaauccucguguucuaccugcccagugacuguggagagaagaugacauuaugcauuagcguacugcucgcccuuacuguguuucuguugcuaaucucuaaaaucgucccuccaaccucccuggaugugccccucguuggcaaguaucugauguucacaauggugcuugucaccuuuucaauugugacgagcguauguguucugaaugugcaccauagaaguccuacuacacacaccauggcuccaugggucaagguggucuucuuggaaaaacuccccgcccuguuauucaugcagcagccgaggcaccauugcgcgcggcagcgucugcgccuaagaaggcggcaacgagagcgcgagggcgcaggggcccucuuuuucagagaagcuccuggagccgacucuuguacuugcuuugugaacagggcauccguucagggucuggcuggcgccuucggggcggagcccgccccaguggcaggaccuggccggagcggugaacccugugggugcggacuucgcgaggcuguagauggcgucagauuuauagccgaccacaugaggucggaagaugacgaucagucuguguccgaggacuggaaguacguugcuauggugaucgaucguuuguuccuguggauuuuugucuucgugugcguauuuggcacaaucgggauguuccuccagccacuguuucaaaauuauaccacgaccacauuccuucauucagaccacagugcccccagcuccaaauga

SEQ ID NO: 54397 - RNA, 1377 nt, Artificial Sequence
  derived and/or modified sequence opt3 from CHRNB3__Homo_sapiens__NP_000740
augcugcccgacuucaugcucgugcuuaucguccugggcauuccuagcuccgccaccacaggguuuaacucuauagcugagaaugaagaugcauuguuaagacaccuguuccagggauaccaaaaguggguuaggccagugcuacauucaaacgacacuaucaaaguauauuuuggucucaagauuagucagcugguggaugucgacgagaaaaaucagcuuaugacgaccaacguguggcugaagcaggaauggacagaucacaaauugcgguggaauccggacgauuacggcgggauccauagcauuaagguucccuccgagucucucuggcugccugacaucgugcuguucgaaaacgccgauggacgcuuugagggcucgcucaugacuaaggucauagugaaaucaaaugguaccguaguuuggacaccacccgcgagcuauaagaguuccugcaccauggacgugacuuucuuuccuuucgaucgacaaaacuguucuaugaaauuugggagcuggacauacgacggaaccauggucgauuuaauccugauuaaugagaacguggaccguaaggacuucuuugauaauggcgaaugggagauccuuaacgcuaaaggcaugaaggggaauagaagggacggaguguauuccuacccauucauuacguauucauuugucuugcggcgccugccccuauucuacacucucuuccugaucauaccuugccuuggucugaguuuucucaccguucucguguucuaccugccaagcgaugaaggcgagaaguuaucucuguccacaucaguacucgugagccuuacugucuuucuguuggugauugaggaaaucauuccgaguucuuccaaaguuaucccccuaaucggggaguaucuguuguucauuaugauauuugugacccugagcaucauugucacaguguucguaaucaacguucaccauagaucgucuuccaccuaccacccuauggccccaugggugaagaggcuuuuucugcagaaauugcccaagcuccuguguaugaaagaccacgucgaucgguauucaaguccugaaaaggaggaaagccagccaguggucaaaggaaagguguuagagaagaaaaagcagaaacaacuguccgacggcgagaagguucuaguggcauuccucgaaaaagccgcugauucuauacgcuacauuagccgacauguaaagaaggagcacuuuaucucacaggucgugcaggacuggaaauucguugcacaggugcuggauagaaucuuucuuugguuguuccugauugucagugugacggguuccguacucaucuuuacucccgcccugaagauguggcuucauagcuaucacuga

SEQ ID NO: 54398 - RNA, 1497 nt, Artificial Sequence
  derived and/or modified sequence opt3 from CHRNB4__Homo_sapiens__NP_000741
augagaagggcccccagccugguccucuucuuucuuguggcucugugcggccgggggaacugucgcguugcaaaugccgaggaaaaguugauggacgauuuacugaacaaaacccgauacaauaaccuaauccguccugcgacauccucuucacagcucauuaguauaaagcugcaacuuagccuggcucaguugaucuccgugaaugagagagaacagauuaugacuacgaacguauggcucaaacaggaguggaccgacuauaggcugacauggaacucuucgcgguacgaaggagugaauauccugcgcauuccagccaagagaaucuggcucccggauauagucuuauauaauaacgcagacgguacuuacgaggugucaguuuauaccaaucugaucgugaggagcaacggcaguguccuuugguugcccccugccauuuacaaauccgcuugcaagaucgaggugaaguauuucccauuugaucaacagaauuguacacugaaauuccggucuuggaccuacgaccacacugaaauugauaugguacuaaugacacccaccgcaagcauggacgauuuuacgccuuccggggagugggacaucguugcccucccaggacgccgaacugugaacccccaggauccuucauacgucgacgugaccuaugauuucauaauuaagagaaaaccacuguuuuacacaaucaaucuuauuaucccgugcgugcugacuaccuugcucgcuauccuggucuucuauuuacccagugacuguggcgaaaagaugacacugugcauuagcguucuccuugcccugaccuuuuucuugcuacugauaucuaaaaucgugccuccaacgucccucgacguaccccugauugguaaguaccuuauguuuacuauggugcuggucacauucucaaucgugaccagcguuuguguguugaacguccaucacaggaguccuucuacucauacaauggcgccaugggugaagcggugcuuucuccacaaacugcccaccuucuuauucaugaagcguccggggccugauuccagccccgcacgcgccuuuccaccuucgaaaucuuguguaacgaagcccgaggcuaccgccacauccacuucaccaaguaacuucuauggaaauagcauguacuuuguuaaccccgcauccgcugccucuaaaagcccugcgggcucaaccccaguggccauaccgagagacuucuggcugaggaguuccggccgguuucgacaggauguccaagaggcacuagaaggggugagcuucauugcucagcauaugaagaaugacgaugaggaccagucugucguggaagauuggaaauauguugccauggugguagaccgccucuuucugugggucuucauguuugugugcguucuuggaacaguggguuuguuccugcccccucucuuucagacucacgcugccucagagggcccauacgcagcccaaagagauuga

SEQ ID NO: 54399 - RNA, 1554 nt, Artificial Sequence
  derived and/or modified sequence opt3 from CHRND__Homo_sapiens__NP_000742
auggagggccccgugcugacccucgggcuucuggccgcuuuggcagucugcggaagcugggguuuaaacgaagaggaaagacugaucaggcaccuauuccaggagaagggcuacaauaaagaacuccggccuguugcccauaaggaggaguccguggacguagcgcuggcucuuacacugucuaacuugauuucacucaaagaaguggaggaaacucugacgaccaaugucuggauagagcacggguggacagauaaccgccugaaguggaaugccgaggaauuuggaaacaucagugugcuccgauuaccaccggacaugguuuggcugcccgagauugugcuugaaaauaacaaugauggcagcuuccaaaucuccuauucuuguaacgucuugguguaccauuaugguuuuguauacuggcugccuccagcaauuuuccguucgucaugccccaucagcguuacuuauuuuccuuucgacuggcagaauuguagucuaaaauuuuccucucucaaguacaccgccaaggagauaacacugagccuuaaacaggaugcuaaggaaaacagaaccuauccaguggaguggaucauuaucgaccccgagggguucacugaaaauggagagugggaaauuguccacaggccugcacgggugaacguggauccacgcgccccgcuggacucccccucaagacaggauaucacauuuuacuugauaauuaggcggaaaccucucuucuacaucauuaauauccuggucccaugcguuuuaaucaguuuuauggugaaccugguauucuaucuccccgcugacagcggcgagaagaccucuguggccauuuccguccuucuggcgcaaucaguguuuuugcuacugauaagcaaacgccucccugcaacgaguauggccaucccacugauuggcaaguuccuucuguucgggaugguuuuggugacuauggucgugguaaucuguguuauagugcucaacauucauuuucgaacccccucuacacacguccuguccgaaggagugaagaaauuauuccuggagacucuaccggagcuccugcacaugagcagaccugcugaagauggucccucgccaggcgcccuugucaggcggucuuccucauugggguacaucaguaaggcagaggaauauuuucugcucaaaagccguuccgaccugauguucgagaagcagucugaacgccauggacuugcuagaaggcugaccacagcccggcgaccucccgcgagcucagagcaggcccagcaagaguuguuuaaugaacucaaaccagcaguggauggcgcuaacuucaucguuaaucacaugcgcgaccagaacaauuacaacgaggaaaaggacaguuggaauagaguggccaggaccguagaucggcugugcuuauuugucgugacgcccguuaugguggucgguacugcuuggauuuuccugcaggggguguauaaccagccuccaccgcaacccuuuccuggagacccauacuccuauaauguacaggauaaacgcuucaucuga

SEQ ID NO: 54400 - RNA, 1482 nt, Artificial Sequence
  derived and/or modified sequence opt3 from CHRNE__Homo_sapiens__NP_000071
auggccagagcuccccugggcgugcuccuucuguugggguuacugggaaggggugucggcaagaacgaggaacuacggcucuaccaccaucuguucaauaacuaugacccugggagccgcccaguucgagagccggaagauaccgugacaaucucccuuaaaguaacucugacgaauuugauuucucucaacgagaaggaagagacccugacaacuucaguguggauaggaaucgacuggcaggauuaccgucugaauuauaguaaagacgauuuuggcgguauugagacccucagaguccccagcgaauuaguguggcugccugagaucguucuugaaaacaauauugacgggcaauucggaguggcauacgaugccaacgucuugguguaugagggcggcuccguaacauggcugccacccgcgaucuacaggucuguuugcgcuguggaggucaccuauuuuccuuucgacuggcagaauuguucgcuaauauuucggucacagacuuacaacgccgaagagguggaguucacauuugcaguggauaaugacgggaagaccaucaacaaaauugauaucgacacggaagccuacacugaaaauggagagugggcuauugauuucugcccaggugucauccgcagacaccauggcggggcaaccgacggacccggcgagacagacguuauauauagccucauuaucaggcggaagccucuguuuuacgugauuaacaucaucguaccaugugugcuuauuaguggucuggucuugcucgccuauuuccugccggcucaggccgggggacaaaagugcacuguguccauaaauguuuuacuggcgcagaccguguuucucuuccuuaucgcacagaaaauucccgaaacaucucugagcgucccuuugcuaggccgcuuucugaucuucgugaugguaguugccacccucauagugaugaacugugucauugugcugaacgucucccagcgaacgccaacuacacacgcuaugucacccagacuuaggcaugugcuguuggagcuccugccucgguuacugggcaguccacccccgccugaagcaccccgugccgcuagcccaccucgcagagccucuuccguugggcuacuccugagggcggaggaacuuaucuugaagaaaccccggucagagcugguguucgagggacaacgacaccgccaggguaccuggacugccgcauuuugccagagccucggcgcugccgcuccagaaguaagauguugcgucgaugccgugaauuucguugcagagaguacaagggaccaggaagccaccggggaggaagugucugauuggguccggaugggaaacgcucuggacaauaucuguuuuugggcggcacuugugcuguucuccguaggcagcucguugauuuuucucggugccuacuucaaccgcgugcccgaucugccuuaugcuccaugcauccaaccguga

SEQ ID NO: 54401 - RNA, 1554 nt, Artificial Sequence
  derived and/or modified sequence opt3 from CHRNG__Homo_sapiens__NP_005190
augcacggcgggcagggaccccugcuccuucuguuguuacuggccgugugccuaggugcucaaggcagaaaccaggaggaaaggcuccuggcagaccuuaugcagaauuacgauccuaaccugcggccagccgagcgcgacagcgaugucguuaauguguccuugaagcucacccugacaaaccugaucucucucaaugaacgagaggaagcguuaacuacgaacguauggauugagaugcaguggugugacuaucgucugagaugggauccgagggacuacgaggggcuuuggguguugcggguccccucaaccaugguguggcgcccugauauaguucuggaaaauaacguggacggagucuucgagguggcucuauauugcaauguacucguuaguccagauggcuguaucuacuggcugcccccugccauuuuuagaagcgcaugcuccaucucugugacauauuucccauuugacuggcaaaacuguucgcuuauuuuccagucacagacuuacagcaccaaugaaaucgaucugcaguugagucaagaggacggucagacaauagaguggaucuuuauugaucccgaagccuucaccgagaacggggaaugggcuauccagcauaggccugcaaaaaugcuccuggacccagccgcuccggcccaggaggcgggacaccaaaaggucguguuuuauuuacugauucagcggaaaccccucuucuacgugaucaauauaauugcaccuugcguccuuaucuccucuguugccauucugauccacuuuuugccagcuaaggccggcggccagaaauguacuguggcaaucaacguacuacuggcucaaacaguguuccucuuucuggucgccaagaaggugcccgaaaccagccaggcgguuccucuuauuuccaaauaccugacguucuugcucguggucacuauacugaucgugguaaaugccguuguggucuuaaacgugucacugcgcaguccacauacccauagcauggcacgaggggucagaaagguguuucuaaggcuccugccccagcuuuugcggaugcacguucguccgcuggcuccugccgcugugcaggacacacaaucucgccuccagaacggauccucagguuggagcauuacuaccggcgaggagguagcccugugccuucccagaagugaacuguuguuccagcaguggcaaaggcaggggcucgucgcagccgcucuggagaaauuagaaaagggaccagagcugggccuaucucaguucugugguucccucaaacaggcggcuccugccauccaagcaugcguggaagccuguaaucugauagcaugcgcccggcaccagcagagccauuuugauaacgggaaugaggagugguuccuuguuggacgaguguuggaccgcgucugcuuucuggcuaugcucucgcuguucauuuguggcacagccggcaucuuuuuaauggcacacuauaacagagugcccgcgcugccauuccccggggauccuaggccauaccuuccgucucccgacuga

SEQ ID NO: 54402 - RNA, 1071 nt, Artificial Sequence
  derived and/or modified sequence opt3 from CHST10__Homo_sapiens__NP_004845
augcaccaucaguggcugcuccuugccgcuugcuucugggugaucuuuauguucauggucgcaagcaaguuuauuacccugacauucaaagaccccgauguuuacuccgccaagcaagaguuuuuguucuuaacuacgaugccugaagugagaaaacugccagaggaaaagcacauaccggaggaacuaaaacccaccggcaaggagcucccugacucucagcugguacagccacuuguguauauggagaggcuggaauugauccggaacgucugucgcgaugacgcgcucaagaaucugucacauacacccgugaguaaauuuguucuggaucgaauuuucgugugcgacaagcacaaaauccucuuuugucagacuccuaaggucgggaacacccaauggaaaaagguguuaauuguacugaauggagcuuucagcuccaucgaggaaauaccagagaacguugugcaugaucacgagaagaauggucuuccccguuugucuucguuuucagacgccgaaauccagaaaagacugaagacauacuucaaauuuuucauugucagggauccuuucgagcggcuaaucagcgcauuuaaggacaaauucgugcacaacccacgcuuugaaccgugguauagacaugagauugcccccggcaucauaaggaaguaccggcgcaaucgaaccgaaacuagagggauucaguucgaggauuuugugagguaucucggagacccuaaccaccgguggcuggaucuucaguucggcgaccauaucauucacugggucacauacguugagcugugcgcuccaugugaaaucauguauagugugaucggucaccaugagaccuuggaagacgaugcacccuacauucucaaagaggccgggauagaccaccugguauccuacccuacgaucccacccggaauuacuguguauaaucguaccaaggucgaacauuacuuuuuaggcaucucuaagcgcgauauaagaaggcuguaugcucgguucgagggcgacuuuaaacucuucggguaccaaaagccggauuuucuucugaacuga

SEQ ID NO: 54403 - RNA, 1044 nt, Artificial Sequence
  derived and/or modified sequence opt3 from CHST11__Homo_sapiens__NP_001167453
augaagcccgcccugcucgaggugaugagaaugaacaggaucugccggaugguccuugcuaccugucugggcagcuucauuuugguuauauuuuacuuccagaucaugcgccgaaauccuuuugggguggacauuugcugucguaagggauccagaucuccauuacaagaacuguauaacccgauccagcuagagcucucaaauacagcaguacugcaccagaugaggcgggaucaggugacugacacgugccgcgccaacagugcgaccagcagaaagaggcggguccuuacacccaaugaucugaaacauuuggugguugacgaagaucacgagcucauuuacuguuaugugccuaaggucgcuugcacuaacuggaaacgccugaugauggugcugaccggucgaggcaaguacuccgacccaauggaaauccccgccaaugaggcacauguaucugccaaccucaagacauuaaaucaauauucgauaccugagaucaaccacagacugaaaucauacaugaaguuccuuuuuguuagggaaccauucgagcgguuggugagcgcuuaucguaauaaauuuacccagaaguacaacauuaguuuccauaaacgcuacgggacuaagaucauuaagagacagaggaaaaaugcaacacaggaagcccugcggaagggagaugacgucaaauuugaggaguucguggcuuaucuaaucgauccccacacccaacgagaggaaccuuuuaacgaacacuggcagacgguguacucccucugucauccaugccacauacauuaugaccuggucggcaaguacgagacucuugaagaggauucuaauuauguucugcaguuggccgguguggggagcuaccucaaauucccgaccuaugcgaaguccacacgcacuaccgacgagaugacaaccgaauuuuuccagaacauuucaagugagcaccaaacgcagcuguacgaaguauacaaauuagauuuccugauguuuaacuauagcgugcccucuuaccucaaacuugaguga

SEQ ID NO: 54404 - RNA, 1245 nt, Artificial Sequence
  derived and/or modified sequence opt3 from CHST12__Homo_sapiens__NP_001230724
augaccaaggccagacuguucaggcucuggcuugugcugggcagcgucuuuaugaucuuguuaauuauaguuuacugggacuccgcuggggcagcccacuucuaucugcauacaucuuuuucacggccccacacuggaccuccacuaccgacgcccgguccugaucgcgaccgagagcucaccgcggauagugacguggaugaguuccuggacaaauuucuuagcgcuggcguaaagcaguccgaucugccacguaaagaaacagaacaacccccugccccagggucuauggaggaaucggugagaggauacgacuggucacccagggaugcacggcgcagcccugaccagggcagacagcaggccgagaggcggagugucuugcgcgguuucugcgcuaacuccucucucgcauuuccaacuaaggagcgagccuucgaugacaucccgaauagcgaacugucccaucugauuguggaugacagacacggggcuaucuauuguuacguucccaaaguggccugcaccaacuggaagagggucaugauugugcucucaggaaguuuacugcaucggggcgcgccuuaucgugacccacuucgcauccccagagagcacguacacaaugcaagcgcccauuugacauuuaacaaguucuggaggcgguacggcaaacugucucgacaccuaaugaagguuaaacucaagaaauauaccaaguuucuguucgugcgcgauccuuuugucagacuuauauccgcuuucaggucaaaguucgaacuggagaaugaggaauuuuaccggaaauucgccgugccaauguugcgccucuacgcaaaccauacuagccugcccgcuagugccagagaggcguuuagggccggguuaaaggugucuuucgcaaauuuuauccaauaucugcucgacccgcacacagaaaaacuugcuccuuucaacgagcacuggcgucaggucuaccggcugugucaucccugccagauugauuaugacuuuguuggaaaguuggaaacccuagaugaggacgccgcucagcugcuccaacugcuucagguggaucgacagcugagauucccaccuuccuacaggaaucgcacggccagcucgugggaggaagacugguuugcaaaaauccccuuggccuggcggcagcaacucuauaagcuguacgaggcugauuucguauuauuugguuauccaaaacccgaaaaccugcuaagagacuga

SEQ ID NO: 54405 - RNA, 1026 nt, Artificial Sequence
  derived and/or modified sequence opt3 from CHST13__Homo_sapiens__NP_690849
augggcagaaggugcugucggcgccgagugcuggccgcugcaugccucggggccgcgcuucuguuguuaugugcugcaccccguagccugagaccugccuucggaaacagggcccuagguuccucuuggcucggcggggagaagcggucaccacugcagaaacuuuacgaccuggaucaagacccgcgcaguaccuuggcuaagguccacagacagaggcgggaucuccugaauagcgcaugcucccgccauucucgaagacagaggcugcuccagcccgaagacuuacggcacguucugguggaugacgcccauggacuuuuguauuguuacguaccuaaaguggcuugcacaaacuggaagcguguccugcuagcccucucgggccaagcgcgcggugauccaagagcaaucucagcccaggaggcucacgcccccgggaggcugccuagccuugcagacuuuaguccagcugaaauuaaucggcgacugcgcgccuauuuggcguuccucuuugugagagagcccuucgaaaggcuggccuccgcauaccggaacaaauuagcucgcccuuauucugccgcuuuucagagaagguacggagcccguauaguucagcggcugcgaccaagagcacucccggaugccagggcucgcggccaugacgugcgguucgcggaguuucuugcauaucuguuggaucccagaacuaggcgcgaggaaccuuucaaugagcacugggaacgagcccacgcucuaugucauccaugccggcugcguuacgacgucgugggcaaguuugagacgcucgccgaggaugcagccuucguacuggggcuugcuggagccagcgaccuguccuuucccgguccuccaagacccaggggcgcagcggcuucacgcgacuuggccgcaagacucuuccgggauaucaguccguuuuaccaaaggcgacuguucgacuuauauaagauggauuuccugcuauuuaacuacagcgccccuucuuaucuccgccugcuuuga

SEQ ID NO: 54406 - RNA, 1131 nt, Artificial Sequence
  derived and/or modified sequence opt3 from CHST14__Homo_sapiens__NP_569735
auguuccccagaccucugaccccacucgccgcuccgaacggcgcagagccccuugggagggcccugcggcgcgcgccuuugggacgagcucgugccgguuuaggcgggccaccccugcuacucccuagcaugcugauguuugcagugaucgucgccuccucuggacuucuguugaugauugaaagaggcauacucgcugagaugaagccacugccccugcacccuccagguagggaagggacagcauggcggggaaaagccccgaagcccggcggccucucauuacgcgcuggggacgccgaucugcagguuagacaagacgugaggaaucggacucuucgcgcgguaugcggacagccugguaugccacgagaucccugggacuugccugugggccagagaaggacgcugcuacggcauauccucgucagugaucguuaccgcuuccuguauuguuacgugccaaaaguugcaugcagcaacuggaagagagugaugaaaguccuugccggggugcuggacuccguagauguuagguugaagauggaccaccggucugaucucguguuucuggcugacuuacgacccgaggaaauucgcuauagacugcagcauuacuucaaguuucucuucgucagggagccgcuugagcggcuguugucggccuaucgcaauaaauuuggagaaaucagagaguaccaacagagguauggcgcagaaauugugcgucgguaccgagcuggugccgggccuucacccgcgggagaugacgugaccuucccagaguuucuaagauaccuggucgaugaggacccugaaaggaugaacgagcacuggaugcccguuuaucaucucugucagccaugcgccgugcacuacgacuucguaggcagcuaugaacgccuggaggcagaugcuaaucaggugcuugaauggguccgggcucccccucacgugagauuuccagccaggcaagccugguaccgcccggcaagucccgagucccugcauuaucacuuguguucugccccucgagcucuccugcaggacguuuuaccaaaguacauccuggauuucagccuauuugcguauccccucccuaacgugacaaaagaggcaugccagcaguga

SEQ ID NO: 54407 - RNA, 1521 nt, Artificial Sequence
  derived and/or modified sequence opt3 from CHST15__Homo_sapiens__NP_001257694
augagacacugcaucaacuguugcauucagcugcuccccgacggcgcccauaagcaacaggugaauugucaagggggaccucaccauggucaccaggcuugcccaaccuguaaaggcgagaacaagauacuuuucagggucgauagcaaacagaugaaucuguuggcaguuuuagaagugcggacagaggggaacgaaaauuggggaggcuuucugcgcuucaagaaagguaagcgaugcucccuaguauuugggcucaucauuaugacucuggugauggccucuuacauccuuucaggagcgcaucaggagcuguugauuaguagcccguuccacuauggcggcuuucccuccaacccuucucucauggacucggaaaauccaucagauacgaaggagcaccaucaccagagcagugucaacaauaucuccuacaugaaagacuaucccucuauaaagcugaucauuaacagcaucaccacacguauugaguucacuaccagacagcugccugaucucgaagaccugaaaaagcaagaguuacauauguuuuccgugaucccaaauaaauuccuucccaacucaaagaguccuuguugguacgaagaguuuagcgggcagaauacaaccgauccauauuugacuaacucuuacguucuguauuccaagagguuccggucaacauuugacgcucuacgcaaagccuucuggggacaccucgcacacgcccaugguaagcacuuuagacugaggugccuuccgcauuucuacauaauuggccagcccaaaugugggaccacggaucuguacgaccgguugcgccuccacccugaggugaaguucagcgcuaucaaagaaccacauugguggacucgaaagagauuuggaauugucaggcugcgggauggcuuacgugaccgcuaucccguggaggauuaccuggaccucuucgaccuugcagcccaccagauccaccaaggucugcaggcuaguucugccaaagaacaguccaagaugaauaccaucauuauaggggaggcgagcgcaucgacaaugugggauaacaacgccuggaccuuuuucuaugacaauucuacugauggagaaccuccauuuuugacacaagacuucauccaugcuuuucagcccaacgccagacuaauuguaaugcugagggauccgguugagcggcucuacuccgacuaucuguacuucgcaucaaguaauaagagcgcugaugacuuucacgagaaagugaccgaagcccuucagcuguucgagaacugcauguuggauuauucccuccgagcgugugucuacaauaacacgcugaauaacgccaugccugugugcacucccccaccucgcacacccagagcaggcccauggcagaaggaauuagugugcuguuacuaugcuucuggcaucgucgggcugagguuuagcauaggaaccgagcggucaguucuaaugugcaaauguugcaguccccucuucauggacgugaaggccgaaaauuga

SEQ ID NO: 54408 - RNA, 1236 nt, Artificial Sequence
  derived and/or modified sequence opt3 from CHST1__Homo_sapiens__NP_003645
augcagugcagcuggaaggccgugcugcuccuugcucuggcauccaucgccauucaauacaccgcgauaagaacauucacugcuaaaucuuuucacacgugucccggcuuggccgaggcaggguuagccgaaaggcugugcgaggaaucaccuaccuucgcuuauaaccuaagucggaagacacauauccucauucuggcaacuacccgcagcggauccucuuuugucggucagcuuuucaaucagcaccuggacguguuuuacuuguucgagccacucuaucauguucagaacacacugaucccgcgauuuacccaaggcaaaucgcccgccgaucguagaguaaugcugggggcuucaagggaccucuuacggagccuguacgauugugaccuuuauuucuuggaaaauuacauuaagccuccacccgugaaccacacuacagaucgcaucuuuagaaggggagccagucggguccugugcucccgcccugugugugacccacccggcccugcggaucuaguucucgaggagggugacugcgugcgaaaaugugggcugcuuaaucugaccgucgcagccgaggcuugcagagaaaggucucauguggccauaaagacgguacggguuccagaagugaacgauuugcgugcacucgucgaggacccgcgccugaauuuaaaggugauccagcuggugagagaucccaggggcauucucgcuagccgguccgagacuuuccgagacaccuaucgccuuuggagacugugguacggaacaggcaggaaaccuuacaacuuggaugucacucagcuaaccacaguuugugaagacuuuucaaauagugugagcaccgggcugaugcggccacccuggcucaagggaaaauauaugcugguacgcuacgaggaccuugccagaaacccuaugaagaaaacggaagagaucuaugguuuccugggcauuccauuggauucucacguggcgagguggauccagaauaacacucguggggaccccacacucggaaagcacaaguacggcaccguccgaaauuccgccgcaacugcugaaaaauggcgguuuagacugucauaugauauaguggccuucgcucaaaacgccugccagcagguuuuagcacagcuggguuacaagauugccgcuagcgaggaggaacucaaaaauccgagugugucucuagucgaggaaagggacuuccgcccuuuuuccuga

SEQ ID NO: 54409 - RNA, 1593 nt, Artificial Sequence
  derived and/or modified sequence opt3 from CHST2__Homo_sapiens__NP_004258
augagcagauccccucagagggcccugcccccaggcgcucucccgcggcuucugcaagcagcccccgcggcugccccucgcgcauuguuaccacaguggccccgacguccugggagaagguggccagccucuccccugggaaugaagguguuccggcgcaaagcucuaguccucugcgcagguuacgcccugcuucugguuuugaccaugcucaaccugcuggacuauaaguggcacaaagagccucuccagcaguguaauccagauggcccguuaggggcugccgcgggagcagccggcgguucaugggggagacccggaccuccacccgcuggcccuccaagggcccaugcacggcuggaccuucgcacacccuaccgaccgccugcugccgcggugggcgccgcacccgcugccgcugccgggauggcaggaguagccgcuccaccugguaacggcacuagagggacgggaggcgugggugauaagaggcaauuggucuauguguuuaccacauggcggagugggagcuccuucuuuggagaacuguucaaucagaaccccgagguguuuuuccuauacgaaccaguguggcacgucuggcagaaacucuaucccggcgacgcggugucucugcagggcgcagcccgugauaugcuuucggcucuguaccgcugcgacuugucaguauuucaacucuauagcccugccgggaguggagguagaaaucugacuaccuuaggcaucuucggggcagccacaaacaagguuguguguuccucuccacugugcccggcuuacaggaaggaggucgugggacucguggaugaccgggucuguaaaaagugucccccucagcgacuugcccgcuuugaagaggagugcagaaaauacaggacccugguuauuaagggcgugcggguauucgauguggcagucuuggcgccacuacugcgcgaccccgcucucgaucugaaagugauacaucuuguuagagacccuagggccguggcaagcucccguauccggucacgacacggucugauuagagaaaguuugcaggucgugaggagccgcgauccacgggcccauagaaugcccuuucucgaggcugccgggcacaagcugggcgcaaagaaagaaggaguaggcgggccggcugacuaucacgccuuaggagcgauggagguuaucugcaauucuauggccaagacucugcagacagcucuacaaccuccagacuggcuccagggucauuaccugguggucagguaugaggaucuugugggcgaccccgucaaaaccuugcgccgaguguacgauuucguugggcugcucguguccccugaaauggagcaguuugcacugaacaugacgucaggaagcggcaguucuuccaagcccuucguagucagcgcccggaaugcuacucaagccgcaaacgcguggcguaccgcccuuacauuccagcagauuaaacagguggaagaguuuuguuaucaaccaauggcuguucuggguuacgaaagaguuaauucgccugaggaggucaaggacuugucuaaaacucuccugaggaagccccgcuuauga

SEQ ID NO: 54410 - RNA, 1440 nt, Artificial Sequence
  derived and/or modified sequence opt3 from CHST3__Homo_sapiens__XP_006718138
auggagaagggccugacccucccccaggacugcagagauuucgugcacagccuuaaaaugagguccaaguacgcccuguuuuuggucuucguugugaucguauuuguguucauugaaaaagagaacaagauaaucucucgggucucagacaaauuaaagcaaauuccucaggcucuggcagaugccaauaguacagacccagcgcuaauccucgcugaaaacgccagccugcuuucccugucugaguuggauucggcauuuucacagcuccagagccgccugcgaaaucugagucuccaauuagggguggaaccggccauggaggcugcaggagaggaagaggaagaacagcguaaggaggaggagcccccuagaccagccguugcuggucccaggcggcaugugcugcuuauggccacuacgcgcaccggcuccucuuucgucggggaauuuuucaaccagcagggaaauaucuuuuauuuguucgagccucuguggcacauugaaagaacagugagcuuugagccaggcggugcgaacgcagccggguccgcucuaguauacagggacguucucaaacaacuguuccuuugugaucuguauguguuggagcauuuuauaacuccccucccugaagaccaccugacccaguucauguuccggcgcggaucaagucgaucuuuaugcgaggauccagucuguacaccguuugugaagaaaguguucgaaaaguaccauugcaaaaauagaagguguggcccccugaacgucacccucgccgcagaggcuugccggcguaaggaacacauggcccuuaaggcgguucgcaucagacagcuggaguuuuugcagccucuagccgaggacccaaggcuggaucuccgggugauucaacugguacgagacccccgcgcagugcuugcuagcagaauggucgccuucgcuggcaaauauaagacuuggaaaaaguggcuggaugacgaagggcaggacggauugagggaggaagaggugcagcggcuccgcgguaauugugaauccaucagacugucagccgaguuaggccugaggcaaccugcauggcuacgugggcgguacaugcucguucgauaugaggauguggccagaggaccacugcagaaagcuagggaaauguaccgcuuugcgggcauuccccuuacaccgcaggucgaggacuggauccagaagaacacccaagcagcccacgaugguagcgggauauacaguacgcagaaaaauucuuccgaacaguucgagaaguggcgguuuagcaugccuuucaaguuggcucaggugguacaagccgcaugcggacccgccaugagacuguuuggcuauaaacucgcuagggacgccgcagcgcugacuaaccgcucgguuucucuucuggaggaacgaggcaccuucugggugacauga

SEQ ID NO: 54411 - RNA, 1161 nt, Artificial Sequence
  derived and/or modified sequence opt3 from CHST4__Homo_sapiens__NP_005760
augcugcuccccaagaaaaugaaacuucuguuguucuuagugagccagauggccauccuggcucuauuuuuccacauguacucccauaacauuucuucacucaguaugaaagcacaaccugagagaaugcacguccugguucuuagcuccuggaggucuggcucgucauuuguggggcagcuguucggacagcauccagacguauuuuauuugauggaaccggccuggcacguguggaugaccuucaagcagagcacagcguggaugcuccauauggcuguccgggaucugauacgcgccguguuucugugcgacaugaguguuuucgaugcauacauggagcccgguccucgacgucaauccucucucuuucagugggaaaauagcagagccuuauguuccgcuccagcaugcgacaucauuccccaggaugagaucauuccuagggcccacugucggcugcuuugcucacagcaaccauucgaaguggucgagaaggcuugucgcaguuauagccacgugguauugaaggagguuagauuuuucaaccugcagucucuauacccccuccugaaggacccuucccuuaaucugcauaucgugcacuuggucagggauccacgggccguguuucgcucacgagaaagaacuaaaggcgaccucaugauagauagcaggaucgugauggggcagcaugagcagaagcugaaaaaggaagaccaaccguauuacgucaugcagguuauuugccagagucaauuagagaucuauaaaacgauucagucucugcccaaggcgcuccaggagcgguaccuucuggugcguuacgaagauuuggcacgcgccccuguagcucagaccuccagaauguaugaguucgugggacuagaguuccugccacaccuccaaacauggguccacaacaucacuaggggcaaggguaugggggaccaugccuuucacaccaaugcacgggaugcucugaacgugagccaggccuggcgauggucgcuucccuacgaaaaaguuucucgccugcagaaggcguguggagacgccaugaauuugcucggcuauagacaugugagguccgaacaggagcaacggaaccuguuacuggaccuacucucaacauggaccgucccugagcagauacacuga

SEQ ID NO: 54412 - RNA, 1236 nt, Artificial Sequence
  derived and/or modified sequence opt3 from CHST5__Homo_sapiens__NP_078809
augggcaugagagccagggugcccaaggucgcucacagcacccggcgcccuccagcagcccgaauguggcugccgcguuucuccucuaaaacaguuacugugcuccuucuggcgcagacgaccugcuuguuacuguuuaucauuucaagacccgggccuaguagcccagcuggaggugaggacaggguacaugugcuaguccucuccucuuggcggucgggcagcagcuuccuggggcaacuuuuuagucagcaccccgauguguucuaccugauggaaccugccuggcauguuuggacaacuuugucccagggaucugcagccacccuccacauggcugugcgcgaccugaugagaagcauauuucugugugauauggacgucuucgaugcauauaugccacaguccaggaaccucucagccuuuuucaauugggcuacaagucgggccuuaugcucacccccugcguguucugcauuuccacgcggcaccaucuccaagcaagacgugugcaaaacucuguguacacgacagccguucucacuugccagagaggcuugcaggagcuacagucauguaguuuugaaggaagugcgguuuuucaaccugcagguccuauauccccuccugucugauccugcccuuaaucugcguauugugcacuuggugcgcgacccaagagcaguccucaggucccgggaggcugccggucccauccuggcgcgagauaacgggauuguuuuaggaaccaauggcaaauggguggaagccgacccucaucugcgccucaucagagagguauguaggagccacgugcggauagcagaggcugccacgcuuaagccacccccguuucugcgcggcagauacagguugguccguuucgaagaucuagcucgggagccucuggccgaaauccgagcacucuaugccuucacugggcugacccuuacaccccagcuggaggcuuggauucacaacaucacucauggaucggguauuggcaagccaaucgaggcguuucacaccucuuccagaaaugcaaggaacgugucacaagccuggcgccacgcuuugccuuucacaaaaauacuccggguucaggaagugugcgccggggcacugcaguuacugggauacagacccgucuauagugccgaccagcaaagggaucuaacccucgaccuggugcuuccacgcggccccgaccauuuuagcugggcuuccccugauuga

SEQ ID NO: 54413 - RNA, 1188 nt, Artificial Sequence
  derived and/or modified sequence opt3 from CHST6__Homo_sapiens__XP_011521387
auguggcugcccagagugagcuccaccgccgucacagcucuccuucuggcacagacuuucuuguuacuguuucuaguuucuaggccuggcccaucaaguccggccgggggagaggcgcgggugcacguacucgugcugagcuccuggcgcucugguucgucauucgucggccaacuuuuuaaccagcaucccgacguguucuaccugauggaaccugcuuggcacguuuggacgaccuugagccaggggagugccgcaacacuccauauggccgugcgagaucugguccguuccguguuucugugcgacauggauguauucgacgcuuaucucccauggagaaggaauuuaucugaucuguuucagugggcaguuagccgggcccuuuguucacccccugcuugcuccgccuucccacgcggagcgaucaguagcgaggcaguguguaagcccuugugcgccagacaaucuuuuacucuggcuagggaagccugucgguccuacucacacgucgugcuaaaagaggugcgcuucuuuaaccuccagguccuguauccucuucugagcgacccagcauugaaucuccgaauuguucaucuggugagagauccgagggcuguauuacggagucgugaacagaccgccaaggcgcuggcccgcgacaacggcauagugcucgguacaaaugggaccugggucgaggcagaucccggacuuagagugguuagggaggugugccggucucacguccgaaucgcugaagccgcuacucugaaaccuccacccuucuugcgcggcagauacaggcuagugcgguuugaggaccuggcccgcgaaccucucgcagagauuagagcccuguaugcuuucacaggccuuucccugaccccacaguuggaggcguggauccacaacauuacgcaugggagcggacccggugcaaggcgugaagccuucaagacuucgucucggaaugcucucaacguaucccaagccuggcgacacgcacugccguuugccaaaaucagaaggguucaggaguuaugugcuggcgcccugcagcuacucggguaccgcccuguguauucagaagaugagcagcggaaucuggcacuugacuugguccugcccagaggacucaacggcuucaccugggcgaguagcacagcuucccauccaaggaauuga

SEQ ID NO: 54414 - RNA, 1275 nt, Artificial Sequence
  derived and/or modified sequence opt3 from CHST8__Homo_sapiens__XP_011525528
augacccugagacccggcacaaugaggcucgccugcauguucagcuccauccuucuguuuggggcugcaggauuguuacuguucauuucucuacaggacccuacugagcucgccccacaacaggugccggguauaaaguuuaacauccggccccgccagccucaccaugaucugccacccggcgggucacaggacggagaucuuaaagaaccuacggagcgagucacccgugaccugaguagcggcgcgccaagagguaggaauuugcccgcuccugaucaaccacagccgccccuccagcgggggacacgccugagacugaggcagcggcgccgaagacucuuaauuaagaaaaugccugccgcagccacuaucccagcuaacuccucugacgcacccuucauuaggccuggaccaggcacccuggauggccgguggguuucgcuucaccguucacaacaggaacgcaagagagugaugcaggaggccugugcuaaauacagggccagcaguucccggcgagcgguaacaccccgccaugugucuagaaucuuugucgaagacaggcaccggguguuguauugcgagguuccgaaggcaggguguagcaauuggaagcgcgugcugaugguccuagccggacucgcuuccucaaccgccgauauacagcauaacacugugcacuacgguagugcacugaaaagacuugacacauucgauaggcaaggcauccugcaccguuugagcaccuauacgaagaugcucuuuguacgggagccuuucgaacgacugguuucugcuuuuagagacaaauucgagcaucccaauuccuacuaucacccaguguuugggaaggccauuuuagcgagguaccgcgccaacgcaucacgggaagcucugagaacuggaagcggcgucagguucccugaguuugugcaguaucuccuugaugugcaucgccccgucgguauggacauccacugggaccacguuagucgacugugcucuccauguuugauugauuacgacuucguggggaaauucgaguccauggaagaugacgccaacuuuuuccuaagccugauccgggcuccccguaaucucaccuuuccuagauucaaggauaggcauucgcaggaggcccgcacaacugcacggauagcccaccaauacuuugcucagcugucugcgcuucagagacagaggaccuaugacuucuacuauauggauuaccugauguuuaauuauuccaagccauucgcagacuuguacuga

SEQ ID NO: 54415 - RNA, 225 nt, Artificial Sequence
  derived and/or modified sequence opt3 from CHST9__Homo_sapiens__NP_001243245
augcagcccagcgagauggugaugaacccuaagcaagucuuccuguccguucucaucuuuggcguggccgggcuucuguuguucauguacuuacagguauggauugaagaacagcacaccggaagaguggagaaaaggcgggagcagaaggucacaucugguuggggcccagugaaauaucugcgcccgguuccccgaauaaagccucaagugucacaugcuuga

SEQ ID NO: 54416 - RNA, 2409 nt, Artificial Sequence
  derived and/or modified sequence opt3 from CHSY1__Homo_sapiens__NP_055733
auggccgcuagaggcaggcgggcauggcugagcgugcuccuugggcuggucuugggauucguuuuagccucccgccuggugcuaccccgagcgucugagcucaagcgugcugguccuagaaggcgggccucaccagaaggcugccgcagugggcaggcagccgcuagccaagcaggaggcgccagaggugacgcuaggggagcccagcuguggccgcccggauccgauccugacggcggcccacgggaucgcaacuuucuuuucguaggggugaugaccgcgcagaaauaccugcagacacgagcagucgccgcuuauagaacuuggucuaagacgauccccggaaaagugcaauuuuucucgucagaggguagcgacaccaguguuccuauuccagugguccccuugaggggcguggaugacuccuacccuccacagaagaaaucuuuuaugaugcucaaguauaugcacgaucauuaccuggacaaguaugaaugguucaugcgggccgaugacgauguauacauaaaaggggaccgucuggagaauuuucuccgcagcuuaaacuccucagaaccgcuguuccuuggacagacaggcuuggguacuaccgaggagauggggaagcuggcacuagaacccggagagaauuuuuguaugggcggcccugggguuaucaugaguagagaagugcucaggcggauggucccacacauuggaaaaugccugcgagagauguauacaacccaugaggauguggaagugggucgcugugucagaagguucgcuggcguucagugcguguggagcuacgagaugcaacagcuuuucuacgaaaacuaugagcagaauaagaaaggguacauccgggaccugcacaacucuaagauucaucaggccaucacuuugcaccccaauaagaacccuccauaucaauaccgccuccacuccuauaugcugucaagaaaaauaagcgaauuaaggcaucguacaauccagcugcaccgggagauuguacucaugaguaaguacucuaauaccgagauccauaaagaagaccuucagcuggggauucccccguccuucaugcgauuucaaccuagacagagggaggaaaucuuggagugggaauuucuaacgggcaaguaucuguacagcgcgguggauggucagcccccacgccgggggauggacucggcccagagagaggcacucgaugacauagucaugcaagugauggagaugauuaacgcuaaugccaaaacuaggggccgcaucauugauuucaaggaaauccaguacggauaucgacggguuaacccuauguacggcgcugaguauauccuggaccuucuguugcucuacaaaaagcacaaggggaaaaagaugaccgugcccguccguagacacgccuaucugcagcagacauuuucuaaaauucaauucguggaacaugaggaauuagaugcacaggagcuggccaagaggauaaaucaggaguccggaucacuaaguuuucucagcaacucccugaaaaaguugguaccauuccagcuucccgguucuaagagcgaacacaaagagccuaaggacaaaaagaucaauauucugaucccacucucaggccgcuuugauauguucguucgguuuauggggaacuucgaaaagacuugucugauaccgaaccaaaaugugaaacuugucgugcuguuguuuaacagugacuccaaucccgauaaggcuaaacaggucgagcucaugagagacuacaggauuaaguauccuaaagcggacaugcagauccugccagugagcggagaguucucucgagcauuagcccuggaaguuggcucaagucaguuuaacaaugagagccuacucuucuuuugcgauguggaccugguauucaccacagaguuccuucaacgcugucgggcuaacaccgucuugggucagcagaucuacuuucccauuaucuucucccaauacgauccuaagauuguguauucugggaaaguuccaucggacaaucauuuugccuucacgcagaagacuggcuuuuggagaaacuacggauucggcauaacaugcaucuauaagggggaucuggugagggucggagguuuugacgugagcauucagggcugggggcucgaagauguagaccuguucaauaaagugguucaggcaggauuaaagaccuuucguucccaagaagucggcguggugcacguccaucaccccguuuucugugauccgaaccuggacccuaaacaguacaagaugugccuugguucaaaagccaguacuuaugggucuacacagcaguuggcugagauguggcucgagaagaaugauccaagcuacuccaaaucaagcaacaauaacggcucugugcgcaccgccuga

SEQ ID NO: 54417 - RNA, 2649 nt, Artificial Sequence
  derived and/or modified sequence opt3 from CHSY3__Homo_sapiens__NP_787052
auggccgugagaagcaggcggcccuggauguccgucgcucugggccucguucuuggguucaccgcagccucuuggcugaucgcgccucgcguggcugaguugucagaacgaaagcguagaggaaguagcuuaugcuccuacuaugguaggucugccgcaggcccacgggccggggcucagcaaccgcugccccagccucagucgcgcccaagacaggagcaaucacccccuccagcaaggcaggaccuacagggacccccucucccagaagccgcuccgggcauuacuagcuuucggaguucccccuggcagcaaccuccaccccugcagcagcgccgaagagguagggagccugaaggggccacaggacuuccaggcgcgcccgcagccgagggcgagccggaagaggaagaugggggagcugccggucagcggcgugacggccgcccugggucuagccacaacggauccggcgaugguggggcagcugcccccucagcgagaccaagggacuuccuguacguaggagugaugacggcccaaaaauauuugggcagucgggcacucgcugcccagcgaaccugggcucgcuuuauaccuggcagagucgaguucuuuagcucucagcaacccccaaaugccgggcagcccccuccaccgcugcccgugaucgcacugccuggaguugaugacuccuacccaccccagaagaaaucauucaugaugauuaaguauaugcaugaucacuaccucgacaaauaugagugguuuaugagggccgaugacgauguguacaucaagggugacaaguuagaagaguuccugcggagccuuaacaguucuaaaccuuuguaccugggccagacagggcuaggaaauauugaagaacucggcaagcugggucuugaaccaggggagaacuuuuguaugggcggacccggcaugaucuucucccgcgagguccugagaaggauggugccgcauauaggggaaugcuugcgugagauguauacuacccacgaagauguagagguuggacggugugugcgaagauuugguggcacacaaugcgucuggagcuacgaaaugcagcagcuauuccaugagaauuaugagcacaacaggaaaggguacauccaggaccugcacaauucgaagauucaugcugcgaucaccuuacacccuaacaaacgcccagcauaucaauaccggcugcauaauuauaugcucucuagaaagauuuccgaacuuagguaccgcacuauccagcugcaccgagagucagccuugaugaguaagcuaagcaacacagaaguguccaaagaggaccagcagcugggagugauacccucuuuuaaucacuuccaaccucgggaacguaacgaggucauugagugggaguuccucaccggcaagcugcuuuacagcgcugccgagaaucagcccccaagacagucacugaguuccaucuugaggacggcacucgaugacacuguucuccaggugauggaaaugauuaacgagaaugccaaaagccgcggucgguuaaucgauuuuaaggagauccaauauggguacagaaggguaaacccuaugcauggcguggaauauauucuggaccuacuccugcuuuacaaacgacacaagggacgcaaauugaccguccccgugcggagacaugcuuaucugcagcagcuguucucuaagccauuuuucagggagacagaggaacuggauguuaacucacuuguggaaaguauaaauagcgagacucaauccuuuucuuucaucucgaacagccugaagauuuuguccucauuucagggcgccaaagagaugggagggcacaaugaaaagaaaguccauauccucgugccgcugauaggucguuacgacauuuucuuacgcuuuauggagaacuucgaaaauaugugucugaucccuaagcagaacguaaaacucguuaucauucucuuuagucgggauucuggccaggacagcuccaagcacaucgagcugauuaagggguaucaaaauaaauaccccaaggcagaaaugacccuuauaccaaugaaaggagaguucucaagaggcuugggucuggagauggcgagcgcucaguuugauaacgacacacuccuguuauucugcgauguggaccugaucuucagggaagacuuucuucagcgaugucgggauaauaccauucaggggcaacaggucuacuaucccaucaucuucucucaguacgacccuaaggugacgaacggcggaaauccacccacugaugacuauuuuauuuucuccaaaaagacaggcuuuuggcgcgauuacggguauggaauaaccugcaucuacaagagugacuugcucggcgccgguggguucgauacuagcauucagggauggggccuggaggacgucgaucuauauaacaaagugauccugucuggucucagaccuuuuaggucccaagaaguuggcgugguacacauuuuccauccgguccacugugacccaaaucuggaucccaagcaguacaaaaugugccuugggucaaaggcaaguacauuugccagcaccaugcaguuggcugagcugugguuagaaaaacaucucggagugcgguacaaccgaacgcugucguga

SEQ ID NO: 54418 - RNA, 2928 nt, Artificial Sequence
  derived and/or modified sequence opt3 from CHTF18__Homo_sapiens__NP_071375
auggaggacuacgaacaggagcugugcggcguggaagaugacuuccacaaccaauuugccgcugagcucgaaguccuugcagagcuggagggggccagcacccccuccccuucuggaguuccauuguucacagcggguagaccgcccaggacuuuugaagaggcuuuagcccggggcgaugcagccucaaguccugcuccagcagccagcgugggguccucucagggaggcgcucgcaagcgacagguagacgccgaucugcagcccgcggguucgcuaccucaugcaccacguaucaaaagacccaggcuccaaguggucaagcggcugaauuuccgcucagaagagauggaggaaccuccaccgcccgacagcaguccuacggauauuaccccacccccuuccccagaggaccuugccgaacugugggggcacggagugucugaggcugccgcagauguuggcuugacaagagcuagccccgccgcgaggaacccggugcuccggcgcccucccauacuggaagacuauguccaugugacuuccaccgagggcguacgagccuaccugguucucagagcagauccaauggcuccuggggugcagggaucauuacugcacguccccuggagggguggcgggcagcuugacuugcugggagugagucuagccagccucaaaaagcaaguggauggcgagcggcgugaacgccugcuucaggaggcucagaaacugucugacacauugcauucccucagaucaggugaagaggaagccgcacagccacugggggcccccgaggaggaaccuaccgacggacaggaugcuagcagucacuguuuaugggucgacgaguuugcgccaaggcacuauacugaacugcucucugaugacuucacaaaucggugccuucugaagugguugaagcuaugggaucugguuguguuuggccaugagcgaccgucccgcaaacccagaccuagcguagaaccagcaagggugucgaaggaggccaccgcucccggcaaauggaagucucacgagcaaguccucgaagagaugcuggaagccgggcuugacccuucccagcggccaaaacagaagguggcacuguuguguggacccccgggucucggcaagacgacucuggcccauguuaucgcucgccacgccggguacucaguggucgagaugaacgcaagugaugacagaagcccugagguguucaggacccguauugaagcggcuacacaaauggaguccguauuaggagccggcgguaaaccaaauugccugguuaucgaugaaauugacggggcacccguggccgcuaucaacguccuacucucuauacugaaucggaagggcccucaggaggugggaccccagggcccagccgucccuagcgggggaggucgaagaaggcgcgcagaaggcgggcuuuugaugcggcccaucauuuguaucugcaacgaucaguuugcuccaucacugagacaacucaaacagcaggccuuccugcuucacuuuccgccuacucugcccaguagguuggugcagcgccuccaagagguuucccugcgacagggaaugcgggcggacccaggcguguuagccgcucugugugagaagaccgacaaugauauucgugcaugcaucaacacacuacaguuccucuauagcagaggucagagggaacugucuguacgcgacguccaagccacccggguggggcuuaaagaucagagaaggggcuuguuuucaguuuggcaggagguguuccagcugccccgagcucaacgccggagagucggacaggacccugcccucccagcagauacgcuguuacugggcgacggggaugcgggaagucuuacuagcgccucccagagguucuaccguguguugcaugcugccgcaucugcuggugaacacgagaagguagugcaaggccucuuugacaauuuccugcgccuacggcugagagauucgagccucggggccguuugugucgcacuggacuggcuugccuuugaugacuugcuggcuggagcggcccaucacucccagucauuccaguuacucagguaucccccuuuucugccgguggcauuccaugugcuuuuugcuaguucucacacaccacgaauaaccuuccccagcucccagcaagaagcccagaaccggaugucacagaugcgcaaucugauucagacuuuggucagcggcaucgccccugcuacaagaucuagggcaaccccacaagcccuccugcuagaugcgcugugccuccugcuugacauuuuggcucccaaacugcggccuguuuccacgcaguuauacaguacccgagagaagcagcagcucgccagccugguggguacaaugcuugcauacucucugacuuauagacaagagcgcaccccggacgggcaguacaucuauaggcuagaacccaacguggaggaacucugucguuuuccagagcugccugcccggaagcccuugacauaccagacuaaacaacugaucgcuagagaaauugagguagagaagaugaggcgcgcagaagccuccgcgcgagucgaaaauucaccacagguggauggcaguccucccggauuagagggccuccuugggggaauaggcgagaaagguguucacagaccagcuccgcggaaccaugagcagaggcuggaacacaucaugcgccgugccgcaagagaggaacagccugagaaggacuucuuugggcggguggucgugaggagcaccgccguucccucggcuggagauacagccccagaacaagacuccguggagcgccgaaugggcaccgcaguagguagaucugaggucugguuccgguuuaacgaaggcgugagcaaugcugugaggcgcucacuguauauuagagauuugcucuga

SEQ ID NO: 54419 - RNA, 750 nt, Artificial Sequence
  derived and/or modified sequence opt3 from CHTOP__Homo_sapiens__NP_001193541
auggccgcucagagcgcacccaaggugguccugaaauccaccacaaagaugucucucaacgagagauucacuaauaugcuuaaaaacaagcaaccuacgccaguuaauaucagggccucaaugcagcagcagcaacagcuggcgagugcucggaaccgccgauuggcccagcagauggaaaaucguccgagcgugcaagcagccuuaaaacugaagcagaagucccuaaaacagagacucggcaagucuaacauucaggcuaggcuggggcggcccauaggagcacuugcccgcggugcuaucggcgggagaggacugccuauuauccaaaggggcuugccacggggugggcuccgcggaggccgagccaccagaacacugcugaggggcgggaugucgcuccggggacagaauuuacugcgugguggccgcgcgguagcacccagaauggggcuuaggcggggaggcgugcgaggucgcgggggaccuggcagaggcggguugggaaggggugccaugggccgcgggggaauuggcggucgggggagaggcaugaucggaaggggccgugggggauuugguggccgggggcgaggaagaggcaggggucgcggggcucuggcccggccaguccuaacuaaagagcagcucgacaaccaacuggaugcauacaugucaaagaccaaaggccaccuugacgcugaacuggaugccuauauggcgcagacagaccccgagaccaaugauuga

SEQ ID NO: 54420 - RNA, 420 nt, Artificial Sequence
  derived and/or modified sequence opt3 from CHURC1__Homo_sapiens__NP_001190992
augagacagcccuaccugagcuccagggaggugucuucaagucggaagcgcuggcgaaccuucccugucgacugcguugccauguguggcgauugcguggaaaaagaguauccaaaccgugggaauacaugucucgaaaacgguagcuuucuucugaauuucacuggaugcgcuguauguuccaagagagacuuuauguugaucacgaacaaaucuuuaaaggaggaagauggcgaggagauugugaccuacgaccaccugugcaaaaauugucaucacgucauagcaaggcaugaauauacauucucgaucauggaugaguuucaagaauacacuaugcuaugccuccugugugggaaggccgaggacaccauuucaauccuuccggaugacccccggcagaugacacuguuguucuga

SEQ ID NO: 54421 - RNA, 1020 nt, Artificial Sequence
  derived and/or modified sequence opt3 from CIAO1__Homo_sapiens__NP_004795
augaaggacagccuggugcuccuuggcagaguccccgcccacccugauuccaggugcugguuccuggcuuggaacccagcagggaccuuguuagccucuuguggaggugaccggcgcauccgaauuuggggcacagagggggauucauggauaugcaaaaguguucugagcgaaggacaucagcguacugugagaaagguagcgugguccccguguggcaauuaccuagcuucugccucguuugacgcaacgaccugcaucuggaaaaagaaccaagaugacuucgagugugugacaacucucgaaggucacgagaaugaagucaaaucaguggccugggcucccagcgggaaccugcuugcaaccugcaguagggauaaguccguuugggugugggaggucgacgaggaagaugaguaugaaugugugucuguacugaauagccauacacaggacguuaagcacguggucuggcauccuucccaggaguugcucgccucagcuaguuacgaugacaccgugaaacuguaucgggaggaagaggaugacugggugugcugugccacucuggaaggacacgagagcacagucuggucucucgcguuugacccauccggccagcgcuuagcaucaugcagcgaugacagaaccguuaggauuuggcggcaauaccugcccggcaacgaacaggggguggccuguaguggaucugauccuuccuggaagugcaucugcacgcuuagcgguuuccacucgcgcacuauuuaugacaucgcuuggugucaguugaccggcgcccuggcaacagcuugcggggaugacgccauacgaguauuucaggaggauccaaauucugacccccaacagccuacuuucucccuaaccgcgcaucuccaccaggcccauucacaggaugugaacugugucgcauggaauccaaaagagccgggacugcuugcuaguugcagcgacgauggcgaaguggccuuuuggaaguaccaaagacccgagggucuguga

SEQ ID NO: 54422 - RNA, 939 nt, Artificial Sequence
  derived and/or modified sequence opt3 from CIAPIN1__Homo_sapiens__NP_064709
auggccgacuucggcaucagcgcugggcaguuuguggcagucguuugggauaaguccucucccguggaggcccugaaaggacucguagacaaacuucaagcgcugaccgguaacgaaggcagagugucagucgagaauauuaaacaguuguuacagagugcucacaaggaaagcuccuucgauauaauccugucugggcuagugccuggaucgacaacucuccauucagccgagauucuggcagaaaucgccaggauucuucggccaggcgguugccuguuuuugaaagagccgguugagacggcuguggacaacaauagcaaggucaagaccgcaaguaaacucuguuccgcccugacacugucugggcucguggaaguaaaggaguuacagcgcgaaccccugacuccugaggagguucaaagcgugcgagaacaccuuggacaugaguccgauaacuugcuguucguccagaucaccggcaaaaagccaaauuuugaagugggcucaagucgucagcuaaaacucagcauaacaaagaagucuucccccucagugaaaccugcugucgacccagccgcggcaaagcuguggacccuuagcgccaacgauauggaggacgauaguauggaccugaucgauucugacgaauugcucgaucccgaggaccugaaaaagccugacccagcuuccuuaagagccgcaagcugcggggaggguaaaaagaggaaggcuuguaagaauugcacuuguggacuggccgaggaacucgaaaaggagaaaucgcgggaacagaugucuucccaaccgaagucagcgugcggcaacuguuaccuuggggaugccuuccgcugcgcaaguugucccuaucugggaaugccugcuuuuaaaccaggcgagaagguuuugcuaagcgacuccaaucugcacgaugccuga

SEQ ID NO: 54423 - RNA, 576 nt, Artificial Sequence
  derived and/or modified sequence opt3 from CIB1__Homo_sapiens__NP_006375
augggcgggagcggauccagacugucuaaggagcuccuugccgaauaccaggaccugaccuucuugacaaaacaagagaucuuacuggcucacaggcgguuuugcgaacuacucccccaggagcagcgcucaguggaaaguagccugcgagcacaggucccuuucgagcaaauucuuucccugccagaguugaaggccaacccguuuaaagaacguauauguagaguuuucucuacuucgcccgcgaaggauucacucagcuuugaggacuuccuggaucugcucaguguguuuuccgacacggcuaccccugauaucaaaucucauuaugccuucaggauuuuugacuucgaugacgaugguacauuaaaucgggaagaccugagccgccuuguaaacugcuugacuggcgagggggaggauaccagacuguccgcaucagaaaugaagcagcuaaucgacaauauucucgaggaaagugauaucgacagggacggaacaauaaaccugagcgaguuucagcacgugaucucucgguccccagauuucgccagcucauuuaagauuguccuuuga

SEQ ID NO: 54424 - RNA, 564 nt, Artificial Sequence
  derived and/or modified sequence opt3 from CIB2__Homo_sapiens__NP_006374
augggcaacaagcagaccaucuucacagaggaacaacuggacaauuaccaggauugcacguuuuucaacaaaaaggacauucucaaacuucacagcagauuuuaugagcuggcccccaauuuggugccuauggauuacaggaaguccccaauaguccauguuccgaugucuuuaaucauucagaugcccgaacugcgggagaacccuuucaaagaacgcaucguggcugcauuuucagaggacggggagggaaaucuaacuuucaacgauuuuguagacauguucagugugcucugugaaagcgccccacgagagcugaaggcgaauuaugcuuuuaagauuuacgauuucaacaccgacaauuuuaucugcaaagaagaucuugagcugacauuggcccgucucacuaaguccgagcuggacgaagaggaagucgugcugguuugugauaaagugauagaggaagcagaccucgauggugacggcaaguuaggguucgccgacuuugaggauaugaucgcuaaagcacccgacuuccugucuaccuuccacauuagaaucuga

SEQ ID NO: 54425 - RNA, 4827 nt, Artificial Sequence
  derived and/or modified sequence opt3 from CIC__Homo_sapiens__NP_055940
auguacagcgcccacagaccccugaugccugcuuccucugcagccucaaggggccucgggauguucguguggaccaacgucgagccacggaguguugcgguguuuccguggcauagccuuguacccuuccuggcuccuucccagccagaccccucugugcaaccuucggaagcccagcagccagcaucacaccccgucgccagcaaucagaguaaggagccugcugaauccgcagccguggcucaugagcgcccaccgggagguacaggcucugccgaucccgaacgaccuccaggggcgacuugccccgagagcccuggaccaggcccaccgcacccuuuggguguuguggaguccgggaaaggacccccaccuacgaccgaagaggaagcaucagggcccccaggcgagccccguuuagacagugagacagaaagcgaucaugacgaugccuuucugucuaucauguccccugagauucaacuaccacucccgcccggcaagagaaggacucagucacugagcgcacuuccuaaagaacgggacaguucuuccgagaaggauggacgcagcccaaacaaaagagaaaaggaccacauaaggcggcccaugaaugccuucaugaucuuuucgaagcgccaccgagcacugguccaucagagacacccuaaccaggauaauaggaccgugucuaaaauuuugggugaguggugguaugcucucggcccaaaggagaaacaaaaguaccaugaccuggccuuccagguaaaagaagcgcacuuuaaggcccaccccgauuggaagugguguaacaaagaccggaagaaauccucaagugaggcaaagccgacaagccuggggcucgcuggaggccauaaagaaacccgugagcgcuccaugucugaaacugguacagccgcugccccugggguuagcucagaguuacugaguguggcagcccagacccuuuuguccagcgauacgaaggcuccaggaucuucaaguugcggcgcggagagacugcacacugucggcgggcccggaagcgcaaggccucgggccuucucccauucuggugugcacucgcuagacggcggggaaguggacagccaggcucuccaagagcugacccagauggucuccggacccgccucauauaguggcccaaaaccuucuacacaguacggugcacccgggccauuugccgcuccgggcgaaggaggcgcccuugcagcgacugggcgaccuccccuguugccaacccgcgcuagcagaucccaaagggccgcaucagaggauaugacaagcgacgaggaacggaugguuaucugugaggaagagggagaugacgaugugauugccgacgaugguuucggcaccacggacaucgaucucaagugcaaggaacgcguaacugacucugaguccggggauaguagcggagaggaccccgaaggcaauaaagguuuugggagaaagguguucucuccugucauaagguccucauuuacacauugucguccaccccuggacccugagccgccaggacccccugauccacccguggcuuucggcaaaggcuaugggagugccccuagcucguccgcaucuagcccggcuucaaguuccgccucugcggccaccagcuucuccuuaggaucagguacuuuuaaggcucaggaaagcggccaggggaguacagcaggaccccugcggccaccucccccaggcgccggugggccugcuacccccucuaaagccacgcgauuccucccaauggacccggcaaccuuuagaaggaagcgcccugaguccguuggcggacuugaacccccaggccccagcgugaucgcggccccuccaucagggggaggcaacauucugcagacauugguccuacccccuaauaaggaggagcaagaaggugggggagcucgggugccgucggccccagcacccucucuggcuuacggcgccccugcagcuccccucaguagaccagccgcgacuaugguaaccaacguugugaggccugucuccagcacacccgugccaaucgccucuaaaccuuucccgacuagcggucgcgcagaggcuucccccaaugauaccgccggcgcccgaacagaaauggggaccggaucacgggucccaggcgggaguccucugggagugagccuuguuuauucugacaagaaauccgcugcagccacuucacccgcgccacaccugguggcuggcccuuugcucgguacgguagggaaggcccccgcaacagucaccaaccuguuagugggaacuccgggcuacggugccccagcuccucccgcaguucaguuuauugcccagggcgcgccagggggaggcaccacagcugggaguggagccggcgcagguagcgggcccaauggaccugugccgcugggcauccuacagcccggugcccucggcaaagcugggggaauaacccaaguccaguacauucugccaacucuuccucagcaguugcaaguggcccccgcuccugcuccagcccccggcacaaaggcggccgcaccuuccgggccagcucccacgaccucuauccguuucacucugccgccuggaacaucgaccaacggcaagguacucgccgcuacagcaccaacucccgguauuccuauccugcagagcgugccaucagcucccccgccuaaagcccaguccguuagucccguccaggccccaccucccgggggaucugcgcaacuucugccaggcaagguguuggugccccucgcagccccuagcauguccgucagaggcgggggagcuggucagccacugccguuaguuucacccccuuuuucugugccagugcagaauggcgcccaacccccuagcaaaaucauucagcugaccccaguacccgucaguacgccuuccgggcuagugccgccacucagccccgcaacccugccuggacccacaucucagccacagaagguucuuuugccuucauccacuaggauaaccuaugugcaaagugccggcggucacgcucugccccucgggacaagcccagcgucgucucaggccggaacugucaccuccuacggcccgacgagcucaguggcacugggcuucacaaguuuagggccuucuggacccgcuuuuguucagccacugcuuuccgccggucaggcacccuugcucgccccuggccaaguggggguaagcccaguccccucaccucagcugccgccagcuugcgccgcgcccggaggcccugugaucaccgcauucuauagugguagcccagcccccacuuccucugcuccucuagcccagcccagccaggcuccaccgucccugguguacacagucgcaaccucaacuaccccucccgccgcuacaauucucccaaaagggccucccgccccagcaacggcgaccccugcccccacuucuccguuuccaagugcuacagccggaucgaugaccuauagccugguugcaccuaaggcucaacgccccuccccaaaggcaccccagaaagugaaggccgccaucgcuucuauaccuguaggcucauucgaggcgggcgccagcgggcggccgggaccagcacccagacagccucuugaacccgguccagugagggagccuacagcucccgaguccgaauuggagggccaaccaacuccuccggcacccccaccucugcccgaaaccuggacgccaacagcccgaaguucuccucccuuaccgcccccugccgaggaacgcaccagcgcuaaagggcccgagacuauggccucaaaguuuccauccaguagcucugauuggcggguccccggacagggccucgagaacagaggugaaccucccaccccaccuuccccggcgcccgcuccagccguggcaccugggggaucaagcgagucgucuaguggcagggccgcuggcgacacacccgaacguaaagaggcagccgggacuggaaagaaaguuaaggugcgcccaccuccccugaagaaaaccuucgauuccgucgacaaccgggugcuuagcgagguugauuucgaagagagauuugcggaacugccggaguucaggccugaagagguguugccaucacccacacuccagucccuggcuacgucuccucgagccauucuagguagcuaccggaagaaacgcaagaauaguaccgaccuggauuccgcaccagaggaccccacuagcccuaaaagaaagaugaggcggcgaucuucauguaguuccgaaccaaacacacccaagagcgccaaaugcgagggcgauaucuuuaccuucgacagaacugggacagaagcugaggacguccucggagaacuggaguaugauaagguaccguacucuucgcuucgcaggaccuuggaccagcgucgggcccuggugaugcaauuauuucaggaucauggcuucuuuccuucagcacaggcuacggccgcguuccaggccagauacgcagacaucuuucccagcaaaguuugucuccaacugaagauuagggaggugcgccagaaaaucaugcaggcugccacuccaaccgaacagcccccuggugcagaggcuccacuucccgucccuccaccgacagggaccgccgccgcgcccgcuccuacuccaucccccgcaggaggcccugauccaacaagucccucuagcgacuccggcaccgcccaagcugccccgccucugccacccccucccgaaucagggccaggacagccggguugggagggcgcaccucagcccaguccacccccuccagggcccucuacagccgcuacuggacgauga

SEQ ID NO: 54426 - RNA, 660 nt, Artificial Sequence
  derived and/or modified sequence opt3 from CIDEB__Homo_sapiens__NP_001305736
auggaguaccugagcgcccucaaccccuccgaccuucugagaucugugucaaauaucaguagcgaguucggcaggcgggucuggaccuccgcuccuccaccgcagcgccccuuucgaguuugcgaucacaagcguacaauuagaaaaggguugacugcagccacgaggcaagaauuacuggcgaaggcucuagaaacccuccugcuuaacggagugcugacauugguacucgaggaagacgguacugccguggauucugaggacuucuuucagcugcuggaggaugacaccugucucauggucuuacagucgggccagucauggagcccuacacggaguggggugcuguccuauggacuuggccgcgaaagaccaaaacauucuaaggauauagcaagguucaccuuugacguuuacaaacaaaauccccgggauuuguucgguagccugaacgugaaggccacuuuuuaugggcuauacuccaugucaugcgacuuccagggacucggcccuaagaaaguccugcgcgagcuucugcgauggacaaguaccuugcuccagggccuggggcacauguuacugggaaucagcucuacgcucagacaugcuguggaaggugcagagcaguggcaacagaagggcaggcuucacuccuauuga

SEQ ID NO: 54427 - RNA, 747 nt, Artificial Sequence
  derived and/or modified sequence opt3 from CIDEC__Homo_sapiens__NP_001186480
auggaguacgccaugaaaagccugucccuccuuuaucccaagucucugucaagacacgugagugucaggaccagcguugugacacagcaauuguuauccgaaccuucuccaaaggcuccgcgggcacgccccugccgaguaucgacugccgaccguucagugagaaaaggcaucauggcguacagccuggaggaucuacuccugaagacgaggaacccugaagcucggagucaggagguccgcgacacccuuaugcuggccgauaaaccauucuuuuuggugcucgaagaggacgggacaacuguugagaccgaagaguauuuccaggcacuggccggagauacaguguuuaugguccugcagaagggucaaaaguggcagcccccuuccgaacagggcaccagacauccacucucuuuaagccacaaacccgcuaagaaaauugacguggcaaggguaacuuucgaucuguacaagcucaauccucaggacuuuauaggguguuugaacguuaaagccacauucuaugauaccuacucccugucauaugaccuacauugcuguggagcuaagcggaucaugaaggaggccuuucgcugggcgcuuuucaguaugcaagcaacgggccacgugcugcuugguacuagcugcuaccugcagcaguugcucgaugccaccgaggaagggcagccaccgaaaggaaaggcuucuucccugauucccacauguuuaaaaauccugcaauga

SEQ ID NO: 54428 - RNA, 3393 nt, Artificial Sequence
  derived and/or modified sequence opt3 from CIITA__Homo_sapiens__NP_000237
augagaugccuggcccccaggccugcuggcagcuaccucuccgagccacaggggucuucacaaugugcaaccauggaacuuggaccgcuggaggguggcuauuuggaauuacugaacagugacgccgauccccuaugccucuaccacuucuaugaccagauggaucuggcgggggaggaagagaucgagcuuuacagcgaaccugacacagauacuauuaauugugaccaguuuucccggcuguugugcgauauggagggagacgaagagacgcgcgaggcuuaugccaacauagcagaacucgaucaguacguguuccaagacucucagcuggagggccugucgaaggauaucuuuaaacauauugguccagacgaagucaucggggagucaauggaaaugcccgccgagguuggacaaaagagccagaaacgaccuuucccagaggaacuccccgcugauuuaaagcacuggaaaccugcagagccaccgaccgugguaacaggcagucugcuugugggccccgucuccgacuguucuacuuugccuugccugccacuacccgcccucuuuaaucaggaaccugcuagcgggcagaugcgucuggagaagaccgaccagauuccaaugcccuucuccucaaguagccuuucuugucugaacuugccggaaggaccuauccaguuugugcccacaauauccacccucccacauggucuguggcaaaucucagaggccggcacugggguuagcaguauuuucaucuaucacggagaggugccucaggcgucucaggugcccccacccuccggcuuuacaguccaugguuuaccuaccagcccagauagaccggggucgacgucucccuucgcaccuuccgccacugaccugccaucaaugcccgaaccugcucucaccaguagggccaauaugacagagcacaagacuagcccaacccaaugccccgcagcuggagaaguauccaacaaacuuccgaaguggccugagccaguugaacaguuuuaccggucucugcaggauacauacggcgccgagcccgcgggcccugacgggauuuugguggaggucgaucuagugcaggcccgccuggaaagaagcucaaguaaaucccucgagagggaacuggcaacccccgacugggcugagcggcaacuugcccagggaggucuggcugagguguugcucgccgcaaaggaacaccgccgaccaagagagacgagggucaucgccguucugggcaaagcugggcagggaaagagcuauugggcgggcgcagugucucgggccugggcuuguggucguuuaccucaguacgauuucguauuuucagugcccugccauugucugaaucgcccaggggacgccuauggccuacaagaucuccuguucagucuuggaccgcagccuuuggucgcagccgacgaaguguucagccacauacugaagagacccgauaggguucuccugauucuugacggcuuugaggaacuggaggcucaggacggguucuugcauuccacuugcggaccagcccccgcagagccuugcucucuccggggucuguuagcgggccuguuucagaaaaagcuacuccgaggguguacacugcuuuugaccgcucgcccaagaggaaggcuggugcaaucgcucagcaaagccgaugcacuguucgaauuauccggcuuuucaauggagcaggcccaggcuuacgucaugcgguauuucgaaaguucugguaugacugagcaccaggaccgcgcccugacacuuuugagagauaggccccuccugcuaagccacucccauucaccuacccugugccgugcagugugucaacucagcgaagcucugcuugaguugggggaggacgccaagcugccgucuacguuaaccggccucuacguaggacugcuuggccgggcggcccuggauuccccacccggggcuuuggcagaacucgccaaacuggcuugggagcuaggacgaagacaccagaguacacugcaggaagaccaauuuccuagcgccgauguuaggacuugggcaauggcgaagggucucgugcagcauccaccccgcgccgcugagucugaacuggccuucccuuccuuucuuuugcagugcuuccugggcgcauuauggcucgcucugucaggggagaucaaagacaaggagcuuccgcaguaucuggcccuaacaccccggaagaaaagaccauacgauaacuggcucgaaggagucccuagguuucuggcaggcuugauuuuccaacccccagcccgcugucugggugcuuuacucgggccuagugcggccgcaagcguggaccgaaagcagaaaguccuggcucgguaccuuaagcgucugcagcccggcaccuugagagccaggcagcuccuggagcuacugcacugcgcccaugaagcugaggaggcaggaaucuggcaacacgugguucaggaacuuccaggccgccucucguuucuggggacucgguugaccccgccugaugcccacgugcugggaaaagcguuagaggcugccggccaggacuucucccucgaucugagaucuacagguaucugucccagcgggcuuggaucacugguaggcuugaguugcgucaccagguuccgagcagcccucuccgacacuguggcucugugggaaucucuacagcaacauggugagacgaagcugcuucaggcagccgaagagaaguuuacaauugagccauucaaagcuaagagccucaaagacguugaagaucugggcaaguuggugcagacccaacgcacucgguccucaagcgaggacaccgcgggggaauuacccgccgucagagaucugaaaaagcucgaguuugcacugggaccugugaguggcccacaggccuuccccaaacuuguaaggauacugacagcuuuuucuuccuugcagcaccuagaccuggaugcccucagcgaaaauaagaucggggacgagggagugucgcagcugucagcaaccuucccucaacuuaagucuuuagagacucugaaccucagucagaauaacauuacagauuugggcgcuuauaaacuggccgaagcgcucccgucccuggccgcaagccuucugcguuugucucuauacaauaacuguaucugcgacguuggugcugagagccuggcccgcguccucccagauaugguguccuuacgggugauggacguccaguauaauaaguuuacggcugcaggggcccagcaacuggccgcuucacuuagaagguguccccauguugaaacccuggcgauguggacuccuacaauacccuucagugugcaggagcaccuccagcagcaagauagccgaauuucuuugcgguga

SEQ ID NO: 54429 - RNA, 3471 nt, Artificial Sequence
  derived and/or modified sequence opt3 from CILP2__Homo_sapiens__NP_694953
auggccagccugcucccccuucugugcuuguguguggucgcugcacacuuagccggcgcgagagacgcuaccccuacagaggaaccaauggccacugcacuggggcuagagaggcgguccguuuacacgggacagccgucucccgcccucgaagauugggaggaggcuucagaauggaccaguugguucaacguggaccauccugguggcgauggggacuuugagagccuggcagccauccgcuucuauuacggaccagcucgaguaugcccccguccucuugcccuggaagcgagaacaacugauugggcauugccauccgccgugggcgagaggguccaccucaaucccacccgggguuuuuggugucugaaccgcgaacaaccuagagggaggcggugcucuaauuaucaugugcgcuuccgauguccacuggaggcuucguggggagccuggggcccguggggccccugcucagggagcuguggaccugguagaaggcuccggcgucgccacugcccaagucccgcaggcgacgcuuguccugggagaccauuagaggcccagaagugcguuaggccccgguguccgggaugcucccuggauacaugcgaauguccugaccauauucuuuugggcucuguggucacccccagcggucagccacugcuaggggcgcgagugucccuccgcgaucagccuggaacuguagccacaucagacgcacacggcaccuuuagaguucccggcgugugcgcugauaguagggccaacauacgggcucaaauggacggguucagcgccggagaggcacaggcccaggcuaaugguucuaucuccgucgugacgauuauccuggauaaacuugaaaagccauaccuggugaaacaccccgagucacgcgucagagaagcgggccagaacguuacuuuuuguugcaaggcaagcgggaccccuaugcccaaaaaguauaguugguuccauaauggaacauugcucgacaggcgugcccacggcuacggugcucaucuggaguuacgggggcugcgaccggaccaagccggcauuuaucacuguaaggcauggaacgaggccggagcugugagaucuggcacugccaggcucaccguacuugcacccgggcagccugcgugcgauccacgcccccgggaauaccugaucaaauugccugaggacuguggacagccagguuccggccccgcuuaccuagauguggggcugugcccggacacaagauguccuagccucgccggaucgucuccaaggugcggcgaugcauccucacgcuguugcaguguccgacggcuggaacguagagagauacacugccccgguuaugugcuuccuguuaagguggucgccgaaugugggugccagaaaugucugcccccaaggggcuuggugcgcggacggguaguugcugccgacagcggcgagccucucagauuugcaaggauccuguuagggcaagagcccauuggauucaccgcuuaccagggugauuuuacgaucgaagugccaccguccacucagcgacuggucgugacauucgucgacccuucuggcgaguuuauggaugccgugcgcguucuacccuucgacccaagaggggcgggaguguaucaugaaguaaaggccaugcggaaaaaggcucccgucauucuccacaccagccaaucaaauacuaucccucugggcgagcuugaagaugaggcaccauugggugagcuggugcuccccaguggggccuucaggcgugcugacggcaagccuuacuccggaccgguugaagcccgcgugacauuugucgacccacgggaucugaccagcgcagcgucugcccccucagaccuuagauucguggauagugacggcgagcuggcuccuuugaggacguaugggauguuuagcguagaucuccgagccccaggauccgcagaacaguuacaggugggccccguugcuguccggguggccgcaucucagauacauaugccuggucacguggaggcccugaaacuguggucgcuaaacccggagaccgggcucugggaagaggaaagcggauuccgcagagagggcuccucaggucccaggguccggcgagaagagagaguuuuucuggugggcaauguggagauucgcgaaaggcgucuuuucaacuuggacguaccagagcggagaaggugcuuugucaaggugcgcgcuuacgcgaaugauaaauucacaccuagugaacaaguugaggggguggucgugacucugguuaaccucgaacccgccccaggauuuucugcaaauccucgagcuuggggcagauucgacagcgccgugaccgggcccaacggagccugucugccagcuuuuugcgaugcagaccggccggaugccuauacagcguuaguaacugcuacccugggcggugaggagcuugaaccugcccccuccuugccaaggccccucccugcaacagucggggugacccagccauaccuggaccgccuaggauaccguagaacugaucaugacgaccccgccuucaagcggaacggcuuuaggaucaaucuggcuaaaccucgcccgggugauccagcagaggccaacggccccguguauccuuggcgaucacucagagaaugucagggggcgcccgucacggcuagccacuuccgguucgccaggguugaggcagacaaguacgaauauaaugugguaccauuucgcgagggaaccccugccucuuggacaggcgaucugcuugcuugguggcccaacccacaggaguucagagccugcuuuuugaaagugaagauucaagggccucaggaauacauggucaggucccacaaugcaggaggcagucauccgcggacucguggucagcuguauggguuacgcgacgcucgaagcgugagagaucccgagaggccaggaaccucugccgcguguguugaguucaagugcuccggcaugcucuuugaccagcggcaaguggaucgcacacuggucaccaucaugccucaggguucauguagaaggguggccguuaacggccuucugcgggacuacuugacucgacacccaccaccugugcccgcagaagauccggcugccuucaguaugcucgcuccacuggacccucuagggcauaauuauggagucuacacaguaacggaucagagccccagacuggcaaaagagaucgccauuggccgcugcuuugacgggucguccgauggauucucuagggaaaugaaggccgacgcuggcaccgcggugacuuuucagugccgggagccacccgcaggucguccuagccucuuccaaagacugcuugaaucaccggccacagcuuugggggacauaaggcgcgagaugagugaagccgcacaggcccaggcucgggcguccggaccccugcgaaccagaaggggccgcguucggcaauga

SEQ ID NO: 54430 - RNA, 3555 nt, Artificial Sequence
  derived and/or modified sequence opt3 from CILP__Homo_sapiens__NP_003604
auggugggcaccaaggccugggucuucagcuuucugguucucgaggugacauccguacuugggagacagacuaugcugacgcaaucugugaggcggguccagcccggaaagaagaacccuucaaucuucgcuaaaccagcagacaccuuggaaaguccgggugaguggacaacuugguuuaauauugauuaccccggcgggaagggagacuaugaacgcuuagaugccauacgauucuacuauggcgaccgugugugcgcgagaccucugaggcuagaggcucggaccacagauuggaccccagccgguagcacugggcagguugugcacggaucccccagggaaggcuuuuggugucucaacagagagcagaggccuggccaaaauugcucuaacuacacaguccgguuccuguguccacccgggucgcuucgccgagacaccgagagaaucuggucaccuuggagcccauggaguaaaugcuccgcagccuguggacagacgggugugcagacuaggacccggauuugccuggcugaaaugguaucuuuguguagcgaggcauccgaagagggccagcauugcauggggcaagauuguacagccugcgaccucacuuguccgaugggacagguuaaugcugauugcgacgccugcaugugucaggauuuuaugcugcacggcgcggugucacugcccgguggggccccugcaaguggagcugccaucuaucucuuaaccaagacaccaaagcugcuuacccagacggacagcgauggccguuuccgcauucccggcuugugcccugacgggaaaucuauccugaagauaacuaaagucaaguuugcaccaaucgugcuaacaaugcccaaaaccucccucaaggcugccacuauuaaggcggaguucgugagagccgaaacaccguacauggucaugaacccugagaccaaagcaaggcgggcuggacaaucaguuagccuguguugcaaggccacggguaaaccccgaccagacaaguauuuuugguaccauaaugauacccuucuggacccuaguuuguacaaacacgaaucuaagcucgugcugcgcaaauuacagcagcaucaagcuggcgaguauuucuguaaggcccaguccgaugcaggggccguaaagagcaaaguggcucagcugaucgucauugcgucggacgaaacacccugcaacccagugcccgagucuuaccucaucagacuuccucacgauuguuuucagaaugcaacuaacuccuucuauuacgacguuggaaggugcccagugaagaccugugccggccaacaggauaaugguauacggugccgcgacgcuguccagaacuguugcgggauuucaaaaacagaggaaagagagauccagugcaguggcuauacucugccgaccaagguggccaaagaauguagcugccaaagguguacagagacccguuccauuguacggggacgaguuucugcagccgauaauggcgaacccaugagauucgggcacguguacaugggaaacagcagggucucaaugacugguuauaagggcacguuuacauugcaugugccucaggacaccgagcgccuaguccugacuuucguggaucggcuccagaaguuuguuaauaccacaaaagugcugccauucaacaagaaagggagugcuguauuucacgagaucaagaugcuuagaaggaaagaacccaucacccuggaggccauggaaacuaacauuauaccuuugggagaggucgugggcgaagacccaauggcagagcucgagauccccucccgcagcuucuaccgacagaauggugaaccguacauugggaagguuaaggcgucugugacauuucuggacccucggaacaucucaacggcuaccgccgcacaaacugauuuaaauuucauaaacgacgagggcgauacauuuccacugcguaccuauggaauguucagugucgacuuuagagaugaagugacaagcgagccccuaaaugccggcaaaguaaaggugcaucucgacuccacucagguuaaaaugccugagcacauuucuaccgucaagcuguggucgcuuaaccccgauacgggguugugggaagaggaaggagacuucaaauuugagaaucagaggcgcaacaagcgggaagauagaaccuuccugguggguaaucucgagaucagggagcgacgccuguucaaccuugacgugccagaaagccggagaugcuuugucaagguuagggcuuaccguuccgagcgcuuccugccuucagaacagauccaaggcguggugauuaguguaaucaauuuggagccccggacaggguuucucucuaacccaagagccuggggaagguucgauagcgucauuacuggcccgaauggugcaugugugccugcuuuuugcgacgaucagucccccgacgccuauucagcguacguucuggccagcuuagcuggggaagaacugcaggcaguggagucuuccccaaaauucaaccccaaugccauaggcgucccucaaccauaucuaaacaagcucaacuaccgacggaccgaccacgaagauccccgcgugaaaaagacagcuuuucagaucaguauggccaaaccuagaccgaauagcgcagaggaaucuaacggaccaauuuaugcguucgagaaucugagggccugugaagaggcucccccuuccgccgcacauuuucgguucuaccagaucgagggcgaccgauacgauuauaacacuguuccauuuaaugaagacgaucccaugucauggaccgaggacuaccuugcuugguggccuaagccgauggaguucagagccugcuauaucaaagugaagauuguagggcccuuggaggucaacgugcgcaguaggaauaugggaggcacgcaccgucagacaguggguaagcuguacgggauacgggaugucagaagcaccagggaccgcgaucaaccaaacguuucggcagccugucucgaguuuaaaugcuccggaaugcuguaugaccaggaucgaguggacagaacuuuaguaaaggugaucccucagggcucuugucggagggcuagcgucaaucccaugcugcaugaauaccuugugaaccacuugccacucgcgguuaauaacgauacaucagaguauaccaugcuggccccucuagacccccugggucauaauuacggcauuuacacugugaccgaccaggauccacgcacagcaaaagaaaucgcucucgggcguugcuucgacggaacgagugauggcuccucuagaauuaugaaaagcaacgucgggguggcccugaccuucaauugcguugagcggcaagugggaaggcaguccgccuuucaguaucuucagucaacuccggcucaaagcccugcagccggcacaguccagggucgcguacccagucgaagacagcaacgggcgucucgcgggggacagcgccagggcggugugguugcuuccuugagauucccaaggguggcccagcaaccccugaucaacuga

SEQ ID NO: 54431 - RNA, 639 nt, Artificial Sequence
  derived and/or modified sequence opt3 from CINP__Homo_sapiens__NP_116019
auggaggccaagacccugggcacagugacucccagaaaaccuguccucagcguuuccgcuaggaagaucaaagacaacgcagccgauuggcacaaucuuauucugaagugggaaacguugaacgacgcgggguucaccacagcuaauaacauagccaauuuaaaaaucucucugcuaaacaaggauaagauugagcucgacucaaguagcccagcauccaaagaaaaugaggaaaaggugugccuggaguacaacgaggaacuugagaaacugugugaagaguugcaggccacucucgauggacugaccaagauccaaguaaaaauggagaagcugucuucgacaaccaaggguauuugcgaacucgagaauuaucauuacggcgaagagucaaaacggccgcccuuauuucacacuuggccuacaacccauuucuaugaagugagccacaagcugcuugagauguaccgcaaagaguugcugcuaaagcgaacggucgcuaaagaacucgcacauacuggggacccagaucugacccuuaguuaucuguccaugugguugcaccagcccuacguggagucugacagccgucuccaccuggaauccauguuacuggagacaggacauagagcccucuga

SEQ ID NO: 54432 - RNA, 1200 nt, Artificial Sequence
  derived and/or modified sequence opt3 from CIPC__Homo_sapiens__NP_219494
auggagagaaagaaccccagcagggaauccccucggcgccugucugccaaagugggcaaggggaccgagaugaaaaaggucgcucgacagcucggaauggcagccgcggaaucagacaaagauagugguuucagcgacggcuccucugagugccuuucgucagcugaacaaauggagagcgaggauaugcugagugccuugggguggucccgugaagacagaccaaggcaaaauucuaagacagcaaagaacgccuuuccgacuuuaagccccaugguugugaugaaaaauguacuggugaagcagggauccucaaguagccagcuacaaucuuggacgguccagccuuccuucgaggugaucucagcucagccacagcuccuguuucuucaucccccuguuccaagccccgugaguccuugucacaccggcgagaaaaagucugauucccggaacuaccugccaauuuugaauagcuauacaaaaauagcaccgcaccccgguaagcgcgggcucucgcugggaccugaagagaagggcacuucuggcguccagaaaaagaucugcaccgaaagacuggggccaucccucucaaguagcgagcccacaaaagccggagcugugccuuccucuccaagcacccccgccccgccuucagcgaaguuagcagaagacagugcccugcaggguguacccucccuuguugcuggcgggagcccacagacuuugcagccugugucuucaagucaugucgccaaagcacccagccugacauucgcuuccccagccucucccgugugugcgucggauagcacccuacacggacucgaguccaacucaccucugaguccacuuucugccaauuacagcuccccgcugugggcagcugaacauuugugcaggucacccgacauuuuuagcgagcaacggcagucuaagcaccgccgauuccagaacacgcucgugguccugcacaaauccggcuuacuggagaucacucucaagaccaaggaacuuauuagacaaaaucaggccacacagguugagcuggaucaguugaaagaacaaacucagcuauuuaucgaggcuaccaagaguagggccccucaggcaugggccaaacugcaggcuagccucacaccagguucuuccaacaccgggucagaccuggaagcguucagugaucaucccgcaauauga

SEQ ID NO: 54433 - RNA, 1353 nt, Artificial Sequence
  derived and/or modified sequence opt3 from CIR1__Homo_sapiens__NP_004873
augggcaagagcuucgccaacuuuaugugcaaaaaggacuuccaccccgcuuccaaaucuaauaucaagaaaguguggauggcagagcagaagauuucauacgauaagaaaaagcaagaagaacugaugcagcaguaucucaaagaacaggagaguuacgacaacagacuucugaugggggaugaaagggucaagaauggauugaacuuuauguaugaggccccuccaggugcgaaaaaggagaauaaggaaaaagaggaaaccgagggcgagacagaauacaaguucgaguggcaaaaaggggcuccgcgggaaaaguaugccaaagacgauaugaacauacgcgaccagcccuuuggaauccagguucgaaaugugcguuguauuaagugccauaaauggggccacguaaacacugauagagaguguccuuuauucggucugagcgggaucaaugcauccucugugccaacggacggaucgggccccucaaugcauccuagcgaacuaauugccgagaugaggaacaguggcuuugcucucaagcggaauguccuggggcgcaaccuuaccgcaaaugauccaucccaggaguacguggccucugaaggagaggaagaccccgagguugaguuccugaagucuuugacaacuaaacaaaagcagaaacuccugagaaagcuggauaggcucgagaaaaagaagaaaaagaaagaccggaagaaaaagaaguuucagaaaucccgcucaaagcacaaaaagcauaaaaguagcagcuccucaagcaguucuuccagcucgucuuccucaaccgagacaagugaaagcuccucugagagcgaaucaaacaauaaggagaagaaaauccagcgaaagaaaagaaagaaaaacaagugcaguggucacaacaauuccgauagcgaagagaaagacaagucuaagaaaaggaaguuacacgaggaacugucaaguagccaucacaaccgggagaaagcuaaggaaaaaccucguuuccuuaagcaugaguccucucgcgaggacucgaaguggagccacuccgauucagacaaaaagaguagaacccacaaacauucuccagaaaagaggggcagcgagcggaaagaaggguccucacgaagccacggacgcgaggaaagaucuaggcggucccgcaguagaagcccgggcucuuauaagcaaagggagacucguaagcgggcccagcgaaaucccggugaggaacaguccagaaggaacgauucacgcagucaugggacagacuuguaccggggagagaaaauguacagagaacacccuggcggcacccauacgaaggugacucaaagggaguga

SEQ ID NO: 54434 - RNA, 507 nt, Artificial Sequence
  derived and/or modified sequence opt3 from CIRBP__Homo_sapiens__NP_001287744
auggccagcgacgagggcaagcuguucgucgggggacucuccuuugauaccaacgaacagucucuugagcaaguguucucaaaauacggucagaucagugaaguugugguagugaaggacagagagacacagaggagccggggcuuuggguucgucacuuuugaaaauauugaugacgcuaaagaugcaaugauggccaugaacggaaaguccguggacggccgccagauacgaguugaucaagcggguaaaucuucggacaaucguucaagaggguauaggggaggcagcgcuggcgggcggggauucuuucgcgguggcagagggaggggacggggcuucagucgcggugggggagaucgaggcuacggcgggaacagauuugaguccaggucuggagguuauggcgggagccgggacuacuauuccucacguagucagagcggaggcuacucugaucgcuccucaggugggagcuauagagacaguuacgauucuuacggcuga

SEQ ID NO: 54435 - RNA, 2061 nt, Artificial Sequence
  derived and/or modified sequence opt3 from CIRH1A__Homo_sapiens__NP_116219
augggcgaguucaaggugcacagagucagguuuuucaacuacguucccagcgggauccggugcguggccuauaauaaccaguccaaucgccuggcuguaucucgaaccgacggaacaguggaaauuuacaaccucucagcaaauuauuuucaagagaaauucuuuccuggucaugaaagucgugccacugaggcgcuuuguugggcugaaggccagagacuguucagcgccggguugaacggagagauaauggaguacgauuuacaggcacugaauaucaaguaugccauggacgcuuuuggcgguccaauuugguccauggcagccucuccgucggggucacagcuacucgucggaugcgaagauggcagcgugaaacuguuccaaaucacgcccgacaagauucaguuugagaggaacuucgaucggcagaaaagucgcauccuuucccugucuuggcacccuagcggcacccauauagcugccggguccaucgacuacauuucaguuuuugaugugaagaguggaagcgcgguccacaagaugaucguggacagacaguauauggguguaucuaaaaggaaguguauuguuuggggcguggcauucuuguccgaugggacaaucauaucagucgacagcgccggaaaagugcaauuuugggauagugcuacuggcacccucgugaagucucaucugauugccaaugcagacguccaguccaucgcuguugccgaucaggaagacagcuucgugguagguacagcggaggggaccguguuccacuuucagcuggucccagugacuucgaacucuuccgagaaacaauggguucggacaaagcccuuccagcaccauacccacgacgugcgcacggucgcccauucaccuacugcacucauuaguggaggcaccgauacacacuuaguguuucgaccacugauggaaaagguagagguuaaaaauuacgacgcugcccuuagaaagaucacuuucccccacaggugcuugaucagcuguuccaaaaagcggcagcugcuacucuuucaauucgcucaucaccuggaacuuuggcgucugggcucuaccguggccacagggaaaaacggagauaccuugccucucagcaagaaugcagaccaucuguuacaccugaaaacgaaggguccagagaacauuauaugcucauguaucaguccgugcggcuccuggauugccuacagcacugucucucgcuuuuuccucuauagacuuaauuacgaacaugauaacaucucacugaagagggugaguaaaaugcccgcuuuucugcggagcgcgcuacagauacuguucuccgaggacucuacaaagcucuuugucgcaucgaaccagggggcccugcacauugugcagcuuagcggaggcuccuucaaacacuugcaugcuuuucaaccucagucagguaccguugaggccauguguuugcucgcagugaguccagaugggaauuggcuggccgcuucuggcacuagcgccggaguacacgucuauaacgugaagcaguuaaaacugcauugcacaguucccgcauacaauuucccugugaccgcgauggcuaucgccccaaacacgaauaaccuagucaucgcacacuccgaccagcaaguguucgaauauucaauucccgauaagcaguacaccgacuggagccgaacaguacagaagcagggcuuucaccaucucuggcugcaacgcgauacuccgaucacccacauuucuuuccauccuaaaagacccaugcacauacuuuugcaugacgccuauauguuuuguaucauugacaagucccugccacucccuaaugauaaaacacugcuuuacaaccccuucccacccacuaaugagagugacgugaucaggcggcgcaccgcucacgccuuuaagaucagcaaaauuuacaagccucuguuguucauggaucuccuggacgaaagaacauuaguugcagucgagaggccacuggaugacauaaucgcucagcuaccgcccccuauuaagaaaaagaaauuugggaccuga

SEQ ID NO: 54436 - RNA, 327 nt, Artificial Sequence
  derived and/or modified sequence opt3 from CISD1__Homo_sapiens__NP_060934
augagccugaccuccucuucaagugugagagucgaguggaucgccgcuguuacaauugcagccggcacugcggcuauaggguaccucgccuauaagagguucuacgugaaagaccaccggaacaaggcaaugaucaaucuucauauucagaaagauaaccccaagaucguacacgccuuugacauggaagaucugggagacaaagcuguguauugccgcuguuggcgaagcaagaaguucccuuuuugcgauggugcacauacgaaacacaaugaggaaaccggcgacaacgucgggccauugauuaucaagaaaaaggagacauga

SEQ ID NO: 54437 - RNA, 408 nt, Artificial Sequence
  derived and/or modified sequence opt3 from CISD2__Homo_sapiens__NP_001008389
auggugcuggagagcgucgccagaaucguuaaggugcagcuccccgcuuaccuuaaaaggcugccuguaccagaauccauuaccggcuucgcacgguugacagugucugagugguuacgccugcuaccguuucucgggguccuggcccuucugggauauuuggcggugcgacccuuccucccuaagaaaaagcaacagaaagacucacugauaaaccugaagauccagaaggaaaauccaaaaguugugaacgagauuaauaucgaagaucucugcuuaacuaaggcugccuacugucguugcuggagaaguaaaacguuucccgcaugugacgguagccacaacaagcauaaugagcugaccggcgauaacgucgggccucuuauuuugaaaaagaaggagguguga

SEQ ID NO: 54438 - RNA, 828 nt, Artificial Sequence
  derived and/or modified sequence opt3 from CISH__Homo_sapiens__NP_037456
auguaccuggagcacaccagccauugcccccaccaugacgaugacacagccauggauacuccucucccaagaccgaggccccuucuggcuguggaacggacgggccagcgcccuuugugggcaccauccuuagagcugcccaagccugucaugcaaccacuacccgccggggcguuccucgaagagguugcugaaggaaccccugcccagacagagucugagccaaaagugcuggacccggaagaggaucuucuguguaucgcaaagacuuuuucauauuugcgagaaagugguugguacuggggcagcauuaccgccuccgaggcucgucagcaccuccagaaaaugcccgaggggacauuccugguaagagacucuacccauccuucguaucuguuuacucucucagugaagacaaccaggggaccaacgaacguccggauagaauacgcagauagcaguuuccgcuuagacuccaauugccugucuagacccaggauccuugccuuuccugaugugguuagcuuggugcaacacuaugucgcuuccuguacugccgacacccggucagauaguccagaccccgcgccgacacccgcacugcccaugccaaaagaggaugccccuagcgaccccgcucuaccagccccuccuccagcaacugcugugcaccucaagcugguacagccguucguucgccgaucuuccgccagaucacuucagcaucugugcagguuggugauuaaccggcucgucgcggacguggauugucugcccuuaccucgucgcauggccgacuaccugagacaguauccauuucaacucuga

SEQ ID NO: 54439 - RNA, 660 nt, Artificial Sequence
  derived and/or modified sequence opt3 from CITED1__Homo_sapiens__NP_001138357
auggagcccagcgcccagcaacugcagcucgcugcaucccuuccugccaaccugucuaauuucugccagggcucagaaaugccaaccacaaguagaccggcguuggacgugaaagggggaacuagccccgcuaaggaggaugccaaccaggaaauguccucugucgcauacucgaauuuagccguuaaggacaggaaagcuguggcaauccugcacuauccugguguagccucaaacggcacgaaggcuagcggggccccaaccaguuccucuggaagccccauuggcuccccuacaacuaccccacccacaaaaccuccaucauuuaaucuacauccggcgccccaccuccuggcaaguaugcaucuucaaaagcugaacagccaguaccaggguauggccgcugccaccccugggcagccaggagaggcaggccccuugcaaaauugggauuucggcgcucaggccgggggagcggaaucucucuccccuucagccggugcacagagcccagcuauaaucgacagugaucccguggacgaggagguccugaugucucuggugguugaacucggcuuagaucgggccaacgagcugccggaacuuugguuggggcagaaugaguuugacuucacugcugauuuuccuuccagcuguuga

SEQ ID NO: 54440 - RNA, 813 nt, Artificial Sequence
  derived and/or modified sequence opt3 from CITED2__Homo_sapiens__NP_001161860
auggccgaccacaugauggcuaugaaccauggcagauuccccgaugggaccaauggacugcaccaucacccugcacauaggauggguaugggccaguuuccaagcccgcaccaccaucaacagcagcagccccaacacgccuucaacgcgcucaugggggagcauauccacuacggagcuggcaauaugaacgccacauccgguauucggcacgcaauggggccuggaacugugaauggcggccauccacccucugcccuugcuccugcagcccgcuuuaacaauucacaguucauggggccacccgucgcuagucagggagguagccugccugccuccaugcaguugcaaaaguuaaacaaucaguauuuuaaccaccauccauacccgcacaaucauuauaugcccgaccugcacccugcggcaggccaccagaugaacgggacgaaucagcauuuccgagauugcaacccaaaacacucuggaggcucgucaacccccggugggagcggaggcaguuccacaccuggcgggucuggaagcuccucagguggcggggccggaaguagcaauucuggcgguggguccggcucaggaaacaugccagcuagcguugcccaugugcccgcagcuaugcuaccgccuaacguaauagacacugauuuuaucgacgaagaggugcucaugagucuggucauugaaaugggccuugaucguaucaaggagcugcccgaauuguggcucgggcaaaaugaguucgacuuuaugaccgauuucguguguaaacagcagccaucuagaguuuccugcuga

SEQ ID NO: 54441 - RNA, 6210 nt, Artificial Sequence
  derived and/or modified sequence opt3 from CIT__Homo_sapiens__NP_001193928
augcugaaguucaaguacggcgccaggaacccccucgacgcuggggcagccgagccuaucgcgagcagggcuucccggcuuaaucuguuuuuccagggaaagccaccguuuaugacccaacagcagaugucucccuugucacgcgaagguauuuuagaugcccuguucgugcuauuugaggaaugcagucagccugcacucaugaagauaaagcacgucagcaacuucguucgaaaguauuccgacaccaucgccgagcugcaagaacuucagccaucugcuaaggauuuugaggugcguucgcugguaggcugugggcauuucgcagaggugcaggucgugagagaaaaggccacuggagacauuuacgcuaugaaaguuaugaagaaaaaggccuugcucgcgcaggagcaagugucauuuuucgaagaggagaggaauauccugagccggaguacgucccccuggauuccucagcugcaguaugcauuucaggauaaaaaccaccucuacuuagucauggaauaucaaccaggcggugaccugcuuucuuugcugaaucgcuacgaggaucagcuagacgaaaaccucauccaguucuaucuggccgagcuuauacuggcugugcauagcguacacuugaugggguacguucauagagauaucaagcccgaaaauauucucguggacaggaccggacacaucaagcuggucgauuuuggcuccgccgcaaaaaugaacucaaauaagauggugaacgcuaaauuaccuauuggcacgccagacuacauggccccggaggugcugacugucaugaauggggauggaaaggguaccuauggccucgacugcgacugguggaguguuggggugaucgcguacgagaugauauauggacggagccccuucgccgaaggcacaucugcacgcaccuucaacaauauuaugaacuuucaacgauuccuuaaauuuccugaugacccaaagguauccucagauuuccuggacuugauccagagccuacuguguggucagaaagagagacucaaguuugaagggcugugcugucaccccuucuuuaguaagauugauuggaauaacaucaggaacucuccuccacccuucgugccgacucuuaaauccgacgaugacacaagcaauuuugaugagccugaaaagaacucgugggucucuuccucacccugccagcugaguccaagcggauucuccggcgaggaguugccuuuugugggcuucucuuacagcaaagcucucgggauccugggacggucagaaaguguuguguccgguuuagacagccccgccaagaccucuucaauggagaaaaagcugcuaauuaagaguaaagaacuccaagauagccaggacaagugucauaaaauggagcaggaaaugacgcgucugcaccgcagagucuccgagguggaggcuguacuuucucagaaggaaguugaguugaaagccucggaaacucaaaggagccugcucgagcaggaccuggcaaccuauauaacagagugcuccucacuuaagcggagucuggaacaggcccgaauggaggugucucaggaagaugacaaggcuuugcaacuccugcaugauauccgcgagcagagcagaaaauuacaggaaauuaaggagcaggaguaccaagcgcaggucgaagagaugaggcugaugaugaaucagcuagaagaggaccucguguccgcacggcgcagaucagaucuguaugaaagcgagcuuagggagucucguuuggccgcugaagaguuuaaacggaaggccacugaaugucaacacaaacugcucaaggcaaaggaccagggcaaaccagaggucggggaauacgccaagcuggagaaaaucaacgcugagcagcaguuaaagauacaagaacugcaggagaaacuugaaaaggccgugaaagcauccaccgaggcgacagaguugcuccagaauauucgacaggcuaaggaaagagccgagagggaacuggagaagcuacaaaaccgcgaagauaguagcgagggaauccggaaaaagcugguugaggcagaagagagaaggcacucucucgaaaauaaagugaagcgccuggagaccauggaacgacgggagaaccgucuuaaagacgauauccagacgaagucccagcagauucaacagauggccgacaagaucuuggagcuggaagagaaacauagagaagcucagguaucagcccaacacuuagagguccaucucaagcagaaagaacagcacuacgaggagaagauuaaagugcuggauaaucagauaaagaaggaccuugcagauaaagaaacucuggagaacaugaugcaaaggcaugaagaggaggcucacgaaaagggcaaaaucuugagugagcagaaggccaugauuaaugcgauggacagcaaaauccgcucgcucgaacagcggaucguugagcuguccgaagccaacaagcuagcugcaaauucuagccuguucacacagagaaacaugaaggcccaagaggagaugauuucagaacucaggcagcagaaauucuaucuggagacccaggcugguaaacuugaagcccaaaaucgaaaauuggaggaacagcuggagaagauaagucaccaggaccauuccgauaaaaaccgcuuacucgagcuggaaacucggcuuagagaggugucucuggaacacgaggaacagaagcuagagcucaaaaggcaacugacagaguugcagcugagcuuacaggaacgugagucccaacucaccgcacugcaggcggcccgcgcugcccuugaaucacagcugcggcaggcaaagacggaguuggaggaaaccacagcugaggccgaagaggaaauccaagcacucacugcccauagagacgagauucagaggaaguuugaugcucugcgaaacagcugcaccgucaucacagaccuagaggaacagcugaaucagcuuacugaggauaacgcggaacucaauaaccaaaauuucuaccugaguaaacaguuggacgaggccucuggggcaaacgaugaaauugugcagcugcgguccgagguagaccacuuacgcagagagaucaccgaaagggagaugcagcucacaagccaaaagcagaccauggaagcucugaaaacuacguguacaaugcuugaggaacaggugauggaucuggaggccuugaaugacgagcuccuggaaaaggagcggcaaugggaagccuggcgaucgguucuaggcgaugagaaaucacaguuugagugcagaguccgcgaacugcagaggaugcuugacaccgagaagcagucucgugcucgggcagaucaaagaauaacugaaaguagacaggugguggagcucgccgucaaggaacacaaagcggagauccuggcuuugcagcaggccuuaaaggagcaaaaacugaaggcagaaucccucagcgacaaacugaacgaccuugagaagaagcaugccaugcuggaaaugaaugcucgcucuuugcagcagaaacuagagaccgaacgagagcugaagcagagacuccuggaggaacaagcaaaacuucagcagcagauggauuuacaaaagaaccacauuuuccggcugacacagggacuccaggaggccuuggacagggcggaucugcucaaaaccgaacgcagcgaccuggaguaucaacuugaaaauauccagguucuguacucccaugagaaggugaagauggagggcacuauuucacagcagacaaaauugaucgauuuucuacaagcuaagauggaccagcccgccaaaaagaaaaaggggcuguucagucguagaaaggaagauccugcacucccaacacaggugccguuacaguauaacgagcugaaacuugcccuggaaaaggagaaagcucggugcgccgagcucgaagaggcauugcaaaagaccaggauagaacugcgcagcgcucgagaggaagccgcgcacagaaaagccacugaccauccccacccuucuacaccagcaaccgcucggcagcagauugccauguccgcuaucguaaggucacccgagcaccagccuagugcaaugagccuccuggccccacccuccucucgcagaaaggagucgagcacaccggaagaguuuucaaggcggcuuaaagaacguaugcaucacaauauuccucaucgcuucaacgucggacuaaauaugcgagccacuaagugugcugugugccuggauaccguucacuuugguagacaagcguccaaguguuuggagugccaggugaugugucauccaaaaugcaguacguguuuacccgcaaccugcggccugccugccgaauacgcuacacacuucacugaggccuuuuguagggacaagaugaacucucccgggcuccagaccaaagagccaagcuccucacugcaccuugaaggauggaugaaggucccucggaacaauaaacgcggccaacaggguugggauagaaaguauaucgugcuggaggggucuaagguucucauauacgacaacgaagcaagggaggccggccagcggcccguggaagaguucgaguugugccugccagacggagauguaagcauccauggcgcugucggggcgagugaacuagccaauacagcaaaagcugacgugccguacauucugaagauggagucccacccucauacuaccuguuggcccggacgaacgcucuaucuucuggcccccagcuuucccgauaaacagagaugggugacagcauuagaaucugucguugccgguggccgcgugucaagggagaaggcugaggccgacgcgaaauugcuggggaacucccuccugaaacuugaaggagaugaccggcuggauaugaauugcacccucccuuucagugaccaaguaguguuggucggcacugaggaaggucuguacgcauuaaacgugcuaaagaauagccugacacacguuccagggaucggcgccguguuccagauuuauaucauaaaagaucucgagaaacuucugaugauugcuggagaggaacgugccuugugccuggucgacgugaaaaagguuaaacagucgcucgcucagucucaucugccagcacaaccugauaucuccccgaacaucuuugaggccgugaagggcugucaccuuuucggggcuggaaagauugaaaauggccucugcaucugugccgcaaugccaagcaaagucguaauucugagauacaacgagaauuugucaaaguauugcauaaggaaagaaaucgagaccagugaacccuguucuugcauucacuuuacuaacuacuccauccugauugguaccaauaaguucuaugagaucgacaugaaacaguacacauuagaggaauuucuagauaagaacgaccauagccuggcgccugccguguucgcugccucaaguaauagcuuuccaguuuccauagugcaggucaacucugcagggcagcgcgaggaauaccuccuuuguuuccacgaguuuggaguguucguagacagcuauggccggcgauccagaacggaugaccugaaauggucaagguugccccuggcuuuugccuaccgcgaaccuuaucucuucgugacccauuucaacucucuggaggucaucgagauucaagcacggaguucggccgguacuccggcuagagcguaccuugauauccccaauccacguuauuuaggcccugccauuagcuccggggcaaucuaccuggcuucuucauaucaggacaagcucaggguuauaugcuguaagggaaacuuggugaaagaaagcggcacagagcaccaccgggggcccuccaccagucgcucuagcccaaauaagcgaggaccucccacauacaacgaacauauuacuaaaagaguggccucauccccagccccgccugagggccccagucacccaagggagcccagcaccccucaucgguaccgcgaagguagaacggagcugaggcgagauaagucuccagggcggccccuagaacgugagaaauccccuggaagaaugcugucaacacgcagggaacggagcccgggcagacucuuugaggacucgucucgcgguaggcuuccagcaggcgcuguccgaacaccccugagucaggugaauaagguuugggaucaauccagcguauga

SEQ ID NO: 54442 - RNA, 2457 nt, Artificial Sequence
  derived and/or modified sequence opt3 from CIZ1__Homo_sapiens__NP_001124490
auguucagccagcaacagcagcagcaacugcagcagcagcaacagcagcuccagcaacuucagcagcaacagcugcagcagcaacaguugcagcagcaacaguuacugcagcuacagcaacuccugcagcagucucccccucaggccccacuuccgauggcuguguccagaggccugcccccucaacagccacagcaacccuugcucaaccugcaggggaccaauucagcaagucugcucaacggaagcauguuacagagggcccugcuuuugcagcaacugcaggguaaucuacggggcuacgggauggcguccccuggacucgcugccccaucucugacacccccucagcuugcaacuccaaaccugcagcaauuuuucccgcaggccacgcgccagucguugcucggucccccuccagucggcguucccaugaauccuucacaguuuaaccugagcgggcgaaauccacaaaagcaggcucguaccaguuccucuacaacucccaacagaaaagacagcuccucacagaccaugccgguggaggauaagagugacccucccgaaggaagcgaggaagcagccgagccaaggauggauacaccugaagaccaagauuuacccccaugccccgaggacaucgcuaaagagaagcggaccccugccccagaaccggagcccugugaagcgucugagcugccugcaaaacgccucagauccucagaggaaccaacugagaaggaacccccuggccagcuucagguaaaggcccagccacaagcuaggaugacagugcccaaacagacccagacgccggaucuguugccugaggcccuagaagcacagguccugccacgguuccaaccccgcgugcuccagguucaggcucaggugcaaagccagacucagccucgaauacccaguaccgacacacagguccaaccaaagcugcagaaacaggcccaaacucagaccucuccugagcaccuugugcugcagcagaagcaaguacagccccaguugcagcaagaggcggaaccacagaaacagguucagccgcaagugcauacacaggcccagccuuccguccaaccccaggagcacccacccgcacaggugagcgugcagccuccagaacaaacccaugagcagccccacacgcagccucaggucucgcuccuggcuccggaacaaacuccaguugugguacaugugugcggcuuagagaugcccccugaugccgucgaggcugggggagguauggaaaagacacugccagagcccgugggcacccagguuucuauggaagagauucagaaugaauccgccugugggcuagacgugggagagugcgagaacagagcaagggaaaugccuggcgucuggggugccgggggaucacucaaggugacuauccugcagaguagcgauucccgggcuuuuucuacaguaccgcuuacccccguuccacguccuagcgacucagugaguuccacgcccgcggcaaccagcacaccaucuaaacaagccuugcaguucuuuuguuauauuugcaaggcuucauguaguagccagcaggaguuccaagaucacauguccgaaccucagcaccagcaacgccugggcgagauccagcauaugucucaggccugccuccugucgcuucugcccgucccaagagacguguuggagacugaagacgaggaaccgccucccaggcggugguguaauaccugccagcucuacuauaugggcgaucugauucaacaccgacgcacacaggaccauaaaaucgcaaagcagagcuuaagaccauuuuguacugucugcaacagguacuucaaaacaccccggaaguuuguggagcacguuaaaucccaggggcacaaggauaaggccaaagaacugaagucacuagagaaagagauagcuggacaagacgaagaucauuucaucaccguggacgccguagguugcuuugagggcgaugaagaggaagaggaggacgaugaagacgaggaagagauugaagucgaggaggaacucuguaaacaggugcgcaguagagauaucucuagggaggaauggaaggggagcgagaccuauuccccuaauacugcauacggaguugacuuccuggugccagucaugggcuauauuugccguaucugucacaaguucuaccauucaaacagcggugcgcagcuuucucacugcaaguccuuggggcauuuugagaaucugcagaaauacaaggcugccaaaaaccccaguccuacgacacggccggugagccgaagaugugcaauaaacgccaggaaugcucucaccgcccuguucacuucuuccggccgcccacccucacaaccuaacacccaggacaagacacccaguaaaguaaccgcacggccaagccagccucccuuaccaagaaggucgacucgccugaagacauga

SEQ ID NO: 54443 - RNA, 2052 nt, Artificial Sequence
  derived and/or modified sequence opt3 from CKAP2__Homo_sapiens__NP_001091995
augagcacccccgccgugccucaggaccugcaacucccaccgucccagagagcucagucugcauucaaggagcagaggcggcaaaaacuuaaggaacaccuguugcgccgaaaaacauuauuugccuacaagcaggagaacgaaaugcugucaaguagccgugaucagagagucguuacuuccgaggaccaggugcaagaaggcacgaaaguacuaaagcucaagaccaaaauggcggauaaggagaauaugaaaaggcccgcugagucuaagaacaauacaguggucgggaaacauugcaucccucugaagccaucgaacgaacuuacuaauucaaccgugguuauugacacacacaagcccaaagauagcaaccagaccccucaucuguugcucacugaggacgauccacagagucagcacaugacacugucccaagccuuccaucugaagaauaacucuaaaaagaaacagaugaccacggaaaagcagaaacaagacgcaaauaugcccaagaagccugugcucggaagcuaucggggucagauaguccaguccaaaaucaacucauuucgcaagccauuacaggugaaagaugagaguagcgccgcuacuaagaaacugucugcaaccauuccgaaggccacaaagccccaaccuguaaauacuuccucaguuaccgugaaaagcaacagaaguucuaauaugacagcuaccacgaaguucgucuccacuacaagccagaacacccagcuugugaggccacccauccggucgcaccacucuaauacucgcgacacagugaaacagggcauuucccgaaccucagccaacgucacgaucagaaaggggccucaugagaaagaauugcugcaaaguaagaccgcgcuaagcuccguuaagacaucuagcucacagggaauaaucaggaacaaaacucucagucgguccauugcaagcgaggugaucgcccguccagcuucucugucaaaugauaagcucauggagaaaagugagcccguagaccagcgcagacacaccgccggcaaggcaauuguggauagcagguccgcucagccgaaagaaacaucugaggagcggaaggcccgacugucggaauggaaggcggguaaagggcgcgucuugaagagaccucccaacagcgugguuacucaacaugagccagccggacagaaugaaaaaccugugggcuccuuuuggaccacaauggcagaggaagacgagcagaggcuuuucaccgagaaggucaacaauacuuuuucagaaugucugaacuuaaucaaugagggcugccccaaagaagacauacuggugacgcucaacgaucuuauuaagaauaucccagacgcuaaaaagcugguaaaguacuggauuuguuuggcccuaaucgagcccaucacaaguccuauugaaaacauaaucgcuauuuaugagaaagccauccuggcaggggcccagccaauagaggaaaugcggcacaccauuguugauauccucacuaugaagucucaagagaaagcuaaucugggagaaaacauggaaaagagcugcgcguccaaagaggaagugaaggaggucucaaucgaagacaccgguguggaugucgacccggagaaguuggaaauggagagcaaacugcaccgcaaucuucucuuccaggauugugagaaggaacaggacaacaaaacaaaggaucccacccaugacgugaaaacuccuaauacagagacgagaaccucuugccugauuaaguacaacguuuccacuacaccauauuuacaaagugugaagaaaaagguacaguuugauggcaccaacagcgcauucaaagaacugaaguuucuaacacccgucaggcguucucggcgacuccaggagaaaacuuccaagcugccugacaugcuuaaggaccacuacccaugugugucaaguuuggaacagcugaccgagcucgggagagagacggaugccuucguuugcaggcccaaugcugcccugugucgcguguauuacgaagcagacaccacauga

SEQ ID NO: 54444 - RNA, 2238 nt, Artificial Sequence
  derived and/or modified sequence opt3 from CKAP2L__Homo_sapiens__NP_689728
auggugggccccgggccuaccgccgcugcagccgucgaggaaagacagaggaagcugcaagaguaccucgcggcuaaaggaaaacuuaagagccagaacacaaagccauaucugaaauccaagaauaacugccagaaucagccgcccucuaagucaacuauccggccuaaaaacgacguuacgaaucacgugguauugccagugaagcccaaacgcaguauuagcauaaaguuacaaccucgaccacccaacaccgccgguucccagaaaccuaagcuggaaccaccgaagcuacucggcaaacgucugacaucugagugugucucgucaaaucccuacagcaagccuaguuccaaaucuuuccagcagugcgaagcagggagcuccacuaccggagagcuuucaagaaagccagugggcagucugaacaucgagcaauugaaaacaaccaagcagcagcucacugaucaggguaaugggaaauguauugacuuuaugaacaauauccauguugaaaacgagagccuggauaauuuccugaaggaaacaaacaaggagaaucucuuagacauucugaccgagcccgaaaggaaaccugauccaaaacuuuauacgcggucuaagcccaagacugacuccuacaaccaaaccaaaaacucauuggugccgaagcaggcccugggaaagagcagugucaauucugcugugcuaaaagaucgcguaaacaagcaguuuguuggcgagacacaauccagaacuuucccugugaaaagccagcagcucucgaggggcgcagaccuggcccggcccggggucaagccaucucgcaccgugccuucccacuuuauccgaacacuuucaaaagugcagaguagcaagaagcccgucguuaaaaauauaaaggauaucaaagugaacagaucccaauaugaaaggccaaaugagaccaagauucggucuuaccccguaacggaacagcgugugaaacauacuaagccucgcacauauccaagccuguugcagggagaguacaacaauagacacccgaacaucaagcaggaccaaaaaucaagucaggucugcauuccccagaccuccugugugcuccaaaagagcaaagcuaucucucagaggccuaaucugacuguuggucgguucaacucagccauaccaaguacacccagcauucgaccuaauggcaccuccgggaacaagcauaauaacaauggauuucagcagaaagcgcagacguuagauucuaagcugaaaaaggcagugccacaaaaccacuuccucaacaagaccgcccccaaaacacaggcugacgucacuaccgugaauggcacacagacuaacccgaauaucaagaaaaaggccaccgcagaggaucgcagaaaacaacuugaagaguggcagaagucgaaggguaaaacauacaagaggccuccaauggaacugaaaaccaagcggaaaguaauuaaggagaugaacaucagcuuuuggaaguccaucgaaaaagaggaggaagagaagaaagcucaguuggaacuaucaaguaagauuaauaacacucugacggagugccucaaucugauagaagggggaguucccucuaacgagauccuuaauauucugagcuccaucccugaggccgaaaaauucgcgaaguuuuggauauguaaggccaaauugcucgcaucaaagggcacauucgacgugauuggccuguaugaggaagcuaucaaaaacggggccacccccauccaggaguuacgcaaggucgugcugaauauucuacaagacagcaacagaacuaccgagggaaucacaucugauucccucgucgcugaaaccaguauuacuagcguggaggaacuggccaaaaagauggagucuguuaaauccugccuuucaccaaaggaaagggaacaggugacagcaacgccucguauagccaaggcugagcagcacaauuaccccgguaucaaauugcagauuggcccaaucccgcggaucaacgggaugccugagguacaagacaugaaguuuauuacccccguccgaagaaguagcaggauagagcgcgcggugucgcgguauccagaaaugcugcaggagcaugaucucguuguggcaucccuggacgaacuucuggaggucgaggaaacuaaauguuucaucuucagaaggaaugaggccuugcccgugacacucggauuucagaccccugaaucuuga

SEQ ID NO: 54445 - RNA, 1809 nt, Artificial Sequence
  derived and/or modified sequence opt3 from CKAP4__Homo_sapiens__NP_006816
augcccagcgccaagcagagaggcuccaaagggggacacggugcugcaucuccuucagagaagggcgcccauccaagugggggagcggacgauguggcuaaaaagccgcccccugccccacaacagcccccuccacccccugcaccacacccgcagcagcauccccaacagcacccucagaaccaggcccauggcaaaggugggcacaggggaggcggcgggggagguggcaagagcuccucuucgucaagcgcuagugcagccgcugccgcggcagccgcuuccucuagcgccuccugcucacggcgccuggggcgagcacucaauuuccuguuuuaccuugcuuuggucgccgcggccgcauucaguggaugguguguucaccauguguuagaagagguacaacaggugcguagaagccaccaggacuuuucuaggcagcgggaagaacugggccaaggucuacagggggucgaacagaaggugcaaucccuccaggcuaccuucggaacauuugagucaauccugcgcagcagucagcauaaacaggaucuuacugagaaggccguuaaacaaggcgaaucugagguguccagaauuagcgaaguccugcagaaguugcagaacgagauacucaaagaccugucggauggcauccacgugguaaaggacgcuagggagcgggauuucacgucucuggaaaauaccguugaggaacgccucacagaguuaacuaaguccauuaacgacaauaucgccauuuuuaccgaagugcagaaacgaucacaaaaggagaucaacgauaugaaagcaaaggucgccagucuggaggaaagcgaggggaauaaacaggaccuuaaggcuuugaaagaagcggugaaggagauacagacauccgcaaagucuagagaaugggauauggaggcccugaggagcacccuacagacuauggagucagacaucuauacagaagugcgggagcucgucagucugaaacaagaacagcaggcuuucaaggaggccgcagauaccgaacgucuugcccugcaggcuuugacggagaaacuccugcgcuccgaggaaagcguuucuagauuaccagaggaaauuaggcggcuggaggaggaacuccgacaacuuaagucagacagucacggacccaaagaggacgguggcuuucgccauagcgaagccuucgaggcacugcagcagaagucccaaggguuggauucuagacuacagcacguggaagacggaguacugucgaugcaaguggcgagcgcuaggcagacugagucccucgagucacugcuuaguaagucucaagaacaugagcagcggcuggccgcauugcagggccgccucgaaggucuggggagcuccgaggccgaucaggacggcuuagcuucaaccgucagaagccugggagaaacacagcuagugcucuacggcgauguugaggagcugaaaaggucugugggggaacuuccuuccacugucgagaguuugcagaaggugcaggaacagguacacacccugcucagccaagaccaggcccaggcagcucgucugccaccccaagauuuucuugaccggcugucuuccuuggauaaccucaaagccucaguuagucagguggaggcggaccugaagauguuacgaacagccgucgauagccugguggcuuauucggucaaaaucgaaaccaaugagaacaaucuagaguccgcaaagggacuccuggacgaccuuagaaacgauuuggacaggcuguucgugaagguugagaaaauucaugagaagguguga

SEQ ID NO: 54446 - RNA, 6099 nt, Artificial Sequence
  derived and/or modified sequence opt3 from CKAP5__Homo_sapiens__NP_001008938
augggcgacgauagcgaguggcugaagcuccccguggaccagaaaugcgaacacaagcuuuggaaagccagacuguccggguacgaggaagcuuugaagaucuuccaaaaaauuaaggaugagaagucuccugaauggucaaaauuuuuaggacugauaaagaaauucgucaccgacaguaacgcaguugugcagcuaaagggucucgaggccgcgcugguauauguggagaaugcucaugucgccggcaaaacaacuggggaagugguuagcggaguggucuccaagguguuuaaccagccaaaggcaaaagccaaggagcuuggcaucgaaauuugucugauguacaucgagauugagaaaggugaagcuguacaggaggaauugcucaaggggcuggauaauaaaaacccgaagaucauaguugcaugcaucgagacgcugaggaaagcccucucugaauucggaucgaagauuaucuuacugaagcccauuaucaaagugcuuccuaaguuguuugagucacgggagaaagcuguccgcgacgaagccaagcugauagcgguggagauuuaucgauggauccgugaugcacuaagaccaccccuccaaaauauuaacagcgugcagcugaaagaacuugaggaagagugggucaagcugccuaccagugccccaaggcccacacgguucuugcgcucccagcaggagcucgaagcuaagcuggagcaacagcagucugccggcggcgacgcagaagggggaggugaugacggcgaugagguuccucagaucgacgcuuacgaauuacuggaggccguggagauccucagcaaacuuccaaaggauuuuuaugacaaaauugaagcgaagaaauggcaagagagaaaggaagcccuggaguccguagagguguugauaaagaauccgaaacuagaagcaggggacuacgcugaucuggucaaggcccucaaaaaggugguuggaaaagacacuaacgugaugcuggucgcucuugccgcaaagugucugaccggcuuggccgugggucucaggaagaaauucgggcaguaugcuggacacguaguucccacaauccuggagaaguuuaaagaaaagaaaccucaggugguccaagcguuacaggaggcaauugaugccaucuuccugaccacuacacuacagaauauaucagaagacgugcucgcugucauggauaacaagaauccaaccauuaaacagcaaacgagucuguuuaucgcccggagcuuccgccauugcacugcaucuacccuucccaaguccuugcugaagccuuuuugugccgcucuccugaaacacaucaacgacucagccccagaggugcgagaugcagcguucgaggcucuuggcacagcccugaagguugugggcgaaaaagcaguaaaucccuucuuggccgacgucgauaagcucaaacuggacaagauuaaggagugcagcgaaaaaguggaguuaauccaugggaagaaagcuggacuggccgcagauaagaaagaauuuaagccgcuaccugguagaacugcugccaguggcgcggccggggacaaggacaccaaagauauuucugcucccaagccaggaccucucaaaaaggcacccgccgcuaaagccggcgguccacccaagaaggggaaaccugcagcgccaggcggagccggcaacacagggaccaagaauaaaaagggacuggagacgaaagagauaguugaaccggagcuuuccaucgaagugugugaggaaaaggcuagcgccgucuugcccccuacuugcauucagcugcucgacucgucuaacuggaaagagaggcuggcauguauggaggaauuccagaaggcuguggaguuaauggaucggacagaaaugccaugccaggcccugguacguaugcuugcaaagaaacccgguuggaaggagaccaacuuucaagugaugcagaugaaauugcacaucguugcccucaucgcucagaagggcaauuucuccaaaacuucagcgcaggucgugcuggacgggcuaguggauaagauuggagacgucaaguguggcaacaaugccaaagaggcaaugacagcuauagccgaagccugcaugcugccuuggaccgcugagcaaguugugaguauggcauuuagccagaagaacccaaaaaaucaguccgaaacgcucaacuggcugucuaaugccaucaaggaguucgguuuuagcgggcuuaacgugaaagcguucauuucaaauguaaagaccgcuuuggccgcaacaaaccccgccguccgcacugcugcaaucacccuguuaggcgugauguaccucuacguuggaccgagucugagaauguuuuucgaagaugagaagccugcccuucugucccagauugacgcggaguuugaaaaaaugcaaggccagagcccacccgcuccuacaagggggaucucuaagcacucaacuaguggaaccgaugagggugaagacggcgaugagcccgacgaugggagcaaugacguggucgacuugcucccacggacagaaauauccgauaaaaucaccucugagcuggugucgaagauuggagacaaaaacuggaagauccgaaaggagggccuagaugaaguugccgguauuaucaaugacgcaaaauucauacagccuaacauuggggagcugcccacugcccucaagggccgccugaaugauagcaacaaaauccuugugcaacagacguugaacauucugcagcaguuagcuguagccaugggaccaaauaucaagcaacaugucaaaaaccucggcauaccgaucauuacagugcugggggacuccaagaauaacgugagagcagcugcccuugcgaccgucaaugccugggcagaacagacuggaaugaaggaguggcuggaaggcgaggaucuaucagaggaacucaaaaaggagaacccuuuucugaggcaggaauugcuggguugguuagcugagaaacuccccacccugcggaguacaccaaccgaccuuauccugugcguuccccacuuguauucuugucucgaggaucgcaauggggacgugagaaagaaagcccaggaugcucugccuuucuucaugaugcaucuaggauacgaaaagauggcaaaagccacuggcaagcugaagccaacaagcaaagaccaaguacuugccaugcucgagaaggcuaaagugaacaugcccgcgaagccugcaccgccaacgaaagccaccuccaagcccauggguggcucagcuccugccaaguuucagccagcaagcgcccccgcugaagauugcauuucuuccaguacugagccuaaaccggaccccaagaaagcgaaggccccagggcugagcucuaaagcaaaguccgcucagggaaagaaaaugccuucaaagacaaguuugaaagaagacgaggauaagagcggccccaucuucauagucgugccaaaugggaaagagcagaggaugaaggacgaaaagggacugaaaguuuuaaaguggaacuuuaccacaccucgugaugaguauauugaacaacucaaaacucagaugucguccuguguggccaaguggcugcaggacgagauguuccacucugauuuucaacaccauaauaaagcacuugccgucaugguggaccaccuggaaagcgagaaggagggcguuaucgguugcuuggaucucauccugaaauggcuaacccugcgguucuuugacacgaacaccucagugcuuaugaaggcucucgaauaccugaaguuguuauucacacugcucagugaggaagaguaucaucugacugaaaaugaggccuccucuuuuauucccuaccuugucguaaaagugggggagccaaaggauguuauccgaaaagacgugagagcgauucugaacaggauguguuuggucuauccggcaagcaagauguucccuuuuauaauggaaggaaccaaauccaagaauucaaagcagcgcgccgagugccuagaagagcugggcugucucguggagagcuacgguaugaacguaugccagcccacaccaggcaaagcucugaaggaaaucgccgugcacauuggggaucgggacaacgcugucagaaaugcagcccuuaacacuaucguuaccguguacaaugugcauggagaccaggucuucaaauuaauuggcaaccugagugagaaggauaugucuaugcucgaagagaggaucaaacgcuccgcuaagcgacccagcgccgcaccuauaaagcaaguggaagagaaaccacagcgggcgcagaauaucucgucaaacgccaauauguugcguaaggggcccgcugaggacaugucuaguaaacugaaccaggccagauccaugagcggacacccugaagcagcucaaaugguuaggcgcgaguuucagcucgaucuggacgaaauugagaaugauaacggcacgguacggugugaaaugccggagcuugugcagcacaagcuggacgauaucuucgagccagucuugauucccgaaccuaaaaucagagccgugucuccccauuucgacgauaugcacagcaauacagcauccaccauaaacuuuauuaucucacagguugccaguggugacaucaauacuagcauucaagcucuaacacagauagaugaggugcugaggcaggaagacaaggcggaggccaugucugggcauaucgaucaguuccucauugcaaccuuuaugcaauuacgacugaucuauaacacucacauggcugacgaaaagcuugagaaagacgagauuaucaagcuguacuccugcauaaucggaaauaugauuucacucuuccagaucgaaaguuuggcccgcgaggccagcaccggcguccugaaagaucucaugcacggucugauuacacuuaugcuagacucccggaucgaagaucuggaggagggccagcaagugauaagaucuguaaacuuguuagucgugaagguucuggaaaaaucggaccagacgaacauucucagcgcacugcuugugcugcuccaggauucauugcuggcuaccgccuccaguccaaaguuuucugagcuagucaugaaaugucuguggaggauggugcgucuccuuccugacacuaucaauagcaucaaccuggaucgcauuuuauuggacauccauauauucaugaagguuuuucccaaggaaaaacugaagcagugcaaauccgaguucccaauucggacacucaagacccugcuucacacacugugcaaacucaaggggccuaagaucuuggaucaucugacuaugauugacaauaaaaacgaaucagaguuagaggcgcaccuauguagaaugaugaagcauucuauggaucaaaccggaagcaaaagugacaaggaaacggagaaaggcgcuuccaggaucgaugaaaagagcucuaaggccaaagugaaugacuuucuggcagagauauucaagaaaauugggucaaaggaaaacacaaaagagggacucgccgagcuuuaugaauacaagaagaaauauuccgacgcugauaucgagccguuucugaagaauaguagccaguucuuccagucguacgucgaacgaggcuugcgggugaucgagauggaacgcgaggguaaagggagaauuucuaccuccacuggaaucagcccccagauggagguaaccugcgugccaacaccuacuucaaccguuaguucuauuggcaacacaaauggcgaagaggucgggcccuccguguaucuggaaaggcucaagauacugcggcaacgauguggacuugacaacacgaaacaggaugacagaccaccucucaccagccuguugucaaagcccgcagugccgacugucgccaguagcacagauaugcugcacuccaaguuaucucagcuacgcgagagcagggagcagcaccaacauuccgaccuggauucaaaucagacccacucuagugguacuguaacaucgagcuccucuaccgcgaacaucgacgaucucaaaaagcgucuugaacggauuaaaucaagcagaaaguga

SEQ ID NO: 54447 - RNA, 1146 nt, Artificial Sequence
  derived and/or modified sequence opt3 from CKB__Homo_sapiens__NP_001814
augcccuucagcaacucccacaaugcccugaagcucagauuuccugcugaggacgaguucccagaucuuucugcacauaacaaucacauggccaaagugcugaccccggaauuguacgcggaauuaagggcuaagucaacacccaguggcuuuacucuggacgaugucauccagacggggguugacaacccuggacauccauauauuaugaccguggguugcguagccggcgaugaggaaagcuacgagguguucaaagaccuauuugaucccauaaucgaggaccggcacgggggauauaagccuuccgaugaacauaaaacagaccucaauccagauaaccugcaaggcggugacgaucuugaccccaauuacguccugucuucgcgcgugcgaacugggcguucaauuagaggauucuguuugccuccacacugcagcaggggcgagcggcgcgcaaucgaaaagcucgccguugaggcucugaguucccuggacggcgaucucgcagggagauauuacgccuuaaagucuaugaccgaggcugaacagcagcagcugauugacgaucacuuucuuuucgacaaaccggugagccccuugcugcuagccuccggaauggcgagggauuggccugacgcacgggguaucuggcauaacgauaauaagacauuucucgucugggugaacgaggaagaccaucugcgcguaauaucaaugcaaaaaggcgggaauaugaaggagguuuucacccgauuuuguacuggacuuacacagaucgaaacccuguucaaaaguaaggauuaugaguuuauguggaacccacacuugggcuacauucucacgugccccagcaaucuggguacuggguuaagagccggagugcacaucaagcugccuaaccucggcaaacacgagaaguucucugaaguccuuaaaaggcugcgguugcagaagcguggcaccgggggaguggacacagcugccguggguggcgucuucgauguuuccaaugcagaccgccuaggguuuucagagguggaacugguacagaugguggucgacggagugaaacuccugauugagauggaacaaagacuugagcagggccaggcuaucgaugaccugaugccagcccagaaguga

SEQ ID NO: 54448 - RNA, 342 nt, Artificial Sequence
  derived and/or modified sequence opt3 from CKLF__Homo_sapiens__NP_001035228
auggacaacgugcagcccaagaucaaacacagaccuuucugcuuuagcgucaagggccauguuaaaaugcugaggcucgcccuuaccgugacauccaugacuuucuuuauuauagcucaagcaccagagccguacaucguaauuacgggguucgaagugaccgucauccuguuuuucauuuuguuauaugugcugcggcuagaucgccucaugaaguggcuguuuuggccccuucuggacaucauaaauucuuugguuacaacuguguucaugcucaucgucucagugcuggcccugauuccugagaccacaacccucacuguaggagguggcuuauuuuga

SEQ ID NO: 54449 - RNA, 1146 nt, Artificial Sequence
  derived and/or modified sequence opt3 from CKM__Homo_sapiens__NP_001815
augcccuucggcaacacccacaauaaguuuaaacugaacuacaagccugaggaagaguauccagaccucagcaaacauaauaaccacauggccaaggugcuuacacuggaauuguacaaaaaguuaagagauaaggagacuccguccggguucacggucgacgauguuauccagaccggaguggacaaucccggucauccuuuuauuaugacaguaggcugcguggcuggggaugaagagucuuaugaggucuucaaagaacuguuugacccaauaaucucagauaggcacggaggcuacaagcccacugacaaacauaagaccgaucuaaaccacgagaaucucaaagguggggacgaucuggacccuaacuaugugcuuaguagccggguucgcacaggacgauccauuaagggcuacacccugccaccccacuguucucguggcgaaagaagggcaguggagaaguugucggucgaggcccucaauucacugacuggggaauuuaaaggaaaguauuacccucugaaaagcaugacagagaaggaacaacagcagcucaucgaugaccauuucuuauucgacaaaccagugaguccgcugcuuuuggcguccgguauggcucgggauuggcccgacgcccgcggcauuuggcacaacgauaauaagucuuuucugguauggguuaacgaggaagaccaucuaagagugaucagcauggagaaagggggaaauaugaaggaggucuucaggcgguuuugcgugggccuccagaagauagaagagaucuucaaaaaggcaggucacccuuuuauguggaaccaacaccugggguacgugcuuaccuguccauccaaucugggaacgggcuugcgcggcgggguccauguuaaacucgcccaccugucaaagcaucccaaauucgaagagauuuuaacucgacugagacuccagaagaggggaaccgguggcguggauacagcugcaguagggaguguguucgacgucagcaacgccgaucggcuuggaucuuccgaaguggagcagguucagcugguggucgacggcgugaaguugaugguagagauggagaaaaagcuagaaaaaggucaaucaaucgaugacaugauuccugcucagaaguga

SEQ ID NO: 54450 - RNA, 777 nt, Artificial Sequence
  derived and/or modified sequence opt3 from CKMT1A__Homo_sapiens__XP_005254555
augcccgugaaggucagaaccggcaggagcauccgggggcugucccucccuccagccugcacacgcgcugagcgacgugaaguugagagagugguaguggacgcacuuucuggacugaaaggugauuuggccggcagguacuaucgguuaucagaaaugacugaggcggaacagcaacagcugauugacgaucacuuccuauuugacaagccggucaguccccuccugacggcugccgggauggcacgcgauuggccugacgccagaggaauauggcauaacaaugagaaauccuuccuuaucugggugaacgaggaagaucacaccaggguuauuagcauggagaagggcgguaauaugaaacggguguuugaacgcuucugucgagggcugaaggaggucgagagauugauccaggaaaggggaugggaguuuauguggaacgaacggcucggcuacauucugacaugcccaucuaaucugggcacugggcuccgugcuggagugcauaucaaguuaccccugcuuucgaaagacucacgcuucccuaagauauuggagaaccugagacuacagaaaagggguaccggcgggguagauacagcagccaccggaggcguuuuugacaucagcaaucucgaucggcuggguaagagugaaguggagcuuguccaacuggugauugacggggugaacuauuugaucgauugugagcgacgccucgaaagaggacaggacauuaggaucccaacucccgucauacacacaaaacauuga

SEQ ID NO: 54451 - RNA, 1347 nt, Artificial Sequence
  derived and/or modified sequence opt3 from CKMT1B__Homo_sapiens__XP_011519498
auggccggccccuucagcagacugcucuccgcuagaccugggcuucggcuguuggcauuagccggagcggguucucuggcugccggcuuucuacuccgcccagagccggugcgagcagccucagaacguagaaggcuguaucccccuagucagaccuggccaacagggcaacuucccggaaacugcacucggagccgcagacuguguccuccauccauggucacgggcuaccccuugccuucugcugaguacccagaccucaggaagcacaauaacugcauggcaucgcaucugaccccggccguuuaugcucggcugugugauaaaacaacucccaccgguuggacacucgaccagugcauccagaccgggguggauaauccuggacacccauucauuaagacuguaggcaugguggccggcgacgaagagacauacgaagucuuugcggauuuauucgaccccgugauacaggagcgccauaacggguaugauccucgaaccaugaaacacacgacugaccuggaugcaucaaagaucagaagcggauacuuugacgagagguauguucuuaguucccgggugcguaccggucgcucuauuagaggcuugagccugccacccgccuguacaagggcugaacggcgagaggucgaacgcgugguaguugaugcccuauccgggcucaaaggagaccuggcaggcagauacuacaggcuuucagagaugacugaggcugaacaacagcagcugaucgaugaccauuucuuguuugacaagccggugaguccucuccugaccgccgcggguauggcccgggauuggcccgacgcacgcgggauuuggcacaauaacgaaaagagcuucuuaaucugggucaaugaggaggaucacacaagagugauaucuauggaaaaaggaggcaacaugaagaggguguuugagcguuucugccggggccugaaagaggucgaacgacucauccaggagagagggugggaauuuauguggaaugagaggcuuggauauauucugaccuguccauccaacuuggguacgggccuacgcgcugggguucauaucaagcugccucuccugucaaaagacagccgguuccccaagauucuugaaaaucugagauugcaaaagaggggaacuggcgguguggauacagccgcuaccgggggcguauuugacaucaguaaccucgaucgccugggaaaaucugagguggaguuaguccagcuggugauagacggcguuaauuaccuaauugauugcgaacgacggcucgagcgugggcaggacaucaggauuccaacucccgugauccacacaaagcauuga

SEQ ID NO: 54452 - RNA, 1260 nt, Artificial Sequence
  derived and/or modified sequence opt3 from CKMT2__Homo_sapiens__NP_001093206
auggccagcaucuucuccaagcugcucaccggcagaaacgcuucucuucuguuugcaacaauggggacuucaguguugacgaccggauacuuacugaauaggcagaaagucugcgccgagguucgggaacaaccccgccuauucccuccaagugcggacuauccggaucuccgaaagcacaacaauuguauggcugagugccugacacccgccauuuacgcaaaacuucguaacaaggugacuccuaaugguuauacccuggaccaguguauacagacaggcguagauaacccagggcaucccuuuaucaaaaccgugggaauggucgccggcgacgaagagagcuacgaaguguucgcugauuuguuugacccuguuauuaagcucagacacaaugguuaugauccaagggugaugaagcauacuacagaccuggaugcauccaaaaucacccaggggcaauucgacgagcacuacguccugucuucgcgggugcgcacgggaagaucaauuaggggccucagcuuacccccugccugcacucgggcugagcgccgagaaguagagaacguugccaucaccgcgcuggaaggccuuaagggggauuuggcaggaagauauuacaaacugagugagaugacagagcaggaccagcagaggcuaauagaugaccauuuucucuucgacaagccaguguccccgcugcuuacuugugccgguauggcucgggauuggcccgacgcccguggcaucuggcacaauuacgauaaaaccuuucugauuuggaucaacgaagaggaccacacacgcgucauuucuauggaaaaagggggaaauaugaagagaguguucgagagguuuugccggggcuugaaggaaguggagcgacucauccaagagcgcgguugggaguucauguggaacgaaagacugggguauauauuaaccuguccuagcaaucugggaacgggccucagggcaggcguccauguucggauuccaaaacuuuccaaggauccccgcuuuucaaagauccuggaaaacuugagacuacagaaaagggggacuggagguguggacacagcugccguagcggauguguacgacauuaguaauaucgaucguaucggccggagcgaggucgaacuggugcagauuguuauagacggggugaacuaucucgucgauugcgagaagaaacuggagcgaggacaggacaucaaggugccuccaccccuuccgcaauucggcaagaaauga

SEQ ID NO: 54453 - RNA, 240 nt, Artificial Sequence
  derived and/or modified sequence opt3 from CKS1B__Homo_sapiens__NP_001817
augagccacaagcagaucuacuauuccgacaaauacgaugacgaggaguucgaauauagacaugugaugcugcccaaggauauugccaaacucgucccuaagacccaccuuaugucugaaucagaguggaggaaccugggcguucaacagagucaggggugggugcauuacaugauacacgaaccagagccgcauaucuuguuauuucggcgcccccugccuaaaaagccaaagaaauga

SEQ ID NO: 54454 - RNA, 240 nt, Artificial Sequence
  derived and/or modified sequence opt3 from CKS2__Homo_sapiens__NP_001818
auggcccacaagcagaucuacuauagcgacaaauacuucgaugagcauuaugaauacagacacgugaugcugcccagggagcucuccaagcaagucccuaaaacccaucuuaugucugaagaggaauggcggcgccugggcguucagcagucauuggggugggugcacuauaugauucaugagccagagccgcacauauuacuguuucgacguccccuaccuaaggaccagcaaaaauga

SEQ ID NO: 54455 - RNA, 4440 nt, Artificial Sequence
  derived and/or modified sequence opt3 from CLASP1__Homo_sapiens__NP_001135745
auggagcccagaauggaaagcugccuggcccaggugcuccaaaaggacgucggcaaaaggcuucagguugggcaggagcugaucgauuacuucuccgacaagcagaaaucugcugauuuggaacacgaccaaaccauguuagauaagcugguggacggacuagcaacaucauggguaaacaguagcaauuauaaagugguccuccuggguauggauauucuuuccgcccuggugacucgguugcaggaccgcuuuaaggcgcagauaggcacgguucucccuucucugaucgaucgacugggggacgcuaaggauucggugcgugagcaggaccaaacccucuuacugaaaauuauggaucaggccgcaaacccacaguacgucugggacagaaugcuuggaggcuucaagcauaaaaauuuuaggacacgggaagguaucuguuugugccugauugccacucuaaacgcuucaggggcacagacccucacacugagcaagaucgugccgcacauauguaaucuucugggagaccccaacagucaaguacgcgaugccgcuaucaauuccuugguugagauuuauagacaugugggcgagaggguccgggccgaccucucuaaaaagggccugccucagagccgcuuaaacgugaucuucaccaaguuugaugaagugcagaaauccgggaauaugauucaaucagcgaacgacaagaauuucgaugacgaggauagugucgacggaaaccgaccaagcucugcauccucaacuagcaguaaagcacccccuucuuccagaaggaauguugguaugggcacaacccggcgucuggggagcucgacgcucggaucuaaguccucagcugccaaagaaggcgccggugcuguggaugaggaggacuuuaucaaggccuucgaugacguaccagugguccagauauacaguagccgcgaccuugaagaguccauuaacaaaaucagagaaauucugucugaugacaagcacgauugggagcagagggugaaugcguugaagaaaauccggagccuacugcucgccggggcagcugaauaugacaacuuuuuccagcaucugcgacuucuggauggagccuuuaaguugucagcuaaagaccuccgcagucaaguugugagagaggccugcaucacucugggccacuuauccagcguccugggcaacaaguucgaucacggggcagaggccauuaugcccaccauauuuaaucuaaucccuaacucugcuaaaauuauggcgacaucaggagugguagcaguuaggcucaucauacggcauacucacauuccacgccugaucccggugaucaccaguaauuguacaagcaaguccgucgccgugagaaggcguugcuucgaguuccuugacuugcugcuccaggaauggcagacccauucucuggaacggcacauuucgguccuugcugagacgaucaagaaagguauucacgaugccgacagcgaagcacgaauagaggccagaaaguguuacuggggcuuucauucccacuucucaagggaggcugaacaucuguaucacacuuuggagaguucuuaccagaaagcccuccaaagccaucugaagaacuccgauucaaucgugagcuuaccccagucugaccgcuccaguagcagcucccaggaaucacugaaucggccucuaagugcaaaaagaagcccaacagggucgaccacuuccagggcgucuacaguuagcaccaagucagugaguacgaccggaucccuccagcgcucucgaagcgauauugacguaaacgcugccgcauccgccaagucaaaagucagcaguucuuccggcacaacucccuuuagcucggcugccgcacugccuccagguucauacgcuucucuugacgggaccacaacuaaggccgagggccggauccguaccagaaggcaaaguuccggaagcgcgacaaauguggccucuacccccgauaaccgcggccggagcagagcuaaaguugugucccagucacagaggagucgaagcgcaaauccggccggggcuggaucucgcuccucaaguccugguaaguugcugggcagcggguauggaggccucacugguggguccucucggggacccccagucacgccuucgagcgaaaagagaucaaagauccccaggucccagggcugcagucgugagacaucuccaaaccgcauuggccuggaccgguucggguuaggacaacccgguagaauaccuggcagcgugaaugccaugaggguacuguccaccucaacugaucuugaggcagcgguggccgacgcuuugcuccugggggauucucgaagcaagaaaaagccaguucggcgcagauacgaaccguauggaauguacagugacgaugacgccaacuccgaugcaagcucugucuguucagagagguccuauggcagucggaauggugggaucccccacuaccuacgacagaccgaagacguggcugaggugcugaaccacugcgccagcucgaauuggucugagagaaaagaaggccuccugggacuucagaacuugcugaagucccaacgcacauuaagcagggucgagcucaaacgucugugugaaauuuuuacccggauguucgcagauccucauucaaagagaguuuuuaguauguuccuugagacucugguggacuuuaucauuauccacaaagaugacuugcaggacuggcuguucgugcuccuaacacagcugcucaagaagaugggcgccgaucugcuugggucuguacaggcuaaaguccaaaaggcguuggacgugacgagggauuccuuuccauucgaccagcaguuuaacauacugaugcgcuucaucguugaucagacccaaacucccaauuuaaaagugaaggucgccauucucaaauauaucgaaagccuggcacgacagauggacccuacagauuucgugaacucaagugagaccagacuugcuguuagccggauuaucacauggacuaccgagccaaaguccucugacgugaggaaggccgcccagauaguacugauuagccuauuugaacucaauacgcccgaguucaccaugcuguugggagcucugccgaaaacauuucaggauggcgcaacuaaguuacuccauaaccaccugaaaaauuccucaaacaccucugucgguaguccuucgaauacaaucgggcgcacuccaagccgucacaccuccucuagaacgucaccccuuacaagcccuaccaacugcucccauggaggccugagucccucuauguuggacuacgauacugaaaaucucaacagcgaggaaauuuacucaucccugcggggugugacagaggccaucgagaaguucaguuuuaggagccaagaagaccuaaaugagccaauaaaacgcgacggcaagaaggaaugcgauaucgugucucgagacgggggagcggcuuccccugccaccgagggcagagggggaucagaagucgagggcggucggacugcacuggauaacaaaaccagccuucucaauacacagcccccaagggccuucccggggccucgcgcuagagacuauaaccccuacccauauucggaugcaauuaauacguacgacaagaccgcccugaaagaggcgguuuuugaugacgauauggaacaguugagggacgugcccaucgaucacucugaccugguagcugauuuacucaaggagcugaguaaccauaacgaacggguggaggagcguaaaggagcccuucuggaauugcucaagauuacucgcgaggacucccugggcgucugggaggaacacuucaagacaauccuacugcuucuccuggaaaccuugggugacaaagaucauagcauacgagcauuagcccugagagugcucagggagauucugcggaaucaaccugcucgcuuuaagaacuaugccgagcuuacaaucaugaaaacucuggaagcacacaaggacucacacaaagagguugugagagcugccgaagaggcggccuccaccuuggcaucuagcauccauccagaacaguguauuaagguccuaugccccaucauucagacggcugauuacccuauaaaucuggccgcuaucaaaaugcagacaaaggugguugagaggauugcaaaggagagucuccugcaacuuuuaguggacaucauuccgggccugcuccagggguaugauaacaccgaauccagcguccggaaagccucuguauucuguuugguggccaucuacucaguuauaggagaggaccugaagccacaccucgcucagcugacuggcaguaaaaugaaacuucugaauuuguacaucaaacgagcgcagaccacaaacuccaauucuucuucgucaagcgauguguccacucauaguuga

SEQ ID NO: 54456 - RNA, 3885 nt, Artificial Sequence
  derived and/or modified sequence opt3 from CLASP2__Homo_sapiens__NP_001193973
auggccaugggcgacgauaagagcuucgacgaugaggaauccguggacgggaacagacccucuucagcugcaagugccuuuaaagucccugcgccaaagaccagcggaaauccggcuaacuccgccaggaaacccgguucugcaggcgggccuaagguuggaggcgccucgaaagaggguggggcuggagcaguggaugaagacgauuucaucaaggccuuuacagacguaccaucaauucagauauacagcagucgggagcuggaagagacucucaauaagauccgcgagauucuuuccgaugacaaacacgauugggaccaacgagcuaacgcccugaagaaaauccguucuuuguuaguggcgggcgcagcccaguaugauugcuucuuucagcaucugagacuacucgacggcgcucugaaguugagcgccaaagaccugaggucccaggucgugcgggaagcauguauuacgguugcucacuugucaaccgugcucgggaauaaguucgaucauggagccgaggcgaucguccccacacuguuuaaccuggugccuaauagugccaagguaauggcaacuagcgguugcgcugccauacgcuucaucauuagacacacccauguuccaaggcucauccccuuaauuacaucuaacuguaccuccaaaucagugccuguccggcgccgaucuuuugaguuccuggaccuuuugcugcaagaauggcagacucacagucuagagagacacgcugccgugcucguggaaacaaucaagaaaggcauacaugaugcagacgccgaggcuagggucgaagcgcggaagaccuacauggggcugcguaaucacuuuccaggagaggcagaaacgcuuuauaacucucuggagccguccuaccagaaaagccuucagacuuaucucaagucgucuggcuccguugccucacugccccaaagugaucgcagcuccucuagcucacaggagaguuuaaauagaccuuucuccagcaaauggucuaccgcuaacccaucaacaguggccgguaggguaagugcagggagcuccaaggccucuucgcugcccggaagccuccagcggucccgaucagacauugaugugaaugcugccgcaggcgcgaaggcucaucacgccgcaggccagaguguccgcucugggagacuuggagccggugcucugaacgccggcagcuacgcauccuuggaagacacuucagauaaacuagacgggaccgcuagcgaggauggaagggugcgggccaagcugucugcgccucucgccggcauggguaaugcuaaagcagacucccgcgggagaaguaggacaaagaugguuagccaaucucagccaggcucccguucaggaagucccggccgggugcugaccacgacugcccuuagcacagucucguccggggugcagcgaguacugguuaacucugcuagcgcccaaaagagaucaaagaucccgaggagucagggaugcucccgcgaagcaucuccuagccgguuguccguggcgagaucaagcaggauuccccgcccaagugucucucaggguuguucccgagaggccagccgggaaucgucacgugacaccucuccugugagaaguuuucagccccucgcuuccaggcaccauagccgcucuacuggcgcccuguaugcaccagaggucuacggggcuagcggacccggcuacgguaucucccaaucaagucgguuaucuagcuccgugucagccaugagaguucugaacacagggagugauguggaggaagcaguagccgacgcucuaaagaaaccugcgaggcgacgcuaugagagcuacggcaugcacuccgaugacgaugccaauucugacgcaucgagcgcuugcucagaacgguccuauaguucuagaaacggaagcaucccaaccuacaugaggcagacggaggaugucgccgaagugcucaaucguugugccuccucaaacuggucugagcgcaaggagggccugcuuggguugcagaaucugcucaaaaaccagcggacccugagcagaguugaacuuaagaggcugugcgagauuuucacacgaauguucgcugacccgcauggaaaacggguguuuaguauguucuuggaaacucucgucgauuuuauacaagugcacaaggacgaucugcaggacugguuauucguacugcuaacccagcuccugaagaaaaugggugcagaucuuuugggcuccgugcaggccaagguucaaaaagcgcuggacgucacacgcgagagcuuucccaaugaccuccaguucaacauccugaugagauuuacuguggaucagacccagacaccuucuuuaaaggugaaagucgcuauucugaaguauaucgagacccuugccaagcaaauggacccaggggauuucauaaauucauccgaaacuagguuggcaguuagucgggugauuacguggacaaccgagcccaaaagcucggacgugcgaaaggccgcucagucuguacucaucucccuguuugaacuaaacacuccugaguucaccaugcugcucggagcacugccaaaaacauuucaggauggcgccaccaaacuuuugcauaaucaccugagaaacacugguaaugggacacaaagcucaaugggcagucccuuaacgcgcccgaccccuaggucuccagcgaacugguccagcccccucacuucaccuacaaauaccagucagaacacacugagccccuccgcuuucgacuacgauacugaaaacaugaauagcgaggacaucuauagcucccuucguggagucaccgaggccauucagaacuuuucauuccggucucaggaagauaugaaugagccacugaaaagagacaguaagaaagaugacggcgauucgaugugugggggaccuggcaugagcgaccccagggccgguggggacgcaacggauuccucucaaaccgcuuuggacaacaaggccucacuccugcacagcaugccaacacauuccaguccgcgcucucgagauuacaauccuuacaacuauagcgacucaaucucccccuucaauaagagugcacuaaaagaagcuauguuugaugacgaugccgaccaguucccagaugaccugagccucgaucacucugaccugguggcggagcuuuugaaggaacuguccaaccauaaugagagaguugaggaacggaaaauugccuuauacgagcucaugaagcugacucaggaagagucauuuagcgugugggacgaacacuucaaaaccauacuucugcuacuccuggagacauugggagauaaggagcccacuaucagggcacuggcuuuaaagguccuccgcgaaauucugcgucaccagccugccagauuuaaaaacuaugcugagcuuaccgugaugaagacgcuggaagcacauaaagacccacacaaggagguugugcggucggccgaggaagccgcuucuguauuggcgacaaguaucucccccgagcaaugcaucaaaguccucuguccuauuauacagaccgcagauuacccgaucaaucuggccgcuauuaagaugcagacuaaggugaucgaaagggugagcaaagagacacuaaaccugcuucucccagaaauuaugcccggccugauccaggguuaugacaauucagaguccucuguccgcaaggccugcguuuucugcuugguggcaguacaugccgugauaggcgaugagcugaaaccucacuuaagccaacucaccgggaguaagaugaaacugcuuaaccuguacaucaagcgagcucagacuggauccggcggggcggacccaaccacagaugucagcggacagucuuga

SEQ ID NO: 54457 - RNA, 1851 nt, Artificial Sequence
  derived and/or modified sequence opt3 from CLCA2__Homo_sapiens__XP_011540750
augacccagagaagcaucgccggccccauuugcaaccugaaguucgugacacuccuugucgcucuguccucugaguugccuuuucuaggggcaggaguucaacugcaggacaaugguuacaacggccuacucauagccaucaauccacaggugccggaaaaccagaaucugauuucaaacaucaaagagaugauuacugaagcgaguuucuaucuuuuuaaugcuacgaagaggcggguauucuuucgcaacaucaaaauacugauccccgccaccuggaaggcaaauaacaauagcaaaauuaagcaagaguccuacgaaaaggccaacgugaucgucacagauugguauggggcucacggagacgauccuuacacuuugcaguaucgaggcugugguaaagaggggaaguacauucauuucaccccaaauuuucuccugaacgacaaucugacagcaggauauggcucucguggcagaguguucguucacgagugggcccaucucagguggggaguguuugaugaauacaacaacgacaaacccuucuacaucaaugggcagaaccagauaaaggucacccggugcucgucagauauuacugguaucuuugugugugagaaaggcccuugcccacaagaaaauuguauuaucagcaaguuauucaaggaggggugcacauuuaucuauaacaguacccagaaugcuacggccuccauuauguucaugcagucucugagcuccguaguugaguucuguaacgcgucaacucacaaucaggaagcacccaaccuucaaaaucagaugugcaguuugcgcagcgccugggacgugauaaccgauucugcugacuuucaucacuccuucccuaugaacggaacagagcugccaccgcccccuacuuuuucauuaguccaggccggcgauaaaguggugugucucguccuggacguuagcaguaagauggcagaagcugauagacuucugcaauugcagcaggccgcggaguucuaccucaugcagaucguggaaauucacaccuuuguagguaucgccucuuucgacuccaaaggggagauaagggcacaacugcaucagauuaauagcaacgacgaucggaaguuacuggugucguaucucccaacaaccgucucugcuaaaacggacaucuccaucugcucaggacuuaagaaaggcuuugaggugguugaaaagcugaauggcaaggccuacgggagugugaugauuuuggucacuagcggagaugacaaacuacuggguaacugucuccccacagugcuguccucuggcagcaccauccacucaauugcucuugggaguuccgccgcaccuaaucuggaggaauugagccgccucacuggaggccugaaguucuuuguaccagauauaucuaacucaaacaguaugaucgacgccuucagccgaauuuccucugguacaggggauaucuuucagcagcauauccaauuagagucgaccggcgaaaauguuaaaccccaccaccagcugaagaacacggugaccgucgacaauacagugggaaacgauacuauguuccuagucaccuggcaggcuagcggcccgccugagauuauacucuuugaccccgaugggagaaaauauuacacaaauaacuucaucacuaaucugaccuucaggacagcgucccuuuggauuccaggaaccgcaaaguugcggcguuuugccuucaucccugacggucgccugaaccucucagugguugacuuugauacucuggcucuuuuccuguuuuugauuuauugccucggccauaaggugaaagggaauaacaagguauacuuccacuga

SEQ ID NO: 54458 - RNA, 2607 nt, Artificial Sequence
  derived and/or modified sequence opt3 from CLCA4__Homo_sapiens__XP_011539317
auggaggacauggugaccacagccagcacuuaccuguucgaagcuacggagaagagauuuuucuuuaaaaacgucuccauccucauucccgaaaauuggaaggagaacccucaguauaaaaggccaaagcacgaaaaucauaaacacgcagauguuauaguggccccgcccacccuuccuggccgggacgagccauacacaaagcaauucacugagugcggggaaaagggagaguauauccauuuuacccccgaucuguuguuagguaaaaagcagaacgaauacggcccuccagggaaacuguucguacacgagugggcgcaucuacgcuggggaguguuugacgaguauaaugaagaucagcccuucuaccgagcuaagucuaaaaagauugaggccacacguuguucagcaggcaucagugguagaaacagggucuauaagugccaagggggaagcugucucucccgggccugccgcauugacucuaccacuaaacuguacggcaaggauugucaguuuuucccugacaaagugcagacagaaaaggcuucgaucauguuuaugcagucaauagauagcguuguggaguucugcaaugagaaaacccacaaccaggaagcaccaagucuucaaaauaucaaguguaacuuuagauccacgugggaggucauuucuaauagcgaagacuucaaaaacacuaucccgauggugacacccccuccacccccuguauucucccuguugaagauuucacagaggaucguuugccucgugcuggauaagaguggcagcaugggagggaaagaccggcugaaucgcaugaaccaggccgcuaagcacuuucucuuacagaccgucgagaaugguucuugggugggcauggugcauuucgauuccacugccaccauagucaacaaacugauucaaaucaagucaagcgacgaacgaaacacacuuauggcgggguugccaaccuacccccugggaggcacgaguauuuguucugguaucaaauaugcauuucagguuaucggggagcuacacucccagcucgacggaagcgaagugcugcuucugacugauggcgaggacaauacagccucgucuugcauugaugagguaaagcaauccggcgcuauagugcauuucaucgccuuggggagagcagcugacgaagccgucauugagaugucaaagaucaccggagguagucacuuuuacgugagcgaugaagcgcagaacaauggccucauagacgccuucggggcacugacuuccggaaacacagauuuaucucagaaaagccugcagcucgagucaaagggccuuacccugaauaguaacgcuuggaugaaugacacgguuauuaucgauuccaccguggguaaagacacauuuuucuugaucacuuggaacagccuaccgccuucuauuucacugugggaucccagugggaccaucauggaaaauuuuacagucgacgccacuagcaagauggcuuaucucuccauuccaggcaccgccaaagugggaacaugggcauacaaccugcaagccaaggcuaauccugagacccuuacuauaacgguaacaucuagggcggcaaacucgagcguucccccaaucaccgugaaugccaagaugaacaaagacgucaauuccuuccccucaccuaugauuguguaugcugagauccugcagggcuacgucccaguguugggggccaacguuacugcauuuaucgaaagucagaacggacacaccgaggugcucgaacuguuagauaauggugccggcgcugacucuuucaagaacgaugggguauauagccgguacuuuacagccuacaccgagaauggacguuauucccugaaaguccgcgcacauggcggugcgaacacugcuagacuaaagcucaggccgccccugaaucgggccgcauacauuccugggugggugguuaacggcgagauagaagccaauccaccccgaccugagaucgacgaagauacacagacgacccuugaggacuucucacgcacugcuagcggaggcgccuucguggucucucaagugccauccuugccccugccggaucaguauccuccaagucagauuacagaccucgaugcaaccguacacgaagacaaaaucauucugacauggacugcucccggggauaacuuugacgugggaaagguucagagauacaucauaaggaucagcgccucuauucuugaucugcgggacuccuucgacgaugcguugcaagucaauaccacggaccucucaccuaaggaggccaacaguaaagagagcuuugcuuucaagcccgaaaauaucucggaggaaaacgcaacccauauuuuuaucgccauaaaauccauugauaagucuaaucugacaagcaaagugucaaacaucgcucaggugacuuuauucauuccacaggccaauccugacgauaucgaccccaccccaacaccgacuccuacccccacgccagauaagagucacaacuccggugucaacauaucuacacugguucuaagcgugaucggcuccgugguaauugucaauuuuauccucucaaccacuauuuga

SEQ ID NO: 54459 - RNA, 648 nt, Artificial Sequence
  derived and/or modified sequence opt3 from CLCF1__Homo_sapiens__NP_001159684
augcuggccugccucuguaccgugcuuuggcaucugcccgcugucccugcauugaacagaacaggcgacccagggccgggacccagcauccagaagacuuacgauuuaacgagguaucuggagcaccaacuacggucccucgccgguaccuaccugaauuaucuuggcccuccauucaacgaacccgacuuuaauccuccacgccugggggcggagacauugccccgagcuacuguugaucucgaaguguggcguucucugaacgacaaacugagacucacccagaauuacgaggccuauucacacuuacugugcuaccuuaggggauugaaccggcaggcagccacagcugaacugcgcagaagucuagcacauuucuguaccagccuccagggccugcuugguuccauugccgggguaauggcugcccugggauauccuuugccacaaccgcuccccggcacugagccuacauggaccccaggccccgcgcacucugauuuucugcagaagauggacgauuucugguuacugaaagagcuccagacguggcuuuggaggucggcaaaggacuuuaaucggcugaaaaagaagaugcagccuccagccgcugccgugacuuugcaucuaggggcacacggauucuga

SEQ ID NO: 54460 - RNA, 429 nt, Artificial Sequence
  derived and/or modified sequence opt3 from CLC__Homo_sapiens__NP_001819
augagccugcuccccgugccuuacaccgaggccgcuucccuuucuacaggcucaacugucacgaucaaggggagaccacuggcaugcuucuugaacgaaccguauuuacagguugacuuucacaccgagaugaaagaagagagugauauuguguuccauuuucaaguauguuucggaaggcggguggucaugaauagccgcgaauacggugccuggaagcaacagguggaguccaaaaacaugcccuuucaggacggccaggaguucgaacugucuauaucgguucuaccugauaaguaucaggugauggucaaugggcagucaagcuacacauuugaccaccgaaucaaaccagaggcggugaagaugguacagguuuggcgugauauuagucucacuaaguucaacguguccuaucugaaaagauga

SEQ ID NO: 54461 - RNA, 2967 nt, Artificial Sequence
  derived and/or modified sequence opt3 from CLCN1__Homo_sapiens__NP_000074
auggagcagagcagaucccaacagaggggcggggaacagucuugguggggaucagacccccaguaccaauauaugccuuucgagcacugcaccaguuacggucugccaagcgaaaacggcgggcuccagcaucggcuucgcaaggaugccggaccgcgacacaaugugcaucccacacagaucuauggccaccauaaagagcaguuuuccgaccgugaacaagauauugguaugccuaagaaaacugggucuucgucaacggucgacagcaaggaugaggaccacuacaguaaaugucaggauugcauacacagacugggacagguugugaggcggaaguugggcgaggacuggaucuucuuaguacugcuaggccuccugauggcucuuguguccuggucuauggauuaugucagcgcaaagucccugcaggccuacaaauggucauaugcgcaaaugcagccaaguuugccccuccaguuucugguguggguuaccuucccucuggugcucauuuuauuuagcgcucuguucugucaucuuaucucuccacaagccgucggguccgguauucccgaaaugaagacaaucuugcgcggagugguacugaaagaguaccuaacuaugaaggcauuuguugccaaaguggucgcucucaccgcaggccuggggucaggaauaccugugggcaaggaagguccauucgugcacaucgccagcauuugcgcugccguccuuaguaaguuuaugucuguuuucugugggguguacgagcagccguauuacuauuccgacauccugacaguaggaugcgcggugggcgucggcuguugcuuugggacccccuugggaggugugcuuuucagcauugagguuacuucgacauacuuugcagugagaaacuauuggaggggcuucuucgccgcuaccuuuucugccuucgucuuucgggugcuggcaguauggaauaaagaugcuguuacgaucacugccuuauuccgcaccaacuuucgaauggacuucccuuuugaucugaaggaacucccagcguucgccgcaauagggauuuguugcggacuucugggcgcuguguuugucuacuugcauagacaggugaugcuaggugucaggaaacacaaggcccugucccaguuccucgcuaaacaccggcugcuuuaucccgggaucgugacauuuguuauugccucauucacuuuuccuccaggcaugggacaauucauggcaggcgagcugaugccccgugaagccaucaguaccuuguucgacaauaacacaugggugaagcaugcuggggacccggagagccucggacaguccgcgguauggauccacccucgcgucaaugugguuauuauaaucuuucuguucuuugugaugaaauucuggaugucuauugucgcaaccacgaugcccaucccaugugguggcuuuaugccuguguucguauuaggggccgcuuuuggaagacuggugggcgaaauaauggccaugcuauuccccgaugguauucucuuugacgauaucaucuacaagauucugccagggggcuacgcaguuaucggagccgcugcccuuacuggcgcagucagccauacagugucaaccgcggugauuugcuucgaguugacugggcagauagcucacauccugcccaugauggucgccguuauucucgcaaacaugguggcccagagucugcaaccuucccuuuaugacagcaucauccaggugaagaaacugccauacuugccggaucucggauggaaucagcugucuaaguauacaauuuuuguagaggacauaauggucagggaugugaaauucguuucagcuaguuacaccuauggugaauuacggacgcugcuacagaccacaacugugaagacccucccccuggucgacagcaaagauuccaugauccuuuugggcucuguggagcgaucggaacugcaagcccuccugcagcgccauuuaugcccugagagaaggcugcgggcagcucaggaaauggcccgcaagcucagcgaguugccauacgacgggaaggcgagacucgccggagagggccugcccggugcuccuccagggaggcccgaauccuuugcauucguugaugaggacgaagacgaggaucuaucaggcaaaagugaacugccgccuucucucgcccugcacccaagcacaacugcuccccuuuccccugaggagcccaacggaccauugccuggccacaagcagcaacccgaagccccagagccggcagggcagcguccuucaauuuuccagagccuguuacauugucuccugggacgggcgcgacccaccaaaaagaaaacaacccaagacucuacugaucuuguggacaauauguccccagaagagaucgaggccugggaacaggagcagcugagucagcccguaugcuuugauagcuguugcauugaccaaucuccuuuccaguuggucgaacagacgacacuccacaagacccauacucuguuuucccuacugggccuccaccuggcuuaugugaccucaauggguaaacuuagagggguguuggcccuggaggaauuacagaaggcaaucgagggacacacaaagaguggcguccaacucaggccaccccuggcuagcuuccgcaacaccacuucgacacggaaauccacgggugccccuccgucuagcgcagagaauuggaaccuuccagaagauagacccggcgccaccgggacuggagacguuauagcugcgucaccugagacaccagugcccaguccuuccccggaacccccacugucucuagccccuggcaagguagagggggaacucgaggagcuggaauugguggagagccccggacuggaagaggaauuagcagauauccuccagggcccaucccugaggucaaccgacgaggaggaugaagacgagcuuauucuguga

SEQ ID NO: 54462 - RNA, 2646 nt, Artificial Sequence
  derived and/or modified sequence opt3 from CLCN2__Homo_sapiens__NP_001164558
auggccgcugcagccgcggaggaaggcauggagcccagagcucugcaguacgaacaaacccucauguaugggagguacacacaggaccuuggagccuucgcaaaggaggaagccgcucggauccgccuggguggcccugagccauggaaagggccgcccagcucccgagcagccccugaguuguuagaauauggacguucuagaugcgcuaggugucgggugugcucaguccgcugucacaaguuucugguuaguagagugggcgaggauuggauuuuccuaguacuccugggucuucugauggccuuggugagcugggucauggacuacgcgauagcagccugccuccaggcucagcaauggauguccagggggcugaacacuucuauccugcuccaguauuuagccugggugacguacccaguugugcugauuaccuuuucggcaggauucacacagauccuugcuccccaggccgucggcucaggcauuccugaaaugaaaacuaucuugcgcggggugguacugaaggaguaucuaacccucaaaacauuuauagcgaagguuaucggacugaccugugcccuugguagcggcaugccacuggggaaggagggacccuucgugcauauugcaaguaugugcgcugccuugcucuccaaauuucugucuuuauucggcgguaucuacgaaaaugagagccggaacacugaaaugcuggcugccgcaugugccgucggggugggaugcuguuuugcugcgccuauuggcggcgugcucuuuuccaucgaggucacaucaaccuuuuucgcaguucgaaauuacuggagaggguuuuucgccgcuacguucagugccuuuauauucagggugcuugcaguauggaaccgggaugaagagacuauuaccgcccuguuuaagacacguuuccgcuuggacuuuccauucgaucuacaagagcugccggcuuuugccgugaucggaauugcaagcgguuucggcggggcgcucuuugucuaucugaauagaaaaaucgugcagguuaugaggaagcagaaaacuaucaaccgguuccuuaugcgaaagcgccuguuguuucccgcucucgugacccuguuaauuucuacacugaccuucccuccaggauuuggccaguucauggccggucaacuaucccagaaggaaacgcucgucacucuguucgacaauagaacaugggugaggcaggggcuuguagaggaauuggagcccccuucaaccagccaagcauggaacccaccccgggccaauguuuuucugacucucgugauauucauccugaugaaauuuuggaugagugcucuugccacaaccauuccggucccuugcggcgcauucaugcccguguuugucaucgauggaauacacacggacucuuccaccuaccgcauugugccaggcggguaugcuguugugggagccgcggcccuggcuggugcaguaacacauacugucagcaccgccgugaucguuuucgaauugacaggccagaucgcucacauucucccugugaugaucgccgucauucuggcaaacgcgguggcccagucguuacagcccucucuguacgauuccauaaucagaauuaagaaacuaccauaucuccccgagcugggguggggaaggcaucaacaguaccguguacggguggaggacaucaugguucgagaugucccucacguggcucuuucauguacuuuuagagacuugaggcuggcccuccaccgcaccaagggccggaugcuggcauuaguggaaaguccagagagcaugauccugcuugguuccauugaaagaucucaggucguugcuuugcucggggcccagcugagcccggcaaggcgccgacaacauaugcaggagcggcgugccacacagaccucaccccuaagugaucaggaaggcccuccaacucccgaggcuuccgugugcuuccaagugaauacggaggacagcgcguuuccugccgcaagaggagaaacacacaaaccacugaagcccgcucucaaaaggggcccgucuguaacccgcaaccugggggagucaccuacuggaagugccgaaagcgccgguauagcacuucgguccuuguucugcggcucuccacccccugaggcugccucggagaagcuggaaagcugugagaagagaaaauuaaagaggguccgaaucucccucgcgucagacgcugaucuggaaggggagaugagucccgaagagauucuugagugggaggaacagcagcuggacgaaccagugaauuuuucugauugcaaaaucgacccugcccccuuccaguugguugagcgcaccagccuccauaagacacacaccauuuucucccugcuaggaguggaucacgcauaugucacuucaaucggccggcugauagguaucgugacacucaaagaacugagaaaggccauugaggggagcguuacggcucaaggcgugaagguaaggccaccgcuugcaucuuuccgugacuccgccaccaguagcucugauacugagacaaccgaaguccaugcguuguggggaccucacucccgccauggccugccccgggaggggucaccaagugacagcgaugacaaaugucaguga

SEQ ID NO: 54463 - RNA, 2376 nt, Artificial Sequence
  derived and/or modified sequence opt3 from CLCN3__Homo_sapiens__NP_001230301
auggagagcgaacagcuguuccacagaggcuacuauaggaacuccuacaauucuaucaccucagccaguagcgacgaggaacuccuugauggggcuggagugauuauggacuuucaaacauccgaggaugacaaccuguuggauggugacacugcagucggcacgcauuauaccaugacaaaugggggaucuauaaacucgucaacucacuuacuggaucuacucgacgaacccaucccuggcguugguaccuacgaugacuuccauacaauugauugggugcgggagaagugcaaagaccgcgagcgacaccguagaaucaauagcaagaaaaaggaaagugccugggagaugaccaaaucccuguaugaugcguggucuggguggcuuguagugacucugacaggauuggcuagcggcgcccucgcaggccugauugacaucgccgcugacuggaugaccgaucugaaggaagggauaugucucuccgcauuaugguacaaccaugagcagugcuguuggggaucaaaugagacgacuuuugaagagagggacaagugcccacaguggaaaaccugggccgaacugaucauuggucaggcugagggcccggggaguuauaucaugaacuacauuauguacaucuucugggcccuuagcuuugcguucuuggcagucucucuggugaagguuuuugcccccuaugcuuguggauccggcauaccugaaauuaaaacaauccuaucagguuucauuauccggggguaccucggaaaguggacucugaugaucaaaaccauuacacuugugcuggccgucgcaagcggcuugagucucggcaaggaggggccacuggugcacguagcuugcuguugcggaaauauauuuucuuauuuauuccccaaguacuccaccaacgaggccaaaaagcgcgaaguuagcuauuacuuuccucugaaaacgcucuggagaucguucuuugcggcccuuguggcagcuuucguccugaggucuaucaauccauucgguaacucccgguuggugcuauuuuauguggaguaccacacucccugguaccuguucgaacucuuuccuuucauucugcuuggcgucuuugggggacuguggggcgccuucuuuauccgcgcuaauauagccuggugucgaagaaggaagucaacaaaauucgguaaguauccaguuuuggaggugauuaucguagcagccaucaccgcugugauugcguuuccgaaccccuacacucggcucaauacaagugaacugaucaaagaguuauucaccgauugcgggccucuggagagcuccucucuaugugacuaucguaacgauaugaacgcaagcaagauugucgacgauauaccagaccgccccgccggcaucggaguguacucagcuauuuggcaacucugccuggcccuuaucuuuaagaucauuaugacgguuuucaccuuuggcauaaaagugccuaguggguuguucaucccauccauggcaauuggagccaucgcugguagaauugucggcaucgccguggaacagcuggcauauuaccaucacgauugguucauauuuaaggaguggugcgaaguaggggcggacuguaucacacccggacucuaugcuaugguuggcgccgcagccugccuggguggggugacuaggaugaccgucagccuuguggucauuguguucgagcugacaggcggauuggaauacaucguuccgcucauggcugccgugaugacuucuaaauggguaggcgaugcauuugggcgggagggaauuuacgaggcucauauccgacugaaugguuauccuuucuuagacgccaaggaagaguuuacccacacaacccuggcggccgacgucaugcgccccagaaggaacgauccaccucuagcugugcucacucaggacaauaugacgguugaugacauagaaaacaugauuaaugagacaucauacaacggcuuccccgugaucaugaguaaagagagccagcggcuggucggguuugcacuucgcagagauuugaccauugccaucgaauccgcuaggaagaagcaagagggaauaguggguucuucgcguguauguuucgcccagcacacuccaagccugcccgcagaauccccucggccacucaaacugcgaucaaucuuagacaugaguccguuuaccgugacagaucauacccccauggagauuguugucgacaucuucagaaagcugggccuuaggcagugcuuggugacucacaaugggcgccuccugggcauuaucacgaaaaaggauauacuacggcauauggcgcagacagccaaccaagacccugcuucuauuauguuuaauuga

SEQ ID NO: 54464 - RNA, 2001 nt, Artificial Sequence
  derived and/or modified sequence opt3 from CLCN4__Homo_sapiens__NP_001243873
augaccgaccugaaggagggcgugugccucagcgccuucugguacucccacgaacaguguugcuggacaucuaacgagacuacguuugaagauagagacaaauguccccuuuggcaaaaguggucagagcuguuggucaaucagagugaaggggcuagcgcauauaucuuaaacuaccugauguauauucuaugggcccuccuguucgcguuucuugcuguuucccuggugaggguauucgccccuuacgcaugcggaucugguauaccagagaucaaaaccauuuugucgggcuuuaucauucggggguaucucggaaaguggacacugcugaucaaaacugugacccucgucuuagugguuucaagcggccugagucuugguaaggaggggccguuggugcaugucgccuguugcuguggaaauuucuuuuccucucuguucagcaaguacuccaaaaacgaaggcaagcgccgagaggugcuaucagcugcagccgcugccggcguaaguguugcguuuggggcacccauaggagguguccucuucagccuggaagaggugucuuauuacuuuccucuuaaaacacuguggcguuccuucuuugccgcuuugguggccgcauucacccucagaucaaucaauccauucggcaacagcaggcugguguuauuuuacgucgaguaucacacucccugguacauggcugaacuguucccuuuuauucuccuugggguuuucggaggccugugggguacauuguuuauccggugcaauauugccuggugucgcagaaggaagaccacgcggcuagggaaauauccagugcuggagguaaucguggucacugcgauaaccgccauuaucgcauaccccaacccuuauacacgccagaguacuucugaacucauuuccgagcuguucaaugauugcggagcucuugaaagcucgcagcugugugacuacaucaacgauccaaauaugacccgaccgguggacgauauccccgacagaccugccggcguuggcguguauacagcuauguggcaauuggcccucgcacugauuuuuaagauagucgugaccaucuucacguuugggaugaagauuccaucuggauuauucauccccuccauggccguaggugcuauagcgggcaggaugguugggauuggaguggagcagcuggcauaccaucaccaugauuggaucaucuuucggaacuggugccguccuggcgccgacugcgucacuccaggucuauacgcuauggugggggccgcagccugucucggcggagucacacgcaugaccgugucacugguugugauuauguucgagcuuacuggcggguuggaauauaucguaccccugauggcugccgcagucacaaguaaauggguggcggaugcuuuuggaaaggaggguauuuacgaagcccacauacaccucaauggcuauccguuccuggacguuaaagaugaguucacccauagaacgcuugcaaccgacgugaugaggccucggcgaggggaacccccacugagcgucuugacacaggacuccaugacuguggaggauguagagacccucaucaaggaaacagacuacaacggauuuccugugguugucucucgcgauagcgagagacugauuggcuucgcccagaggcgggaauuaauccuggcuaucaaaaaugcccgccaaagacaggaggguauugugucaaacaguauaauguauuuuacugaggaacccccagagcuacccgcaaacuccccucacccacucaagcugaggcguauccuuaauuugagcccguucaccgugacagaccauacccccauggaaacugucguugauauuuuucggaaacuggggcuccgacagugccuggugacgagaucuggcagguuacugggaaucauuacaaagaaggacgugcuucgccacauggcucagauggccaaccaagauccugagucaaucauguucaauuga

SEQ ID NO: 54465 - RNA, 2451 nt, Artificial Sequence
  derived and/or modified sequence opt3 from CLCN5__Homo_sapiens__NP_001121370
auggccauguggcagggcgcuauggacaacagaggguuccaacagggaaguuuuuccucuuuccaaaauucaaguagcgaugaggaccugauggauauccccgcaaccgccauggacuuuuccaugagggaugacgugccuccacucgaucgggaagucggugaggacaagucuuacaacggcgggggaauuggcucgucaaaucgcauaauggauuuccuugaggaaccgauccccgguguugggacauaugacgauuuuaacacuauugacugggugcgagaaaaaucucgugauagagacaggcaccgggagaucacgaauaagaguaaagaguccaccugggcgcugauucauucuguaagcgacgcuuucuccggaugguuguuaaugcugcuaaucggccuccugucaggcagucuugccgggcugauagauaucagcgcacacuggaugacagacuugaaggaaggaauuugcacugguggcuuuugguucaaccaugagcacuguugcuggaauagcgaacaugugaccuuugaggagcgcgauaaauguccugaauggaacuccuggucacagcucaucauuagcacagacgagggggccuucgcuuacaucgucaauuauuuuauguacgugcugugggcacuccuguucgccuuuuuagcuguuagucuggugaaggucuucgccccauaugcgugcggaucuggcauacccgaaauuaagaccauccuuuccgguuucauuaucagaggguacuugggaaaauggacucuggugaucaagacaauuacccuaguacucgcaguuagcucgggccugucucuuggcaaagaggggccucuggugcacgucgccuguugcuguggaaacauauugugccacuguuuuaauaaguauaggaaaaacgaagcuaagcggcgcgaggugcucuccgccgcagcugccgcgggugugucagucgccuucggcgcaccaaucgggggaguucuguuuaguuuagaggaagugagcuacuacuucccccugaagacgcucuggcgauccuuuuucgcugcccuuguagcugccuuuacucugagaucuauuaauccuuucggcaacagcagguuggugcuauuuuaugucgaguuccauaccccauggcaccuguuugaacucgugccguucauccugcuugguauauuugggggccuguggggagcauuguucauucggacaaauaucgccuggugccguaaacgcaagacuacccagcucggcaaauaccccguuaucgaggugcuggucgugacagcuauuaccgcgaucuuagcauucccuaacgaauauacgagaaugucaacuagcgagcugauuuccgagcuauuuaacgauugugggcuccuggacagcucuaaacuuugcgauuacgaaaauagguucaacacaucaaaaggaggugaguugccagaccggcccgccggcguagggguuuauagugcuauguggcagcuggcccucacccugauacuuaagaucgugauuacuaucuuuacauucggaaugaaaaucccuagcggccuguuuauuccauccauggcagucggugccauagcugggcgauugcucggcgugggaauggaacagcuggccuacuaucaucaggaguggaccgucuucaauucuuggugcucgcaaggcgcagauuguaucacgcccggguuauacgcgauggugggagcugccgcaugccuggguggcguuacccgcaugacagugagccuaguagucauuauguuugaacucacugggggacuggaguacaucgugccgcuuauggccgcugccaugaccuccaaguggguugcagacgcuuugggcagagaggguauuuaugaugcccacaucaggcugaacggguacccuuuccucgaagcgaaggaggaauuugcccacaaaacacuggcuauggacgugaugaagccccggcgcaaugacccauuacugacuguccuuacccaggauucaaugacaguggaggacguagagaccauaaucagugaaacuacguauucuggcuucccugugguugucagcagagagucccagagguuggugggauuugugcuccgucgggaucugauuaucucaauugaaaacgcacgaaagaagcaggacggcgucguuagcacaucuaucauauacuucaccgagcauuccccaccccuacccccuuauacuccaccgacccugaaacucagaaauauucuggaucuuagucccuuuacagugaccgacuugacuccuauggaaaucgugguagauauuuucaggaagcugggguuacgccaaugucucgucacacacaacggacggcugcuuggcaucauaacgaagaaagacgugcugaagcauaucgcccagauggcuaaucaggauccagacagcauuuuguucaacuga

SEQ ID NO: 54466 - RNA, 2610 nt, Artificial Sequence
  derived and/or modified sequence opt3 from CLCN6__Homo_sapiens__NP_001277
auggccggcugcagagggagccuguguugcuguuguagguggugcugcuguugcggagagcgggaaacccgcacacccgaggaacucacuauccuuggugagacgcaggaagaggaggacgaaauucugccucgaaaggauuacgaguccuuggacuaugaucguuguauaaacgacccauacuuagaagugcuggagaccauggauaauaaaaagggcagaagguaugaggcugucaaauggaugguuguguucgcaaucgggguaugcacagggcuagugggccucuuugucgacuucuuugugcggcuguucacucaacuuaaguuugguguugugcagaccucugucgaagaguguucacagaaagggugccuggccuugagucuccuggaacugcucggauucaacuuaacauuuguguuccuggcgagccuuuugguacugauugagccgguugcugccggcuccggcauccccgaagugaagugcuaccuaaauggggucaaggugccuggaauugugcgccucagaacccugcuuuguaaaguccuggguguuuuguuuucuguggcaggcggacucuucguaggaaaggagggcccaaugauccacucggguucaguggucggggccggacugccccaguuucaaagcauaaguuuaaggaaaauccaguucaacuuuccuuauuuccgguccgaucgcgacaagcgagauuucgugucugcuggcgcagccgcuggcguugccgcggcauuuggggccccaauuggagguacucuguucagccucgaggaaggcuccucauuuuggaaucaggggcuuacauggaaagugcuguucugcaguaugagcgcuaccuuuacguugaacuucuuuagaucuggaauccaguucggcuccugggguucauuucaacuacccgggcugcucaauuucggcgaguuuaaguguagcgacagugauaagaaaugccaucuguggacugccauggaccuuggauucuuugucgugaugggcguaauugggggacuguugggugcaaccuucaacugucucaauaagaggcuggcuaaauaccggaugcguaacguucacccuaagccaaaauuagugcgcguccuggaaucucuacucgugucccuggucacaacugugguuguguucguagccagcaugguccuuggcgagugcagacagaugucgucuuccucacagaucgggaaugauaguuuucaguugcaagugaccgaagacguuaacagcuccauaaagacauucuuuuguccgaaugacaccuauaacgauauggcgacgcuguucuuuaauccccaggagucugccauucuccagcuguuccaucaagacggaacuuuuagcccugugacacuugcacuguucuuugucuuguacuuccuccuggcuugcuggaccuacggcaucucagugccaagugguuuauuuguacccucccugcuauguggggccgcuuucggcaggcucguggccaacguucugaaaagcuauauuggacuuggccacaucuacucugggacuuuugcauugaucggagccgcugcguuccuggguggcgucgugcggaugacaauuucacucaccgugauacugaucgagaguacgaacgaaauuaccuauggguuaccuaucauggucacacugaugguugcaaaguggacuggagauuucuuuaauaagggcauauacgacauucaugugggucuucgaggggugccauugcucgagugggaaaccgagguagaaauggauaaacugcgcgccagcgacaucauggagcccaaccuaacauaugucuacccgcacacuagaauccagucccuggugucuauucucaggaccacaguucaccaugcuuucccuguggucaccgagaaucggggcaacgaaaaggaguuuaugaaaggaaaucagcugaucucgaacaauauuaaguucaaaaagagcuccauacuuacucgcgccggcgaacagagaaagaggucacaaaguaugaaaucuuaucccagcuccgaguugcguaacaugugcgaugagcacaucgcaucagaggaaccagccgaaaaggaggaccuguuacagcagaugcucgaacggcgauacacgccuuaccccaaucuguauccagaucagagccccucugaggacuggacaauggaggaaagauuuaggccucuuaccuuccaugggcugauuuugcgcucccaacucgugacucugcuaguucggggaguguguuacagugagagccagucuuccgcuucacagccaagacugaguuaugccgaaauggcagaggauuacccgagguaucccgacauccacgaccucgaucugacccuuuugaacccucgcaugaucguagacgucacaccauacaugaaucccagcccuuuuaccgugucgccaaacacucacgugucccaggucuucaaucuguuucgaacaaugggcuuacggcaucuccccguugugaacgcgguaggugaaauuguggggauaaucacgcgucacaaucugaccuaugaguuccuucaagcuagacugaggcagcauuaccagacuauuuga

SEQ ID NO: 54467 - RNA, 2346 nt, Artificial Sequence
  derived and/or modified sequence opt3 from CLCN7__Homo_sapiens__NP_001107803
auggccaacgugagcaagaaagucuccuggucuggcagagacagggaugacgaggaagcugcaccccugcuccggcgcaccgcccgaccugggggagguacaccacuucugaauggcgcggggccgggagcugcccgucaggauauggaucccccucacccauuccccaaggagaucccucauaacgaaaaauuguuaucacugaaguacgagagucuagacuaugacaauagcgaaaaccaacucuuucuggaggaggaaagaaggauuaaucacacugcauuccggacgguugagauaaaacgcugggugaucugcgcccuuauuggcauccugaccgguuugguagcuuguuuuauugauaucguggucgaaaaccucgcagggcugaaguacagagugauaaagggaaauaucgacaaauucacagagaagggcggccuguccuuuucucucuuacugugggccacucuuaacgcugccuucguuuugguggggucggucauuguggcguuuaucgagccaguagcagccggaucagguauuccccagaucaaaugcuuccugaauggcguuaagauaccucauguggucaggcuaaaaacccucgugauuaaggugagcggggucauccugaguguugugggaggccuugcuguagguaaggaagggccaaugauucacuccggaucugugaucgccgcaggcaucagccagggccgguccacaucacugaaacgcgauuuuaagauuuucgaguauuuucgaagagacaccgagaaaagggauuucgucagugcuggggccgcggccggagugagcgcagcuuuuggugccccgguuggcgggguguuguucucucucgaggaaggagcuuccuucuggaaccaguuucugacuuggcggauauucuuugccucaaugaucagcacauucaccuuaaauuuuguccugaguauuuaccauggcaacaugugggaccucucuucccccggucuuaucaauuucgggcguuuugauagcgagaagauggcauauacgauacacgagauuccuguguucaucgccaugggcguaguuggaggcgugcugggggcugucuuuaacgcguugaauuacuggcuaacuauguuccgcaucagauauauucacaggccaugucugcaagugaucgaagcaguccucguggccgcuguuaccgccacaguggcauuuguacugauuuacucgucucgggacugccagccccuucagggagguuccaugucauacccucugcaguuguucugugccgacggcgaguauaacaguauggcugccgcauuuuucaacacuccagagaaaagcgucgugucccucuuccaugaucccccggggucuuacaauccucugaccuuaggacuguuuacccuaguuuauuucuuucucgcgugcuggacauacggccugacggugagcgcuggugucuucauacccucacuuuugaucggggccgcauggggccgacuguuuggaauuagucucuccuaucugacuggcgccgcuaucugggccgacccagggaaguacgcacuuaugggagcugccgcgcaacuggguggcaucgugcgcaugacauugagccucaccguaauuaugauggaagccacuucuaacgugacauauggguucccuauaaugcugguuuuaaugaccgcuaaaaucgucggagauguguuuauugaaggccuguacgacaugcacauccagcuacagucagugcccuuccuccauugggaggcaccagucacgagucacagccugaccgccagagagguuauguccacacccgugacuugucuuaggcggcgcgaaaagguggguguaauugucgauguguugucugacaccgcuucgaaucacaacggguuuccuguuguggagcaugccgaugacacacagccagcaagacugcaaggccucauccugaggagccaguuaauaguccugcuuaagcacaaaguguucguugaacguuccaauuugggacucgugcagcggcgacugagacuaaaggauuuuagggacgcguacccgcgcuuucccccuauccaaucaauucauguaagucaggaugagcgggaaugcacuauggaccugucugaguucaugaacccaagccccuauaccgucccucaggaggccucccucccaagaguguucaaacuguucagggcucuuggcuugcgccaccugguggucguugacaaucgaaaccaggugguaggguuagugacacggaaggaucucgcccguuacagacugggaaaaaggggccuugaagaacugucauuggcacaaaccuga

SEQ ID NO: 54468 - RNA, 1905 nt, Artificial Sequence
  derived and/or modified sequence opt3 from CLCNKB__Homo_sapiens__XP_011538921
augacccugggcgugcucauggcccuugucagcugcgcuauggaccuggcaguugaguccgugguaagagcccaccagugguuguacagggaaaucggggauucucauuuacugcgguaucuaucauggacaguguaccccgucgcgcucgugaguuucagcuccggauuuucucaaucgauuacuccuucaagcgguggcagugggauaccagagguuaagacgaugcuggcuggagugguccuugaagacuaucuggauaucaaaaacuucggcgccaaggugguagguuuguccuguacccucgcaugcgggucuacacuguuucugggaaaaguuggcccguucgugcaccucagcgucaugauggccgcuuacuuaggccgcgugcgaacuaccacaauuggggagcccgaaaauaaguccaaacagaacgagaugcugguggcagccgcugccgucggaguugcgaccguguuugcagccccuuucucagguguacuuuuuaguaucgaggugaugagcucucauuucuccgucugggacuauuggcguggcuuuuucgcugccacuuguggggcauuuauguucagauugcuggcuguguuuaauucagaacaggagacaauuaccagccuauacaagacgaguuucaggguugaugugccauucgaccuccccgaaaucuuuuucuuugucgcccugggaggccuuugcgguauacuggggucugcguauuuguucugucagcggaucuuuuucggauuuauucgcaacaauagauucuccagcaagcuccuggccacuucgaaaccuguguacucugcauuagcuacccugguacucgccuccaucacauacccacccucagcuggcagguuucuugccagucggcugagcaugaagcaacacuuggauucccuauucgacaaccauucuugggcacugaugacucagaauagcucaccuccauggccggaggagcucgauccccagcaccuguggugggaaugguaucacccucgcuuuaccauuuucggcacacuugccuuuuuccugguuaugaaauucuggauguugauccucgcuaccacgauaccaaugcccgcgggguacuuuaugccuauuuucguguauggagcagccaucggucgacuguuuggcgagacuuuaaguuucauuuuuccagaagggaucgucgcuggaggcaucacaaaccccauuaugccggguggguacgcccuggcaggcgccgcugccuucuccggagcagugacccauacuauaagcacagcgcuacucgcuuuugaggucaccggccagaucgugcacgcccugccuguucuuauggcaguguuggccgcuaaugccauugcacaaucuugccagcccucauucuaugacgggacgguaaucgucaagaaacugccauaccucccuagaauacugggaaggaacauugguagucaucgggugcguguugaacacuuuaugaaucacagcaucaccacacuugcuaaggauaugccccuggaggagguggucaaggugguaacuuccaccgacguggccaaauauccauugguugaaucuacagagucgcagauccucgucggcauugugcgcagagcgcagcuggugcaagccuuaaaggcugaacccccuagcugggcaccagggcaucagcagugucugcaagauauccuagccgcuggaugcccgacugagcccgucacccucaaacuguccccugaaacaucacuucacgaggcccauaacuuguucgagcugcucaaucugcacaguuuauuuguuaccucuaggggccgggcaguggguugugugagcuggguagaaaugaagaaagcgauuuccaaccugacuaauccacccgccccuaaguga

SEQ ID NO: 54469 - RNA, 624 nt, Artificial Sequence
  derived and/or modified sequence opt3 from CLDN10__Homo_sapiens__NP_001153572
augagcagagcccagaucugggcucugguguccggcgucgggggauucggugcacucguugccgcgaccacaucuaacgaguggaaggugacuacgagggcuucaaguguaauuaccgccacauggguguaccaaggccuuuggaugaauugcgcaggguauauacaggccugucggggacugaugaucgcugcagucagcuugggcuuuuucgguuccauuuuugccuuauucgggaugaaaugcacuaaggugggaggcucugacaaagcuaaggccaaaaucgcgugucuggcaggcauuguuuuuauccuaucggggcucugcucaaugaccggauguagccuguacgccaacaagauaacaaccgaguucuuugauccccuuuucguggaacagaaguaugaacugggugcugccuuguuuaucggcugggcaggggcuagucucugcauuaucggaggcgucauuuucuguuuuuccaucucugacaauaacaaaacuccucgcuacacauauaauggugccaccagcgugauguccucacgaacgaaguaccacgggggagaggauuucaaaacuaccaacccaaguaagcaguuugacaaaaaugcguauguauga

SEQ ID NO: 54470 - RNA, 624 nt, Artificial Sequence
  derived and/or modified sequence opt3 from CLDN11__Homo_sapiens__NP_005593
augguggccacaugccugcaggucguuggcuucgugaccagcuuuguaggguggaucggagugauugucacuacguccaccaacgacugggugguuacaugugguuacacuauaccuaccugcagaaagcucgaugagcuuggcucuaaagggcugugggcugacugugugauggcaacaggauuguaucacugcaagcccuuagucgauauccugauucuaccaggcuacgugcaagccuguagggcgcucaugaucgcugccucaguacugggucuuccggcaauucuguugcuccugaccguucugcccugcauccggauggggcaggaaccuggaguggccaaauaucgccgagcucagcucgcaggcgucuuacugauacuuuuggcccugugugcucuaguggccacuaucugguucccagugugcgcgcaucgugagacaaccauugucaguuuuggcuacagccucuaugcaggguggaucggagccguucugugucuuguggguggcugcguaauucuguguugcgcuggggacgcccaggcauucggagaaaauagauuuuacuauacggcuggcuccucuucgcccacucacgccaagucagcgcauguguga

SEQ ID NO: 54471 - RNA, 720 nt, Artificial Sequence
  derived and/or modified sequence opt3 from CLDN14__Homo_sapiens__NP_036262
auggccagcaccgcugugcagcugcucggcuuccuucuguccuuuuuggggauggucggaacauuaaucacuacgauucugccccacuggagaaggaccgcacauguugguacaaacauacuaacugccgugucuuaccucaagggccuguggauggagugcguauggcacucaaccgggaucuaucaaugucagauuuaccggagucuucuggcguugccucaggaccuccaggcugcccgcgcacugauggugaucagcugccugcucuccggaauugccugugcuugcgcagucaucggcaugaaauguacacgaugcgccaaggguaccccagcuaaaacuacauucgccauauuagggggaacccuguuuauccuugcgggcuugcuguguaugguggcaguuucuuggacgacuaaugaugugguccaaaacuucuauaauccgcuacuccccucgggcaugaaguuugaaauugggcaggcccuguaccuuggauucaucucaagcagucuguccuugauugguggcacccuccugugcuuaucuugucaggacgaggcuccuuaucguccauaccaggcacccccuagagccacaacuaccacagcuaacaccgccccagcguaucaacccccugccgcauacaaagauaauagggcuccaagcgugacguccgccacucauucaggguaccggcugaacgacuauguauga

SEQ ID NO: 54472 - RNA, 687 nt, Artificial Sequence
  derived and/or modified sequence opt3 from CLDN15__Homo_sapiens__NP_001172009
augagcauggccguggagaccuucggcuuuuucauggcuacagucgggcugcucaugcuuggaguuacucugcccaacuccuacuggagagugucuacgguacacgguaaugugaucaccacaaacacuauuuuugaaaauuugugguucucaugcgcaaccgacaguuuaggcgucuauaacuguugggaguuuccuagcaugcuggcccuauccggguacauacaggcgugcagggcucucaugaucacagccauucugcuuggauuccugggcuugcuccuggguaucgcagggcugcgguguaccaauauuggaggccucgaauuaucucgcaaggccaaacuggcugcaacugccggcgcccuucauaucuuggcugggauaugcggaaugguggcgaucucgugguaugcauuuaacauuacacgagauuucuuugacccacuguacccggguaccaaguaugagcuaggccccgcccucuaccugggguggucagcuagccuuaucaguauucugggaggcuugugucucugcuccgccuguugcugugguucugaugaagacccugcagcuagcgcccguagaccauaucaagcgcccguuuccgugaugccugucgccacgucagaucaggagggggacaguagcuucggaaaauacggcaggaaugcauacguguga

SEQ ID NO: 54473 - RNA, 918 nt, Artificial Sequence
  derived and/or modified sequence opt3 from CLDN16__Homo_sapiens__NP_006571
augaccagcagaacaccccugcucgugacugccugccuuuacuauuccuacuguaacucuaggcacuuacagcaaggcguccggaagucaaaacgcccuguuuucagucauugccaggugccagagacgcagaagaccgacacacgacacuugagcggggcucgugcaggaguauguccgugcugucaucccgaugguuuacuggccacuaugagagaccuacuccaguauaucgcgugcuuuuucgccuuuuucuccgcuggcuuucugauuguggcaaccuggacagauuguuggauggucaaugccgacgauucucuugaagugucgaccaaaugcagggggcuguggugggaguguguuacuaacgcuuucgacggaauacggacaugcgaugaauacgacucaaucuuggcagagcacccucucaagcugguggucacccgcgcccugaugauuacggcugauauccucgccggcuuugguuucuuaacucugcuuuuggggcuggacugugugaaauuucuaccagaugaacccuauauuaagguaagaaucugcuucguugcgggagcaacccuccugauagccggcacaccuggcaucauugggagcgugugguacgcugucgacguguauguggagaggaguacucuuguccugcauaauaucuuuuuggguauucaauacaaguucggaugguccugcuggcucggcauggccgggucucugggauguuuucuggcaggcgcuguucugaccugcugucucuaccuuuucaaagauguggguccagagcggaacuaucccuacagccugcgcaaggccuauuccgcggccgggguaucaauggcaaaaaguuacagcgcuccucgaacagaaaccgccaagauguaugcuguggacacgagagucuga

SEQ ID NO: 54474 - RNA, 786 nt, Artificial Sequence
  derived and/or modified sequence opt3 from CLDN18__Homo_sapiens__NP_001002026
auggccgugaccgcuugccagggccugggguucgucguuagccucaucggaauugcagguauaaucgccgcgacauguauggaccaaugguccacucaggaucuuuacaacaaucccgugacggcuguauuuaacuaucagggccuguggagaucuugcgugagggagucaaguggguucaccgaaugucggggauacuuuacauuguuaggccugccugccaugcuacaggcaguccgcgcccucaugauuguggguaucguucugggggcuauuggacuucuggugagcaucuucgcauugaagugcauacgaaucggcuccauggaggacucugccaaagcuaauaugacucucaccucgggcauuauguuuaucgucucagggcugugugccauugcgggagugagcguauucgcaaacaugcugguuacaaauuuuuggaugaguaccgccaacauguauacugguaugggcgggauggugcaaacaguccagacccguuacacguucggagcugcccucuuugugggcuggguggcugguggguuaacucugaucggaggcgucaugaugugcauagcauguagaggccuugccccagaagagaccaauuauaaggcgguuuccuaccacgccucugggcauagcguggcauauaaaccgggagguuucaaggcuuccacaggcuuugggucaaacacuaaaaauaagaagauuuacgauggaggcgccaggaccgaagacgagguacagaguuaccccagcaaacacgauuauguguga

SEQ ID NO: 54475 - RNA, 636 nt, Artificial Sequence
  derived and/or modified sequence opt3 from CLDN1__Homo_sapiens__NP_066924
auggccaacgcuggccugcagcuccuuggguucauccuggcauuuuugggauggauuggugccauagugagcaccgcguuaccccaauggagaaucuacuccuaugcuggcgacaauauugucacagcccaggcaauguacgaggggcuguggaugucuugcguuucacagaguacuggacagauccaauguaagguguucgauagccuacucaaccuguccucuacgcuucaggccaccagggcucugaugguagugggcauuuugcucggugucaucgcaauauuuguggccacaguugggaugaaaugcaugaagugucuggaagacgaugaggugcagaaaaugcggauggcugucaucggaggcgccauuuuccugcucgcgggcuuagcaauccugguggccacugcuugguaugggaaucgcauuguacaggaauuuuacgacccuaugaccccaguuaacgcccgauaugaguucggacaagcacuuuuuacagguugggcugccgcgucguugugccugcuaggcggggcccuccuguguugcucauguccgcguaagaccacuagcuaccccacaccuagaccauaucccaaaccugcaccaaguuccggaaaggauuacguguga

SEQ ID NO: 54476 - RNA, 879 nt, Artificial Sequence
  derived and/or modified sequence opt3 from CLDN23__Homo_sapiens__NP_919260
augagaacccccguggucaugacacugggcaugguucucgccccuugcgggcuucuguugaacuuaacuggaacgcuggcuccagguuggaggcuagugaagggcuuccucaaucagccgguagacguggagcuguaccaagggcuuugggauaugugucgggaacagagcucccgcgagcgagaaugcggacagaccgaccaguggggcuauuuugaggcacaacccguccugguggcccgugcguugaugguuacaucucucgcugccacugugcugggucugcucuuagcaucacugggggucagauguuggcaggaugaaccuaacuucgugcuugccggauugaguggcguaguucuguuuguggcuggccuacucgggcugaucccagucagcugguacaaucacuuccuuggagacagggaugugcugcccgccccugcauccccagugaccguccagguuucuuauucguuggugcucgguuaccugggcucaugcuuacugcuccuugggggauuuagccuggcuuugaguuucgcccccuggugugacgagcggugccgcagaaggcggaaaggcccuuccgcggguccacgccgaucuagcguauccacaauucagguggaguggccggaacccgaucuagccccugcaauaaaguauuacucagacgggcaacauagaccacccccugcucagcacaggaaaccaaagcccaaaccgaaggucggauuuccuaugccccggccacguccuaaggccuauaccaacaguguggauguucuggacggcgagggcugggaaagccaggaugcacccucuuguuccacucauccaugcgacucaagccuccccugugauagugaccuguga

SEQ ID NO: 54477 - RNA, 693 nt, Artificial Sequence
  derived and/or modified sequence opt3 from CLDN2__Homo_sapiens__NP_001164566
auggccagccugggccuccagcuugugggguacauccugggauuguuaggucugcuaggcacccucgucgcuaugcugcuucccuccuggaagacaucuucauauguuggggcaaguauugugacugccguaggauucagcaaaggccuguggauggagugcgcgacgcacuccaccgguauaacacaaugugacaucuacucuacuuugcucgggcugccugcugauauucaggccgcacaggccaugauggugaccucgucagcuaucagcagucuggcaugcauuaucuccgucgugggaaugagauguacaguguuuugccaggaaucuagggccaaggaccggguugcugucgccggcggcguguucuuuauacucgggggauuacuggguuucaucccaguagcguggaaccuucauggcauuuugcgcgauuuuuauagcccgcugguucccgacuccaugaaauucgagaucggggaagcacuauaccucggaauuaucucaagucuguuuagccuuauagccggcauuauccuguguuucucuugcuccucacaacgaaaucguagcaacuauuacgaugcuuaucaggcccagccuuuggcaaccagaaguucuccaaggcccggucagccuccaaaggugaaauccgaguuuaauagcuacucgcucacuggguacgucuga

SEQ ID NO: 54478 - RNA, 912 nt, Artificial Sequence
  derived and/or modified sequence opt3 from CLDN5__Homo_sapiens__NP_001124333
augaccagagccaggaucggcugcuucgggcccggaggucgggcucgcggcacagagagcgcaccugaaccauccaagcgagugccgcccgggcguucuuggcagacucaagaggucagacagacgaggggagccaacggccuggguccucgggcggggucagcuggagccaaagcaccaggccccgcccagggcgcugcacagcacgggcucggagguagugccggccuucgcguuagagugagcccucuggcuaugggguccgccgcguuggaaauuuuaggacugguacuaugucucgugggcuggggugggcugauacuugcaugcggacugccaauguggcaagucaccgccuuuuuggaccauaauaucgugacagcucagacuaccuggaagggccucuggaugucuuguguugugcagucgacaggccacaugcagugcaaagucuacgauucagugcuggcccugagcaccgagguacaagcagcuagggcccucacuguuagugcgguguuacuggccuucgucgcacuuuuugugacauuggcuggggcccaguguaccacgugcguggcucccggaccugccaaggcacgggucgcccugacugguggcguucuauaucucuucugugggcugcuugcucuggugccauugugcugguuugcgaacauuguagugcgcgaguucuacgacccguccguccccgugucucagaaauaugaacucggagcagcccuguacaucggcugggcugccaccgcauuacugaugguuggugggugucuccuuugcuguggcgccugggugugcacaggacgaccugaucugagcuuuccagucaaguauuccgcucccagaaggccuacugccaccggcgacuacgauaagaaaaauuauguguga

SEQ ID NO: 54479 - RNA, 663 nt, Artificial Sequence
  derived and/or modified sequence opt3 from CLDN6__Homo_sapiens__NP_067018
auggccagcgcuggcaugcagauccugggggugguccucacccuucugggauggguuaacgguuugguguccugcgcauuacccauguggaagguaacagccuucauuggcaauucuauaguggucgcgcaagugguuugggaggggcuguggaugucaugugugguccagaguacuggacagaugcagugcaaaguguacgacagccuacucgcucugccucaagaucuucaggccgcaagagcccuguguguaaucgcuuugcucguugcacuguuuggccugcucguguauuuagccggugcuaagugcacgaccugugucgaagagaaagacuccaaggccaggcuggugcuuacaucugggauuguguucgucaucucgggaguuuugacucugauuccagugugcuggaccgcgcacgcaaucauacgggauuuuuacaacccgcuaguagccgaagcucagaaacgcgagcucggcgccucacuguaucuuggcugggcagcuagcgggcuguugcuccugggagguggcuuacuguguugcacaugucccagugggggaucccagggcccuucucauuacauggcccgauauagcaccuccgcgccagccaucucacguggucccagugaauacccuacuaagaauuauguguga

SEQ ID NO: 54480 - RNA, 438 nt, Artificial Sequence
  derived and/or modified sequence opt3 from CLDN7__Homo_sapiens__NP_001171952
auggccaacagcggccugcagcuccuuggguucuccauggcucuguugggauggguggguuuagucgcaugcaccgccaucccccaauggcagaugucuucauacgcgggcgacaauauuauaacagcucaggccauguauaaggggcuguggauggauuguguuacucagaguacgggaaugaugagcugcaaaauguacgacuccgugcuagcacucucugccgcucugcaagcaaccagagcccuuaugguagugucgcuggucuugggcuuucucgcuauguucguggccacaauggguaugaaguguacuaggugcgggggagaugacaaaguuaagaaagcgcggaucgcaaugggcggcgggauuaucuuuauuguggccggaaugucacuggcucugccuagccucuuagccggucagggccugccauga

SEQ ID NO: 54481 - RNA, 678 nt, Artificial Sequence
  derived and/or modified sequence opt3 from CLDN8__Homo_sapiens__NP_955360
auggccacccacgcucuggagaucgcaggccucuuccuugggggaguggguauggucggcacaguugccgugacuguaaugccccaguggagagugagcgcguuuauugaaaacaauauagucguguucgagaacuuuugggaagggcuguggaugaauugcguuaggcaagcuaacauccggaugcaguguaagauuuacgacuccuuguuagcccugucuccugaucuacaggcagcccgcggacucaugugcgcugcaucagugaugaguuuccuggccuuuaugauggcuauccuuggcaugaaauguacgcgaugcaccggugacaaugagaaggucaaagcccauauucuguugacagcggggaucauauucaucauuacuggaauggugguacucaucccaguuagcuggguggcaaacgccauuauccgugauuuuuauaauuccauagucaacguggcucagaagagagaacugggcgaggcccuguaccucggcuggaccacagcauuagugcugauugucgggggagcucuuuucuguugcguguuuuguugcaaugagaaaucuucgucauauagguacagcaucccgagucaccggaccacucaaaaguccuaucauacagguaagaaaucucccagcguuuacucccgcucacaguauguauga

SEQ ID NO: 54482 - RNA, 654 nt, Artificial Sequence
  derived and/or modified sequence opt3 from CLDN9__Homo_sapiens__NP_066192
auggccagcaccggccuggagcuccuugggaugacacuggcuguguugggaugguuagguacucuggucuccugcgcacuaccccucuggaagguuacggccuucaucggcaacucuauugugguagcucagguggucugggaagggcuguggaugucaugugugguucaaaguaccggacagaugcagugcaaaguguacgacagccuucuggcuuugccucaggaucuccaagccgcaagagcccugugugucauagcucugcucuuagcacugcuuggcuugcugguggccaucacaggugcucagugcacuaccuguguagaggacgaaggggccaaggcgaggauuguucuaacagcaggagugauccuccugcuugccggcauucuggucuugaucccagugugcuggaccgcucacgccauaauccaggauuuuuauaauccgcucguggcagaggcucugaaacgggaauuaggcgccucccuguaccucgggugggcggccgcagcgcuucugauguugggagguggccuacuguguugcacuugucccccuccacaggucgagcgcccccgagggccucgucucggauauucuauuccaucgagaucaggcgccagcggucuggacaagagggauuacguuuga

SEQ ID NO: 54483 - RNA, 879 nt, Artificial Sequence
  derived and/or modified sequence opt3 from CLEC10A__Homo_sapiens__NP_006335
augaccagaacauacgagaacuuccaguaucuggaaaauaaggugaaaguccaaggcuuuaagaacgggccccucccucuucagagccuguugcagagguuaugcuccggaccaugucaucugcuacucucucugggucuuggccuguugcuccugguuaucauuugcgugguaggguuccaaaauucaaaauuucagcgggaccuggugacucuccgcacggauuucaguaacuuuaccagcaauacagucgccgagauacaggcuuuaacuucccagggaucuucgcuggaagagaccaucgcaucacuuaaggccgaaguggagggcuucaaacaggagcgacaagcgguucacagcgaaauguugcugcgugugcagcagcuaguccaggaccucaagaagcugacaugucaaguggcuacccuuaacaauaacggugaggaagccaguacugaggggacaugcuguccgguaaauuggguugagcaccaggauuccugcuacugguuuucucauagcggaauguccugggcagaagccgagaaauauugucagcugaagaacgcucacuugguggucauuaauucaagagaggaacaaaacuucgugcagaaauaccucggcagugcauauaccuggaugggccugagcgaccccgaaggggccuggaaguggguggauggaacggacuacgcuacugguuuucagaauuggaaaccuggccagccagaugacuggcaagggcauggauuaggcgguggggaggauugcgcccacuuccaccccgacggaagguggaacgaugacgucugucagcggccuuaucauuggguuugcgaggcgggccugggccagaccucucaggaaucccacuga

SEQ ID NO: 54484 - RNA, 972 nt, Artificial Sequence
  derived and/or modified sequence opt3 from CLEC11A__Homo_sapiens__NP_002966
augcaggccgcuuggcugcucggcgcacuuguggucccccaacuguugggguucggacacggugccagaggcgcggagagggaaugggaggguggauggggcggugcucaggaagaggaacgggagcgcgaggccuuaaugcugaagcaucuacaggaagcacucgggcugccugccggacgaggcgacgagaacccagcuggcaccguugaagggaaagaggauugggagauggaagaggaccagggagaagaggaagaggaggaagcaacaccgacucccagcuccgguccuucuccaucacccacgccugaggauaucgugaccuacauucuuggccgucuggccggguuggacgcuggacuccaccaacugcauguaagacugcacgcccucgauacaaggguggucgaauuaacucagggccugcggcagcuucgcaaugcggcaggggacaccagagaugccgugcaggcuuugcaagaggcccaggggagggcagaacgggagcauggacgccuggagggcugccuaaagggccuccgacuggggcacaaauguuuucuucugaguagagacuucgaagcucaggccgcggcccaggcaaggugcacagcucggggagguagcuuggcccaaccagcugaucgucagcagauggaggcccucacccgcuaucugagagcagccuuagcucccuacaacuggccuguuuggcugggcgugcacgacaggcgggcggaagggcucuaucuuuuugagaauggacaacgagucuccuucuuugcauggcaucgcucuccaagaccggaacugggcgcccagcccucggcuucaccucacccauugagccccgaucagccuaacggugggacucuagagaauuguguggcccaggcaagugacgauggcuccuggugggaccaugacugccaaaggcggcuguacuauguaugugaguucccauuuuga

SEQ ID NO: 54485 - RNA, 828 nt, Artificial Sequence
  derived and/or modified sequence opt3 from CLEC12A__Homo_sapiens__NP_001193939
auguggaucgacuucuuuaccuacagcuccaugucugaggaagugacauaugccgaucugcaguuccaaaacucaagugagauggaaaagauucccgagauaggcaaauuuggggaaaaggcuccuccagcaccgagccacgucuggagacccgccgcucucuuccuuacucuguugugcuuacugcuacucaucggacuggguguucuugcguccauguuucaugugacgcugaaaauugagaugaagaaaaugaauaaguugcagaacaucucugaggaacuccagaggaauauuucgcugcagcugaugucaaacaugaauaucagcaacaagauacggaaucucaguaccacauuacaaacuaucgccaccaaacugugucgcgagcuuuacuccaaggaacaggagcacaaaugcaagccuuguccacgacguuggauuuggcauaaagacucuugcuauuucuugagcgaugacguacagacauggcaggaguccaagauggcaugugccgcucaaaacgcaucacugcuaaagaucaauaacaaaaaugcccucgaauuuauuaagagucagagcagaucuuacgauuauuggcugggccuuucccccgaggaagacucaaccagggggaugcggguggauaacaucauaaauagcagugcuugggucauucgcaacgccccugaccugaauaacauguacugcggauauaucaacagauuguacgugcaguacuaucacuguacuuacaaaaagaggaugauuugcgagaaaauggcgaauccaguucagcucggcucuacauauuuccgggaagcauga

SEQ ID NO: 54486 - RNA, 1473 nt, Artificial Sequence
  derived and/or modified sequence opt3 from CLEC14A__Homo_sapiens__NP_778230
augagacccgccuucgcucugugccuccuuuggcaggcacuguggccuggcccagggggaggugagcacccgaccgccgacagggcgggcuguagcgcuuccggggccugcuacucuuugcaucacgcaacaaugaagcggcaagccgcugaagaggcauguaucuuacgcggaggcgcccugucaacugugcgagcuggugccgaacuacgugcgguccucgcacugcuuagagccgggcccggaccuggcggcgggaguaaagaucuguuguuuuggguugcucucgagaggcggcgcagccauugcacgcuggaaaacgagccacugagaggauucuccuggcucucuucggaccccgguggcuuagagucagauacccugcaguggguggaggaaccucagaggagcuguacagcccggcgcugcgcaguacuucaggcuacugggggaguggaaccagccggcuggaaggagaugcgaugucacuugagagcgaaugguuaucugugcaaauaccaauuugagguccuaugucccgccccuaggccaggggcagcuaguaaccucuccuaucgggccccguuccagcugcauucugcugcccuugacuuuagcccucccggaaccgaaguguccgcacugugccguggccaguugccaauuucaguuacauguauagccgaugagaucggcgcucgcugggacaagcucaguggggaugugcugugccccugcccuggaagauacuuaagggcggguaaaugugcagaacugccaaauugccucgacgaucuuggcggguucgccugugagugcgcuaccggauuugaacugggcaaggacggucggagcugugucacuucuggggagggccagcccacauugggaggcaccggggugccgacgcgacgcccucccgccacugcaaccuccccaguaccucaaagaacauggcccauuaggguugaugagaagcuaggagaaacuccacuggugcccgagcaggacaacucagucaccagcaucccugaaauuccacggugggguagucagucuacaauguccacccuccagaugagccugcaagccgagucgaaagcuacgaucacuccgucuggcuccgugauaucaaaguucaauaguacaaccagcuccgccacuccccaggcauuugauucuagcucagcgguggucuucaucuuuguuaguacagcugugguagugcuugucauucugaccaugacgguguuggggcucguuaaacugugcuuccacgaauccccuagcucucagccacgcaaggagucaaugggacccccuggcuuagagagugacccagaacccgccgcacuggguagcuccucugcccacuguaccaacaauggggugaaagucggcgacugcgaucuaagagacagggcugagggagcccuccuggcagaaucgccgcuuggcagcuccgaugcuuga

SEQ ID NO: 54487 - RNA, 2721 nt, Artificial Sequence
  derived and/or modified sequence opt3 from CLEC16A__Homo_sapiens__NP_001230332
auguucggcagaagcagguccugggucgggggaggucacggcaagaccucucggaacauccauucacuggaccaccucaaauaccuuuaucaugugcugacaaagaauacuacgguuaccgagcagaaccgcaauuuguuaguggaaacaauucgaaguauaacugagauccugauuuggggagaucaaaacgacagcuccguauuugauuucuuucuagagaaaaauauguucguguuuuuccucaacauccugcgucagaagucugggagauacgucugcgugcagcuucugcagaccuugaauauucucuuugaaaacaucucgcacgaaacaucacuguauuaccugcucagcaauaacuauguuaauaguauaaucgugcauaaauucgacuuuuccgaugaggagauuauggccuacuauaucucuuucuuaaagacccugagccuuaaguugaacaaucacacuguccacuuuuucuacaacgaacauacaaaugacuuugcucuguacaccgaggcaauuaaauucuucaaccaccccgaauccauggugaggaucgccguacggacgauaacucuaaacguuuauaagguggauaaucaagcgaugcuccauuacauucgcgacaaaaccgcugucccuuauuuuucaaaccuggugugguucaucggcagucacgugauugagcuugaugacuguguccagacagaugaggaacacagaaauagggguaagcugagcgacuugguugccgagcaucucgaucaucugcacuacuuaaacgacauccugaucauuaauugcgaauuucucaacgacgugcuuacugaucaccuguugaaucggcuauuccugccacucuauguauacucucuggagaaccaggacaaagggggagaacgcccgaagauaucccuucccgugucacuguauuugcucagccaggucuuucugaucauucaucacgcaccuuuagugaauagucuggccgagguuauccuaaacggcgaucucucugagauguacgcuaagaccgaacaagacauacagcgauccagcgcaaaaccaucgauuagauguuucaucaagcccacagagacccuggaaaggucucuugagaugaauaaacacaagggcaaacggcgugugcagaagcgcccuaacuacaaaaaugucggggaagaggaggaugaagagaagggaccaacggaagacgcccaggaggaugcugaaaaggccaaagagaucgagauggugauuauggaaagauccaaguugucagagcuggcggcaaguacuagcguacaagaacagaacacaaccgacgaggagaaauccgccgcugccacuugcucugaaagcacacaguggucaaggcccuuucucgauaugguuuaucaugcacuggacaguccugaugacgacuaccacgcucuuuucgugcuguguuugcucuaugccaugucccauaauaaggguauggauccagagaaacuggaacggauccaauuaccgguccccaacgcggccgagaagaccacguacaaccacccucuggcagaacgacuaauucgcauaaugaauaacgcugcccagccagacggcaagaucagacucgcuacccuggagcuuagcugcuugcugcucaaacaacaggugcugaugucugccggguguauuaugaaggauguccacuuagcaugccuggagggagccagggaagagucagugcaucuuguucggcacuuuuauaaaggcgaagacaucuucuuggauauguuugaggacgaauaccgcaguaugacaaugaagcccaugaauguggaguaucucaugauggaugcuagcauccugcuaccuccaacugguacaccccugaccgggauugacuucguaaaaagacucccguguggagaugucgagaagacuaggcgugcgauacggguguuuuucaugcugcgaucccuuucuuugcagcugagaggcgaaccugagacccaguuaccccucacaagggaagaggaccugaucaagaccgaugacguucuugaucugaacaauucggacuugauugcaugcacugugaucacgaaagacggcgggaugguccagcgcuuccucgccguggauauuuaccagaugagccugguagaaccagacgugucccggcuaggaugggguguugucaaguuugcuggccugcuccaagauaugcaagugacagggguggaggacgauucaagagcccugaacaucaccauacauaaaccugcaaguucuccccacagcaagccauuccccauccuucaggccacuuuuauuuucuccgaccauaucagguguauuaucgcuaaacagcgcuuggccaagggacgaauacaggcacggcguaugaagaugcagagaauugcggcucuguuagaucucccuauccagccaaccacagagguccugggcuuuggucuugggucaagcaccucuacucagcaucugccguucagguuuuacgaccaaggccgccggggauccagugaucccacaguucagagaagcguguucgccucuguggacaaaguaccuggcgaaccagcacccaggccugccccacagcuaguccaccacgggggacgaucccgcucauuuagucucuggagccugugcgaguugcccuuccugucgcaaaagccgcggagauuagcugccccugcauccuga

SEQ ID NO: 54488 - RNA, 591 nt, Artificial Sequence
  derived and/or modified sequence opt3 from CLEC1B__Homo_sapiens__NP_001092901
augcaggacgaggauggcuacaucacccugaacauuaagacaagaaaacccgcccucauaagcgcugugaugcaaaggaauuaucuucagggggaaaacgagaaucggacuggaacgcugcagcaguuggcaaagcgcuucugccaauacgucguuaaacaguccgaauuaaaggguaccuuuaaaggccacaaguguucuccuugcgacacaaacuggcgauauuacggggauucauguuauggauucuuucgucauaaucugacuugggaggaaaguaagcaguacugcaccgacaugaacgccacacuacucaaaaucgauaauagaaacauuguggaguauaucaaggcgaggacccaccugauucgguggguaggccuuagccgccagaaauccaaugagguguggaagugggaagacgguucugucaucucggagaacauguucgaauuucuggaggaugggaaaggaaauaugaacugugcuuacuuccauaauggcaagaugcacccaacuuuuugcgagaacaagcauuacuugaugugugaaagaaaagccggcaugacaaagguggaccaacucccguga

SEQ ID NO: 54489 - RNA, 525 nt, Artificial Sequence
  derived and/or modified sequence opt3 from CLEC2A__Homo_sapiens__NP_001124183
augaucaaccccgagcugagagacggcagggccgauggguucauucaccggauagugccuaagcucauccagaauuggaaaauuggacuuaugugcuuucugagcaucauuaucaccacagucuguauaaucaugauugcuacuugguccaagcaugcaaaaccaguugccugcucuggugacugguugggcgugcgcgauaaguguuucuacuuuucagacgauacgcgaaacuggaccgcgaguaaaaucuucugcagcuuacaaaaggcugaacuggcccagauugacacacaggaggauauggaauuucuaaagcguuaugcagggacugacaugcacuggaucggacucuccagaaaacagggcgauucuuggaaguggaccaaugguacaaccuucaacgggugguuugagauaauuggaaauggcucguucgccuuucugucagcugacggcguacauagcaguaggggguucaucgauauuaaauggaucuguuccaagccgaaauacuuucuuuga

SEQ ID NO: 54490 - RNA, 450 nt, Artificial Sequence
  derived and/or modified sequence opt3 from CLEC2B__Homo_sapiens__NP_005118
augaugaccaagcacaaaaagugcuucaucauugugggcguccugauaacaacuaacaucauuacgcucaucguuaaacuuaccagagacagccagucccugugucccuacgauuggauuggguuucaaaauaagugcuauuacuucucuaaagaggaaggagacuggaacucaaguaaguauaauuguagcacacagcaugccgauuugacuaucauagacaacaucgaggaaaugaacuuuuuaaggcgguacaagugcuccucugaucacuggauuggucugaaaauggcuaagaaucgcaccggccaguggguggacggggcaacauucaccaaaucguuuggaaugcgaggcucagaggguugugccuaucuaagcgaugacggggcggcuacugcccguugcuacacagaaagaaaguggaucuguaggaaacggauucauuga

SEQ ID NO: 54491 - RNA, 585 nt, Artificial Sequence
  derived and/or modified sequence opt3 from CLEC2D__Homo_sapiens__NP_001004419
augcacgacagcaacaauguggagaaggauaucacccccuccgaacugccugccaacccaggcugccuccauucuaaagagcacucaauuaaggcuacacuuauauggagacuguucuuuuugaucauguucuuaacuauuaucgucugugggaugguugcagcccugagugcgauuagggcuaauugccaucaggaaccgagcgugugucuacaagccgcaugccccgaguccuggaucggauuucagcggaaauguuucuacuuuucugacgauacgaagaacuggaccucgucacagcgcuucugcgacagccaggaugccgaccucgcucaaguagaaaguuuucaggagcugaauuuccuucugcgauauaaagguccuuccgaucacuggauaggcuugucucgugagcaggggcagccauggaaguggaucaacggaacagaauggacuagacaacucgugaugaaggaggacggcgcaaaucuguacgucgccaaagugagccagguucccaggaugaacccucggccagugauggucuccuaucccgguucacgcagagugugucuguuugaauga

SEQ ID NO: 54492 - RNA, 645 nt, Artificial Sequence
  derived and/or modified sequence opt3 from CLEC2L__Homo_sapiens__NP_001073980
auggagcccgccagagaaccuccaagcagggcucggccgcccccuccacuggcagcccgccccgcgccugcuccagccgcaccccgaccucguuccccagccgaggcugaagcaagaggcccggaggggcuccuuaggcggucuggaucagguuacgaaggcaguaccagcuggaaggccgcucuggaggacacaacuacgcgcuuguuacugggggccaucgcggugcuacucuucgcaauucuggucguuauguccauacuugccucuaaaggaugcaucaagugugaggcucccugcccugaagauuggcuguuguauggcagaaaauguuacuuuuucucggaggaaccaagggacuggaacaccggucggcaguauugccacacacaugaggccgugcucgcaguaauucaaucacagaaggagcuggaauuuauguucaaauuuacucgccgagagcccuggaucgggcugagaagggugggagaugaguuccacugggucaauggcgacccuuuugauccagacaccuucacaauugcuggccccggggaauguguguuuguugaaccgacccggcucgugagcacugagugcuuaaugacacguccuugggucuguaguaagauggccuacaccuga

SEQ ID NO: 54493 - RNA, 609 nt, Artificial Sequence
  derived and/or modified sequence opt3 from CLEC3B__Homo_sapiens__NP_003269
auggagcuguggggcgccuaccuccuucugugcuuguucagcuuacugacccaggugacaacugaacccccuacgcaaaagccgaaaaagaucgucaacgcuaaaaaggacguugugaauaccaaaauguuugaggaacuaaaguccagacucgauacacuggcacaggagguagcccuucugaaggaacagcaggcguugcaaacugugugucucaaagggaccaagguccacaugaaaugcuuccuggcuuuuacacagaccaagacuuuccaugaggccucugaggacuguauuucaaggggagguacacugggcaccccacagacggggagugaaaacgaugcacucuaugaguacuuacggcagagcgugggaaaugaagccgagauauggcugggccuuaacgacauggcugcagaggguacuuggguugauaugaccggggcccgcaucgcuuauaaaaauugggaaacagagauuacugcccaacccgacggaggcaagaccgaaaacugcgcgguguuguccggcgcagccaaugggaagugguuugauaaacgaugucgugaccagcugccuuacaucugccaguucggaauugucuga

SEQ ID NO: 54494 - RNA, 714 nt, Artificial Sequence
  derived and/or modified sequence opt3 from CLEC4A__Homo_sapiens__NP_057268
augaccagcgagaucacauacgccgaagugagauucaagaacgaguuuaaauccucuggcauuaauacugcuucaagugcagccagcaaggaaaggacggcgccccacaaauccaacaccggguucccuaagcugcucugcgcuucucuucugauauuuuucuuguuacuggccaucucguuuuucauugcauuugucaucuucuuucagaaauauucacaacuacucgagaagaagacaacuaaagaacugguucauaccacacuugagugugugaagaaaaauaugccaguagaggaaaccgccuggagcugcuguccgaagaacuggaaaaguuucuccucuaauugcuacuuuauuagcacugaguccgcuucauggcaggacagugaaaaggauugugcacggauggaggcccaccuguuggugaucaacacacaggaggaacaggacuucauauuucaaaaucuccaggaggaaagcgcuuauuucgucggacugucugaucccgagggucagcgccauuggcaguggguggaccaaaccccuuacaacgaauccucaacguucuggcacccacgagagcccagcgauccuaaugagcguugcguugugcugaacuuuagaaagaguccaaaaagguggggcuggaaugacgucaacugucucgggccccagcggucugugugcgaaaugaugaagauccauuuauga

SEQ ID NO: 54495 - RNA, 642 nt, Artificial Sequence
  derived and/or modified sequence opt3 from CLEC4C__Homo_sapiens__NP_569708
auggugcccgaggaggaaccucaggacagagaaaagggccuguggugguuccagcucaaagucuggagcauggccguuguguccauccuucuguugucuguaugcuuuaccgugucaagugucgugccacacaacuucauguacagcaagacaguuaaaagguuauccaagcugcgggaguaucagcaguaccauccgucucuaacuugugugauggaagggaaagauauugaggacuggucgugcugucccacgccuuggaccucauuucagagcaguugcuauuucauauccacaggaaugcaaucuuggacuaagagccagaagaauuguuccgucaugggugcugaucucgugguaaucaacacccgcgaggaacaggacuuuauuauccagaaucugaaacgaaacucaaguuacuuccuuggccugagcgauccagggggacguagacacuggcaauggguugaccagacacccuauaaugagaacgugaccuuuuggcauucuggcgaaccuaauaacuuggaugagaggugcgcaauuaucaauuuccgguccucagaggaaugggguuggaacgacauacacugucaugucccacaaaagagcaucugcaaaaugaagaaaauuuacaucuga

SEQ ID NO: 54496 - RNA, 648 nt, Artificial Sequence
  derived and/or modified sequence opt3 from CLEC4D__Homo_sapiens__NP_525126
augggccuggagaagccccagagcaaacucgaagggggaaugcacccucaacuuaucccauccgugauugccgucguuuucauacuguuguuaucugugugcuuuaucgcuucaugucugguaacccaucacaacuucaguagaugcaagagggguacaggcgugcauaaacuagagcaccaugcaaagcucaaauguauuaaggaaaagagcgagcugaaauccgccgaagggucuacuuggaauugcuguccgaucgacuggcgggcguuucagucgaacugcuacuucccccuuacggauaauaagaccugggcugagucagagcgcaacuguagcggaaugggcgcccaccugaugacaauuaguacugaagcagagcagaauuuuaucauacaguucuuggaccgacgucucuccuauuuucugggucugagagaugaaaacgccaaagggcaauggaggugggucgaccagaccccuuucaauccacggcgcguguuuuggcacaagaacgagcccgauaauucucagggagagaacugcguugugcucgucuacaaucaggacaaaugggcuuggaacgaugugccuuguaauuucgaagcaagcagaaucugcaagauuccaggcacaaccuuaaacuga

SEQ ID NO: 54497 - RNA, 660 nt, Artificial Sequence
  derived and/or modified sequence opt3 from CLEC4E__Homo_sapiens__NP_055173
augaacagcuccaagucuucagagacccagugcacagaaagaggcuguuucaguagccaaauguuucuguggacuguggccgggauccccauucucuuccuuuccgcuugcuuuauaacgaggugugucguuaccuuccggaucuuucagacaugcgacgagaaaaaguuccagcugccugaaaauuuuacugaguugucuuguuacaacuauggaucggguucagugaaaaauugcuguccauuaaacugggaauacuuccagagcaguugcuacuuuuucuccaccgauacaauuucuugggcacugagccuaaagaauuguuccgccaugggcgcgcaccucguagugaucaacucacaagaggagcaggaauuucugaguuauaaaaagccgaagaugcgcgaguucuuuauugggcuuagcgaccaggucguggaaggacaguggcaauggguugauggcacuccccugaccaaaucuuuguccuucugggacgugggugagccuaauaacaucgcuacacucgaggauugcgccaccaugcgagacucaagcaauccacgucagaacuggaaugaugucacguguuuccugaacuauuuuagaauaugcgaaaugguggggaucaauccccugaacaagggaaaaagucucuga

SEQ ID NO: 54498 - RNA, 846 nt, Artificial Sequence
  derived and/or modified sequence opt3 from CLEC4G__Homo_sapiens__NP_001231785
auggacaccacaagauacaggcccuggggccggugggugcacuggagccgccgaccucuguuccucgcccuugcuguccugguuacuacgguguugugggcaguaaucuuauccauucugcuaucuaaggccucaaccgagcgugcggcucuccuggaugggcaugaccuucugagaacaaacgccaguaaacagacugcagccuugggagcucucaaggaagaggugggugauugccacagcuguugcuccggcacccaagcacagcugcagacaaccagggccgaacugggggaggcucaggccaaacucauggaacaagagucugcguuacgggagcugcgcgaaagagucacucagggacuugcagaggccggcaggggucgggaagacgugcgcacagaguuguuucgagcucuggaggccguuagacuacagaauaacucgugugaaccaugcccgaccucauggcucagcuucgaggggaguuguuacuuuuucuccgugcccaagacgacuugggcagcugcccaggaucauugcgcggacgccucugcacaccuggucauagugggaggccuugaugaacaaggcuuucugaccaggaauacacgggggcguggauauugguugggucuccgcgcuguaagacaucugggcaaaguucagggguaucaguggguggacggagucagcuuauccuucucacacuggaaccagggcgagccuaaugaugccugggguagggaaaacugugugaugaugcugcacacugggcucuggaaugacgcuccaugcgauagugagaaggacggauggaucugugagaagcggcauaacugcuga

SEQ ID NO: 54499 - RNA, 1047 nt, Artificial Sequence
  derived and/or modified sequence opt3 from CLEC4M__Homo_sapiens__NP_001138376
augagcgacuccaaggagcccagagugcagcaacugggccuccuugggugccugggacacggugccuuggucuuacagcugcuaucuuucaugcuccuggcuggcguucuuguggcaauccugguacaggugucaaaagucccuaguagcuugucccaggaacaaucugagcaggaugccauuuaccagaaccucacccagcugaaggcggcugugggggaacugucggagaaaucaaagcuccaagaaauauaucaggaguuaacacagcugaaagccgcaguuggagagcuuccagaaaagagcaaguugcaggagaucuaccaagaacugacuaggcuaaaagccgcugugggcgagcucccggagaagaguaaacugcaggaaauuuaucaggagcuuacgcggcugaaggcagccgucggugaauugcccgagaaauccaagcuccaagaaaucuaccaggagcugaccgaguuaaaggcugccgugggggaacugccugagaaaucuaagcuccaggaaauuuaucaggagcuuacacaacugaaagcggcaguaggagaauugccagaccagagcaagcagcagcaaaucuaccaggagcuaacugaucugaaaaccgccuuugagcgccucugucgacauugccccaaggacuggacauucuuucagggcaauuguuauuucauguccaacucacagcguaauuggcacgauaguguuaccgcuugccaagaagugagagcccagcuggucgugauaaaaacugcagaggaacagaacuuucuucagcugcaaacaagcaggucuaaucgguucuccuggaugggcuugucagaccucaaccaggaggggaccuggcaguggguggauggaagcccucugaguccaucuuuucaacgcuacuggaacuccggugaacccaauaauagcggcaacgaggacugugcugaguucucggggucuggauggaaugauaacagaugcgacgucgauaauuacuggaucuguaagaagccugccgcgugcuuuagggacgaauga

SEQ ID NO: 54500 - RNA, 567 nt, Artificial Sequence
  derived and/or modified sequence opt3 from CLEC5A__Homo_sapiens__NP_037384
augaacuggcacaugaucauuagcggccugauaguggucguucucaaggugguagggaugacccuuuuccuguuguacuuuccccagaucuucaauaaauccaacgacggauuuacaacuacgagaucuuaugguaccgugucacaaauuuucggcaguagcuccccuucuccaaauggguuuaucacaacuaggucguacggaaccgucugcccgaaggauugggaguucuaucaggcccggugcuuuuucuuaucaacaagcgaaaguuccuggaacgagucucgcgacuuuuguaaaggcaaggguagcacccuggcuauugugaauacucccgaaaaacuaaaguuccuccaggauaucacagacgcagagaaguacuuuauagggcugaucuaucaucgagaagagaaacguuggagauggauuaacaauuccguuuucaacggaaaugugaccaaccagaaucaaaacuuuaauugugccacgaucggccuuacuaagaccuucgaugcggcuucaugcgacauuaguuacaggcggaucugugagaaaaacgccaaguga

SEQ ID NO: 54501 - RNA, 630 nt, Artificial Sequence
  derived and/or modified sequence opt3 from CLEC6A__Homo_sapiens__NP_001007034
augaugcaggagcaacagccccagagcaccgaaaagagaggcuggcugucccucaggcuuuggucuguggccgggaucucaauugcucuguugagugcaugcuucauagucagcuguguugugacauaccacuuuacuuauggagagacggguaaacgguuauccgaacugcauucuuaccacucgucacuaaccugcuucagcgagggcacaaagguaccugccuggggguguugcccagcgaguuggaaauccuuuggaucuagcuguuauuucaucuccucagaagagaagguguggaguaaaagcgagcagaacugcgucgaaaugggcgcucaucucgugguuuuuaauacugaggccgaacaaaacuucauugugcagcagcugaaugagucuuuuuccuacuuccuuggucugucagacccgcaggggaacaauaacuggcaauggaucgauaagacccccuaugagaagaauguccgcuuuuggcacuugggagaaccuaaccauagcgcagagcagugugccaguauuguguucuggaaaccaacaggcuggggcuggaaugacguaaucugcgaaacccgacguaacucuauaugugagaugaauaagaucuaccucuga

SEQ ID NO: 54502 - RNA, 606 nt, Artificial Sequence
  derived and/or modified sequence opt3 from CLEC7A__Homo_sapiens__NP_072092
auggaguaccaccccgaccuggaaaaccucgaugaggacggcuauacccagcuucauuucgauagccaauccaauacaagaaucgccguggucucugaaaaggggucaugcgcugcaaguccuccauggaggcugauugccguuauauugggaaucuuaugucuggugauucuaguaaucgcggugguccucgguacuaugggcgugcugagcuccccgugucccccuaacuggauuaucuacgagaaaucuugcuaucuguuuucgaugucacuuaauagcugggacgggaguaagcggcagugcuggcaguugggauccaaccuccugaaaauagauucuagcaaugaacugggcuucaucguuaaacagguguccucacaaccagacaacaguuuuuggauuggucucagccgcccccagacggaggucccuugguuaugggaggaugggucuaccuucuccucaaaucuguuucagauccgaacaacugcuacccaggaaaacccaagccccaauuguguguggauucacguaaguguuaucuacgaccaacuuugcucugugccuuccuauagcauaugugagaagaaguucucgauguga

SEQ ID NO: 54503 - RNA, 726 nt, Artificial Sequence
  derived and/or modified sequence opt3 from CLEC9A__Homo_sapiens__NP_997228
augcacgaggaagagaucuacaccagccugcagugggacucccccgccccugauacauaucaaaagugccucucuucaaacaaauguaguggcgcuugcugucuugugauggucauuagcugcguuuucuguauggggcuguugacugcauccauauuuuuaggagugaagcugcuacagguaucuacgaucgccaugcagcagcaagaaaaacucauucagcaggagagagcgcugcuuaauuucaccgaauggaagaggucgugcgcucugcagaugaaauacugucaagccuuuaugcagaacucauugagcagugcacauaauuccucuccaugcccgaacaauuggauccagaaccgggagagcuguuauuacguguccgagauuuggucaaucuggcacacaagucaggaaaauugccucaaggaggguagcacucugcugcaaauagaaucuaaggaggagauggacuucaucaccggcucccuccgcaaaauuaaggggucauaugauuacugggucggauuaagccaggacggccauaguggucgauggcuguggcaggaugggucuucccccagcccuggacuuuugccagccgaacguucgcaaucugcuaaccagguguguggcuauguuaaauccaauucacugcuaaguagcaacugcuccacauggaaguacuuuaucugcgagaaauacgcacucagaucuagcguguga

SEQ ID NO: 54504 - RNA, 576 nt, Artificial Sequence
  derived and/or modified sequence opt3 from CLECL1__Homo_sapiens__NP_001240679
auggugagcaacuucuuucacgucauccagguuuucgagaaguccgccacccugauuucuaaaacagaacauauaggcuuugugaucuacucauggagaaagaguacuacgcaccucgggagcaggcggaaauucgcuauuuccaucuaucuuucugagguaucgcugcaaaaguacgacugccccuuuucaggaaccagcuucguggucuuuaguuuguucuuaauuugugcaauggccggugaugugguuuaugcggacaucaaaacagugcgcacuuccccucuggaacuagcuuuuccacuccagcgaucugucagcuucaauuuuuccaccgugcauaagucaugcccggccaaggauuggaaaguacacaagggcaaauguuacuggauagcagagacaaagaaaaguuggaacaagagccagaaugacugcgccaucaacaauucuuaucugaugguuauucaggauaucaccgcuaugcuuauuacuuuccuguuguaccuccaaauggcauuucugcaguguguguauaucuccgacgucucaguguaccccaacuucuuccuguga

SEQ ID NO: 54505 - RNA, 1833 nt, Artificial Sequence
  derived and/or modified sequence opt3 from CLGN__Homo_sapiens__NP_004353
augcacuuccaggccuuuuggcugugccucggccuucuguucaucagcauuaacgcugaguuuauggacgaugacguggaaaccgaggauuucgaagaaaauuccgaagagauagacgucaacgagucugaauugucaagugagaucaaguacaaaacaccccaaccuauuggggaaguuuauuuugcagagacuuucgauagcggaagauuagccgguugggugcuguccaaggcgaaaaaggacgauauggacgaggaaaucucuauuuacgaugggaggugggagaucgaggagcuaaaagaaaaucagguaccaggcgaccggggacucgugcugaagucgcgcgcuaagcaucacgccauaucagcaguccuugccaaaccguuuaucuucgcugauaagccccugauugugcaguaugagguuaacuuucaggacggcaucgauugugguggggcauacauuaaauugcucgccgacacggacgaucugauccuggagaauuucuaugacaagaccagcuacauaauuauguuuggaccugauaaaugcggcgaagacuauaagcuccauuucaucuuucgacacaagcauccaaaaacaggcguguucgaggaaaagcacgcuaaacccccugaugucgacuuaaagaaauucuuuacugaucguaagacccaccuguacacacuugugaugaacccagacgauaccuucgagguauugguugaccaaacuguggucaauaaagggagucugcuagaagauguggugcccccuauuaagccaccgaaggagaucgaggaccccaacgacaaaaagccugaagagugggaugaaagagccaaaaucccagaccccuccgcggucaagccugaggauugggacgaaucugagccagcacagauugaggauagcuccguugugaaacccgccggauggcucgacgaugaaccgaaguuuauaccugaccccaaugcugagaagccagaugacuggaacgaagauacagacggugagugggaggccccucagauccugaaucccgcauguaggauuggcugcggggaauggaaaccacccaugaucgauaacccuaaguacaaaggaguauggcggccaccgcuuguggacaaucccaacuaucagggcauauggucaccucgcaagauuccaaaucccgacuacuucgaggaugaccauccuuuucuguugaccaguuucagcgcucucggucuggaauuauggucuaugacguccgauaucuauuuugacaacuucaucauuuguucagagaaagaagucgccgaucacugggcggccgacggguggagauggaagaucaugauugcaaacgcuaauaagccaggagugcugaaacaacucauggccgcugccgagggccaucccuggcuuuggcugauauacuugguuacugcaggcgugccgaucgcccuaauuaccagcuuuugcuggccuaggaaggucaaaaagaaacacaaggauacagaguauaagaaaacugacaucuguaucccacagaccaagggggugcuggaacaggaggaaaaagaggaaaaggcugcgcucgagaaacccauggaucuggaggaagagaagaaacagaacgacggagaaaugcuugagaaggaagaggagagugaaccugaggaaaagucugaggaggaaauugagauaaucgaaggucaagaggaauccaaucagagcaacaaaucgggcucugaggaugagaugaaggaagcagacgaguccacagggucaggagauggccccauuaaaaguguacggaagcgccgaguuagaaaagacuga

SEQ ID NO: 54506 - RNA, 726 nt, Artificial Sequence
  derived and/or modified sequence opt3 from CLIC1__Homo_sapiens__NP_001279
auggccgaggaacagccccaaguggagcuguucgucaaggcuggcagcgacggggcaaaaaucggaaacugcccuuuuucccagagacucuucaugguucuuuggcugaagggugugaccuuuaauguaacaacuguggauacgaaaaggcggaccgaaacaguccagaaguuguguccaggcgggcaguuaccguuccugcuauacggaacugaggugcacaccgacacaaacaaaauugaagaguuucucgaggccguucugugucccccucgcuauccaaaacuugcggcucugaaucccgaaucuaacaccgccggcuuggauauauucgcaaaguuuucagccuacaucaagaauaguaacccugcucucaaugacaaccuggagaagggucugcucaaagcauuaaaggugcuggauaauuaucuuacuagcccauugcccgaagaggucgacgagacauccgccgaagaugagggggugucucaacgaaaauuccuggacggaaacgaacuaacccucgcugauugcaaucugcuuccuaagcugcauauuguacagguugugugcaagaaauaccguggcuuuacgaucccagaggccuucagaggcguccacagguauuugucgaacgcguacgcacgggaagaguuugccucaacuuguccggacgaugaggaaauugagcucgcuuaugaacagguggccaaggcacugaaauga

SEQ ID NO: 54507 - RNA, 711 nt, Artificial Sequence
  derived and/or modified sequence opt3 from CLIC3__Homo_sapiens__NP_004660
auggccgagaccaagcugcaacucuucgugaaagcuagcgaagacggcgaguccgucgggcacugccccucuugucagagacuuuuuaugguucuguuguuaaagggagugccuuucacacugacuacgguagauaccaggcggucaccagacgugcuaaaagauuuugcaccggguagucagcuccccauccugcuuuacgacagcgaugccaagacagacacucugcagauugaagauuucuuggaggaaacccucggcccuccagacuuucccucccuggcgccucgcuaucgagagucuaacacagcugggaaugaugucuuccauaaauuuucggccuucauaaagaacccagugcccgcacaggacgaggcccuguaccaacagcucuuacgugcucuggcaagacuugauucauauuugagggccccucuggaacacgagcuagcuggagaaccacagcuccgggagagccgcagaagguuucuggacggcgaucggcuuacccuggccgacugcaguuugcucccgaagcugcauaucguugacacugugugugcgcacuuccgccaggcacccauuccugccgaguuacgaggugucagaagguaccuggauuccgcuaugcaagaaaaagaguuuaaguauacaugcccacauucugccgaaauccucgcagcuuaccggcccgccgugcacccucguuga

SEQ ID NO: 54508 - RNA, 1233 nt, Artificial Sequence
  derived and/or modified sequence opt3 from CLIC5__Homo_sapiens__NP_001107558
augaacgacgaggauuacagcaccaucuaugacacaauucagaaugaaagaacuuacgaggugcccgaucaaccugaagagaacgaauccccacacuaugacgauguccaugaguaccugaggccggagaaugaccucuaugccacgcagcuuaacacccacgaauacgauuucguuucuguguauacaauaaagggcgaggaaacuucacuggcuaguguacagagcgaggaccggggguacuuguuacccgaugagaucuacuccgaacugcaggaggcacauccuggagaaccacaagaggaccgcgguauuucuauggaaggccuauauucgucaacccaggaucagcagcucugcgccgcggagcugcaagagaaugggagcgugaugaaagaagaccuucccaguccuuccucuuuuacaauccagcacagcaaggcuuucuccaccacuaaauacucauguuauagugaugccgagggacuggaagagaaggaaggcgcacauaugaacccagagauuuacuuguuugucaaagccgguaucgacggggagagcauaggaaauugccccuucucucagcgacucuuuaugauccuguggcugaagggcgugguuuucaacgugacaaccgucgaccucaagcguaaaccugcugauuuacacaaucuggcaccaggcacgcacccgcccuuucuuacuuucaacggggacgugaagaccgauguaaauaaaauugaagaguuuuuggaagagacacugacuccugaaaaguauccaaaacuagccgcuaagcauagagaguccaacaccgccggaaucgacauuuucucaaaguuuagcgcguacaucaaaaauacaaagcagcaaaacaaugcagcccucgagaggggucugaccaaagcucuuaagaaacuggaugacuauuugaacacgccccucccugaagagauagaugccaacacuuguggcgaagacaaggggagucggcgcaaauuccuggauggagacgaguuaacacuggcagauugcaaucuccuuccaaagcugcacguugugaagauugucgcuaaaaaguacagaaacuacgacauccccgccgagaugaccggcuuguggagguaucugaaaaaugcguacgcccgggacgaauuuacuaacacaugugcagcugauucugagauugaacuagccuaugcugacguggccaagcgccucucccgaagcuga

SEQ ID NO: 54509 - RNA, 2061 nt, Artificial Sequence
  derived and/or modified sequence opt3 from CLIC6__Homo_sapiens__NP_444507
auggccgaggcugcagaacccgagggcguggccccugggccacagggaccgcccgaagucccugcgccacuggcugagagacccggugaaccuggcgccgcagggggagaggccgagggcccagaagguagcgagggggcugaagaggcacccaggggagccgcugccguuaaggaggcgggcggcgggggaccugaccgggguccagaagcagaggcccgcggcacccgaggggcucacggagaaacagaggccgaagagggcgcaccggagggugcugaagugccccaagggggagaggaaacuuccggcgcccagcagguagagggcgcgucuccugggcguggagcccagggugaaccaagaggcgaggcacaaagggagcccgaagauucagcugccccugagcggcaggaagaggcugaacagcgcccagaggugcccgaggggagugccagcggagaagcaggcgacuccgucgaugccgaggguccgcucggggacaacaucgaagcugagggcccugcgggagauucuguggaggcagaaggcagaguuggggacucgguggaugccgagggacccgcuggugacucagucgaugccgaaggcccacuuggggacaauauucaggcagagggaccugccggcgauagcguggacgcugaagguaggguaggggauaguguugacgccgagggccccgcaggagacuccguggaugcggagggccgggucggggacucuguggaagcuggagauccagccggugacggcguggaggcagggguccccgccggagauagcguugaagcugagggcccugccggugacuccauggaugcagaagggccagcuggccgcgcccgaagagugucaggagagccgcaacagaguggcgacgggagccugucuccccaggcggaggccauagaaguagcugcaggagaguccgccggcaggucaccuggugaauuggcuugggaugccgcagaggaagcggaggugccaggggucaaaggaagcgaggaagccgcucccggcgacgcccgggcagaugcuggugaggaccgugugggcgacgggccucagcaagaaccaggagaggaugaggaacgcagagagaggagucccgaaggcccgcgggaggaagaggccgcagggggagaggaagagucuccugacuccagcccacauggcgaagccucgcgaggugcugcggagcccgaagcccaguuaucuaaccaccuggcagaggaggggccugcugaaggauccggcgaggccgcccgcguuaaugguagaagggaagauggcgaggcuucagaaccccgggcacuagggcaggagcaugacaucacccucuucgugaaggccggauacgauggcgagaguauugggaacugcccauuuagccaacgccuguucaugauccuuuggcugaaaggagucauuuuuaaugugacgacaguagacuugaagagaaaaccugcggaucuccagaaccuggcucccggcacuaauccaccguucaugaccuuugacggugaaguuaagacagaugugaacaagaucgaggaguuccuggaagagaaacucgccccucccagguauccaaaguuagggacccagcaccccgaauccaauucugcaggaaacgacgucuuugccaaauucagcgcuuuuauaaagaauacuaaaaaggaugcaaacgagauccaugaaaagaaucugcuuaaagccuugcguaagcuggacaacuaccuaaauucaccucucccagaugagauugacgcguauaguacagaagacgugaccgucuccggccggaaauuccuggauggugacgagcuuacgcuggcugauuguaacuugcuccccaagcugcacaucauuaaaaucguggccaagaaauaccgagacuuugaguucccuagcgaaaugacuggcauauggagauauuuaaacaaugcauacgccagggaugaguuuaccaacacaugcccggcugaccaggaaauugagcacgccuauucugauguugcaaagcgcaugaaguga

SEQ ID NO: 54510 - RNA, 1932 nt, Artificial Sequence
  derived and/or modified sequence opt3 from CLINT1__Homo_sapiens__NP_001182484
augcugaacauguggaaggugagagagcucgucgacaaagccaccaauguugugaugaacuacagcgaaaucgaguccaagguaagggaagcuacaaaugaugaccccuggggcccuucugggcagcuuaugggagagauugcaaaagccacuuucauguaugaacaauuuccagagcugaugaacauguuguggucacggauguuaaaggauaauaaaaagaacuggcgccgaguguacaagagucugcuacuccuggcguaucuuauacguaaugguagcgagagagucgugacguccgcuagggaacacaucuacgaccugcggucuuuggagaacuaucauuucguugaugaacacggcaaagaccaggggauuaauauccgccagaaggugaaagagcucgucgaguuugcccaggaugacgauagacugagggaagaacggaagaaagcaaagaagaacaaagacaaguacgugggaguaucgucagauagcguuggcgguuuccgcuauagugaacgauacgacccggagcccaaauccaagugggaugaagagugggacaaaaauaagucugccuuuccuuucagcgacaaacugggggagcucuccgauaagauuggaucaaccaucgacgauacaauaaguaaguuuagaaggaaagaccgggaagauagcccagagcguugcucugacuccgaugaagagaagaaagcucgcagaggcaggucacccaagggcgaguucaaagacgaggaggaaacugugaccacaaagcauauccacauuacccaagcaacugagacaaccacgacucggcauaagcgaaccgccaacccuagcaaaacaaucgauuuaggggcugccgcgcacuacacuggagacaaggcaaguccagaucagaaugccucuacccacacaccccaguccagcgucaaaaccucggugccuucuuccaagucaaguggugaccugguggaccuuuuugauggcacgagccaguccacugggggaucugcugacuuguucggcgguuuugccgauuucgggagcgcagcugccucaggaaguuuuccaucccaagucacagcgaccagcggcaacggcgacuucggggauuggucugccuucaaucaggcaccgucaggacccguugcuaguagcggugaauuuuucggcuccgccucucagccugcuguggagcugguaucggggagccaguccgcccuaggaccacccccugcagccucaaacaguucugaccucuuugaucugaugggcagcucccaagcuacuaugacaucaagccagucuaugaacuucuccaugaugaguaccaauacggugggucuugggcugccaaugagccgcucucagcccuugcaaaacgucuccaccgugcuccagaaaccgaauccucuguauaaccagaauacagacaugguucagaagucagugaguaagacuuuacccagcaccuggucggauccauccgucaacauuucucuggacaaucuccuuccuggcaugcaacccagcaaaccacagcagcccucacugaacacaaugauccagcaacagaauaugcagcagccuaugaacgugaugacucaaaguuuuggagcgguaaauuuguccucuccaagcaacaugcuaccgguuagaccccagaccaaugcacugauaggcgggccuaugccaauguccaugcccaacgugaugacaggaaccauggguauggccccucucggcaauacuccaaugaugaaccagucaaugauggggaugaacaugaauauuggaaugagcgcugccggcaugggucugacggggacaaugggcaugggaaugcccaacaucgcaaugaccaguggcacuguccagccgaagcaagaugccuucgcuaauuuugccaacuucucuaaauga

SEQ ID NO: 54511 - RNA, 4317 nt, Artificial Sequence
  derived and/or modified sequence opt3 from CLIP1__Homo_sapiens__NP_001234926
augagcaugcugaagcccuccggccucaaagccccuaccaagauccuuaaaccagggucuacagcucugaagacuccgacggcaguggucgcccccguugagaaaaccauuucaagugaaaaggcgagcuccacaccuucuucggagacucaggaagaguucguggacgauuuuagaguaggagaaagggugugggucaacgguaauaagccaggcuucauacaauuuuugggggagacccaguucgcucccggacagugggccggcaucguguuagacgagccuauugguaaaaacgaugggucaguugcaggagugcgguacuuucagugcgaaccacugaagggcaucuucacacgccccagcaaacuaacccgaaagguccaagccgaggacgaagcuaauggccuccagacuaccccugcaagucgugccacauccccacuguguacgucuacugcuagcaugguguccucaaguccgagcacccccucuaacauuccucagaaaccaucccagcccgccgcgaaggagccuucagcaacaccacccaucagcaaucuuacuaagaccgccagugagucuauauccaaccugagcgaagcugggucgaucaaaaagggagagagagaauugaaaauuggugauaggguacucguuggcgggacaaaggccggagugguccgguuucugggcgagaccgacuucgcaaaaggugaauggugcgggguggagcuggaugagccgcucggaaagaaugacggcgcuguggccggcacgcgcuauuuucaaugucagccuaaauacggguuauucgcgcccguccacaagguuacuaagaucggauuuccaucuacaaccccugccaaagcaaaggcuaacgccgugagaaggguaauggcuacuacauccgccucacugaaacggagucccagcgcauccucucuuagcucaaugaguuccguggccagcucugucucaagucgcccaagccgaaccgguuugcugacggaaaccuccucuagauaugcuaggaagauuucgggcacaacugcgcuacaggaggcacucaaagaaaagcagcaacauaucgagcagcugcuugccgaacgggaucuggagcgugcugagguggccaaggcaaccagccacguuggggaaauagagcaggaauuggcccucgcucgcgacggacaugaucaacacgugcuggaguuagaagccaaaauggaccagcugagaacaauggucgaggcagcggauagggagaagguggaacuccuuaaucagcuggaggaagagaaacggaagguagaggacuugcaguuccgaguugaagaggaauccauuacuaaaggcgaccuagagcaaaagucacagaucagugaagaucccgagaacacccagacaaagcuggagcaugcucgcauuaaagaacucgagcagucucugcuuuuugaaaagaccaaagccgacaagcugcaaagagaguuggaagauacuaggguggcaacggucagcgagaaaucccggaucauggagcucgaaaaggaccuggccuuacgcgugcaggaggucgcugaacugagaaggcgucuagagucaaauaagccugccggugauguggacaugagccucucucugcuucaggaaaucuccaguuugcaggagaaacuggagguuacacggaccgaucaccaacgagaaauuacuagccucaaggagcacuucggggcaagagaagagacccaucagaaagagauaaaggcucuguacacagccaccgaaaaacuuucuaaggagaacgaaucccugaaaucaaaguuggagcacgcgaauaaggaaaacagugacgugaucgcccucuggaaaagcaagcuggagacugcuauugcaucgcaucagcaggccauggaggaauuaaaaguauccuucucuaagggccugggaacagagacggcugaauuugccgagcuaaaaacccaaaucgaaaagaugaggcucgauuaucagcacgagauagagaaucugcagaaccaacaggacagcgaacgcgcagcgcacgccaaggagauggaagcucuccgggccaaauugaugaaggucauuaaagagaaggaaaacucacuggaggcaaucagaaguaaacucgauaaggcugaggaccagcaucugguggaaauggaggacacuuuaaauaagcugcaggaagccgagaucaaaguuaaggagcuugaaguguugcaagcaaaaugcaacgagcagacaaaggucauugauaauuucaccucccagcucaaagccacagaagagaagcugcuagaccuggaugcucucaggaaggcgucuagcgaaggcaaauccgagaugaagaaacugcgccagcaacuugaggccgcagaaaagcagaucaaacacuuggagauugaaaagaacgcugagucaagcaaagccaguucuauaacucgagaacugcaggggcgggaguuaaagcucaccaaucugcaggagaaccuuuccgaagugagccaaguaaaggagacgcuggaaaaagaguugcagauccucaaggaaaaauuugccgaggcuucggaggaagcagugucaguucagcguucuaugcaagagaccgucaauaagcugcaucagaaagaagaacaguucaacaugcuaaguuccgaccuggagaagcucagagaaaaucuggccgauauggaggcgaaguuuagggaaaaagacgagcgcgaagaacagcuuauuaaggcuaaagagaaguuggaaaacgauaucgccgagaucaugaaaaugagcggagacaauucuagccaacugacaaagaugaacgaugaauuacggcucaaggagagagacguggaagaacugcagcuuaaacugacuaaggcaaaugagaacgccuccuuccuacagaaaucaauugaagauaugaccgugaaggcugagcagagucaacaggaagcagccaaaaagcacgaggaagagaagaaagagcucgaaaggaagcugagcgacuuggagaaaaagauggaaacaucucauaaucagugucaggagcugaaagcgcgauacgagcgcgcuacuuccgaaaccaagacgaagcacgaggaaauauuacaaaaccuccagaaaacacugcuugauaccgaggacaagcugaaaggugcccgggaagagaacucaggcuugcuccaggagcuggaggagcuaagaaagcaggcagacaaagccaaggcugcccaaacugcagaagaugcuaugcagaucauggagcagaugacaaaagaaaagaccgagacucuggccagucuugaggacaccaagcaaacaaaugcgaaacuccagaacgaacuggauacguugaaggagaauaaccugaaaaaugucgaagaguuaaacaagagcaaagaacuccugaccguugagaaucagaagauggaggaauuuaggaaggagauugaaacucuuaaacaggccgcagcucaaaagucccagcagcugucugccuugcaggaggagaacgugaaacucgcugaggagcuggggcguucgcgcgacgaagugacaagccaccaaaagcuagaggaggagcggucaguacugaauaaccagcuucucgagaugaaaaagagagaauccaaguucaucaaagaugcagacgaggaaaaggccagucugcagaaaucuauuagcaucaccuccgccuuguuaacagagaaggaugcugaacuggagaaacucaggaaugaggucacugugcugcgaggagaaaacgcgucagcaaagucucuucauagcguugugcagacccuggagagugacaaggucaaauuggaacuaaaggugaaaaaucuggagcuccaacugaaggaaaacaaacggcagcuuuccucuagcucaggcaauacggauacacaggccgacgaggaugagcgcgcucaagaaucccagauagacuuuuuaaacaguguuaucguggaucugcagagaaagaaccaggaccucaaaaugaagguagagaugaugagcgaagccgcauugaaugguaacggggacgaucugaauaacuaugacucggaugaccaagagaagcagucuaaaaagaaaccaaggcuuuucugcgauauuugugacugcuuugaucugcacgacaccgaggauuguccgacucaggcccagauguccgaagaucccccucauagcacccaccacggcucacggggagaggaacgaccauacugcgagaucugugaaauguucggccauugggcuacaaauugcaacgacgacgagacuuuuuga

SEQ ID NO: 54512 - RNA, 3141 nt, Artificial Sequence
  derived and/or modified sequence opt3 from CLIP2__Homo_sapiens__NP_003379
augcagaagcccagcggccugaaaccuccagggagaggagguaagcacuccucuccgaugggcaggaccucaacagggagugccagcuccucugcugcaguggccgcgucgucaaaagagggaagcccccuccauaagcaaaguuccggcccuucuagcuccccagcugccgcagccgcucccgaaaaaccugguccaaaggcagccgaggucggggacgauuuccuuggagacuuuguugugggcgaacggguaugggugaacggcgucaagcccggggugguucaguaccugggagagacucaguucgcuccuggucagugggccggcguggucuuggaugacccaguggggaaaaaugauggagcgguaggcgguguucgcuauuuugaaugcccggcauuacaagggaucuucacgcgacccucaaagcugacccgucagccuacagccgagggaaguggcagcgacgcucacucuguggagucccuaacugcccagaaccucucacugcauagcggcaccgcaacaccaccccuuaccaguagagucauuccucugagggaaucugugcucaauuccagcgugaaaacugggaacgagucgggaucuaauuuguccgauucagguagugucaagcggggcgaaaaagaccugcgccugggggauagaguucucgugggaggcacaaagaccgguguagugagguacgucggggagacggacuuugcuaagggcgagugguguggaguggaauuagaugagccacugggcaaaaacgacggggccguugcgggaacucgguauuuccagugucccccgaaguuuggucuuuucgccccuauacacaaagugauccgcauuggcuuucccagcaccuccccagcaaaggcuaaaaagacaaaacgaauggccaugggggucucugcuuugacucauagcccuucaaguuccagcaucucuucagugaguagcguagccuccucuguuggaggcagacccucgaggagcggucugcuaaccgaaacauccucacgguacgcacguaagauuagugggaccacggcccuccaagaggcucugaaggaaaaacagcagcacaucgagcagcuucuggcggagcgcgauuuggaaagagcagagguggccaaggcuacuucucacauaugcgaagucgagaaagaaaucgcccuccugaaggcacaacaugagcaguauguggccgaggcugaagagaaauuacagagggcccggcugcucgucgaaagcgugcgaaaggagaagguugaccuuuccaaucaacuggaagaggagcgcagaaaaguggaagacuugcaguucaggguagaggaagagucaauuacaaagggcgaucuagagacccagacucagcuggaacacgcacggaucggagagcucgaacaaagccugcuucuggagaaagcgcaggcugaacgcuugcucagagagcuggccgacaacagguuaacaaccgucgcagagaagucucgugugcugcagcuagaagaggaacucacgcugcggcgaggcgagauugaagaacuucagcaaugcuugcugcauuccgggccacccccuccagaucacccggacgccgcugagauccucagacugagggaacgccuucugagugccagcaaagagcaccagcgggaaucuggaguuuugagagauaaguacgagaaggcacucaaggcuuaucaggccgaaguggacaaacugagggcggccaaugagaaauacgcucaggaggucgcagguuuaaaggauaaagugcaacaggccaccuccgaaaacaugggccugauggacaauuggaagucaaagcuagauagucucgcuagcgaccaucagaaaucgcuggaggaucuuaaggccacauugaacuccgggcccggagcacagcaaaaagaaauaggcgagcugaaggcgguaauggaggguauuaaaauggaacaccagcucgagcuggggaauuuacaggccaagcaugaccuggaaacugcuaugcacgugaaagagaaggaagcccuucgcgagaaguugcaagaggcacaggaggagcucgcuggccugcagcgacauuggcgggcccagcuagaaguucaagcaucucagcaccgucuggagcuccaggaagcccaggaccaaagaagggaugcugagcugcgcguccacgagcuugaaaaauuggacguggaguaccggggacaggcgcaggccaucgaauuucugaaggagcagauuagcuuagcagagaaaaagaugcucgauuaugaaagacugcaaagggcugaggcccagggcaaacaggaaguggagucacuucgagaaaagcuguuggucgccgagaaccgccuccaagcuguugaggcacuguguaguucccagcauacccacaugaucgaaucuaaugacaucagcgaggaaacaauucggacuaaggagaccguggaagggcuacaggauaaacugaacaagagagacaaagaggugacagcccucaccucccagacugagaugcugagggcgcaaguaucagcucuugaaagcaagugcaaaaguggagagaagaaggucgaugccuugcugaaagaaaagcgucgcuuagaggcagaacucgagacggugucucggaaaacacaugacgccuccggccagcugguucuuauaagccaggagcugcuaagaaaggaaaggucgcucaacgagcugcgaguguugcuguuagaagcuaaucggcacucaccugguccagagcgcgaucucucuagagaaguccacaaagcagaguggaggaucaaggagcagaagcugaaagacgauauucgggggcuucgagaaaagcugaccggauuggacaaagagaagagucucuccgaucaaagacgcuacagccugaucgaccccucuagcgccccugaacuacugaggcuucagcaucagcucauguccacugaggacgcgcugcgugaugcuuuggaccaggcccaacagguggagaaacugauggaagcaaugcggucauguccagauaaggcccagaccauaggcaacagugguagcgcuaauggcauucaccagcaagacaaagcccagaagcaggaggauaagcauuga

SEQ ID NO: 54513 - RNA, 1581 nt, Artificial Sequence
  derived and/or modified sequence opt3 from CLK1__Homo_sapiens__NP_001155879
auggccgcuggcagaaggcccgcaagcgcccuguggccugagcggcgcggguccccacuccgaggagaccuucuggguuuccaaaacgugcgugaaccgucuucaugcggcgagaccuugagugggaugagacacagcaagaggacauacugucccgauugggacgauaaagacugggauuauggaaaguggcgguccucuucgucacauaaacgcagaaagaggagccacaguuccgcgcaagaaaauaaacggugcaaguacaaccauucuaagaugugugacagccacuauuuagagucccgcucaaucaaugaaaaagauuaccauagucgaagauauauugacgaguacaggaacgauuauacucagggcugcgagccuggucaccggcagcgugaccacgaaagccgcuaccagaaucauucuuccaagucaagcgggagaaguggaaggucuuccuacaaaagcaagcaccggauacaucacucgacgucucaccgacgcucccauggcaaaucacacagaaggaagcggacccgcagugucgaggaugacgaagagggccaucugaucugucaaagcggggauguucuauccgcuagauaugagauuguggacacacucggagaaggugccuuuggcaagguaguggagugcaucgaccacaaagcagggggaaggcaugucgccgugaagauuguuaaaaacguggaucguuacugugaagcugcacggucugagauccagguccuggaacaccuuaauacuaccgacccaaacagcacauuccgaugcgugcagaugcuggagugguuugagcaccauggccacauauguaucguauucgaauugcucggucugucaaccuaugauuuuauuaaggagaauggguuccugcccuuuagacucgaccauaucaggaaaauggccuaccagauuugcaagaguguuaacuucuuacacuccaauaaacugacucacacagaucuuaagccugaaaacaucuuguuugugcaaagcgacuauaccgaggcuuacaauccaaagauaaaacgcgaugaacggacgcugauuaaccccgacaucaaggucguggauuucggaucugccacuuaugacgaugagcaucacucaacccuagugaguacaagacauuacagggcgccugaggucauucucgcacugggcuggagccagccaugugacguuugguccaucggcugcauccuuauugaauacuaucugggguuuacuguguucccgacccacgacucuaaagagcauuuggccaugauggaacgcauacucggaccccugccuaagcacaugauccagaaaacacgaaagcggaaguacuuucaccaugaucguuuagacugggaugagcacucgagcgcugguagauauguauccaggcgcugcaaaccacugaaggaauuuaugcucucacaggacguggagcaugagcggcuuuucgaucugauucagaaaauguuggaauacgaccccgccaagagaaucacccuaagggaggcacugaaacacccuuucuucgaucuccugaagaagaguauauga

SEQ ID NO: 54514 - RNA, 1500 nt, Artificial Sequence
  derived and/or modified sequence opt3 from CLK2__Homo_sapiens__NP_001281267
augccccacccuagaagguaccauagcuccgagcggggcucucgcgggucauaucgagaacacuaccguaguagaaagcauaaaaggcggcgcagcagauccuggucuucgucaagcgacaggacccggcgccgaagaagggaggauaguuaucacgugcggucccguucuagcuacgacgaucgcuccucagacagaagggucuaugaucggcgauacugcggaaguuaucgcagaaacgacuacagcagggaucggggugacgccuacuaugauacagacuaccgccauucuuaugaauaccagagagaaaauuccucauauaggagccaacguaguucucggcgaaagcacagaaggcgccggagaaggucccgcacuuucagccgaucgucuucccagcacucaagucggcgugcuaaaagcguugaagaugacgcagagggccaucugaucuaccacgugggggauuggcuccaggagagauaugaaauuguauccacgcuuggagagggcaccuuugguagggugguccaguguguggaccaucgcagagggggagcccggguugcgcugaagauaaucaaaaacguggaaaaguacaaggaggcugccagguuggagauuaaugucuuagagaaaaucaacgagaaggacccagauaauaaaaaccugugcgugcaaauguucgacugguuugauuaccacggccacauguguauuucuuucgaacuacucggccugagcacauuugacuuccuuaaggauaauaacuaucugccguaccccauccaucagguacgacacauggcauuucaguugugccaggccguuaaauuccuccaugacaauaagcugacucacaccgaucugaagccugagaacauacucuuugucaauucagacuaugaauuaacauacaaccuggagaaaaagcgcgaugagcggagugugaaauccaccgcugugagaguggucgacuucgggagcgcaacuuuugaucaugaacaccacucuacaaucguuucaaccaggcauuaucgugccccagaggugauucuugaauugggauggagucaacccugugacguauggagcaucgguugcauuaucuucgaguacuaugugggcuuuacgcuguuccagacucacgacaaucgcgaacaucuagcuaugauggagcggauacucgggccuauuccauccagaaugaucaggaagacccgaaaacagaaguacuucuaccggggacgccuggauugggacgagaacacaucugccggcagauaugucagggaaaauuguaaaccccuucggcgauaccugacuucggaggcggaggaacaccaccaguuguuugaucucauugaaagcaugcuggaguaugagccugcaaagagauuaacccugggugaagcccuccaacauccauucuuugcucgccuuagggccgagccgcccaacaagcugugggacuccucacgugauaucagucgguga

SEQ ID NO: 54515 - RNA, 366 nt, Artificial Sequence
  derived and/or modified sequence opt3 from CLLU1__Homo_sapiens__NP_001020404
auguucaacaagugcagcuuucacuccucuaucuacagacccgccgcugacaauucagcaaguagccugugugccauuauaugcuuccucaaccuugugaucgagugugaucuggaaaccaauuccgagauuaacaaauugaucauuuauuuauuuucucagaauaacaggauccgguucucgaagcugcuacucaaaauacuguuuuacaucucaauuuucagcuauccugaacuuaugugcgagcaauacgucacauuuaucaagccaggcauucauuaugggcagguuaguaaaaagcacaucauauacuccacuuuccugucuaagaauuuuaaauuccaguugcuccgcguguguugguga

SEQ ID NO: 54516 - RNA, 3009 nt, Artificial Sequence
  derived and/or modified sequence opt3 from CLMN__Homo_sapiens__NP_079010
auggccgcucacgagugggacugguuccagagagaggaacugaucggccaaauuagcgauauaagggugcagaaccuccaggucgaacgggagaauguucagaagcgcaccuuuacacgauggaucaaccuucaucuggaaaaaugcaaucccccuuuggaggugaaggacuuauucguagauauucaagacgggaaaauccugauggcacuacucgaggugcuguccggacguaaccuucugcacgaauacaagucuucaagucauagaauuuuuagguugaauaacaucgccaaagcgcucaaguuccuggaggauagcaaugucaagcugguguccauagacgcugccgaaaucgcagaugguaacccaucucucguuuuaggccugauuuggaauaucauucuauuuuuccagaucaaagaguugacugggaaccugucgcgcaauucaccgagcaguucccuaucucccggaagcggcgguacggacuccgauucaaguuuuccuccaacccccacagccgagcggagcguggcuauaucugucaaggaccagagaaaagcaauuaaggcccuccuggcuugggugcagaggaaaacucggaaguaugggguagccguucaagauuucgcgggauccuggcgcucaggccuugcauuucuggccgugaucaaggcuauugacccuagcuuggucgauaugaaacaggcccucgaaaacaguacccgagagaaucuggaaaaggcauucucuaucgcucaggacgccuuacacaucccaagacugcucgagcccgaagacauuaugguggauacaccugacgagcaguccauaaugaccuacguggcgcaauuucuugagagguucccagaacuggaggccgaagauaucuuugacagcgauaaagaggucccgauugaaucgacuuucguucggaucaaggagacacccucugagcaggaauccaaaguguucguauugaccgagaacggcgaacguacguauacugugaaucaugagaccucacacccuccacccaguaaggucuuugugugugacaaaccugaaagcaugaaggaguuccgccuagaugggguuuccucucacgcacugagcgacucaaguacagaguuuaugcaucagauaauugaucaagugcuccagggagguccaggcaagacuuccgacaucagcgaacccucuccggagucaaguauccugagcuccagaaaagaaaacgggaggucuaacucgcuuccuauuaagaaaaccguccacuucgaggcugauacauacaaggaccccuuuugcagcaaaaaucuguccuuguguuucgagggaucaccacggguggccaaggaaagucuccgacaggacggccauguacuggcuguugagguggccgaagagaaggaacagaaacaagagucuagcaagaucccugaguccucaagcgauaaagucgccggugacauuuuucuuguggaagggaccaacaauaacucucaguccaguagcugcaauggagcacuggagucuacggcucgccacgaugaagagucccacucacuaagucccccaggcgaaaacacugucauggcggacagcuuccagauaaaggugaaucucaugacaguugaggcacuggaggaaggcgauuauuuugaggccaucccccuuaaggcuucgaaauucaacuccgacuugauugauuuugccucuaccagccaggcauucaauaaggugccuucaccacaugaaacuaaaccggacgaggaugccgaggcuuuugaaaaccacgccgagaagcuggggaaaagaaguaucaaguccgcacauaaaaagaaggacucucccgaaccucaaguaaaaauggauaagcacgagccacaucaggacagcggagaagaggcggaggguugucccuccgcuccugaagagacaccagucgauaaaaagcccgaagugcacgagaaagccaagaggaaaucaacccggccgcacuacgaagaggagggcgaagacgacgaucuccaggggguuggagaggaacugagcaguucuccuccauccagcugcgugucgcuugagacgcugggcucacauucugaagaggguuuggacuucaagcccaguccuccccucuccaaggucagcgugaucccacacgaucuguucuauuuuccucauuacgagguacccuuagcagccgugcuggaggcuuacguugaagacccagaagaucuuaaaaaugaggaaauggaccucgaggagccggaaggguauaugccugaucuggacucucgcgaggaagaggccgauggcagccaguccucaaguucuagcuccguccccggagagucacuuccaagugcaagcgaccaaguguuguaccuguccagaggcggggugggaaccacacccgcuucugaaccugccccacucgcgccccacgaggaucaccagcagagggaaacuaaggagaacgacccuauggauucgcaucagagccaagaaucaccgaaucuggagaacauugccaauccauuagaggaaaacgucaccaaagaguccauaaguucuaagaaaaaggaaaagcguaaacacguugaccauguggagagcucccuguucguggcucccgguucaguacagucuagcgacgaucuugaagaggacaguuccgauuauagcaucccuucucggacaucacacuccgacaguagcauuuacuugcgaagacauacucacaggucgucugaguccgaucacuuuagcuauguccagcuccgcaacgcagccgaccuggaugaccggagaaauaggauccuaacccgcaaggcuaacucaaguggcgaagccaugucucuggggucccauagcccacaaucagauagucucacacagcuggugcagcagcccgacaugauguacuucauuuuauuuuuguggcuguuaguuuauugucuccugcuuuucccucaacuggaugugagccgauuguga

SEQ ID NO: 54517 - RNA, 1122 nt, Artificial Sequence
  derived and/or modified sequence opt3 from CLMP__Homo_sapiens__NP_079045
augagccugcuccuucuguuguuacugguguccuacuaugucggcacccuagggacacacacugagaucaagagaguugccgaagagaaagugacgcuccccugccaucaccagcugggacuuccugaaaaggacacccuggauauugagugguugcucacagacaacgaagguaaucaaaaaguagugauaacuuacucuucaaggcaugucuauaacaaucugaccgaggagcagaagggccggguggcuuucgcaaguaacuuucuggccggggaugcgagccuccagaucgaaccauuaaaaccguccgacgagggacgcuacacauguaagguuaaaaauucuggccgauauguguggucgcacgucauucugaaggugcuuguacgucccucaaagccuaaaugcgaauuggagggugagcugaccgaagggagcgaucuaacucuccagugugagaguuccucuggaacagaaccaaucguuuacuauuggcaaagaauuagggagaaggaaggcgaggacgagcggcugcccccuaaaagccgcaucgauuacaaccauccaggcagagugcuucugcagaauuugaccauguccuacucagggcucuaucagugcacggcuggaaacgaagccgguaaggagaguugugucgugagggugacuguccaguacguucaaagcauaggcaugguggcaggggccguaaccggaaucguggcuggcgcacuguuaauuuuccugcucgucuggcuucugauccggcgcaaggacaaagaacgauaugaggaagaggagagacccaaugaaauuagggaggaugccgaagcuccuaaggcccgguuggugaaaccaucuuccucaagcagugguucucguuccagccgcucggggucuuccucaacaagaaguacugcgaacagcgcauccaggucucagcggacccuaagcacagacgccgcuccgcagcccggacuggccacccaggcauacucacucguuggcccugaggugcgaggcagugaaccaaagaaaguccaccacgcuaaucugacgaaggccgagacuacacccuccaugaucccuagccaaucucgcgcguuucagaccguguga

SEQ ID NO: 54518 - RNA, 1317 nt, Artificial Sequence
  derived and/or modified sequence opt3 from CLN3__Homo_sapiens__NP_000077
augggcgggugcgccggaagcagaaggcgguucuccgacucugagggugaagagaccgugcccgaaccucgccugccacuccuugaucaccagggcgcucauuggaagaacgcagucggguuuuggcuguugggauuauguaauaacuucucauacguugugaugcugagugccgcgcacgacauccuaagccauaaacgaacauccggcaaucaaucucacguagauccgggucccacuccuauuccacauaacucgucaagccguuuugacugcaauaguguguccacggcugccguccuccuggcagauauacuucccacccuggugaucaaguugcucgccccucuggggcugcaccucuuaccauauucucccagaguucuggugagcggaauuugugcugcaggcuccuucguccuuguggccuuuucacacaguguaggcacuagcuugugcgggguuguguucgcuucuaucuccucaggacugggugaggucacauuucuaagccucaccgccuucuacccuagggcggugauuaguugguggucuuccggcacagggggagcaggccugcuuggugcccugagcuauuuggggcucacccaggcuggacugucgccacagcagacuuuacugucuaugcucggcaucccggcccuucuguuggcauccuacuuucuacugcucacaucacccgaagcucaagacccuggcggggaggaggaagccgagagugcggcccggcagccacugauacgcaccgaagcacccgagagcaaaccuggauccucuagcucacuuagucugagagagagguggacgguguucaaggguuugcucugguauaucgucccacugguugugguauacuuugcugaauauuucauuaaccagggcuuauuugagcugcuauucuucuggaauacuucccucagccaugcccagcaauaccggugguaccagaugcuguaucaggcugggguguuugccucucgcucaagucuucgauguugcagaaucagguucaccugggcauuggcccugcuccagugucugaaccuugucuuucuguuggcugaugugugguucggauuucuccccagcauuuaccugguuuucuuaaucauacuguaugaaggccuacucgguggggcggcauacgugaauacauuucacaacauugcccuggagacuuccgacgaacaucgggaguucgcuauggccgcaaccugcaucucugauacacuuggcauuucguugagcggacugcucgcccugccguuacacgacuuucugugucaacuuuccuga

SEQ ID NO: 54519 - RNA, 1224 nt, Artificial Sequence
  derived and/or modified sequence opt3 from CLN5__Homo_sapiens__NP_006484
augagaaggaaccugcggcucggccccagcuccggggccgacgcucagggacaaggugcaccucgcccaggccuugccgcgccgcgaaugcuguugcccccugcuucucaggccucacgugggaguggaagcaccggcugcuccuuaauggcacaggagguggauacagcccagggugcugaaaugagaaggggagcaggggccgcucggggccgcgccucuugguguugggcgcuggcacuacucuggcuggccgucguuccaggcuggucgagagugucagggauccccagcaggcggcacuggccuguaccauacaagcgcuucgacuuucgacccaaaccugauccauauugccaagcuaaguacacuuucuguccgacgggaagucccauuccugugauggagggugacgaugacauagaagucuuuagacuucaggccccagugugggaguucaaauauggcgaucuguuggggcaucucaagaucaugcacgacgcaauuggauuuagguccacccugacaggcaaaaauuacacuauggaaugguaugagcuguuccagcucgguaacugcaccuuuccccauuuacggccugagauggaugcuccauucugguguaaucagggggccgcgugcuuuuucgaaggaaucgacgauguucacuggaaggagaacggcacacuggugcaagucgccaccauuucuggcaauauguuuaaccagauggcaaagugggugaaacaggacaaugaaacugggaucuacuaugagacauggaacguaaaggcuagccccgagaaaggagccgaaaccugguucgauuccuacgacuguucaaaguuuguucuucguacguucaauaaauuggcugaguucggugccgaauuuaagaacauagagacuaauuacacccgcaucuuccuguauaguggcgaaccgacauaccuagggaacgagacuagcguguuuggaccuaccggcaauaagacacucggucuggcaauuaaaagauucuauuaccccuuuaagccacaucuuccuaccaaagaguuccuguugucucuccugcagaucuuugacgccgucauugugcacaagcaauucuauuuauuuuacaacuucgaauauugguuucugcccaugaaauucccauuuaucaagauaacguacgaggaaauuccccucccuaucaggaauaaaacucuuuccgggcuguga

SEQ ID NO: 54520 - RNA, 936 nt, Artificial Sequence
  derived and/or modified sequence opt3 from CLN6__Homo_sapiens__NP_060352
auggaggccaccagaaggcggcagcaccugggcgcuacagggggacccggugcacaacucggcgccagcuuccuucaggcgcgccauggguccgugucugcugacgaagccgcacgaacugccccuuuucaccuggauuugugguucuacuuuacguuacagaacuggguccuggacuucggacguccaaucgcuaugcuaguuuuuccgcucgagugguucccccugaauaagccuucagugggcgauuauuuucauauggcauacaacguaauuaccccauuccuucuguugaaacucauagaaagaagucccaggacacugccucggagcaucacuuauguguccauuaucauuuuuaucaugggugccucuauacaccuggucggggacucggugaaucaucgccucuuauucucaggauaccagcaccaccugagcguuagagagaacccaaucauuaagaaucuuaaacccgaaaccuugaucgauaguuuugagcugcuauauuacuaugacgaguaccucggccauugcaugugguacauuccuuucuuucugauccuuuucauguauuucuccggcuguuuuacagcuucuaaggccgaaagccugauaccagggccggcguugcuccugguggcacccuccggauuauacuauugguaccuggucaccgagggucaaauuuucauccucuuuauuuucacauuuuucgccaugcuugcucugguguugcaccagaaaaggaagcggcuauuucuggauucaaacggccucuuccuguuuaguagcuucgcccuuacucuguugcucguagcacuguggguugcuugguuauggaaugacccugugcugcgcaagaaauauccaggggucaucuacgugcccgaaccuugggccuuuuauacccuacaugugucuucccgacacuga

SEQ ID NO: 54521 - RNA, 861 nt, Artificial Sequence
  derived and/or modified sequence opt3 from CLN8__Homo_sapiens__NP_061764
augaaccccgccagcgacggcgggaccuccgagucuaucuucgaucuggacuacgcuucauggggaauuagaaguacacucaugguggcagguuuugucuucuaucuuggcguuuuugugguaugccaccagcugagcuccucuuugaaugccacuuacaggucguuaguggcgcgggaaaaggucuucugggaucuggcugccacgcgcgcaguguuugggguucaaucaaccgccgcuggacuaugggcacuccugggcgacccugugcuucaugccgauaaagcucgaggucagcagaacugguguugguuccacauaacaacugccaccggguuuuucugcuuugagaaugucgcggugcaucugagcaacuugaucuuccguacauuugaccucuuccugguaauucaccaucuguuugcauuccucggauucuuaggcugucugguuaaucuucaggccggccacuauuuggcuaugaccacucugcuacucgaaaugaguacaccauuuaccugcguguccuggaugcugcuuaaggccggguggucugagagccuguucuggaaauugaaccaauggcucaugauccacauguuucauuguagaaugguccugacguaccacauguggugggugugcuucuggcauugggauggauuaguguccucacuguaucucccgcaccuuacucuguuuuuggucggucuagcacugcucacccugauuaucaaucccuacuggacacacaagaaaacucagcagcuucugaacccuguugacuggaauuucgcucagccagaagccaagaguaggcccgagggcaacgggcaauugcuccggaagaaacgcccuuga

SEQ ID NO: 54522 - RNA, 1287 nt, Artificial Sequence
  derived and/or modified sequence opt3 from CLNK__Homo_sapiens__NP_443196
augaacagacagggcaauaggaagaccacaaaagaggggagcaacgaccugaaguuccaaaauuuuucccuccccaaaaaccggucuuggccucgcaucaauucagccacuggacaguaccagcgaaugaacaagccacuucuggauugggaacguaauuucgcugcaguguuggacggugccaaaggccacagugaugacgauuaugacgauccggaguuaagaauggaagagacguggcagagcauuaagauacugcccgcgaggccuaucaaggaauccgaguacgcugacacccacuauuuuaaagucgccauggauacaccacuaccccucgacacucggaccucuauuucgaucgggcaaccuacauggaacacccagacucgccuggagagaguugauaagccaauuucaaaagacgugaggagccagaauaucaagggagaugcaaguguacggaaaaacaagauaccccuuccuccaccgcgcccccugaucacauugccuaagaaauaccagccacugcccccugaaccagaguccucucgacccccgcugagccaaagacacaccuucccugaagugcagaggaugcccucccagauuucacugcgggaccucagugaggucuuagaggccgaaaaggugccacauaaucagcguaaaccugagagcacgcaccuccuugaaaaccaaaauacucaggagauccccuuggcuauuucuuccuccagcuuuaccacaaguaaccauucuguucagaaucgcgaccacagaggcgguaugcaaccaugcucaccccagaggugucagccuccagcaagcugcucgccgcacgaaaacauccugcccuauaaguacacuucuuggcggccuccauuccccaaacgauccgaucgcaaggacgugcagcauaacgagugguauauaggggaguacucaagacaagccgucgaagaggcuuuuaugaaagaaaauaaggauggaaguuuccuagugagggacuguagcaccaaguccaaagaggaaccuuacguacucgccguguuuuaugagaacaagguuuacaaugucaaaauucgguuccuggagcgcaaccagcaguuugcgcuuggcacaggccugagaggggaugaaaaguucgacucuguggaggauaucauugaacacuauaaaaauuuuccaaucaucuugauugacggaaaggauaagaccggugugcauaggaaacagugccaccucacgcaaccccugccguuaacucgucaucugcucccucuuuga

SEQ ID NO: 54523 - RNA, 714 nt, Artificial Sequence
  derived and/or modified sequence opt3 from CLNS1A__Homo_sapiens__NP_001284
augagcuuccugaaguccuuucccccuccaggcccggccgaggggcuccuuagacagcaacccgacaccgaagcugugcugaacggaaaagguuugggcacagggacuuuauacaucgcagagucuaggcugucauggcuagauggaaguggccucgguuucagccuggaauauccuacgauuucccuucacgcccugucucgggaccgcucggauugcuugggggagcaucucuacgucaugguuaaugcgaaguuugaagaggagucaaaagaaccaguggcugacgaggaagaggaggauagcgacgaugacguagaacccauaaccgaguuccgauuugugccuagugauaaguccgcccuggaagcaauguucacagccaugugugagugccaggcucugcacccagaccccgaagaugaggacucugaugacuaugacggagaggaauacgaugucgaggcacaugaacagggccagggcgacaucccuacuuuuuauaccuacgaggaagggcucagccacuuaacagccgagggacaagcuacccuggagcgucuugaagguauguugucccagucagugaguagccaguauaacauggccggcguuagaacugaggauucuauuagggacuacgaagaugggauggagguggacacaaccccaacggucgcgggacaguucgaagaugcagacguggaucauuga

SEQ ID NO: 54524 - RNA, 2541 nt, Artificial Sequence
  derived and/or modified sequence opt3 from CLOCK__Homo_sapiens__NP_004889
augcuguucaccgugagcugcuccaagaugucuucaaucgucgacagagaugacaguagcauuuuugauggccucguugaggaagacgauaaagacaaggccaaaagggugucccggaacaagucugagaaaaagcgccgagaucaguucaauguacuuauaaaggaacuggggucgauguugcccggaaacgcucguaaaauggacaagucaacaguguuacagaaaagcaucgauuuucugagaaagcacaaagagauuacugcacaaagugacgccuccgaaaucaggcaggauuggaagccuacguuccuaucuaaugaggaguuuacccagcucaugcuggaagcgcuugacgguuucuuucuggcuauuaugacagauggcagcaucauauacgucuccgagucagugacuucauugcucgaacaucugccaagcgaccugguugaccaaucuaucuucaacuuuauuccggagggggagcacuccgaaguguauaagauccucucaacccauuuacuggagagcgauagucuuacacccgaauacuugaaaucuaagaaucagcuggaguucuguugccacaugcuacggggaaccauugacccuaaagaaccauccacuuaugaguacgucaaguuuaucggcaacuucaaaagccucaauucggugucuuccucagcccauaacgguuuugaggggacaauacagcgcacccacagacccaguuaugaagauaggguauguuucguugcaacggugcggcuggccacuccucaguucauuaaggagaugugcaccgucgaggaaccaaaugaagaguuuacaagccgccacucccuugaguggaaauuccuguuuuuggaccaucgagcucccccuaucauuggauaccucccauucgaagugcugggcacuucuggcuaugauuacuaccacguggacgauuuagagaaccuggcaaagugucaugaacaccucaugcaauaugggaagggaaaaagcugcuacuauagauuucuuaccaagggucagcaguggaucuggcugcagacacacuacuauaucaccuaccaucaauggaauaguaggccggaguucauugucuguacgcacacuguugugaguuaugccgaaguacgggcugagcgucgcagagaguugggcauagaagagucccuacccgaaacagccgcggacaaaagccaggauucugggucagacaacaggaucaauaccgugagucugaaggaggcacucgagcgguuugaucauagcccuacuccauccgccucuucgcgaagcucccgcaaaucaagucacacagcugucucugaccccagcuccaccccuacgaagauuccaaccgacacaucaacucccccgagacagcaucugccugcccacgaaaagauggugcaaaggcggagcucuuucuccagucagagcaucaacucucaguccguuggaucaagucuuacccagcccgugaugagccaagcaacaaaucugccaauaccucagggcaugucgcaguuucaguucuccgcucaauugggugccaugcagcaccucaaagaucagcuggagcagcgcacuagaaugauugaagcgaacauccauaggcaacaggaggaauuacguaagauccaggagcagcugcaaaugguccacgggcagggacuacagauguuucuccaacagucuaaccccggccugaauuucggcagcgugcagcuuucaagugggaacuccucuaauauucagcaauuggccccaaucaacaugcagggacagguaguucccaccaaucagauucaaagcgguaugaacacaggccauauagggaccacucagcacaugauccagcagcaaacgcugcaguccacaucaacccagagccaacagaaugugcucaguggacacucucagcagacuucccugccuagccaaacccagucgacacuuaccgcaccacuguacaacacuauggucauuucacagccggcugccggcucuauggugcagauccccaguuccaugccucaaaauagcacacagucugcugccgucacgaccuuuacucaggaccggcagauccgauucagccaaggucagcaguuggugacaaaacucguuaccgcaccaguggccugcggggcuguaaugguccccuccacaaugcugaugggccaggugguuacugcguacccuaccuucgcaacgcaacagcagcaaucacagaccuuaagugugacacagcagcaacagcagcagagcucucaagagcagcagcugacuuccguccagcaaccaucacaggcccagcuaacccaacccccgcagcaguuucuccagacaaguagacugcuucauggaaacccuagcacucaauugauucuguccgcugccuucccacuccagcagucuaccuuuccccagucgcaccaucaacagcaccagagccagcaacagcagcagcugucaaggcaucgcacggauuccuuaccugaccccaguaaggugcaaccacaguga

SEQ ID NO: 54525 - RNA, 1086 nt, Artificial Sequence
  derived and/or modified sequence opt3 from CLP1__Homo_sapiens__NP_001136069
augggcgaggaagccaacgacgauaagaaacccaccacaaaguucgagcuggaaagagagacugaacucagguuugagguggaggcuagccaguccguccaacuugaacuguugacggggauggcagagaucuucggaaccgaauuaacacggaauaaaaaguuuacuuucgacgccggugcgaaaguugcuguguuuaccuggcacggcugcucuguacagcugucagggcgcacagagguggccuacgucaguaaggauaccccuaugcuacucuaucugaacacucauacagcacuugagcagaugcgacgucaggccgaaaaggaggaagagagaggaccaagggugaugguugugggcccgaccgacgucgguaaaagcacggugugucggcuguugcucaauuacgcuauuacuucccgccuggcagauguauucaaccaaagaugcgaaguuaauaggcgggccucugugucggggugugucauaaauaccugcggaugggugaagggcucaggcuaucaggcucuggugcacgccgcgagcgcauuugaggucgacguugugguagugcucgaucaggagcgcuuauacaacgaacugaaacgagaccuuccccauuucgucagaacaguguugcugccuaagagugggggaguuguggagagguccaaagauuuucggcgugaaugucgcgacgagagaaucagggaauauuucuacgguuuucggggcugcuucuauccacacgccuuuaacgucaaguucucugaugugaagauuuacaaaguaggggcucccacuaucccugacagcugucuaccacucggaaugucccaggaggauaaucaacugaaacuuguucccgugaccccuggccgagacaugguccaucaccuguugucagugaguacagccgaggguaccgaagagaaccucagcgaaacgucugucgcaggguucauugugguuacuuccguggaccuggagcaccagguauuuacagucuuaucaccagcuccgcgcccccugccuaagaauuuccuccuuaucauggauauaagauuuauggaccugaaguga

SEQ ID NO: 54526 - RNA, 834 nt, Artificial Sequence
  derived and/or modified sequence opt3 from CLPP__Homo_sapiens__NP_006003
auguggcccggcauccuggucgggggagccagaguggcuagcugcagguacccugcacucgguccacggcuugccgcgcacuucccggcucagcgacccccucaacgcacccugcagaacggcuuggccuuacagcguugucugcaugcaacagccacuagagcucuaccacucauucccauaguuguggagcagacggggaggggagaacgggcauaugacaucuacucccgccugcuuagagagaggauuguaugcgugaugggcccuaucgaugacucugucgccucacuggugauugcucaauugcucuuucugcagagugaaagcaauaagaaaccaauccacauguauauaaacucccccggugggguugugaccgccggacuggcgaucuacgauacaaugcaguauauucucaauccuaucuguacuuggugcgucggccaggcagccucuaugggcucguuacugcuugcugccgggaccccaggaaugcggcauucauugccgaacagccgcauuaugauccaccaacccagugguggcgcacgagggcaggcuacagacauagccauucaggcggaggaaaucaugaagcugaaaaagcagcuauacaauauuuaugccaaacauaccaagcaaucccuccaggugaucgagucugcaauggagagagauagguacaugagcccuauggaagcucaggaguucggaauccuggacaagguacuuguucacccaccccaagauggcgaagacgagccuacucuggugcagaaagagccagucgaagccgcucccgccgcagagccggugccugccuccacauga

SEQ ID NO: 54527 - RNA, 216 nt, Artificial Sequence
  derived and/or modified sequence opt3 from CLPS__Homo_sapiens__NP_001239527
auggagaagauccugauucuccuucugguggccuugagcgucgcuuacgcagcccccggcccuagagggauaaucauuaacuuaacccuguauggaaucuacuauaaaugcccaugugaaaggggucuaacaugcgagggcgacaagacuauuguuggguccaucacgaauaccaacuucggaauaugucacgaugcgggccggucuaaacaguga

SEQ ID NO: 54528 - RNA, 1968 nt, Artificial Sequence
  derived and/or modified sequence opt3 from CLPTM1__Homo_sapiens__NP_001269104
augagcagaaaggcccacaucaccgagaaagugacauccaacggcucuauugggagggaucccccugcugaaacucagccacaaaauccgcccgcacagccugccccaaacgcguggcaggucauaaagggaguucuguuccggaucuuuauuaucugggcuauuucaaguugguuccgccgaggucccgccccucaggaccaagcaggcccagggggagcuccccguguggccagcagaaaucucuuuccuaaagacacgcuuaugaaccugcauguauacaucuccgagcacgaacauuucaccgauuuuaaugcaacaucugccuuguucugggagcagcacgacuuaguguauggcgauuggacuucgggugaaaacucagacgggugcuacgagcauuuugcugagcuggauauaccacagagcguccagcaaaauggaaguaucuauauucacguguacuucaccaaguccggcuuucacccggaccccaggcagaaagcccuauaucggcgccucgcgacaguucauaugucuagaaugaucaacaaguacaagaggcggcgcuuccagaaaaccaagaaucugcuuacuggcgaaacagaggcagauccugaaaugauuaaacgagccgaggacuaugggccaguggaggucaucagccacuggcaucccaacauaaccauuaauaucguggaugaccacacgccuuggguaaagggauccguuccacccccgcuggaucaguacgugaaauuugacgcugucucaggugacuacuauccuauuaucuacuucaacgauuauuggaauuugcaaaaggacuacuaucccaucaacgaaagucucgccagccugccacugagagugucuuuuuguccucucuccuuauggagguggcagcuguacgcagcucagucaacuaagagccccuggaauuuccuuggcgaugaguuguaugaacaaagugacgaggaacaggauucugugaaagucgcccugcuagagaccaacccauaccuccuggcgcuuacaauuauaguuuccaucgugcacagcguauucgaguuucuggccuucaagaacgacauucaguuuuggaacucgcggcagucuuuggaagggcucuccgugcguucagucuucuuuggaguguuccaaaguuuuguugugcuguuauacauccuggauaaugagacuaauuucgucgugcagguaagcguuuuuauaggcgugcucauugaccuuuggaaaaucaccaaggucauggaugugcgccuggacagagaacauagggucgcagguaucuucccccgguuguccuuuaaagauaagucuacauauauugagagcucaaccaaaguguacgacgacauggcuuuccgauaucuaaguuggauccuguuuccucuccuggggugcuacgccguuuauucccuucuguacuuggaacacaagggaugguauagcugggugcucucuaugcuguacggcuucuuacugacguucggcuuuauuacuaugacaccacagcuauucauaaacuacaagcucaaaucaguagcucaucugccguggcgcaugcuuaccuauaaggccuugaauacuuuuaucgaugaccuguucgcauuugucauuaaaaugcccgugauguacagaaucgggugucucagggaugacguuguguucuuuaucuaucuguaccagcgguggauuuaucgcgucgauccuacaagagugaacgaguucggaaugaguggugaggacccaaccgccgcugcgcccguagcagaagugccuacggccgcuggcgcccuuaccccaacacccgcaccgacuaccacaacugccaccagggaggaagcuagcacaucccugccuaccaagccaacucaaggggccucuucggcaagcgagccccaggaagcgccucccaaaccagcugaggauaagaagaaagacuga

SEQ ID NO: 54529 - RNA, 1617 nt, Artificial Sequence
  derived and/or modified sequence opt3 from CLPTM1L__Homo_sapiens__NP_110409
auguggagcggcagauccucuuucaccucacugguggucgggguuuuugugguauacgugguccacacaugcugggugauguauggaaucguuuacacuaggcccuguaguggugacgccaacugcauucagccuuaucucgcucggcgcccaaaacuucaacugagcguguacacgaccacacgaucccauuugggcgcagagaauaacauagauuuaguccugaauguggaagacuucgauguagagucuaaguuugaacguacuguuaacgugucggucccgaagaaaaccagaaauaacgggacacuauaugccuacaucuuccuccaccaugcgggagugcugcccuggcacgacggcaaacaggugcaucuugucucaccucugaccacuuauaugguuccaaagcccgaggaaauuaauuugcucacaggugagagcgauacccagcagaucgaggcugaaaagaagccuacgagugcccuggacgagccagugucccacuggaggccccggcuggcacucaacguaauggccgauaauuuuguguucgacgggucuagcuuaccugcugauguccaccgcuacaugaaaaugauucaacugggaaagacugugcauuaccuuccaaucuuguuuauagaccagcuguccaacagaguuaaagaucuaauggugaucaauaggucaaccacagaacucccgcugacugucaguuaugacaaggugagccuuggccggcugcgcuucuggauucacaugcaggaugcaguauacucuuugcagcaauuuggcuucuccgagaaagacgccgacgagguuaaggggaucuuuguggauaccaaccucuauuuccuggcuuuaacauuuuucgucgccgcguuccaucugcucuuugacuuccuugcauuuaagaaugauauuucauucuggaaaaagaaaaagagcaugaucggaaugaguaccaaagccgugcuguggcgauguuuuucuacggucgugauauucuuguuucuacuggacgaacagacuucccuccugguucuugugcccgcugguguaggcgccgcaauugagcuguggaaggucaaaaaggcuuugaagaugacaaucuucuggagagggcucaugccugaauuucaguucggaaccuacagcgagucggaaaggaaaacugaggaguaugauacacaggccaugaaguaccugucuuauuuacuguacccacuaugcgugggcggugcgguuuacucccuccugaacauuaaauauaagucaugguacaguuggcuuaucaauagcuuugugaacggggucuaugccuucggauuuuuguucaugcugccccaacucuucgugaacuacaaacugaaguccguagcacaccuuccuuggaaggcuuuuaccuauaaagccuucaauacguuuaucgacgauguguucgcuuuuauuauaaccaugccaacaucucaccggcuggccuguuuccgugacgauguugucuuuuugguguaccucuaucagcgcuggcuguaccccguggacaagagaagggucaacgaguucggcgaaagcuacgaagagaaagcaacucgggccccgcauaccgauuga

SEQ ID NO: 54530 - RNA, 738 nt, Artificial Sequence
  derived and/or modified sequence opt3 from CLRN1__Homo_sapiens__NP_001182723
augcccagccagcaaaagaaaaucauuuucugcauggccggcguguuuuccuucgcuugugcacugggggucguuaccgcccucggaacaccucuuuggauaaaggcgacugugcugugcaaaacgggugcuuuguuaguaaacgccucuggccaggagcuggacaaguuuaugggggaaaugcaguacggacuauuccacggcgagggugugagacagugugggcucggagcaaggccauuucgguucucauuuuucccggaucugcuuaaagccauccccgucaguauucaugugaauguuauccuguuuagcgcuauuuugaucgugcucaccauggucggcacagcauucuuuauguauaacgccuucggcaagccuuuugaaacucugcacgggccacugggacucuacuuacuguccuucauaucuguggcucuuugguugcccgccacccgccaucaagcgcaggguucgugcggcugucugguaaugauccuauucgcaucagagguuaagauucaccaucucagcgagaaaaucgccaauuauaaggaagggacauacguguauaaaacccagagugagaaguacacuacauccuuuugggucauuuucuuuugcuucuuugugcacuuccugaacggacuucugauccgauuggcuggcuuucaguucccuuuugccaaaucuaaggacgcagaaaccacgaauguggcugccgaucucauguauuga

SEQ ID NO: 54531 - RNA, 3999 nt, Artificial Sequence
  derived and/or modified sequence opt3 from CLSPN__Homo_sapiens__XP_011540241
augaccggcgagguggggagcgaaguccaccuggagaucaacgaccccaauguuauuucccaggaagaggccgauucuccuucagacaguggacaagguagcuacgaaacaauaggcccacucuccgagggggauucugacgaggaaaucuucgugucgaagaaacuuaagaacagaaaaguacugcaggauucagacagcgagacugaagauacgaaugcuaguccggagaagaccacauaugacuccgcagaggaagagaacaaagaaaauuuguacgccggaaagaacacuaagauuaaaaggaucuauaagaccguggcggauucugacgagagcuacauggaaaaauccuuauaucaggagaaucuggaggcucaggucaagcccugccuagaacucucacugcaaaguggcaacagcacagauuuuaccacugaccggaaaucuuccaagaagcauauucacgauaaagaggguacagccgggaaggcaaaagugaagucaaaacgccgacuugaaaaggaggaacguaaaauggagaagaucagacagcugaagaaaaaggagaccaaaaaucaggaagacgacguugagcagccuuucaacgauagcggauguuugcucguggacaaggaucuguuugaaacgggccuggaggacgaaaauaacaguccacucgaggaugaggaaucuuuagaguccauaagggccgcugucaaaaauaaggugaagaaacauaagaaaaaggaacccagccuggagucgggcguacacucuuucgaggaaggguccgagcuuucaaaaggaacuacccggaaggaacgcaaggcagccagauugaguaaagaggcucugaagcaacuacauagcgaaacacagaggcucauccgggaguccgcccugaaccuuccuuaccacaugccagagaauaaaacuauucacgacuuuuucaagcgcaaaccccgaccuaccugccaugguaacgcgauggcacuguugaagucuagcaaguaucagucaagucaccauaaagaaaucauugauacagccaacaccacggagaugaauagcgaccaccacagcaagggcucugaacagacuacaggggcugagaacgaaguugagaccaaugcccucccaguggucucaaaagagacucaaaucauaacaggaagugaugaaagcuguagaaaggaccuggugaaaaacgaggaauuagagauucaggaaaagcagaaacaauccgauaucaggccgucucccggcgacucgagcgugcugcagcaggaguccaauuuucucgguaacaaucauucagaggaaugccaggucgggggacuuguugcauucgagccucacgcucuggaaggcgagggcccacaaaaccccgaggaaaccgacgagaagguggaggagccugaacagcagaauaagaguucugccguagggccacccgagaaagugcggcguuuuacguuggaucgccuaaagcagcugggagucgacgugagcauuaaaccgagacucggugcggaugaggacuccuucguuauccuggaaccugagaccaacagggaacuugaggcccugaagcaacgguuuuggaaacaugcaaaucccgcugccaagccacgagcuggccagacagugaacgucaaugugaucguaaaggauauggggacugacggaaaagaagaguugaaggccgauguugugccugucacccucgcacccaaaaagcuggacggcgccucacacacaaaaccaggugagaaguuacaggugcugaaggcuaaacuacaggaagcgaugaagcuccgcagauucgaggaaaggcaaaaacggcaggcacuguuuaaguuggauaacgaggacggguucgaagaggaggaagaggaagaggaggaaaugacugaugagagcgaagaggacggcgaagagaaagucgagaaggaagagaaggaagaggaauuggaggaggaagaggaaaaagaggaagaggaggaagaggaaggaaaucaggagaccgccgaguuccugcucucuuccgaagagauugaaacaaaggaugagaaagaaauggacaaggagaacaacgacggcaguagcgagauagggaaagcugugggauuucugucuguucccaagucccuuucaagugauagcacccugcuucucuucaaagacucguccucuaagauggguuacuuuccuacugaagaaaagagcgaaacggaugaaaauucaggcaaacagccaaguaagcuggacgaagaugacuccuguucuuuacugacaaaagagagcucccauaacucauccuucgagcuaaucgggaguaccauuccgucuuaccaacccugcaaucgccagacuggaagaggcaccuccuuuuucccuacagccgguggguuuaggagcccaucgcccggccucuuccgugcaucacuggugucuagugccuccaagagcucuggaaaacuuagcgaaccuuccuugccaaucgaggauucacaggaccuguauaacgcuagucccgaaccgaagacccucuuucugggcgccggggauuuccaauuuuguuuagaggacgauacucagagccagcugcuugacgcagauggauucuugaauguacggaaccaccgaaaucaguaccaagcgcucaagccuagacugccacuagcuucuauggacgaaaacgccauggacgcaaauauggaugagcugcucgaccugugcacagguaaauuuacgucccaggccgagaagcaccuucccaggaaaucagauaagaaagaaaacauggaggaauugcugaauuuauguaguggcaaguucaccagccaggacgcuuccacuccugccucuucggagcucaacaagcaggagaaagaaagcucaaugggggaucccauggaggaagcacuggcucuuugcuccggaaguuucccaacagacaaggaggaagaggaugaggaagaggaauuuggcgacuuccgccuggucucuaaugauaacgaguuugacagcgaugaagacgagcauuccgacucagguaaugauuuggcccucgaggaccacgaagaugacgaugaggaggagcugcuaaaacggucugaaaagcugaaaagacaaaugaggcuccgcaaguaucuggaggacgaggcggaagugagcgggagugauguuggcuccgaggacgaauacgauggagaggagauagacgaauaugaggaagaugugauugacgagguccuuccuagcgaugaagaguugcagucucagaucaagaaaauccauaugaagaccaugcuggacgacgauaaacgacaguuacggcucuaccaagagcguuaucuggccgacggcgaucuucacucagacgggcccggaagaaugaggaaguuccgcuggaaaaacauugaugacgcuucccagauggaucuguuucaccgggacagugaugacgaucagacagaggaacaacuagacgaaagcgaggcaagauggaggaaggaacgaaucgagcgcgagcaguggcuccgggauauggcccagcagggcaagauuacugcugaagaggaagaggaaauaggugaggacucgcaauucaugauccuggccaaaaaggugaccgcaaaagcguugcagaagaacgccucuagaccaaugguaauucaggaguccaaaagccuguuaaggaauccguuugaagcuauccguccugggucagcccagcaagugaagacgggaagucuccugaaccagcccaaagcaguucuucagaagcuggcugccuugucugaccauaauccauccgcaccccgcaacagccggaauuucgucuuucacacccucucaccugugaaggccgaggcugcgaaagaaaguagcaagucccagaaaaucccagagaaggauucugacuggcugacauggagcggcgcccccauuccugguuucuuuagacuauccuucgauccgcauggcuga

SEQ ID NO: 54532 - RNA, 2889 nt, Artificial Sequence
  derived and/or modified sequence opt3 from CLSTN1__Homo_sapiens__NP_001289812
augcugagaaggcccgccccugcucucgcaccagccgcgcggcuucuguuggcuggcuuacugugcgggggaggugugugggccgcacgcgucaacaagcacaaaccguggcuagagcccaccuaccauggcaucguuacagaaaaugacaacacugugcuccuggauccuccacuuauugcccuggacaaggaugcucccuugcgauucgcagagagcuuugaaguaacggugaccaaagagggggaaauauguggauucaagauccacggccagaaugucccuuuugacgccgugguuguggauaaauccacaggugagggggucauucguucuaaggagaagcucgacugcgaacugcaaaaagauuauucauucacuauccaggcuuacgacuguggaaagggcccagauggcaccaacgugaaaaagagucauaaagccacaguacacauucagguuaaugacgugaacgaguaugcgcccgucuuuaaggaaaagagcuacaaagcaaccgugaucgaggggaagcaguaugauuccauacugagaguggaggccgucgacgcugauugcucuccucaauucucgcagaucuguucauacgaaauuaucacuccagacguuccguuuacaguggacaaagauggauauauuaagaauaccgagaaacucaacuacgguaaggaacaucaguacaaauuaacgguaacugccuaugacugcggcaagaagagggcaaccgaggaugugcuggucaaaaucagcauaaagcccacauguacuccuggguggcagggauggaauaaccggauugaauacgagccaggcaccggugcucuugccguguuccccaauauccacuuggagacaugcgacgaaccuguugcgagugugcaagccaccgucgagcuggaaacgucccacauugggaaaggaugugaucgcgacacuuauucugaaaagagccuacauagacucugcggcgcagcugccggcacagcugaacugcuuccaucccccucagggagucugaacuggaccaugggauugccgacugauaauggucacgacagcgaucagguguuugaguucaacggcacacaggccguaaggaucccugacgggguugugucugucucccccaaagagccauuuaccaucucaguguggaugcggcauggaccuuucggccgcaagaaggaaacgauucucuguagcagugauaaaaccgacaugaaucgacaccacuacucucuguauguccaugguugcagauuaauauuucuguucaggcaggaccccuccgaggaaaagaaauaccggccagcagaguuccacuggaagcucaaccaagugugcgaugaagaguggcaucacuauguucuuaacguggaguuucccagcguaacacuguacgucgacgggacuucgcaugaaccuuucucugugaccgaggauuacccauugcacccguccaaaaucgaaacacagcuaguugugggcgccuguuggcagggaggcgaccugcacaugacucaauuuuuccgugggaaucucgcuggacugacccuucgcucagguaagcuggcggauaagaaagucauugacugcuuguauacauguaaggagggccucgaucugcaaguguuagaggacagugggagaggaguacagauccaggcacaucccagccagcuggugcuaacccucgaaggcgaggaucugggugaacuugacaaagccaugcagcacauauccuacuugaacucuaggcaguuuccuacuccagggauucggcgacugaagaucacgagcacaaucaaaugcuucaaugaggcuaccuguauuucaguucccccugucgauggcuaugugauggugcuccagccagaggagcccaagaucagucuguccggaguccaucacuuugcccgcgcagccagcgaguucgaaucuucagagggcguuuuucuuuucccggaacugagaauuauaaguacuaucaccagggagguggaaccugagggggacggagcugaggauccaacagugcaagaaagccugguauccgaggaaauuguccacgaccucgauaccugcgaggugacuguugaaggugaggagcugaaccaugaacaggagucuuuagaaguggacauggcccggcugcagcagaagggcaucgaggucucgagcuccgagcuagggaugacauuuacgggaguggacaccauggcaucauacgaagagguucuccacuugcuucgcuauagaaauuggcaugcgaggaguuugcuggaucguaaauucaagcucaucuguucugaacugaacggccgguacauuagcaaugaguuuaaaguggaaguaaacgucauacacacugcuaaucccauggagcaugccaaccacauggcagcccaaccucaguucgugcaccccgagcaucgauccuucguggacuuaucaggucacaaucuggcuaacccacauccuuuugccgucguucccagcacagcaaccgugguaaucguggucugcgugucuuuccuuguuuuuaugauuaucuuggggguguucagaauuagggcugcccaccgccggacaaugagagaucaggacacuggcaaggaaaaugagauggauugggacgauuccgcgcucaccaucacggucaacccaauggaaaccuaugaggaccagcauaguagcgaagaggaggaagaggaagaggaagaggaggaaucugaggauggagaagaggaggacgauauaacauccgccgaaucagagaguagcgaagaggaagagggcgagcaaggggacccgcagaaugcuacuaggcagcaacagcuggaaugggacgauucgacccuauccuacuga

SEQ ID NO: 54533 - RNA, 2868 nt, Artificial Sequence
  derived and/or modified sequence opt3 from CLSTN2__Homo_sapiens__NP_071414
augcugcccggcagacucugcugggugccucuucuguuggccuuaggggucggaagcgguuccggcgggggaggcgacucuaggcagcggcgccugcuagcugcaaagguuaacaaacacaagccauggaucgagaccucauaccauggugugauuacagaaaauaacgauacuguaauacucgacccgccccugguggcccuugauaaagacgcgccugucccauucgcuggggagaucugugccuuuaagauucacggacaagaacugcccuucgaggcagugguuuugaauaaaacgaguggcgaaggccgacuccgugccaagagcccuaucgauugcgagcugcagaaggaguauaccuuuauuauccaggcuuacgacuguggggcaggaccacaugaaacagccuggaaaaagucccacaaagcugugguccauauacaggugaaggauguaaacgaguucgcccccacuuuuaaagaaccugcguauaaggcaguugugaccgaggguaagaucuacgacucuauucugcaagucgaggccaucgaugaagacugcucgccacaguauucacagauuuguaauuacgagaucgugacaaccgaugugccguucgcuauagacagaaacggcaauauuaggaacacugaaaaacucagcuaugauaagcagcaccaauacgagaucuuagucacagccuacgacugcgggcagaaacccgcagcucaggacacccugguucagguggauguaaagccuguguguaaaccaggauggcaagacuggacgaagcggauugaauaucagcccggcagugguuccaugccucuuuuuccaucuauccacuuggagacuugcgauggggccgucagcucccugcagaucgugaccgagcuacaaacaaauuacauuggaaaaggcugugaccgcgaaacuuauucagagaagagucuccagaagcugugcggcgcgagcucugggauaaucgaucuucugcccuccccgucagccgcaaccaacuggacagcuggauugcucguugacagcagugaaaugauuuucaaauuugaugguagacagggcgccaaggugccugacgggaucguccccaaaaaucugaccgaucaguucacgauaacuauguggaugaagcauggaccaucuccuggcgugagggcugagaaagaaacaauuuuauguaacuccgacaagaccgagaugaaucggcaccauuacgcccuguauguacacaacugccgccucguuuuucuucugcgaaaggauuucgaccaagcagacacuuuuagacccgccgaguuccacuggaaauuggaucagaucugcgacaaggaauggcauuacuaugugaucaaugucgaguucccaguggucacacuauacauggauggugcuaccuacgaacccuaucuggugacgaacgacuggccuauucacccaagccauaucgcgaugcagcucaccguuggggcauguuggcagggcggagaggugacaaaaccgcaauuugcccaguucuuucacggcucgcuggcuucucuuacuauuaggcccgggaagauggaaucccagaaaguaauaucaugccugcaggccuguaaggagggauuggauaucaacagucucgagagccugggucaaggcauuaaguaccauuucaauccuucccagucuaucuuagucauggaaggggacgauaucggaaacauuaaucgggcacugcagaaagugagcuauauaaacucacgucaguuuccaaccgccggcguucgcagacuaaaggugaguuccaaaguccaaugcuucggugaggacguguguaucagcauucccgaaguagaugcuuacgugaugguucuccaggccaucgagccuaggauuacacugcgggggacugaccacuuuuggcgaccagcagcgcaguucgagucugcucgcggcgucacccuuuuucccgauaucaagauagugucaacauucgccaaaaccgaagcaccgggagacgugaagacuacggauccuaagagugaggucuuggaagagaugcugcacaaucucgacuuuugcgacauccugguuauuggcggggaucuugacccaagacaagaaugucuggaguugaaccauagcgagcuccaccagaggcaucuggaugccacaaauuccaccgcuggauauucuaucuacggugugggcucgaugagccgguaugaacagguguuacaccacauucgcuacagaaacuggaggcccgccucccuggaggcacgucgguuccgaaucaaaugcucagaacuaaaugggagauacaccaguaacgaguuuaaucucgaaguaucuauacugcaugaggaccaggucagcgauaaggagcacgugaaccaucuuauuguucaaccucccuucuugcaguccgugcaccauccagaaucaaggagcucuauccagcacuccagugucgugccuagcauugcuacuguugugaucauaaucucuguauguaugcuggucuucgugguggccaugggagucuaucgcguucggauugcgcaccagcauuuuauccaagagacagaagccgcuaaagaguccgaaauggacugggaugacucagcacucaccauuacugugaaucccauggagaagcacgagggcccaggucauggggaagaugagacagaaggcgaggaggaagaggaagccgaggaagagaugaguagcucguccggaucugacgauagcgaggaagaggaagaggaagagggcauggggagaggaaggcacggccagaacggugcucgccaggcccagcuggagugggacgauucaacguuaccguacuga

SEQ ID NO: 54534 - RNA, 711 nt, Artificial Sequence
  derived and/or modified sequence opt3 from CLTA__Homo_sapiens__NP_001070145
auggccgagcuggaccccuucggcgcuccugcaggggccccaggagguccggcgcucggcaacgggguggcuggagccggcgaagaggaucccgcagccgcuuuucuugcacagcaagaaagcgagaucgccgguauugaaaaugacgaggcuuucgccauacuggaugggggagcgccuggcccacagccccacggcgagccuccagggggacccgacgcagucgaugguguuaugaacggcgaauacuaucaggaguccaaugggccuaccgacucuuacgccgcuaucucacagguggauagauugcaaagugaaccagagagcauuaggaaguggcgggaggaacagauggagcgcuuagaagcccuggacgcaaacucccgaaaacaggaggcugaauggaaggagaaagccaucaaggagcuagaagagugguaugcgcgucaggaugaacaacuccagaaaacaaaggccaauaacagaguagcagacgaggcuuuuuacaagcagccguucgccgaugugauuggauaugucgcugccgaagaggcauuugugaaugacaucgaugagucuucgcccggcacugaaugggagaggguugcccggcugugcgacuucaacccuaaaucaagcaagcaggcuaaagacgugagucgcaugagauccguccuuauaucucugaagcaagcgccauuggugcauuga

SEQ ID NO: 54535 - RNA, 5028 nt, Artificial Sequence
  derived and/or modified sequence opt3 from CLTC__Homo_sapiens__NP_004850
auggcccagauccugcccauuagauuccaagagcaccuccagcuucagaaccugggcauaaauccugcuaacaucggguuuagcaccuugacaauggaauccgacaaguucauuugcaucagagagaaagugggagaacaggcacaagucguuauuaucgauaugaaugacccaucuaacccgauucggcgccccaucucagccgauagugcgauuaugaauccugcuagcaaggugaucgccuuaaaagcagguaagacucugcagauuuuuaacaucgagaugaaauccaagaugaaggcccauacgaugaccgacgauguaacauucuggaaauggauaucucuaaauacuguggcucucgucaccgacaacgcaguguaccacuggucgauggaaggcgagucacagccaguuaagauguuugaucgacauagcagucuggccgggugucagauuaucaauuaucguacagacgcuaaacaaaaguggcuucuguugaccggaauuuccgcccagcagaacagaguggucggcgcgaugcagcucuacucuguggauaggaaaguaagccaacccaucgagggucacgcagccuccuucgcucaguuuaagauggaagggaaugccgaggaaucaacucuguucugcuuugcaguucggggacaggcuggcggcaagcugcauaucauugagguggggacaccuccaaccggaaaccaacccuucccuaaaaaggccgucgacguguuuuucccaccggaggcgcagaaugauuuucccguggccaugcagauaagugaaaaacacgacgucguuuuccucaucacgaaguaugguuacauucacuuauaugaucuggagacuggcaccuguaucuacaugaaccgcauaagcggggaaacaauuuucgugacugcaccucaugaggcuaccgccggaaucaucggcguaaauagaaaaggucaggugcuuucugucugcguggaagaggagaacauuaucccauauauuacaaacguuuugcaaaaucccgaccuggcucuaaggauggccgugcggaacaaucucgcaggggccgaggaacuguuugcucgcaaguucaacgcgcuuuuugcacagggaaauuacuccgaagccgcuaaagucgccgcaaacgccccuaagggcauacugcgaaccccagacacgaucagaagguuccagucagugcccgcucagccgggccaaacuagcccuuugcuccaguacuuugggauucuguuagaucagggacagcugaauaaguaugagagucucgaacuuugucggcccguacugcaacagggucguaaacaguugcuagagaaguggcugaaagaggacaagcucgaaugcucugaggaacugggcgaucuuguuaaauccguggacccaacacuggccuugagcgucuaccuccgcgcaaacgugccuaauaaggucauccaguguuucgcggagaccgggcaagugcagaagaucguucuguaugcuaaaaaggugggauacacucccgauuggauauuuuuacugagaaacguaaugaggauaucgccagaccagggccaacaguucgcccagaugcuaguccaggaugaggaaccccucgcagacaucacacaaauuguggauguuuuuauggaguauaaucugauccagcagugcaccgccuuccuuuuggacgcucugaaaaacaaucggccuucugaagguccacuccagacgcgacugcuugagaugaaccugaugcacgccccgcaaguggcagaugcuauuuuggggaaucagauguuuacccauuacgaccgcgcccacaucgcgcagcucugugaaaaggccggccuguuacagagagcucuggagcacuucacagaccuauaugauauaaaaagggcagucgugcauacucaccuccugaaccccgaguggcuuguaaacuacuuuggauccuugucaguggaagacagucuggagugccuccgggccaugcugagcgcuaauauccgccaaaacuuacagauuuguguucaggucgccuccaaguaccaugaacaacugucuacccagagccuuaucgaguuguucgaaucauucaagaguuuugagggccucuucuauuuucugggguccauugugaauuucagccaggauccugacgugcacuuuaaauacauccaggcagcgugcaagacaggacaaauaaaagaggucgaaagaauuugcagggagucuaacuguuaugauccagaacguguuaagaauuuccuaaaagaggccaagcugacugaccagcucccccugaucauugugugcgaucgguuugacuucgugcaugaucuuguauuguaccuguaucgaaacaauuuacagaaguacaucgaaauauauguccagaaagugaacccuucaagacucccaguugugaucgguggccugcuugacgucgauuguagugaggacgugauuaagaaucugaucuugguugugagggggcaauuuagcaccgaugagcucguagcugaagucgagaaacgcaaccggcugaagcuacugcuccccuggcuggaagccaggauucacgagggaugcgaggaaccggcaacacacaaugcucuugccaaaaucuacauagacuccaacaauaacccugagagguucuugcgcgaaaauccauacuaugacucucgaguggugggcaaguacugugagaaacgggauccccaucuggcaugcgucgccuaugaacguggucagugugacuuagagcucauuaacguuugcaacgaaaauucgcuguuuaagagccuuuccagauaccuggugaggcgcaaggauccugaacuaugggggucaguacuccuggagaguaaccccuaucggagaccauugaucgaccaggugguccagaccgcucugucugaaacucaagauccugaggaagugagcguuacggugaaagcguucaugacagccgacuuacccaaugagcucaucgagcugcuugaaaagauuguccuggauaacuccguguuuucagagcacaggaauuugcagaaccuccugauccuaaccgcaauuaaagcugaccgaacucgcguuauggaauacauaaaucggcuggauaacuaugacgccccagauaucgccaauauugcuaucagcaacgagcuuuucgaagaggcauucgccauuuuuagaaaguucgacgugaauaccucugcgguccagguacucaucgagcauauaggcaaccuggauagggcuuacgaauuugccgagcguuguaaugaaccggcaguguggucccaguuggccaaagcucaacugcagaagggaaugguuaaggaggcaaucgacaguuacauuaaagccgacgauccuagcucuuauauggaagugguccaggcggcuaacacauccggcaauugggaggaguuagugaaguaccuccaaauggcccgcaaaaaggcacgggaaucauauguagagaccgaacugaucuucgcccuugcuaaaacuaacagacuggccgaguuggaggaauuuauuaacgggcccaauaacgcacacauccaacaggugggagacaggugcuacgaugagaagauguaugacgcugccaagcuccuguacaauaacgucaguaauuucggucgacuagcgagcacacugguucaccuuggcgaauaucaggccgcaguggauggggcucggaaagccaacucgacgcgcaccuggaaggagguguguuuugcuugcgucgacggaaaagaguucagacucgcacaaaugugcggccugcauauagugguucacgccgaugaguuggaggaauuaauuaauuacuaccaggacagggguuauuuugaggaacugaucacuaugcucgaggccgcucuggggcuugaacgggcgcauaugggcauguucacagagcuggcaaucuuguacuccaaguuuaaaccacagaagaugcgagagcaccuagaacuguucuggucuagaguaaacauucccaaggugcuccgcgccgcugagcaggcccaucugugggcagaacuugucuucuuauaugauaaauacgaggaauaugacaaugccauaaucaccaugaugaaccacccuacagaugcuuggaaggagggacaauuuaaagacauuaucacuaagguggcgaauguugagcuguacuauagggccauucaguucuaccucgaauuuaaaccauugcugcucaacgaccugcuuauggugcugagcccccguuuggaucacacccgggcagucaauuacuucucaaaggugaaacagcuaccucugguaaagccguaucucagaaguguccagaaccauaauaacaaguccgugaaugagucuuuaaacaaccuguuuaucacggaagaggacuaccaagcucuuaggaccagcauagaugccuaugacaauuucgauaacaucucccuggcacagcgccucgagaaacacgaauugauugaguuucgaagaaucgccgcuuaccuguucaagggcaauaaccgguggaaacagucaguugaacucuguaagaaagacagccuguauaaggaugccaugcaauacgcgagugagucuaaggacacagaacuugcagaggagcuacugcagugguuuuugcaggaagagaaaagggaaugcuucggggccuguuuauuuacuugcuaugaucugcuccgcccagacgugguccuggagaccgcuuggcgucauaauauuauggauuucgccaugcccuacuuuauccaggugaugaaggaauaccuuacaaaaguugacaagcuggaugcuuccgagagccucagaaaagaggaggaacaggcaacugaaacccagccuauaguguauggacagccacaguugaugcugacggccggccccucggucgcugugccuccgcaagcccccuucgguuacggguauacagcaccaccuuacggacagccccagccaggcuucgguuauucaauguga

SEQ ID NO: 54536 - RNA, 4752 nt, Artificial Sequence
  derived and/or modified sequence opt3 from CLTCL1__Homo_sapiens__NP_001826
auggcccagauccugcccgugagauuccaagagcacuuucagcuccagaaccuuggcauuaauccugcuaacauaggguucagcacccugacaauggaauccgacaaguuuaucugcauuagggagaaagucggagaacaggcacaaguuacuaucauugauaugucugacccaauggccccgauccggcgccccauaucagcggagagugcuaucaugaauccugccagcaaggugauugcauugaaagccgguaagacguuacagaucuucaacauugaaaugaaauccaagaugaaggcucauaccauggcagaggagguaaucuuuuggaaaugggugucugucaauacaguggcccugguuacugaaaccgcuguguaccacuggucgauggagggcgauucacagccaaugaagauguucgaccgacauacaagccuagucgggugucaggugauacacuaucguaccgaugaauaccaaaaauggcuccugcuuguaggaauuagugcccagcagaacagaguugugggcgcgaugcagcuguauuccgucgacaggaaggugucucaacccaucgagggucaugcagccgcuuuugccgaguucaaaauggaagggaaugcaaagccugcuacuuuguuuugcuucgccgugcggaacccaacaggaggcaagcuccacauuaucgaggucggccagcccgcggccgggaaucagccuuuuguuaaaaaggcaguggauguauucuuuccaccggaagcucaaaacgacuuccccguggccaugcagaucggagcuaaacacggugucauuuaccugauaaccaaguauggcuaccugcaucucuaugauuuagagagcgggguguguaucugcaugaaucgcauuuccgccgacacgaucuucguuacugcaccucacaaaccaaccucaggaauaauuggcgugaacaagaaaggucagguccugaguguguguguagaagaggauaauaucguuaacuacgccacaaaugugcuucagaaccccgacuuggggcugagacuagcugucaggagcaaccucgcgggagcagagaagcuguuugugcggaaguucaauacucuuuuugcccaaggcucuuacgcugaagccgcaaaagucgccgcuuccgccccuaagggcauccugcgcacccgagagacagugcagaaauuccagucaauuccagcacagagcgggcaagcgagucccuugcuccaguauuuuggaauccuguuagaucagggucagcugaacaagcucgaaucucuugagcugugccauuugguucuacaacagggcagaaaacagcugcucgaaaaguggcugaaggaggacaaacuugaguguuccgaagaacugggggacuuggugaagaccacggauccgaugcucgcucugagcguauacuuaagggccaaugucccuucgaaagugauucagugcuucgcagaaacuggacaauuucagaagauaguucuguaugccaaaaaggugggcuacacacccgacuggaucuuccuacuccggggugucaugaagauuucuccagagcaggggcugcaauuuucccguaugcuugugcaggaugaagaaccuuuggcuaacaucucacagaucguagacauuuucauggagaauagucugauacagcaauguaccagcuuucuccuggaugcccuuaaaaacaaucgccccgcagaaggccuguugcagacuuggcuccuggagaugaacuuagugcacgcuccacagguugccgacgcgauccugggaaauaagauguucacacacuaugauagagcccauauugcucagcuaugcgaaaaagcaggccuccugcaacaggcccuugagcacuacaccgacuuguaugauaucaagagggcugucgugcauacgcaucugcucaaccccgaguggcuggugaacuuuuucggguccuuaucugucgaagacagcguugagugucugcacgccaugcuuucagcaaauauucggcagaauuugcagcucugcgugcaaguggcgaguaaauaccacgaacagcugggaacccaggcccuaguagagcuguucgaauccuuuaagagcuacaagggucucuucuauuuucugggcucuaucgucaacuucucacaagauccugacgugcaccuuaaauacauacaggcugccugcaagacagggcagaucaaagagguugagcgaauuugucgcgaaaguagcugcuauaauccagagagagugaagaacuuuuugaaagaagcaaagcugacugaccaguuaccgcucaucauugucugugauagguucggauuugugcaugaccugguucuuuaccuguaucggaacaauuugcaacgcuacaucgagauauaugugcagaaaguaaaccccuccagaaccccugcugucauuggcggucuccuggauguggacugcucugaagaggugaucaagcaccuaauuauggccgucagggggcaguucucgacagaugagcugguugcagaaguggagaagcguaaucggcucaaacugcuuuugccauggcuggaaagccagauccaagagggcugugaggagcccgccacucauaacgcuuuagcgaagauauacaucgacuccaauaacucaccugagugcuuucuccgagaaaaugccuacuaugauaguucuguagugggaagauacugugagaaaagggacccacaccuggcaugcgucgcuuaugaacgcggccagugugaucuugagcugauuaaggugugcaacgagaauagccuauucaaauccgaagcccgguaccucguuuguagaaaggaccccgagcugugggcccacguguuggaagagaccaacccgucaaggcgccagcugaucgaucaggucgugcaaacagcuuuaagcgaaacccgagacccugaggagauuucuguuacugugaaggcauuuaugacggccgaucucccaaaugaacugaucgagcuucuggagaaaauagucuuggacaacuccguauucagugagcaucggaaucuccagaaccugcuaauucugacagcgaucaaggcugaccguaccagagugauggaauauaucagcaggcuugauaauuacgacgcccucgauauugcaucuaucgccguuuccucagcucuguaugaggaggcauuuacuguguuccacaaauucgacaugaacgccagugcgauucaggucuugauagaacauaucgggaaccuggaucgcgcuuacgaguuugccgaacggugcaaugagcccgcaguguggagccaguuagcccaagcucagcuccagaaggaccugguaaaagaagccauuaacucguacaucagaggagaugacccuuccucuuaucuugaggugguccaaagcgcaucaaggaguaauaacugggaggaucugguuaaguucuugcagauggcucgaaagaaaggucgcgaauccuacauugagaccgaacucaucuuugcccuggcgaagacaucucgggugagcgagcuagaggacuucauaaauggccccaacaaugcccacauccaacaggugggggauagaugcuaugaagagggaauguacgaagcagcuaaacugcuuuauuccaacgucucaaauuuugccaggcucgcuagcacccuggugcauuugggcgaguaccaagcagccguugacaacagucguaaggccucuuccacucgcacauggaaagaaguauguuucgcuugcauggauggucaggaguuucgguucgcgcaguuaugugggcugcacauugugauccacgcagacgagcucgaggagcugaugugcuauuaccaggacagaggcuacuuugaggaacuuauucuguugcuagaagccgcucugggacucgagagggcccauaugggcauguucacggagcuggcaauccuuuauagcaaguuuaagccacagaaaauguuagaacaccuggaacucuucuggucgcgagucaauauaccuaagguguugcgggccgcugaacaggcgcaucugugggccgagcucguuuuccuguacgauaaauaugaagaguacgacaacgcagugcuuaccaugaugucacaccccacugaggcuuggaaggaagggcaguuuaaagauauuaucacaaaggucgccaauguggagcuguguuaucgcgcauugcaguucuaccuagacuauaaaccacugcucaucaacgauuuacugcuuguacugucuccgagacucgaccauaccuggacagucuccuuuuucaguaaggccggacaauugccucuggugaagcccuaccucaggagcguucagucucacaauaacaaaagcgugaacgaagcucugaaucaccuucuaacugaggaggaagauuaccaggacgccaugcaacaugcggcagagucccgggaugccgaacuggcucagaaguuguuacagugguuucuggaggaaggcaaacgagagugcuucgccgcuugucucuuuaccugcuaugaccugcuuagaccagauaugguccuggagcucgcauggcgccacaacuugguggaccuggccaugcccuacuucauucagguuaugagggaauaucuaucaaagguggacaaacuggaugcucucgagagucuucguaagcaagaggaacaugucacggaaccugccccacugguguuugacuucgauggucacgaguga

SEQ ID NO: 54537 - RNA, 1242 nt, Artificial Sequence
  derived and/or modified sequence opt3 from CLUAP1__Homo_sapiens__NP_055856
augagcuucagagaccugaggaacuuuaccgagaugaugcgggcccucggcuacccccgccacaucuccauggaaaauuuccgaacaccuaacuuugggcuugugucugagguccuguugugguuaguuaagcguuaugaaccacagacugauauuccgcccgacguggauacggagcaagacagaguauucuuuauaaaagcuaucgcacaguucauggccaccaaggcgcauauuaaacugaauacaaagaaacuauaccaggcugauggauaugccgugaaggaacuccugaagaucacuucaguccuuuacaacgcaaugaaaaccaaggguauggagggcagugagauuguggaagaggacguuaauaaauuuaaguucgaucuggggagcaaaaucgccgacuugaaggcugcaaggcagcucgccuccgaaauaacaucuaagggagcuucgcuguaugaucugcucggcauggagguggaguuacgggaaaugcgcaccgaggccaucgcgagaccucuggaaauuaacgagacugaaaaagucaugaggaucgcaauuaaggagauccuuacacaagugcagaaaaccaaggacuugcugaauaacguagccucagaugaggcuaaucuagaagccaaaauagagaagcggaaacucgaacuggagcgcaaccgaaagagacuugaaacgcugcagagcguuaggccaugcuuuauggacgaguacgagaagacugaagaggaauugcagaaacaauaugauaccuaccucgagaaguuccagaaucugacauacuuagaacagcagcuggaggaccaccaucggauggagcaagaacguuuugaggaagcaaagaacacucucugucuuauucagaauaagcugaaagaggaggaaaagcgcuugcuaaagagugguuccaacgacgauucugacaucgauauucaggaggacgaugaaagcgacuccgagcuggaagagagaaggcuccccaaaccucaaaccgcuauggagaugcugaugcaggggcggccaggaaagcgaaucgugggcacaaugcagggcggggauucagacgauaaugaagacagugaggaaagcgagaucgauauggaagacgacgaugacgaggaugacgaucuugaggacgaaucuauuucccugucacccaccaaaccuaaccgcagagucaggaaaagcgagccauuggaugaaagugacaacgauuucuga

SEQ ID NO: 54538 - RNA, 1350 nt, Artificial Sequence
  derived and/or modified sequence opt3 from CLU__Homo_sapiens__NP_001822
augaugaagacccugcuccuuuucgugggccuguuguuaacaugggagagcgggcagguccugggagaccaaacuguuuccgauaacgaacuacaggagaugucuaaucaggguucaaaauacgugaacaaggaaauccagaaugccguaaacggcgugaaacaaauuaagacgcucauagagaaaaccaaugaagagagaaagacacugcuuaguaaccuggaggaagcuaagaaaaagaaagaggacgcauugaaugaaacuagggagagcgagaccaagcucaaagaacugcccggggucugcaacgagacaaugauggcccugugggaagaguguaagccuugccucaagcagaccuguaugaaauuuuaugcgcgggugugccgcuccggaucuggcuuaguuggucgacagcuggaagaguuccuuaaucagucgucaccauuuuacuucuggaugaacggggaucguaucgacagcuugcuggagaaugauagacaacagacucacaugcuagacgugaugcaggaucauuuuaguagggcuuccucuauuaucgacgaacucuuccaggaucgguuuuucacacgcgagccgcaagacaccuaucacuaccugcccuuuagccuuccucauagaaggccacacuucuuuuuccccaagucccggauuguccgcucacugaugccuuuuaguccauaugaacccuugaacuuccaugccauguuccagccuuuucucgagaugauccacgaagcacagcaagccauggauauacacuuccauagcccagcuuuucagcacccgcccacggaguucauccgagagggagacgaugacagaacuguguguagggaaauucggcauaauucuaccggcugccugcguaugaaagaccagugugauaagugccgcgagaucuuauccguagacuguucaacaaacaauccuagccaggcaaaacugagaagggaacucgaugagagucuucaaguugccgaacggcugacucgaaaguacaacgaguugcuaaaaucuuaucaguggaagaugcugaacaccuccagccuccuggagcagcuuaaugaacaguuuaacugggugucgcgccuggcuaauuugacacaaggcgaggaccaguacuaccucagagucaccacgguggccucucacacuuccgauucagacgugccaaguggggucacagaaguugugguaaagcuguucgauagcgaccccauuaccgugacugucccuguggagguuuccaggaaaaacccaaaguuuauggagacaguggcggaaaaagcauuacaggaguaucggaagaaacaccgcgaagaguga

SEQ ID NO: 54539 - RNA, 1557 nt, Artificial Sequence
  derived and/or modified sequence opt3 from CLUL1__Homo_sapiens__NP_001275965
augagaaccugggacuacagguggagccuggcccucguggcucagacaggcguccacugcuguaaccuuuccucucugcaacccuugccuccacgguucaagcgcuuuucaugcuuaagucugagcuccgggugggauuauucuaauucgggaaacaugaaaccgccccuacucguuuucaucgugugucugcuuuggcugaaggacucacauugcgcaccuacuuggaaagauaagacggccauuagcgagaauuugaaaaguuuuuccgaaguaggugagauagacgcggaugaagaggugaagaaggcucucaccggcaucaaacagaugaagauuaugauggaacgaaaagagaaggagcacacaaaccugaugucuacucugaaaaagugucgugaagagaagcaggaagcccucaaauuacugaaugagguccaggagcaucuugaagaggaagagagauugugcagggaaagccuggcagacuccuggggagagugucggucaugccuagagaacaauuguaugcgcaucuacaccacaugccaaccaaguuggagcucugugaagaacaaaauugaaagauucuuuaggaagaucuaucaguuccucuuucccuuccacgaggauaaugaaaaagaccugccuauauccgagaaacuuaucgaagaggaugcccagcugacccagauggaggacguguuuucacaauugacuguugaugucaacagccucuucaaucggaguuuuaacguguuccgccagaugcagcaggaauuugaccaaacauuccagucucauuucauuuccgauaccgaccugacggagccauacuuuuuccccgcuuuuagcaaggaaccuaugacuaaggcagacuuagagcaguguugggauaucccaaauuucuuucaacuguucugcaacuuuucgguaucuauuuaugaauccguuucagagaccaucacaaagaugcucaaagccauagaggaccuuccgaagcaggauaaagcucccgaccacgggggccugauuaguaagauguugccuggucaggaucgagggcuaugcggagaacuggaccagaaucucagcagauguuucaaauuucacgagaagugccaaaagugucaggcccaucuguccgaagauugcccagacgugcccgcgcuucacacugagcuggaugaggcaaucagguuggucaacgugucuaaccagcaguacggccaaauucuccagaugacccggaaacaucuggaagacacagccuauuuaguggagaagaugcguggccaguucgggugggucagcgaacuggcuaaucaggccccugagaccgaaaucaucuuuaacucaauucaaguugugccacgcauacacgagggaaauaucaguaaacaggaugagacgaugaugacugaccuauccauucuccccagcucuaacuucacacugaagaucccgcuugaagagucagcagaaaguagcaauuuuauagguuacguaguggcuaaagccuugcagcacuucaaggagcauuucaagaccugguga

SEQ ID NO: 54540 - RNA, 1065 nt, Artificial Sequence
  derived and/or modified sequence opt3 from CLVS1__Homo_sapiens__NP_775790
augggccccgugagccugcucccuaaguaccagaaacuuaacaccuggaauggggaccuggccaagaugacacacuugcaagcuggauuauccccagagacuaucgaaaaagcaagacuggagcuaaacgaaaauccggauguccuccaucaggacauucagcagguuagggauaugauaaucacgcggcccgacauugguuuccugcgcaccgaugacgccuuuauccuucgauuccugcgugcgagaaaguuucaccaagcugaugccuucagguugcucgcacaguauuuucaguaccggcagcugaaccuggacauguucaaaaauuuuaaggccgaugacccuggcauuaagcgcgcucucaucgauggguucccaggaguguuagagaacagagaccauuauggcaggaaaauacugcuuuuguuugcagccaauugggaucaaucucggaacucauucacagacauccugcgcgcuauucuacucagucuggaaguacuuaucgaggaccccgagcugcagauuaaugguuuuaucuugauaauugauuggagcaacuucuccuuuaagcaggccucuaaacucacuccuucgauccugaaguuagcgauugaagggcugcaggacucauucccagcacgauucggaggcgugcacuuugucaaucaacccugguacauccaugcccucuauacccuuaucaaaccuuuccugaaggauaagacaagaaaaaggauauuuuugcacggcaacaaucuaaacagccugcaccagcucauucauccagaguuccugccgagugaauuugggggaacccuucccccuuacgacauggguacuugggcucggacacuguugggcccagauuauuccgacgagaaugauuacacccacacgucuuacaacgccaugcaugugaagcacacuagcuccaaccucgagcgugaaugcucacccaaacugaugaagcgcagucagagcguuguggaggcagggaccuuaaaacacgaagagaagggagaaaaugagaacacacaaccucugcuagcucucgacuga

SEQ ID NO: 54541 - RNA, 1023 nt, Artificial Sequence
  derived and/or modified sequence opt3 from CLYBL__Homo_sapiens__NP_996531
auggcccugagacuccuuaggcgggcugcacgcggcgccgcggcugccgcacuguugcgauuaaaggccagccuggcugcagacaucccccgucuaggguacuccucuucaagucaccauaaauauauuccuagaagggccgugcucuacgucccaggaaacgaugagaagaaaauaaagaaaaucccgagccugaauguugacugcgcugugcuugauugugaagacgguguagccgcgaacaagaagaaugaggcacggcugcgcauugugaaaaccuuggaagauaucgaccucggccccacagagaagugcgucagagugaacuccguuucuucggggcuggccgaagaggaucuggagacucucuuacagucaagggugcugccuagcagucuuauguugccaaaagucgaaucccccgaggaaauucaaugguucgcugacaaguuuucuuuccaccugaaaggacggaagcuagagcagccuaugaaucucaucccauuuguggagacggccaugggccugcuuaacuucaaggcaguaugugaagagacccugaaaguugguccccaggugggguuguuucucgaugcugucguguucggaggcgaagacuuucgcgccagcauaggcgcgacauccucaaaggagacucuggauaucuuauaugcccgacagaaaauuguggucaucgcaaaggcuuucgggcugcaagccauugaccucguuuacaucgauuuuagagacggagcuggucuucugaggcagagucgggaaggcgccgcaaugggguucaccggaaaacaggugauacauccuaaucagauugccguagugcaagagcaguuuagcccaucuccggagaagaucaaaugggcugaagaguugauugcggcauucaaggaacaccagcagcuaggcaagggugccuuuacauuccaaggguccaugaucgacaugccccugcucaaacaggcucagaacaccgucacucuggccacaucaaucaaggagaaauga

SEQ ID NO: 54542 - RNA, 744 nt, Artificial Sequence
  derived and/or modified sequence opt3 from CMA1__Homo_sapiens__NP_001827
augcugcuccuuccccugccuuuguuacuguuccuacucugcagcagagccgaggcuggcgaaaucauugggggaaccgaguguaagccacacuccaggccguacauggcauaucuggaaauagugacaucuaacggucccucaaaauuuugcggcggguuccuuauccggcgcaauuuuguccugacugccgcgcauugugcuggacgaaguauuacgguuaccuugggcgcccacaacaucacagaggaagaggacacuuggcagaagcucgaggugauuaaacaauuccgucauccuaaguacaauaccagcacacugcaccaugauaucaugcugcucaaauuaaaggaaaaggcaucccugacccuugccguagguacuuugccauuucccucucaguucaacuuugugccuccagggagaaugugcagggucgcuggauggggccggacaggcgugcugaaacccgggucggacacccuacaggagguuaagcuccgccugauggauccucaggcauguucacacuucagagacuuugaucacaaucuucaacugugcgugggaaacccaaggaaaacuaagagcgccuucaaaggugacaguggcgggccguugcucugugcuggagucgcccagggcauaguguccuauggucggucugaugcgaagcccccugcaguauuuacgcgcaucagccauuaccgaccauggauuaaucagauccugcaggccaacuga

SEQ ID NO: 54543 - RNA, 1305 nt, Artificial Sequence
  derived and/or modified sequence opt3 from CMAS__Homo_sapiens__NP_061156
auggacagcguggagaagggcgccgcuaccuccgucucuaaccccagagggaggccuucacggggacgcccaccgaaacugcagcgaaauagucgugguggccaagggagaggaguugaaaagcccccucaccucgcagcccuuauccuggcgaggggcgguagcaaagggauuccauugaagaacauaaaacauuuagcuggagugccccugaucggcuggguacuacgggccgcacucgauuccggcgccuuccagucugugugggucucgacagaccacgaugagauugaaaauguggcuaagcaguuuggggcacagguucaucgcagaucaagcgaggugaguaaggacuccucuacuagccuggaugccaucauugaguuccuuaacuaccacaaugaagucgacaucgugggaaacauacaagcuacguccccuugccugcauccaaccgauuugcagaaaguagccgagaugaucagggaagaggguuaugacucaguuuuuagugugguccggcgccaccaguuccgauggagcgaaauucagaagggcgugagagaggugacagagccccucaaucugaacccugcgaaaaggccacggcgucaagauugggacggggaacuguacgagaauggaucuuuuuauuucgcaaagcgccaccucaucgaaaugggcuacuuacagggugggaaaauggccuauuacgagaugagagcugaacauuccgucgauauugacguugauaucgacuggccgauagccgagcagagggugcugcgguauggauacuuuggcaaggagaaacuuaaggaaauuaaguugcugguauguaacaucgacggcugccuaacuaaugggcacauuuacgugucaggagaucagaaagagaucaucagcuaugacgucaaggaugcaauugguauaagucuccugaaaaagucuggcaucgaagugcgacuuauuuccgagcgcgcuuguagcaaacaaacccugucgucuuugaagcucgacugcaagauggaaguuuccgugucagauaaacuggccgucguggacgaguggagaaaggagaugggguuauguuggaaagaaguagcguaccugggaaacgagguuagugaugaagagugccucaagagggugggccuuagcggugcccccgcagacgcuuguuccacagcccagaaagcugucggguauaucugcaaguguaauggcggacggggcgccauacgcgaguucgcagaacauauuugccuguugauggagaaggugaacaauucuugucagaaauga

SEQ ID NO: 54544 - RNA, 321 nt, Artificial Sequence
  derived and/or modified sequence opt3 from CMC1__Homo_sapiens__NP_872329
auggcccuggaccccgcugaucagcaccucagacauguggagaaggacguccuuaucccuaaaauuaugagggaaaaggcaaaagagcggugcagcgaacaaguucaggauuucaccaaguguugcaaaaacuccggcgugcugaugguagugaagugucgcaaggaaaauucugccuugaaagagugcuuaacagcguacuauaacgacccagcuuuuuacgaggaguguaagauggaauaucugaaagagcgagaagaguuccguaagacugggauaccgacgaaaaagagacuacagaagcuccccaccucaauguga

SEQ ID NO: 54545 - RNA, 240 nt, Artificial Sequence
  derived and/or modified sequence opt3 from CMC2__Homo_sapiens__NP_064573
augcaccccgaccugagcccucaucuccacaccgaggaaugcaacgugcuuaucaaucuguugaaggagugucauaaaaaccacaauauuuuaaaguucuuuggcuacugcaacgaugucgacagagaacugaggaaaugucuaaagaaugaguauguugaaaaccggacaaaaucccgcgagcaugggauagccaugcgaaagaaacucuucaauccaccggaggaaucugagaaguga

SEQ ID NO: 54546 - RNA, 207 nt, Artificial Sequence
  derived and/or modified sequence opt3 from CMC4__Homo_sapiens__NP_001018024
augccccagaaggacccuugccaaaaacaggccugugagauccagaagugccugcaggcuaacagcuacauggaauccaaaugucaagcagugauucaggagcucagaaagugcugugcccaguauccaaaaggcaggucugucguuugcucaggguucgaaaaggaggaagaggagaaucuuacccggaagagugcgagcaaauga

SEQ ID NO: 54547 - RNA, 2040 nt, Artificial Sequence
  derived and/or modified sequence opt3 from CMIP__Homo_sapiens__NP_085132
augggccaggccgcugagcccaccggguacauggaaaacagcguguccuauucugcaaucgaggacguccaacugcucucaugggaaaaugccccuaaguacugccuucagcugacaauuccaggagguacuguuuuguuacaggcggcuaacaguuaucugagagaucagugguuccacagccuacaauggaaaaagaaaauauacaaguauaaaaaggugcucuccaauccgucuaggugggagguagugcugaaggaaauccggacgcuugucgacauggcccugaccucgcccuugcaggaugacucaauuaaccaggcaccucucgagaucgugagcaaacugcugagugagaauacaaaccucacuacccaggaacaugagaauauuaucguugccauagcuccauuacuggaaaacaaucaucccccuccagaucuuugugaguuuuucugcaagcacugucgcgagcgaccccguuccaugguggucaucgaaguguuuacaccuguaguucaaagaauuuugaaacacaacauggacuucggcaagugcccaaggcugcggcuauuuacccaggaguacauccucgcacugaaugaacuuaacgccgggauggagguggucaaaaaguucauucagucuaugcauggaccgacuggccacuguccccacccucgcgugcugccaaauuugguggcugucugccucgccgcgaucuauagcuguuacgaagaguuuauaaacuccagagauaauucacccagucugaaggagauuaggaacgguugccagcaaccuugugaccggaaaccaacauuaccccugcgccuccuucauccgagcccugaucugguuucucaggaagcaaccuuguccgaggcccgacuaaagucagugguaguggcuagcagugaaauccacgucgagguggaaagaacgucuacugccaaacccgcacugaccgcuuccgccgggaacgacagcgagccaaaucucauugauugccugaugguuucgccugcguguucuacaauguccaucgagcuuggaccccaggccgacaggacucugggcugcuacguggaaaucuugaagcuccugucagauuaugacgacuggcggccaaguuuagcaagccugcuacaacccauuccuuucccaaaagaggcucucgcccaugaaaaguuuaccaaagagcugaaguacgucauacagcguuucgcugaagauccgcgccaggaggugcacuccugccuuuugucuguaagagccggcaaggacgggugguuucagcuguauagccccggagguguugcaugugaugacgauggcgaacucuucgccucaauggugcacauccugauggggaguugcuacaaaacaaagaaauuucuucuguccuuggcugagaacaagcucggaccuuguaugcuguuagcgcugaggggcaaucaaaccauggucgagauucuaugccucaugcuggaauauaacaucauagacaauaacgauacgcagcuucagauuaucagcacuuuggagucuacagacguggguaaacggauguacgagcagcugugugaucgacaacgcgaacucaaggagcugcagagaaaagggggaccaaccagguuaacucugcccucaaagaguacagacgcagaucuugcccgguugcucagcuccggcucuuucggcaaucuggaaaaccuaucgcuggcuuucaccaaugucacgagcgccugcgcagagcaucucaucaagcugccuucccuuaaacaguugaaccuguggucaacccaguuuggggacgccggauuacgccuccugagugaacaccuuacaaugcugcaaguguugaaucucugugagacuccaguuaccgacgcuggucugcuagcccugucuagcaugaagucccucugcucacugaacaugaauagcacaaaacuuucugcagauacuuaugaggacuugaaggcgaagcugcccaacuuaaaagaaguggauguaagauacaccgaggcuugguga

SEQ ID NO: 54548 - RNA, 1122 nt, Artificial Sequence
  derived and/or modified sequence opt3 from CMKLR1__Homo_sapiens__NP_001135815
augagaauggaggacgaagauuacaacaccagcaucuccuauggcgacgaguaccccgauuaucuggacucuauugugguccucgaagaucuuucaccucuggaggccaggguuacacggauauucuuggugguaguguacaguaucgucugcuuuuuagggauucugggaaauggucuagugaucauuaucgcuacuuucaagaugaaaaagacgguuaacauggugugguuucucaaucuggcagucgccgacuuccuuuuuaacguguuccugccaauacacaucaccuaugcggcuauggauuaccauuggguauuuggcacagccauguguaaaauuagcaauuucuugcucauccacaacauguuuacuuccguuuuccugcugaccauuaucucuucggaccgcugcauaucagugcucuuaccggucuggagccagaaucaucgaagugugcgucuggcauauauggccuguauggugauuuggguccuugcauuuuucuuguccucucccagccugguuuuuagagauacagcuaaccuacacgggaagaucuccugcuucaauaacuucucacucaguaccccuggaucuagcuccuggccaacucauucacaaauggaccccgugggcuacagcaggcacaugguagugacagucacccgguuucugugugguuuccuugugccuguucugauuaucacggccugcuacuugacuaucguguguaaacuccagcgcaauagacuggcuaagaccaagaaaccauuuaagauuauagucacaaucauuaucacuuucuuuuuaugcuggugucccuaucacacccugaaccuccuugaacugcaucacacagccaugccugggaguguguucucuuugggacuaccacuggcgaccgcacucgccauagcuaauuccugcaugaacccgauucuguacguauuuaugggccaggauuucaaaaaguuuaaaguugcccuuuucagcaggcuggugaaugcauugucggaggacacgggccauucuuccuaucccucacaccggaguuuuacuaagaugagcuccaugaacgagcgcacaucuaugaacgaacgagagaccgggaugcucuga

SEQ ID NO: 54549 - RNA, 1230 nt, Artificial Sequence
  derived and/or modified sequence opt3 from CMPK2__Homo_sapiens__NP_001243406
auggccuucgcuagaaggcugcuccggggcccccuuagcgggccucuguugggacgccgaggugugugcgcaggcgccauggcgccaccgcguagauuugucuuagagcugcccgacuguacccuagcucacuucgcccucggggcagaugccccuggagacgcugaugcaccagaccccaggcuggccgcccuucugggcccuccagaacgguccuacucuuugugcguucccgugacaccugaugcugguuguggggcgcgcguaagagcagccaggcuccaucagcggcugcugcaccaacuccgccgaggaccauuucagagaugccaguuacugaggcuuuuguguuauugcccgggcggccaggcugggggagcccaacaggguuuccugcuacgggacccccucgaugacccugauacucgucaggcacugcuugagcuguugggcgcuugucaggaagccccacgcccccaucucggggaguuugaagcggacccuagaggacaacuguggcagagguuaugggaggugcaggauggccggcgacugcaggucgguugcgcccaagugguuccagugcccgagccgccucuccaccccgucgugccagaccuuccuucaaguguaguuuuccccgaucgcgaagcagcuagagccgugcuggaggaauguacgagcuuuaucccagaggcuagggccgucuuggaccuaguggaccagugccccaagcagauucaaaaagggaaguuccagguggucgcaauagagggacuggaugccaccggcaaaacaacuguuacccaguccguggcugacucucucaaggcgguacugcuuaaaucgccuccaucauguaucggccaguggcggaagauuuuugaugacgaaccgacaaucauucgcagagcauucuacagccuggggaacuauaucguggccagugagauagcuaaggaauccgccaaaucucccgucaucguggauagguacuggcauagcaccgcaacuuaugccauugcuacagagguuuccggagguuugcaacaccucccuccagcccaccaucccguguaccaguggccugaagaccuguuaaagccagaucugauccuacuccugaccgucucacccgaggagcgucuucagcgguugcagggccgagggauggagaaaacgagagaagaagcagagcuggaagcgaauaguguguuuaggcaaaaguga

SEQ ID NO: 54550 - RNA, 786 nt, Artificial Sequence
  derived and/or modified sequence opt3 from CMSS1__Homo_sapiens__NP_001161396
augcacggcgaggccagcgacggggaaggagagggugauaccgaagugaugcagcaagagacaguccccguuccugugccauccgaaaagacuaaacagccgaaggagugcuuccugauccagcccaaagagagaaaggaaaacacgaccaaaacaaggaagcggcgcaagaaaaagauuacugacguacucgcuaaaucugagccuaagccaggccuucccgaagaucugcagaaauugaugaaggacuacuauucaagucgacguuuagugauagagcuggaggaacuaaaucucccugauagcuguuuucugaaggcaaacgaccuuacccauucccugucuucguacuugaaagagaucugcccaaagugggucaaacucagaaagaaucacucagagaaaaagagcgugcugaugcugauuaucuguaguuccgccguuagggcgcucgaauuaauucggucuaugacagcuuuccgcggggauggaaaagugaucaagcuguuugccaagcauauaaaaguccaagcacaggugaaacuuuuggaaaagagaguaguucaccugggcguggguacccccgggaggaucaaggagcuagucaaacagggaggccucaaccugagcccucuuaaguuccugguguuugacuggaauuggcgggaucagaaguugcgccgaaugauggacauuccagagaucagaaaagaaguguucgagcuccuggaaaugggcgucuuaucccugugcaagucagagagucucaaacuugggcuguuuuga

SEQ ID NO: 54551 - RNA, 549 nt, Artificial Sequence
  derived and/or modified sequence opt3 from CMTM3__Homo_sapiens__NP_853531
auguggcccccugacccagauccggaccccgauccugagccagccggcgggagcagacccggaccugcugugccaggucugagggcacuccuucccgcccgggcguuccugugcuccuugaagggccgcuuacugcuagcugaaucugggcucucauuuaucaccuucauuuguuacgucgccaguagcgcauccgccuuucugacagcuccucuucuggaguucuugcucgcacuguauuuucuguucgccgacgcuaugcagcucaacgauaaauggcaaggauuaugcuggccaaugauggacuuucugcgauguguuacugccgcgcuuauauacuucgcaaucucuauuacggccaucgcuaaguauucggauggcgccucaaaagcagcugguguguuuggguucuuugccaccauuguauucgcgacagacuuuuacuugaucuucaaugauguggccaaguuccugaaacagggagacagcgcagaugaaacuaccgcucacaagacagaggaagagaacagugacuccgauucugacuga

SEQ ID NO: 54552 - RNA, 378 nt, Artificial Sequence
  derived and/or modified sequence opt3 from CMTM5__Homo_sapiens__NP_001032365
augcugagcgccagagacaggcgggaucgccaccccgaggaaggcguggucgcugagcuccagggguucgcaguugacaaggccuuucuuaccucccauaaaggaauccuguuggaaacagaguuagcgcugacucuaauuauauucaucugcuuuacggcuucuauuucagccuacauggcagccgcucuccuggaguucuuuaucacccuugcauuccuguuuuuguaugccacacaauacuaucagcgauucgaucguauuaacuggccuugucucguguuugguaucauacugguaaguaucuucgcuuacgacgccuuuaagauuuauagaacugaaauggcgccaggcgcaagccagggggaucagcaauga

SEQ ID NO: 54553 - RNA, 528 nt, Artificial Sequence
  derived and/or modified sequence opt3 from CMTM7__Homo_sapiens__NP_612419
augagccacggcgccgggcuggugagaaccacaugcuccucuggaucagcucucggucccggcgcaggggccgcgcagccuagugcuagcccacuugagggacuguuggacuuauccuacccgaggacucaugccgcacugcuaaaggucgcccaaaugguuacgcuccugaucgcuuucauuugugugcggucuucgcuuuggaccaacuauucagcauacagcuauuuugaaguagugacaauaugcgaucugaucaugauuuuggccuucuaccucguccaccuguuucgcuucuaucgagugcugacuuguaucaguuggccccucuccgaguuacugcauuaccuuauuggcaccuugcugcuacucaucgcuucuauaguugccgcgagcaaauccuauaaucagucaggucugguggcaggggccaucuuuggauucauggcuacauuucuuugcauggccaguauuuggcugagcuacaagaucucuugugucacccaguccacugacgcagcuguguga

SEQ ID NO: 54554 - RNA, 522 nt, Artificial Sequence
  derived and/or modified sequence opt3 from CMTM8__Homo_sapiens__NP_849199
auggaggaaccccagagagccaggagccacaccgugacaacuacggcuuccucuuucgcagagaacuuuucaaccaguagcuccucuuucgccuacgaccgggaauuucugcgcacacucccuggcuuccuuaucgucgcggagauuguucugggguuguuaguguggacucugauagcuggaaccgaauauuuucgaguaccagccuucgguugggugauguuugucgcaguguucuacuggguucuaacaguguuuuuccucaucauuuauaucaccaugacuuacacacguauuccgcaaguccccuggaccacggugggccugugcuuuaaugggucggccuucguacuuuaucugucagcugcaguuguggaugccagcagugucuccccugagagagacucucauaacuuuaauagcugggcugccuccucauucuucgcguuuuuggugacuaucuguuacgcaggaaacaccuauuucaguuuuauagccuggaggagccggacaauccaguga

SEQ ID NO: 54555 - RNA, 2508 nt, Artificial Sequence
  derived and/or modified sequence opt3 from CMTR1__Homo_sapiens__NP_055865
augaagagaaggaccgaccccgagugcacagccccuaucaaaaagcagaaaaagcggguggcugaacuggcacucagccuuuccucuacuucagaugacgagccaccgaguagcgucucccacggcgccaaagcgucuacgaccucgcugucagggagcgauagugaaacagagggaaagcaacauuccucugacagcuucgaugacgcuuuuaaggccgauuccuugguugaagguacuucaagucgcuacagcauguauaacucugugucccagaaauuaauggcaaagaugggcuuccgagagggggagggacugggcaaauacucacagggucguaaggacauuguagaagccagcagucagaaagggagaaggggacuaggccucacccugcggggcuuugaucaagagcuuaauguggacuggcgcgaugaacccgagccuucugcuugugagcaggucuccugguucccagaaugcacaaccgagauacccgacacucaggaaaugagcgauuggauggugguugggaagagaaagaugaucauugaggacgaaacagaguuuuguggagaggaacuguugcacucggugcuccagugcaaaucugucuucgacgugcuggauggugaggaaaugaggcgggcacgcacccgagccaacccuuaugagaugaucagaggcguauuuuuccugaauagggcugccaugaagauggcgaacauggacuuuguuuucgaucggauguuuacgaauccacgugacuccuacgggaaaccccucgugaaggaucgcgaagcagaguuacuguauuucgccgacgucugugcuggaccuggcgguuuuucagaguacgugcuuuggaggaaaaaguggcaugccaaaggguucggaaugacuuugaagggcccaaacgauuucaagcuggaagacuuuuauagugcaagcuccgagcuauucgaaccguacuacggcgagggcggaauugauggugacggcgauaucaccagacccgaaaauauaucugcuuuucggaacuucgugcucgacaauacagaccgaaaagggguccacuuucugauggccgauggaggcuucagcguugagggucaagagaaccuucaggaaauccugucaaagcaguugcuccugugccaguuuuuaauggcgcugaguauugugcgcacugggggccauuucaucuguaaaaccuuugaccucuucacaccuuuuuccguaggacuuguguaucuguuguacugcuguuucgagagagucugccuauuuaagccaauuaccagcaggcccgccaauucugaacgguaugugguuuguaaaggccugaagguggggaucgaugacguccgcgauuaccucuucgcagugaacauaaagcugaaucaacuuagaaacacggacucagauguaaaucugguugugccuuuggaggucauuaaaggagaccacgaguucacugauuauaugaucaggaguaacgaaagccacugcucccuccagauuaaggcucuggccaaaauccaugcuuuugugcaggacacaaccuuaucugagccacgucaagccgaaauccggaaggagugccugcgacuaugggguauucccgaucaggcaagagucgccccgucgagcuccgacccuaaaucaaaguucuuugaacucauacagggcacugagaucgauauuuucaguuacaagcccacacugcuuaccucuaaaacguuggagaagaucaggccaguguuugacuaucgcuguaugguuagcggguccgaacagaaauuccugauaggacucggcaagucacaaauuuacaccugggacggucggcagagcgauagauggaucaaacuggaccuuaagacagagcugccuagggauacuuugcucucuguggaaaucguacacgagcugaagggggaaggcaaagcucagcgcaagauuuccgcgauccauauuuuagacguccuggugcuaaacggaaccgauguucgagagcagcacuuuaaucaacggauacagcucgcagagaaauucgugaaggccgucaguaaacccagccguccagacaugaaccccaucagagugaaggaaguauacaggcuggaggaaauggagaaaauuuuugugcgccuugaaaugaagaucaucaaggggucuuccgggacaccuaaauugucauauacuggacgggaugacagacacuucguuccaaugggucuguacauugucaggaccgugaaugagccguggacaaugggcuuuaguaagagcuucaaaaagaaauuuuucuauaacaagaagaccaaagauucgacuuucgaccuccccgcugauuccauagccccuuuucauaucugcuacuaugggcgacuguucugggaguggggagacggcauucgcgugcacgauucucagaagccacaggaccaagacaaauuaagcaaggaagauguccugucauuuauccagaugcaucgggcauga

SEQ ID NO: 54556 - RNA, 2313 nt, Artificial Sequence
  derived and/or modified sequence opt3 from CMTR2__Homo_sapiens__NP_060818
augagcaagugcagaaaaacccccgugcagcaacuggccuccccugcuucuuucucaccagacauccucgcagauauuuuugagcuuuucgccaagaacuuuaguuacggcaaaccgcugaauaacgaauggcaguugcccgacccuagcgagauauucacaugugaucacacugaauuaaaugcguuucuggaccuaaagaacucccucaaugaggucaaaaaccugcuuucugauaagaagcuggacgaauggcaugagcacacggcuuucaccaauaaagccgggaagaucauuucgcauguuaggaaaucagugaacgcagaguugugcacacaggccugguguaaguuucacgaaauccucugcagcuucccacugauuccccaggaggcuuuucaaaauggaaaacugaacagucuccauuuaugugaagcaccuggugccuucaucgcuucccugaaucacuaucuuaagucucaccgguuuccaugccauuggagcuggguagccaacacuuugaaucccuaccacgaggcgaacgaugaccugaugaugauaauggaugaccgccuaaucgcaaauacccuccauuggugguauuucggcccugauaacacaggggacauuaugacccugaaguuucuuacuggacugcagaacuucaucuccucaauggccacagugcacuuggucaccgcugauggcaguuucgacugucaggguaauccaggggagcaggaagcccucgugagcucucugcacuacugcgagguugugacggcauuaacuacccugggaaacggcggcuccuuuguccucaaaauguucacaauguuugaacauuguucaauuaaucuuauguaucuguugaacugcuguuucgaccaagugcacguauuuaagccggcuacuagcaaagccgggaauagugagguuuacguggucugccuacauuauaagggacgagaagcgauccacccccugcucucuaaaaugacccugaacuucgguacagagaugaagcguaaagcccuuuuuccucaucacgugauaccagauuccuuccugaagagacacgaggaaugcuguguguuuuuccauaaguaccaguuggagaccauuagcgaaaauaucaggcucuuugagugcaugggcaaagcagaacaggagaagcugaacaauuuacgggacugugcuauucaguacuucaugcaaaaauuucagcugaagcaccuaucgcgcaacaauuggcucgucaaaaagucuuccaucgggugcucaacgaacacuaagugguucggacagagaaauaaauauuucaagacauacaacgagaggaaaaugcuggaagcccuuaguuggaaggauaaaguugcuaagggcuauuuuaauagcugggccgaggaacaugguguguaccaccccgggcaauccucuaucuuggagggaaccgcaagcaaccuggaaugucaccucuggcauauucuggagggcaagaaacuuccuaagguaaaaugcucaccauucuguaacggcgagauacugaagacuuugaaugaagccaucgagaaaagucucgggggagcuuuuaaccuggacuccaaguuccggcccaagcagcaguauagcugcucuugucacguguuuucagaagaguuaauuuucagugagcugugcagccuaacagaaugucuccaggaugagcaagucgugguuccguccaaucagaucaaaugccugcuuguggguuuuucuaccuugcgcaacauaaagaugcauauuccucuggaaguccgacuccuggagucggcggaauuaacgaccuucagcugcucccugcuucacgacggcgaucccacauaccagagauuguuucucgacugucugcuacauucacugagggagcuccacacuggggaugugaugauccugccaguacuuaguugcuucacccgguuuauggcaggauugaucuucguucugcacucuuguuuucguuucauuacauucgugugcccuacuagcuccgaccccuuacgcaccugugccguccuccugugcgugggcuaucaggaucuuccaaaucccgucuuuagauaccugcaaucagugaacgaguugcucagcacacugcuaaauucugacuccccucagcagguucugcaguucgugccaauggaaguacuccugaaaggugcucuuuuggacuuucugugggauuuaaacgccgcaaucgccaagaggcaucuccacuucauuauacaacgggagcgagaagagaucauuaauagucugcagcuucagaacuga

SEQ ID NO: 54557 - RNA, 12210 nt, Artificial Sequence
  derived and/or modified sequence opt3 from CMYA5__Homo_sapiens__NP_705838
auggccagcagagacuccaaccacgcuggcgagucuuuccuggggucagauggcgacgaagaggcaaccagggaacucgagacugaagaggagagugaaggugaggaagaugagacugccgcggagagcgaagaggaacccgacucccggcuuucugaucaagacgaggaaggcaagaucaaacaagaguacauuauaucggauccuucauuuagcauggugacgguacaacgcgaggacagugggaucaccugggaaacuaauuccucucgaagcuccacuccaugggcuucagaggaaagucagaccagcgggguuugcucucgugagggcuccacagugaacucaccgcccgguaaugucucauucauuguggaugaagucaagaaagugagaaagaggacccauaaaaguaagcacgggucuccuucccugcggcgcaagggaaacagaaaaaggaauagcuuugagucgcaggacguuccaacuaacaagaaaggcucucccuugacauccgccucacaaguguuaaccacggagaaggagaagaguuauacuggcaucuacgauaaggcacggaagaaaaagaccacaagcaauacuccuccaauuaccggggccaucuauaaagagcauaagccccugguccuccgcccuguguacauaggaacaguacaguauaaaaucaagauguucaacuccguuaaagaagaacucauuccacugcaguuuuacgguacccuuccgaagggcuaugugaucaaggaaauucacuaccgaaaagggaaggacgcuucuaucagccuggagcccgauuuggacaauucaggaaguaacacggucuccaaaacuagaaagcucguggcacagagcauagaggacaaagugaaggaagucuucccuccauggaggggcgcccugucuaaggguucagagagucugacacucauguuuagccaugaagaucagaaaaagauuuacgcugacucccccuuaaaugccaccucugcgcuggagcacacuguuccuucguauagcuccucagggcgggcagagcagggaauccagcuucgucacagucagucugugccacaacagcccgaagaugaggccaaaccgcaugaaguagagccucccagcgugacaccagacaccccugcuacgauguucuugcgcaccacaaaggaagagugugagcuggccucccccggcacugcagcuucagaaaacgauagcucugucuccccaaguuuugccaaugaggugaaaaaggaagacguuuacagcgcgcaccauucuauuucccuugaggccgcaucacccggccucgcugccaguacccaggaugggcuggacccugaucaagaacagccagaccuuacaagcaucgagagagcugagccggugucggccaagcugacucccacccacccuuccgucaaaggagaaaaggaggaaaacauguuggagccaucuaucagccucucagaaccccugauguuagaggagccugaaaaagaggaaauugagacaagucugccaauagcaaucacccccgagccggaagauuccaaucucguggaggaagagauuguagaacuugacuauccugagucuccacugguuagcgagaagcccuucccuccccacauguccccagaaguggagcauaaagaagaggaauugauccuaccucugcucgccgcuucaagccccgagcacgucgcgcugagugaggaagagagggaagagauagcaucuguguccacugguagcgccuuugucucggaauacucagugccacaggaccuuaaccaugagcugcaggagcaagaaggcgagccgguuccucccucuaacguggaagcuauugccgagcacgcaguauugagugaggaagagaaugaagaguucgaagccuauuccccagcugccgcacccacgagcgagucuagccucuccccuucaacaaccgagaagacaagugaaaaccagagcccacuguuuucuaccgucacacccgaguacaugguguuauccggggaugaagcgucagagaguggaugcuauaccccugacagcacuuccgcuucugaauacucgguuccgagccuggccacaaaggagucacucaaaaagacgaucgaucggaaauccccacuaauccugaagggcgugagugaguacaugauucccucugaagagaaagaagacaccgguagcuucacuccugcagucgccccagcuuccgagcccucacuuucuccuagcacaaccgaaaagacaagugagugucaguccccguugcccagcacugccaccucugagcaugugguaccaucagaaggggaggaucugggcuccgaacgauucacgccugacaguaaacucaucagcaaguaugcagcuccccugaaugccacccaggagucgcaaaagaaaauuauaaacgaggcgucucaguuuaagccaaaaggaaucuccgaacacacagugcuuagcguugauggcaaggaggucauugggccuucaagucccgaccuggugguggccucugaacacuccuucccaccgcauacuaccgagaugacaagcgaaugccaggcuccucccuugucagcaacuccaagugaguacgucguucucagcgaugaggaagccguggagcuggaacgcuauacccccuccucuacgagcgcuuccgaguuuucagugccuccauacgccacacccgaagcacaggaggaggaaaucguacacagaucuuuaaaucugaaaggagcgaguucgccuaugaaccuuagcgaggaagaccaagaggauaucgguccguucuccccagacucugccuuugucucagaguucagcuuucccccuuaugcuacccaggaggccgagaagagggaguucgaaugugauucccccauuugccucacaaguccaucugaacauacaauacugagcgacgaggacaccgaggaagcagagcuauuuucaccugauuccgcuagucaggugagcauacccccauuccggauuucugaaacugagaagaaugaauuggagccugacucccugcucaccgccguuucagcaagcggcuacucguguuuuucugaggccgaugaagaggacaucgggaguacagcugcgacgccgguguccgaacaguucagcucaucccaaaaacagaaggccgagaccuuuccccugaugucuccauuagaagaucugagccuuccucccaguacugacaaauccgagaaggcagagauuaaaccagaaaucccuacaaccagcacaucugucucagaguauuugauacucgcucagaagcaaaagacucaggccuaccuggaacccgagagugaagaucuaaucccgucccaccugaccagcgagguggagaaaggagaacgcgaggccucuucgucaguugcugcaauuccagccgcgcucccugcucagagcuccaucgugaaggaagagacgaaacccgccaguccacacucuguacugcccgacagcgucccugcaauuaagaaagagcaggaaccgacagccgcucuuaccuugaaggcagccgaugagcaaauggcgcuguccaaggugagaaaagaagagaucgugcccgacucacaggaagcuacugcccaugucagucaggaucagaagauggagccacaaccucccaacguuccugagucugaaaugaaauacagcguguuaccagacaugguagaugagcccaagaaaggcgugaagccuaaacucguccugaaugugaccuccgaacuugagcagaggaagcugucaaagaacgaaccagagguuauaaaacccuauagcccguugaaggagacaucucucuccgguccugaagcacugagugccgugaaaauggagaugaagcacgacagcaaaauuacuaccacaccaaucguccuacauucggcuuccucugggguggaaaagcagguugagcacggacccccugcccuggcauucucagcucucagcgaagagauuaagaaagagaucgaaccaaguuccucuacgaccacugccagcgugacaaagcuggacucaaaucuuacccgugcggucaaagaggaaauacccacugauuccaguuugaucacaccgguagaccggccugugcugaccaagguuggaaaaggcgaguuagggagcggacuacccccacuggugacgucugccgaugagcauucaguccuugcagaagaggacaagguggcuauuaagggugccuccccuaucgaaacuagcucuaaacaccuggcuuggagugaggcagaaaaggagauuaaauucgauucgcuacccuccguaagcucaaucgccgagcacucugugcucagcgaagucgaggccaaggaaguuaaagcuggccugccagugauaaagaccuccaguucacagcauucugacaagagcgaggaagcgcgaguggaggauaaacaagacuugcuguuuuccacagucugcgauagugagagauuagugagcucccagaagaaaucucucaugucaaccagcgaaguucuggagcccgaacacgagcuuccucugucguuguggggagaaauuaagaaaaaggagacugagcucccauccagucagaacguaucuccggcaagcaagcauaucauccccaaaggaaaggacgaagagacagccucauccucuccugaacuggagaaucuagcuaguggccuggccccaacccuucuccuguugagcgaugacaaaaacaagcccgcaguggaggucuccucaacagcccaaggugacuucccuagcgaaaaacaggauguggcucuggcggaguuaucucucgaaccagagaagaaagacaagccccaccagccucuggaacuuccgaaugccgggagugaguuuuccagcgaucugggcaggcagucaggaucuauuggcacuaagcaagcaaaauccccaaucaccgagacggaagacucgguuuuggagaaggggcccgcugaacuccgcagccgggagggaaaagaagagaacagagagcugugugccaguucuacaaugccugcaauuuccgaacuaagcucacugcuuagggaggaaagucagaacgaggaaauaaagcccuucuccccaaaaaucauuagccucgagucuaaggagccucccgccucaguggcugaaggcgguaauccagaggaauuucagccguucaccuuuagccugaagggguuguccgaggaggucucucauccugccgauuucaaaaagggaggcaaccaggaaaucggucccuuaccacccacuggcaaucugaaagcgcaagugaugggggacauucucgauaagcugagugaggaaaccggacacccuaacucgagccagguacuucaguccaucacagagccaucaaaaauagcacccucugaccuguuggucgaacagaagaagacugagaaagcccuacacagcgaucaaaccgugaagcugccugacguuaguacguccucagaggauaaacaggaccucggcaucaagcaguuuucucugaugcgcgaaaaucuuccguuagagcagagcaaauccuucaugacaaccaagccagcugaugugaaggaaacuaaaauggaggaauuuuucauuagucccaaggacgagaacuggaugcuggggaaaccugagaaugucgccagccaacaugaacagcgaaucgcuggaucugugcagcucgacucauccagcaguaacgaguugcggccaggccaacugaaggcagccguuucuuccaaagaucacacaugcgaagugcguaagcagguccucccccauucggcugaggaaagccaccugucaucccaggaggccgugucugcacuugacaccaguagcgguaauacugagacacugucauccaaaagcuacucuagugaagagguaaaguuggcggaagaaccuaagucccuagugcuggccgggaacguugagagaaauauugcugaaggaaaagagauccacagccucauggaaucagagucuuuacugcuugaaaaggccaacaccgagcugucguggcccagcaaagaggauucccaggaaaagauaaaacucccaccggagagguuuuuccaaaagccugucaguggcuugucuguggaacaggugaagucagagacgauuagcuccagugucaaaacugcacauuuccccgcugaagguguagagccagcccugggcaaugagaaggaagcacaccgcucuaccccucccuuuccagaggaaaaaccucucgaggaaagcaagauggugcaguccaaaguuaucgacgaugccgacgaggggaagaagcccucaccggaggugaaaaucccaacacagcggaagccuauuagcucuauacaugcuagagaaccccaauccccagagagucccgaagucacccagaacccuccgacacagccaaaaguggcgaagcccgaucugccugaggagaaaggaaagaagggcaucagcagcuucaaaucguggauguccucucuauuuuucgggaguagcacucccgacaauaagguugccgaacaggaggaucuagaaacccaaccaucaccuuccguggagaaagcagucacggugauugaccccgaaggaacaaucccaacuaacuuuaacguagcugagaagccugccgaucacucucugagcgaggugaaauugaagaccgccgacgaaccgaggggcacauuaguuaaaaguggugaugggcagaaugucaaggagaaguccaugauucugagcaacguggaagaccuccagcaacccaaauucaucucugaggugucacgagaagacuauggaaagaaagagauauccggcgauagcgaggaaaugaauaucaacagugucguuaccucugcagacggugagaaucuggaaauucagucauacucccuuaucggcgagaagcuggugauggaagaggcuaaaacuauuguaccaccucaugugaccgauagcaagcgcguccagaagcccgccaucgcgccaccuucgaaauggaacauaucuauuuuuaaggaggaaccccggagugaccagaaacaaaagucccucuugagcuucgaugugguugacaaagugccgcagcagccaaagucagcuucuagcaauuuugccuccaagaacaucacaaaagagagugaaaagccugagucaaucauucugcccgucgaggaaagcaaagggucccuaaucgauuucucugaggacagacugaagaaagaaaugcagaauccaacgagucucaagauaagcgaggaagagacuaaacuuagguccguaucacccaccgagaaaaaggauaaccuggaaaaucguucuuauacauuagcagagaaaaagguguuggccgaaaaacaaaacucgguugcuccucuggagcuccgcgacagcaaugaaauuggaaagacccagaucacucugggcucccggaguacagagcuuaaggagucuaaagcagaugccaugccccagcacuuuuaccagaacgaagacuauaaugagagaccaaagauuaucguggggagcgaaaaagagaagggagaagagaaagagaaccaagucuacgugcugucagaaggcaagaaacagcaggagcaccagccuuacuccgucaacguggcggaaagcaugucuagggagagugacauaucccucggucauucauugggggagacccagagcuucucucugguuaaggcuacgucggugacugaaaaguccgaggccauguuagcagaagcccacccggagauucgagaagcuaaagccguaggaacacagccccauccacuagaggagaguaaggugcuggucgagaaaaccaagaccuuccucccuguugcacuuagcugucgggaugagaucgaaaaucacucacugucucaggagggcaacuuggugcuggaaaaauccagccgcgacaugcccgaucacagugaggagaaggaacaauuuagagagucagaacucuccaagggcgggagcgucgacaucacuaaagagacagugaagcagggauuccaggaaaaagcuguagguacccagccaaggccucuggaggagucuaaggugcuuguugagaaaacuaagacuuuucuccccgugguccugaguugccaugaugaaauugaaaaucacagcuugucccaagagggcaaccugguguuagagaagucuucacgggacaugccggaucauagcgaagagaaagaacaguucaaggaguccgaacuauggaaagggggaucggucgacaucacgaaggagucuaugaaagagggcuuuccuaguaaggaaagcgagcgaacccuggccagaccauucgaugaaacaaagucauccgagacucccccuuaucuccuuucuccagugaaaccccagacccuggcgagcggugccuccccugaaauuaaugcaguuaagaaaaaggagaugccacgcagugaguugacacccgaaaggcacaccguacauacuauacagacgucaaaagacgauaccagcgacgugccgaagcaaucuguccugguguccaaacaccaccucgaggcugccgaagauacacguguuaaggagccucugaguagcgcaaagucaaacuacgcucaguuuaucucuaauacuuccgccucgaacgccgacaaaauggugagcaauaaggaaaugcccaaagagccagaggacaccuaugcgaagggggaagauuucacagucaccaguaaacccgcuggacuuuccgaggaccagaagacugcauuuucuauuaucucagaaggcugcgagaucuuaaacauucaugccccugcuuucauaagcuccaucgaucaggaggaaucugagcaaaugcaggacaagcuggaauaccucgaggaaaaagccagcuuuaagacaauuccauugcccgaugacagugagacgguggcaugucacaaaacccugaagucacggcuagaggaugaaaaaguaacuccucugaaggagaauaagcagaaagaaacacauaagaccaaagaggaaaucuccaccgacagcgagacagaucucucuuucauucaaccaacuaucccgagugaggaagacuauuuugagaaguacacgcuuauagauuauaacaucucccccgacccugaaaaacagaaggccccacagaagcugaauguggaggaaaaauugagcaaggagguuaccgaggaaacaauuucauuccccgucucgucuguggagagcgcucuggaacacgaguacgaccucgugaaacuggaugaguccuucuacggcccugaaaaggggcacaacaucuuaagucauccagagacucagucacaaaauucugcggacagaaacgucagcaaagauaccaagagggacguugauuccaaaagucccggaaugccgcuuuuugaagccgaggaaggugugcugagccgcacacagauuuucccuaccacuaucaagguaauagacccagaguuucucgaggaacccccugcacuagcuuuccuguauaaggauuuguacgaggaagccgugggcgagaaaaagaaagaagaggagacggcaucugaaggggacuccgucaauucagaggccagcuuucccucgcgaaacuccgauacagacgauggaaccggcauuuauuucgaaaaguacauccugaaagacgauauucuccacgacacuucucuuacccagaaggaccagggucaagggcuggaggaaaagagagugggaaaagaugacaguuaucagccaaucgcugccgagggcgagauauggggcaaguuugggacaaucugccgggaaaaaucauuggaggaacagaagggaguuuacggugagggcgagagcguggaucaugucgaaacuguggggaacguagcgaugcagaaaaaggcaccgauuaccgaggacguuaggguggccacacaaaagaucuccuaugcugucccuuucgaagauacgcaccaugugcuggagcgcgccgacgaagcaggaucucacggcaaugagguggguaacgcuagccccgaggucaaucucaacguuccagugcagguaaguuuucccgaagaggaguucgccucaggggcuacccacgugcaggagacuuccuuagaagaaccuaaaauucuggucccacccgagccuagcgaagaacgucuuagaaauucuccagugcaagaugaauacgaguuuacagaaucccugcauaacgagguugugccgcaggacauccuaagugaggaacucagcucagagucuacccccgaagauguccugucccagggaaaggagagcuucgagcacauaucggaaaaugaguuugccagugaagcagagcagucuacuccugcggaacaaaaagaguugggcucagagcggaaggaagaggaccagcuguccagcgaagugguaacagagaaagcccagaaggaacucaagaaaucucagauugauaccuacuguuauacgugcaaguguccaaucagcgcuaccgacaaaguuuucggcacacauaaggaucacgagguguccacucuugacaccgccaucagugcagucaaagugcaacuggcugaguucuuagaaaaccugcaggagaagucauugaggauugaagccuuuguuagcgagaucgaguccuucuuuaauacaauagaagagaacugcucuaagaaugaaaaacgccucgaggaacagaacgaggagaugaugaagaaagugcuggcacaguacgacgaaaaggcccaaaguuucgaggaagucaaaaagaaaaagauggaguuucuacaugaacagauggugcacuuccuucagucaauggauacugcgaaggacacccuggagacaauuguacgagaggcugaagaacucgaugaagccguguuucugaccagcuucgaggaaaucaaugagagauugcuguccgcaauggagucuacugccucgcucgagaaaaugcccgcugccuuuagccuuuucgagcacuaugacgauuccagugcacggucagaccagaugcugaagcaagucgcuguuccucagccacccagguuagaaccucaggagccgaacucugccacgagcacaaccauugcgguguacugguccaugaauaaagaggaugucaucgacaguuuucaaguguauuguauggaggaaccccaggaugaccaggaaguaaacgagcugguggaagaguaccgcuugacuguuaaggagucuuauugcauauucgaagaucucgagccagacagauguuaccaggugugggucauggcugugaacuuuaccgggugcagccugccuucagaaagggccaucuuccggacagcacccuccacgccaguuauucgugccgaggacuguaccgucugcuggaauacugcuacaauccgcuggcgaccuaccacucccgaagcaacagagaccuacacacuagaguauugcagacaacauagcccagaaggagagggucuuaggucuuucucaggcauuaaagggcugcagcucaaggugaaccugcagccgaaugauaacuacuuuuucuaugugcgggccaucaaugcguuuggaacaagugaacaguccgaggccgcuuugauuagcacccgcggcacgagauucuuacugcucagggaaaccgcacacccugcccuucauaucucgucuuccgguacaguaaucagcuuuggggagcggcgaagacugacugagauucccucaguccuaggagaggaacugccaaguuguggccaacacuacugggaaaccacagugacugacugccccgcuuaucgccucggcaucuguucuuccagcgccguucaggcaggggcuuugggacagggugagaccucaugguacaugcacugcagugagccucagagguauacguucuuuuacuccggcaucgugagcgauguccaugugacagaacggccagcccguguugggauucugcuugacuacaacaaucaaagacugauauucaucaacgcggagucugaacagcucuuauuuauuaucaggcaccgcuucaaugagggagugcaucccgccuuugcacuggaaaagccuggcaaauguaccuugcaccuggguauugagccgcccgauucgguacggcauaaguga

SEQ ID NO: 54558 - RNA, 1311 nt, Artificial Sequence
  derived and/or modified sequence opt3 from CNBD1__Homo_sapiens__NP_775809
augcccaugagcucccugccugccgcuauccucucucacaugaccgcaauuaacaaugugccaccgcccccucuucauucaauaccaaaccugaagaaaaguaagcacaucaauuacggccaguugaacgccuuaugccauauuagagggcaacacagcagguccaugucuaauauccugucggcgcaugacacauucaugaaacaguaucccaaggucuuucuacaccagaaaccucggcucccaaagcuguucaagcaggaggaacaacgcgagcuuaacgaaggaaaagaggaaucacagcaccagcagcccgaugacagcaauaacauugcuguucaugugcaacgagcccacgguggccauauccuguaccguccuaagagagcaacugagaaauuugaggaguucuuggccauacucaagaaacugccaauccacaggacgccguaugaacacaagaccguauggaaguuucugaaaacaauucccgaucucacuuuccaguuaaaugacaagcaucugaaaacccuuaguaagacaguguuuuccgaaaccugguugaaagggucuacugucguggcuaacgauggauucuacguuauccugaagggccuagcacggccucagacaaauguguauaaaaaccucauugaggguagcgacuccccagauucauuuaucagucagagcuuccacucuuuuauaugguccgaggaguucaaaaauucaacccuggccgaaauguaccuucccagcuaugacaguaugcugucuaagugguccacguuugggacuuuggaagucaugccucaaaacgagagcgaaacccagauguucucggugguaacagaggaugacugugagauucucaagaucccagcuaagggauacgccaaaauuaaggaagagaaaaucaagcuggaaaauaugcagaaguuaaaacugauccgcaugugccccuacuaugaggaauggccgacucucucuauuuacgagcuuauagcgcuguugaaguggaaaaaguucccucccggccauguuaucguggaguccggcaacauuaucucauuugucggguauauaaacaguggauguugcaauauuuacagaagcaucaucgguuucgugaaacuaagguccaacaaggugaagcggucucaaaaacuggucuauaugggcaagcucaaagaaaaggagagcuuuggggaaauuucaguucugcuucaggugccauucaccuguacaaucauuaccaaaaaggagguagaaauggcaauaaucgaggauaaggaccuguuuguggccuga

SEQ ID NO: 54559 - RNA, 540 nt, Artificial Sequence
  derived and/or modified sequence opt3 from CNBP__Homo_sapiens__NP_001120664
augagcuccaacgagugcuucaaguguggcagaucugggcacugggccagggaaugccccaccggagguggccgggggcgcggaaugcgaucacguggcagagguggguuuacaagugacaggggauuccaguuugugagcuccucucugccugauaucuguuaccggugcggcgagucgggccaucucgcuaaagacugugaucuucaagaagacgucgaggcaugcuauaauugugggcgcggaggucacauugccaaggauugcaaagaaccaaagagagagagggagcaguguugcuacaacuguggcaaaccggggcaucuggcgcgggacugcgaucacgcugacgaacagaagugcuauucauguggagaguucggccauauacagaaggauugcacuaaaguuaaguguuaccgcugcggugaaacggggcacguggccaucaauuguagcaaaaccagugagguaaacugcuaucgauguggagaguccggccacuuggcaagagaaugcacaauugaggccacugcuuga

SEQ ID NO: 54560 - RNA, 1524 nt, Artificial Sequence
  derived and/or modified sequence opt3 from CNDP1__Homo_sapiens__NP_116038
auggaccccaagcugggcagaauggccgcuagccuccuugcagugcuguuguuacugcuagagagggggauguucuccucuccuucaccaccgcccgcccuccuggaaaaagucuuucaguacaucgaucuucaccaagacgaguucguucagacccugaaggaauggguggcgauugagagugauagcguacagccugugccacgguuucgccaggaauuguuccgaaugauggcugucgccgcagacacacuccaacgucugggagccagaguggcuuccguugauauggguccccagcagcugccugacggccagucucucccaauacccccugugaucuuagcagagcuggggucggauccaacuaaaggaacggucugcuuuuauggccaucuugacgugcaaccggccgauaggggugacgggugguugaccgaucccuacguacugacagagguugacggaaagcuauauggccggggcgcuacugauaacaaagggccugugcucgccuggauuaaugcggucucagcauuccgcgcccuggaacaggaccuuccagugaacaucaaguuuauuaucgagggaauggaagaggcugguagcguggcccuggaggaauuggucgagaaggaaaaagacagauucuuuaguggcguugauuacauagugaucuccgacaaucucuggauuucucagaggaagcccgcaaucaccuaugggacacggggaaacagcuacuucaugguagaggugaaaugucgcgaucaggacuuucacuccggcaccuucggugggauucugcaugaaccuauggcugauuuagucgcccugcucggaucacuuguggacaguagcggccacauccugguuccaggcauauaugaugaggugguccccuugacugaggaagagauuaauacauacaaggcgauccaucuagaccuggaagaguaccgaaacucuuccagaguggaaaaauuucucuucgauaccaaggaggagauucugaugcaccuuuggagguauccgucacugagcauccacgggaucgaaggagccuucgacgagccugguacgaagacuguaauucccggccggguuauagggaaauuuaguauccguuuggugccacauaugaaugucucugcaguggaaaagcaagucacccgccaccucgaggauguguucuccaaaagaaacagcucgaauaagaugguugugucuaugacacugggauuacauccuuggauugcuaacaucgacgacacucaguaccuggccgcuaaaagggccauacggaccguauuuggcacagaacccgauaugauucgagacgguuccaccaucccaaucgcaaagauguuccaggagauuguccacaaaucagugguucuaaucccccucggggccguggaugacggcgagcacagucaaaaugaaaagauuaaccgcuggaauuauauagagggaacgaagcuguuugcugcguucuuucuugaaauggcacaguugcauuga

SEQ ID NO: 54561 - RNA, 1176 nt, Artificial Sequence
  derived and/or modified sequence opt3 from CNDP2__Homo_sapiens__NP_001161971
auggccgcucugaccacacucuucaaguacaucgacgagaaccaggauagauauauuaaaaagcuggcaaaauggguggccauacaaagcgucuccgcguggcccgaaaagaggggcgagauccggcgcaugauggaaguugcugccgcagacgugaaacagcuugggggaucuguagaguugguggauauugguaagcagaaggaaaucccugucaaugugcgauuuugcuuagagggcauggaggaaucagggagugagggacuggacgaacuaauuuucgcccguaaagauacuuucuucaaggacguugauuacguguguaucagcgacaacuauuggcucggcaaaaagaaaccaugcauaacguacggucugagagggaucuguuacuuuuucauugaggucgagugcuccaauaaggaucuucacucuggaguguauggcggcucgguacaugaagcuaugaccgaccugaucuugcucauggggucacugguugauaagaggggaaacauucugaucccggguauaaaugaggcaguggccgcugucacagaagaggaacacaaacucuaugacgauauugacuuugacaucgaggaguucgccaaggaugugggcgcgcagauuuuacugcauagccacaaaaaggacauccuuaugcaucgguggcgcuaccccaguuugucccugcacgggaucgaaggagcauuuucuggcagcggugccaaaacugugauuccuagaaaggucguugggaaauucuccauaaggcuagugccaaacaugacccccgagguagugggagaacaagucacaucauaccucaccaagaaguuugcugagcugcggaguccuaaugaauuuaaaguguauaugggccacggcgggaagccauggguuagcgauuuuucucauccccacuaccuugccggacgccgagcaaugaaaacuguguucggugucgagccugaccugacaagagagggcggguccaucccagugaccuugacguuccaggaagcuacuggaaagaacguaaugcuccugccgguuggcucagccgaugacggugcgcauagccagaaugagaaauuaaacagguauaauuacauugaagggaccaagaugcuggccgcauaucucuacgaggugagucagcuuaaggauuga

SEQ ID NO: 54562 - RNA, 2280 nt, Artificial Sequence
  derived and/or modified sequence opt3 from CNGA1__Homo_sapiens__NP_001136036
auggagagcagauccucucccaggcuggaaugcucaggcgccaucagugcucacuguagccuccaucuuccugacuccucugauuuccagcugauuuuuguguucuuggucgagaugggguuucaccauguuggacaagcagguuuagaacugcuaauaucgucagaccucccaaccagcgccagucaguccgcgggcaucacagauaugaagcugucuaugaaaaacaauauuaucaacacucagcagagcuucgugacgaugccgaauguaauugugcccgacaucgagaaggaaauacggcgcauggagaacggggcuugcuccucauuuagugaggaugacgauagcgccucuaccuccgaagagucagaaaaugagaacccucacgcacgaggcagcuucaguuacaaaucucuucguaagggagguccaucccaaagagagcaguaucugcccggggccaucgcuuuguuuaaugucaacaauagcucgaacaaagaccaggaaccugaggaaaagaagaaaaagaaaaaggagaaaaagucuaaguccgaugacaaaaaugaaaacaagaaugauccagagaaaaagaaaaagaaaaaggacaaggagaaaaagaaaaaggaagagaaaucaaaggauaagaaagaagaggaaaagaaagaggugguugugauugaccccaguggaaacacauacuauaauuggcuauucuguaucacucugccugucauguacaacuggaccauggugauugcaagggccugcuuugacgagcugcagagcgauuaucucgaauacugguuaauccuggacuauguauccgauauaguuuaccuuauugacauguucgugcggacacgcaccggcuacuuggagcaaggccugcuagucaaggaggaacucaaacugaucaacaaguauaagucuaaucuucaguuuaaacuggauguguugagccucauuccaacugaccuguuauacuucaagcugggguggaacuauccggaaaucagacucaauaggcuucugcgguuuucacgcauguucgaguucuuucagcgaacagagaccagaacgaacuaccccaauaucuucaggauuaguaacuuggugauguauauagucaucauuauccauuggaaugcuuguguguuuuacuccauaagcaaagccauuggauucgguaacgauacuuggguguauccugacaucaaugauccagaauuuggccggcuagcgcguaaguacguauacucucuguauuggucaacccucacacugacuaccaucggggagacacccccuccagugcgcgacagugaauacgucuucgugguuguggauuuucuuauuggaguccugaucuucgcaaccauugugggcaacauagguagcaugaucuccaauaugaacgccgcuagagccgaguuucaggcaaggauugacgcuaucaaacaauauaugcacuuccggaauguaucuaaggacauggagaagcgaguuaucaaaugguuugauuacuuguggacgaacaagaaaacuguggacgaaaaggagguccucaaauaucugcccgauaaguuacgcgccgaaauugcgauaaaugugcaccuggacacacucaaaaaggucagaaucuucgccgauugcgaggcagggcuccugguggaacuuguuuugaagcugcagccgcagguuuacucgccuggagacuauauuuguaaaaagggcgauaucggcagggagauguacauuaucaaagaggggaagcucgcuguagucgccgacgauggagugacccaauuuguugugcugagcgacgguuccuacuucggcgaaauaucaauccuuaacauuaaagggaguaaggcuggaaaccggcgcacugccaauaucaagucuauuggcuauagcgaucuguucugcuuguccaaagacgaucucauggaggcacugacagaauaccccgacgccaagaccauguuagaggaaaaagguaagcagauccugaugaaagacgggcuacucgaucugaacauagcuaaugcgggcucagacccaaaggaucuugaggagaaggucacgagaauggaaggaagcguggacuugcugcagaccagguuugcacguauucucgccgaguaugaaucuaugcagcaaaaacugaagcagcgguuaacaaaaguagagaaguuccugaaaccucuuaucgauacugaauuuuccaguauugagggccccggggcugagagcggaccaaucgacucuaccuga

SEQ ID NO: 54563 - RNA, 2031 nt, Artificial Sequence
  derived and/or modified sequence opt3 from CNGA3__Homo_sapiens__NP_001073347
auggccaagaucaacacccaguacagccaccccuccagaacacaucugaaagugaagacuucugacagggaucucaaucgggcugagaacggccuuucacgcgcacacaguagcuccgaagagacgucuucgguccugcaaccugggauugccauggaaacccgaggauuggcggacucaggucagggcagcuucacagggcagggaauagcucguuuaaguagacugaucuuucuacucaggcggugggccgcacgccauguucaccaucaggaucaaggcccagacuccuucccggauagauuuaggggugccgagcugaaagaagugucuagccaggaguccaaugcucaggcaaacguagggucacaggagcccgccgaccggggacgccgaaagaaaacuaagaagaaagaugcuauuguggucgacccuaguagcaaucuuuauuacagauggcugaccgccaucgcguugccaguguucuauaacugguaccuccugauuugcagggcauguuuugaugaacugcaaucugaguaucucauguuauggcugguucuugacuacuccgccgauguguuguauguccuggacgugcuaguacgggcucguacaggcuuccucgaacagggccugaugguuucagauaccaaucgccuuuggcagcacuacaagacuacaacccaguuuaaacuggacguguugagccucguccccacggaccuggccuacuuaaagguggggacuaacuauccugaggugagauucaauaggcugcucaaauuuagucggcuuuucgaguuuuucgaucgaaccgaaacacgcacuaacuacccaaauauguuuagaaucggaaaccuggucuuguauauacuaaucauuauccacuggaaugcaugcauuuacuucgcuaucucuaaguucauagguuuuggcaccgacuccuggguuuaucccaacauuagcaucccugagcaugggaggcugucgcggaaguacauuuauucucucuacugguccacacugacccuuacgacuaucggagaaacaccaccgcccgugaaagaugaggaauaccuguucguaguggucgacuuuuuggugggcguucucaucuucgccaccauuguggguaaugucgggucaaugauaaguaacaugaacgcgagccgcgccgaguuucaagcaaagaucgauuccauuaaacaguauaugcaguucagaaaggugacuaaagaccuggagacaaggguaauccguugguuugauuacuuaugggcuaauaagaaaaccguugacgaaaaggaggugcugaagucucuaccugauaaacucaaggccgaaauagcuauuaacguccaccuggacacgcuuaaaaaggugcggaucuuccaagauugugaggccggauugcuggucgaacucgugcugaaacuucgaccaaccguuuuuagccccggcgacuauaucugcaagaagggcgacauugggaaagagauguacaucauuaaugagggaaagcuggcagugguagccgaugacggugucacacaguucgugguuuugucagauggcaguuauuuuggggaaauauccauccucaacauuaaaggaagcaagucuggcaauagaaggacugcuaacauccgcucaaucgguuacagugaccuguucuguuuaagcaaagaugaccugauggaggcgcuaaccgaauauccugaggcaaagaaggcccucgaagagaaagggcggcagauucugaugaaggauaaucuuauagacgaggaauuggcuagagccggcgcagauccaaaagaccuggaggaaaagguggagcagcucggauccucucuggauacauuacaaacuagguuugcccgccugcuugcugaguacaacgccacccagaugaaaaugaagcagcgauugucgcagcucgaaagccaagucaagggcgggggagacaaaccccuggcagauggugaggugccgggcgacgcgacaaagaccgaagacaaacagcaguga

SEQ ID NO: 54564 - RNA, 900 nt, Artificial Sequence
  derived and/or modified sequence opt3 from CNGB1__Homo_sapiens__NP_001129111
augcugggcugggugcagagaguccucccccaaccuccagggaccccgaggaagacaaaaaugcaggaggaagaggaaguugagcccgaaccugagauggaggccgaaguggagccagaacccaacccugaggaggcugaaacugagagcgaauccaugccacccgaggaaucuuucaaggaggaggaaguagcaguggccgacccuucaccacaggagacgaaagaagcggcucuuaccaguacaaucagccugcgggcccagggagcagagauuuccgaaaugaacucuccgucgcgccgagucuugacuugguuaaugaaggguguggagaaaguuauaccccaaccugugcacucaaucaccgaggauccagcccagauucugggccaugggagcacaggagacaccggcugcacugaugaacccaaugaggcucuagaagcacaggacacacguccuggucucagacugcuucugugguuggagcagaaucucgaaaggguccugccacaacccccgaagaguuccgagguguggcgggaugagccugccguagcuaccggggccgcgucugaccccgcaccaccuggacgcccccaggaaaugggcccaaagcugcaggccagagagacgcccagccucccuacuccaaucccguuacagcccaaagaggaaccuaaggaggcuccagcccccgaaccucaaccaggcucccaggcacagaccucaagucugcccccgacaagggauccugcucggcuuguugccuggguguugcaccgccuggagauggcgcuaccacaacccguccuccaugggaaaauuggagaacaggagccugacagccccgguaucugugaugugcagacucgagugaugggcgccgggggacuguga

SEQ ID NO: 54565 - RNA, 2430 nt, Artificial Sequence
  derived and/or modified sequence opt3 from CNGB3__Homo_sapiens__NP_061971
auguucaagagccugaccaaagugaacaaggucaaacccaucggcgagaauaacgaaaaugagcaguccucuagaaggaacgaagaggggucacacccuaguaaucaaagccagcagacaacugcccaggaagagaacaagggagaggaaaaaucccucaagacgaagucuaccccaguuacaucggaggaaccgcauacuaauauucaagacaaacuuucaaagaaaaacagcaguggugaucugaccacaaaucccgacccucagaacgcugcagagccaaccggcacugugcccgagcagaaggaaauggauccugggaaagagggaccaaauucuccccagaacaagccuccagccgcgccgguaauaaaugaauacgcugacgcccaauugcacaacuuagugaagcggaugcgccagcgaacagcacuguauaaaaagaagcuagucgagggcgaucucuccagccccgaagccuccccucagaccgcuaaaccaacggcagugcccccuguuaaagagucagacgauaagccaacugagcauuacuaucgucugcuuugguuuaaagugaagaagaugccccugaccgaauacuugaaaagaaucaagcucccgaauaguauugacagcuauacagauaggcuguaccugcucugguuacugcuugucacuuuggccuauaacuggaacugcuguuucaucccucugcggcuaguguuucccuaccagaccgcugacaauauucacuacuggcucaucgccgauauaaucugcgacauuaucuaucuguacgauaugcuuuucauucaaccacgccugcaguuuguaagagguggggacaucauaguugacucuaacgaguugaggaaacauuaucggacauccaccaaguuccagcucgauguggcgucaauuaucccuuuugacauuuguuaccuguucuuuggauucaaucccauguuucgcgcaaaccgaauguuaaaauauacgagcuucuuugaauuuaaucaccaccuggagaguaucauggauaaggccuacaucuauagagucauuaggacuacaggcuaccuccuuuucauacugcauaucaacgcuugcguguacuauugggccucuaauuacgaaggcauugggaccacucgguggguguaugacggagaggguaacgaguacuugcguuguuauuacugggcaguccgcacacuaaucaccauaggcgggcugccagaaccccaaacgcucuuugagauuguuuuccagcugcuuaauuucuucuccggaguguuuguauucagcucgcugaucggccagaugagagaugugaucggugcugccaccgcgaaccagaauuauuuuagggccugcauggacgauacaauugcauacaugaacaauuacucuaucccuaaguugguccaaaaacgggugcgaacuugguaugaauacaccugggacucccagcgcaugcucgaugagucagaccuguuaaagacacugccaacuaccguucagcuagcucucgccauugaugugaacuucaguauaaucagcaaagucgaccuguuuaaggggugugacacacagaugauuuaugauaugcuuuugagacugaaauccgugcucuaccugccgggagacuucguaugcaagaagggcgaaaucggcaaagagauguauaucauuaagcacggggagguucaagugcuuggaggucccgauggcaccaaaguccuggugacuuugaaggcugggucugucuuuggagaaauaagccuccuggccgcaggcggugggaauaggcggacggccaacgugguugcucauggcuucgcgaacuuacugacacuagacaaaaagacccuccaggagauccuggugcacuacccugauucagaacgcauucuuaugaagaaagcaagaguauugcugaagcagaaagccaagacugcugaggccaccccacccaggaaagaccucgcacuguuauuuccuccaaaggaggaaacacccaaacuguucaagacccuuuugggaggcacugggaaggccagucucgcucgucugcuaaaacugaagcgggagcaggccgcacagaaaaaggaaaauuccgagggaggugaagaggagggcaaagaaaacgaggauaagcaaaaggaaaaugaggacaaacagaaggaaaacgaggauaaagggaaggagaaugaagacaaagauaagggacgagagccggaagagaagccucucgacagaccagaauguacagcgagccccaucgcugucgaggaggaaccucacucugugaggcgcacgguucugccccggggcaccucaagacagagucuuauuaucagcauggccccauccgcagaggguggggaagagguguugacuauagaggucaaagaaaaggccaaacaauga

SEQ ID NO: 54566 - RNA, 483 nt, Artificial Sequence
  derived and/or modified sequence opt3 from CNIH3__Homo_sapiens__NP_689708
auggccuucaccuuugcugcauucugcuacaugcugagccucgugcuuugugccgcgcugaucuuuuucgcuauuuggcacauaaucgccuuugacgaguugagaacagauuucaagucccccauugaccagugcaacccuguccaugcaagggaacgguuacgcaauaucgagcgaauuuguuuucugcuacguaaacucguucugccagaauauucuauccacucacuuuucugcauaauguuucugugugcccaagagugguugacucucggccugaacgugccgcuccuguucuaccauuuuuggagauauuuccacugccccgcugauaguagcgaauuagcauacgacccuccaguagugaugaaugccgauacgcuguccuauugucagaaggaggcuuggugcaaacuugccuuuuacuugcugucuuucuucuauuaccuauacuguaugaucuauacccucgucucgucauga

SEQ ID NO: 54567 - RNA, 2163 nt, Artificial Sequence
  derived and/or modified sequence opt3 from CNKSR1__Homo_sapiens__NP_001284576
auggagcccguggaaaccuggacaccuggcaaggucgccacuuggcugagagggcucgacgauagccuucaggacuacccauucgaggauuggcaacugccggguaaaaacuuguuacagcugugcccccagucccuagaagcucucgcaguuaggucucugggacaccaggagcuuauccugggcgggguggaacaauugcaggcccucucaagucggcugcagacggagaaucugcagagccucaccgagggauuacugggcgcgacacaugacuuucaauccauuguacaggguugucuuggggauugcgcuaagacuccuauagacguguugugugccgcagucgaacugcuacacgaggccgaugcucuccuguucuggcuuucucgcuaucuguuuucgcauuugaacgacuucucagcaugccaggaaauccgagaucuccuggaggaguuaagccaggugcugcacgaagacggaccagccgcugagaaagaaggcaccguucuccguauuuguagucauguggccggcaucugccacaauauucuugucuguugccccaaggagcuguuggaacaaaaagcggugcuagagcagguacagcuggauuccccucucgggcuggagauccacacaaccucuaacugucaacauuuuguuagccagguggacacucaggucccaacagauuccagacuucagauacaacccggagacgaaguggugcagaucaaugagcaggucguugugagggaggaacgggacaugguagguuggccucgcaagaacauggugagagaacuguugagggagccagcaggccucucacuggucuuaaagaaaauuccgauccccgagaccccuccacagacgcccccucaagugcuggauaguccacaccagcggagccccucucuaucccucgccccgcugucaccucgcgcucccagcgaagacguuuucgccuuugaucuuaguucuaauccauccccugggcccagcccagcauggacugacucggcuucuuugggacccgagccucugccaauuccgcccgaaccuccagccauccuccccgcgggcguggccgguaccccugggcugccagagucccccgauaagucaccggucggacgaaagaaaaguaaaggccuugcaacaagacugagcaggcggcguguguccugccgcgaauugggcagaccugacugugauggguggcuccuguuaaggaaggcuccaggagguuucaugggcccccgguggcgacgcagaugguuuguacugaaggggcauacucuauacugguauaggcagccucaggacgagaaagccgagggacucauaaacguuucuaauuacagccuggaaucaggccacgaucaaaagaaaaaguauguguuccagcuuacccacgacgucuacaaacccuuuauuuucgcugccgauacauugaccgaccugaguaugugggugcggcaucucaucacgugcauuuccaaguaucagagcccaggucgcgcaccucccccaagagaggaagacugcuacucugagacugaggccgaagauccggacgaugaggcugggucacacagugcgagcccuucccccgcacaggccggcucuccacugcauggagacacaucgcccgcugccaccccuacucaaaggagcccacguacauccuuuggcucauuaaccgauaguucugaagaggcacuggaagggaugguccggggacuucgacaggguggcgugagcuugcucgggcagccccaaccucugacgcaggagcaguggagauccucauucaugaggcgcaaccgggacccgcagcuaaaugagagaguucacagggugcgcgcccugcaaagcacccucaaagcuaagcugcaggaacuucagguauuggaggaaguccugggagauccagaguuaacaggcgaaaaguuccgacaguggaaagagcaaaaccgggagcucuacucugaaggucugggggccuggggcguggcacaggcggagggauccagucauauccuuacuagcgacucuaccgaacagucaccccacucccugccuagugauccagaggaacacagccauuuguguccccucacaucggaguccucucugcguccuccggaccuauga

SEQ ID NO: 54568 - RNA, 3015 nt, Artificial Sequence
  derived and/or modified sequence opt3 from CNKSR2__Homo_sapiens__NP_001162118
auggcccugaucauggagcccgugagcaagugguccccuucucaggucguugacuggaugaaaggccucgaugacugccuucaacaguacauuaagaacuucgaaagagagaaaauaucaggggaucagcuguugaggaucacccaccaggaauuagaggaccugggagugagucggauuggucaucaagaacuaauccucgaggcuguagaucugcuuugugcacugaauuauggcuuggagacagaaaaccucaagacucugagccacaaacugaaugccuccgcgaagaaccuccagaauuuuauuacggggcgccgacguucuggacauuacgacggcagaaccucgaggaaguuaccaaacgauuuccugacaucaguggucgaccuuaucggugcugccaagagcuugcuggcauggcuagaucggaguccguuugccgcugugacugacuauuccguuacccgcaauaacgugauacagcucugccuggagcuuacaaccaucguccagcaagauuguacuguguacgaaacagagaauaagauucugcacguaugcaaaaccuugucugggguuugugaccauaucauuagccucuccucagauccccuggugagucagagcgcacacuuagaggucauccagcuggccaacauaaagccuucugaaggacucggcauguauauuaaauccacguacgacggccuucacgugaucacugggaccacagagaauagcccagcugacagaugcaagaagauucaugccggagaugaagugauccaggucaaccaccaaacuguuguggguuggcagcugaaaaauuugguaaacgcgcuaagggaggaccccagcggcgugauccugacccucaagaaacggccucagaguaugcugacaucugcaccagcccuucugaagaauaugcgcuggaaacccuuggcucuccaaccucugauuccacgauccccgaccagcucggucgccacgcccucuuccacuauaucaacaccuaccaagagagauaguagcgcauuacaggaccuguauaucccacccccuccagcugaacccuacauuccgagggaugagaaagggaaccuaccuugugaggaccuccggggacauauggugggcaagcccguucacaaggguuccgaaucuccaaacagcuuccuggaucaggaguaccguaaacgcuuuaauaucguggaagaggacacuguccuuuauugcuacgaauaugagaaggggagaucaaguucccagggaaggcgggagagcacaccuaccuacgaaaacucuuugcugcgauauaugucaaaugagaaaauagcccaagaagaguacauguuccagcgcaacaguaagaaagauacgggcaaaaagagcaaaaagaaaggcgacaaguccaauucucccacccacuauucgcuccugccaagccuucagauggaugcgcugagacaggacauuauggggacacccgugccugaaacuaccuuguaccauacauuucaacaguccucacuccagcacaaaaguaagaagaaaaacaagggaccaaucgccgguaaaucuaagaggcggaucagcuguaaagaccugggccgcggggauugcgagggaugguuauggaagaagaaagacgcaaaguccuacuucucacagaaauggaagaaauauugguuuguacugaaggaugcuagccuauacugguauauuaaugaggaagacgagaaagccgaaggcuucaucucucucccggaguuuaagauugauagagcuuccgaguguaggaagaaauacgccuucaaggcaugccaucccaaaauaaagaguuuuuauuucgccgcugaacaccuggacgauaugaaccguuggcuuaaucggaucaacauguugacugcggguuacgcagagcgagaaagaauuaaacaagagcaggacuauuggagcgaaucugauaaggaggaggccgacaccccuuccacaccaaagcaggauucacccccuccacccuacgacaccuacccgaggccuccaaguaugagcugcgcuucgcccuauguugaagccaaacauucccgccugucuagcacugagacgucacagagucaauccucucacgaagaguuccggcaggaagugacagggagcuccgcagucucaccuaucagaaagaccgccagccagaggcgcaguuggcaagaucucaucgagacuccccugaccucuuccggcuuacacuaccugcagacacuuccauuggaggacagcguguuuucggacucagcugccauuucuccugaacaucgacggcagaguacccuccccacucagaaaugucaccuucaagaucauuauggaccauacccgcuagcagaguccgaacguaugcagguccugaauggcaacgggggaaagccuagaucauucacacuccccagggacucugguuuuaaucacugcugucugaacgcgccagugagcgcuugcgauccccaggacgauguucagccuccagagguggaagaggaggaagaggaagaggaggaagagggcgaagccgcaggggagaauauaggagaaaaauccgagucacgcgaggaaaagcugggcgacaguuugcaagaucuguaucgggccuuagagcaggcuagccucucuccccugggugaacacagaaucuccacgaagauggaguacaaacuuucauucauuaagagguguaacgacccuguaaugaacgaaaaacugcaucgauugcgcauccucaagaguacccugaaagcccgggagggggaggucgcaauuaucgauaaggugcuagacaauccggaucugacuagcaaggaauuucagcaguggaaacaaauguaucucgaccuguuccuugauauaugccagaacacaaccuccaaugacccauugucuaucucgagcgagguugacgugauuacaucaucccuggcucacacucauaguuacaucgaaacccacgucuga

SEQ ID NO: 54569 - RNA, 1668 nt, Artificial Sequence
  derived and/or modified sequence opt3 from CNKSR3__Homo_sapiens__NP_775786
auggagcccgugaccaaguggagcccuaaacaggucguugacuggacaagaggccuggaugacugccuccaacaguacgugcacaaguucgaaagggagaaaaucaacggggaacagcuucugcagauuucccaucaagauuuggaggaauuaggaguaacucggauaggucaccaggagcuggugcuagaggccgucgaccuccugugugcucuuaauuauggccuggaaacggauaacaugaagaauuuggugcucaaacugcgcgcaucuucacauaaccugcagaauuacaucaguagccgacguaaguccccagccuaugacgggaacaccucuagaaaggcgccgaaugaguuucucacaucgguuguggaauuaauuggagcugccaaagcacugcuugccugguuggauagggcucccuucacuggcaucaccgacuuuucagucacaaagaacaaaauuauccagcugugccuagaucucaccacuacagugcaaaaggacuguuucguagcagagauggaggauaaaguucugaccguggucaaggugcuuaaugguauaugcgacaagacgauccggagcacuaccgauccugugaugagucagugugccugccuggaagagguccacuugccaaacauuaaacccggggaaggacucggcauguacaucaaguccacauaugacggccugcauguuauuacugggaccacagagaauagcccugcugaccgcagccagaaaauccacgccggagaugaagugauacagguaaaccaacagaccguggucgguuggcaguuaaagaaucuggugaaaaagcucagagagaacccaacgggcguugugcuucuguugaaaaagaggcccacuggguccuuuaauuucaccccugcgccacuaaagaaccugcgguggaaaccgccccucguccaaacaucaccuccacccgcaacuacacagaguccugagagcaccauggacacgucucugaagaaagaaaaguccgccauucuugaucuguacaucccacccccgccugcugugcccuauucaccacgcgacgagaacggaucuuuuguauacggcgguaguucuaaauguaagcagccuuugcccgggccaaagggauccgaaagccccaauucguuccucgaucaggagucucgaagaaggcgguuuaccauugccgacuccgaucaacugccuggcuacucaguugaaacaaacaucuuaccaacuaaaaugcgugagaagaccccgaguuauggcaaaccccgcccucugagcaugccagcagacgggaauuggaugggaaucguggaucccuucgcuagaccuaggggucacggccggaagggggaggacgcccuaugccgauacuuuuccaacgaacgcauuccacccauaaucgaggaaucuagcucaccgccuuauagauucaguaggccaacaacugagcggcaucucguccgcggagcggauuacauuagaggcuccagguguuauaucaauagcgaccugcacucuucagccaccauacccuuucaggaagaggguaccaaaaagaagagugggagcuccgcaacaaaaucuucgagcacugagccuucccuuuuggugucaugguucacgcgucugaagcuccugacacauuga

SEQ ID NO: 54570 - RNA, 894 nt, Artificial Sequence
  derived and/or modified sequence opt3 from CNN1__Homo_sapiens__NP_001290
augagcuccgcccacuucaacagaggccccgcuuacgggcugucugcagaggugaagaauaaacucgcccagaaguaugaccaucaaagggaacaggagcuucgggaauggaucgagggagucaccggucgccgaauuggcaacaauuuuauggaugggcugaaagacggaauaaucuugugcgaguucauuaacaaguuacagccuggcucaguuaaaaagaucaaugaaaguacacagaacuggcaccaacuggagaauauugguaacuuuaucaaggcgauaacuaaauacggggugaagccacaugauaucuucgaagcuaaugaccuauuugagaacacgaaucacacccagguacagagcacacuccuggcccuugcauccauggccaaaacuaagggaaacaaagugaaugucggcgugaaguaugcugaaaagcaggagcguaaauucgagccgggcaagcugagagaagggaggaacauuaucggauugcaaauggguaccaauaaauuugcaucucagcagggcaugacagccuacgggacccggcgccaucucuaugaucccaagcugggaacugaccagccucuggaucaagcuacaauuucgcuccagaugggcaccaacaaaggugccucacaggcggggaugacggcaccaggaacuaagagacaaaucuucgagcccggcuuaggcauggaacacugugacacccugaacguuagccuucagauggggaguaauaaaggagccucccagagggguaugacaguguacggcuugccucggcaggucuaugauccaaaguacugccugacucccgaguacccugaacuaggggagccagcucacaaccaucacgcccauaauuauuacaacucugcauga

SEQ ID NO: 54571 - RNA, 930 nt, Artificial Sequence
  derived and/or modified sequence opt3 from CNN2__Homo_sapiens__NP_004359
augagcuccacccaguucaacaagggccccucuuacgggcugucagccgaggugaaaaauagacuccuuaguaaguaugacccucaaaaagaagcugagcugaggacauggaucgaaggauugacugguuuaagcauuggcccagauuuucagaaggggcugaaagacggaacgauacuaugcacccucaugaacaagcugcagccgggcuccguccccaagaucaaucggucuaugcagaacuggcaccaacuugagaaucugucgaacuucauuaaagcaaugguuucauacgguaugaauccuguggauuuguuugaagccaacgaccucuucgagagcgggaauaugacacagguacaggugagucugcuggcgcucgcuggaaaggccaaaacuaagggcuuacaguccggcgucgauaucggggugaaauauucugagaagcaagaacgcaacuuugacgaugcaaccaugaaggccggacaguguguuauuggucugcagaugggcacaaauaaaugcgcuagccaguccgggaugaccgcauacggaacucgacgucaucuuuaugacccaaagaaccacaucuugcccccuauggaucauucaacaauaagucugcaaaugggcaccaauaaaugugccagccagguggguaugacggcuccagggacuagaaggcacaucuacgacaccaagcuaggaacagauaaaugcgacaacucuuccaugucacuccagaugggcuauacucaaggcgccaaucagagcgggcaggucuucggacugggucggcagauuuacgaucccaaguacuguccucaaggcaccguggcggacggggcaccaaguggaacaggcgacugcccggaucccggugagguaccugaauauccacccuacuaucaggaggaggccggguacuga

SEQ ID NO: 54572 - RNA, 2856 nt, Artificial Sequence
  derived and/or modified sequence opt3 from CNNM1__Homo_sapiens__NP_065081
auggccgcugcagccgcggcugccgcagccgugggcgucagacugagggacugcuguagcagaggggcuguucuccuucuguucuuuuccuugucuccccgcccuccagcagccgcugccugguuacugggacuacgaccggaggauaccgcggguggccgugugucacucgaagggggaacacugagagcagccgagggcacuucauuccuucugaggguauacuuucagcccgguccuccagcuacggccgcacccgugccuagcccaaccuugaacuccggggaaaauggaacaggcgacugggcuccccggcucgucuucaucgaggaaccuccaggcgggggagguguggccccgucugcgguucccacucgcccuccaggcccccaaagaugcagggagcagucggauugggccucagacguggagguccuggggccucugcggccaggaggcguggcagguagcgcucucguacagguucgcgugcgagaauuaagaaagggggaggccgaaaggggaggcgcuggcgggggagguaaacuguuuagucuuugugccugggauggccgggcauggcaccaucacggggccgcuggaggcuucuugcugcguguccgccccagacuauaugguccgggaggcgaccuccugccucccgcguggcuuagggcacugggagccuugcuccuguuagcucuguccgcccucuuuucuggccuucggcugagcuugcuaucccuggauccaguggagcuccgagugcugcgcaacucagggagugcagccgagcaggaacaagcuagaaggguccaggccguucggggacgcgguacccaucuucugugcacauugcuccugggccaggcaggggcgaaugcugccuuagcaggauggcuguacaccagccuaccucccggcuucggugggacuggcgaggacuauucugaagaggggauucacuuuccauggcuccccgcccugguguguacaggcgcuguauuccuuggggccgaaauaugcccuuacuccguguguucaagacauggauuggcaaucgcuagccacagugucugccugaccaggcuccugauggccgcggccuuuccaguguguuauccgcuuggucgucuguuggauugggcucuccggcaggagauuucuacguucuacacucgagagaagcuguuagaaacccugagagcagccgaccccuauuccgaucuaguuaaagaggaacucaacaucauucaaggcgcucuggagcuuaggacaaagguggucgaagagguguugacuccucugggggacugcuuuaugcuccgcagcgaugccguacuggacuucgcaaccguuucggagaucuuacggucuggauacacaagaauaccaguguacgaaggcgaccagaggcacaauaucgucgauauucuguucgugaaagaccuugcguuugucgaucccgacgauuguaccccuuugcucacggugacucgcuucuauaaccgaccacugcauugcguuuuuaaugacacacggcuagauaccgugcuggaggaguucaagaaggguaaaucccaccucgccaucguacagcgugucaacaaugaaggggaaggcgaccccuuuuacgaggugaugggaauuguuacucuggaggauaucauagaagagauuaucaagucagaaauucuugacgagacagauuuguauaccgacaaccggaaaaagcagagggugccgcaacgcgagcggaaaagacaugacuucagucuguuuaaguuaagcgauacggaaaugagggucaagaucuccccucagcuccugcuugcuacccaccgauucauggccacagagguggaaccauuuaaaucucuguacuugagcgagaagauccuccugcgccuacugaaacaccccaauguaauucaggaacucaaguucgacgagaaaaacaagaaagcaccugagcauuaucuguaccaacggaauagacccguggauuauuuuguucuuuugcugcagggcaaggucgaaguggagguggggaaggaaggauuaagguucgagaacggcgcuuuuacuuacuacggugucccagccauaaugaccacagcaugcucagacaaugauguucguaaaguggggagucucgccggauccagcguguuccugaaccgcucuccuucacgguguaguggccuuaacagaagcgaaucccccaauagggagcgaucugacuucgguggcucgaacacucagcuguauagcuccucaaauaaccuauacaugccagauuauaguguacacauccucucugacguccaguuugugaagauuacccggcaacaguaccagaaugcucugacagcgugccauauggauagcuccccgcagucaccugacauggaggccuucaccgauggggacagcacuaaagcacccacgacacgcggaaccccacaaacucccaaggaugacccugcuaucaccuugcugaacaauagaaacucuuuaccauguuccaggagugacggccuccggagccccucugaaguuguguaucugcgaauggaggaacuugccuuuacacaggaggaaaugaccgauuucgaggagcacuccacucagcagcugacauugaguccugccgcugucccgacgagagcagccagugacagcgaaugcuguaauauaaaccucgauaccgagacuucgccaugcuccucugacuuugaagagaauguggggaaaaagcugcuacgcacacugagcggacaaaagaggaaacguucacccgagggcgaacggaccagugaggauaacuccaaucuuacaccucucauuacuuga

SEQ ID NO: 54573 - RNA, 2628 nt, Artificial Sequence
  derived and/or modified sequence opt3 from CNNM2__Homo_sapiens__NP_060119
augaucggcugcggggccugugagcccaaggugaaaauggcuggaggucaggcagccgcggcucugccuaccuggaagauggccgcaagaaggagccucuccgcccggggccgcgggauucuucaagcugcagccggacgacuguugccauuacugcuacucucuugcuguugcggcgcuggugggugugccgcggucggagaaaacgaggaaacaguuauaaucggccugcgucuugaggacacuaaugaugugucauucauggaaggcggggcacugagaguaagugagaggacgcgggugaaauugcgcgucuacggacagaacauuaauaacgagaccuggagcagaaucgccuuuacagaacacgagaggcggcgccauuccccgggugaacgaggccucgggggacccgcuccuccagagcccgacucuggcccucagagaugcgguauuaggacuucggauaucauaauccugccacacauuauccugaaucggcguaccucagggauuaucgagauagaaauuaagccccuccgcaaaauggaaaagagcaagaguuauuacuuauguacaucccugucuaccccugcccuuggagcaggcggcagcggguccacuggaggugcugugggcgggaaaggaggcucagguguugccggguugccaccgcccccuugggcggaaacaaccuggaucuaucaugacggcgaggauacgaagaugauugugggagaagagaaaaaguuccugcuaccauuuuggcuccaggucaucuucaucagucugcuucugugcuugagcggcauguuuucugggcucaaccugggauuaauggcccuggaccccauggagcucagaauugugcaaaauugugguacugaaaaagagaagaacuacgcaaagaggauagaaccuguacggcgacagggcaauuaucuucugugcuccuugcuacuggggaacguucucgugaauaccacacugacuauccuucuggaugacauugcuggaucaggcuuggucgccgugguggucagcaccaucgguauaguuauuuucggggagaucgugccacaggcuaucuguagucgccacggccucgccguaggagcaaacacaauuuuucugaccaaauucuuuaugaugaugacguuccccgccucuuacccgguguccaaguuacuggauugcguccuaggccaggaaaucgggacuguguauaauagagagaaacuccuggagaugcuuaggguuacagacccuuacaacgauuuggugaaggaggagcugaauauuauacaaggagcucucgaacugcggaccaaaacugucgaggacgugaugacaccccuucgcgauugcuuuaugaucaccggugaagcgauucuggacuucaacacgaugagcgagaucauggagucgggcuacaccagaaucccaguauuugaaggggagaggucuaacauuguugaccucuuguucgugaaggaucuggcauucgucgacccugaugacuguacacccuuaaaaacuauaaccaaguuuuauaaucauccacugcacuucguguuuaacgauacaaagcuagacgccaugcucgaagaguucaaaaagggaaaaucccaccuggcuaucguccagcgugugaauaacgagggcgaaggugaucccuuuuacgagguucuugggauugugacuuuggaagacguaaucgaggaaauuaucaagucagagauacuggaugagaccgaccucuauacagauaaucggaccaaaaagaaggucgcccaucgagaaagaaaacaggacuucagugcauuuaagcagacugacagcgagaugaaagugaagaucuccccucaacuguuacuggccaugcacagguuccuugcuacggaaguugaggccuuuucuccaagccagaugucagagaaaauuuugcuccgccugcuaaagcauccgaacgugauccaggaacugaaguacgaugagaaaaauaagaaagcacccgaauauuaccucuaucaacggaacaagccugucgacuacuucgugcugauucuucagggcaaaguagagguggaagcgggaaaggagggcaugaaguuugaagcuagugccuucuccuacuaugggguuauggcauugacagccagcccagucccccugucuuuaucaagaaccuuuguggugaguaggacugagcuccuggcugccggaagcccuggcgagaauaaauccccaccccgcccgugcggucuuaaccacucugauucgcugagccgauccgaccggaucgaugcagucaccccuacauuggggucaaguaauaaccagcucaauucuagccugcuacagguuuacauaccagacuauuccgugcgugcucugucagaucuccaauucgugaagauuagcagacagcaguaccagaacgcccugauggcgucuaggauggacaaaacuccccaauccagugauagcgaaaauaccaagaucgagcuuacauugacggaacugcacgacggauuaccugaugagaccgccaaccuccugaacgagcagaauuguguaacucauucuaaagcuaaccacucccuucauaaugaaggcgcaauuuga

SEQ ID NO: 54574 - RNA, 2328 nt, Artificial Sequence
  derived and/or modified sequence opt3 from CNNM4__Homo_sapiens__NP_064569
auggcccccgugggcgggggagguagaccugucggcgggccagcuaggggacggcugcuccuugcagccccgguucuguugguguuacugugggcgcuaggcgcucgcggucaggggagcccccaacagggaaccaucguaggcaugcgacucgccuccugcaacaagucuuguggcacaaauccugacgggauuauauucgugucagagggaaguacugucaaccugcgucuuuacgguuauagccugggcaauaucuccucuaacuugauuucguuuacggaaguggaugacgcagagacccuccacaaaucaacaagcugccuggaacugacuaaggaucucguugugcagcaguuagucaaugugaguagagggaacaccuccggaguacugguugugcuuacaaaauucuugaggcggucugagagcaugaagcuguacgcccuauguacccgcgcucaaccagacggccccuggcucaaauggacugauaaggacucccugcuuuuuauggucgaggagccugguagauuccugccauuguggcuccauauccuguuaauuacagugcugcucgugcuuucagggaucuuuaguggacugaauuugggccuaauggcacuggaucccauggagcucaggauaguccagaacugcggcaccgaaaaggagcggcgcuaugcccgaaaaaucgaaccuauuagaaggaaggggaauuaccugcuuuguagccuguugcucggaaacguucuggugaauacgucuuuaacuauccugcuagacaaccucauugguuccggccugauggcuguagccucaagcaccaucgggauagugauuuucggagagauccuuccacaggcguugugcagucggcacggccuggcagucggugccaauacaauucuccugacuaaauuuuucaugcuucugaccuuuccguugucuuuccccaucuccaagcuccuggacuuuuucuuagggcaggagauccguacaguguauaaccgcgaaaaacugauggagaugcuaaagguuaccgaaccuuacaaugaucucgugaaggaggaacugaacaugauucaaggcgcucuugaguugagaacgaaaacugucgaggauauaaugacacagcugcaggacuguuuuaugaucaggagcgaugccauucucgacuucaacaccaugucggaaaucauggagucuggauauacucggauaccaguguucgaagacgagcaguccaauauuguagauauccuguacguuaaggacuuagcauuuguggaucccgacgauugcacaccucugaaaaccaucacgcgauucuacaaccauccaguccacuuuguguuccaugacaccaaacuugaugcuauguuggaagaguuuaagaagggcaaaucacaccucgccauuguccaaaaggugaauaacgagggggaaggagaccccuucuaugagguucugggucuagugacacuggaagauguaaucgaggaaauuauaaagagugagauccucgacgagagcgauauguacacugacaaucgcuccagaaaaagggucucugaaaagaacaaacgggacuuuagcgcguucaaggaugccgacaaugagcugaaagugaagauuucaccgcagcuuuugcuggcagcucaccgcuuuuuagccaccgaaguuagucaguucuccccuagccucaucucugagaagauccugcuuagacuguugaaauaucccgaugugauucaagagcucaaguuugacgaacauaacaaauacuaugcuaggcacuaccuguauacacguaauaagccagccgauuacuucauacuaauccugcagggcaaagucgagguggaagcagggaaggagaacaugaaguuugaaacuggagccuucucauacuauggcaccauggcucucacaaguguaccuagcgaccggucccccgcgcauccaacuccccugucucgaucggcaagccuuuccuacccugauagaaccgacgugucaacggccgcuacauuggccgguaguucuaaucaguucgggagcuccguucugggccaguauauuucagauuuuagcgucagggcauuaguggaccuccaauacaucaaaauuacccgccagcaguaucagaacggacugcuugccucucggauggaaaauuccccacaauucccgaucgauggcuguacuacccacauggagaaccuggcugaaaagagugagcuacccguggucgacgaaacaaccacucuccugaaugagagaaacagcuugcugcacaaagccucucaugaaaacgcaauauga

SEQ ID NO: 54575 - RNA, 7116 nt, Artificial Sequence
  derived and/or modified sequence opt3 from CNOT1__Homo_sapiens__NP_001252541
augaaccuggacagccucucccuugcccugucucagaucucauacuugguggauaauuuaaccaagaagaacuauagagcuagucagcaggaaauucagcacaucgucaauaggcacggccccgaagcagaccggcaucugcuacgcugccucuucagccauguugauuucuccggggacggaaagucuucggguaaggauuuccaccagacacaauuucugauccaggaaugugcccuucugauuacuaagccuaacuucaucucaacguugagcuacgcgauugacaauccacuccauuaucagaaaagucugaagccggcuccccaccuguuugcccagcucuccaagguguuaaaacugucuaagguacaagaagugaucuucggccuugcauugcugaacagcuccucaagugaucuacgaggguuugccgcucaguucauaaaacagaagcucccugaccugcuucguagcuacaucgaugcagacgucucuggaaaucaggagggcgguuuucaagauauugccaucgaagugcugcacuugcuccugucccauuuacuguucgggcagaaaggagcuuuuggcguuggccaggagcaaauugacgccuuccucaagacccuuagaagggauuuuccacaggagcggugccccgugguccuggcgccuuugcuauauccagaaaagcgcgacauccugauggacagaauacuccccgauucagggggaguggcaaaaacaaugauggagagcagucuggccgacuucaugcaggaaguagguuacggcuucugugcuucuauugaggagugcaggaacaucauuguucaguuuggggugcgggaagucacugccgcacaaguggcucgcgugcuuggaaugauggcccgaacccacuccggccugacagaugguaucccuuugcagagcaucucggcgccagggucuggaauuugguccgacggcaaggauaaaucagacggcgcccaggcacauaccuggaaugucgagguucucauagaugugcugaaggaauuaaacccgagucugaauuucaaagagguaacuuaugaacuagaccaccccggguuucagaucagagauagcaagggacuccacaacguggucuacgguauucaaaggggccuggggauggagguguucccuguugaccuuaucuaccggccauggaaacaugcugagggacaguuguccuuuauacagcacucucugauuaaucccgaaaucuucuguuuugccgauuauccuugccauacaguggcuaccgacauccucaaggccccacccgaggacgauaaccgugaaauugcaacguggaaaagccuggaccuuaucgagucacuguugcgccucgccgaagucggccaguacgagcaagugaaacagcuguucaguuuuccgauuaagcacuguccugauauguuaguacuggcucuacuccagauaaauacuuccuggcauacccugagacacgagcuuaucagcacauugaugcccauuuuccuggguaaccacccaaacucugcgaucauccuccauuaugcauggcacgggcagggccaaucaccuaguauuaggcagcugauaaugcaugccauggcugaaugguacaugcggggagagcaguaugaccaagccaaauuaagccgaauccuggauguugcacaggaccuuaaggccuuguccaugcuccugaauggcacucccuuugcuuucgugauugaucuagccgcacuggcgucucgcagagaauaccucaaacuggacaaguggcuuaccgauaagaucagggagcacggggaaccauuuauucaggcuugcaugacauucuugaaacggcgcugucccucgauccugggagguuuagccccugagaaggaccagccaaaaagcgcacaacucccgcccgagacccuggccacgaugcuugcuugccugcaggccugugcaggcuccgucucacaggaauugagugagacuauacucacaaugguggcuaacugcucuaaugucaugaacaaggccagacagccuccacccggggugaugccuaaaggaaggccacccagcgcguccucacuggaugccaucagcccgguucaaauugacccucuagcuggcaugaccucucuguccaucggugggagugcagccccacacacucagagcaugcagggcuuucccccuaaucucggaucugcuuuuuccacaccccagucaccagccaaggcauucccuccccugaguaccccaaaccaaacgaccgcguuuagcggcauugggggacuuucgucccaguugccgguggguggccuggggacaggaucuuuaacuggcaucgguaccggggcccucggccugccugcuguaaauaacgaucccuucguccagcguaaacuuggaacaagcggccugaaucaaccaacuuuucagcagaccgaccuaucacagguguggcccgaagccaaccaacauuucaguaaagagauagacgaugaggcaaauuccuauuuucagcggauuuacaaccacccuccacaucccacaaugucuguugacgaagugcucgagaugcugcagcgauucaaggauagcaccaucaaaagagaaagggaggucuuuaauugcauguugcgcaaccuguucgaagaguaccgguuuuucccucaguauccggacaaggaguuacacauuacugcuugucucuuugggggaaucauagaaaaaggccuggugacguacauggcccuuggucuggcauugagauauguacucgaggcccugaggaagccauucggguccaagauguacuauuucggaaucgcugcgcuagaucgcuuuaaaaaucgacugaaggacuacccccaauauugccagcaucuugccucaauuagccacuucaugcaguuuccucaccaucuccaggaauacaucgaguacggccaacagagucgggauccacccgugaaaaugcaggguucuauuacaaccccuggcuccaucgcacuggcucaggcccaagcccaggcucagguuccggcaaaggcccccuuggcggggcaagucagcacuauggugaccacaucgaccacuacaacgguggcuaaaaccgucacuguuacacguccaaccggagugucauucaagaaagacgugccucccucuauaaacacaacuaacauugauacccuguuaguagccacggaccagaccgaaagaaucgucgagccaccugagaauauccaggaaaagauugcauuuaucuucaacaaucucagucaguccaacaugacacaaaagguggaggaacugaaagagacuguuaaggaagaguuuaugcccugggugagccaguaucuugucaugaaaagggugucuauugagccaaauuuccacagccuguacuccaacuuuuuggauacccucaagaauccggaguucaacaaaaugguucugaaugagacauaucgcaacauaaaggugcuacugacuucagacaaggccgcugcaaauuuuagugaucggagccuucucaaaaaccugggccauugguuggggaugaucaccuuagccaagaauaaaccuauucugcacacggaccucgacguaaagucucugcuucuggaagcguacgucaaaggacagcaggaguugcuauauguggugcccuucgucgcuaagguucuggaguccucaaucagaagugugguauucaggccacccaacccuuggacaauggccauuaugaaugugcucgcagaacugcaucaagagcacgaucuuaaguuaaaccugaaauuugaaaucgagguccucuguaagaacuuggcccuggacauaaaugaacucaaaccaggcaaccugcuuaaggauaaagaccgacugaagaauuuggaugagcagcuaagcgcucccaagaaagacgugaagcagccugaggaacugccgccaaucaccacuacaaccacuuccaccacacccgccacgaacaccacuugcacagcaaccguuccuccccagccacaauacucuuaucacgauauuaauguguacucgcucgcugguuuagccccucauaucacacugaaccccacuauuccacuuuuccaggcgcacccucagcugaaacaauguguccgccaggccaucgagcgggcagugcaggaacucguucauccgguggucgacagaagcauaaagauugcuaugaccacgugcgagcagaucguaaggaaagauuuugccuuggacucagaagagucccguaugcgcaucgcugcacaccacaugaugcggaaucugacagccgggauggccaugauuaccuguagagagccccuccugaugaguauaucuacuaaccuuaagaauagcuucgcuuccgcgcuaaggaccgcaucaccacaacagcgagaaaugauggaucaggccgcugcccagcuggcacaagacaacugcgaguuggccuguugcuuuauccagaaaacagcuguggaaaaggcgggaccugagauggacaagcgguuagccacugaguucgagcugcgcaaacaugcaagacaggagggcaggcgguacugugaucccguugugcucaccuaucaggcugaacgaaugccagagcaaauuagacugaaggucgguggcguggacccuaaacagcuugccguauacgaagaguuugcacgcaaugugcccggguuccugccgacaaacgaucucucucagccaacgggauuuuuggcccagccuaugaagcaggcuugggccaccgacgaugucgcgcagaucuaugacaaaugcauuacugagcuggaacagcaccuacaugcaauacccccgacacuggccaugaauccccaagcucaggcccucaggagccuucuggagguugugguguuaagucguaacucccgggaugcuauagcagccuugggccugcuccagaaggcugucgaagggcugcuugacgccaccagcggagcagaugcggaccugcucuugagauacagggagugccaccuguuagugcuaaaggcccugcaggauggccgcgcuuaugguucuccuugguguaauaaacaaaucacucgaugccucauugaauguagagacgaguacaaguauaacguugaggccguagaacuucugauccggaaccauuuggugaauaugcagcaguacgaucugcaccucgcacagucaauggagaacgggcugaauuacauggcugucgccuucgcaaugcaacuugugaaaauucuccugguugacgaaagguccguggcccacgucacagaggcugacuuguuucauaccaucgaaacgcugaugcgcauaaacgcgcacagucguggaaaugccccggagggcuuaccccagcuaauggaggugguaagaagcaacuaugaagcaaugauugaucgggcucaugguggcccaaauuucaugaugcacucggggaucucucaggccuccgaguacgacgauccucccggacugagggaaaaggccgaguaucuccuucgcgaaugggucaaccuguaccacagcgcagcugccggccgagacucaacuaaagcguuuagugcuuucguggggcagaugcaucaacagggaaucuugaagaccgaugaccugauuacaagauucuuucggcucugcaccgagauguguguugagaucucuuauagggcccaggcagaacaacagcacaauccugccgcuaacccaacuaugauacgcgcaaagugcuaccauaaucuggaugccuucgugagacuuauugcguuacuggucaaacacuccggcgaggcuacaaacaccgugacaaagaucaaucucuugaacaaaguucuggguauuguggucggggugcuacugcaggaccaugauguaaggcagagcgaauuucaacagcuccccuaucaccggaucuucauaaugcuucuguuggagcugaaugccccugagcacgugcucgaaacuauuaacuuucagacccugacggcauucuguaauacauuucauaucuuacguccaaccaaggcccccggauucguuuacgcuuggcuugagcugaucucacaccgcauuuuuaucgcccgaaugcucgcacauacuccgcagcaaaaaggcuggccuauguacgcucagcuacugauugacuuguucaaguaucuggccccauuucucagaaacgucgaacuuaccaagcccaugcagauacuguacaaaggcacauugagggugcugcucguguuacugcacgauuucccugaguuucuuugcgacuaucacuacggguucugugaugucaucccacccaacugcauucagcugcggaaucuaauccucagugcguucccgcgcaacaugagacugccugaccccuuuacuccaaauuugaagguagacaugcugagcgaaaucaacauugccccuaggauacucaccaauuucacgggagugaugcccccacaauuuaaaaaggaucuugacuccuaucugaaaacacggucucccguuaccuucuuaagcgaucugcgauccaacuugcaagugucaaaugagccugguaacagauacaaucuccagcugaucaacgcucuaguccuuuaugugggcacucaagcaauugcccauauccacaauaaggggucuacaccaaguaugucgaccauuacucauagcgcacacauggacaucuuucagaaccuggcuguugaucucgacacagagggacgcuaccuguucuugaaugccauagccaaccagcugagguacccaaauucccauacccacuauuuuucuuguacgaugcucuaccuuuucgcggaagcuaacacugaggcaauccaggaacaaauuacccgggugcuguuagagcgucugaucgucaacagaccccacccuuggggcuugcucauuacauuuaucgaacugauaaagaauccagccuucaaauuuuggaaccaugaguucgugcacugcgcucccgagauugaaaagcuauuucagucaguagcccagugcuguaugggucagaaacaagcacaacaggugauggaggggaccggagccagcuga

SEQ ID NO: 54576 - RNA, 1623 nt, Artificial Sequence
  derived and/or modified sequence opt3 from CNOT2__Homo_sapiens__NP_055330
auggugagaaccgacggccacacacugagcgagaagaggaacuaccaggucacuaauuccauguucggggccucucggaaaaaguuuguugaaggaguggauucagacuaucaugaugagaacauguacuauagucaaagcuccauguucccccaccgcucugaaaaagacaugcucgcuucgccuucaacgagcggucagcuuagucaguuuggcgcaucccuguacgggcagcaaucugccuugggauuaccaaugcgaggcaugagcaauaacaccccgcagcugaaucguucccuaucacaggguacacagcuccccagucauguaacuccuaccacaggggugccaaccaugagccugcacacucccccuucuccauccagaggaauccuucccaugaacccuaggaauaugaugaaccauucacaagucggccagggcauugggauaccaagccggacaaauaguaugucuuccagcggacuggguucgccgaaccgcucgucccccucaaucauuugcaugccuaagcagcagccaaguagacaacccuucaccgugaauagcauguccggcuuugggaugaacaggaaucaggcguucggaaugaacaauucuuugagcucaaacaucuuuaacggcacggaugguagugagaauguuacugggcucgaccuguccgauuucccugcucuggccgaccggaaccgccgagaaggaagcggcaauccaacaccccucauuaacccguuagcaggcagagccccuuauguggggauggucaccaaacccgcuaaugagcagucucaagauuuuucaauccacaacgaggacuucccagcacugccuggaaguagcuacaaggaucccacuuccucuaaugacgauucuaagagcaaccuuaauaccuccgguaaaacaaccucaaguacggacggcccaaaguuucccggggacaaaucuagcacuacacagaacaauaaccagcagaagaaaggaauacaaguguugccugauggcaggguaaccaauaucccacaggguaugguuacugaccaguucgggaugauuggccugcuaacauuuauccgggccgcugaaaccgauccgggaauggugcaccucgcccugggcuccgaccuuacgacccugggguugaaccucaauucacccgagaaccuguauccuaaguucgcgagcccaugggcaucuucccccugucguccucaggauauugacuuccaugucccaagugaauacuuaacaaacauccacauacgcgauaagcuggccgcuauuaaacucggaagauacggugaggaccuucuguuuuauuuguacuauaugaauggcggggaugugcuacaacugcucgccgcaguggagcuguucaacagggacuggcgguaccauaaggaggaacgagucuggaucacucgcgcucccggaauggaaccgaccaugaaaacaaauacuuaugagagaggcaccuacuacuuuuucgauugccuuaacuggaggaagguugccaaagaauuucaccuggaguaugacaaguuggaggaacggccucaccucccaagcacauucaauuacaaccccgcgcagcaggccuuuuga

SEQ ID NO: 54577 - RNA, 2262 nt, Artificial Sequence
  derived and/or modified sequence opt3 from CNOT3__Homo_sapiens__NP_055331
auggccgacaagagaaaacugcagggcgagaucgauaggugccucaagaaagugagcgaaggggucgagcaauucgaagacauuuggcagaaacuucacaacgcugcaaaugccaaccagaaggagaaguacgaagcggaucugaagaaagagauaaagaaauugcagcgguuacgcgaccaaaucaagaccuggguugcuuccaaugagauuaaagauaagcgacagcugaucgacaaccguaagcuaauugaaacacagauggagagauuuaaagugguagaaagggagacuaagacgaaagccuauucuaaggagggacucggucuggcacagaaaguggaucccgcccaaaaggaaaaagaggaagucggccaguggcuuaccaauacaaucgacacucugaacaugcaaguggaucaguucgagucagaaguugagaguuugagcgugcagacccggaagaagaaaggggacaaggauaaacaggaccgcauagagggacucaagagacauaucgaaaaacacagguaccauguccggaugcuggagacaauucugcgcaugcucgauaaugacuccaucuuaguggacgcuauucgaaagaucaaggaugacguagaauauuacguugauucuucgcaggacccugauuuugaggaaaacgaguuccuguaugacgaucuugacuuggaggauauaccacaagcacugguggccaccucaccgcccagccacagucauauggaagacgagauuuuuaaucaguccucuagcacuccuacauccaccacgucaaguagcccaauucccccuucuccagcuaacuguacuaccgaaaauuccgaggaugacaaaaagagaggcaggucaacagacagcgaagucagucagucucccgccaaaaacgguuccaagccugugcacagcaaucagcacccacaaucgccggcggugcccccuacuuacccaucugggcccccuccagcagccuccgcucuaucaaccacacccggaaacaauggcgucccggccccugcagcucccccaagugcccucggcccuaaagcgagccccgccccaucccauaacucugggacccccgcaccuuaugcucaggccguugcuccaccggcccccagcggaccuucaacgacucagccacggcccccuagugugcagccauccgguggcgggggaggcgguagcgggggaggcgggucuucaaguagcuccaacucuucggcaggcggaggugccggcaagcaaaauggggcuacaagcuacuccucaguaguggcggauagucccgcagaggucgcccugucuagcuccggaggcaacaaugcuucaagccaggcccuugguccgccuucugggccacacaaucccccucccuccaccaguaaggagccaagcgcagccgcuccuacuggcgccggaggcguggcacccgggucuggaaacaacuccgguggcccaucacuguugguuccgcucccugugaaucccccaaguagccccacaccuucguucuccgacgcgaaagcugccggggcacuguuaaacggaccaccccaguuuucuaccgccccugaaaucaaggcuccggagccacugagcucacucaaaaguauggccgaacgugcagcuaucuccucuggcaucgaggaucccgucccuacgcuucaucugaccgagcgcgacauuauauugagcuccacaucagccccacccgcgagcgcccagccuccgcuacaacugagugaagugaauaucccccucucucuggguguaugcccacuugggccuguuccccugacuaaggagcaguuguaccagcaggcuauggaagaggcagccuggcaccacaugccacauccuuccgauagcgaaagaauuaggcaauaucucccccggaacccauguccgaccccucccuaccaccaucagaugccacccccucacucggacacaguggaguucuaucagcgacugucaacugagaccuuauuuuucaucuuuuacuaucuggaaggcacaaaagcucaauaccuagccgcaaaggcgcucaagaaacagucuuggcgcuuccauaccaaguauaugaugugguuucagagacacgaggaaccaaaaacuauaacggaugaguucgaacagggaacauacauuuacuucgacuaugagaaguggggccaaaggaaaaaggagggguuuaccuucgaauaccgguaucuggaggaucgcgaccuucaguga

SEQ ID NO: 54578 - RNA, 1719 nt, Artificial Sequence
  derived and/or modified sequence opt3 from CNOT4__Homo_sapiens__NP_001008226
augagcagaucccccgacgccaaggaggauccuguggaaugcccacuguguauggagccgcucgaaaucgacgauauuaacuucuuucccugcaccuguggcuaccagauaugcagguucuguuggcaccggauccgcacagacgagaaugggcuuugcccugcuugucgaaaaccauaucccgaagauccugcagucuacaagccacugucucaagaggaguugcagcguauuaaaaacgaaaagaaacagaagcagaaugagagaaagcagaaaaucucagaaaacaggaagcauuuagccaguguucgggugguacagaaaaaucugguguuugucgugggacuaagccagcgccucgcggaccccgagguucugaagagaccugaguauuucgguaaauuuggcaagauucacaagguggucaucaacaauuccacuucuuacgcugggucgcagggaccaucagccagcgcauaugugacguacauaaggagugaagaugcccuucgggcuauccaaugcguaaacaauguuguggucgacggccgcacccugaaagcauccuuggguacaacuaaguauuguucuuacuuccucaaaaacaugcagugcccgaagcccgauuguauguaccugcaugagcugggggacgaagccgcuagcuuuaccaaagaggaaaugcaggccggaaagcaccaggaguaugagcaaaaacucuuacaggaacuguacaagcugaauccuaacuucuugcagcuguccacaggcucaguggauaagaauaaaaacaaggugaccccacuacaaagucccauugacaaaccuagcgauucucucuccaucggcaauggggacaacucacagcagauuagcaacagugacacuccaucucccccgccuggacuguccaagagcaaucccgucaucccaauaucgucuuccaaccauucagcgcgaaguccuuuugagggugcaguuacagaaagccagucccuuuucucugauaauuuuagacaccccaacccaauucccagcggccugccuccauucccgucaaguccccaaaccuccagcgacuggccuacggccccagagccccagucuuuguuuacuucagaaaccaucccugugaguagcuccacagauuggcaggcugccuucggguucggaucuucgaaacagccagaggacgaucucggcuuugaccccuucgauguaacuaggaaggcacuggcugacuuaauugagaaggaacugagcgugcaagaucagccgucccucucaccuaccagucuucaaaauucuagcucccacacaaccacggccaaagguccagggucaggauuucugcaucccgcggccgcaacuaacgcuaauagcuugaacucuacauucuccguccuaccucagcgguuuccccaauuccagcagcaccgugccguguauaauaguuuuagcuucccaggccaggcugcccgcuacccuuggauggcauuucccagaaacucuaucaugcaucugaaucacaccgccaacccaacuuccaauucaaacuuccucgaccugaaucuuccgccucaacacaacacaggccuugggggaauccccguugcuggugaggaagaggugaaggucaguaccaugccauugagcacgucgucccauucucuccagcagggccaacagcccaccagccugcacacaacuguggcguga

SEQ ID NO: 54579 - RNA, 1674 nt, Artificial Sequence
  derived and/or modified sequence opt3 from CNOT6__Homo_sapiens__NP_001290170
augcccaaggagaaauacgaaccuccagacccgagaaggauguauaccaucaugagcuccgaggaagccgcuaacggcaagaaaucucacugggcagagcuggaaauuucagggaaggugcggagucucagcgccucccuuuggucucugacacauuugacugcguuacaccugucggauaauucacuaagccgcauacccagugacaucgcuaaacuccauaaccuggucuaccuugaucuguccucuaauaagauucguagcuugccugccgagcucggaaacaugguuucccugcgagagcugcaccucaauaacaauuuacugagagugcuuccauucgaauuggguaagcuguuucagcuacaaacgcucggccugaaagggaacccccuuacccaggacauccugaauuuguaucaggagccugauggaacaaggcggcuccugaacuacuuacuggacaaucucucaggcacugcaaagcgcauuaccacagaacagccacccccuagaaguuggaucaugcuucaagagccagauaggacccggccgacugcccuguucagcguaaugugcuauaacguguugugugacaaauacgcuacacgccagcuauaugguuacugccccucuugggcacugaauugggauuaccgaaagaaagccauaauccaggagauucucuccuguaacgcugacaucgucucacugcaggaaguggagaccgaacaauauuacagcuuuuuccuuguugagcugaaggaaagaggguauaauggauuuuucaguccuaagucuagggcccggacgauguccgagcaggagcguaaacauguggauggcugcgcgaucuuuuucaagacugaaaaauuuaccuugguccagaagcacacaguggaguucaaccagcucgcaauggccaacagcgaaggcucggaggcuaugcugaaucgcguaaugacuaaagacaacauugggguugccguguuacuggaacuaagaaaggagucuauagagaugccauccggaaaaccccaccucgguaccgaaaagcaacugauucuugucgcaaaugcucauaugcacugggauccugaguacucagacgugaaguuggugcagacaaugauguuucugagugaagucaaaaacaucauugacaaggccagcaggaaucucaaauccucuguucugggcgaguucgggaccaucccacuugugcugugugcggauuugaacagccuccccgacucaggaguaguggaauaucugaguacgggcggugucgagacuaaucauaaggauuuuaaagaguuacgguacaacgaaucccugacaaauuucagcugccacgggaagaacggaaccacuaauggccgaaucacacacggcuucaagcuacagucugccuaugagucagggcucaugccguacaccaacuacacguuugacuucaaaggaauuauagauuauaucuuuuacaguaagccucaacugaauacccuugguauuuugggcccccuggaccaucacuggcucguggaaaacaauaucagcggguguccacauccucugauacccuccgaucacuucucuuuauuugcacagcuggagcuuuugcucccauuccugccccagguuaacggcauucaucuaccuggacgcagauga

SEQ ID NO: 54580 - RNA, 1668 nt, Artificial Sequence
  derived and/or modified sequence opt3 from CNOT6L__Homo_sapiens__NP_653172
augagacugaucggcaugcccaaggagaaauacgacccuccagauccgaggcggauuuauaccauaaugagcgccgaagagguggcuaacgggaagaaaucccacugggcagaacucgagaucucuggacgcguccgaucacuuaguacaagccugugguccuugacucauuuaacggcccugcaccuaaaugacaacuaccucucucguauucccccugauaucgcgaagcugcauaaucuuguuuaucuggacuugucgucaaacaaacucagaagccugccagcugaacuggguaauauggugagucucagggaguuacugcuuaacaauaacuugcugcggguacuacccuacgagcucggccgccuguuccagcuucaaacccugggguugaagggaaauccucucucccaggauauucugaacuuauaucaggacccagauggcacaagaaagcugcucaauuuuaugcuugacaaccuggccgugcaccccgaacaguugccuccaaggccguggaucacucuaaaagagcgggaucaaauacugcccucugccagcuucaccgucaugugcuacaaugugcucugugacaaguaugcaacacgccagcuguacgguuacugcccuuccugggcucuuaacugggaauaucgaaagaaagggaucauggaggagauuguuaauugugaugcagacaucauuucacugcaggaaguggagaccgaacaguacuuuacuuuguuccucccagcccugaaagagagaggauaugauggcuuuuucagucccaagagcagggcuaagaucaugucugaacaagagcggaaacaugucgacggcugcgccauauuuuucaagacagagaaauuuaccuuagugcagaagcacacgguagaauuuaaccagguugcgauggcaaacuccgacgggucagaggccaugcugaaucgugugaugacuaaagauaacauuggagucgcuguggugcuagaaguccacaaggagcucuuuggugccggcaugaaaccuauccaugcagcugacaagcagcugcuuauuguugccaaugcgcacaugcauugggauccagaauacagcgacgugaaguugauccaaaccaugauguucguaagugaggugaaaaacauccuggagaaggccucuucccgccccgggagcccgacagcagauccuaauucgauuccccucguccugugugcugaccuuaacucucugccagauuccggagugguugaauauuugucaaauggcgguguggccgacaaccacaaagauuuuaaggagcucagauacaaugaaugccugaugaacuucaguuguaaugggaaaaacggaagcuccgagggcaggauaacucacggcuuccaguuaaagucugcuuaugaaaauaaccugaugccuuacaccaauuacacauuugacuucaagggggucaucgauuauauuuucuacagcaaaacccauaugaacgugcuaggaguacucgguccccuggacccacaguggcuuguugagaacaauaucacgggcugcccccacccucauauaccaucagaccacuucaguuugcugacucaacucgagcugcauccgcccuuacugccucuugugaacgggguccacuugccaaaucggcgauga

SEQ ID NO: 54581 - RNA, 858 nt, Artificial Sequence
  derived and/or modified sequence opt3 from CNOT7__Homo_sapiens__NP_037486
augcccgccgcuaccguggaccacagccagagaaucugcgaggucugggcauguaaccuggaugaagagaugaagaaaauuaggcaaguuauacggaaguacaauuauguggccauggacacagaguucccuggcguaguggcgcgcccaaucggggaauuucgauccaacgcugauuaccaguaucagcuccuucguugcaaugucgaccuguugaaaauuauccaguuaggacugacuuucaugaacgaacaaggugaguacccgcccggcacgucuaccuggcaguuuaauuucaaguuuaaccuaacagaggauauguaugcccaggacucaauugaacuccugacuaccagugggauccaguucaaaaagcaugaggaagagggaauagagacacaauacuuugcagaacuucugaugaccagcggcgugguuuugugugagggugugaaguggcucuccuuccacucuggguaugauuuuggauaccugaucaaaauucugacuaauucgaaccucccugaagaggaauuagacuucuuugagauccugagacuuuucuuuccagucauuuacgaugugaaguauuugaugaaaucaugcaagaaucugaaaggcggccuacaggagguagccgaacagcucgagcuggaaaggaucgggccccagcaucaagcuggaagcgacagucuucugacagguauggcauucuucaagaugcgggagauguuuuucgaagaucacauagacgaugccaaguacuguggccauuuguaugggcucggauccggcucuagcuacguucagaacgguaccgggaaugcuuaugaggaggaagccaacaaacaguccuga

SEQ ID NO: 54582 - RNA, 717 nt, Artificial Sequence
  derived and/or modified sequence opt3 from CNOT8__Homo_sapiens__NP_001288003
augcccgccgcucugguggagaacagccaggucaucugcgaaguuugggcauccaaucucgaggaagagaugagaaagauuagggaaauagugcuuucuuacucauauaucgccauggacaccgaguucccuggcguagugguccggccaauuggggaguuucgcaguagcaucgauuaccaauaucagcuguugcgauguaacguggacuuacugaaaauuauccagcuaggacucacauucacuaaugaaaagggugaguacccguccggcauaaacacguggcaguuuaauuucaaauuuaaccugaccggguaugauuucggauacaugguuaaacuucugacagacucucguuugcccgaagaggagcacgaauuuuuccauauccucaaucuguuuuucccuucgauuuaugaugugaaguaccugaugaagucaugcaagaaccucaaaggcgguuuacaagaggucgcggaccagcuggaucuucagagaaucgggaggcagcaccaagcuggaagcgacaguuugcugacuggcauggccuuuuuccggaugaaggaacuauuuuucgaggauuccauugacgaugcaaaauacuguggccgccucuaugggcugggaaccgguguggcccagaagcagaaugaagacguagauucugcucaggagaaaaugagcauccuugcaauaauuaacaauaugcaacaguga

SEQ ID NO: 54583 - RNA, 1266 nt, Artificial Sequence
  derived and/or modified sequence opt3 from CNP__Homo_sapiens__NP_149124
augaacagaggcuucagcaggaagucccacaccuuucugcccaaaaucuucuuucggaagaugucuucaaguggggccaaagacaagccugagcuccaguucccauuucuucaagaugaagacacaguggcuacucuguuggagugcaaaacguuauucauucugcgcggacuaccggguagcggcaaguccacccucgcacgagucauaguugauaaguaccgugacgggacaaaaauggugucugccgaugcguauaagaucacucccggagcuagaggcgccuuuucggaagaguacaaaaggcuggacgaagaucuugcagccuauugucggcgcagagacauuaggauccugguauuggaugacaccaaucaugagcgggagcgccucgaacagcuguucgagauggcugaucaguaccaguaucaagugguccugguggaaccuaagacagcauggcgacucgacugcgcccaguuaaaagagaagaaccaguggcagcugucagcugaugaccuuaagaaauugaagccaggucuggagaaagacuuucuaccccucuacuucgggugguuucugaccaagaaaagcagugaaacucuuagaaaggccggacaaguuuuccuggaggaauugggcaaucacaaagcguuuaagaaggagcucaggcaguucgugccuggcgaugaaccacgggagaaaauggaccuggucacauauuucgggaagcgucccccuggaguguuacauuguaccacgaaauuuugcgauuacgguaaggcaccaggcgccgaggaauacgcucagcaggacguacugaaaaaguccuauucuaaggccuucacucucaccauuagcgcacuuuuuguuacaccgaaaacuaccggggcucgcguggagcuguccgaacaacaguugcagcuauggcccucagaugucgacaagcugaguccuacagauaaccucccaagaggaagcagggcccacaucacccugggcugugcggccgacguggaggcagugcaaacgggucuugaucuguuggaaauacuccggcaggagaaagggggaucucgaggcgaggaagucggcgagcugucccgcgggaaguuauacucacugggaaaugguagauggaugcuaacucucgcuaaaaacauggaaguuagggccaucuucacaggcuauuacgggaagggaaagcccgugccuacccagggcagccggaaagguggggcucugcagaguugcacuauuaucuga

SEQ ID NO: 54584 - RNA, 549 nt, Artificial Sequence
  derived and/or modified sequence opt3 from CNPY2__Homo_sapiens__NP_055070
augaagggcuggggguggcuggcccuccuucugggagcuuuguuagguaccgcaugggccagaaggagccaggaccugcacugcggcgcgugucgggcucuaguggaugagcucgaaugggagaucgcccaagucgaccccaaaaagacaauucagaugggguccuuccgcauaaacccugauggaucucagucaguuguggaaguaccauacgcacgaagugaggcccaucugacugaacuucuggaggagaucugcgaccguaugaaagaauauggcgagcagauugauccgagcacgcacagaaagaauuacgugagggucgugggucggaacggggaauccucugaguuggaccuccaaggaauccgcauugauucggacaucucaggcacccugaaauuugcuugugagagcauaguugaagaguaugaagaugagcugaucgaguucuuuaguagagaagcagacaaugugaaggauaagcucugcuccaaaaggacagacuuaugugaucaugcccugcacauuucucaugacgagcuuuga

SEQ ID NO: 54585 - RNA, 837 nt, Artificial Sequence
  derived and/or modified sequence opt3 from CNPY3__Homo_sapiens__NP_006577
auggacagcaugcccgagccugccuccagaugccugcuccuucugccauuguuacugcuacuccugcuucuguugccggcucccgaacucggcccuucucaggcaggggccgaggaaaacgauugggugaggcugccaucaaagugugaggucugcaaauacguugcgguggaacugaagagugcuuucgaggagaccggaaaaacaaaggaaguaaucgguacuggcuaugggauucucgaccaaaaagccagcggagugaaguacacgaaguccgauuuacggcugauagaggucaccgaaacaaucuguaaacgccuuuuggacuauucucugcacaaggagcgaacuggcucgaaucguuuugcaaaagguaugucagagaccuucgaaacacuacauaaccucgugcacaaggggguuaaaguggucauggauauucccuacgagcuguggaaugaaaccagcgccgagguggcugaccuuaagaagcagugcgauguacugguugaagaguuugaggaagugaucgaggacugguauagaaaccaucaggaagaggauuugacugaguuccucugugcaaaucacguccugaaaggaaaggacacaaguugcuuagccgaacagugguccggcaaaaagggcgauaccgcugcccugggagggaaaaagucuaaaaagaaaagcuccagggcgaaggcagccgguggccggucaaguagcucuaagcaacgcaaagagcucgggggacuugaaggcgacccuuccccagaggaagaugaggguauucagaaggcuucaccccugacgcauagcccuccagacgaauuguga

SEQ ID NO: 54586 - RNA, 1419 nt, Artificial Sequence
  derived and/or modified sequence opt3 from CNR1__Homo_sapiens__NP_001153731
augaagaguauccuggacggccucgccgauaccacauucagaacuauuacgaccgaccuucuguacgugggguccaacgauauacaguaugaggacaucaaaggagauauggcuucuaaguuggguuacuuuccccaaaaauucccuuuaacaucauuuaggggcaguccauuccaggaaaagaugacugcaggggacaauccgcagcugguccccgccgaucagguuaacauuaccgaguuuuauaauaaaagccuauccucuuucaaggaaaacgaggaaaauauccaaugcggagagaacuuuauggacauugaguguuucauggugcucaauccuucgcagcagcuggcgaucgcuguacuuucacugacauugggcaccuuuacugugcucgaaaaccugcugguccucugcgugauauuacacagccggagucugcgcugucgaccauccuaccauuucaucgguucucuugccguugcagauuugcuggggagcgugauuuuugucuauuccuucaucgacuuucacguguuccaucguaaggauucaagaaauguauuccuauuuaaacucggaggcguuacagccaguuucaccgcuagcgugggcucucuguuucuuacggcaauugacagguacaucuccauacaccggccccuggccuauaagcgcauugucacuagaccuaaagcugugguggccuucugcuugauguggaccaucgcgauugucaucgcaguucucccacuguuaggguggaacugugagaagcugcagucagugugcagcgauaucuuuccccauauugacgaaacauaccucauguucuggauaggaguaacuagcgugcuucuguuguuuaucgucuacgccuauauguacauucuauggaaagcucacucucacgccgugaggaugauccaacgggguacccagaaguccauaauuauccauacaagcgaggacggcaagguucaggugacccgcccugaucaggcacgaauggacaucagacuggcuaaaacgcucguccugauucuugugguacugaucauuuguugggggccauugcucgccauaaugguuuaugauguguucggaaagaugaauaaacugaucaagacugucuuugcguucugcucgauguuaugucugcuaaacucuacagugaauccgauuaucuacgcccucagguccaaagaccugcggcacgcauuucguucaauguuccccaguugcgagggcaccgcucaaccucuugauaacagcaugggugacuccgauuguuugcauaagcacgccaauaacgcugccucuguccaccgcgcagccgaaagcugcaucaaaucaacugugaagauugcuaagguuacaaugaguguguccaccgacacgagcgcggaggcacuguga

SEQ ID NO: 54587 - RNA, 1083 nt, Artificial Sequence
  derived and/or modified sequence opt3 from CNR2__Homo_sapiens__XP_011538931
auggaggaaugcugggugaccgagaucgccaacggcagcaaggacgggcuggauuccaaucccaugaaagacuacaugauucucucuggaccucagaagacagcugucgcaguucuuuguacucuguuggguuuacugucagcccuagaaaacguggcgguacucuaucugauacuuaguagccaccaacugagaaggaaaccauccuacuuguucaucggcucucucgcuggggccgauuuucuggcaucgguggucuucgccugcucauuugugaauuuccauguuuuucacggaguggacagcaaggcugucuuccugcucaaaauuggcagugugacgaugaccuuuacagcauccguagguucuuuacugcuuacugccaucgaucgguauuugugucugcgcuacccgcccagcuauaaggcucuacucacccgagggcgugcccugguuacacuuggaauuaugugggugcuguccgcguuggucucauaccucccucugaugggcuggaccugcuguccaagacccugcagugaguuauucccucugaucccaaacgacuaucuccuuagcuggcuguuguuuauagcauuccuauuuucuggcaucauuuacacuuacgggcaugugcuguggaaggcccaccagcauguggcuucccucucaggacaccaggauaggcagguccccgguauggcccggaugcgccuggacguuagacuugcaaaaacacugggcuuggugcucgcuguacuguuaaucuguugguucccugugcuggcccuaauggcgcacagccucgccaccacgcugagugaucaagucaagaaagcauuugcuuucugcucuaugcuuuguuugauuaauuccauggugaacccaguuaucuaugcccugaggagcggggaaauacggucgucugcucaucacugccucgcccauuggaagaaaugugugcgcggacugggcuccgaggcaaaggaggaagccccgcgaucaagugucacugagaccgaagcugacgguaagauuacacccuggccugauagcagagaccuugaucuguccgacugcuga

SEQ ID NO: 54588 - RNA, 387 nt, Artificial Sequence
  derived and/or modified sequence opt3 from CNRIP1__Homo_sapiens__NP_001104571
augggcgaccugcccgggcucgugagacuuagcaucgcccugaggauucagccuaacgauggaccagucuucuacaagguugacggucaacgguuuggccagaaucgcaccauaaaauuguuaacaggguccucuuauaagguggagguaaaaaucaagccgucaacucuacagguggaaaacauuaguaucggaggcguccuggugccccucgagcugaaaagcaaggaaccugauggugaccgaguuguguacacggggaccuaugauacagagggagucacuccaaccaaguccggcgaacgucagcccauucaaaucacaaugccugagugccuugagcagagaccacaggaaauaucucugaccuacgagugugaagaguga

SEQ ID NO: 54589 - RNA, 1851 nt, Artificial Sequence
  derived and/or modified sequence opt3 from CNST__Homo_sapiens__NP_001132931
auggacgauagcgacacccccacauacuaucugcagaucgagccucaagauggcugccacccaggggacuccguggaaagaucugucacuugucucccgucagccagugaugagaacgaaaaucagcuugacggagauggucaugagcaccugacgagcuccgacucugcuaugggcaagccccagguuucggaacaggauucauugaacaauaacgagagcugcaccuuaaguugugagguggcagccggggaaaaucugcaaaacacacuaugcgaggcguccagggacgaacaggcuuuccucggaaaagauaagaaaauuccuggcaagcggucuccacgcagcaaaaaggguacugccaagaaaauacccccugggcuguuuuccggagacaucgcaccacuuaugcaggagaagguacugucagccgugaccuacgcugucgaugacgaggaagcagccgaggugaaugcuaacgaacagcccgaggccccuaaauugguucuccaaagucuguucagccugauucgaggcgaaguggagcagcucgacucucgugcguuaccacugugucuucaucagaucgcagaguccuauuuucaggaagaggauuacgaaaaggccaugaaauucauucaauuggagagacuguaucacgaacagcuacucgcuaaucugucagccauccaggagcaaugggagacaaaguggaagaccguccagccgcauacugugacagcacuuaggaacagcgaaaaaggcuuuaauggggaggacuucgaacggcugaccaagauaugcgcuacgcaccaggaucccuugcucaguaaacacaagaucgccgcgguagagaaaucucaggaacgcaaguguuccacucaacuguuaguuagcgaggacccuaaagagggaggugccaccacaaaggaaucggagucuaagacuugccugggcaccgaauccucaaaagagagucagcauacaguggagccacucgggagcucccccuguugccaccagauggauguccagaccgacucuccuagccuuucagugacggcaggaaaggaucauauggaggaacuguuguguagugcugaagccacucuagcucugcacacacaauccagcgagaccgccggcucuccaucaggucccgacaguagcgaagaugcaugcgaggacgauuccagacuccagcuggcccagacugaggcuugccaggacguggcgaggauugaagggaucgcagaggacccgaaagucuuucuuucuagcaagucgaaaacagaaccucugauuucccccggaugugaucggaucccuccagccuugauaucagagggcaaguacagucaagcucagcgcaaggaacuccgacugcccuuaagagacgccucugaggcacugccaaccgaucagcuagagaacaaugaacucaacgagcugcagcaacccgaccuuacggauagcgacggcaaauccccucaggcccaggcugauucagacgggagcgaaaauguuuugugcggaaacaaccaaauuucugaucuggguauccuccugccagagguguguauggccccggaagagaagggcgacaaagaugaccagcuuaauaaggagaccgaagauuaucugaacuccuugcucgaggggugccugaaagacacagaagacaguuuaagcuacgaggauaaucaggacgaugacucugaucugcuacaggaccucucccccgaggaagcaucauacagucugcaagagaaccuuccuagcgaugaaucguguuugucccuggacgaucucgcgaagaggauugagaucgcugaaguaaaucagcgguga

SEQ ID NO: 54590 - RNA, 603 nt, Artificial Sequence
  derived and/or modified sequence opt3 from CNTF__Homo_sapiens__NP_000605
auggccuucaccgagcacagcccccugacaccucauagaagggaccucugcucccggucuaucuggcuugcucgcaagauucgaucagaucugacugcauugacggaaaguuacgugaaacaccagggcuuaaacaagaauauaaaccuggacagcgccgaugggaugccagucgcguccaccgaccaauggucugagcuaacagaagcugagcgucuccaggaaaaucugcaggccuauagaacuuuucauguucuucuggcaagguugcucgaggaucagcaagugcacuucaccccgacagagggagacuuucaucaggccauccacacccugcugcuccagguagcugcauucgccuaccagauugaagaguuaaugauccugcuugaauauaaaauuccccggaacgaggcugaugguaugccuaucaaugugggcgacgggggauuguuugagaagaaacuguggggccuaaagguccuccaagaacugucgcaguggacugugcgcucaauacacgaucuuagauucaucagcagucaucagacagguauuccagccagggggucccacuacaucgcgaacaauaagaaaauguga

SEQ ID NO: 54591 - RNA, 1119 nt, Artificial Sequence
  derived and/or modified sequence opt3 from CNTFR__Homo_sapiens__NP_001193940
auggccgcucccgugccuugggcaugcugugccguccuggcggcugccgcagccguuguguacgcucagagacacagcccacaagaggcaccgcauguacaguaugaaaggcucggcuccgacgugacccuucccugcgggacagccaacugggaugcugccgucacuuggcgggugaauggaacggaccuggcgccugauuuguuaaacgguucucagcugguucuacacggccucgagcuggggcauucaggacuuuacgcauguuuccaccgcgacaguuggcaucugcgacaccagguguugcuccacgucggccugccaccccgugaaccugugcugagcugcagauccaauaccuauccaaaggguuuuuacuguucuuggcaucuccccacaccuacuuauaucccaaacaccuucaauguaacaguuuuacacgggucgaaaauuauggugugcgagaaggauccggcccugaaaaacaggugucauauacgguacaugcacuuguuuucaaccaucaaguauaaagucagcauuaguguguccaaugcucuuggacacaacgccacugcaaucacauucgacgaauuuaccauugugaagcccgauccuccagagaaugucguugcucgccccgugccuucuaacccaagaaggcuggagguaacguggcaaacucccagcaccuggccggacccugaauccuucccccuaaaguuuuuccuccgguaccgcccacugauccuugaucaguggcagcauguggagcugucagacggcacagcccacacuauaaccgaugcguacgccggcaaagaauauaucauucaggucgcagcuaaggacaaugagaucgggacauggagugauuggagcguggccgcucaugccaccccuuggacggaggaaccccgacacuugacuacagaggcacaagccgcugaaaccacuacaucuaccacguccucacucgcgccacccccuaccacaaaaauuugcgacccaggagagcuggguagcggcgggggaccgagugcacccuuuuuaguuucugugccuaucacucuggcccucgcugccgcagccgcuaccgccuccagccuucugauauga

SEQ ID NO: 54592 - RNA, 1176 nt, Artificial Sequence
  derived and/or modified sequence opt3 from CNTLN__Homo_sapiens__NP_001107867
auggccgcuagaagcccucccuccccacacccgucucccccugcaaggcagcugggcccacggucaccccgcguggggcgaggagccgagguccaugcgaugcguagugaagcuagcgguuucgccggcgcagccagagagguuguggcugacgaauccgauaagaucuggguaggggaggaaggaucuggcgguaggcgggggccuggaggcgcagccccagcucacgcgccccuccuuucggccccuaugggcucacgcagacuggaggggauuagcguggaggaagcaauggucaccaggacacaauuguuagaggaagaacugaguucccuaaaagaggaacucgcccugugccaggcugacaaggaguuuguguggucucuuuggaaacggcugcagguuacuaacccagauuugacccagguggucagccucgugguagaacgcgagaagcaaaaauccgaagccaaggaccgaaagguucuggagauacuccaggugaaagaugcaaagauccaggaguucgaacagagagagucaguccugaaacaagaaauuaaugacuuagugaagaggaaaaucgcuguggaugaggaaaacgccuuucugcggaaggaguucagugaccuugagaagaaauuuaaggauaaaagccaggaaauuaaggacacgaaagaguguguccagaauaaggaggagcagaaccguuugguuaucaaaaaucuggaagaggagaacaagaagcuaucuacacgcugcacugaucuccugaaugaccuugaaaaacugagaaagcaagaggcgcauuugaggaaagaaaaguacuccaccgaugccaaaauaaagacauucgaggacaaccucaucgaggcacggaaggaaguggagguaucacagagcaaauauaaugcucugaguuuacagcugucuaacaagcaaaccgaacucauucagaaagacauggauaucacucuugugcgaaaggagcugcaggaauugcagaaucuauacaaacaaaacuccacacacaccgcccagcaggcugagcugauucagcaacuccagguccugaauauggacacgcagaaggugcuucgcaaccaggaggauguucauacugccgaaagcaucucguaucaaaagguguguuuuuacucugucauaaaaauguga

SEQ ID NO: 54593 - RNA, 1884 nt, Artificial Sequence
  derived and/or modified sequence opt3 from CNTN1__Homo_sapiens__NP_001242993
augaagauguggcugcucgugagccaccuugucaucauuuccauaaccacaugccuggccgaguucacuugguacagaagguauggccaugggguuucugaagaggacaaaggauuuggucccaucuucgaggaacagccuauuaacacgaucuacccagaagagucauuggagggcaaggugaguuuaaauugucgggcucgcgcaagcccguuucccguauauaaauggcgaaugaacaauggggauguggaccugaccuccgaucguuacucuauggucggaggcaaccuagugauuaauaacccugacaagcaaaaagaugccgguaucuauuacugccucgcgucgaauaacuaugggaugguuagaucaacagaagcuacucugagcuucggauaccuugacccauuucccccugaggaaaggccagaggugcgggucaaggagggcaagggcauggugcuguugugugaucccccuuaccacuucccagacgaucucaguuaucgcuggcugcugaaugaauuuccgguauucauaaccauggacaaaagaagguuuguuucccagacaaacgggaaucucuacaucgccaacguggaggcaucugauaagggaaauuauagcugcuucgucuccucacccaguauuaccaaaagcguguuuucuaaguucaucccuuuaauuccaauccccgaacggacuacaaaaccuuacccagccgacauagugguccaguuuaaggauguuuaugcucugaugggucagaacgugacccuugaguguuucgcauugggcaaucccguaccggacauucgcuggcgaaaggugcuggaaccuaugcccuccacggccgagaucucaacuagcggggcuguccuaaaaauuuucaacauccaacucgaggacgaaggaaucuacgagugcgaagccgagaacauuagaggcaaggauaaacaucaggcgaggauauaugugcaggcauuuccagaauggguugagcacaucaaugacaccgagguggauauugguagugaccuguacuggccuugugucgccacagggaagcccaucccaacuauacgguggcuuaaaaacggauacgcuuaucauaagggcgaacugcguuuguacgaugugaccuucgagaaugccggcauguaucagugcauugcagaaaacacauacggggcuaucuaugccaaugcggagcucaaaauccuggccuuagcacccaccuuugaaaugaacccuaugaagaagaaaauucuggcugccaagggaggucgcguaaucauugaguguaaaccaaaggcugccccgaaacccaaguucucuugguccaagggcacggaguggcucguuaauagcucgagaauacuuaucugggaagacgggucucuggagauuaacaauaucacuaggaacgauggaggcaucuacacaugcuuugcagaaaauaaccgggguaaagccaauuccaccgggacuuuggugauuacagacccuacccgaauaauccuagcuccaauuaacgcggauaucacggucggcgagaaugcaaccaugcaaugugccgcuucauucgaccccgcccuggaucucacauuuguguggaguuucaacggauaugucauugacuuuaacaaggagaauauccacuaccagcgcaacuucaugcuggacagcaauggcgaacuucugauaagaaacgcacaguugaaacacgccgggagguacacuugcaccgcucagacaaucguggauaauuccucugccagcgcagaccucguugugcggggaaagaaccgcaaagguggcgagaagaauaugguagauucauuucugccugucugcgcgaguuuaccacccacuugguga

SEQ ID NO: 54594 - RNA, 3123 nt, Artificial Sequence
  derived and/or modified sequence opt3 from CNTN2__Homo_sapiens__NP_005067
augggcaccgccacaagaaggaagccccaucugcuccuuguggcugcagucgcccugguuagcuccucugcguggucaagugcuuuggggagccagacuacguucggaccuguguuugaggaccaaccauuauccguacuguucccggaagagucuaccgaagaacaggugcuacucgccugccgggcacgcgccucgcccccugcuacauaccgauggaaaaugaacgguacugaaaugaagcuggagccaggcucacgucaccagcuugucgggggaaaucuggugaucaugaaccccaccaaagcacaggaugccggcguuuaucaauguuuggcuagcaauccuguggguacagucgugaguagagaggccauucucagguuuggguuccugcaggaauuuuccaaggaggaacgggacccaguaaaagcgcacgagggauggggcguuaugcugcccugcaacccuccagcacauuacccgggccucucuuaucgcugguuacugaaugaguuccccaacuuuauaccuaccgaugggagacacuucgugagccagacuacaggaaaucuuuacaucgccaggaccaacgcuuccgacuuggguaauuauucaugucuggccacgagucauauggauuuuagcacuaagucugucuucuccaaguuugcacagcuaaaccucgcugccgaagacacccggcuguucgcgccaucaauuaaagcccgcuuucccgcagagacauacgcucuugugggccaacaggugacucuggaaugcuucgccuucgggaauccugucccacgaaucaaguggagaaaaguugaugggagcuugaguccccaguggaccacagcugagccgacccuccagauuccuucuguguccuuugaagacgagggcacguaugagugugaagccgagaacagcaaggguagggauacuguacaagggcggaucauagugcaggcacagcccgaauggcugaaagucaucucggacacagaggccgauauuggaucuaauuuacguuggggcugcgcugcggcaggcaagccacgcccuaccgugagauggcugaggaacggggaaccccucgccucccaaaaucggguugaggugcuugcuggagaccugcgauucucaaaguugagucuagaggauagcgguauguaccagugugucgccgaaaacaaacacggcacuaucuacgcauccgccgagcuggcugugcaggcccucgcaccagacuuucgccugaaccccguaagaaggcuuauuccugcggcucggggaggagaaauccugauaccaugccagccgcgcgccgcacccaaggccguuguguuguggucuaaaggcacagagauucucgucaauagcucaagagugaccgucacgccugacgguacccugaucauuaggaacaucagucguuccgaugaagggaaguauacauguuucgcugagaauuuuaugggcaaagccaacagcacuggaaucuuaucugugcgggacgcaaccaagauuacacuggcuccaucaagugccgauauaaaucuaggcgacaaccucacucugcaaugccacgcgagccaugaucccaccauggaccuuacauucaccuggacuuuggaugacuuuccuaucgauuucgacaaaccagggggacacuaccgaagaacgaauguuaaggagacaauuggugaucugaccauccucaacgcccagcugaggcauggcgggaaguauacuuguauggcucagaccgugguagacuccgcaucuaaagaagccacaguccuugugcgcggacccccgggcccuccaggugggguugugguccgggacauaggcgauaccacuauucagcugucguggagcagaggauuugacaaucacucccccaucgcuaaguacacauugcaagccaggacgccucccgcaggcaaauggaaacaggugcgcaccaacccagcgaauaucgaggggaacgccgaaacugcucagguacucggacugacaccuuggauggauuaugaguuccgagugauugccucaaauaucuuagguaccggcgagcccagugggccaucuagcaagauucggacacgugaagcagcuccguccguugccccuucaggacugagcggcggugggggcgcacccggagagcuaauagucaacuggacuccaaugucuagagaauaccagaauggcgacggguuuggauaucuccuguccuucaggcgccaaggcaguacccacuggcagacggcccgggugcccggugcugaugcgcaguacuuuguguacagcaacgagucugucagaccuuauaccccauucgaaguuaagaucagguccuacaaccgacgcggggacggacccgagucacuuacagccuugguguauagugcagaggaggagccucggguggcuccgacuaagguaugggccaaaggcgucagcucguccgaaaugaaugugaccugggagccaguucagcaagauaugaacgguauucugcucggcuacgaaaucagauauuggaaggccggggacaaagaggcugcagccgauagggugcguacagcgggacuggacacuucugcucgcgucagcggcuuacaucccaauaccaaguaccacgugacgguucgggccuauaacagagcagggacaggaccugccucaccaagugcuaaugcaaccacuaugaaacccccuccgaggcgacccccaggcaacaucuccuggacauucucuagcuccucacugagcauuaagugggauccugugguacccuuucggaaugagagugccgucaccgguuacaagaugcuuuaccagaacgacuugcaucucacuccaacccugcaccuaacagggaaaaauuggauagaaaucccugugcccgaggauauuggacaugcgcuggugcagauccgcacgaccggcccagguggcgacgggauuccggcugaaguccacaucguuagaaacggaggcacuucuaugaugguggagaauauggccguaaggccugcaccccacccagggacagugauaucccauagcgucgccaugcucauccugauuggaucgcuugaauuguga

SEQ ID NO: 54595 - RNA, 3087 nt, Artificial Sequence
  derived and/or modified sequence opt3 from CNTN3__Homo_sapiens__NP_065923
augauguuccccuggaagcagcugauccuccuuagcuuuauuggcugccuugggggagaguuguuacugcaagguccuguguucauaaaagaaccauccaacucuaucuuuccggucggcucagaggacaagaaaauuacccuacacugugaagccagagggaaucccaguccucauuacagguggcagcucaacggaagcgauaucgacauguccauggagcaccgguauaagcugaauggcgguaaccuuguugugauuaauccaaaccgcaauugggauacagggacuuaccagugcuucgcuacgaacucucugggaaccaucguaucgcgagaagcaaaauugcaguuugccuaucucgagaauuucaagacaaagaugcguucaacugugagcgucagagagggccaaggcgugguucugcugugugggcccccuccacauaguggagaacucuccuacgcguggauauuuaacgaguaucccucuuucguggaagaggacagcaggcgguuugucucccaggagaccggucacuuauacaucucaaaaguggaaccuagugauguaggcaauuauacaugcguugugaccagcauggucacuaacgcucgcgugcuggggucuccaacaccgcuuguguugagauccgacggagucaugggcgaguacgaacccaagauugagguucaguucccugaaacccugccagccgcaaaagguucaacggugaagcuagaguguuuugcccucgggaaucccaucccucagauuaacuggaggcggagcgauggacugccauucaguucuaaaaucaagcugcgcaaguuuuccggcguacuggagauacccaauuuccaacaggaagacgcuggcagcuacgagugcauugcagaaaacucgcgagggaaaaacguggccagaggaagguugacuuauuacgcuaagccgcauuggguccagcucaucaaagauguggagauugccguugaagacucucuguauugggagugucgggcguccgguaagccuaaacccucauaccguugguuaaagaauggcgcagcccuggugcucgaggaacgcacccagaucgagaacggggcucuuacaaucaguaaucugagcgucacugauuccggaauguuccaaugcauugccgaaaacaaacacggcuugguguauucuagcgcagagcuaaagguaguugcuucagccccagacuuuaguaagaauccuaugaaaaagcuggugcagguccagguggguucccucgucagccuggauuguaaacccagagcgucuccaagggcccuuucaaguuggaagaaaggggacgugagcguucaagaacacgagcggauaucccuguugaacgacggcggacucaagaucgcaaaugugaccaaggcugaugccggcacauauaccugcauggcugagaaccaguucgggaaagccaauggaacgacucaucugguagucacagaacccacccgaauuacuuuagcaccuucuaacauggacgugucgguuggugagagcgugauccugccaugucagguccagcacgauccgcuacucgacauaauuuuuacaugguacuucaauggcgcccuggcugauuuuaagaaagacgggucccauuucgaaaaggugggaggcucaaguucuggugaucuuaugauccgcaacauccaauugaaacacagcgggaaguacguaugcauggugcagaccggcguugacuccgucucaagcgcggcagaucugauugugagaggaucucccggcccuccagagaaugugaaggucgacgagaucacggauaccacagcccagcucuccuggaaagaagggaaggacaaccacagucccguuauuagcuacucuauacaggcuaggacuccuuuuuccgugggauggcaaaccgugacaacuguaccagaggucaucgacgguaaaacccauacagccaccgugguugaacugaaucccuggguggaguaugaauuucgggucguggcaucaaacaagauuggcgggggagagccgagucuuccuagcgagaaaguucgcacugaagaggccgugccagaaguacccccuucggaggucaacggcggugggggcuccagaucugaacuggugaucacgugggaucccgugccagaggaguugcagaauggagaaggcuuuggguacgucguugcuuucaggccucucggagugacaaccuggauccagacuguagugaccagccccgacacaccacguuaugucuuucggaacgagucaauugugccguacaguccuuaugaaguuaaggugggcgucuacaauaacaagggugaggggcccuucuccccagugaccacuguuuucucugccgaagaggagcccacaguggcaccuagccaggucuccgcuaauucacugagcaguucugaaauagagguauccuggaacacgaucccauggaaauuaagcaauggacaucugcuaggcuaugaagugcgauacuggaacgguggcgggaaggaggagucgucaucuaaaaugaagguugcgggaaaugaaaccagugccagacucaggggccugaaauccaaccuugcauacuauacugccgugcgcgcuuacaauagcgccggggcaggacccuucucugcuacagucaacgugaccacaaagaaaacuccuccgagccaaccacccggcaauguaguguggaacgccaccgauacgaaggucuugcugaauugggagcagguuaaggcgauggaaaacgaguccgaagugaccgguuauaaaguguucuaccggacaucaagucagaacaauguccaggugcucaacacuaauaagaccagcgccgagcugguuuuaccuauuaaagaggacuauaucauugaaguaaaggcuacaacugaugggggagacggcaccucuuccgagcaaaucagaauaccaaggaucacgucaauggaugcacgcgguaguacaagcgccauuuccaacgugcaccccaugucuucguacaugccuaucguccuguuucuuauuguguauguuuugugguga

SEQ ID NO: 54596 - RNA, 3081 nt, Artificial Sequence
  derived and/or modified sequence opt3 from CNTN4__Homo_sapiens__NP_001193884
augagacugcccugggagcuccuugugcugcagagcuucaucuugugcuuagccgacgauuccacccugcacggcccuauuuuuauacaagaaccaucuccggucauguucccccuagacucagaggaaaagaaaguuaagcucaacugugaggugaaagggaauccuaagccacauaucagguggaaacugaacggaacagauguagacacugguauggauuuucgguacaguguggucgaaggcagccuucugauuaauaaccccaauaagacgcaggacgcugggaccuaucagugcacagcaacuaacuccuucggaaccaucgugucucgcgaggccaaguugcaguuugcguaccucgauaauuucaaaacacgaacccguucgacuguuucagugagaaggggccaagguaugguccugcugugugggccuccaccccacagcggagagcucaguuaugcuuggauuuuuaacgaauacccuuccuaucaggacaaucggcgcuucgugucucaggagacaggcaacuuauacaucgccaagguagagaaaagcgauguuggcaauuauaccugcguggucacgaacacugugaccaaucauaaggugcuggggccaccgacaccccuuauauugagaaacgacggagucaugggugaguacgagccuaaaaucgaaguucaguuuccagagacugugcccaccgcaaagggcgccacaguaaagcuggaauguuucgcucuagggaauccugugccaaccauuaucuggaggcgggcagauggaaaacccauugcccgcaaggcucgaagacacaaauccaacggcauccucgagauaccgaacuuucaacaggaagacgccggucuguacgagugcgucgcggaaaauucaagggggaagaacguggcacggggacagcuuacguucuaugcccagccuaauuggauucagaaaaucaacgauauucauguugcuauggaagagaauguguuuugggaauguaaggccaacggccgucccaaaccaacuuacaaguggcugaagaauggcgagccuuugcucacacgcgacagaauccaaaucgaacaggggacccugaacauuacuauagucaauuuaagugacgcaggaauguaucaaugccuggcugagaacaaacacggugugaucuucagcaaugccgagcucucuguaauugcgguuggccccgauuucuccaggacacuucugaagcgggugaccuuggucaaagucgggggagaaguggugaucgaguguaagccaaaagccucacccaagccuguuuacacguggaagaaaggccgagacauacuaaaggaaaacgagcgcauuaccaucagcgaagaugguaaucugagaaucauuaacgugacaaaaagugacgcagggucuuauacuugcaucgcuaccaaucacuuuggcacagccuccagcacuggaaaccucguagucaaggauccaaccagggugaugguuccgcccucgucuauggacgugacagucggcgaguccauugugcugccuugucagguaacccaugaucacucacuugacauaguguucacuuggaguuuuaacgggcaucugaucgauuucgaccgggauggagaccacuuugagcgcguugguggccaggacagcgcuggggauuugaugauuagaaauauccagcucaaacacgccggaaaguacgucugcauggugcaaacguccguggacaggcugucugcagccgcugauuuaaucguccguggcccacccgguccuccagaagcgguuacaauugacgagauaaccgauacuaccgcacagcugagcuggcggcccgggccggacaaccauucaccuaucacaauguaugugauucaggcccgaaccccauucagugugggcuggcaggcuguauccacuguccccgaacuaaucgauggaaagacauuuacggccaccgugguuggccucaauccuuggguggaguacgaguucagaacugucgcagccaacgugauugggaucggagaacccagcaggccaucugagaaacgccggacagaagaggcucugccugaaguuacccccgccaaugugucagguggcgggggaaguaagagcgagcuuguaauaacaugggagacugucccagaagaguugcaaaacggcagagguuuuggguacgugguggcauucaggccguauggcaaaaugaucuggaugcugaccguccucgcguccgcugacgccucucgcuacguuuuucgaaaugaaucggugcacccuuucagccccuuugagguaaaggugggagucuucaacaauaaaggcgaagggccauucucccccacgaccgugguuuauucagcagaggaggaaccuacaaagccacccgccaguauuuuugcucggucucugagcgccacugauaucgagguguucugggcauccccucuugaaaagaaccguggaaggauucagggcuacgaggucaaauauuggagacaugaagacaaggaggagaaugcucgcaaaauccggaccguggguaaccagacaucaacuaagauaaccaaucugaaagggagcguuuuguaccaccucgccgugaaggcguauaacucugccggaacgggcccguccagugcuacagucaauguaaccacuagaaaaccacccccuagccagccacccgguaacauuaucuggaacucuuccgauucaaagauuauccugaauugggaccaagugaaggcauuagauaacgaaagugagguuaaaggcuacaaggugcuguacagguggaaucgacagagcucgacauccgucauagaaaccaacaaaacuucuguggagcuaagccucccuuuugacgaggacuauaucauugaaaucaagccguucucagaugggggagacggcaguuccucugagcagauucgcauccccaaaauaagcaaugccuacgcucggggguccggagccucaaccagcaacgcaugcacacugagugcgauuucuacgaucaugaucucccuuaccgccagaagcucguuguga

SEQ ID NO: 54597 - RNA, 3303 nt, Artificial Sequence
  derived and/or modified sequence opt3 from CNTN5__Homo_sapiens__NP_001230199
auggccagcuccuggaagcugauguuguuccuuucugugaccaugugccugucagaguacaguaaaagccuccccggcuuauccacaucuuaugcugcacugcuaagaaucaagaaaucgucaagcaguucccucuuugggucuaagacuaggccucgguacagcuccccaucacugggaacgcuuagugccagcucuccguccuggcugggugcggcucagaacuauuacucacccauuaauuuguaucacagcagugacgccuucaaacaagaugaaucugucgacuacggcccuguuuuugugcaggagccagaugacauaaucuuccccaccgauuccgacgaaaagaagguagcacucaacugugaggugcgcgggaauccugucccaagcuaucgauggcugcguaacggaacagaaauugaucuggagucggacuacagauacucucucaucgauggcacuuuuauuaucuccaaucccucagaggccaaagacaguggucauuaucagugcuuagcuaccaacacaguggggagcauacuguccagggaagcaacccuucaguucgccuacuugggaaauuuuucuggccggacucgcagcgcuguuucagugagagagggccaaggggucgugcugauguguaguccuccaccgcacucccccgaaaucauuuauagcuggguauucaacgaguuuccuucuuucguugccgaggauucaaggcgguuuaucagucaggaaacaggaaaucuauacauuagcaaggugcagaccuccgacgucgguucuuauaucugccucgugaaaaacacggugacuaaugcgcgcguccugucgccacccaccccucuuacacugcgaaacgauggcguuaugggggaguacgaaccaaagauagaggugcauuuccccuuuacuguaaccgcagccaaaggaacaaccgugaagauggaauguuucgcuuugggcaauccggucccuacgauuacuuggaugaaggugaacgguuauauccccagcaaagccagacucaggaagucccaggcaguucuggagauuccaaaugugcaauuagacgacgcugggaucuacgagugccgggccgaaaacucacguggcaaaaacaguuuccgcggacagcugcaggucuacacauauccucacuggguggagaagcucaaugauacccagcuugacucuggcagcccccugagaugggaauguaaagcgacugggaagccaaggcccacauaccggugguugaaaaacggaguaccucuauccccacaaucacgaguugagauggugaaugguguccugaugauccauaacgugaaucagagcgaugccggcauguaucagugccucgcagaaaacaaguacggggcuauuuaugccucugcugagcugaagauacuugccuccgcaccgaccuuugcccugaaucaauugaaaaagacgaucauugucaccaaagaccaggaggugguuaucgaauguaagccccagggaaguccuaaaccaacaauaagcuggaagaagggcgaucgcgcugugagagagaacaaaaggauugcgauccuccccgacgguucucugcggaucuuaaaugcauccaagucagaugaagggaaauacguaugccgcggcgagaacgucuucggaagugccgaaauuaucgcuagccugucggugaaggagccuacuagaauugagcuaaccccaaaaaggacagaacucacuguuggcgaguccauagugcugaauuguaaggccauccacgacgcaucucuugaugucaccuuuuauuggacauugaaggggcagcccauugacuucgaagaggagggaggucacuuugaaagcauccgugcccaggcuucaagugccgaucugaugauccggaacauucuccugaugcaugcaggccgauacgggugcagagugcaaaccacugcggacuccguaucugacgaggcugaacuucuggugaggggaccgccuggcccacccgguauaguuaucgucgaggaaauuacggagagcacagccaccuuguccuggaguccugcagccgauaaucacagccccaucaguucuuacaaccuccaggcucgcuccccauucagccugggguggcagacugugaaaaccgugccugagauuaucacaggcgacauggaaucggccauggcagucgauuuaaaucccuggguugaguaugaauuucgggugguggcuaccaacccaauaggaacuggcgacccgucaacaccuucuagaaugaucaggacgaacgaggccguacccaagaccgcgccaacuaaugucagugggcgcuccggacgacggcaugaacuggugauugccugggagcccguuagcgaggaguuccaaaacggugaaggcuuuggguacaucguggcuuuccguccuaauggaacaagaggcuggaaagaaaagauggucaccucuagcgaggcauccaaauuuauuuauagggaugaaucagugccaccccuaacaccuuucgagguuaagguggguguauacaacaauaagggggacggcccguuuagucagaucgucgugauaugcagcgccgagggagaaccaucugcugcccccacugaugugaaagcaaccuccgucucaguuagugagauucucguggcguggaagcacaucaaagaaagccugggccgcccucagggguucgagguaggauauuggaaggacauggagcaggaagauacggccgagaccgugaaaacacggggcaacgaauccuucgucauucuuacugguuuggaggggaauacccuguaccacuuuacagugagagcuuauaacggagccggcuacgguccacccucuucggaaguuagcgcaacuaccaagaaaucaccuccgucccaagcucccaguaaucucaggugggagcagcagggcucucaggugagccuggggugggagccagucaucccuuuagccaacgaauccgaggugguuggauacaagguguucuaucgacaagaaggccauucaaauucucaggucauagagacgcagaagcugcaagcaguagugccccuuccagacgccgggguuuacaucauugaagugcgcgcuuauagcgagggaggcgaugguacagcgaguucccagauccgggucccuagcuacucugggggaaaaauuaccucagcccaguccacuuugcacagucucagcacaucgucuuccagcgugacccugcuacuggcacucaugauccccucaacuucaugguga

SEQ ID NO: 54598 - RNA, 2871 nt, Artificial Sequence
  derived and/or modified sequence opt3 from CNTN6__Homo_sapiens__NP_001276010
augagcuaccacuauagacuggacggagggucccucgccaucaacucuccccauaccgaucaggacauuggaauguaccaaugccuugcuacaaaucuguuggguacuauauuaucaaggaaggcaaaacugcaguucgccuauaucgaggauuuugaaacgaagacccggaguacagugagcguccgcgagggccaggggguugugcuacucuguggaccuccaccgcacuucggcgaccuguccuacgcguggacuuuuaacgauaauccccuuuauguacaggaagacaaccgacguuucgugucucaagagaccgguaaucuguacauugcuaaagucgaaccuucggauguggggaacuauacaugcuuuaucaccaauaaggaggcccagagaucaguucagggaccacccacuccuuuggugcagaggacagacggcgucaugggcgaguacgaaccaaaaauugaggugcgguuccccgaaaccauccaagcagccaaggauagcaguguaaagcucgaguguuuugcucuggggaacccuguuccagacauauccuggcgcagacuggauggaucuccgcuccccgguaaagugaaguacagcaaaucccaggcaaucuuagagauuccuaauuuccagcaggaagacgagggcuuuuaugaaugcaucgccucaaaccugagggggcggaaucuugcuaagggacaauugauuuucuacgccccacccgagugggaacagaaaauccagaacacgcaucugaguauauaugauaaucuacucugggaguguaaggcgagcggcaagccuaacccaugguacacuuggcugaaaaauggugagcgccuuaaccccgaagaacgaauccaaauugaaaacgggacccugauuaucacaauguugaaugucucugacuccggaguguaucagugcgcagccgagaacaaguaccagaucauuuaugcuaaugccgaacucagagugcuggcaucagcuccggacuuuagcaaaaguccugucaagaaaaagucuuucguucaggugggcggcgauauaguaaucggguguaaacccaacgccuuuccaagggcggccauuuccuggaagcggggaacugagaccuuacgucaaagcaagcgcaucuuccugcucgaggacgguucgcuuaaaauauacaauauuacaagaucugaugcaggcuccuauaccugcaucgcuacgaaccaguucgggacugccaagaauacaggaucacugaucgugaaagaaaggaccgucauuacugugccucccaguaagauggacguuacagugggcgagagcaucgucuugccaugucaggugucccacgaucccucuauugaaguaguuuuugugugguucuuuaacggugacgucauagaucugaaaaaggggguggcucauuucgagcggaucggcggagaaagcgucggcgaccuaaugauucgaaauauccagcuccaccacucagggaaguaccugugcaccgugcaaacgacccuugagagucuguccgccguugcagauaucauugugcgcggaccuccagguccgcccgaggacguacaggucgaagauauaagcucuacaacuucacaguugaguuggagagccggcccugacaacaauagcccaauccagauuuuuaccauccaaacaaggacucccuucuccgugggguggcaggcuguugcgaccgugccugagauucucaacggaaaaacauacaaugcaaccgucgugggccugucuccauggguagaauaugaguuucgggugguugccgguaacucgaucgggauaggcgagcccagcgaaccguccgaguuacugcgcacuaaggcuucagucccugugguggccccagucaauauccauggaggcgggggaaguagaucugagcuaguuauuacgugggagagcauccccgaggaacuccagaacggugagggcuucggguacauuaucauguuuaggccugugggauccacaaccuggucaaaagaaaaggugagcucuguagaguccagucguuucgucuaucggaacgaaagcauaauuccccugucuccauuugaggugaaaguuggcguguacaauaacgaaggugaggggucccuuucaacugucaccaucguguauaguggcgaggacgaaccucaguuggcaccccgaggaacaagccugcaaucguucuccgccucugagauggaaguuagcuggaaugcuauugccuggaacagaaauaccggcagggugcucggguacgagguacuguacuggacugaugacucaaaggaaaguaugaucggaaagauacgcgucuccggcaacgugacaacgaaaaauaucaccggucuuaaggcaaacacuauuuauuuugcgucugugcgggcuuacaauacagccgggaccggaccaagcuccccgccugucaacguuacaacuaaaaagucacccccaagccagcccccugcaaauaucgccuggaaacugaccaacaguaaguugugucucaauugggagcacgugaagacgauggagaacgaaucugagguacugggcuauaaaauuuuauacagacagaauaggcaauccaagacccauauccuggaaacaaacaacacuagcgcugagcuacucgugccauucgaggaagauuaucugauagagauucgcaccgucucggacgguggcgaugggucaucuagugaagagauccgaauccccaaaauguccagccuuucuagccggggcauucaguucuuggaaccuuccacacacuuucugucaaucgugauuguuauauuccacugcuuugccauccagccgcucauuuga

SEQ ID NO: 54599 - RNA, 4155 nt, Artificial Sequence
  derived and/or modified sequence opt3 from CNTNAP1__Homo_sapiens__NP_003623
augaugcaccugagacucuucugcauccuucuggccgcugugagcggcgcagagggguggggauacuaugguugugacgaagaguuggucggccccuuauacgccaggucccugggggcgucuucauauuacagucuacucaccgcuccucgguuugcccgccugcauggaauuagcggcugguccccacgaauaggugauccgaaccccuggcuucagaucgaccugaugaagaaacaccguauuagagcaguugccacacaagggucuuucaauucgugggauugggugacuagguauauguugcucuacggagaccggguagauucauggacgccuuuuuaucagcgcggccauaacagcaccuucuuuggcaaugugaacgaaagugcugucgugagacacgaccugcauuuccacuuuacagcaagguacauccggauuguuccacuggccuggaauccccgcgggaagaucggacuccgauuaggucuguacggcugcccuuauaaagcugauauacuuuacuucgacggggaugacgccaucuccuauagauuuccaaggggagugucucggagcuugugggaugucuucgcguuuuccuucaagacugaggaaaaagacggccugcuacuccacgcagagggugcccagggggauuacgugacccuggagcuugaaggagcucaucuguugcuccacaugucacugggcaguagccccauucagccucguccaggccauacaaccguaucugccgggggaguuuuaaacgaccaacacuggcacuaugugcgcgucgacagauuugguagggaugugaauuucacucuggacggcuacgugcagcgguucauccucaacggggauuuugagcgacuuaaucuggacacagaaauguucauuggaggcuuggucggugcagcucgcaagaaccuagccuauagacauaauuuuaggggguguaucgagaacguuauauucaaucgggugaacauugcggaucuggccguacgcagacacuccaggaucaccuuugagggcaagguggcauuccguugccucgacccggucccccauccuauuaauuuuggaggcccacacaacuucgugcagguucccggguuuccucggcgaggaagacuggcugugucauucagguuucgcacgugggaucuuacuggucugcucuuguucagccggcugggcgacggguuaggacaugucgaacugacccuaagugagggccaggugaacguaucuaucgcccaauccgguaggaaaaagcuccaguuugcugccggguacagacugaaugauggcuucuggcacgaaguuaacuucguggcacaggagaaucacgccgucaucagcauugacgauguggaaggagcugagguccgcgugucguacccacuuuugauacgaacaggcacuucuuauuucuucgggggaugucccaaaccggcgucccggugggacugccauucaaaccagaccgcauuucacgguuguauggagcugcucaagguugacggccaacuggugaaucuuacacugguagaagggcguagauugggauucuacgccgagguccucuuugauaccugcggcaucacggacagguguaguccuaacaugugcgaacaugauggucgcuguuaucagagcugggacgauuucauuugcuacugcgagcugacuggguauaaaggcgaaacaugucacacccccuuauacaaggaguccugcgaggcuuaucggcugucuggaaagacuagcggcaauuuuacaaucgacccagaugggucaggaccucuaaaacccuucgugguuuacugugacauaagagaaaacagggccuggaccgugguccgacacgaucgccucuggacgacccgggugacaggcaguuccauggagagaccauuucugggugcaauucaguacuggaaugccagcugggaagagguaucugcucuugccaacgcaucacaacauugcgaacaguggaucgaguucaguuguuauaauagcagguugcugaacacugcugggggauaccccuauuccuuuuggaucggccguaaugaggaacagcacuucuacugggguggcucucagccugggauucaacgcugcgcguguggacucgaccggucgugcguggauccagcccuguauuguaacugcgacgcagaucagccgcaguggagaaccgacaagggcuuacugacauuuguugaccaucuucccgucacucagguggugaucggggauaccaauaggagcacauccgaggcccaauucuucuugcgaccucuccgguguuacggagaccgcaacucauggaacaccauuaguuuucacacuggcgcugcccugagauucccacccauaagggcaaaucauucucuagaugucagcuuuuauuuccggacguccgcuccuucagguguuuuucuggaaaacaugggagggccauacugccaguggcgaagacccuacgugcgcguggagcucaauacaagcagggacguagucuucgccuuugaugugggcaacggugacgagaaucugaccguucacucugaugacuucgaauuuaacgaugacgaguggcaccuugugcgugcggaaaucaaugucaaacaggcccgguugagaguggaucauaggccguggguucugcgcccuaugccauuacagacuuauauuuggauggaguacgaccaaccccucuaugugggcuccgcugaacugaagcgaagaccuuucguagggugccuucgggcaaugaggcugaacggagucaccuugaaucucgagggccgcgccaacgcuagugaggggacaagccccaauuguaccggacacugcgcccauccacgucugccuuguuuucacggcgguagaugcguggaacgguacucuuauuacacuugugauugcgaccuaacagcauucgacgggcccuauuguaaccaugauaucggaggcuucuuugagccagguacguggaugagguacaaucugcaguccgcgcuccgcucagccgcucgagaauuuagucacaugcugagcagaccggugccuggcuacgagcccggguauaucccaggauacgacacccccggcuaugucccuggguaccacggaccaggcuaucggcuucccgauuacccuaggccgggucgcccaguucccggguauagaggaccuguguacaacguaacuggcgaagaggugucguuuuccuucucuacaagcucagccccagcagucuugcuguacgugaguuccuuuguuagggacuauauggcuguguuaauuaaagaugacggcacccuccagcugcgguaccagcuugggacaucucccuaugucuaccaacugacuacccguccugugacggauggacagccgcauagcauaaauaucacccgcguuuaucgaaaccuauucauucagguggacuacuuuccccucacagagcaaaaguucucccuguuggucgauucacagcuggacagcccaaaagccuuauaucucgguagaguaauggaaacuggcgugaucgauccugagauucagagguacaacacccccggguuuaguggaugccugucuggcguucgguucaauaacguggcaccacuuaagacacacuuucgcacuccuagacccaugaccgccgaacuggcugaggcguugaggguccagggugaacucuccgagagcaauuguggggccaugccacggcuggugucggagguaccgccugaacuagaccccugguaccugccacccgacuucccuuauuaccaugaugagggauggguggcaauccuucucggcuuucuggucgcuuucuugcuguuaggccucguugggaugcuggugcuuuucuaucugcaaaaccaccgauacaagggaucauaucacacgaaugaaccaaaagccgcccaugaguaccaccccgguucuaagccuccguugccaacaaguggccccgcucaggugccuacccccacugcagccccaaaccaggcgccugcuuccgcccccgcaccagccccuacaccggcucccgcaccagggccuagagaccagaaucucccccaaauacuggaggaaagccgcucugaguga

SEQ ID NO: 54600 - RNA, 3996 nt, Artificial Sequence
  derived and/or modified sequence opt3 from CNTNAP2__Homo_sapiens__NP_054860
augcaggccgcucccagagcaggcugcggggccgcgcugcuccuuuggaucgugagcuccugucugugcagggcuuggaccgccccuucuacaucacaaaagugugacgagccauuggucaguggauuaccgcacguugcauucagcuccucuucgucaauuagcgguaguuacucccccggcuaugccaaaauaaacaagcgcgggggagcuggcgguuggucuccuagcgauuccgaccauuaccaguggcuccagguggauuuugggaaucggaaacagaucucagcaauugccacucaaggacgauauaguagcucugacuggguaacgcaguaccguaugcuauauuccgauaccggcagaaacuggaagccauaccaccaggacggcaauaucugggcuuuccccgggaacauuaauucagauggaguggucaggcaugaacuccagcacccuaucauagcccgguaugugcgcaucguuccacuggacuggaacggugagggcagaauugggcuuaggaucgaaguguacggaugcagcuacugggcggaugucauuaauuuugacggccaugugguacugcccuaucgguuccgcaacaaaaagaugaagacauugaaagauguuaucgcacucaauuuuaagaccagugagucugaaggugugauacugcacggggagggacaacagggcgacuacauuacccuggagcucaaaaaggccaaauuaguccugucccuuaacuugggcagcaaucagcuggggccuaucuauggacacacaucggugaugaccgguucucuacucgaugaccaucacuggcauuccguggucauugaacgacagggcagaucaaucaaccugacucuugacaggaguaugcaacacuuccggacaaauggggaguuugauuaccuggacuuggauuaugaaaucaccuucggaggcauuccauuuagcgguaagccguccucuagcucacguaagaacuucaaaggguguauggagaguauaaauuacaacggcguuaacaucacggaccucgcucgcagaaagaaacuggagcccuccaaugugggaaaccugagcuuuucuugcguagaaccuuauacugugccagucuucuuuaaugccaccucauaccuggaggugcccggcaggcucaaccaggaucuuuucaguguuagcuuccaguuucggacauggaauccuaacgggcuguugguguucucccacuuugcagacaaucuaggaaacgucgaaauugaucugacugagucuaagguggguguacauaucaauauaacccaaacaaaaaugucgcagauugacaucagcuccggcucagggcucaacgauggacaguggcacgaaguucgauuccuggcuaaggagaauuuugccauccuuaccauugacggcgaugaggcgagugccgugcgcacgaacucuccacugcaggucaaaacuggugaaaaguacuucuuugggggcuucuugaaucaaaugaacaauagcucccauucagugcuccagcccagcuuucagggauguaugcagcugauccaagucgacgaccaguuagugaaccuguaugagguugcacagagaaagccgggcucuuucgcuaacguguccauugauaugugcgccauaaucgacagguguguaccuaaucacugcgaacaugggggaaaauguagucagacaugggauagcuuuaagugcacuugcgacgagacugguuacucuggcgcuacaugucacaacuccauuuaugaacccucaugcgaggccuacaaacaccuagggcaaaccaguaauuauuacuggaucgauccagacggaagcggcccucucgguccccugaaggucuauuguaacaugacggaggauaaaguguggaccaucguuucgcaugaccuucagaugcagacaccaguggucggguacaaucccgaaaaguacuccgugacucaguugguauauucugcaagcauggaucaaauuucagccauaaccgacagugcugaguacugcgaacaguauguguccuacuucuguaagaugucucggcugcucaacacaccugauggcagcccauauacuugguggguuggaaaagcgaaugagaagcacuacuauuggggcggguccggaccgggcauccagaaaugcgcaugugguauugaacgcaacugcaccgaccccaaguacuacuguaauugcgaugccgacuauaaacaauggagaaaggacgcuggguuucugucauacaaggaucaucuuccugucagccaggugguggucggagacacagauaggcagggcagugaggccaaacugucuguugguccauugcguugucagggcgaccggaacuauuggaaugcagccuccuuccccaacccuagcucguaccuccacuucucaaccuuucaaggggagacuucugcugauaucaguuucuauuuuaagacgcugacaccauggggaguguucuuagaaaauaugggcaaagaggacuuuauuaagcuggaacuaaaauccgccaccgaggugagcuucucuuuugauguagggaacggacccgucgagaucgugguucgaagcccgacuccucucaaugacgaucaguggcacagagugaccgcagaaaggaacgucaagcaggcguccuuacagguggaccgccuuccacaacagauacggaaggcucccacagagggccauaccagauuggaacuguacucacagcuguucguugguggggccggaggccagcaagguuuucugggcugcaucaggaguuuacgcaugaacggggugacucuggaucuugaggaacgagcaaaaguaacaagcggauucauuucuggcugcuccgggcacuguacgucauauggaaccaauugcgagaacggcgguaaguguuuggagcgguaccauggguacaguugcgacuguagcaauacugccuaugauggaacauuuugcaacaaagacgucggcgcuuucuuugaagaggguauguggcuccguuacaauuuccaggccccugcaaccaacgcuagagacuccucuucgaggguggauaaugcccccgaccagcaaaacagccacccagaucuggcgcaggaagagauccgcuucucauuuuccacaacuaaggccccuuguauucuacuguauaucaguucuuucaccacggacuuucucgcugugcuggucaaacccaccggcagccuucagauacgguacaauuugggagggacaagagaaccauauaacauugauguugaccauaggaauauggcaaacggccagccgcacuccgugaauaucacucgacacgagaagaccauuuuccugaaauuagaucauuacccuucaguaucuuaucaccuccccagcaguuccgacacacuguuuaacagcccaaagucucuuuuccuggggaaggugaucgagacuggaaaaauagaucaagaaauccauaaguacaauacccccggcuuuacggguugcuugucacgcguccaguucaaccagauugccccucucaaagcugcccugcggcagacaaacgcauccgcgcacgugcauauccaaggggagcuaguugaaaguaauuguggagccagcccacugacccucucgcccaugucuuccgcuacugacccuuggcaccuggaucaccuugacagcgccucagcagacuuuccguacaacccaggccagggccaggcuauuagaaauggggugaacaggaauagugccaucauaggaggugucauugcagugguuaucuucacaaucuugugcacccugguguuuuuaauucguuauauguuccgccauaagggcacuuaccacaccaacgaggccaaaggggcugaaucugcggaguccgccgaugcagcuaucaugaauaacgaccccaauuucacagagacgauugaugaaagcaagaaggaguggcucauauga

SEQ ID NO: 54601 - RNA, 3867 nt, Artificial Sequence
  derived and/or modified sequence opt3 from CNTNAP3__Homo_sapiens__NP_387504
auggccagcguggcuugggcaguccugaagguucuccuucuguugcccacccagacaugguccccugugggcgccgggaacccaccggacugcgaugcgcccuuagcuucugcccugccuagaucaaguuucagcuccucuucggagcuaucaagcagucacggaccagguuuuuccaggcucaaucggcgcgacggcgcagggggauggacuccccugguaucuaacaaauaccaauggcuucagaucgaucugggcgaacgaauggaggugacggccgucgcuacccaggguggguauggaagcuccgacugggugacaucauacuugcucauguucagugauggcggccguaauuggaagcaguauagaagggaagagagcauuuggggguuuccuggaaacacuaaugcagacucuguugugcauuaccggcugcaaccacccuucgaagcccgcuuucugagauuccucccuuuagcuuggaacccaaggggucggauaggcaugcgcaucgaggucuaugggugugccuacaaauccgaggugguauauuuugauggacagucagcgcugcuuuaccgauuggacaagaaaccgcugaagcccauuagagauguuaucagccuaaaguucaaagcaaugcagaguaauggcauucuccugcacagggaaggucagcaugggaaccacaucacccuugagcugauaaagggaaaauugguguuuuuccucaauucuggcaacgccaagcugccuuccacaaucgcuccagucaccuuaacucugggcagccuccuugacgaucaacauuggcacucggugcugauugaauugcuagacacacaggugaauuuuaccgucgauaaacacacgcaucacuuccaggccaagggggacucuuccuaccuggaccucaacuuugagaucucauucggagguauucccacuccuggccggagucgugcauuccgcagaaagagcuuucaugggugccuggagaaucuuuauuacaacggaguugaugugaccgaacuggcuaaaaagcacaaaccacagaucuugaugaugggcaauguauccuucucuuguccccaaccgcagacagugccugucacuuuucucagcucaaggaguuaucuggccuuacccgguaacuccggggaggacaaggugagcguuaccuuccaguuucggacauggaaccgagcgggccaucugcuauucggagaacuccgcagaggcucugggucauuugugcuguuccuuaaagauggaaaguugaaacugagucucuuucaaccaggucagagcccuaggaaugucaccgccggcgcagggcugaacgacggacaguggcacuccgugucuuucucggcuaaguggagccacaugaauguaguuguggaugacgauacggccguccagccccuuguggcuguccugauagacuccggcgauacuuacuauuuuggugggugcuuggacaacucaaguggcucuggauguaagagcccacucggcggguuccaaggaugccugcgguuaauuacaaucggugauaaagccguggaccccauucugguucagcagggcgcacuaggguccuuucgcgaccuccagaucgauucauguggaaucaccgacagaugccugccuagcuacugugagcauggcggugaaugcucucaauccugggauacuuucaguugugacugccuugggacaggcuauaccggagagacgugccacagcucuuuguacgagcaguccugugaagcccauaagcacaggggcaauccaucagggcuguacuauauugaugcugacggaaguggcccgcucggucccuuccugguguacugcaacaugaccgcggaugcagccuggacaguaguccagcacgggggaccugacgcugugacuuuacguggcgccccaagcggucauccccggucggcaguuuccuuugccuaugcugccggcgcagggcagcugcgaucugcggugaaucuugcugagagaugugaacaaagguuggcccuccgcugcggaaccgcacggagaccugauagcagggacggcacaccacugucauggugggucgggcgcacuaacgagacccacacaaguuggggaggcucccuacccgaugcccagaaauguaccugcggucuggaagggaauuguauagacucucaguacuauugcaacugugaugcuggacgaaaugaguggacuagcgacacgaucgugcucucccagaaggagcaucugccgguaacacaaauugugaugaccgacgccggccggccucacucagaagcagcuuacacucuugguccauugcugugccguggcgaucagagcuucuggaacagugccucuuuuaauaccgagacauccuauuuacacuuccccgcguuucauggggaacucaccgccgacguuuguuucuuuuucaaaacuacagucagcucgggaguguuuauggagaaccugggcaucacggauuucauaagaauugaacuuagggcuccuaccgaggugacuuuuucauucgacgucgggaauggacccugcgagguuacagugcagucuccaaccccuuuuaacgauaaccaauggcaccaugugcgcgcagaacggaauguaaagggcgccagucugcaggucgaccaguugccccagaagaugcaaccagcuccggccgauggucacgugagacuccagcugaacucccagcuauucaucgggggaacagcaacuaggcagcgaggcuuccuggguugcauccgcagccuccaacugaauggcguugcgcuugacuuggaggaacgggccaccgugacgccuggggucgagcccggaugugcuggccauugcucuaccuacgggcaccuguguagaaacggagguaggugccgugagaaacgccggggcgugacaugugauugcgccuuuagcgcauacgacgggccauucuguuccaaugaaauuucagcuuauuuugccacuggaaguagcaugaccuaccacuuccaggagcauuauacauuaucugaaaacuccucaagucucguuagcucccugcacagagaugugacucuuaccagggagaugaucacgcugucuuuucgaacaacccggacucccucgcuacuccuguacguaagcucauucuaugaagaguacuuguccgucauucuggcaaauaacggcaguuuacagauacgcuauaagcucgacagacaucagaauccugaugccuuuacauucgacuuuaaaaacauggcugacggccaacugcaccaggugaagaucaauagggaggaagcgguggucaugguugaggugaaccagucuaccaaaaagcaaguaauucuuagcuccgggacugaguucaaugccgugaagucacugaucuugggaaaaguccucgaagcagcuggugccgauccagacacccggcgagccgcuacaucuggcuuuacggggugccugagcgcagugagauucggacgcgccgcgccccuaaaggcugcccugaggccuaguggcccgucccguguuaccgugcggggucaugucgcaccaauggccagaugugcugcaggggccgcgagcggaucucccgcuagggaacuugccccucgccucgcaggcggcgccgggcgaucaggaccagcugaugagggugagccccuggugaacgccgacagacgggauuccgcaguuaucggcggggugauugcugucguaauauucaucuugcugugcauuacugccaucgcgauuaggaucuaccagcagcgcaaauuacguaaggaaaaugagaguaaagugagcaagaaggaagaguguuga

SEQ ID NO: 54602 - RNA, 3927 nt, Artificial Sequence
  derived and/or modified sequence opt3 from CNTNAP4__Homo_sapiens__NP_207837
augggcagcgugaccggggccguccugaagacacuccuucuguuguccacucagaacuggaauagaguugaggcuggaaacucuuacgacugcgaugaccccuuagugucagcacugccucaagccaguuucagcuccucuucggaacuaucaagcagucacgguccaggcuuugcgaggcucaaucggcgcgauggggcuggaggcugguccccgcugguaucuaacaaauaucaguggcuucagaucgaccugggugagcgaauggaagugacggccgucgcaacccagggaggauacggcagcuccaauugggugacaucauauuugcucauguucagugauagcggcuggaacuggaagcaauaccgucaggaggacucuauuuggggguuuuccggaaaugccaacgcugauucaguuguguauuacagacugcagcccagcauaaaagcaagguuccugcgguuuaucccucucgaauggaauccaaagggucgcauuggcaugagaaucgaggucuucgggugugccuauaggagugaggugguagacuuagauggaaaaucuucccugcuuuaccgguuugaccagaagucuuugucgcccauuaaggauaucauaucucugaaauucaagacuaugcaauccgacggcauccuacuccaucgcgaagguccuaacggggaucacauuacccugcagcuuagacgagcuaggcuguuuuugcucaucaauucaggagaggccaaacugccaaguacaagcaccuuaguuaaccugacucucggcucccuucuggacgaccagcauuggcacucuguguugauucagcggcuaggcaagcaagucaauuucacaguggaugaacaucgucaccacuuucaugcgcgcggggaguucaaccugaugaaucucgacuacgagaucagcuuuggagguauacccgcaccuggcaaaucagugaguuucccacacagaaacuuccaugggugccuggaaaaccuuuauuacaauggagucgauauuaucgaccuggccaagcagcagaagccgcaaauuaucgcuaugggcaacguuuccuuuagcuguucucagccccagucaaugccugugaccuucuugaguagcagguccuaucucgcccugccagauuuuucuggugaggaagagguaucggcaacguuccaguuucggacuuggaauaaagcuggguuacugcuauucagcgaacuccaacugaucuccggcgggauucuuuuguuucugucagacggcaagcucaaaaguaaccuguaccagcccgggaaacuuccuucugauauaaccgccggaguggagcugaaugacggucaguggcacagcgucuccuugucagcgaagaagaaccaccucagcguggccguugauggccagauggcaucugcugccccacuguuagggcccgagcaaaucuauuccggaggcacauacuauuucggugggugcccggacaaaaguuuuggcagcaaguguaagucuccucugggaggcuuccaggggugcaugcgacuaauuuccaucucaggaaaaguggucgaucucauaagugugcagcaggguagccugggcaauuuuucggaccuucaaauugacuccugugggaucucugaucgcugcuugcccaacuacugugaacauggaggcgagugcagccagucauggaguacuuuccacuguaauugcaccaacacagguuacagaggggcuaccugccauaauuccaucuaugaacagucuugugaggccuacaagcacaggggcaacacgagcggauuuuauuacauugacuccgauggcucagggccacuggaaccuuuccuccuguauugcaauaugacugagacagcauggaccaucauucagcauaacggaagcgacuuaacucggguacgcaauacaaaccccgagaacccauacgccggcuucuuugaauauguugcuaguauggagcaacugcaggcgaccauaaauagagcagaacacugugagcaggaguucacguacuacugcaaaaagucuaggcuugugaacaaacaagaugguacccccuuguccuggugggucgggcguacaaaugaaacucagaccuauuggggaggcagcucgccugaccuccagaaguguacaugcggucuggagggcaacuguaucgauucacaguacuauugcaauugugacgccgaucggaacgaauggacuaaugacaccgggcuacuggcuuacaaggagcaccucccagugacaaaaauugucaucaccgauacuggacgacugcauucugaagccgcauauaaacuuggcccguugcugugccaaggggacagaaguuuuuggaacuccgccagcuucgauacggaggcuucuuacuuacacuuucccacauuccauggagagcucagcgccgacguguccuuuuucuuuaagaccacugcaucaaguggcguuuuccuggaaaaucuugguaucgcggacuuuauuaggauagagcugcgcagcccuaccgugguaacauucucuuuugaugucgggaacggaccauucgaaaucuccgugcagucacccacccacuucaaugacaaccaguggcaccauguucggguggagagaaauaugaaggaagcuaguuugcaggucgaucaacucacuccuaaaacacagccagcccccgcagacggccacgugcugcuacagcugaacagccagcucuuuguagguggcacggccaccaggcaacgcggguuccugggauguauucgaucccuucaguugaauggcaugacucuggauuuagaggagcgggcucaggugacaccggaaguucaaccugggugccguggacauugcagcucguauggcaagcucuguagaaacggugggaagugcagggagcgcccaaucggauuuuucugugacugcaccuuuagcgccuacacaggccccuucuguucaaacgaaauuuccgcauacuuugguaguggcucuagcgucaucuauaauuuccaggagaacuaccugcuuuccaaaaauucaucuagccacgcugccaguuuucauggggauaugaagcugucccgggaaaugauaaaauucagcuuuagaacuaccaggacgccuucucuacuccuguucgugucauccuucuauaaggaguacuugagugugaucauugcgaaaaacggaagccugcagauccgauauaaguuaaauaaguaccaggagcccgacgucguuaacuuugauuucaaaaauauggccgacggccaacuccaccacauuaugaucaaccgcgaagagggggugguguuuauagaaauugaugacaaucggagaaggcagguacaucugucgucuggaaccgaguucuccgcugucaagagccuugugcugggccguaucuuggaacacucagauguugaccaggacacagcacucgccggugcucagggguuuacuggaugccugagugccgugcaacuaucucaugucgcaccacugaaagcggcccuucacccuucccaucccgauccagugaccguuacaggccacgugacugagagcucauguauggcucagccgggcaccgacgccacgagucgcgagcggacacacagcuucgcagaucauuccgggaccauugacgauagagaaccucucgcuaacgccaucaagucugacagcgcaguaauaggaggucugaucgccgucgugauuuuuaucuugcugugcauuacugcuaucgcggugaggauauaucagcagaaacgauuauacaagcgguccgaggccaaacgcucagaaaaugucgauucugcagaggcuguucucaagagugagcugaacauucaaaaugccgugaacgaaaaucagaaggaguacuucuuuuga

SEQ ID NO: 54603 - RNA, 3921 nt, Artificial Sequence
  derived and/or modified sequence opt3 from CNTNAP5__Homo_sapiens__NP_570129
auggacagccugcccagacucaccuccgugcuuacacuguuguucucuggcuuauggcaccuggggcuaacugccacgaacuacaauugcgaugacccucucgcuucacugcuuaguccaauggcauuuagcuccucuucggaucugaccggaacacauucaccggcccaguugaacuggagggucgguacuggcggguggagccccgcggacaguaaugcucaacaguggcuccagauggaucugggaaaccggguugagaucaccgccguggcaacacagggccgcuaugguuccucugacuggguaaccagcuacucccugauguucucagauacugggcgaaauuggaagcaauauaaacaggaagacaguauuuggacauuugccggaaacaugaaugcugauagcgugguccaccauaagcucuuacacucugugcgugcaagauucguuagguuugugccucuggaguggaacccauccggcaaaauaggcaugcgggucgaaguguacggguguucauauaagagcgacguagccgauuucgacggacgcaguucucuuuuguacagauuuaaucagaaacugauguccacccuaaaggauguuaucagccucaaguucaaaucgaugcagggugacggcgugcuguuucauggggagggacaaaggggcgaccacauuacgcuugaacugcagaagggucgguuggcucuccaccugaacuuaggggauucuaaagcccgccuguccucaagucuccccagcgcgacucuuggaucccuguuggacgaucagcauuggcacucuguccuaaucgagcgagugggcaaacaggugaauuucaccgucgacaagcauacacaacacuuuagaacuaagggcgagaccgaugcacuggacauugauuaugaacucagcuucgggggaaucccuguuccagguaagcccggcacauuucugaaaaagaacuuccacgggugcauagagaaucuuuacuacaacggagugaauaucauugaccuggccaaaaggcggaagcaucagaucuauaccggcaacguaacguucucauguagugaaccucagauugugccaaucacuuuugucaacuccagcgguucuuacuugcuccugccggggacaccccaaauagauggcuuaucagugaguuuccaguuucguaccuggaauaaagacggacugcuacucagcacugagcuguccgagggcucugggacacuuuugcugucgcucgaaggagguauucugcgccuuguuauccagaagaugaccgagagaguggcugaaauucugacgggcagcaacuugaaugaugggcucuggcacuccgucucaaucaacgccaggcggaaucgaaucacccugacauuagacgacgaggcagcuccuccagcccccgauaguacuugggugcagauuuauucuggaaacagcuacuauuucggcgguugcccugacaaucugaccgauucccaaugucuaaacccaauaaaagcguuucaggggugcaugcgccucaucuucauugacaaucagcccaaggaucugaucucaguacagcaaggcagccuuggaaacuuuucugacuugcauauagaucuguguuccauuaaggacagaugccucccgaauuacugugaacacggcgggaguugcagccagucuuggacaacuuucuauuguaacugcuccgauaccucauacacaggagccacuugccauaauaguaucuacgagcagagcugugagguuuauaggcaccaggguaacacugcaggcuuuuucuacaucgacucggauggguccggaccucugggccccuuacaaguguauugcaauauuacggaagacaaaaucuggacaucuguccagcacaacaacaccgagcugacucgggugcgcggugcuaauccagaaaagccuuacgccauggcucuugauuaugggggcagcauggagcaguuggaagccgucauugacggaucagagcauugugagcaggaaguggcauaccacugcagaaggagucgucuccugaacacccccgacggcacaccauuuaccugguggauagggcgguccaaugagcgacaucccuauuggggaggcucuccuccagguguucaacagugugaaugcgggcuagaugagagcugucuggacauccagcacuucugcaacugugaugccgacaaagaugaauggacuaaugacacaggauuucucuccuucaaggaucaucugccggugacgcaaauuguaaucaccgacacugauagaucaaacagcgaggcugcguggaggaucggcccccuucgcugcuacggugaccggagauucuggaaugcagucaguuuuuacacagaggccucuuauuugcacuucccuaccuuucacgcugaguucuccgccgauauuagcuuuuucuuuaaaacaacugcacugucgggcguguucuuagaaaaccucgggauaaaggacuuuaucaggcuggaaauuucaucuccaagugagaucaccuucgccauugauguuggaaauggccccguggagcuugucgugcaguccccuagccuguugaacgacaaucaguggcauuacguacgcgcugaacgaaaccucaaggagacgucucuacagguggacaaucugccacggagcacccgugaaacauccgaggaagggcacuuuagacugcaacucaacucacagcuguucguuggaggcaccaguagcaggcagaaagguuuucuuggguguauccgcucuuugcaucugaauggacagaagauggauuuagaggagcgggccaaagucaccuccggcgugagacccgguugcccgggccacugcucaaguuaugggagcauaugucacaacggaggcaagugcguggaaaaacauaacggguaccucugugacugcacaaauuccccuuaugagggaccauucuguaagaaggaagucucugcaguuuucgaggcgggcacuucggugaccuacauguuucaagaacccuauccugugacgaaaaacaucagccugucauccagugcuauuuacacagauucugcccccagcaaggagaauaucgcacuuuccuucguaaccacucaggccccaucacugcuacucuuuauuaacucuagcagucaggacuucgucgugguucuguugugcaaaaaugguuccuuacaggugagguaccaccugaacaaggaggaaacacaugucuuuaccaucgaugcugacaauuucgccaaccgacgcaugcaccaucucaaaauaaaucgggaggggagagaacugacuauucaaauggaucagcagcuuaggcugagcuauaacuuuucuccugagguggaguuccguguuauccgcucauugacccucggaaaggugacagaaaaucugggccuagacuccgagguagcaaaggcuaacgccauggguuuugcgggcuguaugaguagcguccaauacaaucacauugcuccccugaaagccgcacuucggcacgccacgguggcuccagugaccguccaugggacucucacagaaucgucuugcggauucaugguugauuccgacgugaacgccguaaccacagugcacagcucaagugauccguuuggcaagacugacgagagagaaccucugaccaaugcagucaggucugacuccgcggugaucgggggaguuauagccguggucaucuucauuaucuucuguauuaucggcauaaugacgcgauuuuuguaucagcauaaacagagccaccggacaucacagaugaaggagaaagaguaccccgaaaaccuggauaguagcuuccgcaacgagauugacuuacaaaauaccguguccgaaugcaagagagaguauuuuaucuga

SEQ ID NO: 54604 - RNA, 6978 nt, Artificial Sequence
  derived and/or modified sequence opt3 from CNTRL__Homo_sapiens__XP_005251736
augaagaaaggcagccagcaaaagaucuucuccaaagccaagauucccucuucaagucacagcccuauaccauccucuaugucgaacaugagaucaaggagccugaguccgcucaucggguccgagacccuucccuuucauucuggaggucaguggugcgaacagguggagauugcugacgaaaauaacaugcuguuggauuaccaggaccacaaaggcgcagauagccaugccgggguccgguauaucacagaggcguuaauuaagaagcugacuaaacaagacaaucuagcucucaucaagucccugaaccuuucacugaguaaagauggaggcaagaaauucaaguacauagaaaauuuggagaaguguguuaaacucgaggugcugaaccugagcuauaaucucaucgguaagauugaaaaauuagacaagcugcuuaaauugcgcgagcugaaccuaucuuacaauaagaucuccaaaauugaagggaucgagaacaugugcaaucuccagaagcugaaccuugccggaaaugagauagaacacauuccuguauggcugggcaagaaauugaagucacuccgagugcugaacuuaaaaggcaauaagaucagcagucugcaggauauuucuaaacucaagccacuucaggaccugaucuccuugauccuagucgagaaccccgugguuacgcugccucauuaucuccaauuuaccauuuuccaccugcguagccuugaaucgcuggaggggcagccagugacaacucaggauagacaggaagcauuugagagguucucuuuggaggaagucgagcggcucgaacgcgaccuggagaagaaaaugauagaaaccgaggaguuaaaguccaaacaaacaagauuucuggaagagaucaagaaccaggauaaacuaaauaagucacucaaggaagaggccaugcugcagaaacaaaguugugaagagcuuaagagcgacuugaacaccaaaaaugagcugcucaagcagaaaacuauugaacugacaagggcuugccagaagcaguacgagcuugaacaagagcuggcauucuauaagaucgaugccaaauuugagcccuugaacuacuacccuuccgaauaugcugagauagacaaggccccagacgaaucuccguacauuggaaaaagccgguauaagcgcaauauguucgcgaccgagucauacaucaucgauagugcacaggccgugcagauuaaaaagauggaacccgacgagcagcuccgaaacgaucacaugaaucugagaggucauacgccuuuagacacucaacuggaggauaaagaaaagaagaucuccgcugcccagaccaggcuaagcgagcuccacgacgaaauugagaaagcagaacagcagauacugcgggcuacagaggaguuuaagcaacuugaagaggccauccaguugaaaaagauuucugaagcgggcaaagaucugcucuauaagcagcugucagggcguuuacagcugguaaacaagcuucgccaagaggccuuggaccucgaacugcagauggagaaacagaagcaagagaucgcaggaaaacagaaggaaaucaaagaucuacagauugcuauagacagucuggauagcaaggacccaaagcauucccacaugaaagcccagaagucuggcaaagagcaacagcucgacaucaugaauaagcaguaccagcaacuggaaucgagacuugaugagauuuugagcaggaucgcuaaagagacugaagagauuaaggaccuggaagagcaguuaaccgaaggucagaucgccgcaaacgaggcccucaagaaagaucuggaggggguuauauccggacuucaggaauaucugggcacaaucaagggccaagcuacccaggcgcagaaugagugucggaaauugcgagacgaaaaggagacgcuccugcaacgccuaacugaaguggagcaggagagagaucagcuggaaauugucgcaauggacgccgagaacaugaggaaagaacucgcugagcuggaaucagcccuucaggagcaacacgaggugaaugcaaguuugcagcagacacagggggaucugucugccuacgaagcugaguuagaagcccggcucaaccugcgcgacgcagaggcgaaucaacuuaaggaggaacuggagaaagugaccagacuaacucagcucgaacagagcgcucugcaggccgaguuggaaaaggagaggcaagcacugaagaacgccuuaggaaaagcucaguucuccgaggaaaaggagcaggaaaacucagagcuccaugccaaacugaagcaccuucaggaugacaauaaccuguugaaacaacagcucaaggauuuucagaaucaucugaaccacgucguugacggucuagugcgucccgaagagguagcagcucggguggaugagcugcgaagaaagcuuaaacucggcacaggggaaaugaauauccauagcccuucugacguccugggaaaguccuuggccgaccugcaaaaacaguucagugagauuuuagcgaggagcaagugggaacgcgaugaggcccaggugcgggaaagaaaacuccaggaggagauggcucugcaacaggaaaagcuugcaaccggccaggaggaauucaggcaggccugcgagcgcgcucuggaggcccgaaugaacuuugacaagcggcaacacgaagcacguauccagcagauggagaaugaaauacacuacuugcaggagaaccucaaaucuauggaagagauucaaggucugacggaucuacagcugcaggaggcggacgaagagaaggaaagaauccuugcccaacucagggagcuggaaaaaaagaaaaaguuggaggaugcuaagucccaggagcagguuuucggguuagacaaagaacugaagaaacucaagaaagccguggcaaccucagauaagcuggcuacagccgagcuuacuauugcaaaggaccagcugaaaaguuugcauggcaccgucaugaagaucaaucaagaacgcgccgaggaacuacaggaggcugagcgguuuagcagaaaagcggcccaggcagcuagggaucugacacgagccgaagccgagauagaacuccugcagaaccuuuuacgccaaaagggagagcaguuccggcuggagauggaaaaaacuggcguggggaccggagcuaauucgcagguacucgagaucgaaaaguugaacgagacaauggaaagacagaggaccgagauugcacgucugcaaaauguucucgaccugacugguuccgauaacaaaggcggguuugagaaugugcuugaagagaucgccgaacugcgccgggaggucucuuaucagaacgacuacauuagcucaauggcggauccauucaagagaaggggauauugguacuuuaugcccccgccucccaguuccaaggugucuagccacuccucacaggcuacgaaagacagcggcgucgguuugaaguauagugccucuacaccagugcgaaaaccucggcccgggcagcaagacggcaaggaaggaucccagccacccccugcaagcggcuacuggguuuauucgccaauccgcucagggcuacauaaacuguucccgucuagagaugccgacaguggaggugauucccaggaggagagcgaacucgacgaucaagaggaacccccuuuugugccacccccuggcuacaugauguacaccguauuaccagacgggucucccgucccgcagggaauggcucuguaugcaccuccacccccucuucccaacaauagcaggccacugacuccuggcaccgugguuuacggucccccaccggccggggcgccuaugguguauggccccccacccccuaacuucuccauaccauuuauucccaugggaguccuccacuguaaugugccugagcaccauaacuuggaaaaugagguaucacggcuggaggauaucaugcagcaccucaagaguaagaaacgagaagagagauggaugcgcgcuagcaagaggcagucugaaaaagagauggaggaacugcaucacaacaucgacgaucuucuacaagagaagaaaucccuggaaugcgagguggaagaguugcaucguacaguucagaagcggcagcagcaaaaggacuucauugauggcaaugucgagucauuaaugaccgaacuggagaucgaaaaaagucucaagcaccacgaggacauuguggacgaaauagaguguaucgagaaaacucugcuuaagagaaggagcgaacugcgcgaggccgaucgacucuuggcagaagccgaguccgaacugucuugcacaaaagagaagacgaagaacgcuguggagaaauuuaccgacgccaagagaucgcuacugcagacugaaagcgaugcagaggaacucgagcggagggcucaggagacagccgucaaucuuguuaaagcggaccagcaacugcgcucauuacaggccgaugcaaaggacuuggaacagcauaaaauuaagcaagaggaaauccugaaagagauuaacaagaucguggcugccaaggauuccgacuuccagugucucaguaaaaagaaagaaaagcugaccgaggagcuucagaaacugcagaaggauauagaaauggcugagcguaaugaagaccaccaucuccaaguguugaaggagucugaaguacuguuacaggcaaaaagagccgagcuagagaagcugaaaagccaggucacaucccagcaacaggaaauggccgugcucgaucggcagcuugggcacaagaaagaggaacugcauuugcugcagggaucaaugguucaagcuaaggcggaccuccaggaggcacugaggcuuggcgaaacugaggugaccgagaagugcaaccacauccgcgaagucaaaucucuccuggaggaauugagcuuccagaagggugagcugaaugugcaaauuagugagcgaaaaacgcaguuaacccuaaucaagcaggaaauugagaaagaagaggaaaaccugcagguugugcucagacaaauguccaagcacaagacagagcuuaaaaauauccuggauauguugcagcuggagaaccaugaacuccaggggcugaagcuucagcacgaccaacggguaagcgaguuagaaaaaacucaggucgccgugcuggaggaaaagcucgaguuggagaaccugcagcagauaucucaacagcagaaaggagaaauugaguggcagaagcaacuacuggaaagggacaaacgcgagaucgaaagaaugaccgcugagucaagggcccuccaguccugcguggagugucuuaguaaggaaaaggaggaucugcaggaaaaaugcgacaucugggagaagaaauuggcacaaacaaagcggguccuggccgcugcggaggaaaauagcaaaauggagcagucgaaccucgaaaagcuggaguuaaauguucguaagcuucagcaggaacuggaucaacucaaccgcgacaaacuaucucugcauaaugauauuuccgccaugcagcagcaguugcaagagaagcgagaggcagugaacagccugcaggaagagcucgcuaauguacaggaccaccuuaaccuggccaaacaggauuugcugcacacuaccaagcaucaagacgugcucuuaucagaacagacgagacugcagaaagauauaagugagugggcaaauagguuugaagacugucaaaaggaggaggaaacaaagcagcagcagcuucaaguccugcagaacgagaucgaagagaauaaacuaaagcucgugcagcaggaaaugauguuccaacggcugcagaaagagcgcgagucugaagaguccaaguuggaaaccagcaaaguuacucugaaggagcagcagcaccaacucgagaaggaacuuacagaucagaaaucaaagcuggaccagguguuaaguaaaguccuggccgcugaggaaagagugaggaccuugcaggaggaagagcgguggugcgagagccucgaaaagacucugucccaaaccaaacgacagcuaucugagagagaacagcaacuuguugagaagagcggcgaacugcucgcccugcagaaggaggcggauuccaugcgcgcagacuuuucauugcugaggaaccaguuccucacagagcggaaaaaggccgaaaaacagguggcuucucuuaaggaggcccugaaaauucaacguagucaguuagaaaagaaucuguuggagcagaaacaggaaaacucguguauccaaaaggagauggcuacgauugagcucgucgcacaggacaaucaugaaagagccaggcgccugaugaaggagcuaaaccagaugcaguacgaauauaccgagcuuaaaaagcaaauggcuaaucagaaagaucuggagcggcgacagauggaaaucagcgacgccaugagaacucucaaguccgagguaaaagaugaaauaaggacaucucugaagaacuugaaccaauuuuuaccggagcugccagcagaccucgaagcgauccuugagcgcaaugagaaccuggaaggugagcuagaaucacugaaggagaaucuccccuucaccaugaacgaaggcccuuuugaggagaaauugaauuucagccaggugcacauuauggaugaacauuggcggggggaggcccugagagaaaagcuucgucacagggaggaccggcugaaagcucagcuccgccacugcauguccaagcaggccgaaguuuuaaucaaaggaaagcgacaaacagagggcacucugcauaguuugagaaggcagguggaugcacugggggagcucgucaccucuacgagcgcugacucagccuccaguccaagccuuucucagcuggaauccucacuaacagaggauagccagcugggacaaaaccaggaaaagaaugcaucggcccgguga

SEQ ID NO: 54605 - RNA, 2778 nt, Artificial Sequence
  derived and/or modified sequence opt3 from CNTROB__Homo_sapiens__NP_001032221
auggccaccagcgcugacucccccucuucaccucugggcgcagaggaucuccuuagugacagcuccgaaccaccggggcugaaccaggugucuucggaggucacaucacaauuguacgccagcuuaagacugaguaggcaggcggaagcuacugcccgggcacagcuauaucuccccuccacgucuccuccacacgagggacuggaugguuucgcccaggaacuuagccgcucccugucaguuggcuuggagaagaaucucaaaaagaaagacgggaguaagcauaucuuugagauggaaagcgugcgaggacaacugcagaccaugcugcagacaucucgugauacugcuuacagagacccccucauuccuggcgcagguuccgagaggcgggaagaggauucauucgacagcgauaguaccgccacauuacugaacacccgcccacuucaggacuugucucccuccagcucggcucaagcccuggaggaacuauuuccuagauauacuucucucaggccagggccgccccugaauccuccagauuuccagggacuucgggacgcgcuggauuccgagcacacacgccgaaaacauugcgaaagacacauacagucauugcagaccaggguacucgagcugcaacagcaguuagcaguggccgucgcugccgaccggaagaaggacacgaugaucgaacaacuggauaaaacucucgcacgugugguugagggcuggaaccgccaugaggcugaaagaaccgaggugcuuaggggccugcaggaagaacaccaggccgcggaauugacacggaguaagcagcaagagacugucacccgacuagagcagagccuguccgaagccauggaggcacucaaucgcgaacaggagucugcuagacugcagcaaagggaacgggagacacuugaggaagaacgccaggcccugaccuugagacucgaagcugagcagcagagguguugcgugcugcaagaggaacgugacgccgcacgggccgggcaguuaagcgagcaccgagaacuggagacgcuaagagcugcgcucgaagaggagaggcagacuugggcacagcaagaacaucagcugaaagagcacuaccaggcccuucaagaagagucacaggcucaguuggaacgcgagaaggagaaaagucagcgggaagcccaagcagccugggagacacagcaucagcuggcucucguacaguccgaaguuagaaggcuggagggagaacuugauaccgcccgccgagagcgggacgcacugcaauuggagaugagccucgugcaggcgcguuaugaaucucagaggauucagcuggagucagaauuagcuguccaacuggagcagagagugacugagcgccuagcccaggcacaagaaaguagccuccggcaggccgcuucccugagagagcaccacaggaagcagcuucaggauuugucuggucaacaucagcaggaacuggccucgcagcucgcacaauuuaagguggagauggcugaacgagaggagcgccagcagcaggucgccgaagacuacgagcugcgguuagcgagagaacaagccaggguuugugagcugcagagcggcaaccagcagcuugaggagcaacguguggaguugguagaacgccuccaggcuaugcugcaggcacacugggaugaggccaaucaacuacuguccacaacccugcccccuccaaaucccccggcuccucccgccgggccaucaaguccuggaccccaggaaccagagaaagaggagcggagaguguggacgaugcccccuauggcagucgcgcucaagccagugcuucagcagucuagggaggcccgagacgaauugccgggcgcucccccuguucugugcagcuccucaagcgauuuaucucuccugcuugguccauccuuccaaagucagcauagcuuucagccccuggagccuaaaccagacuugaccucuuccacagccggggcauucucagcucucggagccuuucaccccgaucaucgggcagaacgcccguucccugaggaggacccaggccccgacggcgaagggcugcuaaagcagggacugccucccgcccaacucgagggucugaaaaacuuucuucaccaguugcuggaaacugugccacagaacaaugagaacccuagugucgauuuacugcccccaaagagcggcccgcucaccgugccuucgugggaagaggcuccccagguaccaagaaucccaccuccaguucacaaaacaaaggugccccuugcgauggccuccucucuguucagggucccugagccgccaagcucacauagucaaggguccggacccucuagcggcuccccugaacgggguggggacggccuaacuuuuccacgacagcucauggaggugucacagcuguugagacuguaucaagcacgcggauggggcgcuuuacccgccgaagaucuccugcuuuaccugaagagguuggagcacagcggguacaaaccuggacguaaggaagaggguuucaguggcuggaaacucgacuauggggaguggucuggaaccgauggccggggugacaaugucccgagaaggaacacagauucccgccugggggaaauuccccgaaaggagaucccaagccaggccgugccuagacggcuagcuaccgcacccaaaacugaaaagcccccugccaggaagaaaucgggccaucccgcgccaucaucuaugcgcagucguggaggcguuuggagauga

SEQ ID NO: 54606 - RNA, 441 nt, Artificial Sequence
  derived and/or modified sequence opt3 from COA1__Homo_sapiens__NP_060694
augauguggcagaaguacgccggcagcagaagguccaugccccugggggcucggauccucuuccacggaguguuuuaugccgguggcuucgcaauugucuacuaucuuauacaaaaauuucauucucgcgcgcuguacuauaaguuggcuguugagcaguuacagucacacccugaagcccaggaggcacuggggccaccgcuaaacauccauuaccucaaacugauugaccgagaaaauuucguggauaucguagacgccaaacuuaagauucccgugaguggaagcaaguccgagggccuguuguauguccacucuucgcguggugggccuuuucaaagauggcaucucgaugaaguguuccuggagcugaaggacggacagcagaucccaguuuuuaaacucucaggcgagaacggcgaugaagugaagaaagaguga

SEQ ID NO: 54607 - RNA, 225 nt, Artificial Sequence
  derived and/or modified sequence opt3 from COA5__Homo_sapiens__NP_001008216
augcccaaguacuaugaggacaaaccucagggcggggccugcgcuggacugaaggaagaucucggugcaugucuucugcaaagcgacugcgugguccaggagggcaaauccccaagacaguguuugaaggaaggguacugcaacucuuuaaaauaugccuucuuugaguguaagaggucaguucuggauaaucgggcgcgcuuccgaggacguaagggcuacuga

SEQ ID NO: 54608 - RNA, 1782 nt, Artificial Sequence
  derived and/or modified sequence opt3 from COASY__Homo_sapiens__NP_001035997
augagaacccccaggcugcgggcccagccucgcggcgcuguguaccaagcaccaagcccgcccccugccccagucgggcucggauccauggcgguuuuccgaucuggucuucugguguugacaacucccuuagcuucacuggccccucgucuagcaaguauccucacgagcgccgcuagacugguaaaccacacccuuuaugugcaucugcagccaggcauguccuuggaggggcccgcacagccucagucuucgccaguccaagccacauuugaagugcucgacuucauuacucaccuguacgcuggagccgauguucauaggcaccuggacgugcggauacucuuaaccaauauccgcacaaagucaaccuuucugccgccccuuccuacuagcguccagaacuuggcgcauccacccgaggugguacugacagauuuccagacccuagacggcagucaguauaauccuguuaaacaacagcucgugagauacgcaacguccugcuauucuuguugcccaaggcuggccagcguccuucuguacuccgauuaugguauuggggaagugcccguggagccguuggacgucccucuccccucaacuauccggccagcuaguccuguugccggaagccccaagcagccagugcgcggcuacuaccgaggcgcaguagggggaaccuuugauagacugcacaacgcucacaaaguguuacugucugucgccuguauucucgcgcaggaacaacuugugguugguguggccgacaaggaucuguugaaauccaagcuacugcccgagcuccugcagccuuauacagagagggucgaacaucuuucagaguuccugguggacaucaagcccagcuugacuuuugauguaauaccgcuccuggaccccuacggcccugcagggagugauccaucuuuagaguuccugguuguguccgaagagaccuaucggggaggcauggcuaucaaucguuuucgccuagaaaacgaccucgaggaacuggcccuuuaccagauucaauugcugaaagaccucagacacacagagaaugaagaggauaaggucagcucgucuuccuucaggcagcggaugcuggguaaccuucugcgacccccuuaugagcgcccagaauugccaaccugccucuacgugaucgggcugacgggaauuucaggcaguggcaaaagcuccaucgcucagagauuaaaggggcugggagccuuugucauagacucugaucaucuaggucacagggcauaugccccgggcgggccugcuuaccagccagugguugaggcguucggaacugacauucuccacaaagauggcaucauuaaucggaaggugcuggguagccgcguauuugggaacaagaaacaacuuaagaucuugacagacaucauguggcccauuauagcaaaacuggccagagaagagauggauagggcugucgccgaaggcaagcguguguguguuaucgacgcagccgugcuccuggaggcuggauggcagaauuuaguccaugagguguggaccgccguaauuccugaaacugaggcagugcggcgaaucguugaaagagauggccugucagaggcggcugcccagaguaggcuucagucccaaaugagcgggcagcaguuggucgaacagucucacguggugcucucaacacugugggagccccauauaacccaacgccaggucgagaaagcaugggcccuacugcagaagcggauuccaaaaacgcaccaggcucucgacuga

SEQ ID NO: 54609 - RNA, 1140 nt, Artificial Sequence
  derived and/or modified sequence opt3 from COBL__Homo_sapiens__NP_001274367
auggacgcccccagagcuagcgcagccaagccuccaaccggcaggaaaaugaaggcgcgggcuccgcccccuccagggaaagccgcaacacugcacgugcauuccgaucagaagcccccucacgacggagcccucgguucucaacagaaccuuguccgcaugaaagaggcucugcgagcaucaacuauggauguuacggugguauugccaaguggcuuagaaaagcguagcgugcugaaugggucccaugccaugauggaccuacucgucgagcugugccuucagaaccaccugaaucccucucaucacgcuuuggaaaucagaucgucagagacccagcaaccucucagcuucaagccaaacacacugauuggaacucugaaugugcacaccguuuuucucaaagaaaaggugccggaggagaaagucaagcccggcccuccaaaagugcccgaaaagaguguaagguuaguugugaacuaccugcggacacagaaggccgucgugcgcguguccccugaggucccacuucagaauauauugcccguuaucugugcgaaaugcgaagugucuccggagcauguagugcugcuaagagauaacauugccggugaggaacucgagcugagcaagucccuuaaugaacuggggaucaaagaguuguaugcaugggacaacaggcgggaaaccuuccgcaagucaagucucggaaaugaugagacugacaaagagaagaaaaaguuucugggcuucuuuaaggucaacaaacgaagcaauucuaagggcuguuuaacaaccccuaacucccccucaaugcacagcagaagucugacgcucgggccaucucuuucccugggaagcauuucgggugugucuguuaaauccgaaaugaagaaaaggcgggcuccucccccacccggcucagggccuccagugcaggauaaggccagugagaaggucagcuugggaucccaaaucgaccuacagaaaaagaaacgucgcgcaccggcucccccuccaccccagccuccacccccgucuccucugauaccaaauagaacugaagauaaggaggaaaacaggaaaagcaccaugguguacugcugugccucauuccccacacaggcgaagcgguuuuga

SEQ ID NO: 54610 - RNA, 3702 nt, Artificial Sequence
  derived and/or modified sequence opt3 from COBLL1__Homo_sapiens__NP_001265387
augcccccuagcugguccccacugaugugcggcagagccgcugaggcagccgcgucuucaaggaccccggggcgggaaaugggacaggcugugacacgccgacucggugccggcgcacgugccgcucccagaagggcaauggacgggcggacuccucgcccacaagaugcccccgcuagaagggagaucgccggaaguuggcggaagccuaaagcgaaggcaccacuucccccugccgaaacgaaauacaccgacgucagcuccgcugccgauucuguugagucgacagcauucauuauggaacagaaggagaacaugauagacaaagauguggagcugucaguaguguugccaggcgacaucauuaagagcacuaccguccacgguaguaagccgaugauggauuuacugaucuuucuaugugcucaguaucaucucaaucccuccucuuacacaauugaccugcuuagcgccgaacagaaccacaucaaauucaagccuaauaccccaauagggaugcuggagguggaaaaaguuaucuugaagcccaaaaugcucgauaagaagaaaccuacuccaauuauccccgagaagacagugcgcgucgugauuaacuuuaaaaagacccagaaaacgaucguacgaguuuccccgcaugcgucacugcaagagcuggccccuauaauuugcaguaagugugaguucgacccccuccacacuuuacugcuuaaagauuaucagagccaggagccauuggaccugaccaagucucuaaaugaucucggacugagagaacuuuacgcaauggacgugaacagggcuacauccgucacuguguuuucaaagagcagucugcaagagucuugccagaucucccagaauuuggacauuaugaaagaaaaggagaacaaaggcuucuuuagcuucuuucagcggucgaagaaaaagcgugaucaaaccgccucugcuccugccacaccccucgugaauaagcaucgcccaaccuucacgagauccaacacuaucucaaaacccuauaucaguaauacacugccuagcgacgcaccaaagaaaaggcgggccccguuacccccuaugccagcuucccagucugucccccaggaucuggcgcacauucaagagcgaccugcaagcuguauaguuaagucaaugaguguggacgaaaccgauaaauccccaugcgaggccggccgcguaagagcugggagccuccagcuuucuucaaugagugccggaaacagcucccugaggcggacuaagcgcaaggcacccucuccgccuucgaaaaucccaccccaccagagcgacgaaaauuccagagugacagccuugcagccugucgauggugugcccccagacucagcuagugaggccaacucuccugaagaacuaagcucccccgagaccuuucauccaggccugucaagccaagaacaguguacggcaccgaagcucauggaggaaaccucuguuuucgagugcccugggacacccgaagcggcuauuacuucccugaccaguggaaucagcucugauuacucccuugaggagauagacgaaaaagaggaacugucagaggugccaaaggucgaggccgaaaauauuagucccaaaagccaggauaucccuuuugugucgacagacaucauuaacacuuugaagaacgacccagauuccgcacucggcaaugguucuggggaguucagccagaacucaauggaagagaagcaagaaaccaaaaguacagacggacaggagccccacuccguaguuuaugauaccucuaauggcaagaaaguggucgacagcaucaggaaccugaaguccuuaggcccuaaucaggagaacgugguccagaaugaaauuauaguguacccggagaacacugaagauaauaugaaaaacgggguuaagaaaacggagaucaauguggaaggaguagccaagaacaauaacauugacauggaggucgagcguccaucaaauagcgaagcucaugagacagauaccgccaucaguuacaaggaaaaccaccuggcagcuucuuccgugcccgaccaaaaacuaaaccagccuagcgccgagaagacuaaagaugcggccauccagaccacaccaucguguaauucauucgacgguaagcaccaggaucauaaccucucugacaguaaaguugaagagugcgugcaaaccuccaauaacaauauuagcacucagcacucuugucugagcucccaggauucagucaacacaagucgggaguuucgaagccaaggcacgcuuauaauccauucugaagaccccuugaccgugaaggacccuauuugcgcucacgggaaugaugaccugcucccgcccguagauagaaucgacaagaacuccacugcaucauaucugaaaaauuacccacuuuauaggcaggauuacaacccuaagcccaaaccaaguaaugagauuacacgcgaauauaucccuaagauaggaaugaccacauacaaaaucgugcccccaaagagccuggagauuuccaaggacuggcagucugagacuaucgaauauaaagaugaccaggauaugcaugccuugggcaagaaacacacccacgagaacguuaaggaaacggcuauucaaaccgaggacucggccaucagcgaaucaccggaggagccucuccccaaucugaaaccaaagcccaacuuacggacagaacaucaggucccuuccagugugucuagcccagaugacgcaauggugucaccccugaagccugcgccgaaaaugacuagagauaccgguacagccccauucgcucccaaucuagaggaaauaaacaacauucucgaguccaaguuuaaaucuagggccagcaaugcacaggcuaagccuaguuccuucuuucugcagaugcaaaaacgcgucagcgggcacuacguuacuucugccgcagccaagucagugcaugcugcgcccaacccagccccuaaagaacuuaccaauaaggaggcagagcgagacauguugcccuccccagaacagacgcugaguccucucagcaagaugccgcacucggugccccagccacugguagagaaaacagacgaugacgucaucggccaggcuccugccgaagccucucccccaccuauugcucccaagccggugaccaucccagcaucccaaguuagcacucagaacuuaaaaacacugaagaccuucggagccccucggcccuacucaaguucuggcccaucccccuuugcgcuugcuguggucaaacguagccagucauucaguaaggagagaacugaaagcccuuccgccucugcauuggugcaaccgcccgccaauaccgaggaggggaagacacacagcguuaacaaauuuguggauauaccacagcucggaguauccgacaaggaaaauaacucagcucauaaugagcagaacucucagaucccuacgcccaccgaugguccuaguuucacugucaugaggcaaucgagccugacauuucaguccucugacccagaacagaugcgccagucacuacugaccgcaauucggagcggcgaggccgcggcuaaacucaagagagugacaauccccuccaauacuauuagugugaacgggaggucucgacugagccacucaauguccccugaugcccaagacggacauuga

SEQ ID NO: 54611 - RNA, 1653 nt, Artificial Sequence
  derived and/or modified sequence opt3 from COCH__Homo_sapiens__XP_011534841
augagcgccgcuuggauccccgcacugggccucggggugugccuucuguuguuaccuggaccagccgguuccgagggcgcggcuccgauugccauaaccuguuucacaagagggcuggacaucaggaaggaaaaagcagauguccuaugccccggaggcuguccucucgaggaauuuucuguuuacgguaacauuguguaugccucaguaaguagcaucugcggggcugcagugcaccggggagucauuuccaauucuggcggcccagugcgcguuuacucgcugcccgggcgagagaacuauucaagcguggacgccaauggaauccagagucaaaugcuuucccguuggucugcuagcuucacugucacgaaggguaaauccucaacccaggaagccacaggccaggcggugaguacugcacauccuccaaccgggaagagacugaaaaagacacccgagaagaaaaccggaaacaaggauuguaaagccgacauagcuuucuugaucgauggcagcuucaauauuggucagaggcgguuuaaccuccaaaagaauuucguagggaaaguugcccugaugcugggaaucggcacugagggcccucacguggggcucguccaggcaucugaacauccaaagauugaguuuuacuuaaagaacuucacauccgcuaaagacgugcuguuugccaucaaggaagugggauuccgcgguggcaauucaaacaccgggaaagcgcuuaagcacacggcccagaaauuuuucacugucgaugcaggaguuagaaagggcauaccgaaagugguaguggucuuuauugacgguuggcccagcgaugacaucgaggaggcugggauuguggccagggaauuuggcguuaauguguucaucgucaguguggcuaagccuaucccagaggaauugggaaugguacaggauguuaccuuuguggacaaggccgucugccggaacaauggcuucuuuucuuaucauaugcccaacugguucgggacaacuaaauacgugaagccucugguccaaaaacuauguacccacgagcagaugaugugcuccaagacauguuauaauagcgugaacauugcauuucucauagauggaucgucuuccguuggugacucaaacuuccgccugaugcuugaauuugugaguaauaucgccaaaaccuucgagauuagcgacaucggcgcuaagauagcggcaguacaguuuacguacgaucagcgaacugaguucuccuuuacagacuacucuaccaaggaaaacguccuggccgugauuagaaauaucagguauaugagcgggggaacugcuacaggcgaugccaucucauucaccguucggaacguguuugguccaauucgugagagucccaauaaaaacuucuuggucaucgugacggacgggcaauccuacgaugacguacagggcccggcagccgcugcccacgaugcaggaauuaccauauucagcgugggcguugcgugggcuccucucgacgaucugaaggacauggccucuaaacccaaggaaucacaugcauuuuucacacgcgaguuuacuggguuagaaccaaucgucagugaugugauuagaggaaucugcagggacuuccuggagagccagcaauga

SEQ ID NO: 54612 - RNA, 2943 nt, Artificial Sequence
  derived and/or modified sequence opt3 from COG1__Homo_sapiens__NP_061184
auggccaccgcugcaacaagccccgcccugaagagacucgaccuuagggauccugcggcucuguucgagacucacggcgccgaagagauccggggguuggaacgccaggugcgagcagagauugaacauaaaaaggaggaguuacgucaaauggucggagaaagauacagggaccugauagaggccgcugauacgaucggucagaugcggcgcugcgcaguuggccuaguggacgccguaaaagcuaccgaucaguauugugccagacucaggcaggcgggguccgcagccccacggccgccccgcgcucaacagccucagcagccaucucaagaaaaguuuuacucaauggccgcacagauuaaacugcuucuggagauccccgagaagauuuggaguagcauggaagcgucccagugcuugcacgccacacagcucuaucugcuguguugccaucuccacucuuuacugcaacuugacucgucaagcagucgauacuccccuguguugucuagauucccaauccugauaaggcaggucgcggccgcaagccauuuucgguccacuauccuacacgagucaaagaugcuccugaaaugucagggagugagugaucaagcuguugccgaagcucuuugcagcauuaugcuguuggaggaaucuucaccccgucaggcccucaccgacuuccuguuagcacgcaaggccacaauccagaaacugcucaaccagccucaccauggcgcugguauuaaggcgcaaaucuguucccuuguggagcuguuggcaaccacucuaaaacaggcccacgcucuguuuuauacacucccagaggggcugcuuccggaucccgcccugccuugcggacucuuguucagcacccuggaaacgauaacuggccagcauccagcaggcaaggggaccggagucuuacaggaggaaaugaagcuguguaguugguuuaaacaccuacccgccucuauuguggaguuccaaccuacacucagaacucuggcucacccaaucucccaggaauaccuuaaggacaccuugcagaaauggauucauaugugcaaugaggauaucaagaacgguaucacaaaucugcucauguauguaaaaagcaugaagggccuggccgggauuagggacgcaaugugggagcuucugaccaacgaaucgacgaaucacucuugggauguuuugugucggcgacuccuggagaaacccuuacuguuuugggaagacaugaugcagcaacuauuccucgaccgccugcagacucuuacaaaggagggauuugauuccauaucaaguagcuccaaggaauugcuggugucugcgcuccaggagcuggagagcucaaccaguaacuccccgagcaauaaacauauccacuucgaauacaacaugucuuuauuucuguggucagagaguccuaaugaccuucccagcgaugcugccugggucuccguggcaaacagaggccaguucgccucuucggguuugagcaugaaggcucaagccauuuccccaugcgugcagaauuucugcucagcacucgacaguaaacugaaggucaaacuagaugaccugcucgcuuaccugccuucugaugacagcucccuucccaaggauguuucaccaacucaggccaagagcucugcguuugacagguaugccgaugcugggacagugcaagaaauguugcggacccaguccguagcauguaucaaacauauaguggacugcauucgcgccgagcugcagaguaucgaggaaggaguccagggccaacaggacgcuuuaaacagcgccaagcuccacucugugcuguucauggcaagacuuugucagucccugggcgaguugugcccccaccucaaacaguguauccuggggaagucagaaaguagcgagaaaccugcgagggaauuucgugcccuacggaagcaaggaaagguuaaaacgcaggagauuaucccaacccaggcuaaguggcaggaggugaaagaaguccugcuccaacagucggugauggguuaccagguaugguccucugccguugugaagguccugauucauggcuucacacaaagccuuuugcuggaugacgcagggucaguguuagcuacugccaccaguugggaugagcucgaaauacaggaggaagcagaguccggaucuagcgucacauccaaaauccgacugccggcccagcccucaugguaugugcagagcuuucuuuucagucugugccaagagauuaauagaguuggcggucacgcucuaccuaaggugacucuccaggaaaugcugaagucuuguaugguacaggucguggcggccuacgagaaauuguccgaagagaagcagaucaaaaaggaaggggcauuuccaguuacccaaaacagggcucugcaguuacucuaugaccugcgcuaccuuaauaucgugcugacagccaaaggcgaugaggucaagagcggacggucgaaacccgacucaagaauugagaaggugaccgaucauuuggaagcccucauagacccuuucgaucuggacguauuuacuccacaccuaaacucuaaccugcacaggcuugugcagcgcacgaguguucucuucggccuggucacagggaccgagaaucaguuggcuccccgauccagcacuuuuaacucucaagaaccgcauaauauccugccuuuagcaagcucccagauucgguucggacuccugccacuuucaaugaccaguacacguaaggccaaaagcaccagaaacaucgagacuaaggcucagguggugcccccugcuaggucuacagccggugaucccacggucccaggcucccuguuucgccaguugguuucagaggaagacaauaccagugcaccuagccucuucaaacugggguggcuauccucuaugacuaaguga

SEQ ID NO: 54613 - RNA, 2214 nt, Artificial Sequence
  derived and/or modified sequence opt3 from COG2__Homo_sapiens__NP_001138508
auggaaaagagcagaaugaaccugcccaaaggcccugacacccucugcuucgauaaggacgaauuuaugaaagaggauuucgacguggaucacuuugucuccgacuguaggaagcggguucagcuugaggagcugcgcgaugacuuggaauuauacuauaaacugcuaaagacagccaugguggagcucaucaauaaggauuacgcugacuucguaaaccugucuacuaaucuuguggggauggauaaagcacugaaccaauugucagucccacucggacagcugcgagaggaagugcugagucuccguagcuccguuucugaggguauuagagccguggacgaaaggaugucgaagcaggaggauauacggaaaaagaaaaugugcgucuuacgccugauccaggugauuagaucaguagagaagaucgaaaagauucuuaauagccaaaguuccaaagagacgucugcguuggaagcuagcuccccgcugcuaaccggccagauccucgagaggauagccacagaauuuaaccagcugcaguuccaugcaguucaaucaaaggggaugccccuucuggacaaagugcggccucgcaucgccggaauuacugcuauguugcagcagagucucgagggccuguuacuggagggucuccagaccagcgacgucgauaucauucgacacugucuuagaacauaugcaaccaucgacaagacuagggaugccgaagcucugguggggcaaguguuggucaaaccauacauagacgagguuauuaucgaacaguuuguggagucucaucccaauggacuacagguaauguauaacaagcugcucgaguucgugccucaccauugccggcugcuucgugaagucacaggcggcgccauuuccucagagaaagggaauaccgugccaggauacgauuuucugguuaacagcguguggccccaaaucguccaggguuuggaagagaagcucccuagucuguucaauccaggcaacccggacgcguuucacgaaaaguauacgaucucuauggauuucgugcgcagauuagagaggcagugugggucccaggcaagcguaaaacggcugcgagcccaccccgcuuaccauucguuuaauaagaaauggaaccuaccuguuuacuuccaaauucgcuucagagaaauagccggaucucucgaggcagcucugacugacgugcuugaggaugccccagcggaaucccccuauugcuugcuggccucacacaggaccuggaguagccuccggcgcuguugguccgacgagauguuucugccucuucugguccauagauuguggaggcucacacugcagaucuuagcacguuacucuguguucgucaaugaacugagccuacggccaauuucaaacgagagucccaaggagaucaaaaagccgcucgugacuggcuccaaggaaccuagcauaacccaggguaacacagaggaucaggggucuggacccucagaaaccaaaccaguugugaguauuagccgaacgcaacugguauaugucguggcugaccuugacaaguugcaggagcagcugccugaacuccuggagaucaucaaacccaaguuagagaugauuggcuuuaaaaauuucuccucuaucucggcccuggaagauagccaguccucauuuagugcuugcguuccaucucuuagcuccaagauuauacaagacuugucagauagcuguuucggcuuucucaagucugcccuggaggugcccagacuauacaggcgcacuaacaaagaagucccuacaaccgcauccaguuauguggacagcgcccugaagccacucuuccagcugcagucugggcacaaagauaaacuuaagcaggcuaucauucaacagugguuggagggaacucuguccgaaucaacacacaaguacuaugagaccguaagugacguguuaaauagcguuaagaaaauggaggaaucgcucaagcggcugaaacaggcgagaaagacgaccccggcaaaccccgucgguccuuccggcgggaugucugaugacgauaaaaucaggcuucaacuggccuuggacguggaguaccucggagaacagauccagaagcugggccuacaggcuagcgauauuaaaucauuuagugcccuggcagagcucguggccgcugccaaggaccaagcaacagcggaacagccauga

SEQ ID NO: 54614 - RNA, 2487 nt, Artificial Sequence
  derived and/or modified sequence opt3 from COG3__Homo_sapiens__NP_113619
auggccgaggcugcacugcuccuucugcccgaagccgcggcugagagagacgccagggaaaaguuggcauuaugggaucggcgcccugacaccacagccccacugacugaucgacagacggacagcgugcuagagcucaaagcugcagccgaaaaccugccgguccccgcugagcuuccuaucgaggaucugugcuccuugaccucucaaucacucccaauugaacugacaaguguugugcccgagagcacugaagacauacugcucaagggcuucaccuccuuagggauggaggaggaacguaucgagacagcccagcaguuuuucucuugguuugcgaaacugcagacccaaauggaucaggacgaaggaacuaaguacagacagaugagggauuaucuuucggguuuccaggagcaaugugacgcaauuuugaaugauguaaacucagcccugcagcaccuagaaagccuccagaaacaguaccuguuugugaguaauaagacaggcacccuucaugaggcuugcgagcaacuguugaaggaacaguccgagcucgucgaccuggccgaaaacauccagcaaaaauuaucuuauuucaaugagcuggaaacgauuaacacuaagcucaauagcccuacccuuuccgugaacucagauggguuuaucccaaugcuggcaaaauuggacgacuguauaacauacaucaguagccaccccaauuucaaggauuauccuauuuaccuacugaaauuuaagcagugccucucuaaggcucugcaucuuaugaaaacuuauaccguuaacacacugcagaccuugacgucccagcuccugaagcgggacccaucaagcgugccgaaugccgauaacgcguucacuuuauuuuacgucaaauuccgcgccgcagcucccaaggugagaacacugaucgagcaaauugagcuaaggagugagaaaaucccugaauaccagcagcuccugaaugacauacaccaguguuaucuugaucaacgggaauugcugcucggaccaucuauugccugcaccguagcugagcugacuucccagaacaaucgcgaccauugugcccuuguucgaagcggcugcgcauuuauggugcacgucugucaggaugaacaccagcuguacaacgaguucuucacaaagcccaccucgaaauuggacgagcuccuggaaaaguuaugcgugucucuguaugauguguuuagaccucuaaucauucaugucauccaccucgagacgcuguccgaacuuugugguaucuugaagaacgagguucuggaggaccaugugcaaaauaacgccgaacagcucggggcuuucgcggcaggaguaaaacagaugcuggaggaugugcaggaaagguuagucuaccggacccacauuuauauacaaacagacaucacuggcuacaagccagcccccggcgaccuggcuuauccggauaaacuugugaugauggagcagauugcccagucauugaaggacgaacagaaaaagguuccuagugaggccagcuuuuccgaugugcaccucgaggaaggggagucuaauagccugaccaagucaggaaguacagaaucccuaaacccccguccacagacuaccaucagcccugcagaccugcaugguaugugguaccccacaguccgcagaacccucgugugccugucuaaacuuuacaggugcauagaucgggcuguauuccagggcuugucacaggaggcccugagugcauguauucagagcuuacucggggcguccgaaucuaucucgaagaauaaaacucaaaucgacggacagcuguuucuuauuaagcaccuguugauccuccgagagcagauugcuccauuccauacggaguuuacaauaaaagaaaucagccuggaucuaaagaagacccgcgacgccgcauucaaaauucugaaccccaugacuguuccuagauuuuucaggcucaauuccaacaaugcccugaucgaguuucuuuuggaaggcaccccagagauccgggaacacuaucuggauucaaagaaagacguggaucgccauuuaaagagugcuugcgagcaauucauucagcagcagacaaaacucuuugucgagcaacuggaagaguucaugaccaaggugucugcccuuaagacuauggcaagccagggugggccgaaauacacacugucccagcaacccugggcucagccugccaaggucaacgaccuagcggccacggcuuauaaaaccauaaagacuaaacucccagugacacugagaucaaugagcuuguaccugucuaauaaggauaccgaguucaucuuauuuaaacccguuaggaacaauauucaacagguguuccaaaaguuucacgcacuccugaaggaagaguucuccccugaagacauccagauuaucgccuguccaaguauggagcagcuuagccuguugcucucuguauccaaauga

SEQ ID NO: 54615 - RNA, 2307 nt, Artificial Sequence
  derived and/or modified sequence opt3 from COG4__Homo_sapiens__NP_001182068
augggcaccaagauggccgaccuggauucacccccuaaacucuccggggugcagcaaccaucugagggagucgguggcgggagaugcucagaaaucagugcugagcuuauuaggagccugacagaauugcaggaguuagaagcaguuuacgagcggcuguguggagaggaaaaggugguagagcgcgaacuagacgcccuccuggagcagcagaacacuauagaguccaaaauggugacgcuucaccgaaugggcccgaaucugcaauugaucgaaggugaugcgaagcagcucgcugggaugauuaccuucacaugcaaccuggccgagaaugucucuucgaaagugcgucagcuggaccucgcaaagaacagauuauaucaggccauccaaagggcugaugacauucuggaucuuaaguuuuguauggacggaguucagacugcauugcggucagaagauuacgagcaggccgcugcccauacccaccgcuaucugugccuagacaaaagcgugaucgaacucaguagacagggcaaggagggcuccaugauagaugcgaaucugaaacuucugcaagaggcagaacagagguugaaggccaucgucgcugagaaauucgccauugcaacaaaggaaggggaccucccccagguggagcgguuuuucaagaucuuuccucuguuaggacugcaugaagagggucuccgcaaauucucugaguaccuuuguaagcaaguagcuagcaaagccgaagagaaccuguugaugguucuaggcaccgauauguccgacaggagagcggccgugauuuuugcagacacucugacacuccuguucgaagggaucgcuaggauagucgagacccaccagccaauuguggaaacguauuacggacccggccggcuuuauacucugaucaaguaccuccagguggagugcgaucgucaggucgagaaaguuguggacaaguuuauuaaacaacgcgauuaccaucagcaguucagacacguacagaauaacuugaugaggaauagcaccacagaaaagaucgagccucgggaacuggacccaaucuuaacugaggugacccugaugaacgcccgaagugagcuauaucuccgcuuucugaagaaaagaauuagcucugauuucgaagucggugacuccauggcuucagaggaagugaagcaagagcaccagaaaugucuugauaaguugcugaauaacugccuccugagcuguacaaugcaggaacuuauagggcuguacguuaccauggaggaguauuuuaugagggaaacggugaauaaagccgucgcauuggacacuuacgagaagggacagcucacaaguucuaugguggaugacguauucuauaucguuaagaaaugcauuggccgggcccuguccagcucgucuaucgauuguuuaugcgcuaugauaaaccuggcgaccacugaacuagaguccgacuuccgcgacgugcucugcaauaagcugagaaugggcuuucccgcaacaaccuuccaagauauucagcgaggggucacgucagccgugaacaucaugcauaguagccuucagcagggaaaauuugacaccaaggguaucgaauccacagaugaggcuaaaaugucuuucuugagcgacuguacuaagcuguuuucacaaggcauugggggagagcaggcccaggcaaaguucgauaguugccucuccgaccuggccgcugucagcaacaaauuucgugauuuacugcaagaaggccuuaccgagcucaauucuacagccaucaagccucaggugcagccauggauuaacucauucuuuaguguuagccacaauauagaagaggaagaguucaacgacuacgaggcaaaugauccgugggugcagcaauuuaucuugaaccuggaacagcagauggcggaguucaaggcuucccuaucucccguaauuuaugacucgcugacuggucucaugaccagccuggucgccguggaacuugagaaaguuguguugaaauccacauuuaaucggcugggcggguuacaguucgauaaggagcuccgaucacugaucgcauaccuuaccacugucacgacauggaccaucagagacaaguucgccaggcugagucaaauggcuacuauuuugaaccucgaacgcgugaccgagauacuggauuacuggggaccuaauucuggcccacuaacauggcggcugacccccgccgaaguaagacaggugcucgcacugaggaucgacuuucgcagcgaggacauuaaacgacuucgguuguga

SEQ ID NO: 54616 - RNA, 2583 nt, Artificial Sequence
  derived and/or modified sequence opt3 from COG5__Homo_sapiens__NP_006339
augggcugggucgggggaagaaggcgggacagcgccucucccccuggucgcucccgaucagcugcagaugacaucaacccagccccggcgaauauggaaggcgggggaggcaguguggcuguugccggucugggggcacguggaagcggcgccgcugcagccaccgugagagaacuccuucaggauggcugcuacuccgacuuccugaacgaggauuuugacguaaagacauauacuucucaaucgauucaccaggcugugauagccgaacaguuggcgaaauuagcacaggggaucucacaacuggauagggagcuacaucuccaggucguggcccggcacgaagaccugcuugcucaggccacgggaauugagagccuggaggguguuuugcagaugaugcaaacccgcaucggcgcacuccagggggcuguggauagaauuaaggccaaaaucgucgaacccuacaauaagauaguggcgaggacagcccagcuggcacggcugcagguagcuugugaccucuuacgccgaaucauuagaauccugaaccuuaguaaaagguugcaaggacagcugcagggcgguucccgggagauuacuaaggccgcucaaucucuaaaugaacucgauuaucugagccaggggaucgaccuuuccggaauagagguuauugagaacgaucuguuguucaucgcccgugcacgccucgaaguggagaaucaggccaagagacuguuagaacagggccuggagacccaaaacccuacacaggucggcaccgcucuccagguguuuuacaaucuugggacucugaaagacacaauuaccucaguggucgacggauauugcgcgacguuggaagagaacaucaauagugcacuagauaucaagguucugacucagccaagccaaucugccgugagggguggccccgggcgguccaccaugccuacaccaggaaacacugcugcccuccgagcaucauucuggaccaauauggagaaacugauggaccauauuuacgccguauguggccaggugcagcaccuucagaagguccuggcuaaaaagcgcgaucccgugagccauauaugcuuuaucgaagagauuguuaaggacggucaaccugaaaucuucuauacauuuuggaacagugugacccaggccuugucuucccaguuccacauggcaacgaauagcucgauguuucucaaacaggcguucgagggggaauacccaaagcuguuaagacuguacaacgaucuauggaaaaggcuccaacaguauucucagcacauacaaggcaacuuuaaugcuuccggaacuacagaccuguacgucgaucuucagcauauggaggacgaugcccaggacauuuucaucccgaagaaacccgauuaugacccugagaaggcauugaaagacucacugcagccauacgaagccgcuuaucucaguaagagccugucccggcuuuuugaucccaucaaccugguguucccuccaggcgggcgcaaucccccgucuagcgacgaguuggauggaauuaucaagaccauugccucagaacucaacguagcagcuguugacacuaaucugacauuagccgugaguaaaaacgucgcgaagaccauacaacuguacuccgugaaaagcgagcagcuacucucuacgcagggugaugccucacaggucaucggcccucugaccgaagggcaaagaaggaauguggcuguugugaacagucuuuauaaguugcaccagagcguaacaaaagucguguccucucagucgagcuucccccuggcagccgagcagacuauuaucuccgcucucaaggccauccaugcacugauggagaaugcgguucaaccauuacugaccucagugggagacgccauugaagcuauaaucauuacaaugcaccaggaggauuuuaguggcucucuuagcuccucagguaagccugacguccccuguagcuuguacaugaaagaacuccagggguucaucgcccgugugaugucugauuacuuuaagcacuucgagugccuggacuuuguauucgauaacacugaggcaauugcucaacgggccguggaacuauuuauccgacaugcaucccugauaagaccacucggcgagggaggcaaaaugaggcuggccgcugacuucgcgcagauggaacuugccguugggcccuuuugucgccgggucagugauuugggaaagagcuauagaaugcugaggucuuuccgcccuuuacucuuucaggcauccgagcacguggcuucaaguccagcccugggugacgugaucccguucagcauuaucauucaguuucuuuucacccgagcccccgcugaacugaaaucgccuuuccaacgggcagaguggucccauacacguuuuucucagugguuggacgaucacccaagcgagaaggacagacuccugcuaaucaggggcgcccuggaagcguacguccagucaguucgcagucgggaggggaaggaguucgcucccguguauccuauaauggugcagcuccugcaaaaagccauguccgcacuucaguga

SEQ ID NO: 54617 - RNA, 1848 nt, Artificial Sequence
  derived and/or modified sequence opt3 from COG6__Homo_sapiens__NP_001138551
auggccgagggcagcggggaaguggucgcuguuuccgcaaccggagccgcgaacggucugaauaacggcgcugggggaacaucugccacuacgugcaauccccucucaagaaaacuucacaagauccuggagaccagguuggacaacgauaaggaaauguuagaggcacugaaagcccuaaguacauucuuuguggaaaauagccuccggacucgccgaaaccugcguggcgacauugagagaaagucccuugcuauaaaugaggaauuuguaucuaucuuuaaagaggugaaggaagaacuggagucgauuucagaagauguccaggcaaugagcaacuguugccaagacaugaccaguagguugcaggccgcuaaggagcagacacaggaucucaucgugaaaaccacuaagcugcaauccgaaucucagaaacuggagauucgggcccagguugcggacgcauuccucagcaaguuucaguuaacauccgaugaaaugucacugcuucgcgguaccagagaggggccuaucacggaggacuucuuuaaagccuugggaagggugaagcaaauacauaaugaugucaaggugcugcuacggacuaaccagcagaccgcuggccucgaaaucauggagcagauggcccugcuucaagaaacagcauacgagcgccuguaucgaugggcucagagugaauguagaacuuugacccaggagagcugcgacguaucuccaguucucacacaagccauggaggcgcugcaggauaggccgguguuauacaaauauacccuggacgaguucggcacggcccggcguuccacugucgugcgcggguuuauugaugcacucacaagaggaggucccggcgggaccccuaggccaaucgagaugcacucacaugacccccuucgguacgugggagacaugcuggcuugguugcaccaggccacugcuagcgaaaaggagcaucuagaagcccugcucaaacacgucacaacccagggcguugaggagaauauucaagaagugguaggucacaucacggagggggugugucgaccucugaagguccgcauagaacaggugauuguugcagagccaggagccgugcuucuguauaaaaucaguaacuugcucaaguucuaccaucacaccauuucuggcaucgucggcaauuccgcuacagcgcuguuaacuaccaucgaggaaaugcaucugcuaagcaaaaagauuuucuucaacucgcucucucugcacgcauccaaacuuauggauaagguggaguugcccccuccagaccuggggccgucaagugcccucaaucagacacugaugcuucugagagaaguauuggcuagccacgauuccucuguugugccccucgacgccaggcaggcagauuuuguccaagugcugagcugcgucuuagacccucugcuacagauguguacugugucagccaguaaccucggaaccgcugauauggccacauucaugguuaacucccuguauaugaugaagaccacucuugcauuguucgaguuuacggaccggcgccuggaaaugcuccaguuccagauagaggcgcaucuggauacauuaaucaaugagcaagcuagcuacgugcugaccagaguaggucuuucuuacauuuauaacacuguccagcagcacaaaccagaacagggcucauuggccaauaugcccaaccucgacagugugacccugaaggcagccaugguucaauuugauagguaccuaagcgcuccugacaaucugcucaucccacagcugaacuuccuuuuguccgccacagugaaacgucccccgaaugggccuuga

SEQ ID NO: 54618 - RNA, 2313 nt, Artificial Sequence
  derived and/or modified sequence opt3 from COG7__Homo_sapiens__NP_705831
auggacuucagcaaguuucuggccgaugacuucgaugugaaagaguggaucaacgcugcauuuagagccggcuccaaggaagcggcuucugggaaagccgacggacacgcagccacccucgucaugaaacuucagcuguucauucaagagguuaaucaugcuguggaagagacaucacaccaggcauugcagaacaugcccaaaguauuaagggauguggaagcccugaagcaggaggcuaguuuucuaaaggagcaaaugauacucgucaaagaagacaucaagaaauucgagcaggauacuagccaguccaugcaagugcugguugaaauugaccaggugaagucucggaugcagcuugccgcggagucgcugcaggaggcagauaaauggucaacguugagcgccgacaucgaagagaccuuuaagacacaggauauugcugucaucagugccaagcucacugguaugcaaaauucccugaugaugcugguggacaccccugauuacucugaaaaaugcguacaucucgaggcauuaaagaaccgccuggaagcucuugccagcccacagauaguugcggccuucacaucccaggcaguggaccaaucaaaagucuuugugaagguguucaccgagaucgaccgaaugccgcaguugcuggcuuauuacuauaaaugucacaagguccagcuacucgccgcuuggcaggagcugugccaaagugaucuuagccuggaccgucaguugacuggccucuacgaugcccuguuaggggcauggcauacacagauucagugggccacccaaguuuuucagaaaccccacgaagugguaauggugcugcucauccagacgcuuggagcucugaugccuucuuugccauccugucuaucaaauggcgucgagagagcgggucccgaacaggagcugacuaggcuccuggaguucuaugacgcaaccgcccacuuugcuaaggggcuugaaauggcccuguugccucaucuccacgagcauaaccuggugaagguuacagaauuaguggaugcagucuacgacccauauaaacccuaccaacugaaguacggagauauggaggaaagcaaucuacucauucagaugagugccgugccucuggagcacggcgaaguaaucgacugcguucaggagcuuucucacuccgugaacaaauuguucggccuggcuagcgccgcagucgaucggugugugcgcuucacuaaugggcucggaaccugcggucugcuuucggcgcugaagucuuuguuugcuaaauaugucuccgacuucacaucaacccuccagaguauaagaaagaaguguaaacuggaucauauuccaccgaacagcuuauuucaagaggacuggacggccuuccaaaauuccaucaggauuaucgcaacuugcggcgaacugcuacggcacuguggggacuuugagcagcagcucgccaaccgcauccugucuacagcuggaaaguaccuuagcgauucaugcaguccccgauccuuggccggcuuccaggaaagcauucugaccgacaaaaagaacucugcaaagaauccuuggcaggaguauaauuaccuccagaaggauaacccagcugaguaugccucacugauggaaauauuauacacucugaaggagaaagguaguagcaaccauaaucuuuuggcggcccccagagcugcacucacaaggcugaaccaacaggcccaccagcuagcuuuugacuccguguuccugcggaucaagcagcaacuccugcuuauuucuaaaauggauucguggaauaccgccgggaucggagaaacguugaccgacgagcugccugcauuuagcuuaacaccacucgaauauauauccaacauuggccaguacaucaugucacugccccuuaaucuggagccguucguuacucaggaggauagugcguuggaacucgcccugcaugcuggcaagcuaccuuuucccccagagcagggggacgaacugccugagcucgauaacauggccgacaauuggcugggaucuaucgcacgugcuaccaugcaaacauacugugaugccauucuucagauccccgaauugagcccacacuccgcaaaacagcuggccacugacauugauuauuuaauaaacgugauggacgcucucggucugcaacccucacgcacccuucagcacaucguaacacugcuaaagaccagaccugaggacuacaggcaggucagcaagggccucccacggcgacuggcgacuacgguggccacaaugcgcucuguuaauuauuga

SEQ ID NO: 54619 - RNA, 1839 nt, Artificial Sequence
  derived and/or modified sequence opt3 from COG8__Homo_sapiens__NP_115758
auggccaccgcugcaacaauccccagcguggccacugcgacggcugccgcacugggcgaggucgaagacgaggggcuccuugccucccuguucagagauagguuuccugaagcucaguggcgggagcgcccagacguuggacgauacuugcgugaauuaucugguucaggccuggagagacuaaggcgggagccggaacgccucgcagaggaaagagcccaacugcuucagcagaccagggaucuggcuuucgccaacuauaagacauuuauucgcggggcggagugcacugagcggauacaccgauuguucggagacguggaagcaagucucggcagacugcuggauaggcuccccagcuuucagcaauccugucggaauuucguaaaagaggccgaagagaucucuucgaaccgucgcaugaacucauuaacccugaauagacauacagaaauucuugagaucuuggagauuccucagcugauggauaccugcgugaggaauagcuacuaugaagaggcucuagaacucgccgcauacguccggcgacuggagcgcaaguauaguuccaucccagugauacaggguaucguuaacgaagugagacagucuaugcaacuuaugcugagccaguugauucagcagcucaggacuaauauccaacugcccgcuuguuuacgggucauuggguaccugcgcagaauggacguguuuacagaggccgagcucaggguaaaauuccuucaggcgcgugacgccuggcugcgguccaucuugaccgcaauaccuaacgaugacccauauuuucacauuacgaagacuaucgaggcuucacgaguucaucuauucgauauuaucacccaguacagagccaucuuuagugacgaggauccccugcucccuccagcuaugggagaacacacagugaaugagagcgccauuuuccauggcuggguccugcaaaaagugucucaguuucuucaggugcuggaaacugacuuguacaggggcauagggggacaccucgacucccuguuaggucagugcauguauuucggccugucauucagccgcgucggggcagauuuucggggacaacuagccccgguuuuccagagaguggcuaucaguaccuuucagaaggcgauucaggagacaguagagaaguuccaagaagagaugaacucuuacaugcucaucuccgcacccgccauacugggcaccagcaauaugccugcugccgugccagcaacgcagcccgguacucuucagccuccaauggucuugcuggacuuucccccgcucgccuguuuccugaacaauauucuuguggcuuuuaacgaucugagguugugcuguccuguugcccucgcacaggacgugacaggggcgcuggaagaugcuuuagccaaagucaccaagaucauccuggcauuccaccgcgccgaggaggcugccuuuucgucuggagaacaagagcuauucgugcaguuuugcacuguauuccucgaagaccugguucccuaucuuaaucgauguuugcaagugcuguuucccccugcacagauugcucagacacucggcaucccaccaacccagcuguccaaauacggcaacuuagggcaugucaacauuggagccauacaggagccccuggcguucauccuuccuaagcgggaaacguuguucacccucgaugaccaagcccuggguccagagcuaacagcuccggcacccgagccuccagccgaagaaccccgucuggaaccugcuggcccagccugccccgagggagggagagcagaaacucaggcggagccgccuucagugggcccauga

SEQ ID NO: 54620 - RNA, 1731 nt, Artificial Sequence
  derived and/or modified sequence opt3 from COIL__Homo_sapiens__NP_004636
auggccgcuagcgagaccgugagacugaggcuccaguucgacuaucccccuccagcaacaccgcacugcacugccuuuuggcuucuggucgauuugaaccggugucgcguugugacggacuuaaucucccugauucgacaacguuucggcuuuucuucaggggcguuccuaggacucuaccuggaagguggccuucugcccccugcugagagugccagauugguaagggauaaugacugccuccgggugaagcuggaggaacgcggggucgcagaaaacagcgugguuauauccaauggagauaucaaccugucucucagaaaagccaagaaaagggcuuuucaguuagaggagggcgaagagaccgaaccagacuguaaguacucgaaaaagcauuggaagucacgggagaauaacaauaacaaugagaaagugcuggaucuugaacccaaggcagucacagaccagacugugagcaaaaagaacaaacgcaagaauaaggcuaccugcgguacaguaggggaugacaacgaggaagccaaacgaaagaguccuaaaaagaaagagaagugugaauauaaaaagaaggccaaaaauccaaagucccccaaaguucaggcggugaaggauugggcaaaccaaagaugcucuagcccuaaaggauccgccaggaauaguuuggucaaggcuaagcggaaaggcagugugagcguguguucuaaggaguccccaucaagcaguucugaguccgaaagcugcgacgagucgauuucugauggcccguccaaagucacccuggaagcccguaacucaagugagaagcuacccacugaacucagcaaagaggagccuuccacaaagaacaccacggcagacaagcuggcuaucaaacuuggguucucucugacuccaagcaagggaaaaaccucagguacaacuucauccagcucugacucaagugccgaaagcgaugaccaguguuugauguccucuucgacccccgagugcgcggccggcuuucucaagacaguugggcuguucgcaggacgcggcagaccugguccaggguuaagcucccagaccgcuggagccgcuggcuggaggcggucaggcaguaaugggggaggucaggcccccggcgcaucuccgagcgugucccugccugccucacucgggcgaggauggggccgcgaagagaaccuuuuuagcuggaaaggugcuaaggggagaggcaugaggggacggggccgcgggagaggacaccccguaucuuguguggucaauagguccacggauaaccaacgucagcagcagcugaaugacgugguuaagaacaguagcacuauuauccaaaauccaguggaaacaccuaaaaaggauuacucuuugcuaccccugcucgcggcagccccacaggucggugagaaaauagcuuucaagcugcuugagcugaccuccucauauagucccgacgugagcgauuacaaagaaggccggaucuugucgcauaacccugagacucagcaaguagacauugaaauccucuccucucugccagccuuacgagagccggggaaguuugaucugguuuaucacaaugagaacggagcagaaguggucgaguacgccgugacacaggaaagcaaaauuaccgucuucuggaaggagcuaaucgaccccagacucauaauugaaucaccuaguaauacguccucuaccgagccagcuuga

SEQ ID NO: 54621 - RNA, 2043 nt, Artificial Sequence
  derived and/or modified sequence opt3 from COL10A1__Homo_sapiens__XP_011533735
augcugccccagaucccuuuccuccuucuggugagcuugaacuuaguccacggcguguuuuacgccgagagauaucaaaugccaaccgggauuaagggaccgcugcccaauacaaaaacucaguucuuuauaccuuacacgaucaaguccaaagguauugcugugaggggcgaacaggggaccccaggacccccuggcccagcagguccccgggggcauccuggaccaucuggcccgcccggcaagccuggguauggaucaccaggucuacagggcgagcccgggcucccuggaccacccggcccgagugccguagguaaaccuggggugcccggacugccaggcaagccuggcgaacgcgggcccuacggaccaaagggugacgucggccccgcggggcuuccuggaccacgaggcccgcccgguccuccagggauccccggcccugcuggaauuagcgugccaggcaaacccgggcaacagggaccgacaggugccccuggcccacguggguuccccggagagaagggcgcaccugguguucccgggaugaacggccagaaaggagaaaugggcuauggggccccaggaagaccuggugagaggggccugcccgggccacagggaccgacuggcccuuccggucccccaggggugggcaagcggggagagaauggcguccccgggcaaccuggaaucaaaggcgaucgcgguuuuccaggggaaaugggacccauaggcccuccggguccacaggggcccccuggcgagagaggaccagaaggcaucgggaagcccggagcugcaggcgccccuggucagccggggauucccggaaccaagggcuugccaggugcuccuggcaucgccgggcccccaggaccucccggcuucgggaaaccaggacucccgggccugaagggugagagggggccugcgggacugcccggcgguccaggcgcaaaaggggagcagggacccgccggccucccugggaagccaggauuaacaggucccccuggcaacauggggccgcaaggaccaaaaggcauucccggcucucacgggcugccuggacccaagggugaaaccggcccagcugggccugccggauaccccggcgcaaaaggugagcgggggucgccaggaucagacggcaagccuggcuauccggggaagcccggacuugaugguccaaaaggcaauccuggguugcccggaccaaagggcgacccugguguugggggacccccgggccugccaggcccuguagggcccgcuggagccaaagguaugccaggccauaacggggaagcgggaccccgcggcgccccugguaucccggggacucgaggacccauaggcccaccuggcauucccggguuuccuggaagcaagggugauccaggcagucccgggccuccaggacccgcaggcaucgcuacaaaaggucuaaaugggccgaccggaccuccagggcccccuggcccaagaggccacuccggagagcccggucucccgggcccucccgggccaccuggacccccaggccaggccguuaugcccgaagguuucauuaaggcugggcagaggccuucucugagcggcacgccacuuguguccgccaaccaaggagucacuggcaugccggugucagcauuuaccgugauccugaguaaggccuaccccgcuaucgggacaccuauuccauucgacaaaauauuguacaaucggcagcagcauuaugauccccguacuggaaucuuuaccugccagauuccugguaucuacuauuucagcuaccacguccacguuaagggcacacauguguggguagggcucuauaaaaacggaaccccagugauguacacguaugacgaguacacuaagggcuaccuggaucaagcgucugguuccgcaauaauugacuuaacagagaaugaucaggucuggcugcagcuccccaacgccgaaucaaaugggcuuuauagcagugaguacgugcacucuuccuuuagcggcuuccugguugcuccuauguga

SEQ ID NO: 54622 - RNA, 4395 nt, Artificial Sequence
  derived and/or modified sequence opt3 from COL11A1__Homo_sapiens__XP_011539021
auggagcccuggagcuccagauggaagaccaaaagguggcugugggacuucacagugacuacgcucgcccuuaccuuucuguuccaggcucgggaaguccgcggcgcagccccuguugauguguugaaggcguuagacuuucacaacucuccagaggggaucucaaaaacaacuggauucugcaccaaucgaaagaacaguaaagguagcgauacagcuuaccguguauccaagcaagcccagcugucugcaccgaccaagcagcuauuucccggcgggacuuucccugaagacuuuucgauucucuucacagugaaaccaaagaaaggaauacagucauuucugcuuagcaucuauaaugagcauggcauucaacagaucggugucgaaguggggagaagucccguuuuccuguuugaggaucacaccggaaagccugccccagaggacuaccccuuguucaggacggugaacauugcugauggcaaauggcaucgggucgcaaucuccguggaaaagaagacuguaaccaugauaguugacuguaaaaagaaaacaacuaagccucucgaucgcucugagagagccaucguggacaccaauggcauuacagucuuugggaccaggauccuggaugaagagguguucgagggagacauucagcaguuccugaucacgggugauccaaaagcugccuaugacuacugcgaacacuauagcccggacugugauuccucagcgcccaaggcagcccaagcucaggagccucagauagacgaauacgccccagaggauauuaucgaauaugacuacgaguacggcgaggcagaauauaaagaggcugaaagugugacugaggggcccacagucaccgaagagacuauugcccagacagaggcgaacaucguugaugacuuucaagaauacaauuauggaaccauggagagcuaccagacggaagccccucggcaugugucuggcaccaacgagccaaaucccguagaagagaucuucacagaggaauaucucacuggugaggauuacgacucccagcgcaagaacucagaagauaccuuauaugagaauaaggagauugacgggcgagauagcgaccugcuuguggacggagauuugggcgaauacgacuuuuacgaguauaaagaauacgaggauaagccgacaaguccucccaacgaagaguucggcccaggggucccugcagagacugacauaaccgaaacaucuaucaauggacacggugcuuauggcgagaaagggcaaaagggagaacccgccgugguugagccaggcaugcugguggaaggucccccugggccagcuggcccggccggaauuauggggcccccugggcuacagggaccaaccggucccccuggcgauccaggggacagaggacccccgggcaggccuggucucccaggggcagauggccugcccggaccucccggcacuaugcuuaugcugccauuucgguacgggggagacgguuccaaaggcccuacgaucagcgcccaggaggcucaggcgcaagcaauauugcagcaggcccguauugcucuccgcgggcccccaggaccgaugggccugacagguagaccugggcccgucggcggaccaggcucgucuggggccaagggagaguccggcgaucccgguccucaggggccaaggggagugcaagggcccccugguccgaccggcaagccagggaaacggggacgacccggcgcagacgggggacgcggcaugccuggugaaccaggggccaagggagauagaggcuucgacgguuuacccggccugccuggggauaaaggacacaggggcgagcgggggccgcagggacccccaggcccucccggugacgacgggaugcgcggagaagauggcgagaucgguccaagaggccucccuggggaagcuggacccaggggccuucuggggccacguggaacuccgggcgccccuggucagcccgggauggcaggaguagacggcccacccggcccuaaggggaacaugggaccacagggugagcccggcccuccggggcaacagggaaauccaggcccccaggguuugccugggccccagggaccaaucggcccucccggcgagaaagggccacaaggaaagccuggucuagcgggccugccgggggcugauggacccccaggccauccugguaaggaagggcagucaggagagaaaggcgcccucgggcccccaggcccucagggacccauugguuauccgggcccacggggcguuaagggagcagacggcgugcgaggucugaaagggaguaagggagaaaaaggcgaggauggcuuuccuggguucaagggagacaugggucuuaagggcgauagaggggaggucggacaaaucggccccaggggugaagacgggccagagggacccaaaggccgcgccggcccuaccggggauccgggacccagcggucaggcuggcgaaaaggggaaacugggagugccaggcuugccugguuaccccgggcggcagggcccuaagggauccacaggcuuuccaggguuccccggagccaacggugagaaaggcgcaagaggggucgcuggaaagccuggcccaaggggucagcgcgggcccaccggcccgcgaggaucucggggcgcccgugggccuacuggaaaaccaggucccaagggcacaagcgggggagacggcccuccaggucccccgggggaaagaggcccucaaggaccccagggcccagugggguuuccuggacccaagggcccacccgguccuccagggaaagauggacucccgggccaccccggucagaggggcgagacgggguuccagggaaagaccggcccuccagggcccggaggcguuguggguccucaagggccaacuggagagacaggccccauuggugaacgcggccauccugggccgccaggacccccuggcgagcaggggcugcccggagcggccggcaaagaaggugcuaagggggacccaggaccucagggcauaucaggcaaagaugggcccgcaggauuacgggguuuuccaggcgagagagggcugccgggagcccagggcgcuccuggucuaaagggcggagaaggcccccaaggcccacccgggccuguaggaaguccaggugagaggggcuccgccgggaccgcaggacccaucggccucccuggucgaccggggccacagggacccccuggcccagcgggcgagaagggggcccccggagaaaaagguccucagggccccgcugggcgcgacggaguccaaggcccagugggucugccggggccugccggacccgcaggcagcccaggcgaggacggggauaagggagaaauuggugagccuggccagaaagggucuaagggagacaaaggcgaaaacggucccccagggccucccggacuucagggcccgguuggcgcuccagggaucgccggaggugauggcgagccugggccccggggacagcaaggcauguucggucagaagggggacgagggagcaagaggcuucccagggcccccuggcccgaucggauugcagggucugccagggcccccuggcgaaaagggagagaauggcgaugugggucccauggggccaccuggacccccaggcccuaggggcccgcaggggcccaacggagccgacgguccacaaggcccucccgggucagucggaagugugggcgguguaggggaaaaaggcgagccaggagaggcuggcaauccugggcccccgggagaagcgggugugggcgggccaaagggagagcguggcgaaaaaggugaggccggcccucccggggcagcuggaccacccggcgccaaggggccucccggagaugacggcccaaaagguaacccugggccgguuggauuucccggcgauccagguccucccggcgaaccagggccugccggacaggacggcgucgggggagauaagggcgaggacggugaccccgggcagccgggaccuccaggccccagcggugaggcuggcccuccagggcccccuggaaagcgcggcccacccggggcagccggagcggaaggccggcagggugagaaaggggcuaagggagaagccggcgcagagggcccgccugggaaaacaggacccguggguccacaaggccccgccgggaagccuggaccagaaggccucagagguauucccgggccugugggagagcagggccugccaggcgcugcagggcaggauggaccgcccgguccuaugaaacuuccagucacuaccuauugcauaguuuccacgggcgagaucaagcugcccaggcacucuccuuucccacacuugcucaauaccacauga

SEQ ID NO: 54623 - RNA, 873 nt, Artificial Sequence
  derived and/or modified sequence opt3 from COL11A2__Homo_sapiens__NP_001157243
auggagagaugcuccaggugucaccggcugcuccuucuguugcccuuagugcugggccuauccgccgcuccugggugggcaggagccccaccggucgacguucuccgcgcgcugcgauuccccucucuuccugauggugugcguagagcuaagggcaucugcccagccgacguagcauacaggguggcccggcccgcucagcugucagcaccuacccgccaauuguuuccagggggauuccccaaagauuuuagucuccugacagucgugagaacuaggccuggccugcaggccccacucuuaacgcuguauagcgcucaggguguucggcagcuuggguuggaacugggacgcccggugcgauuccuauacgaggaccaaaccggcagaccccagccuccaucccagcccgucuuuaggggccucucucuggccgaugggaaguggcaucggguggcgguagcaguuaaaggacagucggugacacuuauugucgacuguaagaaacgugugacucgcccucugccaagaucagccaggcccguguuggauacccacggugucauaaucuucggcgcucggauucucgacgaagagguuuuugaaggggaugugcaagagcuggccaucguaccgggagugcaggcagcuuaugagagcugcgaacagaaggaguuagaaugugagggcggucagcgagagcgcccucaaaaccagcagccccauagagcccaaaggaguccacagcagcagccuucccggcugcaccgcccccaaaaucaggaaccacagucucaggucagagagcucggggaacccccuagcgcggcccauccaagggagggacgucacccgggcauuagcccucccuga

SEQ ID NO: 54624 - RNA, 9192 nt, Artificial Sequence
  derived and/or modified sequence opt3 from COL12A1__Homo_sapiens__NP_004361
augagaagcaggcugcccccugcccucgcugcacuuggcgccgcgcuguuguuauccucuaucgaggcugaaguggacccaccgucagaucugaacuucaagauuauagacgagaauaccguccacaugaguugggccaaacccguugauccuaucgugggguaccggauuacaguagacccaacuacggauggacccaccaaggaauuuacacuaagcgcauccacuaccgagacacuccugucugaacuugugccugagaccgaguaugucgugacuaucacaucguacgacgaaguugaggaaucagugccagucauuggucagcugaccauccaaacgggcagcaguacuaaacccguggagaagaaaccugggaagaccgagauacagaagugcuccguaucugccuggacagauuugguuuuccucguggacggaagcugguccgucggccgcaacaauuuuaaauauauccuggauuucauugcugcacuggugucagccuuugacaucggugaagagaagacucgagugggggucguucaguacaguagcgauacccguacagaauucaaccucaaucaguauuaccaaagagacgaguuacuggcugccauuaaaaagaucccauauaaaggaggcaacaccaugacgggcgaugcgauagacuaccuugugaagaauacuuuuacagaaucugcaggggccaggguaggauucccgaagguggcuauuaucauuaccgacgguaaaucccaggaugaggucgagauccccgcccgggaauugcgcaacgugggcguugagguguuuucacuggggaucaaggcagcugacgccaaagaacuaaagcagauugcgagcacuccuagucucaaucaugucuucaacguggccaauuuugaugcaauaguagacauccagaacgagauuaucucucaaguuuguuccggaguggaugaacagcugggcgagcuugucagcggugaggaaguggucgagccacccucgaaucugauagcuauggaagugucuuccaaauacguuaaguugaacuggaauccuucaccaagucccgugacaggguauaaaguaauucucaccccgaugacggccggaagcagacagcacgcucuguccgucggcccucagaccacaacuuuaucugugagggaccugagcgccgauaccgaguaccaaaucucaguuagugcaaugaagggcaugacauccagcgaacccaucucuauuauggagaagacucagccaaugaaagugcaggucgagugcucacgggggguggacaucaaggccgauauuguauuccucguggacggaaguuauagcauagguaucgcuaacuuuguuaaaguccgcgcguuccuugaagugcuggugaaguccuucgagauuucuccuaaccgaguccaaaucucguugguucaguacagcagagauccccauaccgaauuuacacuaaaaaaguucaccaagguggaggacaucauugaggcaauaaauacuuuuccauauaggggcggguccacgaacacaggaaaagccaugaccuacgugcgggaaaagaucuucguacccucaaaaggcagucguucuaaugucccuaaggugaugauucugaucacugacgguaaaagcuccgaugcuuuucgcgacccagccauuaagcucagaaacucagauguugagaucuucgcagugggggucaaggacgccgugaggagcgaacuggaggcuauagccucuccgcccgcagaaacccacguuuuuacaguggaggauuucgacgcguuucagcggaucuccuucgagcuuacccagaguauuugucugcgaaucgaacaagaguuggcugccauuaaaaagaaagcauauguaccuccaaaggaucucagcuuuucugaagucacuuccuacggcuucaaaacaaauuggucacccgccggagagaacguguuuaguuaccauaucacguauaaggaagcugccggcgacgaugaggugaccgucguugagccugcaagcucgacuuccgugguacugucuagcuuaaagccagaaacacuguaccuagugaaugucaccgcugaguaugaagacggguucucaauaccccucgccggagaggaaacaacugaggaggugaaaggugcgccgcgcaaccugaagguuaccgaugaaacgaccgacaguuucaaaauuacauggacucaggccccuggcagagugcuuagguaccggaucauuuaucgcccagucgcugggggagaguccagagaagugaccacacccccuaaucagaggcgucggacuuuggagaaccugauccccgauaccaaguacgagguuucugugauaccagaauauuuuagcggcccugguacgccccucacagggaaugcagccaccgaggaaguccgaggcaacccaagagaccugaggguauccgacccgacuacaucaaccaugaaacuuagcuggaguggagcuccuggcaaggugaaacaguaccugguuacuuacacccccguggccgggggagagacacaagaagucacggugcgcggugauaccacuaauacaguauugcagggccucaaggaggggacccaguaugcacugucugugacagcguuauacgccuccggagcuggcgacgcccuguucggugaggggacuacccuagaagagcggggcagcccacaggaucucgucacgaaggacaucacagauaccucgauuggagcauauuggacuucagcucccggcaugguuagaggguacagggugucuuggaaaagucuguaugacgauguggacaccggagaaaagaaccuuccugaggaugccauccacacaaugauugaaaauuugcaaccagagacuaaauaccgcaucuccgucuuugcaaccuauagcucuggcgagggugaaccccugacaggggacgccacgaccgagcucagccaggauuccaagacucugaaaguggacgaagagacagaaaacaccaugcgaguuacuuggaagccugcuccgggaaagguagugaacuaccgggucguguaccguccacacggcagagguaaacagaugguugcgaaggugcccccuacagucaccucaacgguguuaaaaaggcugcagccacaaacuaccuaugauauaacaguacuucccauuuacaagaugggcgaggggaaauugcgccagggaaguggcaccacugccagccgguucaagucuccuagaaaucucaagacauccgacccgaccaugucaaguuuuagggucacaugggagcccgcaccaggggaagugaaaggauauaagguuacuuuccauccuaccggcgacgaucgacgccugggugagcuaguggucgggcccuacgacaacacggugguucuggaagagcuccgggcuggaacaaccuauaaagugaaugucuuuggcauguucgaugguggcgagagcuccccacugguggggcaggaaaugacuacccuuucugacacaacuguaaugccuaucuugucgagcggaauggagugccugaccagagccgaagccgauaucguguuacucguugacggcucaugguccauugggagggcuaacuuucguacgguccgcaguuucaucucucggauuguggagguguuugauauaggacccaagagaguccaaaucgcacuggcccaguacagcggcgacccaaggacagaauggcagcuuaaugcgcaccgagauaaaaagucccuguugcaggcuguagccaaccucccguauaagggugggaauacccugacuggaauggcacuaaacuucauucggcaacagaauuuucgcacacaggccggcaugagaccuagggcucggaaaaucggugugcugauuaccgacggcaagucacaggaugacguugaggcacccucuaaaaagcucaaagacgaggggguggaacuguucgccaucggaauaaagaacgcggaugaggucgaacuuaaaaugaucgcuacugacccagaugacacacaugccuacaauguggcagauuucgagagcuugagucgaauuguugacgaucugaccaucaacuuauguaauuccgugaagggccccggggaccucgaagccccuagcaaccuggucauuucugagagaacgcaccgcucauuuaggguguccuggacuccacccagugauagcguagaccguuacaagguggaguauuacccuguuucgggaggcaaacggcaagaauucuaugucucuagaauggagaccuccacagugcuuaaggaucugaaaccggaaaccgaguacguggucaauguuuauagcgugguagaagacgaguacucagagccacuaaaggguacagaaaaaacucuccccgugccugucgugagucugaacaucuaugauguugggcccaccacgaugcacgugcaguggcagccagucggaggcgcuacaggcuacauauugucuuacaagccuguaaaggacacugagcccaccaggccaaaagaagugcgccuggggccuacaguuaacgacaugcaguuaaccgaucucgugccgaauacugaguaugccgucaccgugcaagcaguccugcaugaccuuacauccgagcccgugacgguucgagaagugacucugccauugccuagaccccaggaucucaagcugcgggacguaacccacagcacaaugaacguguuuugggagccagucccuggaaaaguuaggaaguacauugugcgcuauaaaacccccgaagaggaugucaaggaaguggagguagaccguucagagacuaguacaagccuaaaggaucuguucucccagacccuuuacacggugucuguuagcgcugugcaugacgaaggugaguccccgccagucacugcccaagaaacaaccagaccugugcccgcgccaaccaaucucaaaaucacugaggucacaucagaaggcuuucgggggaccugggaucacggagccucugacgugagucuguauaggaucacaugggcacccuucggcucgagcgauaagauggagacuauuuugaacggugacgagaauacgcugguuuuugaaaacuuaaauccuaacaccauauacgagguauccaucacagcuauuuauccggaugaaucugagucagacgaccucaucgggagcgaacgcacucugcccauucuuaccacacaggccccaaaauccggaccucgaaaucugcagguguacaacgcuaccaguaauucuuugacugucaagugggaucccgcaagcggcagagugcagaaauaccggaucacguaucaaccuucaaccggcgaggggaacgagcagacaacuaccauaggagguaggcagaauuccguugugcuccagaagcugaagccagacacacccuacaccaucacugucaguagccuauauccugauggcgaagggggacgcaugacaggcagagguaaaacgaagccacugaacaccgugaggaaucuucggguauacgaccccucuacuuccacacucaacgugcguugggaucaugccgaggggaacccgcgccaauauaaacuguucuacgccccugcugcgggaggcccagaagaguugguucccauuccuggcaauaccaacuaugcaaucuuacgaaaucugcagccagacaccucauacacagucacuguggugcccgucuacacggagggggauggagguagaaccagcgacacaggcaggacucucaugcgggggcuggcccgcaacguucagguguauaauccgaccccuaacucgcuugauguaagaugggaccccgcuccaggaccugugcugcaguacagggucguguauucucccguugauggcacacggccaagugaauccauugugguccccgguaauacccgaauggugcacuuggagagacuaaucccugacacucuguacagcguaaaccucguugcccuguauucagacggggaaggaaauccauccccggcacaaggccgcacgcuucccaggucuggcccucggaacuuacguguguuuggggagacaaccaauagccugagugucgccugggaucacgcugacggaccagugcagcaguacagaauaauuuauucccccacugugggugauccuaucgacgaauacaccacagucccaggcaggcgcaacaauguuauccuccagcccuugcaaccugauacuccguacaagauuaccgugaucgcgguauaugaggacggggauggaggccaucugacagguaacgggcggacggugggacuccugccaccccagaauauacacauuagcgacgagugguacacccgauucagagucucuugggauccuucacccaguccagugcuuggcuauaaaaucguuuacaagccugugggcuccaacgaacccauggaggccuuugucggggaaaugacuagcuauacacugcauaauuugaacccaucuaccacuuacgacgugaacguauaugcacaguacgauucgggacuaucaguuccgcugacagaccaagguaccacgcucuacuuaaaugugaccgaucugaagacauaucagauuggcugggacacuuucugcgucaaauggagcccucacagggcugccaccuccuaccgccuuaagcugagucccgcagacgggacacggggacaggagaucacugugagaggcucugaaaccagccacuguuucacaggucucuccccagauaccgacuaugggguuacuguguuuguccagacgcccaacuuggagggcccuggagugucaguaaaagagcauacaaccgugaagccaacugaagcccccaccgagccuccgacaccacccccuccacccacgauaccucccgcucgugaugucugcaaaggcgccaaggcggacauuguuuuccugaccgaugcaaguuggucuaucggggacgauaauuuuaacaaaguggucaaguucaucuuuaauacugugggagguuucgacgaaauuagcccagccggcauccaaguauccuuugugcaguacucagaugagguuaagagcgaauucaaacucaacacauauaaugacaaggcucuggcccuuggggcucuacagaacauuagguaccggggaggcaauacccgcacugguaaagcacugacauuuauaaaggagaaaguguugaccugggagucugggaugcgaaagaacgucccgaagguguuaguugucgugacagauggcagaucccaggacgaagugaaaaaggccgcucugguaauccaacagaguggauucagcgucuuugugguuggcguggccgacgucgauuauaaugagcucgcaaacauugcgucgaaaccuuccgaaaggcacguguucaucguugacgauuuugagucuuucgagaagaucgaagacaaucugauuacuuucgugugugagaccgccacgucaagcugcccccuuauauaccuggauggguacaccaguccaggauuuaaaaugcucgaagcuuauaacuugacagagaagaauuucgccuccguacagggugucucucuggaaagcggcucauuuccuuccuacagugcauaucggauccagaagaacgcuuucgugaaccaacccacugccgaccuacauccaaaugggcugccucccagcuacaccauuauccuccuuuuucgccuguuaccggagacaccaucugauccuuucgcaauuuggcagaucacugacagagauuauaaaccccaggugggaguuauagccgacccaucauccaagaccuugagcuuuuucaacaaagauacgaggggcgagguccaaacagugaccuuugacacugaagagguaaagacacuguucuacgguucuuuucacaaagugcauaucgucgugaccaguaagucgguuaagauuuauaucgauuguuacgaaauuaucgagaaagacauaaaggaagcugggaauauuacuaccgacggcuacgagauccucggaaaacugcuuaagggcgagcgaaaauccgcggccuuccagauucagagcuuugauaucgugugcucacccgucuggacaucucgggaccguugcugugauauaccuagcagacgcgacgaagggaagugcccggcauucccaaacuccuguacgugcacccaggauagugugggacccccuggccccccagguccugcugggggacccggcgccaaagguccaaggggcgagcgggggaucucaggagccauuggcccuccggggcccagaggagacaucggcccaccugguccccaagggccaccuggaccccagggcccgaauggucugucuauuccaggcgaacaggggcgccagggaaugaagggcgaugcaggggagccuggacuccccggcaggacugguacaccaggguugcccggaccucccggcccaaugggcccuccgggggaccgaggauucaccgguaaggauggcgcuauggggccccggggaccaccuggccccccagguagcccugggucccccggaguuacuggcccgaguggcaaaccugggaagccaggagaccacgguagacccggcccuagcgggcugaaaggagaaaagggcgauaggggugacaucgccucccaaaacaugaugcgcgcgguggcucgucagguaugugagcaguuaauaucugggcagaugaaucgguuuaaccaaaugcuaaaucagauuccaaacgauuaucagucaagcagaaaucagcccggaccuccaggccccccgggcccucccgggucggccggagcaaggggugagccaggccccgggggacgcccuggcuucccagguacacccgggaugcaaggaccuccaggcgaacgaggccugccgggggagaaaggagaacgggguaccggcuccagugggcccagaggacucccuggcccacccgguccucagggggagucuaggacgggaccacccggcagcacaggcucacgcgggccgccuggaccacccgguagaccuggcaacuccgggauccggggacccccaggcccgccugguuacugcgacucuagucagugugccagcauccccuauaaugggcaaggauacccaggcuccggcuga

SEQ ID NO: 54625 - RNA, 2154 nt, Artificial Sequence
  derived and/or modified sequence opt3 from COL13A1__Homo_sapiens__NP_001123575
augguggccgagagaacccacaaggcugcagccacaggcgcgagggggcccggagaacugggugcuccuggcacugucgcccucguugcagcccgggcugagcgcggggcacgacuuccaagcccgggauccugcggccuguugacguuagcccuguguucucuagcucucucacugcuugcccauuuccguaccgcggaacugcaggcaagaguguugaggcucgaggccgaacggggugagcaacagauggagacagcuauccuggggcgcguaaaccagcugcucgacgaaaaauggaaguuacacaguagaaggcggcgcgaggcccccaaaacuagcccuggaugcaauuguccacccggcccuccaggccccaccgggcgaccuggacugccaggugauaagggcgcaauugggaugccgggaagagugggcucccccggugacgcugggcuuucuauaaucggaccuaggggcccacccggccagccugggacacggggauuuccagguuuccccggcccgauuggguuggauggaaaaccuggccaucccgguccaaagggggacaugggccugaccggaccucccggccaaccagggccccagggacagaagggugaaaaaggccagugcggggaguacccucaccgugagugucuaucgucaaugccagccgcgcuccgcagcagucaaaucauugcccugaaacuucugccguugcucaacuccgucagacuggcacccccuccagugaucaagaggcggacuuuucagggagaacagucucaggcuagcauacaagggcccccugguccacccgggccgccuggcccauccggacccuuaggccauccugggcugcccggaccaauggguccucccggccucccagggccgccuggacccaagggcgauccagguauccagggguaucacggccgaaaaggagagcgcggcaugcccgggaugccuggaaagcacggcgccaagggugcuccagggauugccguugcaggaaugaaaggcgaacccgguaucccuggcacaaagggggagaaaggagccgaaggcucaccggggcuuccaggacuguugggccagaagggugagaaaggggacgcuggaaauaguauuggcgguggcagaggggagcccggaccuccaggccuacccgggccuccgggacccaagggcgaagcggguguggaugggcaagucggaccaccuggccagcccggugacaaaggcgagaggggcgcagccggagaacagggcccagaugggccuaagggaagcaagggcgagcccgguaaaggggaaaugguggacuacaacggaaauaucaacgaggcucugcaggagauacggacccucgcccugaugggcccaccgggccuuccugggcaaauuggacccccaggugcacccggcaucccugggcagaagggagaaauuggccugccaggucccccugggcaugauggagagaaaggcccgcgcggcaagccaggggacaugggacccccugguccccagggcccaccugggaaagauggacccccaggcguaaagggugaaaaugggcacccuggaucuccgggcgagaagggcgaaaaaggggagacgggacaggccgguucccccggcgagaagggggaagcuggagagaaaggcaacccaggugccgaaguuccuggguugcccggaccagagggcccucccggcccgccagggcuccaaggagugccuggucccaagggcgaggcagggcuggacggagcgaaaggcgaaaaggguuuccagggggagaagggagacagaggcccauuaggccugcccggggcuucaggacuagaugguaggccuggcccgcccgggacuccaggaccuaucggcguccccgguccugccgggccaaaaggcgaacguggaagcaagggcgaccccgggaugaccggaccuacaggugcagccggccucccagggcugcauggacccccgggcgauaaagguaaucgaggggagcggggcaagaaaggaaguagaggcccuaagggggacaagggagaucagggugcuccaggccuugacgcccccugcccuuugggggaagauggacugccagugcagggcuguuggaacaaauga

SEQ ID NO: 54626 - RNA, 5343 nt, Artificial Sequence
  derived and/or modified sequence opt3 from COL14A1__Homo_sapiens__XP_005251116
augaagaucuuccagaggaaaaugagguacuggcugcuacccccuuuucuugccauuguguauuucugcaccaucguccaaggccagguugcuccaccgacacggcugcgcuacaacgugaucagccacgacuccauucagaucucuuggaaggcaccccgagggaaauuuggagguuauaaguuguuaguaacuccuacgucaggcgggaaaaccaaucagcugaaccuccaaaauacagccacuaaggcgauuauccagggacucaugccagaucagaacuacaccgugcagauaaucgcuuauaauaaggacaaagagaguaagcccgcccaaggccaguuccguauuaaagaucuggaaaagcggaaagacccuaagccaagggucaaggugguugaucgggguaacgggagccgccccuccucuccugaggaagugaaauuugucugucagacaccagcaaucgccgacauugugauccuuguagauggaucguggucaauaggcagauucaauuuuaggcugguucggcauuucuuggagaaccucgugaccgcuuuugacgucggcagcgaaaagacucgcauugggcuggcacaguacaguggagauccgcgaaucgaguggcaccugaaugccuucuccacaaaagacgaggugauugaagcugugagaaaccuccccuauaaggguggcaauaccuuaacggggcuggcccuuaacuacaucuuugaaaauucuuucaaaccugaagcgggaagcaggacuggcgucuccaagaucgguauuuugauaaccgaugggaaaucacaagacgauaucauuccacccagucggaaccugcgugagagcggaguugagcuauuugcaaucggcgugaagaaugccgacguaaacgaacuccaggagauagcuucugaaccugacuccacacauguguacaacgucgccgaguucgaucugaugcacacugugguugaaucacuuacccgcacacugugcagcagaguggaggagcaggacagggaaauuaaggcaagugcucaugccaucaccggcccacccacggaguugaucacuucugaagucacagcgcgguccuucauggugaauuggacccacgccccggggaacguagagaaauaucgaguuguguacuauccuacucgcggagguaagcccgaugaagucguggucgacggcacagugagcucgaccguucucaaaaaucugaugucuuuaacggaguaccaaauugcaguguuugcuaucuaugcccacaccgcuuccgaggggcugagaggaacagaaacuacccucgcccuuccaauggcaucagaucuguugcuauacgacguaacagagaacaguaugagggucaagugggaugccgugccuggcgcuagcgguuaucugauucucuacgcgccccugacugaagggcuugcaggcgacgagaaagaaaugaagauaggagagacccauacagauaucgagcuguccggcuugcucccaaauaccgaauacacuguuacgguguaugccauguucggggaggaggcuucugaccccgucacaggacaggagaccacucuggccuuaagcccuccacggaaccugcgcauuucaaauguggguaguaacuccgcaagacuaaccugggauccgacaagcaggcagaucaauggcuaccguaucguauauaacaaugccgacgggaccgagauuaacgaaguggagguugaccccauaacuacauuuccucucaagggacugacgccacuuaccgaauacacuaucgcuauuuucucuaucuaugaugagggccagucagaacccuugacaggugucuuuaccacagaggaggugccugcccaacaguaccuggaaauugacgaggugacuaccgauaguuuccgggucacguggcacccacucagcgcagacgaagggcugcauaaacuuauguggauccccguuuauggcggaaagaccgaggaaguggugcugaaagaggagcaggauucccacguaauagaaggcuuggagccggggacagaauacgaggucucucuccuggcgguguuagacgauggaucggaaagcgagguugugacugcugucgguaccacacuggacuccuuuuggacugagccugccaccacgaucgugccaacaaccucaguuacuucuguguuccagacaggcauucgaaaucuaguagucggggaugaaaccacuucuagccucagagugaagugggacaucuccgauucagacgugcaacaguuuagggucaccuacaugacagcacagggagaucccgaggaagagguuauuggcacggugaugguaccugguagccagaacaaucugcuuuugaaaccccugcucccagacaccgaguauaaggugacugucacaccuaucuacaccgacggggaaggcgugucuguuuccgcccccggaaagacacugccaaguagcggcccgcaaaacuuacgcgugucugaggaaugguauaaccggcugagaauaacuugggauccucccuccucaccagucaaaggguacaggauuguguauaagcccguuagugugccuggaccaacccuugagacguucgucggcgcugacaucaauacaauuuugaucaccaaccuccugagcgguauggauuacaauguaaaaauauuugccucgcaggcauccggguucucugacgcucuaacuggaauggugaagacccuguuucucggcguuacaaaccugcaggccaaacacguggaaaugacuagccuuugugcgcauuggcagguccaccgccaugccaccgcuuaucgagugguaaucgagucauugcaagaucggcagaagcaggagaguacaguggguggcgggacgacccgucacugcuucuacggacugcaacccgacuccgaauacaagauuucugucuauacuaaauuacaggagaucgaaggcccuagcguuuccauuauggagaagacacagucacucccgaccagaccacccacuuucccuccaacaauacccccugcaaaagaaguguguaaggccgcuaaagccgaucugguguuuauggucgacgggagcuggaguauaggagaugagaauuucaacaagauuaucucuuuucuuuacuccaccgugggcgcacugaauaaaaucgguacggacgggacucagguugcgaugguacaauucaccgaugacccgaggacagaguuuaaguugaacgccuauaagaccaaagaaacucuccuggaugcuauuaagcauaucagcuacaaaggaggcaauacaaagaccgguaaagccauuaaguaugugcgcgacacacuauucacugcagagucgggcacccggagagggauacccaaggucaucgugguuauuacggacggaaggucacaggaugacgugaacaaaaucucucgagaaaugcagcuggauggcuacaguauuuuugcuaucggggucgccgacgcagauuauuccgagcucgugagcauaggaucuaagccaagcgcccgccacguauucuuugucgacgauuucgacgcuuuuaaaaagaucgaagaugagcugauuacauucgugugcgagaccgcguccgccacuuguccuguugugcacaaagacggcaucgaucuugcagguuuuaagaugauggaaauguucggguuggucgagaaggacuucucaaguguggaaggaguuagcauggagcccggcaccuuuaauguguucccaugcuaccagcugcauaaagacgcuuuagucucucaaccuacacgguaccuccaccccgagggucugccauccgauuauacuauuucauuucuuuucagaauccugccggacaccccucaggaacccuuugcccuaugggagauacucaacaagaauagugauccacuggugggcguaauuuuggacaacgggggaaaaacgcugacauacuucaauuaugaucagagcggcgacuuucagaccgugacuuucgaagggcccgagaucaggaagaucuuuuacggauccuuccauaaauuacacauuguugucucugaaacacucgugaagguggucauagauuguaagcaaguaggcgagaaagccaugaacgcuucggcaaacaucaccagcgacgguguggagguucuggggaagauggugcguucacgcggaccuggcggcaauuccgccccauuucagcuucagauguucgauauugucugcaguacuucuugggcgaacacagacaaauguugcgaacugcccggguugcgggaugacgagagcugcccugaucucccgcacuccuguucaugcucugaaaccaaugagguggcucugggaccagccggucccccuggcgggcccggacuaagaggcccaaagggucaacagggggaaccuggacccaaaggcccagacggcccuagaggggagaucggacugccggguccccagggcccaccugggccccagggaccaagcggccuuaguauucaagguaugccugggaugcccggagagaagggcgaaaaaggcgacacggggcucccgggaccacaggguaucccuggcgggguuggaucccccggccgagaugguagcccagggcagcggggacugcccggcaaggacggcaguucagggccuccgggacccccagguccuauaggcauccccgggacuccuggagugccaggcauuaccgguuccauggggccccagggagcauugggcccuccaggcguccccggggccaagggagagcgcggugaaagaggcgaucugcaaagucaggcuauggugaggagcguagcaagacaggugugugagcaguuaauccaaucgcauauggcccgauauacagcgauucucaaccagaucccgucucacuccagcucaauaagaaccguucaggggccuccaggagaacccggccgcccugguaguccaggggcucccggcgagcagggaccgccuggcacacccggguucccaggaaaugccggugucccuggcacucccggggagaggggacugaccggcauuaaaggugaaaaggggaacccaggcgugggaacgcaaggcccccgugggccuccaggaccggcaggucccucuggcgagucccggccugggagcccaggacccccuggcucaccaggucccagagggccuccgggccaucuuggagugccaggcccccaggggccuaguggacagcccggcuacugcgacccaagcuccuguucugccuauggugucagggaucugaucccuuacaaugacuaccaacacuga

SEQ ID NO: 54627 - RNA, 4167 nt, Artificial Sequence
  derived and/or modified sequence opt3 from COL15A1__Homo_sapiens__XP_011516516
auggcccccagaaggaacaauggccagugcuggugucugcucaugcuucugagcguguccaccccuuugccagcugucacacaaacucggggcgcaacggagaccgccucucagggacacuuagaccugacacagcuaaucgguguuccgcuccccucaagugugagcuucguaacuggcuacgggggauuuccugcguauuccuucggcccaggugcuaacguggggcgccccgcccgaacccugauuccuucuacauuuuuccgugauuuugcaauaucggucgugguuaagccaucaagcaccagaggaggcgugcuuuucgccaucacugacgcuuuucagaaagucauuuaccugggcuugaggcucagugggguggaagauggacaucaacggaucauucuguauuacacagagcccgguucccacguaucucaggaagcagccgcuuucagcguuccugugaugacccaucgcuggaauagauuugccaugaucguccagggcgaggaagugacgcugcucgugaacugcgaggagcacuccaggauaccauuccagcggucaagucaagcguuagcauuugaaagcucugccgggaucuucaugggaaaugcuggcgccacuggucuggagcgcuuuaccgggucccuucagcaguugacaguccauccggacccccgaacuccugaggagcugugugauccagaggaaucaagcgcaaguggagagaccucuggccuacaggaagcugacggcguugccgagauucucgaagcggugacauauacccaagccucccccaaggaggcaaaaguagagccuaucaacacgccacccacuccgagcucgccuuucgaagauauggagcugucuggggaacccgugccagagggaacacuugaaaccacuaauauguccauuauccagcacucaaguccuaagcaggguagcggcgagauacugaacgacacauuggaggggguccacuccguggauggagaccccauuaccgauucuggcagcggugcuggggccuuccucgacaucgcugaagagaaaaaucuggccgcaacggccgcuggcuuagcggaaguuccaauuucaaccgcaggagaggccgaagcuaguuccgugcccacaggcgggccuacucugagcaugucuaccgagaacccagaggaaggagucacaccgggucccgauaaugaggaaagacucgccgcaacugccgcuggcgaggccgaggcacuugcgucaaugccuggggaaguggaggcuaguggaguagccccaggcgaacuggacuugagcauguccgcacaaucucuaggugaggaagccaccguugggcccucgagcgaggacucccugacaaccgcugccgcagcuacugaggugucacucaguacguuugaagaugaggaagccucuggcgucccuacagacggacuggcgccacuuaccgccacuauggcucccgagagggcagugaccagcggcccgggggaugaagaggaccuggccgcugccacaaccgaggaaccuuugaucacugcaggaggugaggaauccggcucaccacccccugaugggcccccacucccucugcccacagucgcgccagagcgguggaucacgccggcccagcgugaacaugugggaaugaagggccaggcugguccuaagggggagaaaggcgacgccggagaggaauuacccggcccacccgagccuagcgggccaguuggacccaccgcaggcgcugaagccgaggguucugggcugggauggggcuccgauguggguaguggcagcggggaccuaguaggaucugagcagcuccugcgcggcccuccggggccacccggaccuccaggccuucccgguauuccugggaagccgggaacugaugucuucauggggcccccagguuccccuggcgaagacgggcccgcaggagagccaggcccucccgggccagaaggacaaccgggcguggauggugccacaggguugccuggaaugaaaggcgagaagggugcuagaggccccaacgggucaguuggagaaaaaggcgacccagggaauaggggacugcccggcccuccagguaagaaggggcaggcgggacccccuggcgugaugggcccgccagggcccccuggacccccagguccucccggcccagggugcaccaugggacucggcuuugaggacacagaggguagugggagcacucagcugcuuaacgaaccuaaacugucgcggccgaccgccgcaauaggauugaagggcgagaaaggcgaucgagggcccaagggagaacgcgguauggacggcgcuuccaucgucgggccaccuggacccagaggcccaccuggucacauuaaagugcucucuaauagccugaucaacauaacgcauggguucaugaacuuuucagauauucccgaguuaguaggaccgccaggcccugacggccugcccgggcuaccaggauuccccgguccuaggggcccgaagggggauaccggacuccccggcuuuccaggucugaaaggggaacagggagagaagggcgagccuggcgccauccuuacagaagacauccccuuggagcggcugauggggaagaaaggagaaccugguaugcacggcgccccagggcccaugggaccuaagggcccacccggucacaaaggggaguucggacucccgggccgcccuggcagaccagggcugaauggauuaaaggguacuaaaggcgaucccggggugauuaugcaaggaccuccaggccugcccgguccgccugggcccccaggcccucccggagcuguuaucaacauuaagggcgcaauauuuccaauccccgucaggccucauuguaagaugccaguggacaccgcccacccggggagucccgaacuuauuacauuccauggagugaaaggugagaagggcuccuggggguugccuggaucuaaaggcgagaagggugaucagggggcgcagggcccacccggaccuccacucgaccuggcuuaccuacgucacuuucugaauaaccucaaaggcgaaaauggggauaagggauucaagggugagaaaggcgaaaagggggacaucaacggaucauuucugauguccggucccccuggccuuccggggaauccaggccccgccggacagaaaggcgagacugucguugggccucaaggacccccaggcgcaccugguuugcccgggccaccgggauucggccggccuggugaucccggcccacccgggccuccaggacccccuggcccgccagccauccugggggcugcaguggccuuacccggaccuccaggucccccuggccagcccgggcucccaggaucacgaaaccuggugaccgcguucagcaauauggacgacaugcuucagaaggcucaucugguaauugagggcacguuuauauauuugagagauaguacagaguucuuuaucaggguccgcgacgguuggaaaaagcuccagcugggcgaacuaauuccgaucccugccgauucucccccaccucccgcacuguccagcaacccacaccaacuccugccucccccgaauccaauuucgucagccaacuacgaaaagccugcccuucacuuggcugcacugaauaugcccuucucuggggacauccgggcugauuuucagugcuucaaacaggccagagcggccggauuacucaguaccuacagggcauuucuguccagccaucuucaagaccugucuacuauagugcgcaaggcugagcgauauagccuaccaaucguuaaccucaaaggccaggugcuguucaauaacugggauuccauuuuuagcgggcacggaggccaguucaacaugcauauccccauuuacaguuuugacggucgggauaucaugacagacccuagcuggccgcagaaggucauauggcacgggucuuccccacacggagugcguuugguugauaauuauugugaagccuggagaaccgcugacacugcagugaccggccuggccucacccuuaaguacaggcaaaauucucgaucaaaaggccuacagcugcgcuaacaggcugaucguacuuuguauugaaaauuccuucaugacggacgcgcgcaaauga

SEQ ID NO: 54628 - RNA, 4692 nt, Artificial Sequence
  derived and/or modified sequence opt3 from COL16A1__Homo_sapiens__XP_011539026
augugggugagcugggcccccggccuguggcuccuugggcugugggcuaccuucggacacggugcaaacacaggcgcccagugcccuccaucccaacaggagggguugaaguuagaacauucuucaagucugccggcgaaugucacuggauuuaaccuaauccacagacucagccugaugaaaacguccgcuauuaagaaaauaaggaaucccaagggcccucuuauccugcgguugggugccgcaccaguuacccagcccacacgccgaguguucccucgugggcucccagaggaauuugcccugguacugacucucuuacugaaaaagcauacccaccagaagacaugguaccuuuuccaagugaccgacgcuaacggauauccccagauuucuuuggaggucaauucgcaggaaagaucacuggagcuaagggcacagggccaagauggcgacuuugugagcuguaucuucccuguuccacagcucuuugaucugcgguggcauaaacuuaugcugaguguggccgggcgcgucgcuuccgugcacguagacugcucuagcgccuccucacagccguugggacccagaaggccuaugcggccaguuggucacguguuccucggccuggaugcggagcaggggaagcccgucaguuuugacuuacaacaggugcauauuuacugugauccugaacuggugcucgaggaaggaugcugugagauccuuccagcaggcugucccccggagacuagcaaagcccgccgagacacacagucuaacgaacugauagagaucaauccucaauccgaagguaaggucuauaccagaugcuucugcuuggaggaaccccagaacucagagguugaugcucagcuaacggggaggauuagccagaaagccgagcggggagcaaaggugcaccaagaaacugcugccgacgaguguccaccuugcguacauggcgcgcgugauaguaaugugacccuggcccccucuggcccaaaagggggaaagggugaacgcggccuccccgggccuccaggauccaagggcgagaaaggugcaagagggaacgacugugucaggaucagcccggaugcuccccugcagugcgccgaaggcccuaagggagagaaaggcgagucgggggcucuuggaccaucuggucugcccggcuccacaggggaaaagggacagaaaggcgagaagggugacgggggcauuaagggagugccuggcaaaccagggcgggacggacgacccggugaaaucugcguuauaggcccgaaggggcagaaaggagauccuggcuuuguggguccagagggguuggccggcgaacccggaccucccggccucccagggccucccggaauuggccugccagguacuccgggggacccuggaggacccccaggucccaagggcgauaaagggucaaguggaaucccuggcaaggaggggccaggaggcaagcccgguaaaccuggggucaagggagagaaaggcgacccgugugaagugugcccaaccuuacccgaggguuuccaaaauuuuguaggccugccugggaagccaggacccaaaggcgaaccuggggauccgguucccgcacgcggagacccaggcauucaggguaucaagggggagaagggagagccuugucuaagcugcuccucuguggucggcgcccagcaccucgugagcucaacaggugcuaguggcgaugucgggucccccggauucggccugccagggcuuccuggcagagcgggcgugcccgguuugaaaggggaaaagggaaacuucggcgaggcaggcccagccgggagcccgggaccucccgguccaguuggccccgcugggaucaaaggagccaagggcgaaccuugugagccaugccccgcacugucuaaucuccaggacggugaugugaggguagucgcccugccugggccgucaggagaaaaaggcgagccaggacccccuggguuuggacuucccgguaagcaaggcaaggcuggggagcggggacugaaaggccagaagggugacgccgggaacccaggagauccuggcacccccggcacgacugggcgcccaggauugaguggugaaccuggcgugcaggggccggcaggacccaaaggcgagaagggucagccagggcucccuggaguucaagggcccccaggccugaaaggcgugcagggagaaccuggucccccgggcagagggguccagggaccacaaggcgagccuggugcgcccggguuaccaggcauucagggccugcccggcccuagggggccgcccggaccaacaggugaaaagggcgcucaggggagcccuggagugaaaggcgccaccggucccguagggccuccaggcgcauccgugucuggacccccuggccgugacgggcagcaaggacagacuggucuacggggcacaccaggggagaagggaccccgaggcgagaagggugaaccgggggaguguucgugcccuagccagggcgaccucauauucuccggaaugccaggcgcccccgggcuguggaugggaucaaguuggcagccugguccacaagggcccccgggcaucccuggacccccaggcccucccgguguuccagggcuucagggcguccccggaaauaacggcuugccugggcagccaggacugaccgcugaacucggcucucugccgauugagcagcacuuacugaaaagcaucuguggugauugcgugcaagggcagagagcccaucccggauaccuuguggaaaagggcgagaaaggugaccagggcauaccuggggucccaggauuggauaacugugcacaaugcuuucucucccuggagaggccccgcgcugaagaggcccggggcgacaauucagaaggggauccuggaugcguuggcagcccaggucuacccgggccuccgggacugccaggccagagaggugaggaggggcccccuggcaugaggggaucucccggcccaccugggcccauuggaccaccgggcuucccuggugcgguggggucccccggacucccaggccugcagggcgaacgcgggcuuacgggauugaccggugacaagggcgagcccgggccuccaggacagcccggcuauccuggugccacagggccgccaggacugcccggcaucaaaggcgaacgaggguacacuggaagugcuggugagaagggcgaaccugggccacccggaagcgagggcuuaccuggucccccagggccggcaggaccucggggcgagcguggcccccaagggaacucuggagaaaagggugaucagggcuuucaggggcagccaggauucccuggucccccaggcccucccggguuuccgggaaaagugggcuccccaggcccucccgggccacaagccgagaagggaucagaagguaucagaggccccagugggcucccuggaagcccgggcccacccgguccucccgggauucagggaccagcuggccuggacggccuugaugggaaagacggaaagccuggucugaggggcgaucccgggccagccggaccuccgggcuugaugggucccccaggguucaaaggaaagaccggccacccuggccuccccgggccaaagggagacugugguaaaccugggcccccgggcucgacaggacgcccaggcgcagagggugaaccuggggcgaugggcccccagggacggccagggcccccuggccauguaggacccccagguccuccgggccagcccgggccagccggaaucuccgcugucggccugaagggugauagaggggccacuggcgagaggggacuagcaggccugccugggcaacccggaccaccuggucaccccggcccgccuggggagccaggaaccgacggcgcugccgguaaagaagggcccccuggcaagcagggauuuuauggcccacccgggccuaaaggagacccaggcgcagccggucagaaggggcaggcuggagagaagggccgagcggguaugcccggcgggccgggaaaaucuggcagcauggggccugugggacccccaggccccgccggugaacgcgggcauccuggagcaccaggccccucagguaguccuggccucccagggguuccgggauccaugggcgauauggugaauuacgacgagauuaagcgguucauaagacaagaaaucauuaaaauguuugaugagaggauggcuuacuauacaucucguaugcaguuccccauggagauggccgccgcuccugggcgcccaggacccccuggcaaggacggugcaccagggcggcccggagccccgggcagcccuggccugccagggcagaucggaagagaagguaggcaaggccuucccgggguccgaggauugccuggcaccaaaggugagaagggggauaucggaauuggcauagcgggcgaaaacgggcugcccggaccaccggguccucaggggcccccaggcuacggaaaaaugggcgcuacuggucccauggggcagcagggaaucccuggcauuccagggcccccuggcccaaugggacaaccggguaaggccggccacugcaaucccuccgacuguuuuggggcaaugccuauggagcagcaguauccacccaugaagacgaugaaaggaccuuucggcuga

SEQ ID NO: 54629 - RNA, 4494 nt, Artificial Sequence
  derived and/or modified sequence opt3 from COL17A1__Homo_sapiens__NP_000485
auggacgugaccaagaaaaacaagagagauggcacagaggucacugaaaggaucguuacggagaccgugacaacucggcugaccagccuucccccuaaagggggaacauccaaugguuacgccaagaccgcuucucucggcgggggaucacgccuggaaaaacagaguuugacucacggcagcuccgguuauauuaacucuacagggucgacccgaggacaugcaucaacgagcaguuaccguagagcccacuccccagcgucuacuuuaccgaauagccccggcuccaccuucgagaggaagacacauguaacucggcacgcuuaugaaggcucaaguagcgggaacucuuccccugaguacccacgcaaggaguuugccucaagcaguaccagaggaaggucucaaacacgggaauccgagauacgcgugcgacugcagagcgcaucgcccucuaccagauggacggaacuagacgaugucaaaaggcuccugaaggguucccggucagccagugugagcccuacucguaauuccucuaacacacuuccaauccccaaaaagggcaccguugagacuaaaauugugacagcuagcucacagagugucuccgggaccuaugacgcaacgauccuggaugccaauuugccuagccauguguggucuucaacccucccagcuggaaguagcaugggcacauaccacaacaauaugacuacccaguccucuucgcugcugaacacaaaugccuauagcgcggguuccguauucgggguuccgaacaauauggcaucaugcagucccacucuccacccuggauuaucuaccagcuccucaguguuuggcaugcaaaacaaucuggccccaagccuuacaaccuugucucauggcacuacgacaaccuccacugcuuacggggucaagaagaacaugccccagaguccugccgcagugaacaccggagugagcacaucugcugccuguaccacuuccguccagucagacgaucugcuacacaaagacugcaaguuccucauucuggagaaagauaauacaccagcgaagaaagaaauggagcuucugaucaugacgaaggacagugguaaaguuuuuaccgccagccccgcaucgauagcugccacuuccuucucugaagauacauugaagaaggagaaacaggcugccuacaacgcagacagcggccucaaggccgaagcuaauggggaucugaaaaccgugucaacaaagggaaaaacuaccacggcggacauccauaguuauggcuccucuggugggggcggaagcggcgggggagguggcguagggggagcaggcggugggccguggggcccugcccccgcuugguguccaugcggauccuguugcucaugguggaagugguuacugggccuccuucugaccugguugcuacugcucgggcugcuuuuuggacugauugccuuggcagaggaggugcgcaagcucaaagccagagucgacgaacuggagaggauccggcgaagcauuuuaccuuacggugauaguauggaccgcaucgaaaaggauagacugcaaggcauggcucccgccgcaggggcggaccuagauaaaauaggacuccacucugacucccaggaggaacuguggauguucgugaggaagaaacuuaugauggagcaggagaacggcaauuugcgggguagcccagggcccaagggcgauaugggaucgccuggcccaaagggggaccgcggauuuccgggcacacccgguauuccugggccacugggacaccccggcccucaggguccaaaaggccaaaaggggucaguuggagaucccggcauggaagggccgaugggacagagaggcagggaggguccuauggggccacguggagaagcuggacccccugguucuggcgagaaaggggaacggggagccgcaggcgagcccgggccacauggaccucccggcgugccagguagugucgggccgaagggauccagcggcucuccugguccccagggcccacccgggccugugggacuccaaggccugcgaggggagguaggacuuccaggcguuaaaggugacaaggggcccaugggaccuccgggcccaaagggcgaucagggggaaaaaggacccagaggucugacuggcgagccugggaugaggggauugccaggcgccgugggugaacccggggcuaagggagccaugggcccugcaggcccggacgggcaccagggaccccgcggugagcagggccucaccgggaugccaggaauccggggcccucccgguccaagcggggacccuggaaaacccggccugacaggcccacaagggccgcagggauuaccugguacucccggcagaccagggauuaagggagagcccggcgcuccugguaaaaucgucaccuccgaagggucaaguaugcugacggugccaggacccccuggcccgccaggcgccauggggcccccuggacccccaggugcgccuggccccgccgggccagcuggacuaccuggccaucaggagguccucaaccugcaggguccgcccgggccaccuggacccaggggcccaccuggccccagcaucccggggccaccuggaccccgcgguccacccggcgaagggcuuccuggaccgcccggcccaccugguucuuucuuguccaauucagagacauuucugagugggcccccuggcccacccggaccuccaggccccaagggggaucaaggaccgccugguccacgaggccaccagggggaacagggacuccccggcuucagcaccuccgguucuucgagcuuugggcugaacuuacagggcccuccaggacccccgggcccucaagggcccaaaggagacaagggugauccaggcgugccuggggcacugggcauucccucaggcccauccgagggugggaguucuagcacuauguauguuuccggacccccuggcccaccggggcccccuggcccacccggaucaauaucuagcaguggccaggagauccagcaguacauuuccgaauauaugcaaagcgacucuauccggucauaccuuuccggugugcaggggccuccaggacccccuggcccgccaggucccguaacaaccauaacuggcgagaccuucgauuauagugaauuggccagccaugucgugucguaccuccguacaucuggguacggaguuucccuguucagcucaaguauuucuuccgaggacauccuagcugugcugcagagagaugacgucaggcaauaucuccgccaguaccugaugggcccucgggggcccccaggaccucccggcgccagcggugaugggucacuuuugagucuggacuaugcagaauuaagcuccagaauccucucuuacaugagcuccucaggaauuucuaucggccugccagguccgccugggcccccaggccuucccggaacgaguuaugaggagcuguugucgcuccugaggggcagcgaauuucgagggauugugggaccuccaggucccccuggcccgccagggauacccggaaauguaugguccucuaucucaguggaggaucuaagcuccuaccugcacaccgcgggccucaguuucauuccuggcccacccgggccucccggaccaccggguccucgcgggcccccaggcguuucuggagcccuggcuacuuaugccgcagaaaacagcgacucauuucgguccgagcuuaucaguuacuugacaagcccugaugucagaucuuucaucgugggucccccaggcccucccgggccgcagggaccaccuggcgacuccaggcuguuaucaaccgacgcuagccacucgcguggcucuaguuccagcucacauuccucuagcgugcgccgggggaguuccuacucuagcucaaugaguacaggagguggcggggccggaucccucggcgccgguggggcauuuggagaagcugcgggcgauagaggccccuaugggacugacauuggaccagguggcggguacggagccgcagcugagggcgguauguaugccgggaauggaggccugcuuggcgccgauuucgcuggggaccuggauuacaacgagcuagcagucaggguuagcgaaucuaugcagcgacaaggacuccugcaggguauggccuauaccgugcaggggcccccuggccagccgggaccacaaggucccccuggcauaucgaagguguuuucagcguacagcaauguaacggcugacuugauggauuucuuucagacauauggggccauccagggacccccaggccagaaaggcgagauggggaccccuggacccaagggugaccggggcccagcagggccuccgggacaccccggcccaccugguccccgcgggcauaaaggagaaaagggcgauaaaggcgaccaagucuacgccgggagaaggcggcgaagauccauugcugugaagccauga

SEQ ID NO: 54630 - RNA, 4551 nt, Artificial Sequence
  derived and/or modified sequence opt3 from COL18A1__Homo_sapiens__NP_085059
auggcccccuacccuugcggcugucacauccugcuccuucuguucugcuguuuggcugcagccagagcgaacuuacugaaucuaaacuggcucugguuuaauaacgaggacaccagccaugcugccacaacuauuccagaaccgcaggggccccugccugugcaaccaacggcagauaccacaacucacgucacccccaggaauggauccacagagccugccaccgcuccagguucucccgaaccuccaucagagcuucuggaagacggccaggauacuccgacaagugcagagagccccgacgccccugaggaaaacauagcugggguuggagccgagaucuugaauguggcgaagggcauucgguccuucguacagcucuggaacgauaccgugccaacggaaucucuggcacgcgccgagacucugguccucgagacccccguggguccuuuagcucuggccgggccaucgucaacaccccaggaaaauggaacuacccuuuggccgagccgaggcaucccuaguucccccggcgcacauacaaccgaggcugggacguugccagccccuacucccucuccacccagccugggacguccuugggcgccacuaacagguccguccguucccccuccaucaagugaaagaauuagcgaggaagugggccuccugcaacuucugggggacccgccuccacagcaggucacccagacugaugaccccgaugugggauuggccuauguauuuggcccggacgcaaacucuggucaaguugcuagguaccacuucccuucccucuuuuuccgggauuuuucacuguuauuccauauccgcccagccacagaggggcccggagugcuguuugcuauaaccgacagcgcccaggcaaugguccuccuuggcgugaaacugaguggcgugcaggaugggcaccaggacaucucuuugcuauauacggagccuggagccggucaaacccacacagcugcguccuucagacugcccgcauuugucggccaguggacucaucucgcccugagcguugcugggggauucguggcccuuuacguagacugcgaagaguuucagaggaugccacuggcacggucgucucgcggcuuggaacucgagccuggugccgggcuguucguggcucaagccggcggagcagaucccgacaaguuccagggcgucauugcggaauuaaaagugcgaagagauccacagguuuccccgaugcacugucuggacgaggagggggaugacucagauggagcuaguggugacagcggcuccgggcuaggagaugccagggaacuccugcgggaggaaaccggcgcagcccuuaagccucguuugcccgcuccacccccugugacaacuccaccccuggccggugggucuagcaccgaggacucacgcagugaagaggucgaggaacagacaaccguggcaucccucggcgcucaaacucugccuggaagcgauucuguaucaacgugggacggcaguguuagaacacccgggggaagggugaaagaggguggccuuaaggggcagaagggagaaccaggcguccccgguccuccagggcgggccggacccccuggcagcccgugccugcccggcccaccuggguugcccuguccaguguccccucucggacccgcgggcccagcccugcagaccgucccggguccucaggggcccccaggacccccuggccgagacgguacuccaggccgcgauggggagcccggagacccuggcgaggaugggaaaccgggagacaccggcccacaagguuuucccgggacaccuggagaugugggccccaagggugacaaaggcgauccagggguuggagaaagaggcccucccgggccacagggaccuccgggucccccaggcccuucuuucaggcaugacaaguuaaccuuuaucgauauggaggggucgggauucggcggugaccuggaagcucuacggggcccccgcggguuuccaggaccucccggcccgccaggggugccuggacuccccggcgagccagguagauucgggguaaauagcuccgauguccccggaccugcaggccugccgggcgugcccgggagggaaggaccaccugguuuucccggccuuccugggccacccggaccuccaggccgugagggucccccggggcggacuggacagaaaggcucauugggcgaggccggggcuccuggacacaaggguaguaagggcgccccagggcccgcaggagcgcgaggcgaaucuggucuggccggggcuccuggaccagccgggcccccgggcccucccggcccaccuggacccccaggucccggccucccugcaggguucgacgauauggagggaagcggcgguccauuuugguccacagcuagaucagccgacgggccgcagggacccccuggccugccaggcuuaaaaggggaccccggaguuccuggucugccaggcgcaaagggggaagugggagccgauggcguccccgguuucccugggcuuccgggaagggagggcauugcuggcccacaagggcccaaaggagaccgcgguagccggggcgaaaagggggauccuggaaaagacggcgugggucagcccggguugccaggcccucccggaccaccgggcccuguaguguauguuucugagcaggauggguccguccucagugugcccggaccagaggguagacccggcuuugcgggguucccuggaccagccggccccaaggguaaccuggggagcaaaggcgaaaggggaucuccuggcccgaagggggagaagggagaaccagguuccaucuuuucacccgacggcggggcacuaggaccugcucagaaaggcgccaagggugagccaggguuccgcggacccccuggccccuacggccgaccaggguauaaaggagaaauaggcuucccgggucggccugggcgucccggaaugaauggccugaagggugagaaaggcgagccaggggaugccagucucggauuuggcaugagagggaugccuggacccccaggcccucccgguccgccagggccucccggaacgccaguguacgacagcaacgucuucgcugaaucguccaggcccggcccuccgggucugccaggcaaucaagggcccccuggacccaagggcgcaaagggggagguuggaccaccuggucccccaggccaguuuccuuucgauuuucuucaguuggaagccgagaugaaaggggagaagggagaccgcggcgaugcgggccaaaaaggggaacggggagagccggguggcgggggauucuuuggcucuagccugcccgguccaccugggcccccaggaccuagaggcuaccccggcauuccggggccaaagggagaaucaaucaggggucagccugggcccccaggcccccagggaccucccggcauugguuaugaggggcgacagggaccaccuggcccgcccggcccaccugggcccccaaguuucccuggaccccaccgccaaaccaucuccgugccggguccuccagggcccccuggcccacccggaccuccaggcacuaugggugcuucuagcggggugcgguuaugggccacaagacaggcaaugcucggacagguacaugaaguccccgagggcuggcugaucuuuguggccgagcaggaggaacuuuacguuagggugcaaaacggcuuccguaaaguccagcuggaagcucgcaccccguugccucgggggacagacaacgagguggcagcccuccagcccccaguugugcagcugcacgauuccaaucccuauccuagaagggaacauccacaccccacugcgcgaccuuggcgggcugacgacauucuagccucaccaccgcgccugcccgagccucaaccauaccccggagcaccucaucacagcaguuauguacaccucagaccagccaggcccaccucuccgccugcucauucccaccgggauuuucagccaguccugcaucuuguggccuugaacagcccccugucggguggcaugcgagggauaagaggagcagacuuccagugcuuucaacaggcucgcgccgugggcuuagcggguacguucagggccuuccucucaucucgucugcaggaucuuuacaguaucguccggagagcagacagggcugccguuccuauugugaaucugaaggaugagcuacucuuucccuccugggaagcucuguucagcgggucugagggaccauugaagccgggcgcacgcaucuuuagcuucgacggcaaagauguacugcgacacccuaccuggccccagaaguccguguggcacgggucagacccaaacggaagacgguuaacagaaaguuauugugagacuuggaggaccgaagcccccagcgccacaggucaggcuucuucccuccugggcgggcgccuucugggacaaucagcggcaaguugccaucacgccuacauagucuuguguauugagaauagcuuuaugacugcuuccaaauga

SEQ ID NO: 54631 - RNA, 4395 nt, Artificial Sequence
  derived and/or modified sequence opt3 from COL1A1__Homo_sapiens__NP_000079
auguucagcuuuguggaccugagacuccuucuguuguuagccgcuaccgcacugcuaacacacggccaggaggaagggcaagucgagggacaggaugaagacauucccccuaucacuugcguucagaacggucucagguaccaugaucgggacguguggaagccagagccgugucgcauaugcguaugugauaauggcaaagugcugugcgacgaugucaucugugacgaaacgaagaacugccccggggccgaggugccugagggagaauguugcccaguuugucccgauggcuccgagucuccuaccgaccaggaaacaacugguguggaggggccaaaaggagauaccggcccccgaggcccucgugggccagcgggaccgcccgguagagacggcauuccugggcaaccaggacuucccggcccuccaggucccccggggccucccggaccaccuggccugggcgggaauuucgcuccccaguugucauauggauacgaugagaagaguacagguggcaucagcgucccagggcccaugggaccuuccggcccaaggggucucccggggcccccuggcgccccaggaccccagggcuuucaggggccuccaggagaacccggugagccgggcgcaucugggccuaugggaccacggggcccucccggucccccagggaaaaacggcgacgacggagaagccggcaagccugggcgccccggagagagagguccaccgggcccucaaggggcuaggggacugcccggcaccgcaggucugccagggaugaagggccaccggggauucucgggccucgauggggccaaaggagacgcuggccccgccgguccuaagggggaaccaggaucacccggcgagaauggugcgccuggccagauggggccgcgcggauuaccaggcgagcgagggagacccggagcaccuggcccagccggugcuagggggaacgauggagccacuggcgcagcuggucccccuggcccgacagggcccgccggaccaccuggcuuucccggggcggugggagccaaaggcgaagcagguccacaggggccucggggaagcgagggcccccaggguguacguggcgaaccagggccgccuggacccgcuggcgccgcugggccagccggaaaucccggcgcagacggucaaccuggggccaagggagcuaacggcgcgccaggcauugcaggggcccccggauucccuggugcucgcggcccgagugggccacagggacccggcgguccucccgggccaaaaggaaauuccggcgagccuggcgcccccgggucuaagggagauaccggugcaaagggcgaaccagggccuguuggagugcagggcccgcccgguccagccggggaggagggaaaaagaggcgcuaggggcgaaccugggcccacgggacugccagguccucccggcgagcgagggggaccgggcagccgggguuuuccaggggccgacggagucgcaggcccuaagggccccgcgggggaacgcggauccccaggucccgcuggcccuaaagggucaccgggagaggccggcagacccggugaagcagggcuuccaggagccaagggcuugacuggcaguccugggagccccggaccugaugguaaaaccggcccacccgggccugcuggacaagacggcaggccaggucccccggggccuccaggcgcccggggacaggcaggcgugaugggguuccccggaccuaagggugcugccggcgagccagggaaagcgggagagcgcggcgugcccgguccgccuggggccgucggccccgcuggaaaggauggcgaagcaggggcccagggaccaccuggucccgcuggcccagccggggagagaggagaacagggccccgcagguucuccuggguuucaaggccugccaggaccggcggggcccccuggcgaggccggaaagccaggcgagcaggguguucccggggaccuaggagcuccuggcccauccggugccaggggcgaacguggguuccccggagagcggggcgugcaggggccuccgggaccagcaggcccccgaggugcuaacggggccccuggaaaugauggcgcaaaaggugacgccggcgcucccggggcgccaggaucacagggcgccccugggcuccaaggaaugcccggcgaaagaggugcagcugggcugccaggaccgaagggcgacaggggcgaugccgggccuaaaggagccgacgguagccccggcaaggaugggguacgcggacuuacaggcccaaucggucccccugggccagcuggagcacccggcgacaaaggcgagagugggccuucuggaccggccgguccaacuggcgcgagaggggcucccggagaucggggcgaaccugguccacccgggccugccggauuugcagggcccccaggcgccgacggccagccgggagcuaagggugagccuggcgaugcaggggccaagggagacgcgggucccccaggcccugcugggcccgccggaccaccuggccccauaggcaacgugggggcaccgggagccaaaggugcuaggggcuccgccgggccaccuggagcaaccggcuuccccggugcugccgggcgcgucggaccacccggcccuagcggcaaugcggggccgccaggacccccuggucccgccggcaaggaagggggaaaaggcccacgaggugagacagggccugcaggacggcccggcgaggugggcccaccugggccgcccggaccagcuggugaaaagggcucgccuggggccgauggacccgcuggcgcaccagguaccccugggccccagggcaucgccggacagcguggcguuguggggcugccgggacaaagaggugagaggggcuuuccaggguugccuggacccucuggcgaaccagguaaacaggggcccuccggcgccucaggagagcgcggcccucccgggccaaugggaccuccgggucucgcugggcccccaggcgagaguggacgggaaggcgcgccuggugcagagggcagccccgggagagacggauccccaggcgccaagggggauaggggagaaacgggcccugcuggucccccgggggccccuggagcaccaggcgcccccgguccugucggcccagcugggaagucuggagaccgaggcgagacugggcccgcgggaccugccggcccagugggucccguaggggcacgcggaccggcuggcccucaggguccccggggcgauaaaggggaaacaggagagcagggcgacagagggauuaagggacauaggggcuucagcggucugcaagggccacccggaccuccaggcucacccggcgagcaggggccuaguggagccuccgguccagcaggcccgcgugggcccccuggaagcgccggcgcuccagguaaagacggguuaaacggacugcccggcccuaucggcccacccgggccgcgcggacggaccggugaugccggcccuguugggccacccggaccucccggcccaccggguccucccgggccacccucugcgggauucgacuuuucauuccucccucagccaccccaagaaaaggcacacgauggcggcagauauuacagggccgacgaugcuaaugugguccgagaccgggaucuugagguggacacuacacugaaaaguuugagccagcagauugaaaacauccgcuccccugaggggucuagaaagaacccagccaggaccugccgggaucuaaagaugugucauucggacuggaaaagcggagaguauuggauagauccgaaucaggguugcaaccuggacgcuauuaaggucuuuugcaauauggaaacgggcgagaccuguguguaccccacacaaccuuccguugcacagaaaaacugguauaucucaaagaauccaaaagauaagcgacacgugugguucggggaaaguaugacugacggauuucaguucgaguacggcggucaggggucugaccccgccgauguagcuauucaacucaccuuucugagacuuaugagcacagaagccucccagaacaucacuuaccacugcaaaaauucagucgcauauauggaccagcagaccggaaaccugaagaaggcguugcuccugcaaggcagcaaugagaucgagauucgcgccgaaggcaacucuagguucacauacuccgugaccguugauggguguacgagucauacuggagcuugggguaaaacagugauagaguauaagaccacuaaaaccagccguuuaccuaucauugacgucgccccacuggaugugggcgcacccgaccaggaauuuggguucgauguaggaccugugugcuuucuauga

SEQ ID NO: 54632 - RNA, 4101 nt, Artificial Sequence
  derived and/or modified sequence opt3 from COL1A2__Homo_sapiens__NP_000080
augcugagcuucguggacaccagaacacuccuucuguuggccgucacuuuaugccuggcuacgugucagucccuacaagaagaaaccguuaggaagggccccgcaggggaucggggaccucgcggugagcgaggcccaccggggcccccuggacgugacggcgaagaugguccaacagggcccccuggaccacccggcccuccaggcccgcccgggcucggagguaacuuugccgcgcaguacgacggcaaaggggugggacugggcccugguccaauggggcuuaugggacccagaggcccuccaggcgcugccggggcacccggaccgcaggguuuccagggcccugccggggagcccggagaaccaggccaaacugguccugcuggggcaaggggccccgccggaccacccggcaaggcuggggaggauggacacccugguaaaccaggccggccgggggagcgcggaguagugggcccccagggugccagaggguuuccuggcaccccaggacugcccggcuucaaggggaucaggggacauaaugguuuggacggccucaaagggcagccuggagcgccaggcgucaagggugaacccggggcaccgggcgagaacggaacaccuggccagaccggggcccggggacugccaggcgaacgcggucgagugggggcucccggaccugccggcgcaagagguucugauggcucaguugggcccgugggaccagcuggcccuauugggagugccggacccccaggcuuuccgggugcgccugggcccaagggagagauaggcgccgucgguaaugcaggcccagcugggcccgccggaccuaggggcgagguggggcugccaggacucagcggccccguagguccuccggggaacccaggagcuaauggcuuaacuggugccaaaggcgcagccgggcugcccggaguugcuggcgcgccugggcuuccaggaccccggggcaucccugguccggugggggcagccggagcuacaggcgcccguggcuuggucggggaacccggaccagcagguuccaagggcgagucugggaacaaaggagaaccuggcucggccgguccccaagggccaccuggacccucaggcgaggaaggcaagcgcgggccaaauggagaggcugguagcgccggcccgccugggcccccaggacugagaggcagucccgguuccagggggcuaccuggagcagacggccgggcgggcgugauggggccacccggaucucgaggugcuagcggcccugccggggugcgcggaccgaacggcgaugcagguagaccaggggagcccggacucaugggcccuaggggccugcccggguccccaggaaauauugguccugccggcaaagaagggcccgucggacuuccaggcaucgacggucggccugggccgauuggacccgcuggcgcccgcggcgagccagggaacaucggauucccuggucccaagggcccaaccggggauccuggaaagaauggcgacaaaggucacgcagggcuggcuggcgccagaggagcgcccggcccggaugggaacaauggagcccaggguccaccuggcccccaggggguucagggaggcaagggugaacaagggccacccggcccuccgggauuucagggcuugcccgggccaucaggaccugcuggugaggugggcaaacccggggaaaggggacuccauggcgaguucggucugccugggccagcaggcccccguggagagcggggcccuccaggggaaaguggagccgcuggccccacggguccgauagggagccgaggaccuucuggcccacccgguccugacggcaacaagggggagccaggaguagugggcgccgucgggacugcaggacccuccggcccgucagguuuaccuggggaaagaggagcggccggcauccccgguggcaaaggggagaagggagaaccaggccugaggggagagauuggaaauccuggccgcgacggugcucggggcgcccccggagcagugggcgcuccaggccccgccggggcaaccggagauagaggugaggccggcgcugcggggccugccggaccagcaggcccgagggguagccccggggaacgcggagagguuggcccugcuggcccaaacggguuugccggacccgccggugcugcaggccagccuggggccaaaggagaacgaggcgcgaaggguccaaagggggagaacggaguggucggccccacaggcccugugggggcugccggaccggcagguccaaaugggcccccugggcccgccggaagucggggcgacggugggccaccuggaaugacuggcuuccccggcgcugcagggcguaccggaccaccggguccuucuggcaucuccgggcccccaggacccccuggcccagccgguaaagaggggcucagaggacccaggggcgaucaaggcccuguagggcgcacaggagaaguuggugcggugggcccgccaggguuugcuggagagaagggccccagcggugaagccgggaccgcaggaccuccaggcacgcccggcccucaggggcuucugggagcccccgguauuuugggccuaccagggucgcggggagagagaggccugccgggugucgcuggggccgugggcgaaccuggaccccucggcaucgcagggccaccuggagcuaggggucccccaggcgccgucgggucuccuggagugaacggcgcgcccggugaggccgggcgagacggcaauccgggaaacgauggcccaccugggcgcgacggacagcccggucacaaaggcgagcggggguauccaggaaauauaggccccguuggugcagcuggcgccccugggccgcauggaccagugggccccgcugggaagcacggaaacagaggcgaaacugguccuuccgggcccguaggaccagcaggcgccgucgguccuaggggccccucagggccacaggggauucguggcgauaaaggggagccuggagaaaagggcccgcgcggucugcccgggcuuaagggacacaauggccugcaagguuugccaggcaucgccgggcaucacggagaccagggcgcuccugggagugugggacccgcgggcccacgggguccugcagggcccagcggaccggccggcaaagauggcagaacagggcauccaggaaccguugguccugcuggcauuagggggccccagggacaccagggcccagccggucccccugggcccccaggaccuccggggcccccaggcguguccggcggagguuacgacuucggcuaugauggggacuuuuaccgagcagaccaaccucggucugcccccagccuccgcccaaaggauuaugaggucgacgcuacucugaaaucauuaaacaaucagaucgaaacacugcuaaccccugagggaaguagaaagaaccccgcgaggacgugccgggaucuccgacugucccacccggaguggagcucuggcuacuauuggaucgacccuaaucaggguuguaccauggaugccauuaaaguguacugcgacuucucaacaggggaaacuuguauaagagcacagccagagaacauccccgcuaagaauugguaccgcaguagcaaggauaaaaagcauguauggcuuggagaaaccauuaacgccggcucccaauucgaguauaauguggaaggcguuacaucuaaagagauggcaacucaguuggccuuuaugaggcugcucgcuaacuacgccucgcagaacaucaccuaucacugcaagaauagcauagcguacauggacgaggaaacagggaaccugaaaaaggcagucauucuucagggauccaaugauguggagcugguggccgaagguaacucacguuucaccuauacugucuugguugacggcuguaguaagaaaacgaaugagugggggaagacaaucaucgaguacaaaaccaacaagccuucucggcucccauuucuggauauugcucccuuagacaucggaggcgccgaucaagaguucuuuguggacauugguccugugugcuucaaauga

SEQ ID NO: 54633 - RNA, 3855 nt, Artificial Sequence
  derived and/or modified sequence opt3 from COL20A1__Homo_sapiens__NP_065933
augagcuccggcgaccccgcccaccuggggcucugccuuuggcugugguugggagcuaccuuagguagagaacaggugcaagcaucuggccugcuaaggcucgccguccugccugaggaucggcuucagaugaaguggcgcgagucagaagggaguggacugggcuacuugguucaggugaaaccaauggcgggugacagcgagcaggaaguaauccucacaacuaagacgccgaaagcuaccgucgggggacugucccccucuaagggcuauacacugcaaauuuucgagcucacuggcucggggcgauuuuuacuggcccguagagaguucgugauagaagaucuuaaaucaagcaguuuggacagguccucucagcggccucugggaagcggugcaccagagcccaccccuucccauacaggcucaccagaucccgaacaggccagugagccucagguggcuuuuaccccaagccaagacccgcgcacucccgcagggccucaguucagaugucuaccacccguuccugccgauaugguguuucucgucgacggaucuugguccaucggccacucacauuuccaacaggugaaggauuuucuggcuagcguaauugccccauucgagaucggucccgacaagguucagguggggcuuacacaguacaguggagaugcgcagaccgaaugggaccugaacucuuuguccacgaaagagcaaguccucgcagccgugaggcggcugcgcuauaagggcggcaauacuuuuaccggguuagcucugacacacgugcucggacagaaccuucagccggccgcaggucugcgaccugaagcugccaaagucguuauuuuggugacugauggcaagagccaggacgacguacauaccgcggccagagugcuaaaagaucugggggucaauguguucgcaguuggagugaagaacgcugacgaggccgaacucaggcugcuugcuucgcccccacgggauaucacaguccacucugugcuggacuuuuugcaacucggcgcccuggcagguuuacugucccgucuaauaugccagcgccuccaagggggcucaccuagacagggacccgccgcugcgccagcacuggauacccuucccgccccuacgaguuugguacugagccagguuacuuccucuagcaucaggcucucauggacaccagcuccgcggcacccccugaaguaccuuauuguguggcgagccagucgcggcgggaccccuagagaggucguggucgagggaccagcagccuccacugaacugcauaauuuggcuagcaggacagaguaucucgugucuguuuuccccaucuacgaagguggcgugggggagggacugcggggcuuaguaaccacggccccucugccacccccgcgcgcacuaacccucgcggcugucacaccuagaacugugcaccugaccuggcagccaucagccggugcaacacauuaucuuguuagguguagucccgccagcccuaaaggggaagaggaggaacgugaggugcaggucggccggcccgaaguguugcuggacggacucgagccaggccgagauuacgaaguauccgugcagucucugagagggccugagggaucggaggcuagggguauucgcgcccggacucccaccuuagcaccaccgagacaccugggcuuuagcgacguuucccacgaugcugccagggucuucugggaaggggcgccucgccccgugcgacuugugcgggucacauacguuucaagugagggaggccauucuggucaaaccgaagccccagggaacgcuacuagcgcaacguugggcccccucuccucaagcacaaccuauacugugcgugugaccugccuguacccuggaggcgggucuuccacacuaaccggaagaguaacuacaaagaaagccccaagucccagccagcugucuaugacggagcucccuggcgacgcuguccagcuggccuggguggcagcggccccguccgguguucuuguguaucagaucaccuggacuccauugggggagggaaaggcucacgaaauaucaguccccggcaaucuggguacagccguguuaccuggccucgggaggcauaccgaguacgauguuacaauucuggcauauuaccgcgacggagcucggagugacccagugagccuuagauauacucccucgaccguauccaggucuccuccgagcaaccuggccuuggcaucagaaacgcccgauagucuccaagucuccuggaccccaccucugggccgagugcuacacuacuggcugacauacgcccccgcuucugggcucggaccagagaaaagcguguccgucccuggcgcgcgcucacauguuacucugcccgaccuucaggccgcaaccaaguaucggguguugguaagcgcuaucuacgccgccgguagaagugaagcugugucugcaacagggcagacugccuguccagcgcugaggccggauggauccuuaccuggcuucgaccucauggucgcuuuuagccugguggagaaagccuaugcaucgauucgugguguugccauggagcccucagcuuucggcgggaccccaacguuuacacuuuucaaggaugcacaacugacccgccgggugucugacgucuaccccgccccucuaccacccgaacacacuaucguguuucucguuagacuguugccugagacaccgagggaagcguucgcucuguggcagaugaccgccgaggauuuucagccauuacucggagugcugcuugacgcaggcaagaaaagucugacuuauuuccaccgagauccccgggccgcuuugcaggaagccaccuuugacccucaagagguccgcaagaucuucuuuggguccuuccauaaaguacacguggcaguuggaagaagcaaggugaggcucuacgucgauugccggaaaguggcugagcgaccccugggcgaaauggguucucccccugccgcgggguuuguaacacuaggaagacuggccaaggcacgcggccccaggagcuccucagcugccuuccagcuucagaugcuccagauuguguguagugacacgugggcugaugaggaccguugcugugaacugccagcaagccgggacggugagaccugcccugccuucgucucugccuguuccugcucaagugaaacuccgggcccaccagggccucaaggacccccaggcuugccugggagaaauggaacacccggcgagcaggguuuuccggggccaaggggaccucccggcguuaagggcgagaaaggggaucauggacugccagguuuacagggccaccccgggcaccagggaauaccuggccgcgugggucuccaagggccgaagggaaugcgaggccuggaaggcaccgcugggcuucccggaccaccuggucccagaggcuuccaggggauggcgggagcacggggcacaagcggugagagggggccuccaggaacugugggccccaccggccugccugggccaaaaggagaacgcggugagaagggcgagccccaguccuuggccacgcucuaucaacuggucucucaggcuucgcaugugagcaaauuugacucauuccacgaaaacacacguccgccuaugccaauccuagagcagaagcuggaacccgggaccgagccucuuggauccccaggcacuagaaguaaggcccucguucccggugaaugggggcggggaggcaggcaucuggagggccgcggggagccgggagcaguaggucagaugggcucuccugggcaacagggagccagcacccagggcuugugggaauga

SEQ ID NO: 54634 - RNA, 2874 nt, Artificial Sequence
  derived and/or modified sequence opt3 from COL21A1__Homo_sapiens__NP_110447
auggcccacuacaucaccuuccugugcauggugcucguccuucuguugcagaacagcguuuuagcugaggacggcgaagugagauccucuuguaggacagcacccacugaucugguauuuauucuagacgggucauauagugugggaccugagaauuucgaaauagucaagaaauggcucgugaacaucacgaagaauuuugauauugguccaaaauucauccaaguuggcgugguccaguacagcgacuauccggugcuggagauuccccuuggguccuacgauucuggagaacaucugaccgccgcgguagagucgaucuuguaucucggcgguaacacaaagacugggaaagcuauacaguuugcccuggacuaccuguucgcaaagucaagccgguuucucaccaagaucgccguuguguuaacagauggaaaaagucaggacgaugucaaggacgcugcacaagccgcucgcgauuccaaaauuacccuguucgccaucggcgugggcucugagacugaagacgcggagcuucgagcaauugccaauaagccuagcuccacauauguguuuuacgucgaagauuacaucgcuauaucaaaaauucgugagguuaugaagcagaaguugugcgaggaaaguguguguccaaccagaauccccguagccgcaagggacgagcggggguucgacauucugcuaggacucgaugugaacaaaaaggucaaaaagcgcauccagcugagcccuaaaaagaucaaagguuaugaagugacgucuaagguugaccuuuccgagcugacuucaaauguguuuccagaaggcuugcccccuagcuacgucuucgugaguacccagagauuuaaggugaaaaagauuugggaucucuggaggauacugacaaucgacgggcggccacaaauugcuguuacuuuaaacggaguggauaaaauccuccuguucaccacaaccucugucauaaauggcucccagguggucacguucgccaacccgcagguaaagacucuuuuugacgaggguuggcaccagauucgccuguugguuacagagcaagaugugacccuauauaucgacgaucagcagaucgaaaauaaaccccugcauccuguacucgggauucugaucaacggacaaacucagauuggcaaguacagcggcaaggaggaaacaguccaguucgacgugcagaaacuucgaauauauugcgauccagagcaaaauaacagagaaaccgcgugugagauccccggguuuaauggagagugccugaacgguccuucggacguuggcucuacgccagcccccuguauuugcccgccugggaagcccggauugcagggcccaaaaggugacccugggcuccccggcaacccaggauaccccggccagccugggcaggauggaaagccagguuaucaaggcaucgcagggaccccgggagugcccggcuccccugguauccagggggcuaggggccugccaggauacaaaggcgaacccgggcgggacggagauaagggugaccguggcuuaccuggguucccaggacugcacggcaugcccgguucaaagggggagaugggcgccaaaggagauaagggcaguccgggguuuuacggcaaaaagggagcuaaaggugaaaaggggaaugccggauucccuggccuaccaggucccgcaggcgagccugggcgccauggaaaggacggccucauggggagccccggauuuaaaggcgaagccgguuccccaggggcuccuggacaggauggcacaagaggugagcccggcauuccaggguucccgggaaacaggggccugauggggcagaagggagagauaggcccucccggucaacaggggaaaaagggagcgccaggcaugcccggucuuaugggcucuaaugggagcccuggacagccaggcacucccgggucaaaaggaaguaagggcgaaccugguauccaggggaugccgggagcauccggcuugaaaggcgagccaggggccaccggaagccccggugaaccuggcuauauggggcugccaggcauucaaggaaagaagggugacaaagggaaccagggagagaagggcauccagggccaaaaaggggagaauggacggcaggguauucccggccagcaggggauccaaggacaccacggcgcuaagggugaacgaggggagaaaggagaaccuggcguccgcggcgccauagggucuaagggagagucagguguggauggccucauggggccggcaggacccaagggccagccaggugacccugggccccagggaccaccuggccuggauggcaaacccgggagagaauuuagugagcaguucaucaggcaaguauguacagacgugauucgggcccagcuuccaguucuguugcagagcggacgcaucagaaacugcgaucauugucucucccagcacgguucuccgggcauuccugggcccccaggacccaucggcccugaggguccaagggggcugcccggauuaccuggccgugacggcgucccggggcuggugggagugccaggucggcccggcguccgagggcuaaagggacucccuggcagaaauggugaaaaagggucgcaaggcuuuggauaccccggcgagcaggggccaccuggacccccagguccugaaggcccgcccgggauaagcaaggagggaccaccuggcgaccccggucugccagggaaagauggcgaccauggaaagccuggcauucaggggcaacccggaccgccagguaucugcgauccuucccuuugcuucucaguuauugcuaggcgcgaccccuuucggaagggcccaaacuauuga

SEQ ID NO: 54635 - RNA, 4881 nt, Artificial Sequence
  derived and/or modified sequence opt3 from COL22A1__Homo_sapiens__NP_690848
auggccggccugagagggaacgcuguggcaggacuccuuuggaugcuguuguuauggagcgguggcgggggaugccaggcccaaagggcgggcuguaaguccguccacuacgaccugguuuuccuacucgauaccucuucaaguguggguaaagaggacuuugaaaagguacggcaguggguggcuaaucuggucgauacauucgagguggggcccgaccgcacucgaguuggagugguccguuauagcgauagaccuacgaccgccuuugaacuuggccuguucggcucccaggaggaagugaaagcagccgcuaggcgguuggcauaccaugggggaaacacaaauacuggugacgcccuccgcuauaucaccgcuagaucuuuuucgccacacgccggcgggaggccgcgggaucgcgcguacaagcagguagcaauucugcugacagacggacgaucacaagaucucguuuuagacgccgcugccgcagcucauagagccggcauaaggaucuucgcggugggugucggggaggcccugaaagaggaacuugaggaaauugcaagcgagcccaagagugcucacguguuucauguguccgauuucaacgccaucgacaagauucggggaaaauugcgucgcagacugugcgagaauguccuauguccuucuguuaggguggaaggcgaucgguuuaagcacaccaacggcgggacuaaagagaucacaggauucgaccucauggaccuguuuagcguaaaggaaauacuugguaaacgagagaauggcgcucaguccucauaugugcgcauggggaguuucccagucgugcagagcaccgaagauguuuuuccccagggacugccugacgaguacgccuucgugacgacuuucagauuuaggaagaccucucggaaggaggauugguauaucuggcaagucauugaccaguacuccaucccacaggugucaauucgcuuggauggcgaaaacaaagcaguagaguacaaugccguuggugcuaugaaggacgcggugagagucguguucagggggagccgugucaacgaucucuuugaccgggauuggcacaaaauggcacugaguauccaggcccaaaaugugucuuuacauauagacugcgcucugguucagacacuccccauugaggaacgagaaaacaucgauauucagggcaagacugugaucggaaaaagacuuuaugacuccguaccuaucgacuucgaucugcaaaggauugucauauacugugacagccgccacgccgaguuggagaccugcugugauaucccaucgggcccgugccaggugacaguugugaccgaacccccuccacccccuccaccccagcggccgccuacgcccgggucugagcagauuggauuucuaaagacuaucaauuguuccugcccagccggugaaaaaggcgagaugggggucgcaggaccuaugggccugcccgguccaaagggggacauaggcgcuauuggacccgugggcgccccugggccaaagggagaaaaaggugauguaggcaucgggccguucggacaaggcgagaagggugagaaagggucacucggccugcccggaccuccaggcagagacgggaguaagggaaugaggggcgaacccggugagcuuggggaaccuggacugccaggcgagguggguaugcgcggcccccaggggccgccuggauugccaggacccccugggcgaguuggagcacccggccuccagggugagcggggcgaaaaaggaacacguggcgagaagggugaaagaggccuggauggguuuccaggaaagccuggcgacaccgggcagcaaggaaggcccggcccaagcggugucgcggggccgcagggagagaaaggcgauguggguccugcuggcccacccggggugcccggauccgucguucagcaggaaggcuuaaagggggagcaaggagccccuggcccacgcggucaucagggggcacccggaccuccgggcgcccggggcccaaucgggcccgagggaagagacgguccuccaggccugcaggggcuaaggggcaaaaagggcgauaugggucccccugggauuccgggacuccugggccuucaggggcccccagggccucccggagugccagguccucccggcccagggggaucuccgggcuugccuggugaaaucggguuccccggaaaaccagggcccccuggcccaacugggcccccuggaaaggacgguccgaacggcccacccgggccucccggaacaaagggcgagccaggugaacgaggggaggauggacugccuggcaaacccggccuccgcggggaaauuggagagcaaggucuggcuggccggccaggggagaagggagaagccggccuuccuggugcaccgggguuucccggagugagaggcgagaaaggcgaccagggggaaaagggagagcuggguuugccaggccucaaaggggacaggggagaaaagggcgaggcugguccugccgggcccccaggccugccuggaaccacgagcuuauucacaccccacccgcguaugccaggcgagcaggggccuaagggagaaaaaggugaucccggccugccaggggagcccggacuacaaggccgcccuggugaacucgggccgcagggccccaccggaccaccuggcgcgaaggggcaggagggagcccacggugcucccggcgcagccgggaauccuggagcuccaggccauguaggugcccccgggccuucaggcccacccggaagugucggcgcaccggggcugcggggaacuccuggcaaagacggugagagaggggaaaagggagcggccggcgaggaagguuccccaggccccguggggccuaggggagauccaggcgcucccgggcuuccgggaccucccggcaaagguaaggacggggagccaggauugcgaggcagcccuggucugcccggcccacucgggaccaaagccgcauguggaaagguucggggcucugaaaacugcgcucugggcggacagugcgugaagggcgaucgcggugcccccgggauaccuggaucaccaggcaguagaggcgacccggggaucggagucgcaggucccccuggcccaagcgggcccccuggagauaaaggcuccccagguucuaggggguuacccggauuuccuggcccgcaaggcccagccgggcgggacggagcucccgguaacccuggcgagcgagggcccccaggaaagccuggccugucgagccuuuugucccccggugauauuaaucuccuggcgaaagacguguguaacgauugcccaccggggccucccggacuaccaggccugcccggcuucaagggggacaaaggaguuccugguaagccaggcagagaggggacagaaggaaagaaaggcgaggccggucccccugggcucccgggaccacccggcaucgcaggcccucaggggucacagggagaacgcggugcugauggcgagguggggcagaagggagaccaaggccacccagguguacccggguuuaugggaccucccggcaauccaggcccgccuggggccgacggaaucgccggugcugcagggcccccaggcauucagggaaguccuggcaaagaaggucccccagggccucagggacccucuggccugccgggcauaccaggggaggagggaaaggaagguagggauggcaaaccugggcccccaggagagcccggcaaggccggugaaccugggcuuccgggcccagagggagcgcgugggcccccuggcuucaagggacauacuggugacagcggcgcucccgggccacggggagaauccggcgccauggguuugccugggcaggagggccugcccggaaaagauggcgacaccgggccaacaggaccucaagguccgcagggccccagagggccaccuggaaagaacggcucacccgguagcccaggcgagccugggcccucuggaaccccgggccagaaaggguccaagggagaaaauggcaguccagguuuaccuggguuccucggacccaggggcccacccggugagccuggcgaaaaagggguccccggaaaggagggcgugccagggaagccuggagagccgggcuuuaaaggugaacgcggggaucccggaaucaagggcgacaaagguccaccuggcgggaagggacaacccggcgauccagggauuccuggacacaaaggccauacuggucugauggggccccagggacuuccgggcgagaacggcccuguggggccacccggaccuccaggucagcccggcuucccugggcugcgaggagaaagcccaucuauggagacguugagacggcucauccaggaggaacugggcaagcaacuagagacaaggcuggcauaucuccuggcccagaugcccccggcuuacaugaaauccucacagggucgcccugggcccccaggacccccuggcaaggacggccuuccagggcgugcaggacccaugggugaaccuggcagaccagggcagggaggcuuggaggguccgagugggcccauuggaccuaagggcgaacggggcgccaaaggggauccaggagcgcccggugucggccugcgcggggagaugggaccuccaggcauccccggucaaccgggggaaccuggauaugcuaaggacggcuuaccaggcauacccgggccucagggagagaccggucccgccggccacccagggcucccgggaccucccggcccacccggucagugugauccuagccagugcgcauacuuugccucgcuggcugccaggccagggaauguuaaaggacccuga

SEQ ID NO: 54636 - RNA, 1623 nt, Artificial Sequence
  derived and/or modified sequence opt3 from COL23A1__Homo_sapiens__NP_775736
augggccccggggagagagccggagguggcggggacgcuggaaagggcaacgcagccggugggggaggcggcgggaggagcgcgaccacagcuggaucccgggccgugucugcacugugccuccuucugucagucgguagugccgcugcauguuuguuacugggcguucaggccgcugcccuacaagggcgcguggcggcacucgaagaggaacgagagcugcuucguagagccggaccuccaggcgcucuggaugccugggcagaaccgcacuuggagaggcuccugcgggagaaacuggacggucucgcuaagauccgcacugccagagaagcgcccagcgagugcguauguccuccagggcccccuggaaggcggggcaaaccaggccgccgaggggaucccggaccuccaggucaguccggcagagacggguacccgggacccuuaggccuggaugguaagccugggcuuccaggccccaaaggagaaaagggcgccccuggggacuucggaccaaggggugaucagggccaggacggggcagcuggacccccgggcccucccgguccaccuggggcccggggacccccaggcgauacgggcaaggacgggccccguggagcucaagguccugccggcccaaaaggggagccgggacaggauggcgagaugggucccaaggggccuccaggccccaaaggagaaccuggcgugccagggaagaaaggagacgauggcacccccucucagccggguccuccagggcccaagggagagccuggcucgauggguccccgcggcgaaaauggggucgacggagcaccaggcccuaagggggagcccggacauagaggcacagacggugccgcugggccaaggggagcgccgggcuugaaaggugaacagggcgauacugugguuauugacuaugaugggcggauacuggacgcacuaaagggaccucccggcccacaagggcccccuggaccacccggcaucccuggugccaaaggggagcucggacugccgggcgcuccagguauugauggcgagaaggggcccaaaggacagaagggcgacccuggggaaccaggacccgccggccuuaaaggugaggcaggggaaaugggacugucaggcuugccuggcgccgaugggcucaagggagagaagggugaaagcgcuagugacucccugcaggagucuuuagcccagcugaucguggagccggggcccccaggcccucccggaccaccuggccccaugggucuccaagggauucagggaccaaaaggccuugauggcgcaaagggggaaaaaggagcgagcggugagcgaggcccguccgggcugccuggacccgucggcccacccgguuugaucgggcuaccuggaaccaagggcgaaaaaggccgcccaggggagcccggacuggacgguuuuccuggcccgagaggggaaaagggagauaggucagagcggggcgagaagggugaacgcggggugccaggaagaaaaggcguaaagggccagaaaggggagcccggaccucccggucucgaccaaccaugcccuguuggccccgacgggcugccagugccuggauguuggcacaaguga

SEQ ID NO: 54637 - RNA, 5091 nt, Artificial Sequence
  derived and/or modified sequence opt3 from COL24A1__Homo_sapiens__XP_011539493
augcaucugcgggcccacaggacccggcgcggaaaggugucacccacagcuaaaacuaagucccuccuucacuucaucguccugugcguugcaggggugguugugcaugcccaggagcaaggaauugacauauugcaccaguuaggucugggcgggaaagauguccgacauucuagcccugcgacggcugugccaagugccagcaccccgcuaccccagggaguucaccucacagaauccggcgugaucuuuaagaacgacgcauacauugagacuccuuucgucaaaauccugccagugaaucuuggucagcccuuuaccauucugacaggguugcaaucucaccguguaaacaaugccuuccucuuuucgaucagaaacaagaauaggcugcagcugggaguucagcucuuaccuaagaaacuggugguccauauacggggcaagcagccagcuguguucaacuauucagugcacgaugaacaauggcauagcuuugcaaucaccauucgcaaucagagugucuccauguucguugaguguggcaaaaaguacuuuucuacugaaacaauccccgaggugcagaccuucgacagcaacuccguauuuacgcuugggucaaugaauaacaauaguauucacuucgagggaaucgugugccaguuggauauaauuccuagcgccgaggcuucugccgacuauuguagauacgucaaacaacagugcaggcaggcggauaaguaucaaccagagacuuccaucccguguaccacacugauucccacuaagaucccugaacacucaccacccccuaaacuauuugcagagaaggugcucagcgaggacaccuucacagaagguaaaaguaucccaaacauuauaaagaaugauucugagaccguuuacaaacggcaggaacaucagaucucccgcagccagcugucgucucuucaauccggcaacgugucagccgucgaccugacgaaucacgggauucaggcuaaggagaugaucacugaagaggauacacagaccaacuucaguuugagcgugacuacacaucgaauauccgaggccaaaaugaacaccaaggaaaaguuuucuagccuccugaauaugucagacaacauuacgcagcacgaugacagaguaaccggauuaagucuguucaaaaagaugcccuccauccucccgcaaaucaaacaggacacaauuacuaaucuuaagaaagcaaucaccgcuaaccugcauacaaaugaguugauggaaaugcagccuauucuaaacacuagccugcacaggguuaccaaugagcccucuguggauaaccaccucgaccugcggaaggaaggcgaguuuuauccagaugccacauacccuauagaaaauucauacgaaaccgagcuuuaugacuacuauuacuaugaagaucugaacacuauguuggagauggaauaccuccguggucccaagggggacacgggaccacccggcccuccaggcccggcggggauccccggaccuagugguaaacgcggcccaagagggauucccggaccucauggcaauccaggucugcccggguuaccgggcccuaagggaccaaaaggcgaucccggguucagcccuggacagcccgucccaggugagaagggcgaccaagggcuguccggacuaaugggcccucccgguaugcagggggauaaaggccucaagggacacccaggccugccggggcuuccuggagagcaggguauccccggcuuugccgggaacaucggaucuccaggcuaucccgguaggcagggguuggcaggcccugaaggaaauccaggccccaagggggcucaaggauucauuggcucgccuggugaggccgggcagcugggaccggaaggcgagcgggguauaccaggcauccgagggaaaaagggauuuaaaggccgccagggguuccccggagacuuuggcgauagagguccugcugggcucgacggaagcccaggccugguggguggcacagggcccccuggauucccgggccuuaggggguccgucggacccgugggcccaauugguccugccgggauccccggaccaaugggccugucagguaacaagggcuugccugggauuaaaggagacaagggcgagcaagggaccgcaggagaacucggcgagcccgguuacccaggggauaagggagccguuggccugccgggcccucccgggaugcggggaaaaagugguccaucuggccagacuggggaccccggauuacagggcccuagcgguccacccgggccugaaggauuuccgggcgauaucggcauaccagggcagaauggacccgaggguccuaagggccugcuagggaaccgcggacccccaggcccucccggucucaaagggacccaaggagaagagggcccaaucggcgcuuucggggagcugggaccuagagguaagccgggccagaaaggguacgcgggagaacccggcccagagggucuuaagggggaagugggagaccagggcaacauuggcaaaaucggggagacaggaccuguagguuugcccggcgaagucgggaugaccggauccauuggcgagaagggugagagggggucaccaggaccucugggcccccagggcgaaaagggggugaugggauauccggguccaccuggcguucccgggccaaucggaccccucggccugccugguagccgugggccggauggcuuacugggagagcaaggcauacagggggcaaaaggagaaaagggugaccagggcaaacgggggccccauggacuuauuggcaagacugguaauccaggggagcgaggcuuucagggaaaaccuggcuugcaagggcuccccggaucuacaggugauagaggccugccuggggaaccaggacuaaggggccugcagggugacguggggcccccuggcgagaugggaauggagggcccacccgggacggaaggagaguccggccuccagggugaaccgggggccaagggagaugucggcaccgcugguagugugggcgggacuggagagccuggccugcgcggggagccaggagcccccggcgaagagggucuucaagggaaggacggauugaaaggcguaccugguggccgggggcugccaggagaagauggcgagaagggggaaaugggauuacccggcaucauugguccgcucgggagaagcggacagacaggccugccuggccccgaggggaucgugggaauaccaggucagaggggccgcccugggaaaaagggagacaaaggccagaucggucccaccggggagguuggaucucgaggcccacccggcaagauugggaaguccggaccuaaaggugcacggggcacacguggggccgucggacaccuuggccugauggguccagauggggaaccgggaauccccggcuacagaggccaccaagggcagccuggaccaucagguuugcccggcccuaagggggagaaaggauauccaggcgaagacaguacugugcucggucccccugggccgaggggagagccaggccccgugggcgaccagggggaacgcggagagccuggugcugagggcuacaaggggcaugucggaguucccggccugcggggugccaccgggcagcaaggaccaccuggcgaacccggcgaucagggggagcagggacuaaaaggugaaagaggcagcgaggggaacaagggaaagaaaggcgcaccagguccgucggggaagccuggcauucccggccugcagggccuccuggggccaaaaggaauccaagguuaucacggcgcggacgggauauccggaaaucccggcaagauugguccuccagggaaacagggccuucccggaaucaggggcgggccuggacgaacggguuuggcuggcgccccggggccacccggagugaagggcucuagcggucugccugggucaccaggcauccagggacccaaaggcgaacagggguuaccuggacaacccgguauucagggcaagcgcgggcaucggggagcacagggcgaucaagguccaugcggcgacccggggcucaagggacagccuggcgaguacggggugcagggacugaccggcuuccaggguuuccccgggccaaaaggaccugagggcgaugccgguaucguaggcauuagugggcccaagggaccaauaggccacagagggaacacaggaccucuuggcagggaagguaucauugggcccacuggacguaccggcccgcgcggugagaaaggcuuuagaggggaaacaggaccacaaggcccuagagggcagcccggaccacccggcccuccgggugcuccagggcccaggaagcagauggacaucaaugccgcaauucaggcucugaucgaguccaacacugcccuacaaauggagucuuaucagaauaccgaagucacgcucauagaucauagcgaggaaaucuucaaaacacugaacuacuuguccaaucuguuacacucaauuaagaacccucucggaacccgagacaaucccgcgcggaucuguaaggaucugcuuaacugcgagcagaaagugagcgacggcaaguacuggauugauccaaaucugggcuguccuagugacgccaucgaaguauuuugcaacuucucugcugggggacagacuuguuugcccccaguguccgucacaaaacucgaguuuggugugggcaagguucaaaugaauuuccugcaccuacugagcucggaggcaacccauauaauuacuauccacugccuuaacaccccucgcuggacaucaacgcagaccucugggccgggacuccccaucggcuuuaaagguuggaacgggcagauuuucaaggugaauacucuguuggaaccaaagguacugagugaugacugcaaaauacaagacggauccuggcauaaggccacauuuuuauuccacacccaggagccuaaccagcuccccgucaucgaagugcagaaacugccacaucuuaagacagagagaaaauauuacauugauagcucuagcguguguuuucuguga

SEQ ID NO: 54638 - RNA, 1938 nt, Artificial Sequence
  derived and/or modified sequence opt3 from COL25A1__Homo_sapiens__NP_001243003
augcugcucaagaaacacgccggcaagggcggagguagagagcccaggagcgaagacccuaccccagcugagcagcauugcgcacggacaaugccgcccugugccgugcuugcggcucuguuguccgucguugccgugguaucuugcuuauaccugggcgugaaaacuaacgaucuacaagcacgcaucgccgcucucgaaucagcaaagggggccccuaguauucaucugcuuccagacacgcuggaucacuugaaaaccaugguccaggagaagguggaacgacuccuggcucaaaagagcuaugagcacauggccaaaauacguaucgcgagagaggcacccuccgaauguaauugcccugccggaccacccggcaagagggguaaacgggggcgcagaggagagucuggcccuccaggccagccggggccccagggaccuccaggucccaagggcgacaaaggggaacagggagaucagggcccuaggggucugccaggguuccccacaguugcugcccuccauucgaaccagauuuuaacugugaagggagaccaaggccaggcaggcccgccugggcccccaggaccucccgguccacgggggcccccuggggauaccggaaaggacggcccacgcgguaugccggggguccccggcgagccuggaaaaccaggcgagcaggggcugaugggaccccuugguccuccaggccagaaggggucaaucggagcucccggcauuccggguaugaaugggcaaaaaggcgaaccuggauugccaggcgccguggggcagaacggaauccccgguccuaagggcgagcccggggaacagggagagaaaggcgaugcgggugaaaaugggccaaagggcgacacaggagagaaaggcgauccugggagcagugccgcaggaauaaagggcgagcccggugaauccgggcgaccaggacaaaagggcgagccgggucugccuggccuacccgggcucccaggaaucaaaggcgaacccggguuuauuggaccucagggcgagccaggucugcccgggcuuccuggaaccaagggcgaaagaggugaggcuggcccgccagggaggggagagcggggcgaacccggggccccuggaccaaaaggcgaccguggugagaagggggauucuggagcucagggcccccgcgguccuccgggccagaaaggggaccaaggagccacugaaaucauugacuacaacggcaaucugcacgaggcauugcaggggcccccaggaccucccggcccacagggucuccaggggccuaagggagaacaaggcagccccggcaucccagggauggauggagagcagggucugaagggcuccaaaggggacaugggagauccgggcaugacaggugagaagggcggaauaggcuuaccuggccugcccggggccaacggaaugaaaggugaaaagggcgacucagggaugccaggaccccagggcccuaguauuaucgguccacccgggccuccgggaccacacgggcccccuggccccauggggccacauggacucccuggucccaaaggcgagccagggcuuaauggaguaaagggccugaagggugaaccugggcagaaaggagauagaggcccguugggccuacccggggcuagcggacuggacgguaagccaggcucuagggggaccgauggaccuaugggcccccacgguccagcggggccuaaaggagagcggggcgagaagggcgcaaugggggaacccggaccgcgagguccauauggccucccuggguuccccggaccacgcggcgagaaaggugaccugggggaaaagggcgagaagguuacgucccccucacaacaugugccuugucuuauucuguugcuccugagcgccuuacuguuuagucuaugcgauucuaucuga

SEQ ID NO: 54639 - RNA, 1326 nt, Artificial Sequence
  derived and/or modified sequence opt3 from COL26A1__Homo_sapiens__NP_001265492
augaagcuggcccuccuucugcccugggcuugcuguugcuuguguggcagcgcauuagccaccggguuccuguacccuuuuuccgcggcugcccuacagcaacacggauauccagagccgggugcaggcucucccgggucaggauacgccaguagaaggcauuggugccaccauacagugacucggacggucagcugucagguucagaacggcuccgaaaccgugguacagcgcguguaucaaucuugccgauggccugguccaugugcuaaucucgucucguaccguacacugaucagacccacuuauagggugucauaccggaccguuacagugcuugaguggcgcugcuguccuggguucaccggaagcaacugcgacgaagaguguaugaauugcacuagacugagugauauguccgaaagguugacaacccucgaggcaaaaguccugcugcucgaggccgcugaacggccaucuagccccgacaacgauuuaccugccccagaguccacgccgcccacuuggaaugaagacuuucugccugaugcgauuccacuugcacaccccgugccucgccagcgaagaccaaccggccccgccggcccgccugggcagacaggacccccagguccugcugggcccccagggucaaagggagacaggggccagacuggugagaaagggcccgccggaccuccaggcuugcugggcccgcccgggccucggggacuaccaggugagaugggccgucccgggccuccaggacccccgggcccugcagguaacccagggcccaguccuaauagcccccaaggcgcucucuauucucugcagccaccuaccgauaaggacaacggagauucccgccuugccucagcgauaguagacacaguucuggccggcgugcccgggccaagaggaccgccuggucccccagggcccccuggcccaaggggacccccuggcccgccagguacccccgggagccagggcuuggcaggagaacggggcacggucgggccuaguggagagccaggugugaaaggcgaagagggggaaaaggcugccacugcugagggagagggcgugcagcaacuccgagaagcccugaagaucuuagcagagcgcguccugauucucgaacauaugaucgguauucacgauccccuugccucuccugagggcggcuccggacaggacgcugcgcugagagcaaauuugaaaaugaagaggggcggggcccagccggauggaguucuagcugcccugcucggccccgacccaggucagaaaagcguggaccaagcaucgucucggaaguga

SEQ ID NO: 54640 - RNA, 5583 nt, Artificial Sequence
  derived and/or modified sequence opt3 from COL27A1__Homo_sapiens__NP_116277
augggcgccgggagcgcuaggggcgcaagggguaccgccgcggcugccgcagcccggggcgggggauuccuguuuuccuggauccucgugucuuucgcuugccaccuugcaucaacacagggcgcccccgaggacgucgauauucugcaacgcuuggguuuaaguuggacuaaggcugggagcccugccccaccgggaguuauacccuuucaguccggcuucaucuuuacgcagcgagcgcgucugcaggcaccuaccggcacagugauuccagccgcucuagggacugaacucgcccugguacuuucucuguguucgcauagagugaaccacgcauucuuguuugcugucaggucacaaaagcggaagcuccagcugggacugcaguuccuccccgguaaaaccgugguucauuuaggcagccgcagaaguguggccuuugaccuggauaugcacgacgggagguggcaucaccuugcguuggagcugcggggacgcacagucacccuagugacugccugcggccagcgaagaguaccuguucuccugccauuccacagggaucccgcacuugacccugguggguccuuucuguucggaaagaugaauccacaugcugugcaauuugaaggcgccuugugucaguucucuaucuacccggucacacagguggcucacaacuauugcacccaucuccggaaacaguguggccaagccgauacguaccagagcccccuggggccuuuauucucccaggacucaggacguccauuuacuuuccaaagugaucuggcacuccuuggucuggagaauuugaccacagccacucccgcucuaggcagccugccugcggggcgcggaccaagaggcaccguggcacccgccacaccgaccaagccucagaggacgucucccacuaacccacaccagcacauggcugucggugggccugcccagacaccccuccugccagcaaaacuuuccgccucaaaugcucuggaccccauguugccugccagcguuggcggaaguacccggacuccacgaccggcagcggcucaacccucucagaaaauuacagccaccaagaucccuaaaucccucccaacgaagcccagcgcaccuucgaccucuauagugccaaucaaaagcccccauccgacacagaagacugccccuucaaguuuuaccaagagcgcucugccaacacagaaacaaguacccccuacuucccgccccgugccagccagagucucuaggccugcagaaaagcccauucagcggaacccaggcaugccgcgcccucccccacccagcaccagaccuuuaccacccacaaccucaaguuccaaaaagccuaucccgacucuggcuaggacggaggccaaaauuacaagccacgcgucuaagccagccucagcucguaccaguacucauaaacccccuccauucaccgcacuaagcuccucucccgccccuacaccggggucgacccggagcacucgacccccagcuacaauggugccucccacguccggaaccucaacuccaagaacagccccugcaguucccaccccagguagugcgccgacaggcucuaagaagccuaucgggagcgaggccuccaaaaaggcuggacccaaaucaagcccaaggaagcccgugccucuccgcccaggcaaagccgcacgggaugucccccugucugaccuuacuaccagaccuuccccgaggcagccacagcccagucaacagacgaccccugcuuuggugcuggcccccgcacaguuucucuccucuuccccacgcccuacaucaagugguuauagcauauuccaccuggccgggucgacucccuuuccacuucugaugggcccuccgggacccaagggcgauugcggguugccaggaccucccggucucccaggccugccugggauucccggagcucgaggcccgcgggguccaccugggcccuacggcaauccaggauuacccggcccuccgggggcgaagggacagaaaggcgaccccggucuguccccagggaaggcccaugacggagcaaaaggcgauaugggucuaccuggccucucugggaaccccggaccuccaggccguaaggggcacaaaggauaucccggcccugcuggucacccaggggaacaaggacagcccggcccggaggguagcccuggcgccaagggguacccaggaagacagggccugcccgggccuguaggagacccaggccccaaggguucaaggggguauaucggacuuccgggcuuguucggucugccuggcagugauggggaacgcggacuccccggcguuccagggaaacggggaaagaugggcaugccugguuuucccgggguguucggagagagaggcccacccggccuggacgggaauccuggagaguuaggucugccaggcccgcccggggucccuggacuuauuggcgauuugggugugcucgggccaaucggauaccccggcccuaaaggcaugaaggggcugaugggauccgucggugaaccaggccuaaaaggggacaagggagagcaaggcgugcccgguguuucuggggauccuggauuucagggcgacaagggcagccaggggcugccgggauucccaggugccaggggcaaacccgggccucucggaaaggugggcgauaaagguuccaucggguuucccggaccaccuggccccgaaggcuucccaggggacauuggaccgccuggugauaacggccccgaggggaugaagggaaaaccaggcgcucgaggucugcccgggccucgcggacagcuuggcccagaaggcgacgaggggcccaugggaccuccgggugcaccaggcuuggaggggcaacccggacggaagggcuucccugguagaccagggcuggacggcguaaaaggagaacccggcgauccugggaggcccggaccagucggugagcagggcuuuaugggguucauaggauuagugggcgaaccggguaucguuggggagaagggcgaccguggaaugaugggcccucccggggugccaggaccuaaggguucaaugggccaucccgggaugccaggaggcauggguaccccuggggaacccggcccgcagggaccaccuggcagccgcgggcccccaggaaugcggggcgccaaagguagaagggggccccgaggaccugauggcccggcgggugagcagggcagucgggggcucaagggaccacccggcccucaagggcgccccggaagaccaggccagcagggugucgcuggggagaggggacaccugggcucucgggguuuuccuggcauucccgggccauccggaccuccgggcacaaaagggcuucccggagaaccaggcccucaggguccccaagggccaaucggaccucccggcgagaugggcccgaaggggccaccuggagccgugggugaacccggccugccaggggaggcaggaaugaaaggcgacuuggguccccucgggacuccuggagaacagggccugauaggccagcgaggggagcccggacuagagggugauagcggcccaauggggccugacggacugaagggcgauagaggugacccggggcccgauggagaacauggcgagaagggccaagaagggcucaugggagaggacgguccaccuggacccccagggguaaccggagugcgcggcccugaggguaaaucggggaagcagggagaaaaaggcaggacgggcgccaagggggcuaaaggauaccagggucagcugggcgagauggggguucccggagauccgggcccuccagguacacccgggccuaagggaucacguggcucucuuggcccaaccggggcacccggacggaugggugcccaaggcgaaccuggguuggcgggauaugacggccacaaggguauugucgggccacugggacccccgggcccuaaaggcgagaagggggaacagggagaggaugguaaagcugagggacccccagggcccccuggagacagaggcccagugggugacagaggggaucgcggcgaacccggagacccuggcuacccagggcaggagggagugcaggguuuacgaggcaagccggggcaacagggacagcccggccacccugguccaagaggguggcccggcccuaaaggaaguaagggcgccgaagggccaaagggaaaacaggguaaggcaggcgcccccgggcggaggggaguccaaggccuccagggucugccgggcccucgcgggguugugggacgucagggccuugaggggaucgcuggaccagauggccugcccgguagagacgggcaggccggacaacagggcgaacagggugaugacggcgauccugggcccaugggaccagcaggcaaacgggggaauccgggaguggcuggccuaccuggugcccaagggcccccaggauucaagggcgaguccggucuccccggccagcuggggccuccaggaaaaaggggcacugaggggcgcacaggauugcccggcaaccagggugaaccugggagcaagggacagccaggcgacucuggcgagaugggguuuccgggaauggcgggucuguucggccccaaagggccuccaggagauaucggcuuuaaggguauucaagggccccgaggaccuccaggcuuaaugggcaaggaagggaucguaggaccccucgguauucugggcccuagcgggcuuccgggacccaaaggcgacaaggguuccagaggggauuggggacugcagggcccacggggcccucccgggccaaggggacgcccuggucccccaggcccgccugggggacccauacaguugcagcaagacgaucucggcgccgcauuccagaccuggauggacacuucaggugcucugagaccagagaguuauagcuaccccgacaggcuaguccuggaucaagggggcgaaaucuuuaaaacccuucauuaucucucuaaucugauucaguccaucaagacaccuuugggcacgaaagagaacccagcccgggugugucgugaccugauggauugcgagcagaagaugguugacggcaccuacuggguggaucccaauuuaggguguucaagugacacuaucgaagucagcugcaacuucacacacggaggucagaccugucucaagccuauuacagcuuccaaaguggaguuugcaauaucucgcguucagaugaacuuccugcaucuucugucgagcgaagugacucaacacaucaccauucauugcuugaauaugacgguauggcaggagggcacagggcagaccccggccaagcaggccguccgauuuagagcuuggaacggacaaaucuucgaggcgggcggucaguucaggcccgaagugucaauggaugggugcaaagugcaggacggacgguggcaccagacucucuuuaccuuccgcacacaagauccacagcagcugccuauuaucuccgucgacaaucuacccccagcaaguucuggcaagcaguauagacuggagguuggcccugccuguuuucuuuga

SEQ ID NO: 54641 - RNA, 3378 nt, Artificial Sequence
  derived and/or modified sequence opt3 from COL28A1__Homo_sapiens__XP_011513662
auguggaacagauacuucguguuuuaucugcuccuucugagcgccuucaccucccagacagucucuggccaaaggaagaaagggcccaagucaaauuuguuagcucggaaaagugacguucagggaagcaucugcuuuauugauauaguguucaucguagacuccucugagucgucaaagauugcacuguuugauaaacagaaggacuucguggauagccuaagugacaagaucuuucagcucacuccuggucgcucccuggaauacgauauuaaacuugccgcgcugcaauucucuagcuccguccagaucgacccaccguuuucaaguuggaaggauuugcagacguucaaacagaaggugaaaagcaugaaccucauaggccaagggaccuuuucuuauuacgcuaucuccaaugccacacgacugcugaagcgugagggaagaaaggacggcguuaaagugguccucuuaaugacugaugguauugaccaccccaagaacccugaugugcagucaaucagcgaagacgcaaggauuagugggaucucuuucauaaccauugcccuguccacaguaguuaaugaggcuaaacuucgguugaucagcggagacucgucuuccgaaccaacccugcuacucucagaucccacucugguggacaagauucaggaucgccuugacauccuguuugagaaaaagugugagagaaaaaucugcgaaugugagaagggcgauccuggcgacccagggcccccuggaacacaugguaacccaggcauuaagggggaaaggggaccgaaaggcaaucccgguaacgcacagaagggggaggccggagagcggggcccuggcgggauaccaggauauaaaggugauaagggcgaacgcggggagugcggaaaacccggcaucaagggugacaaggggaguccuggcccauacggacccaaaggcccgcgagggauucaaggaaucaccgguccucccggcgauccagggccuaagggauuccagggcaauaaaggugaacccgggccacccggcccuuauggaagcccaggcgcuccggggauaggacagcaagguauuaagggcgagagagggcaggaaggaaggcccggcgccccugguccaaucggggucggcgagcccggacagccuggcccacgggggcccgagggagugccgggcgaacgugguuugccuggggagggauucccaggccccaaaggugaaaagggcuccgaggggccuacgggaccccagggccuccaagggcugucuaucaagggagaaaaaggcgacauugguccaguggggccucagggacccaugggcaucccagguauuggcagccagggggagcagggaauacaaggcccgaucgggccucccggaccacagggccccgcgggucagggguuaccuggaucaaagggcgaggucggucagaugggcccaacugggccccgcggaccuguuggcauuggggugcaaggaccgaaaggcgaaccagguaguaucgggcugcccggacagccuggcguaccaggcgaggauggggcagccggaaagaaaggugaagcuggccuccccggggccagaggaccugagggcccgcccgguaaggggcagccaggaccuaagggcgacgaaggcaaaaagggguccaaaggaaaccagggucaaaggggccuucccgggccagagggaccuaagggcgagcccgguaucauggggccauuuggaaugccgggcaccagcauuccugggcccccaggccccaaaggagaccgggguggcccugggauaccaggauucaagggcgaacccggucugucuauccgagggccuaaaggagugcagggcccgcgcggcccagucggggcacccggauugaagggugauggcuacccuggggugcccggaccaagaggccuaccuggucccccagggccuaugggacugaggggcguuggcgacacaggggcuaagggagagccgggugugcgggggcccccaggcccuucaggaccccgcggcgucgguacucaggggccaaaaggcgauaccggacaaaagggccucccugggcccccgggaccaccugguuacggcagucaggggauuaaaggagaacagggcccccaggguuuuccagggcccaagggcacaaugggacacggccugccugggcaaaaaggagagcauggugagagaggcgacguggggaagaagggagauaaaggcgaaaucggugagccggggagccccggcaagcagggacuucagggcccaaaaggggaccugggauugaccaaggaagagauuaucaaacucauaacggaaaucuguggcugcgguccuaaguguaaggagacuccccuggaguuaguauucguuauugauuccucugaaucgguggggccugagaauuuucagaucauuaaaaacuucgucaagacaauggccgacaggguggcgcuggaucuagccaccgcacguaucggaauaauuaauuauagccacaaagucgaaaagguggcuaaccucaaacaauuuuccucaaaggacgauuucaagcuggccguugacaauaugcaguaccuuggcgaggguacuuauacagcuaccgccuugcaggcagccaacgauauguuugaagacgcucggccaggcgugaaaaagguagcgcuggucaucacggacgggcagaccgauagucgagacaaagagaagcucacagaggugguuaaaaacgcaucugauacuaauguggaaauuuucgucaucggagugguaaagaaaaacgaccccaauuuugagauauuccauaaggaaaugaaccugaucgccaccgauccugagcacguguaccaauuugacgauuucuucacacuucaggacacucugaagcagaaauuguuucaaaagauuugcgaagauuucgacagcuaucucguucagaucuuuggcuccucaagcccacagcccggguucggaaugucuggcgaggagcuguccgaaaguaccccggagccucagaaagaaauuagcgagucuuuauccgucacaagagaucaagacgaggaugacaaggcuccagaacccaccugggccgacgaucugccugcaacuacgucaagugaggccacaaccacuccaaggccccuacucagcaccccgguggacggugcugaagauccucgcugucuggaggcccuuaaacccgggaauugcggagaauacgugguccggugguauuacgacaagcagguuaacucgugugcaagauuuugguucuccggcugcaaugguucuggcaacagguuuaauagcgagaaggagugccaggaaacauguauccagggguga

SEQ ID NO: 54642 - RNA, 4464 nt, Artificial Sequence
  derived and/or modified sequence opt3 from COL2A1__Homo_sapiens__NP_001835
augaucagacugggcgcaccccagacccucgugcuucugacauuguuagucgcugcaguucugaggugccaagggcaggacgugcaggaggccggaagcuguguacaggauggucaacgguacaacgacaaggauguguggaaaccugaaccaugccgcauuugugucugcgacacuggcacggugcuaugugaugacauaaucugcgaggauguuaaggacugucucuccccggaaauucccuucggggagugcuguccuaucugcccaaccgaucuggcgacagcuucuggacagcccggcccuaaaggucagaagggggaaccaggagacauuaaagauaucgugggccccaagggcccuccagggccgcagggacccgccggugagcaaggcccucgaggggaccguggagauaagggcgagaaaggugcaccagggcccagaggaagggacggcgaaccuggcacuccagggaaucccggaccgccuggucccccaggcccucccgggccacccggacuuggcgguaacuuugccgcucagauggcagggggcuucgacgagaaggccggaggcgcucagcugggggucaugcagggaccuauggguccaaugggcccgcgggggcccccuggaccagccggcgcgcccgguccucaaggguuucagggcaauccaggagaacccggcgagccgggggugucaggaccuauggguccacgcgggcccccugggcccccaggaaaaccuggcgaugacggugaggcagggaagcccggcaaagccggagaaagaggcccaccggggccucagggagcuaggggcuuccccgguaccccaggguugcccggaguaaagggccaccgggguuauccuggccucgauggggccaagggagaggcaggcgcuccagggguuaaaggagaaaguggcagccccggugagaacggguccccuggaccgaugggcccacgcggucugcccggcgaacgagggagaacaggaccugccggcgcggccggggcaaggggaaaugacggccaaccaggucccgcugggccuccgggacccgugggcccagccgguggcccuggguuucccggagcuccaggcgccaagggggaggcaggaccuaccggcgcccggggucccgagggggcucagggaccacguggcgaaccgggcacuccugggucucccggaccagcgggugcaucgggcaaccccgggacagauggaauaccuggcgccaaagguucagcuggggccccaggaaucgcaggcgcccccggcuucccugggccgcgcggaccacccgguccucagggcgcuaccgggccccugggaccaaagggccagacgggugagccugggauugccggauuuaaaggcgaacaaggccccaagggggagccaggaccugcagguccgcagggcgcgcccgggccagcuggagaagagggcaaaagaggugccaggggcgagccuggaggcgucggccccaucgggccaccuggagaacggggugcacccggcaaucgaggguucccgggacaggacggccucgccgguccaaagggggcuccuggagagcgcggccccagcggcuuagccgggccaaagggagcaaacggugaucccggcagaccuggggaaccgggacugcccggcgcuaggggucuuacugggcggccaggcgacgccggaccucagggcaaaguggggcccaguggagcgccuggugaggauggccgcccagggcccccuggaccacaaggcgccagaggucagcccggggugaugggcuuuccgggaccuaagggcgcuaauggggaaccaggaaaagccggugagaagggcuugcccggggccccuggacugaggggccuaccagguaaagacggggagaccggcgcugccggacccccgggcccugcagggcccgcgggagaacguggcgagcagggugccccagggccuuccggauuccagggccuccccgguccacccggcccuccaggggaaggaggcaagccgggggaucaaggaguccccggcgaggcuggugccccugggcugguuggaccacggggcgagcgagguuuucccggcgaaagagggucuccuggagcacagggccuucaggggccaaggggacugcccggcacaccugguacugacgggccgaagggagcuagcggcccagccgggcccccuggggcacagggacccccagguuugcaaggcaugccuggggagcgcggagccgcuggcauugcgggucccaaaggggaccggggagaugugggcgaaaagggcccagagggggccccgggaaaagacgguggcagagggcucaccggaccuaucggucccccaggccccgcaggggcuaacggagaaaagggcgagguaggcccuccagggcccgccggauccgccggugcuaggggcgcaccuggggagcgcggagaaacaggcccgccaggucccgccggguucgcgggaccuccaggcgcugauggccagcccggggccaaaggagagcagggugaagcaggccaaaagggggacgccggagcuccuggcccccaggguccaucaggggcaccgggaccucagggccccaccggcgugacggggccaaagggagcccgaggugcgcagggcccucccggggcuacuggauuuccaggcgccgcaggucgggucgggccucccggaaguaauggcaacccgggcccaccugggcccccaggacccagcgguaaagauggcccuaagggggcccguggagacucuggcccgccagguagagcuggggagcccggccugcaaggaccugccgggcccccaggcgaaaaaggagagccuggugaugacggccccuccggggcagagggaccaccuggcccgcaggguuuagcugggcagaggggcauagugggacugcccggccagcgcggggaacggggauucccaggucucccuggccccucaggggagccaggaaagcaaggcgccccuggugcgagcggcgauagagggcccccgggaccaguuggcccucccgggcuuacaggaccagccggcgaacccgguagggaggggaguccuggagcagacggucccccaggccgagauggcgcugccggggugaaaggagaccgcggcgaaaccggggcugucggagcaccuggcgccccgggucccccagggucuccuggacccgccggcccaacugguaagcagggcgaucggggcgaggcuggagcgcagggcccuauggggcccuccggaccggcaggcgccagagguauucaggggccucaaggaccaaggggcgacaagggcgaggcuggggaacccggagagcguggucugaaaggccaucgcggguucacaggauugcagggccuaccugguccacccgggccuagcggagaccagggcgccucgggcccagcagggcccucuggaccgcgggguccucccggcccaguggggcccuccggaaaggauggcgccaaugguaucccugggccaauuggacccccuggcccaagaggcaggucaggggaaaccggaccggcuggucccccuggcaacccagggcccccuggaccacccggcccgccugguccagggaucgacaugagugcguuugccggacugggcccccgagagaaaggcccugauccccuccaauacaugcgggcagaccaggcugccgggggacugcgccagcacgaugcagagguagacgccacgcuuaagagccugaauaaccagaucgaauccauuagaucuccagaggguagcaggaaaaacccggcucggaccugucgagauuugaagcucugccauccugaauggaaaucaggcgacuauuggauagaucccaaucaagggugcacacuggacgccaugaagguuuucuguaacauggagacuggagaaaccugcguguacccaaaucccgcgaacgucccuaagaaaaauugguggaguuccaagagcaaagagaagaaacacaucugguuuggcgagacaauuaacgguggguuccauuuuucuuauggagaugacaauuuagcaccaaacacugccaaugugcagaugaccuuccugagacuacucucaacagaaggcagucagaacaucaccuaccacuguaagaauagcauagcuuaucuggaugaggccgcuggcaaccuuaagaaagcauugcugauucagggguccaaugacgucgaaauccgcgccgagggaaacucuagguuuacuuacacggcucucaaggacgguugcacaaaacacaccggcaagugggggaaaacugugaucgaauaccguucgcaaaagaccagccggcugcccauuaucgauauugccccuauggacauaggaggcccagagcaggaguucgguguugauaucgggccgguguguuuucuuuga

SEQ ID NO: 54643 - RNA, 4401 nt, Artificial Sequence
  derived and/or modified sequence opt3 from COL3A1__Homo_sapiens__NP_000081
augaugagcuucgugcagaagggcuccuggcugcuccuugcccuguugcaccccaccaucauuuuagcucaacaggaggcagucgaagggggaugcucucaucugggucagucauacgccgacagagauguuuggaaaccugagccaugucagauaugcgugugugacaguggcagcguacuaugcgaugacaucauuugugaugaccaagaacucgauugcccgaaccccgagaucccuuuuggggaauguugcgcgguguguccacagcccccuacagcuccaacuaggcccccuaauggacagggcccacaggguccgaagggggaccccggaccuccaggcauucccggccggaacggggauccuggaaucccaggucaacccggcuccccggggucuccuggacccccaggcauaugcgagucguguccuacggguccccagaauuauucaccacaguacgacagcuaugaugucaaaagugggguggccguuggaggccuggcaggcuaccccgggccugccggaccaccgggucccccuggcccacccgggaccuccggacacccuggcucuccagguagccccggguaucagggcccgccuggagagccaggccaagcugggcccuccggaccucccgguccaccuggcgcaaucgggcccucaggaccagccggcaaggacggugaaagugggcgcccgggccgaccuggagagcguggccuucccgggccacccggaauuaaagguccugcuggcaucccaggguuccccggaaugaagggccauagagguuuugaugggaggaacggcgaaaagggagagacaggcgccccugggcugaaaggagagaauggcuugccgggugaaaacggggcgccaggacccaugggcccucggggugcaccaggcgagcgcgggagacccggacucccuggcgccgcuggggccaggggaaaugacggcgcacgggguagcgacgggcagccgggacccccaggcccucccgguacugcuggcuucccagggucuccuggagccaagggcgaaguggggcccgcgggauccccaggcucaaacggugccccggggcagcgcggagagccuggcccccaaggucacgcaggcgcucaggggccacccggaccuccaggcauuaaugggagccccggaggcaaaggugaaauggggccugccggaaucccgggcgcuccaggccugaugggggcccgaggacccccuggucccgcaggcgccaacggggcuccaggacugagaggcggugcgggggagccuggaaagaauggcgcaaaaggcgagcccgggccaaggggagaacggggugaggccggcauaccuggggucccgggagcuaagggcgaagaugguaaggacgggagucccggagagccaggcgccaacggccucccuggggcagccggagaacguggugcucccggcuuucgcgggccagccggaccuaauggcauucccggugagaaagggccggcaggagagagaggcgcgccaggcccugcugggcccaggggagccgccggugaaccaggccgggauggggugcccggaggcccugguaugcgagggaugccgggaucucccggcggcccaggguccgacggaaagccuggucccccuggcagccagggggagucgggacgcccaggcccgccugguccaucugggcccagaggccagccgggaguaaugggcuucccugggccaaaaggaaacgauggugcacccggcaagaauggggaaaggggaggcccuggugggccaggcccccaaggaccgccuggcaaaaacggggagaccggaccccaggguccaccuggccccacagggccaggaggcgacaagggugauaccgggcccccuggcccacagggauuacagggccugccggggacuggagggcccccuggugaaaacgggaaaccaggagagcccggcccuaagggugacgcuggcgccccaggggcacccggaggcaagggggaugcuggagccccuggcgagcgggguccgccagggcuugcgggagcccccggcuugcgcgguggcgcugggccucccggaccagaaggcgggaaaggagcagccggcccucccgguccaccgggggcugccggaacaccuggccugcaaggcaugcccggggagagaggaggucuaggcuccccagggcccaagggagacaaaggcgaaccuggugggccaggagcagauggcguucccggcaaggacgggccuaggggaccgaccgguccaaucgggcccccugggccagcgggacagcccggcgacaaaggugagggcggagccccuggccuccccggcauugcugggccacguggaucaccgggugagcggggcgaaacggggccucccggaccagccggcuuuccuggugcacccgggcagaauggagagccaggcggcaagggggaacgaggagcuccuggugagaagggcgaagggggacccccgggcguggccgguccaccugggggaaguggccccgcaggcccacccgggccucagggagucaaaggugagagaggcagccccgggggaccaggcgccgcugguuuccccggggcgaggggacugccugggcccccaggcuccaacgggaauccuggacccccagguccuucuggcagcccggggaaggauggacccccaggcccugccgguaacacuggggcacccggcucaccaggagugaguggcccuaaaggggacgcuggacaacccggugagaagggcuccccgggggcccagggaccaccuggcgcccccgguccacuugggaucgcuggcaucaccggagcacgcggccuggccgggcccccuggaaugcccgguccacggggcagcccugggccgcagggagugaaaggcgaaucugguaagcccggcgcgaauggguugucaggagagagaggcccaccugggccccagggacucccaggccuggcugguacagccggggaaccuggaagggauggcaaccccgguagugacggcuuaccggggcgcgauggaagcccuggcgggaagggagaccgaggcgagaaugguuccccaggggcacccggagccccuggccauccaggucccccuggcccagucgggcccgcuggaaaaucuggcgaucggggcgaaucgggaccggcaggcccugccggugcgcccgggccagcuggaagccguggcgcccccggcccucaagggccaagaggagacaagggugagacuggcgagaggggcgcagccggaauuaaaggccaccgcgguuuucccgggaacccuggagcuccaggcuccccgggccccgccgggcagcagggagcaauagguucaccuggcccagcugggccccggggaccuguuggcccaaguggucccccggggaaggauggaaccucuggccacccuggcccaaucgggcccccuggacccagagguaauaggggcgaacgagggagcgagggauccccaggccauccgggucaaccugggcccccaggacccccuggcgccccaggccccugcugcgggggagugggugcggccgcaauugcuggcaucgggggagaaaaagccggcgguuucgcuccuuacuauggggacgagccaauggauuuuaagauaaacacagacgaaauuaugaccucacucaagagcguaaauggacagaucgagucucugaucuccccggauggcagucgcaaaaaccccgcacggaauuguagagaccuuaaguucugccacccugagcugaaaagcggcgaauacuggguggacccaaaccagggguguaaguuggaugccauuaaagucuuuugcaauauggagacgggagaaacuuguaucucugccaacccccuaaacgugccuaggaagcauugguggacagacuccucagcugagaaaaagcacguuugguucggugagaguauggauggcggguuccaguuuagcuacggaaauccagaacugcccgaggacgugcucgauguccaacuggcguuccuucgucuguugucgucccgcgcaucucagaacauuaccuaucacugcaagaauagcauagccuacauggaccaggcuucaggcaacgugaaaaaggcccucaaacugauggguaguaaugaaggggaguuuaaggcagaaggcaacuccaaauucacuuauacaguauuagaggauggauguaccaagcauacgggcgaguggucuaagaccguuuuugaauaccggacaagaaaagccgugaggcugccuaucgucgacauugcuccguaugauaucgggggacccgaccaggaguucgguguggaugucggcccagugugcuuucuauga

SEQ ID NO: 54644 - RNA, 1560 nt, Artificial Sequence
  derived and/or modified sequence opt3 from COL4A1__Homo_sapiens__NP_001290039
augggccccagacugagcguguggcuccuucuguugccugccgcuuuacugcuacacgaggaacauuccagggcagccgcgaaagggggaugcgcugguucuggcugugggaagugcgacugucacggagucaagggccagaaaggugagcgggggcucccaggacugcaaggcguuaucggcuucccggggaugcagggacccgaagguccucagggcccacccgggcagaagggagauaccggcgagccuggucuuccagggacaaaaggaacucgcggacccccuggcgccucaggguacccaggaaacccgggucugcccggcauuccugggcaagacggaccacccggcccuccagguauacccgggugcaauggcacgaagggagaacgaggcccguuggggccucccggacucccagguuuugcaggcaacccugggcccccaggacugcccggcaugaagggugauccuggggagauccugggccaugugccaggaaugcucuuaaaaggcgagcguggguucccgggcauucccgguaccccuggcccacccgggcugccuggacuucagggcccaguaggucccccgggguuuacaggcccuccaggacccccugggcccccaggcccucccggagaaaagggccagauggguuugaguuuccaggggccaaaaggagacaagggcgaucaaggugugagcggcccgccugggguccccggacaggcccaggugcaggagaaaggcgacuuugcuacuaagggggaaaagggacaaaaaggcgagccagguuuccaggggaugcccggaguuggcgagaagggugaaccuggcaaaccagggcccagaggaaagccuggcaaagauggggacaagggagagaaaggcuccccggguuuuccaggggaacccggauauccuggccugaucgguaggcagggcccacaaggggagaagggagaagcagggcccccuggcccgcccggaauugugaucggcaccgguccacuaggggagaagggagagcggggcuacccuggcacacccgggccacgcggagaaccuggucccaaaggcuucccagggcucccgggacagccuggucccccaggccugcccgucccugggcaggccggagcuccaggcuuucccggcgagagaggggaaaagggagauagggguuucccuggcaccucucuuccggggccaucgggacgggacggccugcccgguccucccgggucaccaggaccucccggccagccaggcuauacuaaugggauaguggagugucaaccuggaccgcccggugaucagggcccaccugggauccccggacagccaggcuuuauuggugaaaucggggagaaaggacagaagggcgagagcugcuugauuugugacaucgauggcuaccgcgggccucccggaccgcaagguccaccuggcgaaauaggguuccccggacagccaggcgccaaaggugaccgagggcuccccggaagagacggcguagcgggcguuccucuguuauuucagauucacaaguga

SEQ ID NO: 54645 - RNA, 5139 nt, Artificial Sequence
  derived and/or modified sequence opt3 from COL4A2__Homo_sapiens__NP_001837
augggcagggaccagagggccguggcugggcccgcacugcggcgcuggcuccuucugggaaccgucacaguugguuucuuggcccagagcguguuagcgggcgugaagaaauuugaugugccuugcgggggacgagacuguuccggcgguugccaguguuacccagagaaagggggccguggccagccgggccccgucgggccucagggauauaacgguccacccggccugcaaggguucccuggacuacagggcagaaagggugauaagggggaaaggggagcuccaggcgugacuggccccaaaggggacguuggagcccggggugugucuggcuuuccuggggcagauggaaucccaggccacccgggucaagggggaccccgcggaagaccuggcuacgacgggugcaauggaacgcagggugauucaggcccacaagggcccccuggaagugagggcuucaccgguccacccgggccgcagggcccuaagggacagaagggcgaacccuaugcccucccaaaagaggaaagggaccgguaccgcggggagccuggagagcccggucuggucggcuuucaggggccacccggacgaccuggccaugugggucaaauggggccaguaggcgcuccgggaagacccggcccuccagggcccccuggaccaaagggccagcaggguaacagggggcuuggauucuauggcguuaaaggugaaaagggcgauguggggcaacccggaccgaauggcauuccuagcgacacacugcacccaauaaucgcacccacuggggucaccuuucauccugaucaguacaaaggagagaagggcuccgaaggugagcccgggauucggggaaucucuuugaagggcgaggaagguauuaugggcuucccagggcuccguggauauccuggccugucgggggagaaaggaucacccggccagaaggguagccgcgggcuggacggauaccagggcccagaugguccgagaggcccuaaaggggaagccggagaccccggcccacccgggcucccugcuuacaguccacaccccuccuuagccaagggagcgaggggcgacccugguuuuccgggggcacaaggagagccaggcucucagggcgaacccggggauccuggacugccaggucccccuggccuuagcaucggggacggagaucagcggcgaggcuugccgggugagauggggcccaaaggauucauaggcgacccaggcaucccugcccuguaugggggacccccagguccugauggcaagcgcgggcccccaggaccgccuggccuacccgguccacccgggccugacggauuucucuucggccugaaaggcgcuaaggggagagccggauuuccaggucuucccggcuccccuggggcaaggggaccgaagggcuggaaaggugaugcuggggagugucggugcacagaaggagacgaggccauuaagggccugccaggcuugcccgggccuaaaggauucgcggguaucaacggcgaacccgggcgcaagggagauagaggcgacccaggucagcaugggcucccuggauuccccggccugaaaggcgugccagggaauauuggagccccugguccgaagggcgcaaagggggauucaaggaccaucacuacaaaaggagagcguggccaacccggugugccaggggucccuggcaugaagggagacgacggcagucccgggcgggauggauuagacgguuuuccaggccugccugggcccccgggagauggcauaaaagguccaccuggggaccccggcuacccaggcauucccggcaccaaggggacgccuggagaaauggguccgcccggccucgggcuuccaggacugaaaggccagcgagguuucccuggggaugcuggcuugcccggaccuccaggcuuucuagggcccccuggaccagccggcacucccggucagaucgacugugauaccgacguuaagagagcuguagggggagauaggcaggaggccauucaaccgggcugcaucgguggcccuaaggggcugccaggacuccccggcccuccagggcccacaggagcaaaaggccugcgcgguaucccgggguucgccggagcugacggcgguccuggcccccgggggcuuccaggagaugcgggcagagagggguuuccuggacccccaggcuucauuggucccagggggagcaagggagcaguaggccugccuggcccagacgggucuccgggacccauagguuugccuggcccagaugggcccccuggagaacgcggccucccaggugaggugcugggggcccagcccggaccucgaggcgacgcuggcgucccggggcagccaggauuaaaaggucugcccggcgaccgggggccucccggauuucguggcucccaggguaugccagggaugccuggacuaaagggccaacccggccucccagggccgucaggacagccuggucuguauggacccccagggcuucacggauuccccggcgccccuggucaggaagggccauugggacugcccggcaucccuggcagagaggggcucccgggagauaggggugacccaggcgauacuggggcacccggaccugugggcaugaaaggucugagcggggaccgcggagaugccggcuuuaccggcgaacaagggcacccaggaagucccgguuucaagggcauugacgggaugccuggaacacccggccuuaagggugaucgggggucuccaggaauggacggcuuucagggcaugccggggcugaaaggaagaccugguuuccccggcuccaagggggaggcuggauuuuucggcaucccagguuugaaagggcucgccggcgagccuggauucaagggcagcagaggggaucccggaccaccuggucccccgccaguuauacugccuggcaugaaagacauuaagggggaaaaaggagaugagggccccauggguuuaaagggguaccugggcgcaaagggaauccagggcaugccagggauccccggacuaucggguauuccuggccucccggggcgaccaggacauaucaaaggcgugaagggugacauuggcguccccgggauaccuggacugcccggcuuuccagggguggcgggaccucccggcaucaccgguuucccaggguuuauuggaucucgcggcgauaaaggugcuccuggccgggccgggcuuuauggagaaaucggcgcaacgggggacuucggagacaucggcgauacuauuaacuugccggguagacccgggcugaagggagagaggggcacaaccgguauaccaggccucaaaggguuuuucggagagaagggcacugaaggggacaucggauuuccuggcauuacagguguaaccgggguucagggacccccaggccugaagggccaaacgggguucccuggauuaaccggucccccgggcucccagggggagcugggacguaucggccuuccaggugggaaaggagaugacggcuggccuggcgcccccggguugccaggauuucccggucuccgcggcauucgggggcugcacggacuaccuggcacaaaggguuuccccgggucaccaggaagugauauccauggcgacccuggcuuuccggggcccccaggagaaagaggugauccuggcgaggcuaauacucugcccgggccagugggagucccuggccagaaaggugaccagggggcccccggagaaaggggcccgccuggcagcccagggcuccaaggauuccccgguauaaccccuccauccaacaucucuggcgcacccggggauaagggagcuccuggcauuuuuggucugaaaggguaccgaggaccacccggcccgccuggcagcgccgcgcuucccgggucaaagggagacacagguaauccaggcgcccccgggacuccuggaaccaagggcugggcuggugauagugggccacagggccggcccggaguguucggcuugccuggggagaaaggaccacgcggugagcagggcuucauggggaacacaggaccgaccggcgcagucggugacagagggcccaagggcccuaaaggagacccaggcuuucccggggccccuggaacugugggugcuccaggcaucgccgggauuccccagaagaucgcaguucaaccgggaacggugggcccucaggguaggcgggggccacccggcgcgccuggagaaaugggcccccaggggccaccgggagagccugguuuccgaggcgcccccgggaaagcuggaccacaaggcagagguggcguauccgccguccccggguuucgcggagaugaaggcccuauagggcaccagggaccaauuggccaggagggugcacccgggaggccuggaagcccaggccugccggguaugcccggccguucugugucaaucggguauuuacucguuaagcacagucagacagaccaagaaccuauguguccagugggaaugaauaagcuguggagcggcuacucccuucuguacuucgaggggcaggagaaagcucauaaccaggauuugggacucgccggcucuugccuggcacgguuuucgaccaugcccuuccuauauuguaauccuggugacgucugcuacuaugccagcagaaacgauaaguccuacuggcugucaacuaccgcuccacuccccaugaugccuguggcggaagacgagauuaaaccguauaucaguaggugcucuguaugugaagcccccgcaauagcuaucgccgugcacagccaggauguuuccauuccacauugcccugccggguggcgcucacuguggaucggauacagcuuucuuaugcacacagcugcaggcgacgaggguggcgggcaaucuuuggucucccccggaaguugucuggaagauuuccgagccaccccauuuauugagugcaauggcgggagaggaacuugucauuauuacgcgaacaaguacagcuucugguuaacaacgaucccugagcagucuuuucagggcucccccucagcugacacccucaaagccggucugauacggacucacauuaguaggugccagguguguaugaagaaccuuuga

SEQ ID NO: 54646 - RNA, 2259 nt, Artificial Sequence
  derived and/or modified sequence opt3 from COL4A3BP__Homo_sapiens__NP_001123577
augcagcacagcugcauccccaccccuccauccccguucucugcucccccugccuuucugccaguggucacaagagagucaaggcggggccucaguagcgggggauccgcaggucgcaacgccggcguuacugcgacggcugccgcagccgacggguggaagggacgacuucccucuccucugguguuguuaccacguucggcuagaugucaagcaaggcggcgcagaggcgguaggaccucaagccugcuacuccugcccccuacaccagaacgggcccuuuucgcuaguccgucccccgauccuucuccacgcgggcugggagccagcuccggcgcggcagagggcgccggggcuggauugcuccuggguugccgagccucaaugagugacaaucagagcuggaacucuuccggcucagaagaggaucccgaaacugagagcgggccuccaguagagagauguggagugcugaguaaauggaccaauuacauucauggcuggcaggacaggugggucgugcucaagaacaaugcauuaucuuauuacaaauccgaagaugagacagaauaugguugccgggggagcauaugucugucgaaggcuguuaucacuccccacgacuuugaugagugccguuucgacauuucugugaacgauuccgucugguaccuucgcgcccaggacccggaucauagacaacaguggaucgacgcgauugagcagcacaaaaccgaaucaggauauggcagugagagcuccuugaggcggcauggcucuauggugagccugguaucaggggccaguggauacuccgcaacaagcaccucuucauuuaagaagggucacagucuacgagaaaaacucgcugagauggaaacguuccgcgauauccuguguagacagguugacacucuucaaaaguauuuugacgccugcgcugaugccgugagcaaagacgagcugcagagggauaaggucguggaggacgaugaagacgauuucccuaccacacgguccgacggcgauuucuugcacucuacuaaugggaacaaagagaaacucuucccccaugugaccccaaagggaauaaauggcaucgacuuuaagggugaagcaauuacauucaaggccaccacggcugggauccuggcgacuuuaucgcacuguauugagcugauggucaaacgcgaagauagcuggcagaagagacucgacaaagagacagagaagaaaaggcguaccgaagaggcauacaagaacgccaugacugaacuuaagaaaaagucccauuuuggcggaccugacuacgaggaaggccccaauucacugaucaacgaggaggaauuuuucgaugcuguugaggccgcauuggaccggcaggauaaaauagaggaacaaagucagucugagaaggugcgacuacacuggccaacaagccugcccuccggggacgccuuuucaagcguaggaacccacagauucgugcagaaaccuuauucuagguccaguagcaugucuuccauugaucucgucucagcuagugacgaugugcaucgcuuuagcucgcaaguugaagagauggugcagaaucacaugacguacucccugcaggacgucgguggcgaugccaacuggcagcuugugguagaagagggggaaaugaagguuuaucggagagagguggaggaaaauggaaucguccuggacccauugaaggcaacccaugcggugaaaggcgucacaggucacgaggugugcaacuacuucuggaacguugaugugaggaaugacugggaaacuaccauugagaacuuucauguagucgaaacacucgcugauaaugccaucaucauuuaucaaacucacaagcgcguguggccggcaucucagcgagacguucuguacuuaagcgugauacggaaaauccccgcccugaccgagaacgacccugagacauggauugucuguaauuucucaguggaucacgacagugcuccacuaaacaaucguugcguaagagccaagaucaacguggcaaugauaugccagacccucguuucucccccugaagggaaucaggagauuuccagggauaacauccuguguaaaaucacuuaugucgcuaaugugaacccaggcggaugggcccccgcgagcgugcuucgcgccgucgcuaagcgggaauacccgaaguuuuugaaaagauucacguccuacguucaagagaagacagcaggcaaaccuauucuguuuuga

SEQ ID NO: 54647 - RNA, 5013 nt, Artificial Sequence
  derived and/or modified sequence opt3 from COL4A3__Homo_sapiens__NP_000082
augagcgccagaaccgcucccaggccucaggugcugcuccuuccacuguuguuaguccugcuagcagccgcgccggcugccuccaagggcugcguuuguaaagacaaggggcaaugcuucugugauggagcaaaaggugagaagggcgaaaaaggguuucccggaccuccaggcucucccggucagaagggguucacaggaccugagggccucccaggcccccaggggccuaagggauuuccaggucugccgggccuuacugggucaaaaggagugcggggcaucaguggucugcccggguucagcggauccccuggcuugccaggcacgcccgggaacaccggaccuuacggucucguaggcgugccagggugcucuggaucgaagggcgaacaggguuuucccgggcugccgggcacacugggauauccuggcauucccggggccgcuggacucaaaggucaaaagggcgcaccagccaaagaggaagacauagaguuagaugcuaagggggacccuggacugcccggcgccccagguccccaggggcuuccuggcccaccgggauuccccggcccugucgggccacccggaccuccagguuuuuucggcuuucccggggcgaugggaccgcgcggcccuaagggucacaugggggagcgagugaucggccauaaaggagaacguggcguuaagggguugacuggaccacccggcccucccgguaccgugauugucacacugaccgggccagauaauagaacugaccuaaaaggagagaagggcgauaaaggugcaaugggcgaaccugggcccccaggaccgucaggccucccuggggagagcuacggaagugagaagggcgcccccggugacccagggcugcagggaaaacccggcaaggauggugugccuggcuucccaggguccgaaggaguaaagggcaacaggggguuucccggacuuaugggcgaggacgguaucaaagggcagaagggagauauuggcccuccggguuuccggggcccaacagaauauuacgacaccuaucaagagaaaggggaugaaggaacgcccggcccuccagggccccgcggagcuagaggcccucaggguccgucugggcccccaggaguuccuggcagccccggcuccucaaggccagggcugcggggagccccugguuggcccggcuugaaggggaguaaaggagagcgcggccgaccagguaaggacgcaauggggacuccgggaagcccuggcugugcuggcucucccgggcucccaggaucccccgguccuccaggccccccuggggacaucguguuuagaaagggaccgccaggcgaucacggucugcccggguacuuaggaucaccuggcauacccggcgucgacgggccaaaaggagagccuggucugcucugcacccagugucccuauaucccaggcccuccggggcuucccggacugccaggcuugcauggugugaaggggauuccuggaaggcagggcgccgcgggccuaaaagggagccccggaaguccagguaauacaggccugccuggguuccccggauucccgggcgcccaaggugauccagggcucaagggagaaaaaggcgagacucugcagccugaaggccagguggggguccccggagacccaggucuucggggccaacccgggcguaagggacuggauggcaucccugguaccccggggguuaagggcuugcccggaccaaaaggcgagcucgcacugucuggggaaaagggagaccaggguccucccggcgauccuggguccccaggaagccccggcccugcugguccagccgggcccccgggcuacggaccucagggcgagccaggguuacagggaacacaaggugugcccggcgcuccugggccacccggagaggccggcccgcgcggugaacugucgguaucuaccccugugcccgggccaccuggccccccaggacccccuggccacccagggccgcagggacccccuggcauuccagguucccuagggaaaugcggagaccccggccucccugguccagauggcgagcccgggaucccuggaauaggcuuuccggggccacccggaccuaagggcgaccaggguuuccccgggacgaaaggaucacugggcuguccagguaagaugggcgaaccugggcuucccggaaagccaggcuugccgggggcaaaaggagagccugccgucgcuaugcccggcgguccagggacucccggauuuccuggcgaaagaggcaacaguggggagcauggagagauuggucugccaggccuccccgggcugccuggaacaccgggcaaugaaggucuugaugggccaaggggagaccccggccagccuggcccacccggggagcaaggaccucccggucggugcaucgaaggcccacgaggggcgcagggacugccgggcuugaacggucucaaggggcagcagggacgcagaggcaaaaccggcccuaagggggaccccggaauuccaggucuggauaggagcggcuucccuggggagacuggaucccccggcaucccaggucaccaaggggagaugggaccuuuaggccagcggggcuaccccgggaauccgggaauccuggguccaccuggcgaagacggggugauuggaaugaugggcuuucccggugcaauagggccacccggaccuccgggcaacccaggcacacccgggcagcgcggaucuccugguauccccggcguuaaagggcagagaggaaccccaggcgccaagggugagcaaggggauaaaggaaauccuggccccagcgaaauuucacacgugaucggcgacaagggggagccaggacuaaaggguuucgcuggcaacccuggggaaaaaggaaauaggggcgucccggguaugcccgggcucaagggccugaaaggacuuccaggcccugccgggcccccaggaccucguggugauuugggcaguacggggaaccccggagagccgggccugcgggguauaccaggguccaugggcaauaugggaaugccuggcagcaaggggaaacgaggaacccucgguuuucccggcagagcagggaggccaggacugcccggcauucaugguuuacagggcgacaagggggagccuggauauucugaaggcacacgccccgggccaccuggaccgacuggcgaucccggucugccaggggacaugggaaagaaaggcgagaugggucagccuggccccccagggcaccuuggaccugccggccccgaaggggcuccgggaucaccuggcaguccagguuugcccgggaagccuggaccacauggcgaucucgguuucaaaggcaucaaggggcugcuaggacccccuggcauccgggggccacccggacugccgggcuuuccugguagccccgggccaaugggaauuagaggcgaccaaggcagggaugggauccccggaccugccggugagaaaggcgaaaccgggcuccugcgcgcaccacccggaccucgaggcaacccaggugcgcagggggcuaagggagaccggggcgccccgggcuuccccgggcuuccuggacguaagggugcaaugggcgaugccgggccaagaggacccacaggcauugaggguuuuccugggccacccggauugccgggcgcuauaaucccuggccagacugggaauaggggaccacccgguucccgcggcucuccuggggcccccggaccaccgggcccucccgguucgcacgugauugggaucaaaggagacaagggcagcaugggccacccagggcccaaaggaccuccagguaccgcaggcgacauggggcccccuggacggcugggcgcuccagguacaccgggguuacccggaccuagaggcgauccaggcuuccagggguuucccggaguaaagggugagaaaggcaacccuggguuccucggauccaucggcccacccgguccuauugggccgaagggccccccaggaguuaggggcgacccugggacccugaagauaaucucacuucccggaaguccagguccucccggcacuccaggggaaccgggaaugcaaggcgagccuggucccccagggcccccuggcaaccugggaccauguggcccccgagggaaaccuggaaaggaugguaaaccgggcacgcccgggccagccggagaaaagggcaauaaagguucuaagggggagccuggccccgcgggaagcgacggcuugccagggcucaaaggaaagcgcggugauuccggcucaccugccacauggaccacucggggguucguguuuaccagacauagccagacaaccgcuauucccucuugcccagaaggaacugucccgcuguacuccggcuucaguuuucuauucgugcaggguaaccagagggcacacggccaagaccuggggacacucggaagcugccugcagcguuuuacgaccaugccuuuccuuuuuuguaaugucaacgaugugugcaauuucgccucucgcaacgacuauuccuacugguugucaacucccgcucugaugccaaugaauauggccccuaucacaggccgggcauuagagcccuauauuaguagauguaccguuugcgaggggccagcgaucgccauagcugugcauagccagacaacugauaucccucccuguccgcacggauggauuucgcucuggaagggcuuuuccuucaucauguuuaccucugccgguagcgaagggacgggacaggcacuggcuucaccaggcaguugccuugaggaauucagggccucccccuuucuggagugucauggucgaggcaccugcaacuacuauucuaauagcuacuccuucuggcuagcaucacucaacccugagcggauguuccgcaaaccaauucccagcacaguaaaggccggggaacuggagaaaaucauaaguagaugucaagucugcaugaagaaaaggcacuga

SEQ ID NO: 54648 - RNA, 5073 nt, Artificial Sequence
  derived and/or modified sequence opt3 from COL4A4__Homo_sapiens__XP_005246338
auguggagccugcauaucgugcucaugagaugcuccuucaggcuuaccaagucucuggccacaggccccuggucauugauuuuaauacuguuuaguguccaguacguuuaugggagcggcaaaaaguacaucgguccuuguggcgggcgggacugcuccgugugucauugcguaccagagaaaggcucucgcggcccgcccgguccuccagggccccaaggcccuauuggcccacuaggcgcucccgggccuaucggccucucgggugaaaagggcaugcgaggggaucguggcccaccgggcgcagccggugacaaaggggauaagggccccacuggcgugccuggcuucccagggcuggacggcauucccggucacccuggcccacccgggccgagagggaagccuggcaugucaggucauaacgggagcaggggcgaucccggauuuccaggcgggcggggagcgcuugguccuggcgggccccugggacacccaggcgagaaaggugaaaaggggaauagugucuucaucuugggcgcugugaaaggaauacagggcgaccgcggggaucccggacucccuggucugccaggcuccuggggagccggaggcccggcaggucccacgggguauccuggcgagccaggacugguuggacccccugggcagccaggaagacccggccucaaggguaacccgggggugggagucaaaggccagaugggugacccuggcgaaguggggcaacagggaucuccaggccccaccuuacugguagagccucccgauuuuugucuuuacaagggggagaagggaaucaaaggcauuccagguaugguuggguugccuggacccccaggcaggaagggugaaagcggcaucggggccaaaggagagaagggcauuccgggguucccuggaccccggggcgacccagguuccuaugggucacccggauuuccuggccugaaaggugaacuaggccucgugggggauccaggacuguucggccuuaucgggcccaagggagacccuggcaaucgcggucauccggggccacccggaguccuggugacaccuccauugccccucaaaggcccuccgggcgaucccggguuuccaggacgauacggugagacuggcgacguggggccucccggaccaccuggccuguuagguagacccggggaggcuugcgcaggaaugauaggcccaccgggcccucagggguuccccggacugccaggucuccccggcgaagccgggauuccuggaaggccagacagugcucccggcaagccugguaagccggggagcccaggacuucccggcgccccuggccugcagggguugcccggaucuuccgucaucuauuguucaguugguaacccaggcccucaagggauuaaaggaaaggugggacccccaggugggcggggaccuaaaggcgagaagggcaaugaagggcuaugcgcgugugagccgggacccauggguccaccuggacccccagggcugccuggacgucagggcagcaaaggugaucucgggcugcccggauggcuuggcaccaagggcgacccggggccaccuggagcagaaggucccccaggccugcccgggaagcacggagccaguggcccuccggguaacaaaggggcuaagggcgauaugguagugucucgcgucaaaggacacaagggcgagagagggcccgacggaccaccugguuuucccggccagccugggucccauggaagggauggccacgccggugagaaaggggacccaggacccccuggagaucaugaagacgcaacaccaggcgggaagggauuccccgguccguugggcccuccagggaaggcuggacccgugggcccuccaggucucggguuucccggcccgccuggagagcggggccaccccgggguuccaggacacccuggcgugcgaggucccgaugggcugaaaggacagaagggcgacaccaucagcugcaaugucacuuacccaggucgccauggacccccuggguucgauggaccaccgggccccaaaggguucccuggaccacaaggcgcccccgguuuaucggggucugacggacacaagggcagaccugguacaccaggcaccgcggaaauccccgggccuccgggauuuaggggcgacaugggggauccaggauucggcggugagaaaggguccucacccgugggaccucccggcccaccuggcagucccgggguaaacggacagaaggguauuccaggcgacccggccuuugggcaucugggaccucccggcaagcggggucuaagcgggguuccaggaauaaaaggcccccgcggcgauccuggguguccaggagcagaaggucccgcuggcaucccuggguuccucggacugaagggcccgaaagguagagaggggcacgccggauuuccaggcgugcccggcccuccagggcauuccugcgagaggggagcucccgguauuccuggccagcccgggcuuccaggauacccgggcucuccuggugcccccgggggaaagggccaaccaggcgacgucgggccucccggaccagcagguaugaaaggcuugccugggcugcccggacguccgggcgcccacgguccaccugggcuccccggaaucccaggccccuucggcgaugacgggcugccuggaccgccaggucccaagggcccucgggggcuucccggauuuccaggcuucccuggugaacgagggaaacccggagcugagggcugcccaggcgcgaagggggaaccuggagagaaggguaugagcggccugccgggggauagaggauugaggggcgcaaaaggugccauagggcccccaggcgacgaaggagagauggcuauuaucucacagaagggcacgccuggggagcccggaccaccuggugaugacggcuuucccggggaacgcggagauaaaggcacuccggguaugcaggggcggagaggcgagccaggaagguauggcccucccggguuccaccgcggagaaccaggugagaagggccagcccgggccucccggaccaccuggcccgcccgguaguaccggccuccgaggguuuaucggauucccaggccugccuggggaccaaggagagcccggcuccccagguccucccggguuuagcggaauugauggcgcccgggguccgaaaggcaauaagggggacccugcaucucauuucggaccacccggcccuaagggggaaccaggaucacccggcuguccuggucacuucggggccaguggagagcagggcuuaccagguauccagggcccccgugggagcccgggaagaccuggacccccaggguccucuggacccccuggcugcccaggugaccaugggaugcccggacugaggggccagccuggcgaaaugggggauccaggaccgcgcggucuacaaggcgaccccgggauuccuggaccacccggcauaaaagguccuucggggagcccaggacucaacggccugcacggccuuaaggggcagaaaggaacaaagggugcuuccggcuugcacgauguggggcccccgggaccugucggcaucccaggucugaaaggggagcggggagaccccggcucaccuggcauuagucccccagggccgagaggaaagaaggguccucccggcccacccgggucuagcggaccuccaggccccgccggugcaacugggagggcgccuaaagauaucccagacccgggacccccuggcgaucagggcccacccgggccugacggaccacgaggugcucccggcccuccggggcuccccggauccguggaucuguuacgcggcgaaccaggugacugugggcugccuggacccccaggcccucccggcccaccggggccucccggauacaaggguuuuccaggcugcgaugggaaagacggacagaagggccccguugguuucccugggccacaaggcccccauggauuuccuggcccgcccggggagaaaggacuuccagguccucccggccggaaggggccaaccggauugccuggccccagaggugagccagggccgccugccgauguggacgacugucccaggaucccaggccucccuggagcacccggcaugcgugggccagaaggagccaugggucugccuggcaugcgcgggcccucaggaccgggcugcaagggugagccagggcuagauggccggagaggaguagacggcguccccgggagcccuggaccacccgguaggaaaggcgauacaggggaagacggauauccuggcgguccgggacccccagggccuauuggagaucccggcccaaagggguucggaccuggcuaccuggguggguuucuccuggugcuucacucucagaccgaccaggagcccacguguccauugggaaugccucgacuguggacuggcuauuccuuacucuaccuggaaggucaggagaaagcucauaaucaagaucuuggccuggccgggaguugcuugcccguuuucagcacacucccguuugcauauuguaacauacaccaggugugccauuacgcucagcggaaugaccgcucuuacuggcuggccuccgcggccccucuaccaaugaugccccugucagaggaagcuaucagaccuuaugucaguaggugugcagugugcgaggccccagcucaagccguagcagugcacagccaggaucagucgauucccccgugcccucagaccuggcggucccucuggaucggauacucuuuccugaugcacacuggcgcgggggaccaaggaggcggucaggcccuuaugagccccgggucauguuuggaagauuuucgagcugccccauuccuggagugccagggaagacagggcacaugucacuuuuucgcaaacaaguauaguuuuugguuaaccacgguuaaagcugaccuccaauucuccucugcccccgcaccugacacccugaaggaaagccaggcccagcgccagaaaauuuccaggugccaagucugugugaaguacucauga

SEQ ID NO: 54649 - RNA, 5058 nt, Artificial Sequence
  derived and/or modified sequence opt3 from COL4A5__Homo_sapiens__NP_000486
augaagcugagaggcgugagccucgccgcugggcuuuuccuguuggcauuaucccuguggggacagcccgccgaggcggcugccugcuacgguuguucuccuggcucaaaaugcgacuguagugggaucaagggagaaaaaggcgagagggguuuuccagggcuagaaggacacccgggccuccccggcuucccugggccagagggacccccugguccacggggccaaaagggggaugacggaauucccggcccuccagguccgaaagggauacgcggacccccuggccugccaggcuuucccgggaccccuggacuuccagguaugcccggccaugauggggcaccgggaccucagggcauccccgguugcaacgggacaaagggcgaacgaggauucccaggcagcccuggguuucccggacugcaggguccacccggcccuccagggauuccgggaaugaagggcgagcccgguuccaucauuaugucuucguugccugggccaaaaggcaaucccggauauccuggcccacccgggauccagggacucccggguccuacuggcauaccagggcccaucggaccucccggcccaccuggucugauggggcccccaggcccgccuggacugcccggcccaaaggggaacaugggacucaauuuccaaggccccaaaggugagaagggggaacagggauuacagggcccuccaggucccccuggccagauuucagagcaaaaacguccgaucgacgucgaauuucagaagggggaucagggacugccaggcgacagagggcccccuggaccacccggcauuagggguccuccggggcccccaggaggcgagaagggugagaaaggcgaacagggggagccuggaaagcggggcaaacccgggaaggauggagaaaacggccaaccagguaucccugggcuucccggagacccaggcuacccgggugagccuggccgcgauggggaaaaaggacagaagggcgacacggggcccccaggacccccuggcuugguuauaccaagacccgguaccgggauuacaaucggagagaaaggcaauauuggccugccugggcuaccgggagagaagggugaaaggggcuucccagggauccagggacccccuggccuccccgguccaccuggggccgcugugaugggacccccaggcccuccgggcuuucccggggagcggggacaaaagggugaugaaggcccaccugggaucagcauucccggaccaccuggccuggacggucagcccggggcaccgggacuuccaggcccucccggcccagccgggccccacauaccuccgagugaugagaucugugaacccggaccaccuggucccccuggcuccccaggggacaaaggacugcagggcgagcaggguguaaagggggacaaaggagauacuugcuucaacuguauuggcaccggcaucucugggcccccuggacaaccagguuugcccggccucccggggccuccaggaagccugggcuuucccggucagaagggggagaaaggacaggcuggcgccacaggcccuaagggguuaccaggaauacccggugcgccgggcgcaccuggguuccccggauccaagggcgaaccaggugacauucugaccuuuccugggaugaaaggcgauaagggagagcucggcucacccggggccccaggacuucccggucugccuggcacuccagggcaggacggauugccgggccuacccgguccuaaaggggaaccaggcggaaucacauucaagggcgagcgcgggcccccuggaaauccaggucugcccggccucccugggaacaucggaccgaugggcccacccgguuucgggccucccggcccagugggagaaaaaggcauucaaggggucgcuggaaauccuggccagcccgguaucccagggccgaagggagauccuggccagaccauuacgcagcccgguaagccaggccugcccgggaacccuggacgagacggcgauguggggcuuccaggagaccccggccugccuggucaaccgggguugccaggaauacccggcaguaaaggugagccuggcaucccagggauuggacuccccggcccucccgggccaaagggauuuccgggcaucccuggucccccaggggccccuggaacucccggcagaaucggccuggaggggccaccuggacccccggguuucccaggcccuaaaggggaacccggauuugcauuaccaggccccccugguccgccagggcugcccggauucaagggcgcucuaggcccuaaaggggauaggggauuucccgguccaccuggccccccagggcggaccggacucgacggccugccugguccgaagggggauguuggacccaauggccagccaggcccuauggggcccccaggacuuccugguauuggcgugcaggggcccccgggaccaccuggcauacccgguccaaucgggcagcccggauugcauggcauuccuggcgagaagggggaccccggaccaccuggucuggacgucccgggccccccaggggaacguggaagcccuggcauccccggugccccagggccuauuggacccccgggcucuccuggccucccagggaaagcgggagccuccgguuuccccggcacaaagggggagaugggaaugaugggcccuccaggucccccugggccacugggaauccccggccgcucaggcgugccggggcuuaaaggagaugacggucugcaaggccagccuggguugcccggaccaacuggcgagaaggguagcaaaggggaacccggccucccuggaccacccggcccuauggauccaaaccuguuagggaguaagggagagaaaggugaaccgggccugcccgggauaccuggaguaucuggcccaaaggguuaucaggggcuacccggcgacccuggacaaccaggccucuccgggcagcccggacugccggguccuccaggccccaaggggaauccuggacuucccggccagccagguuugaucggcccgccugggcugaaaggaaccauuggcgauaugggguuucccggaccacagggcguugagggucccccugggccaagcggagugcccggccaaccugguucgccaggccucccggggcagaagggagacaaaggcgaucccgggaucucuuccauuggacugccuggcuuaccaggucccaagggggaaccuggacugccaggcuaccccgguaacccuggcaucaaagggucagucggagacccgggccuucccggguugccaggaacaccuggcgcaaagggucagcccgggcucccaggauucccuggcacccccggcccaccggggccuaagggaauaaguggucccccaggcaaucccgggcugccuggagagccaggccccgugggugggggaggccacccuggccagccggggcccccaggagagaaagguaagccuggccaagaugggauucccggaccagcuggccagaaaggugaaccugggcagcccggauuuggcaacccaggcccgccugggcuacccggacugagcggucagaagggcgacgggggacucccaggcaucccugguaaccccgggcugccaggaccuaaaggcgagcccggcuuccauggguuuccgggagugcaagguccacccggcccuccagggucccccggaccugcccuugaaggcccgaaggguaaucccgggccacagggaccucccggcagaccaggcuugccugggcccgagggaccaccuggucugcccggcaacgggggaauuaagggcgaaaaagguaauccggggcagccuggcuuaccaggacuccccggccugaagggggaucaaggaccuccaggucuucagggcaaccccgggaggccgggacugaauggcaugaaaggugacccuggguugcccggcgucccaggauuccccggcaugaaggggccuucuggaguuccagguagcgcuggccccgagggggagccuggacucaucggcccaccgggucccccugggcugccaggccccucaggacagaguauaaucauuaaaggcgaugccgggccuccaggaauccccggucagccgggccuaaaggggcugccuggaccacaaggcccccagggucucccuggccccacggggccaccuggagaccccggccggaacgggcugccaggauuugacggcgcaggugggcgaaagggagauccgggccuucccggucagccuggcacucgcggguuggacggaccacccggcccugaugggcugcagggaccacccggcccuccggguacauccagcguggcccacggguucuuaauuaccagacacucucaaacuacagacgcuccacagugcccccagggaacccuccagguauaugaaggcuucucacugcuuuacgugcaagguaauaaaagggcgcauggccaggaucuggggacggcaggaaguugucuacggcgcuuuagcaccaugccuuucauguuuugcaacaucaauaacgucuguaauuucgccuccagaaacgacuauucuuacuggcucucgacaccagagcccaugccuaugagcaugcagccccugaagggccaguccauacaaccauuuauuucaaggugcgcugugugcgaagccccggcaguugugaucgccguccacagucagacuauccagauuccucauuguccccaagggugggauucuuuguggaucggauacagcuucaugaugcacaccuccgcuggcgccgaggguucagggcaggcacuggcgagcccaggaucuugcuuagaagaguuucguuccgcuccuuucauugagugucacggccggggcacaugcaauuauuacgccaacaguuauagcuuuuggcucgcaacuguggacguaucugauauguucuccaaaccccagucagaaacccugaaggccggggaccuucgaacaagaauaaguaggugucagguuugcaugaaacgcaccuga

SEQ ID NO: 54650 - RNA, 5001 nt, Artificial Sequence
  derived and/or modified sequence opt3 from COL4A6__Homo_sapiens__NP_001274688
augcaccccggccuguggcuccuucuggugaccuugugcuuaacagaggaacuggccgcugcaggggagaagagcuacggaaaaccuugugguggccaggacugcuccgggucuugucaaugcuucccagaaaagggagccagaggcaggccgggucccaucgggauucagggaccuacuggcccacagggcuuuacggggucaaccggacuaaguggucucaaaggcgagcggggguuccccggacugcuuggcccuuaugguccaaagggggauaaaggacccaugggcgucccuggcuuucuggggauaaacggaaucccaggucauccgggccagcccgggccucgcggaccacccggcuuggacgguuguaaugggacacaaggcgcgguuggauucccuggcccagauggguaccccggacuccuggguccgccuggccugcccgggcagaagggaagcaagggcgacccagugcucgcuccugguuccuuuaaagggaugaagggcgaucccggauuaccaggccuggacgggauuacuggaccccagggugccccuggcuucccaggggcaguaggaccggccggccccccuggucuucaggggccacccggcccuccaggacccuugggcccggaugggaacaugggacugggcuuucaaggugaaaaaggggugaagggagacgucggccuaccugguccagcuggccccccucccucuaccggggagcucgaguucaugggauuuccaaaaggcaagaaggggucgaaaggagaaccuggccccaaggguuucccagggaucucaggaccgccuggcuuucccggucugggcacaaccggggagaaaggagaaaagggcgagaaagggauuccaggacuucccggcccucgagguccaauggggagcgagggagugcagggccccccuggucagcagggcaagaaagggacucugggauucccgggcuugaauggguuucaaggaaucgaaggccagaagggugauauagggcucccaggacccgacguuuucaucgauauugacggcgcagugaucaguggcaacccuggggauccaggaguccccggucugccuggcuuaaagggggacgagggaauucagggccugcgugguccguccggggugcccggacucccagcccuuucuggcguaccuggcgcucuggggccccaaggauucccagguuugaaaggcgaccaggggaauccuggaagaacaaccaucggcgccgcgggucuacccgggagggauggacugccaggcccgccuggccccccagggcccccuagcccagaauuugagacggaaacucuccacaacaaggaguccggauuccccggucugcggggcgagcaggggccuaaaggaaaucuuggccugaaggguauaaaaggggacucaggauuuugcgcaugugauggcggcguuccgaacaccgggccacccggagaaccuggucccccaggcccuuggggguugauuggacuccccggccugaagggugcccgcggggacagaggaaguggcggcgcucaggggccagccggagcaccugguuuagugggcccgcuggggcccagcggaccaaagggcaaaaagggugagccuauccuaucuacaauucaagggaugcccggcgauaggggagacuccggcucacagggguuccggggagucaucggugaaccaggcaaagauggggugccuggacuccccggccugccgggucuuccaggggacggcggacagggcuuuccuggggagaagggauugcccggucugccaggcgaaaaagggcaucccggaccuccgggccuccccgguaaugggcugccaggccuuccuggaccccgcggccugccuggggauaagggaaaggacggcuugccaggucagcaagggcuccccggaagcaaaggcaucacucugccuugcauuauaccagguaguuauggccccucuggguucccgggaaccccuggcuuuccagggcccaagggaucccgaggcuuaccugguacaccagggcagcccggaagcucgggcucuaaaggugagccgggcuccccugggcuggugcaccuacccgagcucccaggauucccuggccccagaggggaaaagggacugccaggcuuucccggucuuccugggaaagauggauugccaggcaugaucggcucaccggggcugcccggaaguaagggugcuaccggcgacauuuucggggccgagaacggagcgccuggcgaacagggucuccaggggcugacgggacauaagggcuuuuuaggcgacagcgggcugccaggacuuaaagguguccacggcaagcccggguugcucggaccuaaaggcgagagggguuccccagggacucccggacaaguuggccagccuggcacaccggggucuagcggaccauacgguaucaagggcaaaucagggcugcccggagccccuggcuuccccgguauaagugggcacccaggaaagaaaggcacccggggcaagaaggggccucccggauccauugugaaaaagggucuaccaggccugaaagggcucccgggaaauccuggccugguaggucuuaaggggagccccggaucuccaggcguggcaggcuugcccgcucugucagggccuaaaggagaaaaggguagugucggcuuugugggguucccaggaauccccggcuuaccugguaucccggggacucguggacucaagggcauuccaggcagcacagggaaaaugggacccuccggucgcgccggcaccccuggggagaagggagauagaggcaacccaggucccguugggaucccuucucccaggcggccaaugucgaaucuguggcuuaaaggcgacaagggaagccagggcuccgcugggucaaacggauucccggguccucgaggcgauaaaggggaggccggacgccccggcccaccuggucugcccggggcaccaggcuugccuggaauuauaaagggcgugagugggaagcccggaccgccagguuuuaugggcaucagagggcucccuggacugaaaggcucuagcgguauuacgggcuuccccgggaugccaggagaauccggcucacaggggaucaggggaagccccggccuaccuggugccucugggcugccgggacucaagggcgacaauggucaaaccgucgagaucuccggcaguccagggcccaaaggacagccuggcgaaagcggguuuaagggaacaaaaggccgggauggucugauugggaacauaggauuccccggcaacaagggugaggacggcaagguggggguaucuggagauguuggccuuccaggggcuccuggauuucccggcguggcggguaugcgcggggagccaggauugccuggcuccucaggccaucagggggcaaucggaccgcuggguagucccggcuuaauugggccaaaaggaccuagcaucacuggcguccccgguccagccgggcucccuggacccaagggcgaaaaaggcuauccggggauuggaaucggugcuccaggcaagccugggcugagaggacaaaaaggcgacagggguuuccccgggcuucagggaccagccggccugcccggcgcaccugggauaucgcuacccucccucaucgccggacagccaggugauccuggccguccggggcuggacggagagcggggccgacccgguccagcugggccucccggaccaccuggccccucuagcaaucagggcgauaccggggacccgggauuuccugguauuccaggccccaaggggccuaaaggagaucaaggcaucccagguuucucaggguugcccggagaacugggcuuaaagggcaugagaggggagccuggauuuauggguacaccaggcaagguggggcccccgggagacccuggcuuccccgguaugaaagggaaggccggcccaaggggaaguuccggccuccagggggaccccggacagacuccuaccgcagaagcgguccaggugccacccgguccucugggccuuccagggauugauggaaucccgggccugacaggugaccccggggcucaaggcccuguuggauugcagggcucuaaagggcucccaggaauacccgguaaggauggcccuagcgggcugccaggacccccgggcgcccuaggugacccugggcugccaggccuucagggacccccuggcuuugagggggcacccggacagcaagguccauucggcaugccggggaugccuggacaguccaugcgcgugggcuacacccucguaaaacacucacagagcgagcaaguccccccaugucccauugguaugagucagcugugggugggcuauucuuugcuguuuguugaagggcaggagaaggcccauaaccaggauuuaggauucgcuggcuccugccucccucgguucagcacuaugccauuuaucuacuguaauauuaacgaagugugccacuacgccagaaggaaugacaagucguauuggcugucaacgacagcacccaucccuaugaugccagucucucaaacccagauaccgcaguacaucagucgcugcuccgugugugaggcucccagccaggccauugcgguacacucucaagauaucacuauuccucagugcccacuuggguggcgaagccuguggaucggauauuccuucuugaugcauaccgccgcuggcgcagaaggugggggacagucacucgugagucccggcagcugucuggaggacuuucgggccacaccuuucauagagugcucuggugcucguggcaccugucacuacuuugccaacaaauauuccuucuggcuaacuacaguugaagagagacagcaauuuggggaacugccagucucagagacgcuuaaggcaggacagcuccauaccagggugagucgcugccagguguguaugaaaagccuguga

SEQ ID NO: 54651 - RNA, 5517 nt, Artificial Sequence
  derived and/or modified sequence opt3 from COL5A1__Homo_sapiens__NP_000084
auggacgugcacaccagauggaaggccaggagcgcucugcggcccggcgcaccucuccuuccaccgcuguuguuacugcuacucugggcccccccuccaucccgcgcggcucagcccgccgaucugcuuaaaguccuggacuuccauaacuugccugaugggaucacaaagacuacgggauuuugcgcaacccgacguucuucaaaagguccagacguugccuacagagugacaaaggaugcucaacucagugcacccacuaaacagcuguauccugccagcgcuuucccagaggacuuuuccauucugaccacaguaaaggccaagaaaggcucucaggcguuccucgugucgauauacaaugaacaggggauccaacagauuggauuagagcugggcaggucaccggucuuucuuuaugaagaucacaccgguaagcccgggccugaggacuacccauuguuccggggaaucaaccugagcgauggcaaauggcaucgcauugcacuaagugugcacaagaaaaauguuacucucauccuggacuguaagaagaaaacaaccaaguuucuugauagauccgaccaucccaugauagauaucaacggcauuaucguguucgggacgaggauucuggacgaagaggucuuugagggagacauccagcaguugcucuucgugucugaucaccgggccgcuuaugacuacugcgaacacuauagcccugauugugacacugccguaccagauaccccccaaucccaggacccgaauccugaugaguacuacacagaaggugacggcgagggggagacuuauuacuaugaauaccccuauuacgaggauccagaagaccugggaaaagagccuacccccucaaagaaaccaguugaagcagcuaaggagacaaccgaggugcccgaagaguuaacgccuacuccaacagaagccgcgccgaugcccgagaccagugaaggcgccgguaaagaggaggaugucgggauaggagacuaugacuacgugccuagcgaagauuacuauacuccaucucccuacgacgaucugacauauggcgagggcgaagagaacccugaccagccaaccgaucccggggcaggagcugaaauuccgacguccaccgccgacacaucaaauagcaguaacccugcuccacccccuggugagggcgccgaugaccucgagggggaauuuacugaggaaaccauccgcaaucuugaugagaacuacuaugaccccuacuaugauccaacaucuuccccuagcgagauuggacccggcaugccagcaaaucaggacacuaucuacgaagguaucgggggcccgcgaggagagaagggccaaaagggggaaccugccauuauagagcccggaaugcugaucgaagguccacccggcccugaggggccagcuggauugcccggcccuccggguaccauggggccaacaggccaggugggagaucccggcgagagagggccuccaggaaggcccggucuaccuggcgcggacgggcugccgggacccccaggcaccaugcucaugcugccuuuccgguuuggugggggcggagacgcaggcucgaaagggcccauggucucugcccaggaaucccaagcucaggccauucuucagcaggcacgucuggccuugcgcggaccagcuggcccuaugggucucacugggagacccggaccaguuggcccgccugguucaggcgggcugaagggagagcccggcgauguggggccacaaggacccaggggcguacaggguccuccagggcccgccggaaaaccuggccggcgaggucgcgcaggcagugacggggcgagaggaaugccgggccagacggggccaaagggagauaggggcuucgacgguuuagcugggcugcccggagaaaaaggccaucggggugauccuggccccagcgggccaccuggacccccaggcgacgauggggagcgcggagacgauggcgaaguggguccuagagggcuaccgggagagcccggcccaaggggccuccuggggccuaagggacccccagguccucccggcccgccaggggucacaggaauggacggccagccuggucccaaggggaacgugggaccacaaggcgagcccggcccuccggggcagcagggaaaucccggugcccagggccuuccagggccucaaggagcaaucggccccccuggugaaaaagggccauugggaaagcccggccugccuggcaugccaggggccgauggacccccgggucacccuggcaaagaggggccacccggagaaaagggcggucaggggccuccaggaccccagggcccgauaggcuacccugggccccguggaguuaaaggugcugacggcauucgggggcucaagggaaccaagggcgagaaaggugaagauggguucccaggauuuaagggcgacaugggcaucaaaggggaccgaggagagaucgguccucccggcccaagaggggaggauggacccgaaggcccuaaggguagggggggcccaaacggagacccgggcccccuggggccuccaggagagaaagguaagcuuggcgugcccgggcugccuggauauccaggccgccagggucccaagggguccauuggcuucccuggauuuccgggcgccaauggggaaaaaggaggucggggcacuccagggaagcccggaccuagaggccaaaggggucccaccgggccacgcggcgagcgaggaccucggggcaucacagggaaacccggaccaaagggcaacucugguggggauggaccggcaggcccucccggugagcguggcccaaacgggccccagggaccuaccggcuucccagggcccaaaggaccuccgggcccacccgguaaggacggguugccuggacauccaggccagagaggugaaacuggcuuucaagggaaaacaggacccccuggccccccaggggucgugggaccgcagggcccuacgggugagaccgggcccaugggagaaaggggccacccaggcccucccgggccaccuggagagcagggucuccccggccuggcugggaaggaaggaacuaagggcgauccggguccagccggguuaccuggaaaagacggccccccaggccugcgcggguuccccggagaucggggucuaccuggcccgguaggggcgcucggacugaagggcaaugaggguccacccgggccucccggaccagccggcagcccuggcgagagagggcccgcuggagcagccgguccaauuggcauaccugggaggccgggaccccagggcccaccuggucccgcuggggaaaaaggagccccaggcgagaagggcccucaagggcccgcaggacgagacggucuucagggcccgguuggguugccaggaccugcgggccccguggguccacccggggaagauggagacaaaggcgagaucggcgaaccugggcagaagggaucaaagggugauaaaggcgagcaggggcccccaggaccuacaggcccgcaaggucccauugggcagccaggaccuaguggcgccgacggcgagcccgggccacgcggacagcagggucuguuuggccaaaagggggacgaaggaccucggggcuuccccgguccgccugggccagucggccuccagggacugcccggcccuccaggggagaaaggagaaaccggugaugugggccagauggggcccccuggaccacccggcccgagagguccuuccggggcucccggcgccgacggaccacaaggccccccugggggaaucgguaacccaggcgcagucggggagaagggagaacccggcgaggcuggugagccuggcuuaccaggggaaggaggcccgcccgggccuaaaggagagaggggcgaaaagggugagagcgggccaucuggagccgcaggccccccugguccaaagggccccccgggggaugacggaccuaaaggcucaccagggcccgugggauuuccuggcgaucccgguccaccgggggagccuggacccgccggccaggacgguccacccggcgauaagggggacgauggagaaccuggccagacagggaguccaggacccacuggcgagccugguccaagcgggccgcccggaaaacguggcccuccaggccccgcugggccugaaggacgccagggugagaagggcgcgaaaggggaagccggacuggagggcccacccgguaagaccgggccuaucggaccgcaaggcgcacccggcaagccagggccugacggacuucgggguauucccggcccaguuggggagcagggauugccuggcucccccgguccagaugggccgccuggacccaugggcccacccggccucccugggcugaaaggagacucugguccaaagggcgaaaaagggcaccccggacuaauaggccugaucgguccuccgggggagcagggagaaaagggcgauagaggccuccccgggccacagggaucgagcgguccuaaaggcgagcaagggauuacgggacccuccggcccaaucgguccucccgggccaccgggacugccuggccccccaggcccuaagggggcuaaaggaucaaguggucccaccggcccaaagggggaagccggacauccuggccccccggguccacccgggccuccaggcgaggugauucagccccuuccuauccaggccucuaggacacgacggaauauagacgcuagccaguugcuggacgauggaaacggcgagaauuacguagacuaugcagaugggauggaagagaucuucggauccuuaaacucacucaagcuggaaauugagcaaaugaaacgcccgcuugguacucagcagaaucccgccagaaccugcaaggaccugcaguugugucacccagauuuuccugacggcgaauacugggucgaucccaaccaagggugcagcagggacucuuucaaaguguauuguaauuuuacagcgggaggcuccacuugcguuuucccagauaagaaaagugagggugcucggaucaccagcuggccuaaggagaaccccgggucuugguucuccgaauuuaagcgaggcaaacuccugucauacguggacgccgagggaaauccagucggcgugguacagaugacguuccuaagacugcucagugcaagcgcccaucagaacgugacauaucacuguuaccaaucgguugcuuggcaggaugcagccaccggguccuacgacaaggcgcugcgcuuucuuggaucuaaugaugaagagaugagcuaugacaacaauccuuacauuagggcuuuggucgacgguugcgccacuaaaaagggcuaucagaaaacagugcuggagaucgauacccccaagguggaacaggucccgauaguugacauuauguucaacgauuuuggggaggcaucacaaaaguucggauuugaagugggcccugccuguuucauggguuga

SEQ ID NO: 54652 - RNA, 4500 nt, Artificial Sequence
  derived and/or modified sequence opt3 from COL5A2__Homo_sapiens__NP_000384
augauggccaacugggcugaggcaagaccccugcucauccuuauugugcuguugggccaguucgucagcauaaaggcccaagaagaggacgaagaugagggguacggagaagagaucgcgugcacccagaauggucagauguauuuaaacagggacauuuggaaaccugcuccaugucagaucugcguuugugauaauggcgccauucugugcgacaagaucgagugucaagaugugcuagacugcgcagauccgguaacacccccuggggaauguugcccaguguguucccagacucccggaggcgguaacacgaauuuugggcggggacgcaaaggccagaagggcgagccugggcucgucccagugguuaccggaauacgaggucgucccggcccugccgggccaccgggaucucagggccccagaggugaaagggggccuaaaggacggccaggcccccgcggcccucaagggaucgacggagagccaggugugcccggccagccgggggcuccuggacccccaggccacccuucacaucccgguccagaugggcugaguagacccuucagcgcacagauggccggccuugacgagaaguccggacugggcucucaggucggguugaugccuggaucgguggguccaguaggcccgagggggccccaaggacuccagggccagcaagguggggcuggcccuacaggaccacccggcgaaccuggggauccaggacccauggguccgauuggcucacgggggccugagggaccacccggcaagccuggugaagacggggagcccggccgcaacggaaauccaggcgaaguuggguuugccggaagcccuggcgcgcgagguuuccccggggcaccaggacugccgggccugaaaggucacagaggccauaaggggcucgagggaccuaaaggcgaggugggggcccccggaaguaagggcgaagcugguccaacugggcccaugggagccaugggcccuuuagguccaaggggcaugcccggggagcggggacgucugggcccucagggggcaccgggacagcgcggcgcucacgguaugccagggaaacccggaccuaugggcccacuugguauccccggcuccucuggguuuccuggaaacccgggcaugaagggggaagccggacccaccggcgcgagagguccagaggggccucagggacaaaggggcgaaacaggacccccagggccugucggaagccccgguuugccaggcgccauugggaccgauggaacuccgggcgcaaaggguccuacagggucccccggaaccucaggcccacccggcagugcugggccuccaggaagccccgguccucagggcucuacggggccgcagggaauccggggccagccaggugaccccggggugccuggauucaaaggcgaggccggccccaagggggagccaggaccucaugguauacaaggccccauugggccaccuggagaagagggcaaacgagguccgcgcggggaccccggaacugugggcccaccuggccccgucggggaaagaggagcuccagguaauaggggcuuuccuggguccgauggacugcccggcccgaagggugcccagggggagcggggaccaguuggcucaagcggcccuaaagggagucagggagaccccggucgcccaggcgaacccgggcuaccuggagcaagaggccucaccgguaacccgggggugcagggccccgagggaaagcugggcccacuuggggccccuggagaggaugguaggcccggcccuccagggucuaucggcauucguggccaacccgguuccauggggcugccuggcccaaaaggaagcucgggcgaccccgggaagccgggagaagcugguaaugcgggcguaccugggcagcggggagcaccaggcaaggauggugagguggggcccucuggcccugucggaccacccggcuuggccggggaacgaggagagcagggcccgccuggucccacaggguuccagggacucccaggcccucccgguccacccggcgagggaggaaaaccuggcgaccaaggggugccaggagauccgggcgcuguugguccccuggggccuagaggagaaaggggcaacccaggugagcgcggcgaacccgggaucacuggauuaccuggcgagaaggggauggccggaggccacgguccagacgggcccaaaggauccccuggcccgucaggcaccccaggggauacaggacccccuggucugcagggcaugcccggggaacggggaaucgcaggcaccccagguccuaagggggacagaggaggcauuggcgagaaaggggccgagggaacggcugguaaugauggcgccagggggcuccccggaccacuuggcccgccuggucccgcagggccaacuggagaaaagggcgagcccggcccucgcgggcuggugggaccacccgguagucgaggcaacccugggagccggggagaaaauggcccgacaggugcggucggguuugcuggaccacagggccccgacggccaaccuggggugaagggagagccaggugaacccggccagaaaggggacgccggauccccuggcccccaggguuuggcagggucuccaggaccgcacggcccuaacggcguacccgggcuaaagggaggucguggcacccaggggccaccuggagccacuggcuuccccgguagcgcugggagaguuggaccaccuggccccgccggcgcaccggggccagcuggaccucugggugagcccggcaaagaggggccacccggacucaggggcgauccugguucacaugggcgcgugggcgaccggggaccggccggcccacccgggggaccuggugauaagggcgaccccggggaagauggacaaccaggcccugacggucccccagggccugcgggcacaaccggacagagaggcauagucgggaugccgggacagaggggugagcgaggcaugcccgggcugccaggaccugccggcacgcccgguaaagugggcccaaccggggcuacaggagauaagggcccucccgggccggucggaccaccuggcaguaacggucccgugggggaaccaggacccgagggcccugcagguaaugacggcacucccgggcgcgauggagccguuggcgaacggggcgacagaggagauccaggcccugcuggucuuccggggucccagggagcccccggcaccccagguccugugggcgcacccggggacgcgggacaaaggggcgauccagggagccguggaccuaucgggcccccgggucgcgccgggaagcggggacugccuggcccacagggccccagaggggacaaaggagaccacggugauaggggcgaccgagggcagaagggacaucggggcuuuacagguuugcaggggcucccuggaccacccggcccuaacggcgagcaagggucugcugggauuccaggucccuucggcccgcgcgggccucccggaccaguaggccccucagguaaagaggggaauccuggaccacugggccccaucggcccuccaggggucagaggaagugugggugaagccggcccggaggggcccccuggagaaccaggucccccuggcccacccgggccgccuggacacuuaacugcagcucugggcgauauaaugggccacuacgacgagagcaugccagauccccuaccugaguuuaccgaagaccaggccgcacccgaugacaagaacaaaacagauccagggguucaugccacccucaagucccugucuucgcagauugagacuaugaggagcccggacggauccaagaaacacccugcucggacgugcgaugaccuuaaguugugucauucagcgaaacaaaguggugaauauuggaucgaucccaaucagggcucuguggaggacgccaucaaggucuacugcaacauggaaacaggggagaccugcauuagcgcaaauccauccucagugccccgaaaaacuuggugggcuagcaagucuccugacaacaaaccaguaugguauggacuggauaugaauagaggcucccaguucgccuacggugaccaccagagucccaacaccgccaucacacaaaugaccuuccuccgccugcuuagcaaggaggcuucucagaauauuacuuauauauguaagaacuccgugggguacauggaugaccaggccaaaaaucugaagaaagcaguugucuugaagggagcgaacgaucucgacaucaaagcugaaggcaauauuagguuucguuacaucgugcugcaggauacaugcucaaagcggaacggcaacguggggaagacggucuucgaguauagaacccaaaauguugccagguuaccuaucauugaccuggcaccaguggaugugggagguacugaccaggaauuuggcguagagauagggccggucuguuucguguga

SEQ ID NO: 54653 - RNA, 5238 nt, Artificial Sequence
  derived and/or modified sequence opt3 from COL5A3__Homo_sapiens__NP_056534
augggaaacagaagggaccuggggcagccccgggccggacucugccuucuguuggcugcauuacagcugcuaccugguacccaggccgauccaguggacguccucaaggcgcugggcguucaagggggccaggcuggcgugccggaaggucccggguucuguccucagcgcacaccagaaggagaucgagccuuucguaucggccaggcaagcacucuuggcauucccacgugggagcuguucccugaagggcacuuuccagagaauuucuccuugcucauaacccugagaggacagcccgccaaccagucuguacugcucucaaucuacgacgaaaggggugcucggcaauuaggccuggcacuugggccugccuugggacugcuaggcgauccauuucgcccgcucccccaacaggugaaucugacagacgguagauggcacagggucgcugugaguauugauggggagaugguuacucuuguggccgacugcgaggcgcagccuccaguccugggacacggcccccgguucaucagcauugcaggcuugaccgugcucgggacacaagaucugggagagaaaaccuuugagggugacauccaggaauuacugauauccccugauccacaggccgcuuuccaagccugugagcgcuaucuccccgacugcgauaaccuugcaccggcugccacuguagcgccucagggcgagcccgaaacaccacgaccuagaaggaaggggaaaggaaagggccggaaaaagggucgugggcgcaagggcaaaggaagaaagaaaaauaaggagaucuggaccucuucgcccccacccgacucagccgaaaaccagacgagcacugacauuccuaaaaccgagacaccagcaccgaaucugcccccuacuccaacccccuugguugugacaaguaccgucacgacuggccuaaacgcuacaauccuggaaaggucccucgauccugacucugggaccgagcugggaacucuugagacaaaggccgcucgggaagaugaggaaggugacgauagcaccaugggcccagacuuucgagccgcagaguaccccucccgcacgcaguuccaaauuuuuccgggggccggagaaaagggcgcuaaaggugagccugcggugaucgagaaggggcagcaguucgaaggcccacccggagcaccuggcccccaggggguggucggaccaucagguccucccggcccaccgggguuuccuggagaucccggcccacccgguccugccgggcugccaggcauacccggaauugacggcaucagagggccuccgggaaccguuauuaugaugccauuccaauucgcuggcgguaguuuuaaagggcccccugugagcuuccagcaggcccaggcacaagccguauugcagcagacacagcucucuaugaagggaccacccggcccugugggucugacuggcaggccggggcccgucggauuaccaggccauccugggcugaaaggagaggaaggcgcugaggguccccaagggccacggggacuacagggcccucacggucccccaggccgcguggggaagaugggaagaccgggcgccgauggggcaaggggacucccuggcgacaccggucccaaaggggaucguggauuugacggccugccaggucuucccggcgaaaaggggcagcggggagacuucggccauguugggcaaccuggaccacccggcgaggauggugagcgaggggcggaaggaccuccgggcccaacaggccaggcuggggagcccggaccuagagguuugcugggccccaggggguccccaggaccuacuggccgccccggugugaccgggaucgacggagccccaggcgcaaagggcaaugucgggccuccgggagaacccgguccaccuggccagcaggggaaccacggaucacaaggccuccccgguccacaggggcugaucggaacaccuggcgagaaaggacccccggggaauccaggcauuccuggucuucccggcagcgaugggccacugggacaccccggccaugaggguccuaccggggaaaagggagcccagggcccgcccggcagugcugggccaccuggauaucccgguccucggggcgugaaagggacuucuggaaacagaggcuugcagggugagaagggggaaaaaggagaggacggcuuuccaggcuucaagggggauguaggacucaagggugaccaaggcaaacccggggccccuggaccaaggggcgaagauggucccgaggggccgaagggccaggcaggacaggcuggcgaggaagggccuccaggauccgccggugagaaaggcaagcuggggguucccggauuaccuggcuacccaggucgccccgggccgaaaggcagcauaggauuuccuggcccccuggggccaaucggagaaaaggguaagucgggcaaaacggggcagccuggacuagagggcgaacgaggucccccagggucucggggcgagcguggacaacccggcgcgacagggcagccuggaccaaagggcgacgugggucaggauggggccccgggcauucccggcgagaaaggucucccuggccugcaagggccacccggauucccuggcccaaaggggcccccuggacaccagggcaaagacgguagaccggggcauccaggacagaggggcgaacuugguuuucagggccaaaccgggcccccuggacccgcuggcgucuuggggccacagggaaagacuggcgagguggguccucugggggaacgcggacccccaggcccgccuggacccccaggggagcagggacuccccggucuggaaggccgggagggggcaaagggagaguuaggcccuccagguccccuggggaaagaaggaccugccggccuuagaggcuucccggggccaaagggaggucccggcgauccugggccaaccggauugaaaggcgacaagggucccccugggcccgucggagcuaauggcuccccaggcgagagggggccgcucggaccugccgguggcaucgggcugcccggacagucaggcagugaagguccaguggggccugcaggcaaaaagggcagccgaggcgagcgcgggcccccaggaccuacagguaaagauggcauacccgggccgcuaggaccacugggcccucccggugcggccgggccauccggagaggaaggcgacaagggcgacguuggggcucccggacacaaggguucuaaaggcgauaagggggacgccggaccuccgggccaaccagguauucgggggcccgcaggacacccuggacccccaggcgcugauggggcccagggaagaagggguccucccggccucuuugggcagaaaggagacgauggcgugcgugguuucguaggggucaucggcccaccuggacugcagggccuuccggggcccccaggagagaagggugaagugggcgacguugggagcaugggaccucauggcgcacccgguccacgcgggccucaaggccccaccggaucagagggcacuccgggguugccaggaggugugggccagccuggggccgucggagaaaaaggcgagcggggugaugcuggcgaccccgggccacccggagcgccuggcauccccgggccaaagggagauauuggcgagaagggugacagugggccuuccggagccgcaggcccgcccgguaaaaagggcccaccuggggaagauggagcuaaaggcagcguggggcccacaggacugccaggcgacuuagguccucccggggauccgggaguaucuggcaucgacgguucaccuggcgagaagggggacccaggagaugugggcgggcccggaccuccaggcgccaguggugaacccggggccccuggaccacccggcaaaagaggcccgagcgggcacaugggaagggagggucgagaaggcgagaagggggcuaagggagagccuggccccgacgguccacccgggcggacgggaccuaugggcgcacgcggcccacccgggagaguuggaccugaaggucucaggggcauuccagggccggucggagagcccggccugcuuggugccccugggcagaugggaccacccggcccucugggcccauccggguugcccggacucaaaggugauaccggcccgaagggggaaaaaggacauauaggccugaucggucuaauugggccuccaggagaggcgggcgaaaagggcgaccaggggcugcccggagugcaagguccucccggcccaaaaggggauccgggaccucccggcccaaucgguucucucgggcaccccggaccuccaggcguggcuggcccccuggggcagaagggaucgaaggguagcccuggcuccauggggccacggggagacacuggcccggccggucccccugggccacccggcgccccugcagagcuucauggauugcgaagacgcaggcguuuugucccaguuccccugccugugguggagggcggguuagaagagguacucgcuucacugacaagucuuucucuggaacuagagcagcuccggagaccgcccggaaccgcagagaggccaggucuggucugucacgaauugcaccgcaaccauccucaucugcccgauggcgaguauuggaucgacccaaaucaagggugcgcccgagauagcuucagaguguucuguaacuuuacagcgggaggcgaaacuugcuuauacccugacaaaaaguucgagauuguuaaacucgcuuccuggucaaaggaaaaacccggugggugguauagcaccuuucggaggggcaagaaauucucuuacguggaugccgacggauccccagucaacgugguucagcugaauuuucuuaagcuguugagugcaacggcccgccagaacuucaccuacagcugucagaaugcugccgcauggcucgacgaggcuacaggcgauuauucucauuccgcccguuuucuggggacuaacggagaggaacuaucauucaaucaaaccacagcggccacugugaguguaccgcaggacgguugcagacugcggaagggccagaccaaaacgcuuuuugaguucagcucguccagggcaggguuucucccucugugggaugucgcugccacagacuucggacagaccaaccaaaaguuuggcuucgaauugggucccguguguuucucuagcuga

SEQ ID NO: 54654 - RNA, 3087 nt, Artificial Sequence
  derived and/or modified sequence opt3 from COL6A1__Homo_sapiens__NP_001839
augagagccgcuagggcacugcucccccuucuguugcaggccugcuggaccgcggcucaagacgagccugaaacaccacgggccguggcauuccaggauuguccggucgacuuauuuuucguucuggauacuagcgaguccguggcccuacgccucaagcccuacggcgcucugguagacaaagugaagucuuuuacgaaacgauucaucgauaaccuucgugacagauauuacaggugcgaucggaaucuggucuggaacgcaggggccuugcacuauucagacgaaguggagauuauacagggacucacccgcaugccugguggcagagaugcucugaagaguagcguugacgccgugaaauacuuugggaagggaacauauacugauugugcgaucaagaaaggccuggaacagcucuuagucggugggucccaucugaaggagaauaaauaccuuauugugguaaccgacggacacccauuggagggcuauaaggaacccugcggcgggcuggaggaugcaguuaacgaagccaaacaucuaggagugaaggucuucucuguggcuaucacaccugaccaccucgagccaaggcugucgauuaucgccaccgaccauacuuaccggcgcaauuuuacagcagcugauuggggucaaucacgagacgccgaggaagcgauaagccagaccaucgauacgauuguggacaugaucaagaacaaugucgagcagguuuguugcaguuucgaaugucagcccgccagaggcccuccagggcuuaggggagauccgggcuuugagggugaacgggggaaacccggacugccuggcgagaagggcgaggcaggggacccaggacgucccggugauuugggcccugugggguaccaaggaaugaaaggcgaaaaggguucccgcggggagaaaggcucuagaggaccaaagggcuauaaaggggaaaagggaaagagggguauugacggcguagauggggugaaaggagagaugggcuaccccggucucccggggugcaagggcagcccuggauucgacggcauccaggggcccccaggaccuaaaggugaucccggcgcuuuugggcugaagggagaaaaaggcgagccaggugccgacggggaggcuggccggcccggauccucaggcccuaguggggacgaaggacagccaggcgagccgggucccccuggggaaaagggagaggccggcgaugaagguaacccaggccccgacggggcaccuggagagcgaggcgggccaggagagcgcggccccagagguacuccggggaccaggggaccucggggcgauccaggugaagccggcccccagggggaccaaggacgcgagggcccugucggggugcccggagauccaggcgaagcugguccuauagggcccaagggauauagaggcgacgaggguccaccgggcagcgagggggcgaggggagcaccuggccccgccgggccacccggagauccuggcuuaaugggugaacguggggaggacggaccagcuggcaauggcacagaaggguuccccggauuuccugguuacccgggcaaccgaggggccccaggaauuaauggcacuaaagguuaucccgggcugaagggagaugagggcgaagcaggcgacccuggggaugacaacaaugauaucgccccacggggaguuaaaggugcuaagggcuacagagggcccgagggaccucagggcccgcccggucaccaggggccaccuggacccgacgagugugaaauucucgacaucaucaugaaaaugugcucuuguugcgagugcaaguguggcccaauugaucuucuguucguguuggacuccucagaaagcauaggccuacaaaacuucgagaucgccaaggauuuugucgugaaaguaauugacaggcugagucgcgaugaacucguuaaguucgagccugggcagucuuaugcaggagugguccaguacucccacagccagaugcaagagcaugugucgcugcggucucccuccaucagaaauguccaggaacuuaaagaggcgauaaagucacugcaguggauggcugguggcaccuuuacaggggaagccuugcaguacaccagggaccaacuccugccaccgaguccuaacaaccgcauugcauuagugaucacggauggacgaagcgacacucagcgggauacaacuccccugaauguucuaugcuccccaggcauccaggugguaucugucgguauuaaagacguguucgauuuuauccccgggagcgaccagcucaacguuauuucaugucaaggacuggccccuagucagggccguccaggccuuuccuuggugaaggagaauuaugcugaacugcucgaggaugccuuccugaagaacgucaccgcacagauaugcaucgacaaaaagugucccgacuacacaugcccuauuaccuuuagcucuccggcugauaucacgauccuucuggacgggucagccagugugggaagccacaauuucgauaccacaaaaagauuugcgaagagguuggccgagcgcuuccucacugcuggucggaccgacccagcacaugauguaagaguggccguuguccaguauuccggcacagggcaacagaggcccgaacgagcuucucugcaguuuuuacaaaacuacacugcccuggcaucggcgguggacgccauggauuucauuaaugacgcuaccgaugugaacgacgcccuaggauaugucacacgcuuuuaccgggaggcaagcuccggcgcugccaaaaagagacuccugcuuuucucagaugguaauagucagggggcaaccccugccgcuauagaaaaagcgguucaggaggcccagagggcaggaaucgagauuuucguggugguagucggccgucaagugaacgaaccccacauccgcguuuuggugacuggcaagacggcugaguaugacgucgccuacggggaaucucaccuguuucgggugccaagcuaccaggcccuccugagaggaguuuuccaucagacaguguccaggaagguagcuuuagguuga

SEQ ID NO: 54655 - RNA, 2757 nt, Artificial Sequence
  derived and/or modified sequence opt3 from COL6A2__Homo_sapiens__NP_478054
augcugcaggggaccugcagcgugcuccuucugugggggaucuugggagccauucaagcucagcagcaggaggucauaucccccgacacaacugaaagaaacaauaacuguccugagaagacggauugcccaauccacguuuacuucguguuagacaccucugaaucaguaacaaugcaaaguccgacugauauucugcuauuucauaugaaacaguucgugccccaguuuaucagccagcuccaaaaugaguucuaucuggaccaggucgcacuuuccuggagguacgguggccugcacuuuucugaucagguggaaguuuucucgccuccagggucagaccgggccagcuuuauuaagaacuugcagggaaucaguuccuuccgccgaggcaccuuuacagauugugcgcucgcuaauaugaccgagcaaauacgucaggacagaucuaaagguacugugcauuucgccgucgugaucacagaugggcacguaaccggaagccccugcggcggcauuaagcugcaggcagagagggcccgggaagaggggauccgccuguuugcuguugcaccuaaccaaaaucucaaagaacagggauuaagagacauugccuccacgccacaugagcuguauaggaacgauuacgcuacuaugcuucccgacucaaccgagaucgaucaggacacaauaaaucggauuaucaaggugaugaagcacgaagccuauggugaguguuacaaagucaguugcuuggaaauuccuggcccaagcgggccgaagggauaucgcggccagaaaggugcgaaggggaacaugggagagcccggcgaaccuggccaaaaagggcgacagggagacccagguaucgagggccccaucggguucccuggaccaaagggcgugcccgguuuuaagggggagaaaggcgaguucggagcagauggcagaaagggggccccgggacuggcugguaaaaauggcacugacgggcagaagggaaaacuaggcaggauugguccucccggguguaagggcgauccaggaaaccggggcccugacggguaccccggagaagccgguucuccaggcgaacguggggaucagggaggcaaaggugaccccgggcgcccuggcagaaggggaccaccgggcgagauaggggcaaagggauccaagggcuaccaagguaauucaggggcucccggaagcccuggcgugaaaggugccaagggcgggccaggaccccggggcccuaaaggggaaccaggacgacgcggcgaucccgguaccaaggggaguccgggaucugacggcccuaaaggugagaagggcgauccagggcccgagggaccuagaggccucgcgggggaagucggaaacaagggcgccaaaggugacagggggcugcccggaccacggggcccucagggugcacuuggcgagcccgggaagcagggaucccgcggcgauccaggggacgcuggaccgagaggcgacagcggucagccugggcccaaaggagauccaggcaggcccggcuucucguauccugggccacguggagcccccggugaaaagggcgagccugggccgcggggaccagaaggcggucgaggggacuuuggacugaaaggcgagcccggcagaaagggggagaagggagaaccugcugauccaggucccccuggcgagccggggcccaggggaccacgcggcguuccuggucccgaaggggagccaggaccucccggcgacccaggcuugacagagugcgaugugaugaccuacguacgggaaacgugugggugcugugacugcgagaaaagaugcggagcccucgauguggucuucgugaucgacucuuccgaaucaauugguuauacuaauuuuacacuggagaagaacuucguuaucaacguggucaauagguuaggcgcaauagccaaagauccgaagagugaaaccgggacucgcgugggaguaguucaauacagccacgagggcacauuugaggcuauucagcuggacgaugaacgaaucgacucccucucuagcuucaaagaggcggugaagaaccuugaauggaucgccggugggaccuggacgccuucagcacugaaguuugcuuaugaucgguugauuaaagagagucguagacagaagaccagggucuucgccguggucaucacagacggacgccaugacccccgggaugacgaucuaaaucugagagcacucugugacagggaugugacuguuaccgccauuggcauaggcgacauguuucacgaaaaacaugaguccgagaaccuguacagcaucgcuugcgauaagccacagcaagugcgaaauaugacacuuuucucugaccugguagccgaaaaauuuauugaugacauggaggaugucuugugucccgacccucagaucgugugcccagaucuccccugucagacugacgcaccuuggccgggcggagaaccacccguuaccuuccugcgcacagaggaagguccugacgcgaccuuuccccggacuaucccauuaauucaacagcugcuaaacgcuacggagcucacacaggauccugccgcauauucacagcugguggccguccuuguguacaccgcugagagagccaaguucgcaacuggcguagaaaggcaagacuggauggaguuguucauagauaccuuuaaacuggugcaccgugacaucguuggggaucccgaaacagcucucgcccugugcuga

SEQ ID NO: 54656 - RNA, 9534 nt, Artificial Sequence
  derived and/or modified sequence opt3 from COL6A3__Homo_sapiens__NP_004360
augcggaagcacaggcaucugccccucguggccgucuucugccuuuuucugagcggcuucccuaccacacacgcucagcaacagcaggcagacguuaaaaacggggccgcggcugauaucauauuuuugguggacuccucuuggacuauuggagaagaacauuuccaguuaguacgggaauuucuguacgauguggucaagucacuagccgugggugaaaaugacuuccacuuugcacucguucaauucaacggcaauccacauacggaguuucugcuuaacaccuaucgcacaaaacaggaagugcugagucacaucagcaauauguccuacauugggggaacuaaccagaccggcaaggguuuggaguauaucaugcagucucaccucacaaaagccgcugggucgcgagcaggagauggcgucccgcaagugauuguaguucugaccgacggccauucaaaggaugggcuggcccuccccagcgcugaguuaaagagugccgacgugaaugucuucgcgaucggaguggaagaugcagacgagggugcccugaaagaaauagcuuccgagccucuuaacaugcacauguuuaauuuggagaacuucacuucucugcaugauaucgugggcaaucuagucagcuguguucacuccucagugaguccagaacgugccggggacacagagacccucaaggauauuacggcacaggacagcgcugacaucauuuuucugaucgauggaucuaacaauacuggcuccguaaacuucgccgugauacuugacuuccuggucaauuugcucgaaaaacugcccauugguacccagcagauccggguggggguugugcaauuuucagaugagccuaggacaauguucagcuuagacacuuacaguaccaaggcgcagguccugggagccgugaaagcacucggcuuugcuggcggggaacuugccaacauuggacuggcuuuggauuucguaguugagaaccacuuuacacgggccgguggcucucgcguggaggaaggggucccacaggugcuaguccugaucuccgcaggacccagcucggacgagauccgcuauggcgugguugcccucaagcaggcuucuguguucuccuuuggucugggggcgcaggcagccucaagggcugaacuucagcauauugccaccgaugacaaucugguauucacggucccugaguuucggaguuucggcgauuugcaggaaaagcuccugccauacauagugggaguugcacaacgccacaucguguuaaaaccgcccacuauugucacacaggugaucgagguaaacaagcgagacauaguguuucugguugauggcagcuccgcccuagggcucgcuaauuucaacgccauuagagacuuuaucgcaaaagucauccagaggcuggagauuggacaggaccuuauccaaguggcgguggcucaguaugccgauaccguccggccugaguucuacuucaauacucauccaacaaagcgugagguuauuaccgcagugcgcaaaaugaagcccuuggacgguucugcccuguacacgggcagcgcucucgauuuugugagaaacaaucuguucaccucaagugccggguauagggcagcugaaggaauaccuaaacuucugguauugaucacaggcgguaagucccucgacgagauuagccagccagcccaggaacugaagcggucuucaaucauggcguuugccaucgggaacaaaggcgcugaucaagcagaguuagaggaaauugccuucgacaguagccuggucuuuauacccgcugaguuccgagccgcaccgcuacagggaaugcucccuggccugcuugcgcccuugcgcacucuguccgggaccccagaagugcacucuaauaagagagauaucauuuuucuccuggacggaucggccaacguugguaaaacaaauuucccuuacgugagggauuuugucaugaacuuagugaauagccuggacaucggcaacgauaauauucggguugggcuugugcaguucuccgacacucccguaaccgaguuuucauugaacacauaucagaccaagagugauauccucggacaucugcgccaacuacagcugcagggcgguucugggcucaacacuggcagcgcucuguccuacgucuaugccaaucacuucacggaggcaggaggcucaagaauaagggaacacgugccacaacuuuugcuguuacucacagcugggcagagcgaggacucuuaccugcaggccgcaaacgcccuuacccgugcuggaauccugacuuuuugcgugggcgcgucccaggccaauaaagcagaauuggagcaaauugcuuucaaccccagucucgucuaucugauggacgauuucagcucucuaccugcccugccacagcagcucauccagccgcugaccacauacguuuccggugggguggaagagguaccccuugcccaaccugagucaaagcgggacauuuuguuucuguucgauggaagugcuaauuuagugggccaguuuccagucgugcgagacuuccucuacaagaucauagaugaacugaacguuaaacccgaggguaccagaauugcaguggcccaguauagcgacgaugucaagguggaaucgagguuugacgagcaucaguccaaaccugaaauccuuaaucugguuaagcgcaugaaaauuaagacuggcaaggcgcuaaaccucggguacgcucuggauuaugcccaacgguacaucuucgugaaaucugcaggaagcagaauagaggacggcgucuugcaguuucugguauuacucguggccgggaggucaagugaucgcguugacggaccagcuuccaaucugaagcagucuggcgugguccccuucaucuuucaagccaagaacgccgauccggcggagcuugaacagauugugcugagcccugcuuucaucuuggccgcagagucccucccaaagauuggugaccugcacccccagaucguaaaucuacugaaaucagugcauaacggggccccugcucccgucagcggagaaaaggacguuguguuucuucucgauggcagugagggugugcgaucuggcuucccacuguugaaggaguucguccagcgggugguugagucccuggacguagggcaagaucgugugagagucgccgugguucaguauagcgacaggacacgcccugaguuuuacuuaaauucguauaugaacaaacaggauguggucaaugcagugcggcagcucacgcugcuuggaggccccaccccaaacacuggggcugcccuggaguucguauugagaaacauacucgucucaucugcgggaaguaggauuacagaaggcgugccgcaacugcuaaucguucugaccgccgaccgauccggugaugacgugcgcaauccuagcgucgugguuaagagagggggagcagugcccaucggcauugguaucggcaacgcugauauuacagaaaugcagacuauaucuuuuaucccagacuucgccgucgcuauucccaccuuuagacagcuugggacggugcagcaaguaaucagcgagagggugacccagcucacacgugaggaacugucccgcuugcagccuguuuuacagccacugcccucaccuggagucggcgggaaacgggaugugguguuccucauugacggaagucaaagcgcaggcccggaguuucaguacgucagaacucugaucgaaaggcuuguagacuaccuggauguggguuucgacaccacacgaguugccgugauacaguuuucugaugacccaaaggucgaguucuugcuaaaugcccacuccucaaaagaugaagugcaaaacgcuguucagcggcugcgccccaaagggggaagacagaucaaugugggcaacgcgcucgaguaugucaguaggaauauuuuuaaacggccucugggcagccgaaucgaggaaggggugccacaguuccuuguauuaauuuccucuggaaagucggacgaugagguggacgaucccgcaguugaacugaagcaauuuggugucgccccuuucacuaucgcuagaaacgccgaccaggaggaacucgugaaaauuagcuugucaccggaguacguguucuccgucaguaccuuucgcgagcugcccucucucgaacagaagcugcuuacgccaauaacaacccugacuagcgagcagauccaaaaauugcuagcauccacaagguauccucccccagccguugaaucagaugcugcggacaucguguuccugauugauucuagcgagggcguacguccugacggguuugcccacauacgggacuucgugaguagaaucgucaggcgccucaauauuggacccuccaaggugcgaguuggcgugguccaguuuagcaacgauguauucccagaauuuuacuuaaaaaccuauagaucucaggcaccggugcuggacgcuauccggaggcuucgccugcguggugggucaccucucaauacuggaaaggccuuggaguucguugcaagaaaccuguuugugaaguccgccggcagucggauugaggauggcgucccccagcaucucgugcugguccuugggggaaaaagccaagacgaugugucgagguucgcucagguuaucagaucuuccgguauagugagccuaggcguaggggaccgaaauaucgauagaaccgaacugcagacaauuacgaacgacccacgguugguguuuaccgucagggaguuccgcgaauuacccaauaucgaggagagaauuaugaacucauuuggaccuagugccgcgacuccagcacccccuggcguugauacaccgccacccucuaggccugaaaagaaaaaggccgacaucguguuccugcucgaugguuccauaaacuuccggcgugacagcuuucaagagguccugcgcuucgugucagaaauuguagauaccguguacgaggacggggacaguauccagguuggacuugugcaguauaauagcgaucccacagacgaauuuuuccugaaagauuuuuccacuaagcgacagaucauugacgcuaucaacaaggucguguacaaaggcggcagacacgccaauaccaaggucgggcucgagcauuugagggugaaccacuucguuccagaggcuggaucucggcuggaucaacgcguaccucagauagcauuugugauuacggguggcaaaagcgucgaagacgcccaggaugugucccuagcucugacacagagagggguuaagguguucgccgucggagugaggaauaucgacucagaggaaguaggcaaaauugcaucuaacagugcgaccgccuuucggguggguaauguucaagagcucucggaacuuagcgagcagguccuggagacuuuacaugaugcuaugcacgaaaccuugugucccggggugacagacgccgcaaaggcuugcaaccuggaugugauccucggauucgacggcucccgagaccagaaugucuuuguugcccagaagggcuucgagucuaaaguggaugcaauacugaacagaauuucacaaaugcaccgcguaagcuguuccgggggaaggaguccaacugugcgggucucugugguugccaauaccccuagcgguccgguggaggcuuuugacuucgaugaguaccagcccgaaaugcuugagaaguuccguaacaugagaucacagcauccauauguccugacagaggacacgcucaaaguguacuugaauaaguuuaggcaguccaguccugauagcguaaaaguugugauccacuucaccgacggcgcggauggggaccuggccgauuuacaucgcgcaucugaaaaccuacggcaagagggaguccgagcucugauccucgugggccuugaaagaguggucaaucuggagagguugaugcaccuggaguuuggucgcggguucauguaugaccggccccucagacugaaccuucucgaucuggacuacgaauuggccgagcagcuggauaauauugccgaaaaggcaugcuguggaguuccaugcaaauguuccggccagcguggcgacagggggccuaucggaucaauuggucccaagggcauaccgggggaggacggauaucggggcuacccaggugaugaagggggcccuggagagcgcggacccccaggggugaacggaacucaagguuuucagggcugccccgggcagcgaggaguaaagggcagcagagguuucccuggggagaaaggcgaagugggagagaucggcuuagacgggcuagauggagaagacggugauaagggccugccggggucgucuggagagaaaggcaaccccgguaggagaggggacaagggcccacgcggagaaaaaggcgagagaggggaugucggaauuaggggcgacccugguaaucccgggcaggauagucaagagcgaggaccuaagggcgaaacaggugaccucggcccaaugggggugcccggacgggauggcguuccugggggaccaggcgagaccgguaagaacgggggauuuggccguagaggucccccgggcgcuaaagggaauaagggaggcccugggcagccaggauucgaaggcgagcaggguacucgcggggcccagggacccgcgggcccugcuggcccacccgggcuuaucggagaacaagguaucuccggcccgagggggagcggaggcgccgcuggugcaccuggggagcggggaagaacaggcccccugggccgcaaaggggagccaggagaaccuggucccaagggcgggauuggaaacaggggcccacgaggugagaccggggacgacggacgggauggcgugggcucagaagggagaaggggcaaaaagggugagcgcggcuuucccggguauccuggaccaaagggcaauccgggugagcccggguugaacggaacgacuggcccuaaaggcauacgugggcggagaggaaauuccgguccacccggcaucgucgggcagaagggagacccuggcuacccaggucccgcagggccuaaaggaaacaggggcgauucuauugaccagugugcacugauccagagcauuaaggauaaaugcccgugcuguuacggcccacucgaaugccccguguucccuaccgagcuggccuuugcgcuugacacaagugaagggguaaaucaagauaccuucggacgcaugcgagacguuguguuauccaucgucaacgaucugacuauagcugagagcaauuguccccggggugccagaguggcaguugugacauauaacaaugaagucaccacagagaucagguuugccgacucuaagcgcaagucagugcucuuggauaaaauuaagaaccugcagguagcucuaacaaguaaacagcaaucccuggagaccgccaugagcuucguggcaagaaauacguucaagcgggucaggaacggcuuucucaugcguaaaguugcuguguucuuuucuaacacaccaacccgagccucgccucagcuucgcgaagcgguccugaaguugucagacgccgggaucacuccccuguuccucaccagacaggaggaucggcagcugauuaaugcauuacaaaucaacaauacagcugugggacaugcccuuguacugccagcaggcagggaccucacugacuuucuagaaaacgugcugaccugccacguuuguuuggauauaugcaauauugacccgagcugugguuucggguccuggcgcccuaguuuuagagaucggagggcugccggaucugacguggauaucgacauggccuucauucuggauagcgcggagacgacaacccucuuucaguucaacgaaaugaagaaauacaucgcuuaucuuguccgacagcuggacaugucccccgauccaaaggcaucacagcacuuugcccguguggcuguuguccaacaugcccccagugagucuguggacaaugcaagcaugccuccagugaaaguagaguucuccuugacugauuacggcucaaaggaaaaacuggucgacuuucucagcagaggcaugacacaguuacaggggacccgcgcccugggaucugcuauagaguauacuaucgaaaacguguucgaguccgcgcccaauccucgggaucuuaagauuguugugcugaugcuaacaggugaagucccggagcagcaacucgaggaagcccagagggugauccugcaggcaaaaugcaagggcuacuucuuuguuguguuggggauuggaagaaagguaaacaucaaagaggucuauaccuucgcuagugaaccaaaugacguguuuuucaagcugguggacaaaagcacggagcucaacgaggaaccccuuaugcgcuuuggccggcuguuaccuucguucguuuccucugagaaugccuuuuaccugucaccagauauaaggaagcaaugugacugguuccagggugaucagcccacuaaaaacuuggucaaguuugggcacaagcaagugaauguaccuaacaacgugaccagcagucccacauccaauccagucaccacaacuaaaccggugaccacgacaaagccuguuacuaccacaaccaaacccgugacuaccacaacgaagccagucacuauuaucaaccaaccuucugugaaacccgcagccgcuaagccagccccugcgaagcccguugcagccaaaccgguggcuaccaagauggccacaguacgaccaccugucgcagugaaacccgcuaccgccgcuaagccaguugccgcaaaacccgcggccgugagaccuccggcugccgcagcugccaagccagucgcaacuaagcccgaagugccucggccccaggccgcgaaaccagcugccacaaagccugcaaccacgaaacccaugguaaagaugagcagggaggugcaggucuucgaaaucacugaaaauucagccaaacuccauugggagcgcgcugaaccaccuggcccguacuuuuaugaccugacaguuaccuccgcccacgaucagagucuagugcuuaagcaaaaccugaccgugacugaccgugucauuggaggccuccuggcagggcagacauaccacguggcuguuguaugcuauuugagaagccaggugcgagccaccuaccauggaucuuucucaacuaaaaagucccagcccccaccuccccaaccagcgaggagcgcuucuaguucgacuaucaaucugauggucuccacggagccucucgcccuuaccgaaacagauauauguaagcugcccaaagacgaggguacuugccgggauuuuauuuuaaagugguauuacgacccgaacaccaaaagcugcgcacgcuucugguauggcggguguggaggcaaugaaaacaaguucgguucacagaaagagugcgagaaggugugugccccaguucuggcuaagccuggggugaucucugucaugggcacauga

SEQ ID NO: 54657 - RNA, 7845 nt, Artificial Sequence
  derived and/or modified sequence opt3 from COL6A5__Homo_sapiens__NP_001265227
augaagauccugcucauuauauucgugcuuaucauuuggaccgagacacuggccgaccagagccccggcccugggccagucuacgcugauguuguguuuuugguagacuccucugaucacuuaggaccgaaaucauuccccuuugugaagacuuucaucaacaaaaugauuaauagucugccuaucgaagcaaacaaguauagagucgcccuagcgcaauacagcgacgaguuucauuccgaauuccaccucucuacguuuaaagguaggucgccaaugcugaaucaucuuaagaagaacuuccaguuuauaggcgggucacugcagaucggaaaagcuuugcaggaggcccaccggaccuauuucagcgcacccauuaauggccgcgaucgaaagcaauuuccuccaauccucgugguucuggccagugcugaauccgaggacgagguggaagaggcaucuaaagcccugcagaaggauggugucaaaauuaucagcguggggguacagaaggcuuccgaagagaaccucaaggccauggcgacaucacauuuccacuuuaauuuacguacuauaagagaccugaguaccuucagccagaacaugacacaaauuaucaaagauguuaccaaguacaaagagggagcaguggacgccgauaugcagguccacuuccccauuucuugccagaaggacucccuugcugauuugguguuucugguggacgaaucacuaggcacuggcgggaaucucaggcaucugcagacauuccuugagaacaucaccagcaguauggacgucaaagaaaauuguaugcggcugggauugaugucuuauuccaacagcgccaagacgaucucguuucucaaaucuuccacuacccaaucagaguuccagcagcaaauuaagaaucugaguauacagguugguaagagcaacacaggcgcagcuaucgaucagaugcgcagagacggguuuuccgaaucuuacggaagcaggcgggcccagggcgugccucaaauugcgguauuagugacucaccgcccaucagaugacgagguccaugaugccgcacugaaucuccgacuugaggacgugaacguuuucgcucugaguauccagggugccaacaauacccaguuggaagagauaguguccuauccgcccgaacagacaauuagcacccuaaaaucuuacgcugaucuggagacguacucaacuaaguuucucaaaaagcugcaaaacgaaaucuggagucagaucagcacauaugccgagcagagaaaucuugacaaaaccgggugcgucgauacuaaggaggcagacauucacuuccugaucgauggauccucuucgauucaggaaaagcaauuugagcagauaaaaagguucauguuggaagugacagagauguuuagcaucggcccugacaagguacggguuggcgugguccaguacuccgacgauaccgaaguggaguucuauauuacggacuacucaaacgauaucgaccuccguaaagccaucuuuaauauuaagcagcugaccgggggaacauauacugguaaagcuuuagauuacauacugcaaaucauuaagaacggcaugaaggaccgcaugaguaaagucccauguuaucuaaucgugcucaccgaugggaugucuacagacagaguuguggagcccgcgaagaggcugcgggcagaacagauuacuguacacgccgucggaaucggcgcugccaauaaaauagagcuucaggaaaucgcagguaaggaggagcgagugagcuucgggcaaaacuucgaugccuugaaauccauuaagaaugaaguugugcgcgagaucugcgcugaaaagggcugugaggacaugaaagccgauauuauguuucuggucgacucaagcuggucuaucggaaacgaaaauuucagaaagaugaaaauauuuaugaagaaccuccugaccaaaauucagaucggcgcagauaagacacagauuggggugguacaguucuccgacaaaaccaaggaggaguuucaacuuaauagguacuucacucagcaggaaaucagugacgcgauagaucggaugagccugaucaacgagggaacguugacagguaaggcucucaauuuugugggccaguacuucacccauucuaaaggggcccgccugggagcaaagaaauuuuuaauucugaucacugacggcguugcccaagaugacgucagagauccugcuaggauucuacgugguaaggacgugaccaucuucuccgugggggucuauaacgccaaccggucacagcucgaagagauaaguggcgauagcucgcugguuuuucacguggaaaauuucgaccaucuuaaagcauuggagcgaaagcugauuuuuagagugugcgcucuccacgauuguaagaggaucacacuguuagacguagucuucgugcuggaucauuccggaucuaucaaaaagcaguaccaggaccacaugauuaaccuuaccauccacuugguuaaaaaggccgaugugggccgcgaccggguccaauucggggcgcucaaauauagcgaccagccaaauauucuguuuuaccuaaacacuuauucaaauagaagugccauaaucgagaaccugaggaagcgccgagauacaggagguaauacguacaccgcuaaggcacucaaacaugccaacgcucuguucacugaagagcacggcucccggauuaagcagaaugugaaacaaaugcuuaucguuauuacagacggggaaucucaugaucacgaccaguugaacgauaccgcccuggaguuacguaauaagggaaucacaauauuugcagugggcguagguaaagcgaaccagaaggaacucgaggggauggccggcaauaagaacaauacuaucuaugucgacaacuucgauaaacugaaggacguguuuacccuugugcaggagagaaugugcacggaagcucccgaggucugucaccugcaagaagccgauguuauuuucuugugcgacggaagcgauaggguguccaacucagacuuuguaaccaugacaacuuuccucagcgaccugaucgauaauuuugacauucagagucagcgcaugaaaaucggcauggcacaguucgggucuaacuaccaauccauaauugagcuaaagaauagccugaccaaaacacaguggaagacucagauccagaacgugucgaaaucaggaggcuuuccgcggaucgauuucgcucucaagaaggucucuaauauguucaaccugcaugccggugggagaaggaaugcaggagugccucaaacccuuguugugauuacgaguggcgacccccgauacgaugucgccgacgcugugaaaacauugaaggaucuggguauauguguuuuagugcucggcaucggggacgucuauaaagagcaccugcuuccaauuaccggaaacuccgaaaagaucauuacuuuucaggauuucgacaaacugaagaauguagaugugaagaaacgcaucauacgggagaucugccagagcugcggcaagacaaacuguuuuauggacauuguugugggguucgauaucucuacccauguccagggacaaccucuauuucagggccacccccagcucgaaagcuaccugccagguauuuuggaggacaucuccucaauaaaaggggugaguugcggagcgggcacugaagcccaaguaagccuggcauucaaggugaauucugaccaggguuuucccgcuaaauuccagauuuaucagaaggccgucuuugauuccuuacuccaaguuaacgugucaggcccuacccaucugaaugcccaguuccuuagaagucugugggacacauuuaaggauaaaagcgcuuccagggggcagguguugcucaucuucucugacggacugcagucggagagcaacaucaugcuagagaaucaaucagaucgucugcgcgaagcaggccuugacgcccuccuggucguguccuugaacacgaccgcgcaccacgaguuuaguucuuucgaauucgggaagcgguuugauuacagaacucaucugacaauuggaaugagggaguuaggcaaaaagcucagccaguaucuggguaacaucgcugaacgaaccuguugcuguacauucugcaaauguccagggauaccgggaccccacggcacucggggucuucaggccaugaagggcucccaggggcugaagggaucacgcggccauagaggggaggacggaaauccuggcguuaggggugauaccgggccacaaggagacaaaggcauugcaggcugccccggggccuggggacagaaggguuugaaaggcuuuucugggccuaagggaggccacggugaugacgggaucgauggacucgacggcgaggaaggcugucauggguucccaggaauuaaaggugagaagggcgaccccgggagccagggaaguccgggcucccggggugcuccugggcaauacggagaaaagggcuuuccaggcgaucccgggaacccuggacagaauaacaauaucaaaggucagaagggcagcaaaggggagcagggacgacaaggcagaucuggucagaaggggguacagggaucacccuccagucgcggcagcaggggccgugaagggcagcggggacugagaggugugucgggcgagccagggaacccuggacccacgggcacacuaggugcagaggggcugcaaggaccacagggcucucagggcaauccggggaggaaaggagaaaaggguucccagggccaaaaagggccucagggaagccccggccuuaugggugccaaggggucaaccggccgcccaggacuccugggcaagaaaggggagcccggauugccuggugacuuaggcccagucgggcagacuggacagcgaggcagacaaggugauagugggauacccggcuauggacagaugggccggaagggggugaaaggaccuagggguuucccgggcgacgcggggcagaagggagauauuggcaacccagguauccccgggggcccuggaccaaaaggcuuucgcgggcuggcucucaccguuggacugaagggcgaagaggguucucgugggcuucccggaccuccgggccaaagagguaucaagggcauggccgggcagcccguguacucccagugcgaccugauucgguucuugagggagcacagcccauguuggaaagaaaagugcccugcauaccccacagagcuagucuuugcccuggauaauucauaugacgugacugaagagaguuucaacaaaacccgcgauaucauuacaagcauaguaaaugaccucaacauccgagaaaauaacugcccagucggagcuagaguggccaugguuuccuacaauucuggcacgagcuaucugauucggugguccgauuacaacaggaagaaacagcuuuuacaacagcugucacagaucaaguaucaggacaccacugagccucgcgacguggggaaugcaaugagauuugucacaaggaacguguucaagcggaccuacgcuggagccaacguucgucgcguggcggucuuuuucucuaauggccaaacugccagucgaucgagcaucauuacagcaaccauggaguucuccgcucucgauauaucucccacgguguuugccuucgacgaaagaguauuuuuggaggcuuucgguuuugauaacacugggaccuuccaggugaucccaguuccgccuaauggagaaaaccagacacuggagaggcuccggcgcugugcacugugcuaugacaaauguuuucccaaugccugcauuagagaagccuuccuuccagaggauucauacauggacgucguguuucugaucgauaacagcaggaauauugcuaaggacgaguucaaagcggugaaggcauuggucuccaguguaaucgauaacuuuaauauagccucugacccccuaaucagcgauucaggcgaccggauugcucugcucuccuacaguccuugggaaagcucucgaagaaaaauggguaccgugaagacugaguucgauuuuaucacauaugacaaccaguuacugaugaagaaucacauucaaaccuccuuccagcagcuuaacggcgaagccacaaucgggcgcgcacugcucuggacuaccgagaauuuguucccagaaacgcccuaccugaggaaacauaagguuauauuuguggucucagccggagagaacuaugagcggaaagaauucgugaagaugauggcucuccgugcgaaaugucaaggcuacguuauuuuugugaucagccuggggucgacaagaaaggacgauauggaggaacuugccucuuauccucuagaccagcaccugauucaguugggaaggauccauaaaccggauuuaaauuacauagcaaaguuccugaagccauuucucuauaguguccgccggggcuucaaccaguaccccccucccaugcuggaggacgcuugccgacuuaucaaccuggguggggagaauauucaaaacgauggauuucaguucgugaccgaacuccaggaggacuuuuugggcggcaauggguucaucggacaggaacugaacuccgguagagagagcccauuuguaaaaacugaagauaauggcucagacuaccuaguguaucugccuucccaaauguucgagccccagaagcucaugauuaacuacgagaaagaucagaagucugccgaaaucgcaagccuuaccagugggcacgagaauuauggaaggaaagaagagccagaccacacauacgaaccuggcgauguuucccugcaggaguauuacauggacgucgccuuuuuaauagacgcuagccaacgcguggguucugaugaguucaaggaagugaaggccuucauuacuucagucuuggacuauuuucauaucgcgccgaccccccugacgaguacacucggggaucggguugcagugcuguccuacagcccaccuggauacaugcccaacaccgaggaauguccaguauaucuugaguucgaccuggugacuuacaauucuauccaccagaugaaacaucaccuccaggauucgcaacaguugaacggcgacgucuuuauuggccaugcccugcaguggacaaucgauaauguguucguugggaccccuaacuuaagaaagaauaaagugauauuugucauuucagcuggagaaacuaacagccuagacaaggauguacugcguaaugugucccucagggccaaaugccaggguuauaguaucuucguuuuuucuuucggccccaagcacaacgacaaggagcuugaggaacuggcuagccacccguuggaucaucaccuggugcaacucgggcggacacauaaaccagacuggaacuacauuaucaaguuugucaaaccuuucgugcaccugauacgccgagcaaucaauaaguaucccaccgaggauaugaaagccacgugugucaacaugacuuccccaaaucccgaaaacggaggcaccgagaauacagugcuucuccugccugguauuuacgagaucaagaccgaaaacggggacuuguuugacgaguucgauucacaggcucagcaccuguuaguucuaggaaauaaccauaguucuggcagcgaaacagccacugaccugaugcagaagcucuaucuucuguuuuccaccgagaaauuggcaaugaaggauaaagaaaaggcgcaccuggaggagauuucagcccucgugguagacaaacaacaggaaaaggaggauggcgaagacacgagaagcucuuga

SEQ ID NO: 54658 - RNA, 8835 nt, Artificial Sequence
  derived and/or modified sequence opt3 from COL7A1__Homo_sapiens__NP_000085
augacccugagacuccuuguggccgcucugugcgcaggcaucuuggccgaggcgcccaggguccgggcucagcaccgcgaacgaguuacauguacucguuuauacgccgcagacauuguguuccugcuagaugggagcuccucuauaggaagaucaaacuuuagggagguacggaguuuccucgaaggucuggugcuuccuuuuagcggcgccgcuuccgcacaagggguccgcuucgccacggugcaguauucugacgauccaagaaccgaguuuggacuggacgcuuugggcucggguggggauguuaucagggccauucgggaacucucauacaagggaggcaauacacgcacuggcgcggcaauccugcauguggccgaccacgucuuccugccgcagcucgcucgacccggggugccuaaaguaugcauuuuaaucaccgauggaaagagccaggaccugguugauacagccgcacaaagacuuaaaggucagggcgugaaguuguuugcugucgggauaaaaaacgccgacccagaggagcugaagaggguggcgagucagcccaccuccgauuucuuuuucuuugugaaugacuucucuauccuacggacucuccugccucuugucagccgucgcguuuguacaaccgccggaggcgugccaguaacgagacccccugaugacuccacuucagcaccaagggaccugguguugagugaaccgagcucucagucccuccggguccaauggaccgcugccucaggucccgugacaggguauaagguucaguacacuccucugaccggauuaggccagccacugcccagcgagcgacaggaagugaacgucccugcuggcgagacaagugugcgccucagagggcuuaggccacugaccgaguaucaaguaacgguuauugccuuguacgcaaauucuaucggagaagccguguccgguacugcucggacaaccgcgcuagagggccccgaacugacuauucagaacacaaccgcacauagccuccuggucgccuggcgcucggugccgggggcuacgggauauagagucaccuggagggugcuuucuggcgguccuacacagcaacaggagcuggggcccggccagggauccguuuugcuccgugaucuggaaccaggcacugacuacgaggugaccguaucaacauuauuugggcggagugucggaccugccacuagccugauggcacgaaccgaugccuccguggagcagacacuaagacccguuauccucgguccaaccucuauacugcuuagcuggaauuuggugcccgaagcuaggggcuaccgccuggaguggcggagagaaacugggcucgagccuccacaaaaagucgugcugccgucagacguaacgagguaucagcuugauggacugcagcccggcacagaauaccgcuugacccucuauacucuguuagagggucacgagguggccaccccugcaacaguugucccaaccgggcccgaacugccugugaguccagugacugaccuacaggcgacagagcuccccggccaacgaguccggguuuccuggagcccggugccuggagcuacgcaguaccguauuaucgugagaucuacccagggcguagaaaggacucugguccuuccagggucacagacagccuucgauuuggacgaugugcaagcaggacugaguuauaccguucgcgugagcgcccgggucggucccagagagggcuccgcuucugugcucacaguuaggcgagaaccugagacuccccuggccgugccaggguuacgcguagucgugucggacgcaacccgggugagagucgcuuggggaccuguucccggcgccagcgguuucaggauuuccuggucaacggggaguggcccagagucuagccagacccugccgccugauuccacagcgacugacaucaccggacuucagcccggcacaacuuaccagguggccguaucaguguugcgugggcgcgaagagggaccagcugcagucaucguggcccggaccgacccccucggcccuguuagaacggugcaugucacacaagcuagcucuuccagugugaccauuacuuggacaaggguuccaggugccaccggguaucgagugagcuggcacucugcacacggacccgaaaagucccagcuggucucaggcgaggcgacuguagccgagcuagauggucuggaaccugacaccgaguacacagugcauguucgggcucacguggccggcgucgaugggccgccagcaagugugguagugcgcacggcucccgaaccugucggaagaguuagcaggcuccagauacugaacgccucguccgacgugcuucggaucaccugggugggcgucacuggggcaacagccuaccgauuggcuuggggaagaucugagggcgguccaaugcgccaucaaauucugcccgggaauaccgauagcgcggaaaucaggggauuagagggcggugugucauauaguguucguguaacagcccucgugggcgaccgggaggggacuccugucuccauagugguuaccacgccgcccgaagcaccaccugcucugggaacacuucacgugguccagagaggcgagcacucucugagguugcgcugggaacccgugccacgagcccagggguuucuccugcauuggcagccugagggaggccaagaacagagcagaguacuaggucccgagcuguccucauaccaccucgaugggcuggagccagccacccaguaucgggucaggcuuagcguguugggaccggcuggcgaagguccuagugcagagguuacugcccgcaccgaaucuccccgugugccauccauugagcugagagucguggacacaagcaucgauucgguuacuuuagcguggacccccgugucacgggcuucuaguuacauccucuccuggaggccucugcgcggcccagggcaggaaguccccggaagcccucaaacacuuccgggcauuucuagcucccagcgagugacggggcuggagccaggaguaucauauaucuucagucuaacccccgugcucgacggcguuagagguccugaggccagcgucacucagacacccgugugcccacgggggcuggcagauguggucuuuuugccucaugccacccaggacaacgcucacagggcagaagccacucgcagaguacuggagagguuagugcucgcgcugggaccccuuggcccacaagcuguucaggugggccuguugucuuacucccaucggccuucaccgcucuucccccugaaugggagucacgaucuaggaauuauacugcagcguauccgcgacaugccauauauggacccuagcgguaacaaucuuggcacagccgucgugaccgcacaccgauacaugcucgcccccgaugcuccagggagaaggcaacauguuccuggagugaugguccuguugguggacgaaccccugcggggcgauauuuuuuccccgauccgcgaggcccaggcaucugguuuaaacguagugaugcucgggauggcuggagccgacccagagcagcugagaaggcuugcgccuggcauggauucgguucagacguucuuugccgucgacgauggccccagccuggaccaagcagugucaggguuggcuacugcccucugucaggcuuccuucaccacacagccacggcccgaaccuugcccgguguacugucccaaaggacagaagggugagccaggcgaaauggggcugcgaggacaagucggcccucccggugauccugggcuaccaggaagaaccggcgcacccggcccucaggggccacccggaagugccacugccaaaggugagcgcggcuuuccgggggcugacggaaggccuggcucuccaggucgggcggggaaucccggaacaccuggcgcaccaggccugaaggggagccccggacuuccggguccucguggcgaucccggggaaagaggaccaaggggcccuaagggugagcccggggccccaggacagguuaucggcggcgaggggcccggacucccuggucgcaaaggcgacccagggccguccggacccccuggcccacgggguccccugggggauccuggcccacgaggacccccuggcuugccggggaccgcuaugaagggagacaaaggugacagaggcgaaagggggccacccggaccuggcgagggugggauugcccccggcgaaccaggauuaccuggccugcccgggucaccaggaccgcaggguccugugggccccccagggaagaaaggagagaagggcgauucugaagacggugcacccgggcucccuggccaaccaggaagccccggcgagcaggggccucgcggaccgccaggcgccauaggucccaaaggggaucggggauucccuggcccacugggugaggcuggcgaaaagggggagagaggacccccuggccccgcggggagucguggacuuccaggcguagccgguaggccgggggcaaagggaccugaaggccccccagguccuacaggccggcagggggagaaaggagaacccggccgcccaggggacccugcuguggucggacccgccguggcaggcccgaagggugagaaaggggauguuggaccagccggcccucgaggcgcuacuggggugcagggagagagaggucccccaggccuggucuugcccggggacccuggaccgaagggcgauccaggugacagggggcccaucggacuaaccggccgggccggcccucccggggauuccggaccaccuggugaaaaaggcgaccccgggcgcccaggaccuccgggccccguagguccaagagggagggauggagaggugggcgaaaagggcgacgaggggccucccggagacccaggucugccuggcaaggcgggggagcgaggacuccggggcgcacccgguguucgugggccggugggagaaaaaggcgaucaaggcgacccaggggaggauggaagaaacgguagcccuggcucuucagggcccaagggagaccgcggcgaaccaggucccccugggcccccaggaaggcuggucgauacgggcccuggcgcccgggagaaaggggaaccgggagacagaggucaggagggcccccgcgggccaaagggagauccuggccuucccggugcuccaggggagaggggaauugaaggcuuucgaggcccucccgggccgcagggagacccuggugugcggggcccagccggggagaaaggagauagaggccccccugguuuagacgggagguccggccuggauggaaagccaggcgcugcagggcccaguggaccuaacggugccgcuggcaaggccggggacccaggacgcgauggccuccccgguuugcguggggaacaaggccugccgggaccuagcggccccccagggcuccccggaaaaccuggugaggacggcaagccagggcugaauggaaaaaacggcgaacccggugacccuggcgaggaugggcggaagggagagaaaggcgacucgggggcaucuggaagagaaggcagggaugguccaaagggggagcgcggagcgccgggcauccuugguccccagggcccuccagggcugcccggaccugucggcccacccgggcagggauucccgggcgugccuggugggacaggaccaaagggcgaccgaggugaaaccggcuccaaaggggagcagggauugcccggcgaacgggggcuaagaggagagccuggcagcguucccaauguggauaggcugcucgagacugccgguauuaaggcuucagccuuacgcgaaaucguagagaccugggacgaaaguucuggguccuuucugccagugccggagagacggaggggaccuaaaggcgauagcggcgagcaagggcccccaggaaaggaaggucccauaggcuucccuggggagcguggacuuaaaggcgaccgaggugauccagggccccagggaccuccaggccuggcacucggcgaacgcgggccgcccggaccuucagguuuggcuggcgagccagggaagcccggaaucccuggccugccagguagagccgggggagucggcgaagcaggccggcccggggagaggggagagcgcggugaaaaaggcgagagaggggaacagggacgggacggcccuccgggucuccccgggacaccaggaccucccggcccaccuggccccaagguuaguguggaugagccagggccgggacugagcggugaacagggcccucccgggcuuaagggagccaaaggcgagccagguuccaacggggaccaaggacccaagggcgauaggggcgucccugggauuaaaggagaccgaggugagccaggcccccgugggcaggacggaaauccuggccuaccgggugaaagagggauggcuggccccgagggaaagccaggccugcaggggccucgcggacccccagguccugugggcgggcacggagaucccggcccaccgggugcgccuggguuggccggccccgcaggaccacagggcccuucuggguuaaaaggagaacccggugagacuggcccaccugggcggggacugaccggccccacgggugcuguagggcucccgggcccacccggaccuagcggccugguggggccacaaggaucccccggucuuccuggccagguuggggaaacaggaaagccgggcgcccccgguagggacggcgccucagggaaggauggagacagaggcucuccaggggugccuggaagucccggccugccagguccugucgggcccaaaggagagccaggcccuaccggugcacccggccaggcuguggucgggcucccgggagccaagggcgagaaaggggcgccuggaggcuuggcuggugaucuggugggggaaccaggagccaagggcgaccgcggucuacccggcccucggggggagaaaggagaagcaggcagggccggggagccaggagaucccggcgaggacggucaaaagggggcuccgggaccuaagggcuucaaaggcgaucccgggguuggaguaccagguucgcccggcccuccagggcccccuggagugaagggcgaccugggucucccagggcuuccgggagcacccggcgucgugggcuuuccugggcagacuggaccacgaggugaaaugggccagcccgggccuagcggagagagaggccuggccgguccacccgggcgggaaggaaucccgggcccuuuaggcccacccgggccucccggauccguugguccaccuggcgcgucuggguugaaaggagauaagggcgaccccgguguggggcugccaggaccgaggggcgagcgcggcgaacccgggauucguggagaggacgguagaccuggccaggaggggccacgaggacucacaggccccccugguucaaggggggaacggggagagaaaggcgaugucggcagcgcugggcugaagggagacaagggugauuccgccgugauccuuggcccacccgggccucgcggagcaaaaggcgacaugggugaaagagggccgaggggccuggauggagacaagggcccacggggggauaacggagaccccggugauaaaggcaguaagggggagccuggagacaaaggcucugccggucucccaggguugcgcggccuguuaggaccccaaggccagccuggggcugccggaauacccggugauccaggcagcccggggaaggacggaguaccuggcauuagaggugaaaaaggggaugugggcuucaugggaccccgaggccuaaagggggagaggggaguuaagggcgcaugcggucuggacggggagaaaggagacaagggcgaagcugguccaccuggccggcccgggcucgccggacauaaaggcgagaugggggaaccaggagucccgggccagucaggugcgccugggaaggagggacuuaucggccccaaaggugaucguggcuuugacgggcagccaggacccaagggcgaucaaggggaaaagggagagcgcggcaccccugguauugggggauucccaggccccuccgguaaugacggcagugccgggccuccgggaccacccggcagcguggggccuagaggacccgagggccugcagggucagaaaggggaaaggggaccaccuggcgagcggguggucggcgcacccgggguuccaggagcuccuggugaaagaggcgagcaggggcgcccgggacccgccggcccacgaggugagaagggggaagcagcuuugacugaggaugacaucaggggauuugugcggcaagaaaugucucagcacugugccugccagggccaguucauagccuccggcucaagaccucugcccagcuaugcggcugauacagcagggucgcaacuccacgccguaccagugcugcgugucucucaugcugaggaagaggagcgcgugccucccgaagacgaugaguacagugaauauuccgaguacagcguugaagaguaucaggacccggaggccccaugggauucagacgaccccuguucccuuccucucgaugaaggaucuugcaccgcauacacgcugaggugguaucaccgggccgugacugguagcaccgaggcuugccauccauuugucuacggcggguguggaggcaacgcgaauagauucgguacacgagaagccugcgagaggcgcugucccccucgggugguacagagucaagggaccggaacagcacaggacuga

SEQ ID NO: 54659 - RNA, 2235 nt, Artificial Sequence
  derived and/or modified sequence opt3 from COL8A1__Homo_sapiens__NP_065084
auggccgugcugcccggcccucuccagcuucugggggucuuguuaaccaucagccuguccucuauuagacuaauacaagcuggagcauacuaugguaucaagccacucccgccccagauuccuccacagaugcccccucagaucccacaauaccagccccugggccagcagguuccucacaugccacuugccaaagacgggcuggcgaugggaaaggagaugccgcauuugcaauauggcaaagaauacccccaccucccucaguauaugaaggagauucagccagcucccaggauggguaaagaagccgugccuaagaaggggaaagagaucccacuggcaucacugcggggagaacagggcccccgcggcgagccggggccucgaggacccccagguccucccggccucccagggcauggaauacccggcaucaaggguaaaccugggccacaaggauacccgggcguaggcaagcccgggaugccuggaaugccagguaaacccggcgccauggggaugccuggagcuaagggcgagauuggucagaagggggaaaucggcccaaugggcauucccggcccgcaggggccuccaggaccccacgguuuaccuggcaucgggaaacccggaggcccaggucugccugggcaacccggcccaaagggagaucguggcccgaaagggcuuccuggaccccaggguuugagaggcccaaagggggacaaaggauucggcaugcccggugcaccuggggugaagggcccacccggaaugcauggcccuccggggccagucggacugcccggcguggguaaaccugggguuacaggauuuccaggcccccaggguccucuaggcaagccgggggcccccggagagccaggcccucaggggcccauaggagugccaggcguccaagguccucccgggauuccaggaaucggcaagccgggucaggauggcauuccugggcagcccggauucccaggcgggaaaggagaacagggccuccccggucugccugggccacccggacuuccuggcaucgguaagccgggcuuuccagggcccaaaggagacaggggcaugggaggagugccuggcgcucuggguccccggggagagaagggaccaaucggcgccccuggcauugggggacccccaggugagccuggcuugccggggauacccggaccaaugggcccucccggugcgaucggguucccaggaccuaaaggcgaaggcgggauuguaggaccccaagguccgccaggcccuaagggggagcccggacuccagggcuuuccagguaagcccggguuccugggagaaguuggcccuccgggcaugcgcggguuacccggaccaaucgguccuaaaggcgaggcagggcagaagggagugcccggccugccuggugucccagggcuccuuggacccaaaggcgaaccuggcauaccaggggaucagggacugcaaggucccccgggcauuccugggaucggaggcccaaguggucccaucgggccuccagggauucccggcccgaagggcgagccuggguugcccggaccaccugguuuucccggcaucgggaaaccaggaguggccggccuacacggucccccugggaagccaggcgcucugggaccgcagggccagcccgggcucccuggaccacccgguccuccaggacccccugggccgccagccgugaugcccccuacucccccaccucagggagaguaucugcccgacaugggccuugguauugauggggucaagccaccgcacgcauacggcgcuaaaaaggggaaaaacggcgggccugccuacgaaaugcccgcguucacggccgagcugaccgcaccauuucccccuguuggagcuccagugaaguucaauaaauugcucuauaacgguagacaaaauuacaacccccagacaggcauauuuacuugcgaaguaccugggguguauuacuucgccuaucauguccacuguaagggaggcaauguguggguugcucuguuuaagaacaaugagccggugauguacaccuaugacgaauacaaaaaggguuucuuagaucaggccagcggguccgcaguccugcuacucaggccaggcgaccggguguuccugcaaaugcccucugagcaggccgcuggacuuuacgcgggccaguauguacauucgucauuuagcggguacuugcuguauccuauguga

SEQ ID NO: 54660 - RNA, 1917 nt, Artificial Sequence
  derived and/or modified sequence opt3 from COL8A2__Homo_sapiens__NP_001281276
augccccugccucuccuuccaauggaccugaagggcgagccggggcccccuggaaaaccaggucccagaggcccuccagggcccccuggauucccaggcaagccggguauggggaaacccggauugcacggccagccuggcccagccgggcccccuggauuuagcaggauggguaaggcuggcccacccggguuaccgggaaaagugggcccucccggucaaccagggcugcggggagaaccuggcauccgcggcgaucaggggcuacgaggacccccaggucccccuggccucccagggccguccggaauuaccauacccggcaagccuggugcacagggggucccagggcccccuggauuccagggcgagccagggccccaaggagaaccggguccuccaggcgaccgugggcugaagggagauaacggcguuggucagcccgggcuuccuggcgcccccggacagggcggggcgccaggaccucccggucugccaggcccggcuggguugggaaaaccuggccucgacggucugcccggggccccaggcgauaagggagagucugggcccccuggcgugccaggacccagaggcgaaccuggugcaguagggccgaaaggaccacccggcguggacggugucggcgugccuggggccgcuggacugccaggcccccaggggccuucaggagcaaagggcgagccggguacaagggggcccccaggacucaucggcccuacugguuacggcaugcccggguuaccaggaccuaaaggcgaucgggggcccgccggaguuccaggccugcuuggugaccgcggggagccgggagaagauggcgagccuggugaacaaggcccccagggguugggaggcccacccgggcugccuggaagugcuggccuaccagguagaagggggcccccuggaccgaagggcgaggccggcccagggggacccccuggugugcccggcauucggggcgaccagggaccaagcggccucgcggguaagccugggguccccggagagcgcggccugccaggcgcacaugggccuccgggacccacggguccaaaaggcgaaccuggguuuaccggacgacccggcgguccagggguggccggagcucuuggccagaagggcgaucugggguugccuggacaacccggucucagaggcccguccgggaucccaggacugcagggcccugccggucccauugggccacagggauuacccggccugaaaggcgagccugggcucccgggacccccaggugaaggcagggcaggggagccuggaacagcuggccccacugguccuccagggguacccggaucuccuggcaucaccggcccacccgggccgccuggaccacccgguccuccaggcgcccccggggcguucgacgaaacaggaauagccggccuucaucugccgaauggugggguugagggcgcaguguugggaaagggcgggaaaccucaauuuggacuaggugagcugucggcucacgccacccccgcuuucacugccguccucacaucaccauuuccugcaagcggcaugcccgugaaguucgaucggacccuguauaacgggcacaguggauacaauccagccacgggcaucuuuacuugccccguggguggggucuauuacuucgcuuaucauguucacgugaaaggcaccaacguauggguggcgcuuuacaagaauaacgucccugcaacauauacuuacgacgaauacaagaaaggauaucuggaccaggccuccggcggggcuguguugcagcuccguccaaaugaucagguuugggugcaaaugccgucugaccaggccaacggacuguacagcaccgaguauauucacuccucauuuagugguuucuuacugugucccacauga

SEQ ID NO: 54661 - RNA, 2766 nt, Artificial Sequence
  derived and/or modified sequence opt3 from COL9A1__Homo_sapiens__NP_001842
augaagaccugcuggaaaauccccguguucuuuuucgucuguagcuuucuggagccuugggccuccgcugcaguuaagagaaggccacgguucccggugaacucuaauucaaacggcgggaaugaacucugccccaaaauucgcauaggacaggacgaucuuccugguuuugaccugaucagucaauuccagguagauaaggccgcgagccgacgugcuauucagagaguggucggcuccgccacauuacagguggcauacaaauuggggaacaauguugacuuuaggaucccaacucggaaccuguaucccucuggacuaccugaggaauacucguuccucacgaccuuucgcaugacaggcucaacucugaagaagaauuggaacauuuggcaaauccaggauagcagugguaaagaacagguggggauaaagaucaauggacagacccaauccgucguguucucuuauaaaggccuugacggcagccugcagacagccgcuuuuuccaacuugucaagucucuucgauagccaguggcacaagauuaugaucgggguagagagaucuuccgcaacccuguuuguugacuguaauaggauugagucacugccaaucaaaccccggggaccuauagauauugacgguuucgccgugcucggcaaguuagcugauaacccacaggucagcgugccguucgagcugcaauggaugcuuauccauugcgaccccuugcgcccucgaagagaaacuugucacgagcugccagccaggauuacacccagucagaccacggaugaacgggggccuccaggagagcagggucccccgggcccucccgggccaccuggagugcccggcaucgacggcaucgacggggaucguggaccaaagggucccccuggcccaccggggcccgcgggagagccuggcaaaccaggugcacccgggaagccuggcacuccaggagccgacggccuaaccgggcccgauggaucuccggguuccauuggcagcaaagggcaaaagggagaaccuggcgucccagguucgcgcggguuucccggcagaggaauaccugggcccccaggcccucccggaacagcuggucucccaggcgagcuggggaggguuggaccggugggcgacccuggucggcgagggcccccaggacccccuggcccacccggcccucgcgggacuaucggauuccaugauggcgacccgcuuugcccaaaugccugucccccugguagaucuggguacccaggacugcccggcaugaggggucacaaaggcgcaaagggggaaauuggagagccuggccggcaggggcauaaaggagaagagggcgaucagggugaguugggggaaguaggagcucagggcccgcccggugcccaaggccuccgcgggaucaccggaauagugggcgacaagggggagaagggagcgagaggccuggauggugaaccagggccucagggauuacccggcgccccaggugaccagggccagagggggccucccggagaggcaggcccaaaaggggaucguggagcugaaggcgcccgggguauuccggggcugccuggacccaagggcgacacaggccucccaggggucgacggacgagaugguauccccggcaugccugggaccaaaggagagccaggcaagcccgguccuccgggggacgcuggacuucaaggccugccaggcgugcccgggaucccuggagccaaagguguugcaggcgagaagggguccacgggagcccccggcaagccaggucagauggggaacucaggaaaaccuggccagcaggggcccccaggcgaagugggaccuagagguccgcaaggcuugcccgggaguaggggagagcuaggcccagucgguagcccugggcugcccggaaagcucggcucccugggcucuccagggcuuccuggacugcccgguccgccaggcuugccugggaugaaaggagaucgcggcgugguaggugaacccgggccaaagggagagcagggcgcuagcggcgaagagggggaggcgggagaacggggugagcucggcgacauugggcugcccggaccuaaaggcucagcagguaauccgggggaacccggcuuaagaggaccagagggcaguagggggcugccuggaguugaggguccccgcggcccuccagggccccgaggagugcagggcgaacagggugccacugggcuaccuggcguccaaggaccacccggccgggcuccgacagaucagcacaucaaacaggugugcaugcgugucauucaagagcacuuugccgaaauggcagccucccucaagagaccugacagcggggcuaccggacugccagguaggcccggcccuccagggcccccgggaccucccggcgagaacgguuucccagggcagaugggcauacgcggacuuccuggcaucaaggggcccccaggagccuugggccugcggggucccaagggggaucucggagaaaaaggcgagagagguccuccaggcagggggccgaacggacugcccggcgcaauugggcuuccuggagacccaggccccgcgucuuauggucgaaaugggcgcgauggagagcggggcccuccagguguggcuggcauccccgggguuccuggaccgccagggcccccuggccugcccggauuuugugaaccagccucaugcacuaugcaggcaggccagagagccuucaacaaggguccugaccccuga

SEQ ID NO: 54662 - RNA, 1215 nt, Artificial Sequence
  derived and/or modified sequence opt3 from COL9A2__Homo_sapiens__XP_011539020
auggccgcugcaaccgccagccccagaucccugcucgugcuucugcaggucguuguguuggcguuagcucaaaucaggggcccuccaggggagcggggaccgcccgguccuccagggcccccuggcguaccaggaucugacggcauugauggugacaacgggcccccuggaaaggccggcccaccgggccccaaaggggaaccuggaaaggcagguccagauggccccgacgggaaaccuggaauagauggccugacaggugccaagggggagccaggacccaugggcaucccgggcgugaaagggcagccuggacuacccgguccaccuggccuccccgggccaggauucgcuggucccccuggcccaccggggcccgucggccugccuggagaaauuggcauccgcgggccaaagggagaccccgguccugauggcccaucagggcccccgggaccuccaggcaagcccggucgaccugggacuauucagggccuugagggaagugcagacuuucuggugcgugaugaaugccccacgaauuguccaccuggcaugaaagggcccccaggauugcaggguguuaagggccacgccgggaaaagaggaauccucggcgacccgggucaucaagggaagccuggccccaaaggagaugugggcgcuagcggggagcagggaauaccaggucccccuggcccacaggggaucaggggauaccccggcauggccgguccuaagggcgagaccgggccgcacggauauaagggcauggucggggcgauuggagcaacaggcccacccggugaagaggggccucggggaccacccggccgcgccggugaaaaaggcgacgagggguccccuggaaucagaggcccgcaggggauuacuggacccaagggcgcuaccgguccaccugggaucaacggaaaagauggcacacccgguaccccaggcaugaaggggucugccggacaagcaggccagccugggucgcccggacaucagggccuggcuacuccagguccggggaggcaggccauacugugcgcgccucucuuaugucaccauugcggaaaugugcaacugucaagcaguugucggggcuggacauucugcuguuccgcccccaccggcgggggaaaccuugacugggguugggaggcaaaacagcagguacacggcgcuccaucuugccaagggcgcaauuga

SEQ ID NO: 54663 - RNA, 2055 nt, Artificial Sequence
  derived and/or modified sequence opt3 from COL9A3__Homo_sapiens__NP_001844
auggccggccccagagcuugcgcaccucugcuccuucuguuguuacugggggagcuacucgccgcggcuggagcccagagggugggucugccaggcccgcccgggccuccaggacccccuggcaagccaggucaagacgggaucgauggagaagcagggcccccuggccuuccagggccgcccggaccuaaaggugccccaggcaagcccgggaaaccuggagaggcuggccugccagguuugcccggggucgacggacucaccggccgggauggcccgccugggcccaagggagcaccaggugaacgcggcagccuggggccucccggaccacccggccugggugggaaaggccucccuggaccaccgggcgaggccgggguuuccggacccccugguggcauuggguuacgaggaccacccggcccuucuggucugccagggcuucccggcccgccuggaccacccggcccucccgggcacccaggaguguugccugaaggugcuacagaccugcagugucccucaauaugcccaccgggcccucccgggccacccggaaugccuggcuucaaggguccaacuggguacaagggcgagcagggagagguaggcaaagauggggaaaagggagaccccggcccuccggguccagccgggcuacccggaagugugggccuccaggguccucguggccugagagggcuuccaggaccccugggcccuccgggggauaggggacccaucggcuuucgggguccaccugggauucccggagcgccaggcaaagccggugaccgcggcgagagagggccugaaggauucaggggccccaagggggauuugggacggccaggcccgaaagguacgccuggggucgcaggacccagcggcgagccagguaugcccggcaaggacgggcaaaacggagugccuggccucgaugggcagaagggagaggcuggccgcaauggugccccaggggaaaaaggacccaacggccugccuggcuuaccggggcgagcaggauccaagggugagaaaggcgaaagagggagggcuggagagcugggcgaagccgguccaucuggggagcccggaguuccuggcgacgcgggcaugcccggggagcggggagaagccggucaucguggcucggcaggggcucucggaccacagggcccucccggugccccaggggugcgcggauuucagggccaaaagggcucaaugggggauccuggacuuccggguccccagggccugagaggggacgucggagacaggggcccagguggggcugccggaccuaaaggcgaucagggcaucgcagggagcgacggauugcccggugauaagggcgagcuagggccaaguggacuggugggcccuaaaggugaauccgggucucggggagagcucggccccaagggcacccaggggccgaauggaacaagcgguguacaaggcguuccagggccucccggaccacugggccuucagggugugcccggggucccuggcauuacuggaaagccgggcgugcccgggaaagaagccuccgagcagcgaauccgcgagcuguguggagguaugauaucagaacaaaucgcucaguuggcggcacaccucagaaagccacuggccccuggcaguauugggaggcccggaccugcuggcccacccgguccuccagggcccccgggcagcaucggacauccuggcgcccgggggccacccggauaucgcgguccuaccggcgaguuaggggacccaggacccagaggcaaccagggugauaggggcgacaaaggcgcagccggagcuggccuggaugggccggaaggagaccagggcccucaagguccccagggggugccaggaacaucuaaggauggccaggacggugccccuggcgagcccgggccacccggagauccuggccuaccaggggcaauuggagcgcagggcaccccggguaucugcgacacuuccgcuugucaaggggccguccucggaggcguuggugaaaaaucaggcagccguaguucuuga

SEQ ID NO: 54664 - RNA, 375 nt, Artificial Sequence
  derived and/or modified sequence opt3 from COLCA1__Homo_sapiens__NP_001289574
auggagagcugcuccguggcccaggcuggcguccugaccucucccuucauguggagauggacagggauggcaggagcccucucagcgcuugacaacacuaucgaagaugacgcugaugaccaacugccuuguggugagggcaggccaggguggguucggggagaauuguuaggcagucagggugugugcaaggauagcaaagaccuguuuguaccgacguccucuucgcuauacggguguuucugcgugggacucgucucaggcauggccauuagcgugcugcuucuggcaagugauuuucgcaaguuggacuucucccgacccgagccuuguuuugaaaaagaggccucucucugguucguugcucagcacuga

SEQ ID NO: 54665 - RNA, 465 nt, Artificial Sequence
  derived and/or modified sequence opt3 from COLCA2__Homo_sapiens__NP_001258386
augcaccccgagccucugcucaacagcacccaguccgccccacaucacuucccggacucuuuucaagcuacacccuucugcuuuaaucagucacuuaucccuggcaguccaagcaacuccucuauucugucggggucauuggauuacagcuauagucccgugcaguuaccuuccuacgcaccagaaaauuauaacucucccgccagccuggacacuagaacguguggauacccuccagaggaucauuccuaucagcaccuaucaagucaugcgcaauacagcugcuucucuuccgcuaccacaucaauauguuauugcgccagcugugaagcagaggaccucgaugcccugcaggcugcagaauacuuuuacccgaguacugacugcgucgauuucgcccccucugcugccgcgaccuccgacuuuuauaagagggagacaaauugugauaucugcuacagcuga

SEQ ID NO: 54666 - RNA, 834 nt, Artificial Sequence
  derived and/or modified sequence opt3 from COLEC10__Homo_sapiens__NP_006429
augaacggcuucgccagccugcucagaaggaaucaguuuauccuucugguguuguucuuacugcaaauucagucccuagggcucgacauagauucucggcccaccgcugaggucugcgcaacacacacuaucucaccuggaccaaagggugacgauggcgaaaaaggggacccgggagaggaaggcaagcaugguaaaguugggcgcaugggacccaagggcauuaaaggcgagcugggggauaugggagaccaggguaacaucggcaagacggggccuauuggaaagaaaggcgauaagggugaaaaagggcuucugggaaucccaggcgagaagggcaaagccgggaccgugugugacugcggacgauaccguaaguuuguaggucaguuggauauaaguaucgcgagacucaagacaagcaugaaauucgugaagaaugucauugcuggcaucagggagacugaagagaaauuuuauuacauugugcaagaagagaagaacuaucgggagucccugacccacugucgcaucagagggggaaugcuggccaugcccaaagacgaagcagccaauacacucauagcugauuacguugcaaagucuggcuucuuuaggguguucauuggugucaacgacuuagagcgggaagggcaguauauguuuaccgauaauacuccucugcagaacuacucgaauuggaacgagggcgaaccaucagaccccuauggacaugaggacugcguggagaugcuuagcaguggccgcuggaaugauacagaaugucacuugaccauguacuucguaugcgaguuuaucaaaaagaagaaauga

SEQ ID NO: 54667 - RNA, 744 nt, Artificial Sequence
  derived and/or modified sequence opt3 from COLEC11__Homo_sapiens__NP_001242912
augagaggcaaccuggcccucguggggguccuuaucagccuggcuuucuuguccuuacugcccucuggacacccucagccagcaggcgacgaugccugcucaguucaaauucuagugccgggccucaagggggacgcgggagagaaaggcgauaagggugcucccgggaggccuggacggguaggcccaaccggcgaaaaaggggagaagggagacaguggugauauaggucccccugggccaaauggagaacccggccugccuugugagugcagccagcuucgcaaagccaucggugaaauggacaaccaggugucccagcugacaucugaguugaaguuuauuaagaaugcagucgccggggugcgagagacugaaucgaaaaucuaccuccugguuaaggaggaaaaacguuaugcugaugcacaacugucaugucagggaagaggcggcacgcucagcaugccaaaggacgaggccgcuaacggguuaauggccgcguaccuggcacaggccggacuugcuaggguguucauugguaucaaugauuuggagaaagaaggcgccuuugucuauagugaccauuccccgaugcggaccuucaacaaguggcgcucuggggagcccaauaacgcauacgaugaagaggacugcguggaaaugguagcuagcggaggcuggaaugauguugccugucacacaacuauguauuuuaugugcgaguucgacaaggagaacauguga

SEQ ID NO: 54668 - RNA, 2229 nt, Artificial Sequence
  derived and/or modified sequence opt3 from COLEC12__Homo_sapiens__NP_569057
augaaggacgauuucgccgaggaagaggaagugcagagcuuuggcuacaaaagauucgggauccaagagggaacccagugcacaaaguguaaaaacaauugggcucugaaguuuuccauuauacuccuuuauauccugugcgcauuguuaacuauuacggucgccauccuggguuacaaaguuguggaaaagauggacaacguaaccggcgggauggagacaucuaggcagacuuaugaugacaagcuaaccgcgguggagucagaucucaaaaagcugggagaccagacaggcaaaaaggcuauuaguaccaauagcgaacuuuccacuuuccggucugauauccuggacuugcgccaacagcuccgagagauaacagaaaagaccucgaagaacaaggauacgcuggagaaacugcaggccucaggugacgcacucgucgaucgucagagccaauuaaaggagacucuggaaaauaacaguuuucuuaucaccacagugaauaaaacuuugcaggccuacaacggguauguuaccaaucugcagcaggacacauccgugcuacaaggaaaccuccagaaucagauguacucucacaacgucgugauuaugaaucugaacaaucuuaaccugacccaaguacagcagagaaacuugaucacgaaucuccagaggagcguugaugacacuucccaagcuauucagcggaucaagaacgacuuccagaaucugcagcaaguguuuuuacaggccaaaaaggauacagacuggcugaaagagaagguccagucacuccagacccuugcagcuaacaauagugcccuggcgaaggcaaacaaugauacuuuggaagacaugaacagccaacuaaauucuuucacaggccagauggagaacauaaccacgauuucccaggccaaugaacagaaccugaaagaucuccaagaccugcauaaggaugcugagaaucgcaccgccaucaaauuuaaccagcuugaggaaagauuccagcuguuugagacagacauugugaauaucaucucaaacauuagcuauacugcacaccauuugaggacccucacaaguaaccugaaugaagugcggacuaccuguacagauaccuuaacuaagcacacggacgaucugacaucucuaaacaauacccucgcuaacauacgccuggacuccgucagccuucgaaugcaacaggacuugaugagaucgaggcuggauacugagguugccaaucucucugugaucauggaagagaugaaacugguagacuccaagcauggccagcuuauuaagaacuucaccauccugcaggggcccccuggaccacgggguccgcguggcgaucgcgggucacaaggacccccuggcccaacagguaauaaagggcagaagggagagaaaggcgaacccggcccuccagggcccgcgggagagagagguccuauaggcccagccgggccgcccggagaaaggggcgguaaggggaguaaaggcagccagggaccuaagggcucccgggggucuccaggaaagcccgguccucagggcccaagcggggaccccggaccgccuggucccccaggcaaagagggguugccuggcccccaaggaccacccggcuuucaggggcuccagggaaccgugggugaaccuggcgucccagggccgcgaggacugcccggcuuaccuggugugccagggaugcccggcccuaagggaccacccggcccgccugggccaucaggagcaguugugccccuggcucuacagaacgagccuacucccgccccagaggauaauggcugcccuccccacuggaaaaacuucacagacaaguguuacuacuucagugucgaaaaagagauuuuugaagaugcuaaacucuucugcgaggacaaguccagccaccugguguuuaucaauacgcgcgaggaacaacaguggaucaaaaagcagaugguagguagagagucucauuggauugggcuuaccgauucagaaagggagaacgaauggaaaugguuggacggaacaaguccagauuauaagaauuggaaagccggccaaccggacaacuggggucacggccaugggccuggagaggauugugcaggccugaucuacgccgggcaguggaaugacuuccagugcgaggacguuaacaacuuuauuugugaaaaggaucgggagacugugcucagcuccgcucuguga

SEQ ID NO: 54669 - RNA, 1665 nt, Artificial Sequence
  derived and/or modified sequence opt3 from COLGALT2__Homo_sapiens__NP_001290349
auggccgcuagacccgcagccacccuggcguggagccuccuucuguuguccucugcuuuacugagggagggcugccgggcccgcuucguggcagaacgagacucagaggaugacggggaggaaccugucguuuuuccagaaaguccgcuacagagccccacagugcucguagccgugcuggcucguaacgcagcccacacucuuccucauuuccugggauguuuggagagacucgauuacccaaaguccaggauggcuaucugggccgcgacggaccacaaugucgauaacaccacagagauuuuucgggaauggcugaaaaaugugcaacgccuguaucauuacguugaguggagacccauggacgaaccugagucuuauccagaugagauaggucccaagcacuggccuacuucgagguucgcacaugugaugaaacuccggcaggccgcuuuacgcaccgcccgagaaaaguggucagacuacauccuguuuauugaugucgacaacuuccuuacaaauccacagaccuugaaccugcuaaucgcagagaauaaaacuauuguggcuccgaugcucgaaagcagaggccuguauaguaacuuuuggugcgggaucacacccaagggauucuacaagaggaccccugauuauguacagauacgggaguggaaacguacgggcuguuuuccaguucccauggugcacuccacuuuccuuaucgaccugcgcaaggaagccucugauaaauugaccuuuuacccuccacaccaagacuacacauggacuuucgacgauauuaucgucuuugcguucagcuccagacaggccgguauucagauguaucucugcaauagggagcauuacggguaucugcccaucccguuaaagccucaccagacccugcaagaggacauagaaaaccucauucaugugcagaucgaggcaaugauugaucggcccccaauggaaccuucacaguacgugagugucguucccaaauauccagacaagaugggauucgaugagaucuuuaugaucaaucuuaagcgacgcaaagacagaagggaucggaugcugcgcacauuguacgaacaggagauugaggugaagauaguagaagcuguggacggcaaagcccuaaacaccagccaacugaaggcucucaauaucgagaugcugcccggcuauagagauccuuacucuuccaggccacuuacgcguggggaaauuggauguuuccugucacacuacagcgucuggaaagaggugaucgaccgggaauuggagaagacucucguuauagaggaugacgugcgauuugaacaccaguucaaaaagaagcugaugaaauuaauggacaacauugaucaggcccaacuggacugggagcuaaucuauaucgguagaaagaggaugcaggucaaagaaccggagaaggcagugcccaauguagccaaccucguugaggcugauuacaguuauuggacacugggcuacgugauuucucuugaaggggcgcagaaauuggucggagcaaacccuuuuggcaagaugcugccaguggacgaguuccuccccgucauguauaauaagcauccugugcugcuuuccagcccacacugccaucuguuucagaccuugucggaugacugucaacgcuga

SEQ ID NO: 54670 - RNA, 1368 nt, Artificial Sequence
  derived and/or modified sequence opt3 from COLQ__Homo_sapiens__NP_005668
auggugguccugaaccccaugacccucggcaucuaccuucagcuguucuuuuugagcauuguuucccaaccuacauucauaaauucuguguuaccaaucucagccgcucugccgagucuagaccagaagaaaagagggggacacaaggcaugcugucuccugacucccccuccacccccucuuuuuccacccccuuucuuuagggguggccggagcccacuguuguccccggauaugaaaaaccucaugcuggagcuggaaacgucucagucgcccugcaugcaggggucacucggaagcccuggcccacccgguccucaagggccacccggauuaccgggcaagaccggcccuaaaggggagaagggagaacugggucgccccggccgaaaggggcguccaggaccucccggcguaccagguaugcccgggccuauuggauggccaggcccggagggccccagaggggaaaaaggagaccuugguaugaugggcuugccugggaguaggggaccaaugggcuccaaggguuaucccgggucucggggcgagaaaggaagccgcggcgagaagggggaucugggaccuaaaggugaaaagggcuucccaggguuucccggaaugcuaggccagaagggugagauggggccgaaaggcgaaccuggaaucgccggccauagagggccaacaggaaggcccgguaagcggggcaaacaggggcagaagggagacuccggcgugauggguccucccgggaaaccaggcccuucaggacaacccggccgcccagggccgccuggacccccacccgcgggccagcucauuauggguccuaagggggagcgaggauucccaggucccccuggcagaugucugugcggcccgacuaugaaugucaacaauccaaguuacggggagagcguguauggacccucuuccccuaggguuccagugaucuuugucgugaacaaucaggaggaacuugaacggcugaacacccagaaugcuauagccuuccgucgcgaucaaagaucauuguacuuuaaagacagccucggcuggcugcccauccaguuaacaccuuucuauccgguagauuacaccgcagaccagcacgggacuuguggagauggccugcuccaacccggugaggaaugcgacgaugggaacagugacguuggagaugacuguauuaggugccaucgggccuauuguggcgacggucaccgacaugagggcguggaggauugcgacgggucugauuuuggauaccuuacaugugaaaccuaccugccaggcuccuauggggacuugcagugcacgcaguacugcuauaucgauagcacuccuugucgcuacuucaccuga

SEQ ID NO: 54671 - RNA, 609 nt, Artificial Sequence
  derived and/or modified sequence opt3 from COMMD10__Homo_sapiens__NP_057228
auggccgugcccgcugcacugauccucagagagagcccuuccaugaagaaagccgucucucuuauuaacgcgauagacaccggcagguucccacggcuguugacacgcaucuuacagaagcugcaccuaaaagcugaaucaaguuuuagcgaggaagaggaagagaagcuccaagccgcauucucccuggagaaacaggaucuucaucugguuuuggaaacuauuucuuuuauccucgagcaggccguguaccacaauguaaagccggcugcacugcagcaacagcuggaaaacauucaucuccgacaggacaaggccgaggcuuucgugaauacguggucgucaauggggcaggagaccgucgaaaaauuucgucaaagaaucuuagcccccugcaagcuggagacagugggauggcagcuuaacuugcagauggcgcacagcgcacaggccaaacugaagaguccucaagcuguucuacagcucggugugaauaacgaagauuccaaaucucuggagaagguccuuguggaguucagccauaaggaacuguuugacuucuauaauaaauuggagacuauacaggcccaacucgauucccugaccuga

SEQ ID NO: 54672 - RNA, 573 nt, Artificial Sequence
  derived and/or modified sequence opt3 from COMMD1__Homo_sapiens__NP_689729
auggccgcuggcgagcuggaagggggaaagccccucagcggucuucugaacgcauuggcccaggacaccuuccacggcuacccugggaucacagaggaauuacugagaucccaacuauauccagaggugccgcccgaagaguuuaggccuuuccucgcgaaaaugcggggcauucugaagucuauagcuucagccgauauggacuuuaaucagcuugaggcauuccugacugcccagacgaaaaagcagggagguaucaccagugaucaagcugcagucauuagcaaauuuuggaagucccauaagacaaaaauccgcgaaucuuugaugaaccagucgcgauggaacucagggcuccguggacugagcuggagaguugacggcaagagucaguccaggcacucugcccagauucauacuccaguggcuaucauagagcuggaacucggcaaauacgggcaagagagcgaguucuuaugccuggaauuugaugagguaaaggugaaucagauccuuaaaaccuuguccgaagucgaggaaucaauuaguacacugaucagccagcccaauuga

SEQ ID NO: 54673 - RNA, 1410 nt, Artificial Sequence
  derived and/or modified sequence opt3 from COMMD3-BMI1__Homo_sapiens__NP_001190991
auggagcugagcgaauccgugcagaagggcuuccaaaugcucgccgaccccagaucuuuugauucaaacgcuuucacccuucuguugagggcagccuuucagaguuuacuggacgcgcaggcugaugaggccguccuagaccacccugaucucaaacauaucgacccaguugugcugaagcacugccaugcagccgcugcaacauacauucuugaagccgggaaacaccgggcugauaagagcacucuguccacguauuuggaggacuguaaauucgaucgcgaacgaauagagcucuuuugcaccgaguaccagaauaacaagaauagucuggaaauccugcucggacguacauuaauuccgcaucccauccaaagacugguacuuguggccgcguggaacaauuauaggauuuucuaccaggcagagaugcaccggacuacccgcaucaagauaacagaauugaacccucaccugauguguguccuaugcgguggcuauuuuaucgacgccaccacuauuaucgagugucuccauucguucugcaaaacauguauugugagauaccuggagaccucaaaguauugcccaaucugugauguucaggugcacaaaacgaggccccuucugaauauacggagcgacaagacuuugcaggauauugucuacaaacucgugccugggcuguuuaagaacgaaaugaagcgccgaagagacuucuacgcugcccauccaagugcagacgcugccaauggauccaacgaggauaggggcgaaguagcggacgaggauaaacggaucauuaccgacgaugaaaucaucucuuuaagcauugaguuuuucgaccaaaaucgucuggaucgcaagguuaacaaagacaaggagaaauccaaggaagaggugaaugauaaaagauaucucaggugccccgccgcaaugacagucaugcaccuucggaaguuucugcgaucaaagauggacauaccuaacacuuuccagaucgaugugauguacgaagaggaaccauugaaagacuauuacacccuaauggacauugcuuauaucuacacauggcgcagaaaugguccgcugccccucaaguauagggugcggccuaccuguaaacgcaugaagauaagucaccagagagaugggcugacgaacgccggagagcuugagagcgacucuggcuccgauaaagcuaacucaccagccggcgggauucccagcacuucuucuugccugccuuccccaagcacacccguccagucgccgcauccucaauucccccacaucucuuccaccaugaauggaacuucaaacaguccaagcgguaaucaucaguccucuuuugcaaacaggccucguaagagcucaguuaauggcaguuccgccacaagcucuggguga

SEQ ID NO: 54674 - RNA, 675 nt, Artificial Sequence
  derived and/or modified sequence opt3 from COMMD5__Homo_sapiens__NP_054785
augagcgccgugggcgcugcaacccccuaccugcaccauccuggggacucccacucuggaagagucucauuccucggugcccagcuuccaccggagguugcggcuauggccaggcuguugggcgauuuagaccggaguacauuucgcaagcugcuaaaauucgugguaagcucccuccaaggggaagauugccgagaggcagugcagcgucugggagucucugccaaccuucccgaggaacagcugggcgcuuugcucgcagguaugcauacucugcugcagcaagcccucagauuaccuccaacgucgcugaagcccgacaccuuuagggaucagcuucaggaauuguguaucccucaggaccuggugggggaucuagcuucaguuguguucggaagccaacggccacuccuggacagugucgcccagcagcagggcgcguggcuuccccacguggcagauuuucgcuggagaguagacguugccauuuccacaucugcucuggccaggagcuugcaaccuuccgugcucaugcagcugaaauuaucagauggcagugcauaucgguucgaggucccaacugcuaaguuucaggagcugcgcuacagcguggcccucgugcuuaaagaaauggcggaccuggagaagcgaugcgaaagaagguugcaagauuga

SEQ ID NO: 54675 - RNA, 600 nt, Artificial Sequence
  derived and/or modified sequence opt3 from COMMD7__Homo_sapiens__NP_001092809
augggcagacugcacugcaccgaggaccccgugccugaagccgucgggggagauaugcagcaacucaaccagcuuggugcucaguucagcgcacugacagagguuuuguuucauuucuuaacugaaccaaaggagguggaaagguuucuggcccagcuauccgaguucgcgacgaccaaucaaaucucucucggcucacugcggaguauuguaaaaagccuucuguuggugccgaacggggcucucaagaaaucccugacagccaagcagguccaggcagacuuuauaacucugggacucucugaggaaaaagccaccuacuucucggagaaguggaagcagaaugcucccacauuagcacgcugggccaucggccaaacccugaugauuaaccagcuuaucgauauggaauggaaauuuggugugacuucagggagcagugaguuggagaagguuggauccauuuuccugcagcuaaaacucguggucaagaaaggcaaucagacagaaaacguguauaucgagcugacccuuccucaauuuuacucuuuccugcacgaaauggagcgaguacguacgagcauggaauguuuuugcuga
